United States Patent 9,920,329 (ISOLATED POLYNUCLEOTIDES AND POLYPEPTIDES, AND METHODS OF USING SAME FOR INCREASING PLANT YIELD AND/OR AGRICULTURAL CHARACTERISTICS) - sequence listing, part 2

SEQ ID NO: 1434 - DNA, 2461 bp, Sorghum bicolor
ctcgtgtccaaaccccacctaaatttaattgccaactaaacgatcaacagctcgatattgaaacttgtctagtgtggctgactggctggtaaccaaacgaaacctggttttccggcaatccagagccaaaaaaggaccgccaccaaccgctcgctttcccgcacctccccaacctctcgctctctccctccctccaattgcaggatcagcaccgatgcgattcgaccgcggcctcgcgtccggtgcggaggtctgcaattggggggaggctcctctccgccgctggaaccgctgcggcgtcgcggcctgtgcgagtttcctgctggttcctcatccctcggggagagattttgcgtgccttggcattactgtttgatggcagacagtagtgctgcttctctaaggaggcattggggcaataggcagttgaactgaaccgcagcagaaatccattcgcaggagagagagagaggcagagagagaaatcaaagaggagagtgatcatggagcatgtgattggagggaagtataagcttgggaggaagattgggagcggatccttcggggagctatatctcggtgttaatatacagaatggagaggaagtaggaataaagttggagcctgtgaaaacaaaacatccacagctgcactatgaatctaaagtttatatgctactgcagggtggaaacggtatcccacacctcaagtggtatggtgtcgaaggggagtacaatgttatggtgattgatcttcttggcccaagtttggaagatttgtttaattgctgcaacaggaaattttctatgaaaacagtgcttatgcttgctgatcaactgataaaccgagtggaatacatgcattccaagggatttattcaccgtgacatcaagccagacaacttccttatgggcttaggtcggaaagctaatcaggtctatatcattgattatggccttgctaagaaatacaaggaccttcagactcataaacacatcccatacagagagaacaaaaatctgactggaacagcacgctatgctagtgtgaatactcatcttggaatagaacaaagcaggagagatgatctggagtctgttggctatcttctgctatattttttaagaggaagcctcccatggcagggtcttaaagctggcactaagaaacaaaagtatgacaaaattagtgaaaagaaaatgcttacctcagcagaggtcctgtgcaaatcttacccatcggaattcatctcatatttccactattgtcgctccctgcgatttgaagacaggccagattactcttttctgaagaaactctttcgtgatgtatttatccgggaaggataccaatttgattatgtatttgactggactgcactcaagtaccctcaaatgggttccaacaacaagcttgttcaacaaccaagtgcaagaatggctggagttggaccatcagttgagagaacagacaaagcttctgtgggacaagagatccgggaaagattcactggtgctgttgaggcattcgccagaagaaatccaggctctggccgccatggagatcattccaggcacaaaagccttgcagattcctttggaacatccaacgaagcagtcgctgccgactcagagaaaacgcgcatcttgtcccggggagggagctcgtcgaaaatgcccgcggctaattcgtccggccggccgacctcttcgggggactgcagtgaccagaaccgccggtgggtctctggcagcagtggcggcagcgggcgcccgtccaccgcgcagaggctccaccactcgggaggcgccgagaacagcaggtcgtccccgcgctctcccgtggcccggaacgcggctgggagaggaggctccggctcgcgggacaacacgacgttccggagcctcgagcgcctctccatcaccaccagcaggaggaagtgagctgccgaggaccacgccgacaaattctgagagtggaaggcagttactaggctgagaacttttgcgggatcgttgttctctgcagctgaagcaaatcggcaaatggatggatggatgggattgcagcacaatgacctcgagtatggacctcgttacaagggtgccatgaaaatgctttctccaaacctcaacgtataacgctttctccaaactccaagaggcaagataactctgaagtacaatgcaatcctgcttcacggcaagctttcactgttgttcactttctgattctgccgttctggtactagtttgtaaagtgttattgcagaatccctccatttgaccataaatttttttaagaaaacgtatataagcacctgaattaattttatttatggggcatttggatcgaagaatggagtgatctgtcactttctcactacacattttctttgtgggtccgaagaagggttatttgtattggtaccgttaaaattttcgaagttgtgagaattacc

SEQ ID NO: 1435 - DNA, 2670 bp, Panicum virgatum
acttcgtatctgcatattatgcataaacctccccgcaacttatcgtcccaaaagaaaccttctgtcccaactgcctatcttctttctttagctcccccgtctcgcgcgccaccgcatgcgggcatgcggcagccggcaccggcaccggcagcgactcccacagtgtgtcccttcccttggtccctcctcgcctccgcgcccgaccagcctggaagtctgataacctggttttccgggggcccggagccgaaaaaggactgccaccgaccgctcgctttcccgcacctccccccacctctcgccccctccttccctccctccagttgcaggatcggcatcgatgcgattcgaccgcggccgcgcgtccggtgcggaggtctgcagttggggggaggaggctccgctccgccgccggaaccgctgcgagcgagtttgatttcctggttcctgctgcctcttaatcacgcggggagcgatattcggtgtcgctcggcattactgtttgatggcagacggcagtgctgcttctccgaggaggcattgtggcaataggcagcttcgttgaacagcaatccattcgcaggaggaattagaacaaatcaaaggggaggctgatcatggagcatgtgattggagggaagtacaagcttgggaggaagattgggagtggatccttcggggagctatatctcggtgttaatatacagaatggagaggaagtgggaataaaattggaacctgtgaaaacaaaacacccacaattgcattatgaatccaaagtgtatatgctattgcagggtggaaatggtatcccacacctgaagtggtatggtgtcgagggggagtacaacgttatggtcatcgatcttcttggcccaagcttggaagacttgtttaactgctgcaacaggaaactttcaatgaaaacagtgcttatgcttgctgatcaactgataaatcgagtggaatacatgcattccaagggatttattcaccgtgacatcaaacctgacaacttccttatgggcttaggccggaaagctaatcaggtctatataattgattatgggcttgctaaaaaatacaaggaccttcagactcataaacatatcccttacagggagaacaaaaatctgactggaacagcacgttatgccagtgtgaatactcatcttggaatagaacaaagcagaagagatgatctggaatctgttggctatcttctgctatattttttaagaggaagcctcccatggcagggtcttaaagctggaactaagaaacaaaagtatgacaaaattagtgaaaagaaaatgcttacctcagcggaggttttgtgcaaatcttacccatcagagttcatctcatatttccactattgtcgctccctgcgatttgaagacaggccagattactcttttctgaaaaagctctttcgtgatgtatttatccgtgaaggataccaattcgattatgtatttgactggactgcactcaagtaccctcaaatgagttctaacaataagcttgttcaacaacctagtgcaagaataactggagccgggccatctggtgagagaacagacaaaccatcagtgggacaagagatacgggatagattcactggtgctgttgaggcatttgccagaagaaatccaggctctggtcgccatggagaacattccaggcacaaaagccatgcagattcatttggaacatctaacgaagcagttgccgactcggagaaaacgcgcatcctgtcccggggcgggagctcgtcgaaaatgcccgcgggtccgtccagccggccaacctcttcgggggactgcagcggcgaccagaaccgccggtgggtctcgggcagcagcggcggcagcgggcgcccgtccaccgcgcagaggctccacccctcgggaggcgccgagaacagcaggtcgtccccgcgctcccccgtgtcccggaacgcggcgcaggggagaggaggctccggctcgcgggacaacacgacgttccggagcctcgagcgcctctccatcagcacgagccgtaggaagtgagccgccgatcggccaccgacgggttctcaaagtggaaggcggtttctttcgttcttcgcacggtgggtgaaccgccggttcggatcgttgctcgttgcagctgaaacgaatcggcgaatggatgagaggagctgcagcaaaatacaaatactagccctcactgtggaagaacggtgcctggagtcatggactcatgatgacctcgttccaaacccccaacgtatgtgtaccgtcctaggagaaaaagaaaaacaaccccaaagtataatgcaatcctgtttgacggcaaagcttcacactgttgttaccttcagattctgccgtttgggggacagttttatgaagtgccgacaagaaccaagtctataactatacaagcatctcagttaatttcgttaagtttttcacgagattaacatgtggaagcgaaaagtcattagtagtgagctcgtctacaatgttttatgtgtttttatccgacaagcaagattgggaacgttactgggcttgatcgcaccctgtgatatacaccgtctcccatacccaaaacatgtggcaggcaactgcgctcaatgcctgggaaggcaaagcaaacagtgaaaaagaaacaccg

SEQ ID NO: 1436 - DNA, 2062 bp, Setaria italica
aacctggttttccggggaccccgagccgaaaaaggattcccaccaaccgctcgctttccgcaccttcccccacctcccgcccgccggcccgctccctccctccctccctccagttgcaggatcggcatcgatgcgattcgaccgcggcctcgcatccggtgcggaggtctgcgattggggggaggctccgcttcgccgccggaaccgctgggagtttcctgctggctcctaatcccaagtggagcgatttggtatctcccggcattactgtttgatggcagacagcagtgctgcttctctgaggaggcattgtggcaataggcagctacgttttgtacagcagcagcaatccattcacaggagaaactagaacagatcaaagaggagcctgatcatggagcatgtgattggagggaagtataagcttgggaggaagattgggagtggatccttcggggagctatatctcggtgttaatatacagaatggagaggaagtgggaataaaattggaacctgtgaaaacaaaacatccacaactacattatgaatctaaagtttatatgctattgcagggtggaaatggtatcccacacctgaagtggtacggtgtcgagggggagtacaacgttatggtgatcgatcttcttggcccaagcttggaagacttgtttaactgctgcaacaggaaactttcaatgaaaacagtgcttatgcttgctgatcaactgataaaccgagtggaatacatgcattccaagggatttattcaccgtgacatcaagccagacaacttccttatgggcttaggccgaaaagctaatcaggtttatataattgattatgggcttgctaaaaaatacaaggaccttcagactcataaacatatcccctacagggagaacaaaaatctgactggaacagcacgttatgccagtgtgaatacccatcttggaatagaacaaagcagaagagatgatctggagtctgttggctatcttctgctatattttttaagaggaagcctcccatggcagggtcttaaagctggcactaagaagcaaaagtatgacaaaattagtgaaaagaaaatgcttacctcagcggaggttttgtgcaaatcttacccatcagagttcgtctcatatttccactattgtcgctccctgcgatttgaagacaggccagattactcttttctgaagaaactatttcgtgatgtatttgtccgcgaaggataccaattcgattatgtatttgactggactgcactcaagtaccctcaaatgagttcaaacaataagcttgttcaacaaccaagtgcaagaatagctggagctggaccatctgccgagagaacagacaaagcatcagtgggacaagagatccgggatagattcactggtgctgtcgaggcatttgccagaagaaatccaggctctggtcgccatggagaccattccaggcacaaaagccatgcagattcctttggaacatctaacgaagcagttgccgactcggagaaatcgcgcttcttgtcccggggcgggagctcgtcgaagatgcccgcgggctcgtccagccggccgacctcctcgggggactgcagcgaccagaaccgccggtgggtctcgggcagcagcggcggcagcgggcgcccgtccaccgcgcagaggctccaccactcgggcggcgccgagaacagcaggtcgtccccgcgctcccccgtggcccggggcgcggcgccggggaggggaggggggggctccggctcgcggaacaacaccacgttccggagcctcgagcgcctctccatcagcacgagccggaggaagtgaacgaaccggtcagccgaggaatttcgatatttgacatcgaatccgcagccctcacttattttgaccctcaattcacgtacctttcaaaataaatataatcctccgactgctaattcttttgattcaagaaattctctccacttttctccattttatttccttttcattttccagtattagtgaatggataagttaactctgccttatgttccctacctattagat

SEQ ID NO: 1437 - DNA, 2239 bp, Zea mays
aaaccaggttttccgacaacccagagagccaaagaaaggactaccaacaaccgcaaccgctcgcttcccagcacctccccacctttcgctccctccctccctccaattgcaggatcggcaccgatgcgattcgaccgcggcctcgcatccggtgcggaggtctgtcattggagggaggctcctctccgctgcgcgcgcgcgtcgcggcctgggcgagtttcctgctggttcctcgtccctcgggagagattttgcgatccttggcgttactgttcgattgcaaacagtattgctgcttctctgaggaggcattagggctatgggcagttgaactgaaccgccgcggcagaaatccattcgtgggagagagaaatcaaagaggagagtgagtgatcatggagcgcgtgattggagggaagtataagcttgggaggaagattgggagcggatcttttggggagctatatctcggtgttaatatacagaatggtgaggaagtgggaataaaattggagcctgtgaaaacaaaacatccacagctgcactatgaatctaaagtttatatgctactgcagggtggaaatggtatcccacacctcaagtggtatggtgtcgagggggagtacaatgttatggtgatcgatcttcttggcccaagcttggaagatttgtttaattcctgccacaggaatttttctatgaaaacagtactcatgcttgctgatcaactgataaaccgagtggaatacatgcattccaagggatttattcatcgtgacatcaagccagacaacttccttatgggcttaggtcggaaagctaatcaggtctatatcattgattatggacttgctaagaaatacaaggaccttcatactcataaacacatcccatacagggagaacaaaaatctgactggaacagcacgttatgctagtgtgaatactcatcttggaatagaacaaagtaggagagatgatctggagtctgctggctatcttctgctatattttttaagaggaagcctcccatggcagggtcttaaagctggcactaagaaacagaagtatgacaaaattagtgaaaagaaaatgcttacgtcagcagaggttctttgcaatcttacccgtcggagttcgtctcatatttcaactattgtcgctccctgcgatttgaagacaggccagactactcttttctgaagaaactgtttcgtgatgtatttatccgggaaggataccagtttgattacgtatttgactggactgtactcaagcaccctcaaatcggttccaacaacaagcttgttcaacaaccaagtgcaagaatggctggagttggaccatcagttgaccgaacagacaaagcctccgtgggacaagaggcccgggacagattcacgggtgctgttgaggcattcgccagaagaaatccaggctctggtcgccatggagatcattccaggcaccaaagccttgcagattcctttggcacatccaacgaagcagttgccgactcagagaaaacgcacatcttgtcctggggagggagctcgtcgaaaatgcccgcggcttcgtccagccggccgacctcctcgggggactgcagtgaccagaaccaccggtgggtttctggcagtagtggcggcagcgggcggccgtccacagtgcagaggcaccaccactcggcaggcgccgagaacagcaggtcgtccacgcgctcccccgtggcccggaacgcggccgagagaggaggctccggctcgcgggacagcacgacgttccggagcctcgagcgcctctccatcaccaccagcaggaggaagtgagctgccgaggaccacgccgacgatttctgtgagtgaaaggcggttactaggccgacatcttttgcgggatcgttgctctctgcagctgaagcaaatcggcaaatggatggacgggattgcagcgcaatgacctcgaggatggcctcctttacaagaactgccatgaaaatgctttctccaaaccgtaacgtataacgcttcccccaaccaaccagagggaagacaactccaaagtacaatgcaatcctgtttcacggcaagctttcactgttcacttgttttgccgttctggcactagtttctaaagtctccagcaatgtaatctatattcatcttctatgcctgtactttatagtctcatctaaaagattctctcttctatatctttctaatctgcagcagcgtcctcta

SEQ ID NO: 1438 - DNA, 1555 bp, Panicum virgatum
gcagcagcaatccattcgcgggaggaattagaacaaatcaacggggacacagatcatggagcatgtgattggagggaagtacaagcttgggaggaagattgggagtggatccttcggggagctgtatctcggtgttaatatacagaacggagaggaagtgggaataaaattggaacctgtgaaaacaaaacacccacagctgcattatgaatctaaagtgtatatgctattgcagggtggaaatggtatcccacacctgaagtggtatggtgtcgagggggaatacaacgttatggtcatcgatcttcttggcccaagcttggaagacttgtttaactgctgcaaccggaaactttcaatgaaaacagtgcttatgcttgctgatcaactgataaatcgagtggaatacatgcattccaagggatttattcaccgtgacatcaaaccagacaacttccttatgggcttaggccggaaagctaatcaggtctatataattgattatgggcttgctaaaaaatacaaggaccttcagactcataaacatatcccttacagggagaacaaaaatctgactggaacagcacgttatgccagtgtgaatactcatcttggaatagaacaaagcagaagagatgatctggagtctgttggctatcttctgctatattttttaagaggaagcctcccatggcagggtcttaaagctggaactaagaaacaaaagtatgacaaaattagtgaaaagaaaatgctcacctcaccagaggttttgtgcaaatcttacccaccggagttcatctcatatttccactattgtcgctccctgcgatttgaagacaggccagattactcttttctgaagaagctttttcgtgatatatttatccgcgaaggataccaattcgattatgtatttgactggactgcactcaagtaccctcaaatgagttctaacaataagcttgttcaacaacctagtgcaagaataactggagctggaccatctggtgagagaacagacaaaccatcaatgggacaagagatacgggatagattcactggtgctgttgaggcatttgccagaagaaatccaggctctggtcgcgggtcgccatggagaacattccaggcacaaaagccatgcagattcctttggaacatctaacgaagcagttgccgacacggagaaaccacgcatcctgtcccggggcgggagctcgtcgaaaatgcctgcgggtccgtccagccggccaacttcttctggggactgcagcggggacggcggcggcagcgggcgcccgtccaccacgcagaggcttcacccctcgggaggcgccgagaacagcaggtcatccccgcgctcccccgtgtcccggaacgcggcgccggggagaggaggctccggctcgcgggacaacacgacgttccggagcttggagcgcctctccatcagcacgagccggaggaagtgagccgccgatcatccatcgacgggttctcaaagtggaaggcggtttctttcgttcttggcacggtgggtgaaccgccccgg

SEQ ID NO: 1439 - DNA, 1912 bp, Triticum aestivum
ccccgcgccgcaaacgcgacctgccggttcatcactttccccgccgcctgctatcctagcgcggttcgatccgcctctggaagttggattggcgaatggtggcgcaccaggaggcggaggcgacgacgacgacgacggtggacccgatgcgcctggcgtcgcggtggcggtccccggcggagtgggttgccaccgcagcggcactggactcggagcccatgccatccgagctcaacaccgccaacagctcgggcctctttgcagtcgtctccgtcgacaagatgtccgtcaagtacctcggcgtcaaccaccacggccatgacgtcggagtcgtgcaggccgactgccccgctcccatgcaccgagccgtctactactttgagatgaccgtgaggaatgctgggctcaagggccagacctccatcggcttcaccaccgagagcttcaagatgcgccgccaacctggttgggaatctcaaagttgtggataccatggcgatgatggctatctttaccggggtccagggaaaagtgagtcttttggtcccaaattcacatcaggcgacataattggcgctggaattaactacatagaacaacttcttttcttcacaaaaaatggatctctgattggagcctttccaaaagatattaaaggaccactatatcctactattgcggtccatagccaggatgaagagttgacagtaaacttcggaaaagaacagttctgttttgatattgagggttatattcttgagcagaaaatgacgcaacaatctattagcgacaaactgtacttgcaacctgatatcagtcattggattgttcgttcatatctcctacattacggctaccaagatacattgaattcttttgatgcggcaagtgaaactgaccctccagcgaatcatcaaactggttatggggaacctcctgaaatgtatggtcttagccacagaaaaatgttgcgtcagctcatcatgaatggggatatcgattctgcattcaaaaggcttgaagagtggtatccacaggtcttaaaggacgaaatatcagttatttgcttcttgcttcattctcagagattcattgaatacatcagggctgagcaactggagggtgctgtaaaatatgcccgtgctaacctggccaactttttggcacacaaagcttttgaggggttgctgaaggagagtgtggccctgcttgcgtatgagaagccttcagaatcttgcattggatatttgctggagtccccacagcgtgaatttgtagcggacgcggtgaatgctgccatcctgtccacgaaccccaaaatgaaggatccagagagctgcctttactcgtgtctggagaagttactgaggcagctcacggtatgcagctctgagctacgtgcgttcaacagcgatcaaggggatgtcttcttacttcataaggagatctacgaaagatccaggcgtccctaaggcacgtcgagcatacatacgagcagtcaactcggaaaataagatcctcattcttcttggaaagaaagaaacatcacctggaattgtggaccatgccatgaggaaacacacacatattctcccctgagtgaggcctcaaggtgaatggaaatttcgcagcttgggcataggactttccaggagctccttccctgtaatcagtgaatttagattcacgtgtgatctcaacccctttggtgttttcataaacttgttggctatgtgcagttgcacattgtgaactttaagataaagagcttgaacagtactgtaaatggaatcagaataccattcttgttgacgtgctatgccatcaggtatgttcgttccagagatgtaactgtgctctccttttcattgtcgtagcatttgggtcaatagcgtatgagcagcgggaagga

SEQ ID NO: 1440 - DNA, 1836 bp, Secale cereale
catcctggcacgcttctactagccctgttccccacccccgcgccgcaaccgcgacctgccggttcatcactttccccgccgcctgctatcctagcgcggttcgatccgcctctgtaagttggattggcgaatggtggcgcaccaggaggcggaggcgacgacgacggtggacgcgatgcgcctggcgtcgcggtggcggtccccggcggagtgggttgccaccgcagcggcactggacacggagcccatgccatccgagctaaacaccgccaacagctcgggcctctttgcagtcgtgtccgtcgacaagatgtccgtcaagtacctcggcgtcaaccaccacggccatgacgtcggcgtcgtgcaggccgaccgccccgctcccatgcaccgagccgtctactactttgagatgaccgtgaggaatgctgggctcaagggccagacctccataggcttcaccaccgagagcttcaagatgcgccgccaacctggttgggaatctcaaagttgtggataccatggcgatgatggctatctttaccggggtccaggaaaaagtgagtcttttggtcccaaattcacatcaggcgacataattggtgctggaattaactacgtagaacaaattcttttcttcacaaaaaatggatctctcattggatcctttccaaaagatattaaaggaccactatatcctactattgcggttcatagccaggatgaagagttgacagtaaactttggaaaagaacagttctgttttgacattgagggttatattctcgagcagaaaatgacgcaacaatctattagcgacaaattgtacttgcaaccagatatcagtcattggattgttcgttcatatctcctacattacggctaccaagatacattgaattcttttgatgcggcaagtgaaactgaccctccagcgaatcatcaaactggttatggggaacctcctgaaatgtatggtcttagccacagaaaaatgttgcgtcagctcatcatgaatggggatatcgattctgcattcaaaatgcttgaagagtggtatccacaggtcttaaaggacgaaatatcagttatttgcttcttgcttcattctcagagattcattgaatacatcagggctgagcaactggagggtgctgtaaaatatgcccgcgctaacctggccaactttttgacacacaaagcttttgaggggttgctgaaggagagtgcggccctgcttgcgtatgagaagccttcagaatgttgcattggatatttgctggagtccccacagcgtgaatttgtagcggacgcagtgaatgctgccatcctgtcgacgaaccccaaaatgaaggatccggagagctgccttcactcgtgtctggagaagttactgaggcagctcacggtatgcagctctgagctacgtgcgttcaacagcgatcagggggatgtgttcttacttcataaggagatctacgaaaggtccaggcgtccgtaaggcacatcgagcatacatacgagcagtcaactcggaaaataagatccttgttcttcttggaaagaaacaaacattacctggaattgtggaccatgccatgaggaaagacacacatattctcccctgagagaggcctcaaggtgaagggaaatttcgcagcttggacataggactttccaggagctccttccctgtaatcagcgaatttagattcacgtgtgatctcaacccctttggtgttttcataaacttgttggctatgtgcaattggacattgtgaactgtaagataaagagcttgaacaatgctgtaaatgaaatcagaataccattctt

SEQ ID NO: 1441 - DNA, 1964 bp, Panicum virgatum
ttgatcggaacaccaacgtcaccagttgcttctcctgaactcttcgagaggctttcttcatcctctccgtcttccttcccctgaccccatccaccccgcccgctgctacaagcaaccgccgatccagtccgttccgcctccaggcgaatggtcgccaaccaggaggcggaggcggcatcggcggcagcgcccggggcagggacgacggtggacccgatgcgtctggcgtcgcggtggcggtccccggcggagtgggagtgtgcggcggcggagctggatgctgagccgctcccgtccgagctcaacaccgtcaacagctcgggccttttcgccgtcgtctccatcgacaagttgtccgtcaaataccttggcagccatcatcatggccacgacgtcggggtcgtgcaagccgaccgccccgcgcccacgcgccgggccgtgtactactttgagatgggtgtcaagaacgccggctacaaggggcagacctcaatcgggttcacaagcgaaagcttcaagatgcggcgacaaccgggttgggagtctaacagttgtggataccatggtgatgatggctatctttaccgaggtcaagggaaaggtgaatcattcggacccaaatttacatctggcgacacaattggtgctggcatcaactacttgtcacaagaatttttcttcacgaaaaatggatctctggttggagcctttccaaaagaaattaaaggtccactatatcctactgttgcagttcatagtcagggtgaagagttgactgtaaactttggaaaagaaccattctgttttgatattgagggttatatactcgaagagaaaatgaggcaacaatcgatgacagacaaattgaaattggaagagaacatcagtcatgtgattgtccgttcatatctcctacattatggttaccaagatacattaaattcttttgacatggcaaatgcaactgacccccctggcagtcgccaaaatggacacagggaacctccagaaatgtatggtcttagccacagaaaacttttgcgtcagcttatcatgagcggagatattgactctacattcaaaagactagaggaatggtatccacaagtgataaaggatgagaaatcggttatttgcttcttactccattctcagagattcatagaatatatcagggctgaacaactggaggatgctgtgaaatatgctcgtgctaacctggcaagcttcttgacacacaaagctttcgaggggttgctgaaggagagtgtggccctgcttgcgtatgagaagcctgcagaatcatgcatcggatacctgctggactccccccagcgtgaattcgtggcggatgcagtgaacgcagctgtcctgtctacgaaccccgccatgaaggaccctgagagctgtctttactcgtgtctcgagaggttactaaggcagctcacagtatgtagctttgagcgacgcacattcaacaacgaccaaggagatgcattcttacttcacaaagaagtgcgcaactgtgaaaggtcccggcgttcataggcacatctgagaattcaactcagatgttagactccaactgctgttcggaggaccaaggatcacctcggatggagttgttgaccattgcaggagcaagcacagatccttccttttgaaggtctgcagcgtccatgggctttctgaattccgataggtgcacactcagttgcacagagctctgaaggagtttcctttctgtaatcagaaaactcgttcagaatcggccgaagtatctattcccataatttgttggttggctaatagaccgtttgattctgtgaatgttaaaaaggcttcaatatatgttctttacctttgtataatgtctcgttgcttaaaacatttttctactgcttgccttgaacgttgtgaaggaggattggccgataagatagactagtgcttgttgcataaga

SEQ ID NO: 1442 - DNA, 2168 bp, Oryza sativa
agcccaaactgttcacccgctgaacaacactgcaacgcaagcacagccgtcgcgaaaacgccggaaagtacacgagtacgttacccccctccccctctctctcgccgcgacgccacacgacacgacacgcgacgacgcgacgcccaactcctcacgcttcccttcccttcccttcccccatccatcctctcctccgactccgacctcccgcaaccgcagcgccgcccgatccgccgccaccgccaccgccaccgccggcagctcgatcccccgcactcgggggggttttggaattggcgaatggtggcgaacgaggtggttgcggcggcggcggtggtggaagaaccggcgcccgcgtcggcgggggcggttgacccgatgaggctggcgtcgcggtggcggtcgccggcggagtggggggccgcggcggccgagatggaggcggagccggcgccgtccgagctcaacaccaccaacagctcgggcctcttcgccgtcgtctctaccgaccggatgtccgtcaggtacctcggcgtcaaccagcacggccacgacgtcggcgtcgtgcaggccaaccgccccgcccccacgcgccgcgccgtctactacttcgagatgggcgtcaagaacgccggccagaaggggcagacctccatcggcttcaccaccgagaatttcaagatgcgccgccagcccggctgggagtctaacagctgtggatatcatggcgatgatggctatctttaccgtggtcctgggaaaagtgagtcatttggtcccaaattcacttctggtgacacaattggtgctggcatcaactatttctcacaagaatttttcttcacgaaaaatggatctctagttggatcctttcaaaaagaaattaaaggcccactatatcctaccattgcagtccatagtcaagatgaagaggtgacagtaaactttggaaaagaaccattctgttttgacattgagggctatatttttgaagagaaaatgaagcaacaatctgtcagcgacaaattggatttgcaaccagacatcagtcattggattgttcgttcatatctcctacattacggctaccaagatacattaaattcttttgatatggcaagtgaaactgatcctccatccaatcatcaaaatggttatggggaacctcctgaaatgtatggtcttagccacagaaaattgctgcgtcagcttatcatgagtggagatattgattctgcattcaaaaaacttggagaatggtatccacaggtgataaaggatgaaacatcaattatttgcttcttactccattcccaaagattcattgaatttatcggggctggacaactggaggatgctgtaaaatatgctcgctctaacctggccaacttcttgacacataaagcttttgatgggttgctaaaggagagcgtggccctgcttgcatatgaaaagcctgccgaatcgtgcattggatatctgctagactctccacagcgggaatttgtagcggatgcagtgaatgcagctgtcctgtcaacgaacccgaacatgaaggaccctgagagttgcctttactcatgtctcgagaaactactgaggcagctcacagtatgcagcttcgagcgacgtgcattcagcggagaccaaggggatgcattcttactacataaagaagtgcagtcctgcgatagatccaggtgttcctaggcatcaaagcattcaagttgcacctgcatctgagcagtgaactcagagatgagactttgtgcccctcttggaaggaaagggattcacctcggagcggagatgtagaccatgatccatgcgcaatcacagatactttgattcttgaagtttcgcagtatactctccacaaggtgaacgcctaactgctgggaaatttggcagcagctccttccctgtaatctgaaaacttacattcacacatggccttaaacatctctgtttccataaactcggaagctttgagctggtagacattctgaatgtgaaatgagaagagaaaaacaataagatttgtgtaaatgaaatcgagttgccctttaaccttgtggttcattctaattcattgatacattcaattgcaatgtcttggttgcgctcgagtatatgtttacttgaaatgataaaccatttgcaagaac

SEQ ID NO: 1443 - DNA, 1860 bp, Panicum virgatum
ctgaactcttcgacacttcgacaggctttcttcatcctcttcgtcttccttcccctggcctcccatccacccccacggccccaccccgcccgcaactacaagcaacccccgaactagtccattccgcctccaggcgaatggtcgccaaccaggaggcggaggcggcatcggcggcagcgcccggggcagggacgccggtggacccgatgcgtctggcgtcgcggtggcggtccccggcggagtgggagtgtgcggcggcggagctggatgctgagccgctcccgtccgagctcaacaccgtcaacagctctggacttttcgccgtcgtctccaccgacaagttgtccgtcaaatacctcggcagccatcaccatggccacgacgtcggggtcgtgcaagccgaccgccccgcgcccacgcgccgggccgtgtactactttgagatgcgggtcaagaacgccggctacaaggggcagacctcaatcgggttcacaaagcgaaagcttcaagatgcggcgacaaccgggttgggagcctaacagttgtggataccatggtgatgatggccatctttaccgaagtcaagggaaaggtgaaccattcgggcccaaatttacatctggcgacacaatcggtgctggcatcaactacctgtcacaagaatttttcttcacgaaaaatggatctctggttggagcctttccaaaagaaattaaaggtccactatatcctaccgttgcagttcatagtcagggtgaagaattgactgtgaactttggtaaagaaccattctgttttgacattgagggttatatactcgaagagaaaatgaggcaacaatcgatgacgaacaaattgaagttggaagagaacatcagtcatgtgattgtccgttcatatctgctacattatggttaccaagatacattaaattcttttgacatggcaaatgcaactgacccccctggcagtcgccaaaatggacacagggaacctccagaaatgtatggtcttagccacagaaaacttttgcgtcagcttatcatgagtggagatattgactctacattcaaaagactagaggaatggtatccacaagtgataaaggatgagaaatcggttatttgcttcttactccattctcagagattcatagaatatatcagggctgaacaactggaggatgctgtgaaatatgctcgtgctaacctggcaagcttcttgacacacaaagctttcgaggggttgctgaaggagagtgtggccctgcttgcgtatgagaagcctgcagaatcatgcatcggatacctgctggactccccccagcgtgaattcgtggcggatgcagtgaacgcagctgtcctgtctacgaaccccgccatgaaggaccctgagagctgtctttactcgtgtctcgagaggttactaaggcagctcacagtatgtagctttgagcgacgcacattcaacaacgaccaaggagatgcattcttacttcacaaagaagtacgcaactgtgaaaggtcccggcgttcataggcacatctgagaattcaactcagatgttagactccaactgctgttcggaggaccaaggatcacctcggatggagttgttgaccattgcaggagcaagcacagatccttccttttgaaggtctgcagcgtccatgggctttctgaattccgataggtgcacactcagttgcacagagctctgaaggagtttcctttctgtaatcagaaaactcgttcagaatcggccgaagtatctattcccataatttgttggttggctaatagaccgtttgattctgtgaatgttaaaaaggcttcaatatatgttctttacctttgtat

SEQ ID NO: 1444 - DNA, 2318 bp, Panicum virgatum
caccaacatcaccagttgcttctcctgaactcttcgacacttcgacaggctttcttcatcctcttcgtcttccttcccctggcctcccatccacccccacggccccaccccgcccgcaactacaagcaacgccggatccagtccgttccgcttccaggcgaatggtcgccaaccaggaggcggaggcggcatcggcggcagcgcccggggcagggacgccggtggacccgatgcgtctggcgtcgcggtggcggtccccggcggagtgggagtgtgcggcggcggagctggatgctgagccgctcccgtccgagctcaacaccgtcaacagctctggacttttcgccgtcgtctccaccgacaagttgtccgtcaaatacctcggcagccatcaccatggccacgacgtcggggtcgtgcaagccgaccgccccgcgcccacgcgccgggccgtgtactactttgagatgcgggtcaagaacgccggctacaaggggcagacctcaatcgggttcacaagcgaaagcttcaagatgcggcgacaaccgggttgggagcctaacagttgtggataccacggtgatgatggccatctttaccgaggtcaagggaaaggtgaaccattcggggccaaatttacatctggcgacacaatcggtgctggcatcaactacttgtcacaagaatttttcttgacgaaaaatggatctctggttggagcctttccaaaagaaattaaaggtccactatatcctaccgttgcagttcatagtcagggtgaagaattgactgtgaactttggtaaagaaccattctgttttgacattgagggttatatactcgaagagaaaatgaggcaacaatcgatgacgaacaaattgaagttggaagagaacatcagtcatgtgattgtccgttcatatctgctacattatggttaccaagatacattaaattcttttgatttggcaaatgcaactgatccccctggcagtcgccaaaatggacatagggaacctccagaaacgtatggacttagccacagaaaacttttgcgtcagcttatcatgagtggagatattgactctacattcaaaagattagaggaatggtatccacaagtgataaaggatgataaatcggttatttgcttcttactccattctcagagattcatagaatatatcagggctgaacaactggaggatgctgtgaaatatgctcgtgctaacctggcaagcttcttgacgcacaaagctttcgaggggttgctgaaggagagtgtggccctgcttgcgtatgagaagcctgcagaatcatgcatcggatacctgctggactccccccagcgtgaattcgtggcggatgcagtgaacgcagctgtcctgtctacgaacccagccatgaaggaccccaagagctgtctttactcgtgtctcgagaggttactaaggcagctcacagtatgtagctttgagcgacgcaccttcaacaatgaccaaggagatgcattcttacttcacaaagaagtgcgcaactgtgaaaggtcccggcgttcataggcacatctgagaattctcggatgttagactccaactgctgtttggaggaccaaggatcacctcggatggagttgttgagcatggcacgcgcaagcacagatccttccttttgaaggtctgcagcgtccatgggctttctaattccgataggtgcacttaattgcacagagctctgaaggagtttccttcctgtaatcagaaaacttgttcagaatcggccaacgtgtctgttcccatagtttgatggttggctaatagaccatttgattttgtgaatgctaaaaacgcttcaatatatgttctttacttttgtataatgtctcgttgcttaaaacatttttctacagcatgccttgaacgttgtgaaggagaattggccgataagataaataacagaggaccacagccccaccgccggctaggctgggtggatgaaaaacagcatgattggctacctgttttcttctagcaaggctatagtgcatgttgcataagaaaattgtttaaaaacagttgtcaatatgatgtgtattttatacgagtactctttaatagctcttattataccttattaaatactaaccagctttgaaaatcactaataacacttaatacacgctaatcatacgctaatagccgcctgcacgaagcgagccaggccgccagaaacgaaaaaaaaaatctcgtatctgcagagccaggctgaagccctgtgcgggcaaccaaacggccagaggctgcatgtgggcctggccg

SEQ ID NO: 1445 - DNA, 2006 bp, Sorghum bicolor
cagacctgggcccactcatcatagaagaacgcctcagtttaccaaatcaaccccccagaaaacctgcaaaatcacactccgtatctctacgagtacacccacccagttgcttctctccaactcgtcacgcttcttcagcgccggctctcctctccatccctctcctacactgaccttctcctccacatctcccgcaaccgcaagcaaccactgatccagcccgctccgcctcccggcgaatggtgacgaaccaggacgcggaggcggcatcggcggcagcgccgggggcaggggcgacggtggacgcgatgcggctagcgtcgcggtggcgatcccaggcggagtgggcctgcgcggcggcggagctggagtctgagccggcgccgtccgagctcaacaccgtcaacagctccggactcttctccgtcgtctctaccgacaagttgtccgtgaaatacctcggcagccatcaccacggccacgacgtaggtgtcgtgcaggccgaccgccccgcgcccacgcgccgggccgtgtactacttcgagatgagcgtcaggaacgcgggatacaaggggcagacatccatcgggttcacgaacgagagcttcaagatgaggcgacaaccgggttgggagtcaaacagttgtggataccacggtgacgatggccagctttacgtgggtcaagggaaaggtcaatcatttgggccaaaattcacatctggtgacataattggcgctggcatcaactacttgtcacaagaatttttcttcacgaaaaatggagctcaggttggagccattccaaaagaaattaaaggcccactatatcctaccattgcggttcatagtcagggtgaagagttgactgtaaactttggaaaagaaccattctgttttgacattgagggttatattcttgaagagaaaatgaggcaacaatctgtgtctgataaattgaacttggagccggacatcagtcattggattgtccgttcatatctcctacattatggataccaagatacattaaatgcttttgatatggcaaatgcaactgatccccccaccaatcgccaaaatggtcatgcagaacctcccgaaatgtatggtcttagccacagaaaacttttgcgtcagcttatcatgagtggggatatcgactctgcattcaaaagacttggggagtggtatccacaagtgataaaggatgagaaatcggttatttgcttcctactccattctcaaagattcatagaatatatcagggctgaacaactggaggatgctgtgaaatatggtcgtgctaacctggcaagcttcttgacacacaaagcttttgagggactgctgaaggatagtgtggccctacttgcgtatgagaagcctgcagaatcatgcatgggatacctgatggactctccccagcgtgaattcgtggcggacgcagtgaacgcagctgtcctgtcgacaaaccccaccatgaaggaccctgagagctgcctttactcgtgtctcgagaggttactaaggcagctcacagtttgtagctttgagcggcgtgcattcaacaacgaccaaggagatgcattcttactccacaaagaagtgcagaattatgaaaggtccaggcgctcatagccatcatcaggtttgatgcgcatctgagaagtagactcagatgctagactcccgactcctgtttgaagggacgaagattcatgacggagtggttgaccatggctagcacagatccttccctttgaaggtctgcagtgcccctcagctttggcaagggggaacaccaaattgcacagacagagctcaggcgcttcggaaggtgttctatcctccctgtaatcagaaaactcattgtgacatacggccaacgtttcagtttccttaatttgttggttggctactatgctgtttgacattgtgaaacgtgaatgcaaaaaaagtaaagacgcttcaaggtactccctcggtcccaaaataactgtttct

SEQ ID NO: 1446 - DNA, 1824 bp, Saccharum officinarum
tctctccaaaactcctcacgcttcttcagcgccggctccatccctctcctacacctacactgaccttctccttccacatctcccgcaaccgcaagcaaccactgatccagccggttccgcctcccggcgaatggtgacgaaccaggaggcggaggcggcatcggcggcagcgccgggggcaggggcaacggtggacccgatgcggctggcgtcgcggtggcgatcccaggcggagtgggcctgcgcggcggcggagctggaggctgagccggcgccgtccgagctcaacaccgtcaacagctcgggactcttctccgtcgtctctaccgacaagttgtccgtgaaatacctcggcagccatcaccacggccacgacgtcggtgtcgtgcaggccgaccgccccgcgcccacgcgccgggccgtgtactacttcgagatgagcgtcaggaacgcgggacacaaggggcagacatccatcgggttcacgaacgagagcttcaagatgaggcgacaaccgggttgggaatcaaacagttgtggataccatggtgacgatggccagctttacgtggatcaaaggaaaggtcaagcatttgggccaaaattcacatctggtgacataattggcgctggcatcaactacttgtcacaagaatttttcttcacgaaaaatggagctcaggttggatccattccaaaagaaattaaaggcccactatatcctaccattgcagttcatagtcagggtgaagagttgactgtaaactttggaaaagaaccattctgttttgacattgagggttatatctttgaagagaaaatgaggcaacaatcggtgtctgataaattgaacttggagccagacatcagtcattggattgtccgttcatatctcctacattatggataccaagatacattaaatgcttttgatatggcaagtgcaactgatccccccaccaatcgccaaaatggtcatgcagaacctcccgaaatgtatggtcttagccacagaaaacttttgcgtcagcttatcatgagtggagatatcgactctacattcaaaagacttggggagtggtatccacaagtgataaaggatgagaaatcggttatttgcttcctacttcattctcaaagattcatagaatatatcagggctgaacaactggaggatgctgtgaaatatggtcgtgctaacctggcaagcttcttgacacacaaagcttttgagggacttctgaaggatagtgtggccctacttgcgtatgagaagcctgcagaatcatgcattggatacctgatggactctccccagcgtgaatttgtggcggacgcagtgaacgcagctgtcctgtcgacgaaccccaccatgaaggaccctgagagctgcctttactcgtgtctcgagaggttactaaggcagctcacagtttgtagctttgagcagcgtgcattcaacaacgaccaaggagatgcattcttactccacaaagaagtgcagaattatgaaaggtccaggcgctcataggcattatcaggtttgatgcgcatctgagaagtaaactcagatgctagacttgcaactcctgtttgaagggacgaaggttcacgacggagtggttgatcgtggcaagcacagatccttccctttgaaggtctgcagcgcccctcaactttggcaacggtgaacaccgaattgcacagacagagctcaggcgtctcagaaggtgttctatcctccctgtaatcagaaaactcagtgagatacggccaacgtttctgttaacctaatttgtgggttgctaatatgctgtttgacat

SEQ ID NO: 1447 - DNA, 2228 bp, Setaria italica
gttgcttctcccgaactcttcttcatcctctccgtctttccttcccctgacctcctcccatccacccgcccgcaaccgcaagcaaccaccgatccagtccgttccgcctcccggcgaatggtagcgaaccaggaggcggaggcgggatcgccgggggcagggacgacggtggacccgatgcggctggcatcgcggtggcggtgcccgacggagtgggaccgcgcggcggcggagttggatgccgagccgctcccgtccgagctcaacaccgtcaacagctcgggcctcttcgccgtcgtctccaccgacaagttgtccgtcagataccttggtagccataaccacggccacgacgtcggggtcgtgcaggccaaccgccccgcgcccacgcgccggcccgtgtactactttgagatgggggtcaagaacgcgggctacaaggggcagacctcaatcgggttcacaaccgatagcttcaagatgcggcgacaaccgggttgggagtctaacagttgtggataccatggtgatgatggccacctttaccgaggtcaggggaaaggtgaatcgttcgggcccaaatttacatctggtgacacaattggtgctggcatcaactacttgtcacaagaactttttttcacgaaaaatggatctctggttggagccgttccaaaggacctcaaaggcccactatatcctaccgttgcagttcatagtcagggtgaagagttgactgtaaactttggaaaagaaccgttctgttttgacattgagggttatattcttgaagagaaaatgaggcaacaatcggtgacagacaaagtgaagttggaagaaccaaacatcagtcattggattgttcgttcatatctcctacattatggctaccaagatacattgaattcatttgatttggcaaatgcaactgatccccctgccagtcgccaaaatggtcatagggaacctcccccagaaatatatggtcttagccacagaaaacttttgcgtcagcttatcatgagtggagatattgacactacattcaaaagactcggggagtggtatccacaagttataaaggatgagaaatcggttatttgcttcttactccattctcagagattcatagaatatatcagggctgaacaactggaggatgctgtgaaatatgctcgtgctaacctggcaagcttcttgactcacaaagcttttgaggggttgctgaaggagagtgtggccctgcttgcgtatgagaagcctgcagaatcatgcattggatacctgctggacgctccccagcgtgaattcgtggcggacgcagtgaacgcagctgtcctgtcaacgaaccctgccatgaaggaccctgagagctgtctttactcatgtctcgagaggttactacggcagctcacagtatgtagctttgagcgacgcacattcaacaacgaccaaggagatgcattcctacttcacaaagaagtgcgcagctgtgaaaggtcgaggcgctgataggcacagctgagaatctgactcagatgttagactccaactgctgtttggaggaccaaggatcacctcgttcggagtgggttgactcatggcaacagcaagcacagattccttccctttgaaggtctgcagcctccctgggcttcctgaattcccataggtgtgcgccgaattgcacagagctcagacgctttggaaggagcttccttcctgtaatcagaaaacaaacaaacattcagattcggccaacgtcgctgttaccataatttgttggttggctaatgtattgtttgacattgtgaatgctaaaaacgcttcaatacatgtccttcgcccctgtagaccttggtttctcgtagcatgtctccgctttgtctggtggcctctttttgagtgacttgaccgcgggtagttatcaggagtcaagccagtcgagtcaggaggctctttgaggccagacatttgattttccataagcgtgtgatactcgttacgtgacagccaaactgctgttacgcacaaatgtaacattcgtctaacattctaatagtgtgttttgcttgtgtgcttggaggatttaacgtataattaaataaactatcgtgaaataacaccaaagggagaccgccaaactggtctaagtcttaacattcggccagcggtctttcactggtgtgcttttacaattgttataaataagattacatccacgaatt

SEQ ID NO: 1448 - DNA, 1889 bp, Zea mays
aaatcacacccgtgtctgtacgccacccagttgcttctctgtgtactctccaactcatcaccggctccatccttgtcctacactgacctcgtccccatcccgcaaccgcaagcaaccaccgatccagcccgttcggcctttcggcgaatggtgacgaaccaggacgcggaggcggcatcggcggcagccccggggccaggggcgacggtggacccgatgcgcctagcgtcgcggtggcggtcccagacggagtgggaccgcgcggtgccggagctggaggctgagccggagccgtccgagctcaacaccgtcaacagttcgggactcttctccgtcgtctctacggacaagttgtccgtgaaatacctcggcagccatcaccacggccacgacgtcggtgtcgtgcaggccgaccgccccgctcccacgcgccgggccgtgtactacttcgagatggccgtcaggaacgcgggatacaaggggcagacatccatagggttcacgagcgagagcttcaagatgaggcgacaaccgggttgggagtcaaacagttgtggataccatggtgacgacggccacctttaccggggtctagggaaaggcgaaccgtttgggccaaaattcacatctggtgacataattggcgctggcatcaactacttgtcacaggagttcttcttcacgaaaaatggagctccggttggagccattccaaaagaaattaaaggcccactatatcctacaattgcagttcatagtcagggtgaagagttgactgtaaactttggaaaggaaccattctgttttgacattgagggttatattcttgaagagaaaatgaagcagcaatcggtgtctgataaattgaacttggagacggacatcagtcattggattgtccgctcatatctcctacattatggataccaagatacattaaatgcttttgatatggcaaatgcaactgacccccccaccaatcgccaaaatggtcatgcagaacctcccgaaacgtatggtcttagccacagaaaacttttgcgtcagcttatcatgagtggagatattgactctacattcaaaagacttggggagtggtatccacaagtgataaaggatgagaaatcggttatttgcttactactccattctcaaagattcatagaatatatcagggctgaacaactggaagatgctgtgcactatggtcgtgctaacctggcaagcttcttgacacacgaagcttttgagtggctgctgaaggatagtgtggccctgctggcgtacgagaagcctgcagaatcatgcttgggatacctgatgggctctccccagcgtgaattcgtggcagacgcagtgaacgcggctgtcctgtcgacgaaccccaccatgaaggaccctgagagctgcctctactcgtgtctcgagaggctactaaggcagctcacagtttgtagccttgagcgacgtgcattcaacaacgaccaaggagatgcattcttactccacaaagaaatgcaaaactatgaaaggtctaggcgctcatagcctcataggcatcaggattgttgcgcttctgaagtaaactcggttcgggtgttagacctcctcatctgccgtttgaagggacgaagattcaatgacaagcacgtatccttccctttgcaggtctgcagcgcccctcagctttcgcaagggtgagcaccgaattgcatggacacagctcaggcgcttcgggaggtgttctaacctctctgtaatcagaaaactcacagtgagataaagccaacgtttcagatttcccctattttgttggttggctaatatgctgtttgacactatgaatgctaaaaagtaaagacgcttcgacatatgcccctggtacaaga

SEQ ID NO: 1449 - DNA, 1846 bp, Zea mays
ccagttgcttgcctggtctctccaactcaccctttttcaccttcggcagtctggctccatccgtctcctgcactgaccttttcctccacgtttccggcaactgcaagcaaccactgatccagcccgttctgtgtcccggcgaatggtgacgaaccaggacgcggatgcggcagcgccaggggcaggggcaacggtagatccgatgcggctagcatcgcggtggcgatcccggccagagtggaactgcgcgtcggcggagctggaggctgagccgtccgagctcaacaccgtcaacagctcgggactcttctccgtcgtctctaccgacaagttatcggtaaaatacctcggcagccatcaccacggccacgacgtcggtgtcgtgcaggccgaccgtcccgcgccgacgcgccgagccgtgtactacttcgagatgggcgtcaggaatgctggatacaaggggcagacatccattgggttcacgagcgagagcttcaagatgaggcgacaaccgggctgggagacaaacagttgtggataccatggtgacgacggccatctttatcggggtcaagggaaaggtgaatcatttgggccaaaattcacatctggtgacataattggtgctggcatcaactacttgtcacaagaatttttcttcacgaaaaatggtactctggttggagccattccaaaagaaattaaaggcccactatatcctaccattgcagttcatagttacggtgaagagttgactgtaaactttggaaaagaaccattctgttttgacgttgagggttatattcttgaggacaaaatgaggcagcaatcagtgtctgataaattgaacttggagccagacatcagccattggattgtccgttcatatctcctacattatggataccaagatacattaaatgcttttgatatggcaaatgcaaccgatcgccccaccagtcgccaaaatggtaatgcagaacctcccgaaatgtatggtcttagccatagaaaacttttgcgtcagcttatcatgagtggagatattgactctacattcaaaagacttcgggagtggtatccgcaagtgataaaggatgagcaatcggttatttgcttcctacttcgttctcaaagattcatagaatatatcagggctgaacaactggaggttgccgtgaaatatggtcgtgctaacctggcaagcttcttcacccacaaagcttttgaggggctgctgaaagatagtgtggccctacttgcgtatgagaagcctacagaatcatgcttgggatacctgatggactcttcccagcgtgaatttgtggcggacgcggtgaacgcggctgtcctgtcgacgaaccccactgtgaaggaccctgagagctgcctttactcgtgtctcgagaggctactaaagcagctcacagtatgtagctttgagcgacgtgcattcaacaactaccaaggagatgcattcttactccacaaagaagtgcagaattatgaaaggtctaggcgctcataggcatcgggtttgatgcgcatctcagaagtaaactcagatgctagactcccaagtctcaactgctctttgaagggacgaaggttcagaaccaagtggtcgaccatgctaagcacaaatccttccccttgatgcagcacccctactttcggaagggtggatacaagatttcacagacagaggtcaggctttcggaaggtgtcttatcctccctgtaatcagaaaactacgtttcagtctccctagttttttttgttggttggctaatatgctgtttgacattgacattgtggatgctaaaaagtaaagatgctttaatgt

SEQ ID NO: 1450 - DNA, 2685 bp, Hordeum vulgare
aaatcccagaaaaatcgaggaggaaggcgacgactcgggcggagcggtgcggtgggagagcgcggccatgtgggagccatgggcgcgcgcggcgtggacgtcgtgctcgtgacgacacctgccgccttccaggcccttccccacgcccgcgcccatgaccgcgccgccgcaatgcgcctcaaaaccccaccccgctcccctccccgatctctgacccggcaggcttcttgatccaggcccaggcatggcggaggcggcgccgccgaagctgctctacattgctgtcgccgacggcggcggccggcgggcgttccggtacacgcgccccgtcctgcagagcaccctccagctcatgggctgcaaggctcgccacgccttcaagattagcaagaaagtcttcagtgtgataaggaatgaattcttggatgcatcgaggtcggatagggctgttaaagaagaaaatgctcgtagccacattggggaagatgctgatatgcttaacacagaaattccagacgcaagtagcagcagcatgcccttcgaattgtacaagacgcagacaacaattcttatttcaagagagaagtttctgaatattgtgtgtgatgcactctcttcttacaagtatgttggaccaaaccagaaggctgacttgcttcttgcttgcagaattaaggagaaaaaggaatcagtgacggtactcttgtgtgggacaagcggatgtggcaaatccactctatcatctttgttgggtagtagattgggcattacaacagtagtttctactgattccatacgccatatgatgagaagctttgcagatgaaaagcaaaatcctcttctctatgcatcaacctaccatgcaggcgaacacttggaccctgttgcagttgctaagtcaaaggcaaagaagctctcaacggcttctcataccaatgaaggcaaagatggcacttcagatgttaaatctcagcatggctcctcagatttacctcctagagcagagttggttggaaacaaacaaatggcaatagaagggttcaaggcgcaaagcgagatggtcattgacagcctggacagattaattacatcatgggaagagcagaagcaatctgttattgttgaaggagttcatttgagcctcaattttgtgatggggctgatgaagaaacacccttccataataccatttatggtatatattgccaatgaggagaagcacatggagagatttgctgtacgtgcaaagtacatgacattggacccggcaaagaacagatatatcaagtacatccggaatatcagggctatccaggaatacctttgcaaccgagcggacaagcatctggtgcctaagattaacaatactaatgttgaccagagcgtggcagccatacatgccacggttttcagctgtcttcgccgacgagaagttggggagcagttgtacgatctcaacacgaacactgtttctgttgtggatgaggaatacaggaaccagcgtgcctctaactccttgggctccaagggcatgttccagttcattcaaaggaaggggtcttctaggaatctgatggctctccttaaccctgatggttcagtcaccaaggcttggcatgtagattcgtgtgatggcaatgccaatggcagtagaagcagtgataaatcagtaggaaaggttaacccatcacaaattgggaaggtagaatcagttaatctccaatttggttctttcgggattagcgcgtggctgagtgatacaggtggcaccagccatacagggagtgtagatgacctgagggctgatggcaacgaggcaggcggtagatactactcctcatgctgcagctcaccaaagacgtcagattgcgcatccaaagagcatatggaggattattcagtctatggtagtgaagaagaagctgacgacccacctgatgctgaaactgacgaggatctaactgatgaagaaagagatattcacgagattgaagcgggctcggtcgacgaacattccaccaagtccgacgaggaatacaacgacctagccatgcaggacatgatggggaacggtaactgctctgacgatgacgacgagcaagctgcggggttcggcaacaggagctcgccgtccctggatgagagcatccttggagcagctgacggcgatgatgccgcgaggtaccaccacaacctggacctcttcacgatatccaaggacatagctgccagacagatgccgtgcgcctgacactgccgccccaaccaaccgatgggaagaaaatccatgaatcagacaccatcgccacgattcgctgcgccattgtgctctcctgtgccgcttccagttgggagtctgcaccgtcggctgtactcatatatgttggtggttatgactgttagacacactgatgcttgtccaagcttacacatataggaatctggggcttagcccgtgaaactcaaataatggaaggttgaaattgtatctataattgcgcaagaatctcttggcacaatacaataacttgctgtttttcatccaacatactgatgaaattgagaacagaagtataaagttgcatcagaaaaatgaactagatcaaattaggatcggagagtaatcctgattaaggggacacatgtgtagcgacttcagatttgtactttctactccggcttcgg

SEQ ID NO: 1451 - DNA, 2159 bp, Secale cereale
ctccctcgtgccgagccagagccagagagggagcgcggccatgtggaagccatgggcgcgcacggcgtggacgtcgtgacggcacctgcttcccctctcggccacctcccccaccgccccccacgcccgcgcccatgaccccgccgccgcaatgcgcctcaaaaccccatctttgacccggccggctccgtgagggatccctgatccggaccccggccatggcggaggcggcgccgcccaagctgctctacattgccgtcgccgacggcggcggccgccgggccttccggtacacgcgccccgtcctgcagagcaccctccagctcatgggctgcaaggctcgccacgccttcaagattagcaagagagtgttcagtgtgatgaggagtgaattcttggatgcatcaaggtcggacagggctgttaaagaagaaaatgcctctagcatgggcattagagaagatgctaagatgcttaacacagaaattccagacgcaagtagcagcagcttgcccttcgaattgtacaagacacagacaacgattcttgtttcaagagagaggtttctgaatatcgtgtgtgatgcactctcttcttacaagtatgttggaccaaaccagaaggctgacttgcttcttgcttgcagaattaaggagaaaaaggaatcggtgacagtactcttgtgtgggacaagtggatgcggcaagtctaccttatcgtctctgttgggtagtagattgggcataacaacagtggtttctactgattctatacgccatatgatgagaagctttgcagatgaaaagcaaaatcctcttctctatgcgtcaacctaccatgcaggagaatacttggaccctgttgcagttgctaagtccaaggctaagcgccaggcaaagaagctcgcaatggtttctaatcctaacaccaatgaaggccaagataacacttcagatgttaaatctcgtcacggctcagtattacctcctagaaccgagctgattggcagcaaacaaatggcaatagaagggttcaaggcgcaaagcgagatggtcattgacagcctggacagattaattacatcctgggaagagcagaagcaatctgttattgttgaaggagttcatttgagcctcaattttgtgatggggctaatgaagaaacatccttccataataccatttatggtatacattgcaaatgaggagaagcacatggaacgatttgctgtacgcgcaaagtacatgacattggacccagcaaagaacagatatatcaagtacatccggaacatcagggccatccaggaatacctttgcaaccgagcagacaagcatctggtacccaaaattaacaacactaatgttgaccagagcgtggcagccatacatgccacggttttcagctgtcttcgccggcgagaagttggggagcagttgtatgatctcaacacaaacactgttcctgtagttgacgaggaatacaggagccagcgtgcagctaactccttgggttccaagggcatgttccagttcattcaaaggaaggggtcctcgaggaatctgatggctctccttaaccctgatggttcggtgacaaaggcttggcatgtagattcaagtgatggcaatgctaatggcagtacaagcagtggtagatcagtaggaaatcgcatggttaacccatcacaaatcgggaaggcggagtcagttaatctccaatttggttcttttgggattagcgcgtggctgagtgacacaggtggtggcaccagccatgctggaagtgtagatgacctgagggctgatggcatcgagacaggcggtagatacttctcctcatgctgcagttcaccaaagacgtcagactgcgcctccaaagagcatatggaggattattcagtctatggtagtgaagaagaagctgacgaccacctgacgctgaaactgatgaagatctaactgatgaagaaagagatgttcacgagattgaagcgggctccgtcgacgagcactccacaagtcagacgaggaatatgacgacctagcgatgcaggacgtgatggagaacggcaactgctccgacgacgacgagcaggctggcgggtacggcaccaggacggtcaccgcccatggatgagagcatccgtcggagcagat

SEQ ID NO: 1452 - DNA, 2811 bp, Oryza sativa
ggcatcgacacatgcaaggaaggaagcatttgattgatgcaaggaagcaaagaatccaaaacaaggaagggagaacagaacactataaaagcggaacaaagaagaagagaagagaagaggtagaagaagaataaggtaggacacacacacaactccactagatttaatgacccccccttaaaattaggagaaaattaggcgaaaaacaaatccaaaagcgaagacccaagaggaagaaggttaatcaaaccaagacaagagagagagagagagaaagcaagcacagatagagagagaaacaagagagagaagaagaagaagaagaagaagggtagaagaggacgccgagagcggcagaggggtgaggccatgtgtacgccatgggcgtgcgctgcgtggacgtcgtgacacctgccgccgcccgcgcaccgccatcgccatgcccatgccgccgcaatgcgcctcctcaaaacccccttctcctcctcctcctcctcatccccacgagcacgaggtaggggacgacatggcggaggaggcgccgccgccgccgccgccgcccaagctcctctacattgccgtctccgacgccgccgctcgccgcgccttccgctacacgcgccccgtgcttcagggcaccctccaactcatgggatgcaaggctcgccatgccttcaagattagcaagagggtgttcaatgtgatgaggagtgaattcttggatgcatccaaatcagatactgcagataatgaagaaaatgccccttcccttgtaaaagatgttgagatgctgaagcccaaaattttggaagcaactcttagtagcatacccttcgagttatacaagacccaaacaaccatcgttgtttctagggagaagttcctaagtgttgtatgtgatgccctctcttcatacaagtatgtggggccaaaccagaaggctgactttcttcttgcttgcagaattaaggagagaaaggaatcagtgacagtactcttatgtgggactagcggatgcggcaaatctacgctatcatctttgttgggtagtagattgggtatcacgacagtagtttctactgattccatacgccatatgatgagaggctttacggatgagaagcaaaatcctcttctctatgcatcaacctatcatgcaggcgaatgcttagaccctgttgcagttgctcaggcaaaggcaaaacggaaggcacagaagcttgacattgtttctcatcctaataccaatgaaggcagagacgacacttcagatgataaagctcatcatggatcctccgaattgcctcctagaacggagttgatcggcagcaagcaaatggcaatagaagggttcaaggcgcaaagcgagatggtaatagacagcctggacagattaattacgtcctgggaggagcagaaacaatctgtaattgttgagggagttcatctaagcctcaattttgtgatggggctaatgaagaaacacccttccataataccatttatggtatacattgcgaatgaggagaaacacatggagcgattcgctgtacgtgcaaagtacatgacactagacccagcgaagaacagatatatcaaatacatccggaacatcagagcaatccaggactacctttgtaaccgtgcagacaagcatctggtgcccaagattaacaatactaatgttgaccagagtgtggcggccatacacgccacggttttcagctgtcttcgcaggcgagaagctggggagcagttgtatgacctcaacacaaacactgtagctgtagtgaatgaggaatacaggaaccagcgtgctgctaactcactgggttccaagggaatgtttcagttgatacaaagacagggatcttcaagaaatttgatggctatccttaatactgacggtagtgtcaccaaagcttggcatgtggataaaaacaatggcaatggaagtctcgatggtacaagcagtgacaaatcaacaaaaaatcccatgtatgatacatttgggaaggcggagccagtcaatctccagttcggatctttcgggatcagtgcatggatgagtgacacaggtggcaccagccatacaggaagtgtagatgacttgagagctgatggcattgaaacgggcggcagatattattcctcatgctgcagttcaccaaaggtgtcagattgcccttcaaaagagcttatggaggatgattattcagtttttggtagcgaagaagatgctgatgatcctcctgatgctggaactgacgaagacctaactgatgaagaaagagatatgcacgagatagaagcaggctctgttgatgaacactccaccaagtccgacgaggaatacgacgatctggcaatgcaggatgtgatggagaacggttactggtccgacgacgaacaggctgcaagcagcaccaagaactcatcgaaccaggagaagaacatccatggagcagctgatggtgatgttgttgatgatgaaggcagtggcaatgacaggtttcaccacaatctggccttcttcctgaagatgtccaagaaagtagccgccacagaactgccgtgtgcatagtgcctccggtgtcaaagcaactgttgttggtccagatgtgctctgaactcggttgttatgtatcctgatgagcttacctccatgactgtaactgtaagagaggatctgctgcttgtctaagcaatacagatcacttagaatccgtgtaatccaataactcttgaaaagatgaaataataaagggtgaataaatagtttgatacaaagttggagattgcatccgggag

SEQ ID NO: 1453 - DNA, 2504 bp, Panicum virgatum
cggttttaattaggtgatgggtgatcattttatcagctggcatcatggtttatcttttgatgaagtgtaaggtgtatatcttctttgttactactctttccaaattgtatcgcctctttattttcccagttgaaaaccttgtagtgtttttgggtgctcaaggcccttcaatgcaactcaggtggagattccccatgccccattgacctaaaaaaaaaggtatactcgtaagcagccaggaaggtctgaccagatctcctccgtgtttttacaaacgtgatgcacacacgtaaacaccaccaccactccaaactggtttttactggtataataactacagtaatcccaggtccctgcacgcaatacattcaccgaactttccccagcccagctgatcgcgacatgaaacccatcccgatgaccagatgcattcgcgtgacggcacccacatggccgcgaaaccggaccagacacgattcgcggctgcgaaacaaaaaaatgcccagcgacaagtgtccccggagctcacgaaagcgacacgtcagcgcgctcgcggcgaggacgatcggtctgggtggggccccggcggcgcggacggtctggatccctcgcgcagtctgacggagtcacgccaccacgatctcggccgtccgcggagggggcggagcggttatttatccgggcgtgcggccacggagctctcccccctctaatctgaccccgtcgatttgggtggttgcgttgcttggagttggaggtggagtgggcggccgcgtgcgtgcgtgcgagaggaggagggtccgagcggggagggcatggaggagagcgattagctgttcacgagtcgggaggaggggtagttctcatcttacgagcggagaggcctcgaatttgagcaggcaaggttggttttggtgaatttcgggggctgcaagttgttatcctcgtggattttgtgtttcgggtgttcaattttggtcggggtttttaagcaggagccaatttgtgtagatttttgtttttgtttgtgtgttgggagcaatgattttggttggattccctgttcgccacatgaagatttgatacgagccgattacagaattttgcccaaaaagaaccatttttttggttgtgctattcatcaatccagtggacttgaactctgaaggaagtaactttcccaattgggcccggatttttgttattggcttcaaaagaagtgattttccttcttaaccttggatttactcgtgtaaaaaaatcgggtttttatctgagatactatttgttgatttaggttttcggcctggcagatccaagagaacgccgaattttggttgatttcgccgcgatttttggtctgatcgggaggcccccgagcctgttttttcgcgtgaagcaagtatttttctttttgcgccatgtccatggcgttgagccgcttcacgcaatggctgtggccggggggcgccgccgcccgggtggccacccacgagctcccgggcacggcgctcacaagctcctccttcccggacttcccctccgggttccgggagcccgacaccgtcacgttctacaccgccggccgccgcacgcggccaaggagggcccggaaccggcgccgcagccgcggggagcctagggtcgacagggagtacgacatggtcatcgtgccgtccgacggcggcgggtgcctgtctgggtcggactctgacgactccgactggtccatcggctggctcgagccccaggcgccggagctgcagacggacggcgaccccgagaactgcttcgccgtcctcgtgccgtgctaccgccatggccgcccagagcagcctgagaggcgcgagggcaggtttcttggcgccggagccctggccgacggtggcctctctgatgggaagaattttgtagagcagtggctttcttctctccagaactgataactcaggcttcccctagctacgctgtaaatactaaatagtattgctccgttttgtactactatgtttgtcctagacgcaggatgtatcgatgaaggaagacatgaaaaacctaaaaaagaagcataaaccgaaaagaaaaacaatgagcagtgggattctgaagcagcactgaatgggtatgtccttcctgaggttccaaggctattctactcttgcaatgcaaggcgaatgctgaacaagacaagctgtgcgtcattgaaaaaagattttgccatgtctgatatgtgctgagtgctaacatttgattgataacatgtagagatgaacgctattccattgttagtttttcccacttgcttgtggacctcgaattctactgtatgtagatagtgttcttgcagtgtatatagtctgcgcaaactgcagttgcgctattcttcagtgtgtggtgcgtgtgcgtgctattcttgtgcattggaactgaatgcttatgaatgaatcaatctgctgtatataaattttgtgagaatgtaaattttggtttctcgtgagtgtttg

SEQ ID NO: 1454 - DNA, 1135 bp, Panicum virgatum
atcgggaggcccccgagcctgttttttcgcgtgaagcaagtatttttctttttgcgccatgtccatggcgttgagccgcttcacgcaatggctgtggccggggggcgccgccgcccgggtggccacccacgagctcccgggcacggcgctcacaagctcctccttcccggacttcccctccgggttccgggagcccgacaccgtcacgttctacaccgccggccgccgcacgcggccaaggagggcccggaaccggcgccgcagccgcggggagcctagggttgacagggagtacgacatggtcatcgtgccgtccgacggcggcgggtgcctgtctgggtcggactctgacgactccgactggtccatcggctggctcgagccccaggcgccggagctgcagacggacggcgaccccgagaactgcttcgccgtcctcgtgccgtgctaccgccatggccgcccagagcagcctgagaggcgcgagggcaggtttcttggcgccggagccctggccgacggtggcctctctgatgggaagaattttgtagagcagtggctttcttctctccagaactgataactcaggcttcccctagctacgctgtaaatactaaatagtattgctccgttttgtactactatgtttgtcctagacgcagaatgtatcgatgaaggaagacatgaaaaacccaaaaaaagaagcataaaccgaaaagaaaaacaatgagcagtgggattctgaagcagcactgaatgggtatgtccttcctgaggttccaaggctattctactcttgcaatgcaaggcgaatgctgaacaagacaagctgtgcgtcattgaaaaaagattttgccatgtctgatatgtgatgagtgctaacatttgattgataacatgtagagatgaacgctattccattgttagatttttcccacttgcttgtggacctcgaattctactgtatgtagatagtgttcttgcagtgtatatagtctgcgcaaactgcagttgcgctattcttcagtgtgtggtgcgtgtgcgtgctattcttgtgcattggaactgaatgcttatgaatgaatcaatctgctgtatataaattttgtgagaatgtaaattttggtttctcgtg

SEQ ID NO: 1455 - DNA, 1842 bp, Panicum virgatum
ttggagttggaggagggtccggagcgagcgggagggcatggaggagagcgattagctgttcacgagtcgggaggaggggtagttctgatcttacgagcggagagccctcgaatttgagcaggcaaggttgttttttattggtgaatttcgggggctgcaagttgttatcctcgtggattttgtgctttgggtgttcaattttggtcggagtttttaagcaggagccaatttggggagatttttgtttttatttgtgtgttgggagcaatgattttggttggattccctgttcgccacatgaagatttgataggttggtgaggcgcttaatttcgcacccgattagagaattttgccccaaaaaagagccatttttttcggttgtgctactcatcagtccagtgaacttgaactttgaaggaagaaactatcccgattgggcccggatttttgttgttggcttctaaagaagtgattttccttcttactctggccaaaagcttttccttggatttgtaaaaaaatcggggttttttttctgagatattatttgttgatttaggttttcggcccggcagatccaagagaacgccgaattttgctcgatttcgctgcgatttttggtctcatcgggaggctccctagcctttttctcgcgtgaagaagtattttcttttttgcgccatgtccatggcgttgggccgcttcacgcaatggctgtggccggggggcgccgccgcccgggtggccacccacgagctcccgggcacggcgctcacgagctcctccttcccggacttcccctccgggttccgggagcccgacaccgtcacgttctacaccgccggcggcggcgcggccggccgccgcacgcggccaaggagggcccggaaccggcgccgcagccgcggggagcccagggtcgacagggagtacgacatggtcatcgtgccgtccgacggcggcgggtgcctgtctgggtccgattctgacgactcggactggtccatcggctggctcgagccccaggcgccggagctgcagacggacggcgaccccgagaactgcttcgccgtcctcgtgccgtgctaccgccatggccgccaagagcagcctgagaggcgcgagggcaggtttcttggcgccggagccctggccgacggtggcatctctgatggaaagaattttgtagagcactggctttcttctctcaagaactgataactcagacctcccctagctacgctgtaaatactaaatagtatgctccgttttgttctactatgtttgtcctagacgcagaatgtatcgatgaaggaagacatgaaaaccccaaaaaaagaagcataaaccgaaaagaaaaacgatgagcagtgggattctgaagcagcactgaatgggtatgtccttcctgaggttccaaggctattctactcttgcaacgcaaggcgaatgctgaacaagacaagctgtgcgtcattgaaaaaaaaaattgccatcgtctgatatgtgctgagtgctaacatttgattgataacatgtagagatgaacgctattccattgttaattttcccacttgcttgtggacctcgaattctacggcctgtagatagtgttcttgcagtgtatatagtctgcgcagactgcagttgcgcgattcttcagtgtgtggtgcgtgtgcgtgctattcttgtacattggaactgaatccttatgaatcaattaatctgctgtatataaattttgtgaaaatgtaaattctgatttcttgtgagtttgtcggccagtcatgtgagatgtcactgtattatcgaatcattttataggctctgtttagtttcc

SEQ ID NO: 1456 - DNA, 1519 bp, Panicum virgatum
ggtggttgcgttgcttggagttggaggagcatccgagcgagcggggagggcatggaggagagcgattagctgttcacgagtcgggaggaggggtagttctgatcttacgagcggagagccctcgaatttgagcaggcaaggttgtttttttattggtgaatttcgggggctgcaagttgttatcctcgtggattttgtgctttgggtgttcaattttggtcggagtttttaagcaggagccaatttggggagatttttgtttttatttgtgtgttgggagcaatgattttggttggattccctgttcgccacatgaagatttgataggttggtgaggcgcttaatttcgcacccgattagagaattttgccccaaaaaagagccatttttttcggttgtgctactcatcagtccagtgaacttgaactttgaaggaagaaactatcccgattgggcccggatttttgttgttggcttctaaagaagtgattttccttcttactctggccaaaagcttttccttggatttgtaaaaaaatcgggtttttttttctgagatattatttgttgatttaggttttcggcccggcagatccaagagaacgccgaattttgctcgatttcgctgcgatttttggtctcatcgggaggctccctagcctttttctcgcgtgaagaagtattttcttttctgcgccatgtccatggcgttgggccgcttcacgcaatggctgtggccggggggcgccgccgcccgggtggccacccacgagctcccgggcacggcgctcacgagctcctccttcccggacttcccctccgggttccgggagcccgacaccgtcacgttctacaccgccggcggcggcgcggccggccgccgcacgcggccaaggagggcccggaaccggcgccgcagccgcggggagcccaggatcgacagggagtacgacatggtcatcgtgccgtccgacggcggcgggtgcctgtctgggtccgattctgacgactcggactggtccatcggctggctcgagccccaggcgccggagctgcagacggacggcgaccccgagaactgcttcgccgtcctcgtgccgtgctaccgccatggccgccaagagcagcctgagaggcgcgagggcaggtttcttggcgccggagccctggccgacggtggcatctctgatggaaagaattttgtagagcactggctttcttctctcaagaactgataactcagacctcccctagctacgctgtaaatactaaatagtatgctccgttttgttctactatgtttgtcctagacgcagaatgtatcgatgaaggaagacatgaaaaccccaaaaaaagaagcataaaccgaaaagaaaaacgatgagcagtgggattctgaagcagcgctgaatgggtatgtccttcctgaggttccaaggctattctactcttgcaacgcaaggcgaatgctgaacaagacaagctgtgcgtcattgaaaaaaaattttgccatcgtctg

SEQ ID NO: 1457 - DNA, 1113 bp, Avena sativa
gttacctgtatacgattcaggaaacggaagtgaagaatcggcactatctttgtttttgggttgccttctctcattctccgagagttctttagtttggatccgggcatggagagcgattgacgagccctggaccgtgggagggttttcgattcgcgttctggagtttgccgtgtctcgatttctgagcagggcgtagagtttttcgatccccacctggtctgaaattttctgggacgaggttttgcagaagagggctagttttaatgggacttctcgtcacaaatcagtgagctggaactttcccaataggagcagatttttcgtggctgcggcgcgcagtttcagggggcggcacctttgtttgctacgctttacttccggtgttcgttttaacttggcagatccagggaacaccggattttgttcgattttgccgatttttttgatctgatcgaaaggatcacaggcatttttttggtcatggccatggggctgggccgattcacccactggctgtggccggctacctcggcgcgggtgtcccaccacgagctccccaccacggccctgacgagctcctccttcccggacttcccctccggcttccgggagccagacaccgtcaccttctcgagtgccgccgccggccgccgcgcgcggcagaggaaggtcaggaaccagcggcgcagccgcggggagtgcagggtcgacagggagcacgacatggtcatcgtgccatccgacggcggcgggtgcctatccggctccgagtccgacgactctgattggtccatcggctggctggagccgcaggcgccggagatgcagacggacggtgaccctgagaccggcttcgccgtcctcgtgcggtgctacagccgcggccgcgccgagcagcccgggaaggcccagggccgattcctgggcgctggcgctctcgccgacggtggcctctctgatggaaataattttgtagaacagtggctttcttctctccagaactgatatgtgcaatccccccattgccacactgtatatattatagccccgtatcattctactatgtttctccgtcccgtacgcaaaatatatcgatgaaggaagacattgaaa

SEQ ID NO: 1458 - DNA, 1766 bp, Setaria italica
cttctctaatctgaccccatcgatttgggtggttgcgttgcttggagttgggaggtggagtgggagaggaggatccgagcggggagggtatggaggagagcgattagcggttgccgagtagggaggaggggtagttcttgatcttactcgcgtttgccgggcctcgaatttgagcgggcaaaggttgtttctttaccgggattcttgggcgtgtgttttgggtgaatttcgggggctgcaagttgttatcctcgtggatttctgtttcgggcgttcaatttttttgtcggaatttttaagcgggagccaatttagggtgatttttgtttttctttctgtgttgggagcaatgagtttggttggattccatgtttgccgcatgaagatttgatggttggtgacgcgcttaatttctcaccggattagagattttttccccagaaagagccatttttctcggttgtgctagtctgtcaatccaattaactcgaactctgaaagaagaaactttcccaattggaccaggatttttgtggttggcgtctaaagaagtttttggctcggcagatccaagagaacgccgaatttgctcaacttttggcctgatagggaggtccccgagctttttttttcctcgcgagaagcaaggatttttctttttgcgccatgtccatggcgttgagccgcttcacgcaatggctgtggccggggggcgccgcggcgcgggtgtccacccacgagctctcgagcgcggggctgacgagctcctccttcccggacttcccctccggcttccgggagcccgacaccgtcactttctacaccggcggcggcggcggcgcgggcggccgccgcacgcgcccgaggagggtcaggaaccggcgccgcagccgcggggagtcccgggtcgaccgggagtacgacatggtcatcgtgccgtctgacggcggcgggtgcctgtccggctcagactccgacgactccgactggtccatcggctggctcgagccccaggcgccggagctgcagacggacggcgaccccgagaactgcttcgccgtcctcgtcccatgctaccgccacggccgccaagagcagcctgggaggcgcgagggcaggtttctgggcgccggagccctggccgacggtggcctctctgacgagaagaattttgtagagcagtggctttcttcgctccagaactgatagctcaggcctcccctagctacgtgtaaatactaaatagtatcactccgtttcgttctactaagtttgtctagacgcagaatgtatcgatgaaggaagacatgaaaaaacccccaaaaaaagaagcaaaaccaaaaagaaaacaatgagcagtgggattctgaagcagcaccgaatgggtatgtccttcctgaggttccaaggctattctactcttgcaatgcaaggcgaatgctgaacagtacaagctgtgcgtcattgaaaaaagatttttgccgtcctgatatgtgctgagtgctaacattggattgataacatgtagagatgaactgctattccattggtaaattgtcccacttgcttggggacctcgaattctactgcctgtacatactttcttgtagtgtatatagtcggcgtagagctgcggttgtgtgattcttcgtttgtggtgcgtgtgcgtgttatttcttgtacattggaactgaatcccttatgaatcaatcagtctgctgtatataaatcctgtgaaaatgtgaattttgatctctgctgagtgt

SEQ ID NO: 1459 - DNA, 2364 bp, Sorghum bicolor
gcacagccgagcagcgagcaacgaacgaagcaacagcaacacgcccaggatcgaaacgaaatgcccggtgacaagtgtgaagaagtgccccggcacggcagcgcacgaaatcgagcggagcaaggggcttggccccgcacgctggcccctcggggccgcgacacgtcagcacggtcgcggcaggatgattggcctgtgtgtgtgtgggcccgcgcccgcatggacggctgggatgtctcgcccagggtgtagtattatttatccggccgtgtggccgcggggctcgctccctccctccacaatccttaacctccccatcgttccatcgattggtggttgcgtcgtttcttcgagttcgtggaggttggagtcggagtgtgagtgggccgcgtgcgtgcgagaggatctgagcggagacgagagggcatggaggagagcgaatagcggttgccgagtcagaggcgttgttgtggtttctgatcgtactcgcgtgcgtttgccgggcctcgatttcgagcaggcaacagctttttaccggagattcttgggtgtgtgtgtgtgttttgggcctacccgaggcgggttttgtgtgctggtgttcagttttgttgccggattttgaattggaggaggagcggagattttttttttttgcctgtgttttcgggggtaatggttttggattccctgttttgcccgccacatgaagacttgagattcatataggttgttggtctcgcgcttcggattactgaatttttgctccattttttcgttgtgctactcgtcaatcaaaccagtgaagtttgaactctgaaagaagaaactttcctaattggacccggtatttcgtggttggcgtctaatctaaacaagttttcgacgactcggcagatccagggggggaacgccgacgaattttgcctgatttctccgcggtttttggtccgatccagaggctcccagtctcaggctttttttctcgcgaagaagcaaggttttcccttcttttttttcccccgccatgtccatggcgttgagccgcttcacgcaatggctgtggccggggggcgcggcggcgcgggtggcggccacccacgagcaccccagcgcggggctgacgagctcctccttcccggacttcccatccgggttccgggagcccgacaccgtcacgttctacaccggcgggggcgccggcggccgccgcgcgcgcccgaggagggtcagcaaccgccgccgcagccgcggggaggcccgtgtcgaccgggagtacgacatggtcatcgtcccgtccgacggcggcgggtgcttgtccggctccgactcggatgattccgattggtccatcggctggctcgagccacaggcgccggagctgcagacggacggcgaccctgagaactgcttcgccgtcctcgtgccctgctaccgccatggacgccaagagcagcagccccggaggcacgagggcaggtttcttggcgccggcgccctcaccgatggtggcctctctgatggaaagaattttgtagagcagtggctttcttctctccagaactaatattgccagtcctgtcctagctacgctgtaaatagtagtattactctgttttgttctactacgtttgtcctagtcgcagaatgtatcgatgaaggaagacatgaaaaagccctaaaaaaaagaaggaaatctaaaaataaaaaatgaggagcagtgggattctgaagcagcaccaaatgggtatgtccttcctgaggttcccaagctattctactcttgcaaagcaaggcgaaagctgaactacacaaactgcgcgtcatcgaaaatgattttgccgtcctgatatgtgctgagtgctaacttatgatgattgataacacgtagagatgaactgctattccattgttaatttgtcccacttgcttgcggacctcgaattctactgcctgtacatagtgttcttgtagtgtatatagttttgcgcagagctgcagttgcgcgatttttcagagtgtggtgtgtgtgtgtcctattcttacatgggaattgaattctgatgaatgaatctatctgctgtatataaattatgacaatgtgttcaattctgctgtgtcatcctgtcctgttgtatgatgtgcgtgattgaatttctgtatatagttcttcagtgtctgtgtgatgcacgtgagtgattgaatttgccaaaggggcacaaatctgggtaagaagaaacaagtaggtctgcagcagattccaacattttttttcttcttctgataagattgctgtttttccatgggttgcgccaaacttgatagggtcttagagcaactccaacagctttgctattcttattatgg

SEQ ID NO: 1460 - DNA, 1314 bp, Triticum aestivum
acgttttcggggttaggttagttggtggttgctcctagtcgcagactttattaatctcaatctggatccgggcacggggagcgattgactgatcgacgagactcgagagcctggagagccgggggtttcgcttctcgttgcgtttggagtcttgccgggtctcggttttcgagcagatccagggaacaccggttttcctttgattttgccgaaatttttgatctgatcggagcgatcccggagcttcgcaaggagcaaggcatttttctgggggccatggccatggggctcggccgattcacacactggctctggccgggtaacgccgcgcgagttggcaaccacgagctccccggcatcgccttgacgggcgcctccttcccggagttcccctccgggttccgtgaggcggacgctatcgccttctccagtgccgccgccggccgccgcacgcggccgaggagggtcaagaaccagcggcgcagtcgcggggagcccagaatcgacagggagtacgacatggtcatcgtgccgtccgacggcggcgggtgcctttccgggtccgagtccgacgactccgactggtccatcggctggctggagccgcaggcgccggagatgcagacggacggtgaccaggagacctccttcgccgtcctcgtgccctgctaccgccacggccgcgccgagcagcccgcgatgccccagggacgcttccttggcgctggccctctcgccgatggcggcctctctgatggaaagaattttgtagagcagtggctttcttccctccagaactgatatctggaatctccgttagctatgttgtatatattattgctcagtatcattatcgatgaaggaagacatcaaaacccaaaaaaatgagaaaatggaaaaagaacaaaaagaggagcagcggaattttgaagcagcactgaacgggtttgtccttccggaggtttcaaggctaattctactcattgcaaagcaaggccaatgctgaacaagaccagctgcgctgcgggtcgtagaagacacattcattcttattaaccaatctacgacaacatttgtagatattatttggtatcacatcgttcattttgtcccactttgattctggacctcgaccctgctactggcatgtgtatatatggtgtcatttgccgtgtatatataagctgcagatgtgcagctcctcagtgtgcgtgtgtgttgatgtagatcggaacaggattgctccttgtgaaattcagatgtatataagctttttgcgtttttgtggaacaagttcttggctcaagtttctga

SEQ ID NO: 1461 - DNA, 1665 bp, Triticum aestivum
ctttgtgaagtcaatttttgacaagtctggcaccttttcagttatgagttatccattgatggtttgggaataaattcagcttgtgttaagctggcagaactcagcctataacaggataagccgataagattcgttcttggtgtctcttgctgttgtactagcatttatggggcacaactactactggtcatatgctattttcatgtttggagctgttgattggtgggtttggttggcttgctctatagtactagtactttgggcttgaagatatttgtttgagattcctatgctcaacagtagatatgcaatacttaataccgttgttttatcactaaaaactctttactatttcatcagataaccctagaggcatggatgtatgatagaatccgttgactaattttttcttcaaaatttggcaatctataacttactctgttagacctcttcagttgttaaacttgtagccataccacttgctttggttggcttctgccactttgtgtgctgtagttgaggtttgagcttgctgtgtcaaaatgtgctacttcgacttgtgaattgattctataacttttattcttctttcagcatcacgttttgtatatttatgttaatcaaacaaggcatcaaatacccccgcaagaaaaacaaggcatcaaacatattactttattacacccgcatcacagggagctgatggcttcctgttattggttctcttatatttagtcaattcaacaacagcactgtatttgttacaatgatagtatacggtctttgcggaataatagtactgcaattgcttaccatgttcctgatttaccatttactccagtcaactcctgcattttattggttctagagtgattggtgtttgaacatgataaagccacttcattgtctgcttgtgccattttgattatcaacgattgttttggattgtgtggaaggtctttcatcgtaattcatttatcttataagagttttagttgctagcaatgtttactcatgtgcatagtcttagtgttactctatttatttcatcattacagcttctgatatttttctgacactcttctttccttttcccgctcggcagatggaaagaattttgtagagcagtggctttcttccctccagaactgatatctggaatctccgttagctatgttgtatatattattgctcagtatcattatcgatgaaggaagacatcaaaacccaaaaaaatgagaaaatggaaaaagaacaaaaagaggagcagcggaattttgaagcagcactgaacgggtttgtccttccggaggtttcaaggctaattctactcattgcaaagcaaggccaatgctgaacaagaccagctgcgctgcgggtcgtagaagacacattcattcttattaaccaatctacgacaacatttgtagatattatttggtatcacatcgttcattttgtcccactttgattctggacctcgaccctgctactggcatgtgtatatatggtgtcatttgccgtgtatatataagctgcagatgtgcagctcctcagtgtgcgtgtgtgttgatgtagatcggaacaggattgctccttgtgaaattcagatgtatataagctttttgcgtttttgtggaacaagttcttggctcaagtttctga

SEQ ID NO: 1462 - DNA, 1294 bp, Triticum aestivum
tcagtggtggttgctcctagtcgcagacttctttattaatcacaatctggatccgggcacggggagcgatcgactgatcgacgagagcctggagagccgggggtttcgcttctcgctgcgtttggggtcttgccgggcctcggttttcgagcagatccagggaacaccggttttcgtttgattttgccgaaacttttgatctgatcggagcgatcccggagcttcgcaaggagcaaggcatttttcttggggggcatggccatggggctgggaagattcacacactggctctggccgggtaacgccgcgcgagttggccaccacgagctccccggcatcgccttgacgggcgcctccttcccggagttcccctccgggttccgtgaggctgacgctatcgccttctccagccgccgccggccgccgcacgcggccgaggagggtcaagaaccagcggcgcagtcgcggggagcccaggatcgacagggagtacgacatggtcatcgtgccgtccgacggcggcgggtgcctttccgggtcagagtccgacgactccgactggtccatcggctggctggagccgcaggcgccggagatgcagacggacggtgaccaggagacctccttcgcagttctcgtcccctgctaccgccacggccgcgccgagcagcccgcgatgccccagggacggttccttggcgctggccctctcgccgatggcggcctctctgatggaaagaattttgtagaacagtggctttcttccctccagaactgatatctggaatctccgttagctacgctgtatatattattgctcagtatcattatcgatgaaggaagacatcaaaacccaaaaaaatgagaaaatagaaaaagaacaaaaagaggagcagcggaattttgaagcagcactgaacgggtttgtccttccggaggtttcaaggctaattgtactcattgcaaagcaaggccaatgctgaacaagaccagctgcgctgcgcgtcgtagaagacacattcattcttattaaccaatctacgacaacatttgtagatattatttggtatcgcatcgttcattttgtcccactttgattctggacctcgaccctgctactggcatatgtatatatggtgtcatttgccgtgtatatagaagctgcagatgtgcagctcctcagtgtgcgtgtgtgttgatgtagattggaacaggattgttccttgtgaaattcagatgtatatataagcttttgtgtttttgtggaacaggttcttggctcaagtttctgatt

SEQ ID NO: 1463 - DNA, 1295 bp, Setaria italica
taattttcctgcttactctggtcaaaaagcttcccattggatgtacatgttcaaaaaatcgggtttttaatctgagttatcgtttgttgattcaggtttttggctcggcagatccaagagaacgccgaatttgctcaacttttggcctgatagggaggtccccgagctttttttttcctcgcgagaagcaaggatttttctttttgcgccatgtccatggcgttgagccgcttcacgcaatggctgtggccggggggcgccgcggcgcgggtgtccacccacgagctctcgagcgcggggctgacgagctcctccttcccggacttcccctccggcttccgggagcccgacaccgtcactttctacaccggcggcggcggcggcgcgggcggccgccgcacgcgcccgaggagggtcaggaaccggcgccgcagccgcggggagtcccgggtcgaccgggagtacgacatggtcatcgtgccgtctgacggcggcgggtgcctgtccggctcagactccgacgactccgactggtccatcggctggctcgagccccaggcgccggagctgcagacggacggcgaccccgagaactgcttcgccgtcctcgtcccatgctaccgccacggccgccaagagcagcctgggaggcgcgagggcaggtttctgggcgccggagccctggccgacggtggcctctctggtgagcacggagaagaattttgtagagcagtggctttcttcgctccagaactgatagctcaggcctcccctagctacgtgtaaatactaaatagtatcactccgtttcgttctactaagtttgtctagacgcagaatgtatcgatgaaggaagacatgaaaaaacccccaaaaaaagaagcaaaaccaaaaagaaaacaatgagcagtgggattctgaagcagcaccgaatgggtatgtccttcctgaggttccaaggctattctactcttgcaatgcaaggcgaatgctgaacagtacaagctgtgcgtcattgaaaaaagatttttgccgtcctgatatgtgctgagtgctaacattggattgataacatgtagagatgaactgctattccattggtaaattgtcccacttgcttggggacctcgaattctactgcctgtacatactttcttgtagtgtatatagtcggcgtagagctgcggttgtgtgattcttcgtttgtggtgcgtgtgcgtgttatttcttgtacattggaactgaatcccttatgaatcaatcagtctgctgtatataaatcctgtgaaaatgtg

SEQ ID NO: 1464 - DNA, 1827 bp, Zea mays
ggctcgctccaatccttaacccaatcggttggtggttgcgtcgcgttgtgtcggaggttggagttggagcgtctcgcgtgcgagaggatctgagcggagaaggccatggaggagagtaattagcggttgctgggtcgggaggaggtggtgtggttttgatcgtagtcgcgtttgccggggctcgatttcgatcagaaaactttttttaccggatattcttgggtgggtgtgtttttgggccgcaaattgttatcgccggtgttcggggctcgattttgaagaagaacccaatttattaggggggaaatttcctgcttttgttttcggggcaatggttttggactcccagacgcttcggattagagaatttttgccccaataacgagccattttttcagttgtgctactcgtcaatcaatccagtgattctgaactctgaaagaaagaagaagctttcctaattttcgtgctcactgtgtccaaaagctttccgttggatctacttgtgaatcggttccttttttttttaatctgagatatccttgtcgctttaggttttcgactcggcagatccaagggaacgacgaatttgcctgatttctccgcgatttttggtccgatcgagaggctccaagcctctttttttctcgcgaggagaagcaagggttttccttttttttacgccatgtccatggcgctgagccgcttcacgcaatggctatggccggggagcgccgcggcgccggtggccgcccacgagcaccccaacgaggggctgacgagctcctccttcccggacttcccctccggcttccgggagcccgacaccgtcacgttctacaccggcaggggcgccggcggccgccgcgcgcgcccgaggagggtcaggaaccggcgccgcagccgcggtgagccccgtgtcgaccgggagtacgacatggtcatcgtcccgtccgacggcggtgggtgcctctccggctctgactcggacgactccgactggtccatcggctggctcgagccacaggcaccggagcttcagacggatggcgaccccgagaactgcttcgccgtcctcgtgccctgctaccgccacggccgccaagagcagcagcccgggaggcacgagggcaggtttcttggcgccggcaccctcaccaatggtggattctctgatggaaagaattttgtagagcagtggctttcttctctccagaactaataccgtccgacctgtcctagctaccctgtaaatagtatcactctgttttgttctactacgtttgtcctagtcgcagaatgtatcgatgaaggaagacatggaaaagccctaaaaaaagaaggaaatctaaaaagaaaaatgaggagcagtgggattctgaagcggcaccaaatgggtatgtccttcctgaggtgttcccagatcccaggctattctactcttgcaaagcaatgcgaaagctgaactacacaaactgcacgccatcaaaaatgattttgccgtcctgatatgtgcggagtgctaacctgatgattgataacacgtagagatgaactgctattccattgttaatttgtcccacttgctcgtggacctcgaattctactgcatgtacattctgttcttgcagtgtatatatatatagtcttgcccagagctgcagtggcgtgattgttcagtctgcctgtatatagtgttcttgcagtgtatatagccttgcgcagagctgcagttgcgtgatttagtgtgtggtgcgtgtgtcctattcttgtacatgggaattgtattctgatgaatgaatctatgaatgaatctatctatctgct

SEQ ID NO: 1465 - DNA, 1772 bp, Zea mays
ctagttaccatccattggtgtggacgtgtggtggactggtggttgcgttgcgttgcgttgcttcgagttggaggttggagttggagtgggccgcgtgcgagaggatctgagcggataggccatggagtggagtgattagcggttgctgggtcaggagaaggcggcgtgtgttttgatcctactcgcgtttgaggggccccgatttcgagcgggtgttcaattttggtgccggatttttaaggaggatccaatttaggaagaattttggttttggggacaatggttttggactgcctgatattcgattcataggttggtcaaacgctttggagtagagaatttttttcccggaaaacaagagccatttttctagttgtgctactcgtcaatcaatccatggaagctgaactctggaagaagaaactttcctaattagacccggtatttcgtggttggccgttggcgtctaaagcgcgttttagtttaaatatatgaacacattttcctgtttactccgcccaaaatctttccgctggatctacttgtgaatcgggtttgtttgttttttacctgagctattcttgttgatttaggatttcgagtcggcagatccaagggaacgccgaattttgcctgatttcttcgcaatttttggtccgatcaagaggctcctagccttttttttttcctcgcgagaagcaagggggtctcccttttcttctttcgctatgtccatggctttgagccgcttcacgcaatggctgtggccggggggcgccgcggcgcgggtggacacccacgagcaccccagtggggggctaacgagctcctccttccctgacttcccctccgggttccgggagcccgacaccgtcacgttctacaccggccgccagcgcgcgcgcccgaggagggtcaggaatcgccgccgcagccgcggggaggcccgtgtcgaccgggagtacgacatggtcatcgtcccgtccgacggcggtggctgcctgtctggctccgactccgacgactccgactggtccatcggctggctcgagccacaggcgccggagcttcagacggacggcgaccccgagaactgcttcgccgtcctcgttccgtgttaccgccacggccgccaggagcagcagccacggaggcaggagggcaggtttcttggcgccggcgccctcaccgatggtggtccctctgatggaaagaattttgtagagcagtggctttcttctttccagaactaatatcgtcagacctctcctaagctaccctgtaaatagtatcactctgttttagttctactacgtttgtcctagtcgcacaacgtatcgatgaaggaagacatgaaaaagaaatctaaaaagaaaaagaaaaaaaagaggagcagtagaattttgatttctgaagcagcaccaattggatatgtccttcctgagggtcccaggttattctactcttgccaagcaaggcgaaagctgagctgcacaaactgcgcgccgtcgagaatgattttgccgtcctgatatgtgctgagtgctaacacgtagagatgaactgctattccattgttaatttgtcccatttgcttggcgacctcggattctactgcctgtacagtgttcttgcagtgtatatagtcttgcgcaggactactgcagttgcgcgatttttcagtgtgtgttggtacgtgtgtcgtattcttgtacatggaactgaatttctgatgaatgaatctatctggtgtatataatttttgtgacaat

SEQ ID NO: 1466 - DNA, 1589 bp, Triticum aestivum
gtcactcccagtctcactcaagttcctgctcaccacccaaattatctagcgcgcaccaaaaaatcgcagggcgtcatcaaacatctcgtcaccatacagcggggctggggcgccatgtcgcatcattttcacctgcgcacctcggttcttcccctgtcctccttccccggcgagctcggcgcccggttctcgcccgctaataagcccaggcatccggcgagcagcgtcggcgtcgctgctgcgtcgccgtcgagaaccctgcggcaccacatggcgaaggcggtggcgaaggaggtgggggcgcaggaggcggcgcaaggcagcgcggcgctcgggtgggcggccagggacgcctccggtgtcctctccccgttcgacttctcaagaagggctcaaaaagatgatgatgtgacgatcaaggtgctgtactgcgggatctgccacactgacctctacaccatcaagaacgagtggggcaccgccatgtaccccgttgttcccgggcacgagatcctgggcgtggtgaccagcgtcggcgccggcgtcagcaagttcaaggccggcgacacggtgggcgtgggctacttcgtcgggtcgtgccgctcctgcgagtgctgcggcaacggctacgagaactactgctccggcatggtgctcacctccaacggcatcgaccccgagcacggcggcgcggtcacccaggggggcttctccgacgtcatgctcgtgaacgaggactacgtggtccgcgtcccggacgggctgccgctggacaaggccgcgccgctgctctgcgcgggcgtcacggtgtacagcccgatgatgcgcttcggcctgaacgcgccggggaagcacctgggcgtcgtcggcctcgggggcctcggccacgtcgccgtcaagttcggcaaggcgttcggcatgcgggtcaccgtcatcagcacctcgcccgggaagcgcgaggaggcgctggagcggctgggcgcggacgagttcctggtgagccgggaccccgagcagatgcaggcggccgtgggcaccatggacggcatcctcgacacggtgtcggcgtggcaccccatctcgccgctgttcgcgctgatgaagccgatggggcagatggtgttcgtgggcgggccgaccaagccgctggagctgccggcgtacgccatcgtgccgggcgggaagggcatcgccgggaactgcgtcggcggcatcagggactgccaggccatgctggagttcgcggcgaagcacggcatcaccgccgaggtggaggtgatcaagatggactacgtcaacacggcgctcgagcggctcgccaagaacgacgtccgctaccgcttcgtcatcgacgtcgcgggcagcctcggctcaacatcgtgagctggaatggccaccttgttgatactagctgcgttaattttcttcggcgaatgcgtgcagatttagaccgagcagacatagaacactgtcccacctccagttttttggagttacagcagcaaaaacggtgcactgtttatggatgttcgcatatcaggtttcggaaatttttgactttttcctgaattgctaaattatttttcgca

SEQ ID NO: 1467 - DNA, 1549 bp, Secale cereale
tcaggttcctgctcaccacccaaagtgccaaacgcgcaccgaaaaatctcagggcatcatcaaacattcaaacatcacttcatcatcgtacagctgggctgggggtgtcatgtcgcaacatttccacctgcgcagctcggctcttcccctgtcctccttccccggcgagctcggcgcccggttctcgcccgctaagcccaggcctccggcgagcagcgtcagcgtcgccgctgcgtcgccgtcaagaaccctgcggccccacatggcgaaggcggtggcgaaggaggtgggggcgcaggaggcggcgcaaggcagcgcggcgctcgggtgggcggccagggactcctccggtgtcctttccccgttcgacttcacaagaagggctcaaaaagatgacgatgtgacgatcaaggtgctctactgcgggatctgccacactgacctctacaccatcaagaacgagtggggcaccgccatgtaccccgttgttcccgggcacgagatcctgggcgtggtgaccagcgtcggcagcggcgtcagcaagttcaaggccggcgacacggtgggcgtgggctacttcgtcgggtcgtgccgctcctgcgagtgctgcggcaacggctacgagaactactgctccggcatggtgctcacctccaacggcatcgacccagagcacggcggcgcggtcacccaggggggcttctccgacgtcatgctcgtgaacgaggactacgtggtccgcgtcccggacgggctgccgctggacaaggccgcgccgctgctctgcgccggcgtcacggtgtacagcccgatgatgcgcttcggcctgaacgcgccggggaagcacctgggcgtcgtcggcctcgggggcctcggccacgtggccgtcaagttcggcaaggcgttcggcatgagggtcaccgtcatcagcacctcgcccgggaagcgcgaggaggcgctggagcggctgggcgcggacgagttcctggtgagccgggaccccgagcagatgcaggcggcggtgggcaccatggacggcatcctcgacacggtgtcggcgtggcacccgatctcgccgctgttcgcgctgatgaagccgatggggcagatggtgttcgtgggcgggccgaccaagccgctggagctgccggcgtacgccatcgtgccgggagggaagggcatcgccgggaactgcgtcggcggcatgagggactgccaggccatgctggagttcgcggcgaagcacggcatcaccgcggaggtggaggtgatcaagatggactacgtaaacacggcgctcgagcggctccagaagaacgacgtccgctaccgcttcgtcatcgacgtcgcaggcagcctcggctcaacttcgtgagctggaatggccaccttgttgatataatttctttaattttctacgccgaatgcgtgcagatttagagcttttagtaactgtactcgttgatcactgttgttgatgtaatgatgtgttgtgtggatgtgctctcacatggagcttcgttactgagaaaatcagacatcagttaga

SEQ ID NO: 1468 - DNA, 1724 bp, Hordeum vulgare
cttgcgagcagcacatgcgcagccagctccacaacagtgcagttactctcactcaaattcctgctcaccacgcaaaaatatcaagcgcgcaccgaaaaatcgcagggcgtcatcaaacatctcgtcatcgtacagcgggactggggcgtcatgtcgcaacatttccacctgcgcaactcggtccttcccctgtccttcttccccggcgagctcggcgcccggttctcgcccactgagcccaggcatctgacgagcagcgtccgcgtcgctgttgcgtcgccgtcaagagccctgcggccccacatggcgaaggcggtggcgaaggaggtgggggcgcaggaggcggcgcaaggcagcgcggcgctcgggtgggcggccagagacgcctccggtgtcctctccccgttcgacttctcaagaagggctcagaaggacgacgatgtgacgatcagggtgctctactgcgggatctgccacactgacctctacaccatcaagaacgagtggggcaccgccatgtaccccgtcgtccccgggcacgagatcctgggcgtcgtgaccagcgtcggcagcggcgtcagcaagttcaaggccggcgacacggtgggcgtgggctacttcgtcgggtcgtgccgctcctgcgagtgctgcggcaacgggtacgagaactactgctccggcatggtgctcacctccaacggcatcgaccccgagcacggcggcgcggtcacccaggggggcttctccgacgtcatgctcgtgaacgaggactacgtggtccgcgtcccggacgggctgccgctggacaaggccgcgccgctgctctgcgccggcgtcacggtgtacagcccgatgatgcgcttcggcctgaacgcgccggggaagcacctgggcgtcgtcggcctcgggggcctcggccacgtcgccgtcaagttcggcaaggcgttcggcatgcgggtcaccgtcatcagcacctcgcccgggaagcgcgaggaggcgctggagcggctgggcgcggacgagttcctggtgagccgggaccccgagcagatgcaggcggccgtgggcaccatggacggcatcctcgacacggtgtcggcgtggcacccgatctcgccgctgttcgcgctgatgaagccgatggggcagatggtgttcgtgggagggccgaccaagccgctggagctgccggcgtacgccatcgtgccgggcgggaagggcatcgccgggaactgcgtcggcggcatcagggactgccaggccatgctggaattcgcggcaaagcacggcatcaccgcggaggtggaggtgataaagatggactacgtcaacacggcgctcgagcggctcgcgaagaacgacgtccgctaccgcttcgtcatcgacatcgcgggcagcctcggctcaacctcgtgagctggaatagccaccttgttcattttcttcagggaatttagagctcttagtaactgcgcccagcgcccgttaaaccactgttgtgtcttgtgtggatgtgctctcgcgtggagcttcgtcttcgttatttagttatgggcagcgctagacatcagactactggtgatttgctaactatcagactagttggtagccgtcagatgtgatcagtggtggatgagacatgactgcatgcagcccatccggcgtgatagtttcctaaacagaaaccaatgtacgtacattactcacaattgcatgcagccgta

SEQ ID NO: 1469 - DNA, 1449 bp, Leymus cinereus x Leymus triticoides
  misc_feature (52)..(52): n is a, c, g, or t
  misc_feature (54)..(54): n is a, c, g, or t
  misc_feature (83)..(83): n is a, c, g, or t
  misc_feature (85)..(85): n is a, c, g, or t
  misc_feature (121)..(121): n is a, c, g, or t
  misc_feature (155)..(155): n is a, c, g, or t
  misc_feature (167)..(167): n is a, c, g, or t
  misc_feature (209)..(209): n is a, c, g, or t
  misc_feature (228)..(228): n is a, c, g, or t
  misc_feature (1410)..(1410): n is a, c, g, or t
gcacgaggatcattttcacctacgcagctcggtccttcccctgtccttcttncncggcgagctcggcgcccggttctcgcccncngagcccaggcatctggcgagcagcgtcggcgtcgcngttgcgtcgccgtcaagagccctgcggccccacntggcgaaggcgntggcgaaggaggtgggggcgcaggaggcggcgcaaggcagcncggcgctcgggtgggcggncagggacgcctccggtgtcctctccccgttcgacttctcaagaagggctcaaaaagatgacgatgtgacgatcaaggtgctctactgcgggatctgccacactgacctctacaccatcaagaacgagtggggcaccgccatgtaccccgtcgtccccgggcacgagatcctgggcgtcgtgaccagcgtcggcagcggcgtcagcaagttcaaggccggcgacacggtgggcgtgggctacttcgtggggtcgtgccgctcctgcgagtgctgcggcaacggctacgagaactactgctcgggcatggtgctcacctccaacggcatcgaccccgagcacggcggcgcggtcacccaggggggcttctcggacgtcatgctcgtgaacgaggactacgtggtccgcgtcccggacgggctgccgctggacaaggccgcgccgctgctctgcgccggcgtcacggtgtacagcccgatgatgcgcttcggcctgaacgcgccggggaagcacctgggcgtcgtcggcctcgggggcctcggccacgtcgccgtcaagttcggcaaggcgttcggcatgagggtcaccgtcatcagcacctcgcccgggaagcgcgaggaggcgctggagcggctgggcgcggacgagttcctggtgagccgggaccccgagcagatgcaggcggcggtgggcaccatggacggcatcctcgacacggtgtcggcgtggcacccgatctcgccgctgttcgcgctgatgaagccgatggggcagatggtgttcgtgggcgggccgaccaagccgctggagctgccggcgtacgccatcgtgcctggagggaagggcatcgccgggaactgcgtcggcggcatcagggactgccaggccatgctggagttcgcggcaaagcacggcatcaccgcggaggtggaggtgatcaagatggactacgtcaacacggcgctccagcggctcgagaagaacgacgtccgctaccgcttcgtcatcgacgtcgcaggcagcctcggctcaacctcgtgagctggaatagccaccttgttgatcgttgcgttacttttcttcggcaaatgcgtgcagatttacaagagcttttagtaaccgtacccgttaaatcactgttgtgatgtgttgtgtggatgtgctctcacatggagcttcgttgntgagttatcaatatcaagacaaattgagtttaaaaaaaa

SEQ ID NO: 1470 - DNA, 1492 bp, Avena sativa
caggacagggcgccagggccgggggcgtagtcatgtcgcatcattttcagctgcgcagctcggttcttcccctgcgattcttccccggtgggctcggcgcccgcttctcgcgcactgagcccaggtatcttgggagcagcggcagcagcggagccttcgccgtagcatcgccggcaagaaccctgcagcggcacagggcgacggcgacggcgaaggaggtgggggtgcaggcggagacggcccaaggcagcgcggcggttggttgggcggccagggacgcctccggcgtgctctccccgttcgacttctcgagaagggctcagaaagacgacgatgtgacgatcaaggtgctgtactgcggaatctgccacaccgacctctacaccatcaagaacgagtggggaaccgcaatgtaccccgttgttcctgggcacgagatcctcggcgtcgtgaccagcgtcggcagcggcgtcaccaagttcaaggccggcgagacggtgggcgtgggctacttcctcgggtcctgccgctcctgcgagtgctgcgggaacggatacgagaactactgctccggcatggtgctcacctccaacggcatcgaccgcgagcacggcggcgcggtcacccagggcggcttctccgacgccatcgtcgtcaaccaggactacgtggtgcgcgtgcccgacgggctgccgctggacggggccgcgccgctgctctgcgcgggcgtcacagtgtacagccccatgatgcgcttcggcctcaacgcccccgggaagcacctgggcgtcgtcggcctcggcggcctcggccacgtcgcagtcaagttcggcaaggccttcggcatgaaggtcaccgtcatcagcacgtcgccggggaagcgcgaggaggccctggagcggctcggcgccgacgagttcctcgtcagccgggaccccgagcagatgcagaaggcggtcggcaccatggacggcatcctcgacaccgtgtccgcgtggcatccgatctcgcctctcttcgcgctgatgaagcccatggggcagatgatcttcgtgggcgggccgaccaagccgctggagctgccggcgtacgccatcgtgccgggcgggaagggcatcgccgggaactgcgtcggcggcatcagggactgccaggccatgctggacttcgccaggaagcacggcatcaccgcggaggtggaggtcatcaagatggactacgtcaacacggcgctcgagcggctcgagaagaacgacgtccgctaccgtttcgtcatcgacgtcgccggaagcctcggctcaaccgcataagttagaataaccaattgcttgatggctatgttaattttcttcaccgcatgaatgcagatctagagcttgtagtaacagtagagagtacacgttaaatcactgagaacgatggaaaaaagtgtgctagccggtctgcgtggttttctcgcagtgcttcagatccagcgagatcagtttcccaa

SEQ ID NO: 1471 - DNA, 1448 bp, Pseudoroegneria spicata
  misc_feature (69)..(69): n is a, c, g, or t
  misc_feature (73)..(73): n is a, c, g, or t
  misc_feature (233)..(233): n is a, c, g, or t
  misc_feature (467)..(467): n is a, c, g, or t
  misc_feature (1332)..(1332): n is a, c, g, or t
atcattttcacctacgcagctcggttcttcccctgtccttcttccccggcgagctcggcgcccggttcncgcncgcagagcccaggcatctggcgagcagcgtcggcgtcgctgttgcgtcgccgccaagagccctgcggccccacatggcgaaggcggttgcgaaggaggtgggggcgcaggaggcggcgcaaggcagcgcggcgctcgggtgggcggccagggacgcctcnggtgtcctctccccattcgacttctcaagaagggctcaaaaagatgacgatgtgacgatcaaggtgctctactgcgggatctgccacactgacctctacaccatcaagaacgagtggggcaccgccatgtaccccgttgttcccgggcacgagatcctgggcgtcgtgaccagcgtcggcagcggcgtcagcaagttcaaggccggcgacacggtgggcgtgggctacttcgtngggtcgtgccgctcctgcgagtgctgcggcaacggctacgagaactactgctcgggcatggtgctcacctccaacggcatcgaccccgagcacggcggcgctgtcacccaggggggcttctccgacgtcatgctcgtgaacgaggactacgtggtccgcgtcccggacgagctgccgctggacaaggccgcgccgctgctctgcgccggcgtcacggtgtacagcccgatgatgcgcttcggcctgaacgcgccggggaagcacctgggcgtcgtcggcctcgggggcctcggccacgtcgccgtcaagttcggcaaggcgttcggcatgagggtcaccgtcatcagcacctcgcccgggaagcgcgaggaggcgctggagcggctgggcgcggacgagttcctggtgagccgggaccccgaggagatgcaggcggcggtgggcaccatggacggcatcctcgacacggtgtcggcgtggcaccccatctcgccgctgttcgcgctgatgaagccgatggggcagatggtgttcgtgggcgggccgaccaagccgctggagctgccggcgtacgccatcgtgccgggcgggaagggcatcgccgggaactgcgtcggcggcatcagggactgccaggccatgctggaattcgcggcgaagcacggcatcaccgccgaggtggaggtgatcaagatggactacgttaacacggcgctcgagcggctcgcgaagaacgacgtgcgctaccgcttcgtcatcgacgtcgcaggcagcctcggctcaacatcgtgagctggaatggccaccttgttgatggttgcgttaattttcttcggcgaatgcgtgaagatttagagcttttagnaactgtacccgttaaatcactgttgtgatgtgttgtggatgtgctctcacacggagcttcgttattgagttatcaatagaaaatcaccagacgccaattacgaaggtttgacatca

SEQ ID NO: 1472 - DNA, 1488 bp, Triticum aestivum
tcggcgcccggttctcgcccgctaataagcccaggcatccggcgagcagcgtcggcgtcgctgctgcgtcgccgtcgagaaccctgcggcaccacatggcgaaggcggtggcgaaggaggtgggggcgcaggaggcggcgcaaggcagcgcggcgctcgggtgggcggccagggacgcctccggtgtcctctccccgttcgacttctcaagaagggctcaaaaagatgatgatgtgacgatcaaggtgctgtactgcgggatctgccacactgacctctacaccatcaagaacgagtggggcaccgccatgtaccccgttgttcccgggcacgagatcctgggcgtggtgaccagcgtcggcagcggcgtcagcaagttcaaggccggcgacacggtgggcgtgggctactttgtcgggtcgtgccgctcctgcgagtgctgcggcaacggctacgagaactactgctccggcatggtgctcacctccaacggcatcgaccccgagcacggcggcgcggtcacccaggggggcttctccgacgtcatgctcgtgaacgaggactacgtcgtccgcgtcccggacgggctgccactggacaaggccgcgccgctgctctgcgccggcgtcacggtgtacagcccgatgatgcgcttcggcctgaacgcgccggggaagcacctgggcgtcgtcggcctcgggggcctcggccacgtcgccgtcaagttcggcaggcgttcgcatgagggtcaccgtcatcagcacctcgcccgggaagcgcgaggaggcgctggagcggctgggcgcggacgagttcctggtgagccgggacgccgagcagatgcaggcggcggcgggcaccatggacggcatcctcgacacggtgtcggcgtggcaccccatctcgccgctgttcgcgctgatgaagccgatggggcagatggtgttcgtgggcgggccgaccaagccgctggagctgccggcgtacgccatcgtgccgggagggaagggcatcgccgggaactgcgtcggcggcatgagggactgccaggccatgttggaattcgcggcaaagcacggcatcaccgcggaggtggaggtgatcaagatggactacgtcaacacggcgctcgagcggctcgccaagaacgacgtccgctaccgcttcgtcatcgacgtcgcaggcagcctcggctcaacctcgtgagctggaatagccaccttgttgatggttgcgttaatttgcttcggcgaatgcgtgcagatttagagcttttagtaaccgtacccgttaaatcaccgttgtgatgtgttgtgtggattcgctctcacatgaagcttcgttgtgatttatgaaggtgtgacatcaggacatcagcaaatattgtataccgagcagacatagaacactgtcccgcctccagttttttggagttgcagcagcaaaaacggtgcactgtttatggatgttcgcatatcaaaaaaaaaa

SEQ ID NO: 1473 - DNA, 830 bp, Secale cereale
tgggggcagaaaagaaaaggcgagaaagaaggaagcaacgaaaccgaggggattccgcggagtaggtggaggcgagggtttggtgcgcggccatggagaacctggcgatgctgtgggggatcatcgggccgggcgtcgccggcgcgctcttcggcgccggctggtggttctgggtcgacgccgtcgtctgcagcgccgtccaggtctccttcatccactacctgcccgggatcttcgcgtcgctggccgcgctcatgttcaattgcgtcgacaaggatgccatcgggaacgactactactcgtcctacggggatgattccgagtggagggtgaagctttggcttttcgtcgcctacgtcgtctctttcgtctgcctggctggatcggtgggtttgttggtgcaagacgccctgacagacaagggcccttcggtgtggactggtgttgccggcgttctgcaatgcgttttcgtgttgataagcgggttgacatactggacgtgccacaccgaggattaagagggtcaaaaatctcgcaaagacgtcatagtctatacccgtgtgtggtcctgtgtaaaaaatatgttcattccagggcgggattacttggtgtccgtgtgtgcatagctgaccgcttcctgaaatggatccgtagcatcagtactacgtgcgtacgtacgtgactttatcctaatttgttgtgagcatcagtattacttggtgtccgtgtggtgcttggtggctcgagagggtagcattgagattggatcacgagctgcctgcagcaaatcgttattactgtcgaaacctccatgtgaaaattcagttgac

SEQ ID NO: 1474 - DNA, 942 bp, Secale cereale
ggaaatcggcagaaaagaaaaggcgagaaggaaggaagcaacgaaaccgaggggattccgcggagtaggtggaggcgagggtttggtgcgcggccatggagaacctggcgatgctgtgggggatcatcgggccgggcgtcgccggcgcgctcttcggcgccggctggtggttctgggtcgacgccgtcgtctgcagcgccgtccaggtctccttcatccactacctgcccgggatcttcgcgtcgctggccgcgctcatgttcaattgcgtcgacaaggatgccatcgggaacgactactactcgtcctacggggatgattccgagtggagggtgaagctttggcttttcgtcgcctacgtcgtctctttcgtctgcctggctggatcagtgggtttgttggtgcaagacgccctgacagacaagggcccttctgtgtggactggtgttgctggtgttctgcaatgcgttttcgtgttgataagcgggttgacatactggacgtgccacaccgaggattaagagggtcgaaaatctcgcgaagacgtctagtctatacccgtgtgtggtcctgtgtaaaaaatatgttcattccagggcgggattacttggtgtccgtgtgtgcatagctgaccgcttcctgaaatggatccgtagcatcagtacgtacgtacgtgtttatcctaatttgttgtgagcttgtggtgcttggtggctcgagagggtagcattgagattggatcacgagctgcctgcagcaaatcgttattactgtcgaaacctccatgtgaaaattcagttgactccattaaagctgctgatgggcggttgctcgcagattcttattttttcttggtgatcgcaagacagtagtagaccggcataatgtcactgggtattttttttcgggtaatgcatcgctccttaaatccaaaaaaaaaaa

SEQ ID NO: 1475 - DNA, 743 bp, Secale cereale
agcaacgaaaccggggggattccgcggagtaggtggaggcgagggtttggtgcgcggccatggagaacctggcgatgctgtgggggatcatcgggccgggcgtggccggcgcgctcttcggcgccggctggtggttctgggtcgacgccgtcgtctgcagcgccgtccaggtctccttcatccactacctgcccgggatctttgcgtcgctggccgcgctcatgttcaattgcgtcgacaaggatgccatcgggaacgactactactcgtcctacggggatgattccgagtggagggtgaagctttggcttttcgtcgcctacgtcgtttcattcgtctgcctggctggatcggtgggtttgttggtgcaagacgccttgacagacaagggcccttcggtgtggactggtgttgccggcgttctgcaatgcgttttcgtgttgataagcgggttgacatactggacgtgccacaccgaggattaagagggtcaaaaatctcgcaaagacgtcatagtctatacccgtgtgtggtcctgtgtaaaaaatatgttcattccagggcgggattacttggtgtccgtgtgtgcatagctgaccgcttcctgaaatggatccgtagcatcaggtactacgtgcgtacgtacgtgtttatcctaatttgttgtgagcttgtggtgcttggtggctcgagagggtagcattgagattggatcacgagctgcctgcagcaaatcgttatta

SEQ ID NO: 1476 - DNA, 850 bp, Triticum aestivum
aggaaggaagcaacgaagcgaggggattccgcggagttggtggaggcgagggtttggtgcggccatggagaacctggcgatgctgtgggggatcatcgggccgggcgtcgccggcgcgctcttcggcgccggctggtggttctgggtcgacgccgtcgtctgcagcgccgtccaggtctccttcatccactacctgcccgggatcttcgcgtcgctggccgcgctcatgttcaattgcgtcgacaaggatgccatcgggaacgactactactcgtcctacggggatgattccgagtggagggtgaagctttggcttttcgtcgcctacgtcgtttctttcgtctgcctggctggatcagtgggtttgttggtgcaagacgccctgacagacaagggcccttctgtgtggactggtgttgccggcgttctgcaatgcgtttttgtgttgataagcgggttgacatactggacgtgccacaccgaggattaagggtcaaaaatctcgcgaagacagacgtctagtctatacccgtgtgtggtcctgtgtaaaaaaatatgttcattccagggcgggattacttggtgtccgtgtgtgcatagctgaccgcttcctgaaatggacccctagcatcagtactacgtacctacgtgcgtgtttatcctaatttgttgtgagcttgtggtgcttggtggctcgagaggctagcattgagattggatcacgagctgcctgcagcaagtcgttattactgtcgaacctccatatgaaaattcagttgactccattcattaaagctgctgatgggcggctgctcgcagattcttgtttcttggtgatcgcaagacagta

SEQ ID NO: 1477 - DNA, 807 bp, Avena sativa
gcgagaggaagcaacgaaccgaggagattccgcggaaggaaggtgggttgttggaggagggtttgctctgccgcggccatggagaacctggcgatgctttgggcgatcatcgggccgggcgtcgccggcgcgctcttcggcgccggctggtggttctgggtcgacgccgtcgtctgcagcgccgtccaggtctccttcatccactacctgcccgggatcttcgcgtcgctggccgcgctcatgttcaattgcgtcaacaagaatgacatcggcaacgactactactcgtcctatggggatgataacgagtggaggctgaagctttggctttttattgcatacgttgtttctttcgtctgcctagctgcgtcagtgggtctgctggtgcaagatgccttgacagagaagggcccttctgtgtggaccggcgttgctggcgttctgcagtgtgtgttcgtgttgataagcgggttgacttactggacgtgccactcttctgacgattaagggggtcaaagatgtttctgagcagacttggaaggttggtcaaaatctgtgtggattaagggtgaacgtgttgggaaggttggccaaatctcgtgaagaagtctttgtctaccggtgtgtgtggtcttgtgtaaattatgttgattttcgcggcggggagactgggtgtttaatgtgtgaataactgactgcttcctgaaatgatccgtagtagcatcagtactccgtgtttatcctaacttttctgttgtgttgcctcgagcgagttcagaacatactataaattggatcacgagctgc

SEQ ID NO: 1478 - DNA, 885 bp, Setaria italica
ttggaaaaataattcggcagaaaaacggaggagagagcaagcaaggaagattgcttggtgggaggagttggtgaggagaggtcgcggccatggagaaccttgcgctgctgtgggggatcatcgggccaggcgtggccggggccatcttcggggctggatggtggttctgggtggacgccgtcgtctgcagcgccgtctcggtctccttcctccactacctcccagggatcttcgcgtcgctggcggcgctcatgttcaactgcgtgaacaaggatgagatcggatacgattattactcgccatatggggacgattcagagtggagagtgaagctctggctttttgttgcatacgtcgtttcttttgtctgtctagctggatctgttggtttattggtgcaagatgcgctgacagacaagggcccgtctgtctggactggtgttgctggtgttctgcaatgcgttctcgtgttgataagtgggttgacatattggacatgccactctgaagattaagcgtgtaatgttctgagcgaatggtttgcaaggttggcaatcgcttgaagaaaattatttctggcaacttatggtcgtgtgtgatgggaaaacgtgcctactgtatagtggaacggctatatgtttcatttgtgcatatctgactgtttttcggaaacgatgcttaacaccacttcacgttttttcttccaacctgtgatgcgtcaagatcatgcatattaattatcctgagggtaaaactgaaactgacagtgaattggtcccagtgtcgcaactgacagtctcctgcaggctgcactaagttactgcctgacgcctcctagtcagttccggttgacttcatttaatccagatgccgtgtcatcgttac

SEQ ID NO: 1479 - DNA, 874 bp, Zea mays
ttagaaaagaataatttctcccgaaaaagggtgaagagcagaacgacgaggagattgcttggtgggaggagttggtgaggagaggtcgcgaacatggagaaccttgctctgctttggggcatcatcggcccgggcgtgtccggcgccatcttcggggccggatggtggttctgggtggacgcggtcgtttgcagcgcggtccaggtctccttcctccactaccttccagggatcttcgcttcgctggcggcgctcatgttcaattgcgtgaacaaggatgagatcggatacgactattactcaccctacggggacgattcagagtggagagtgaagctctggctttttgtggcatatgtcgtttcttttgtctgtttagctggatccgtgggtttattggtgcaagatgcgctgacgaacaagggcccttctgtctggactggtgttgctggcgttctgcaatgtgttcttgtgttgataagcggcctggtgtattggacatgccactcagaagattaagggcgtaatgtcatgagcagacttgcaaggttggtcacagttgtgtgaaggaaattatttctggcaacatatgattttgtgtgatggaaatgacggacactgttcactgctgagtgggatgactagatgtttcatctgtgcatatctgacttttggaaaatgatgtttcttaacaccggtgcatgtgttagccccagcttcttgtgagttgccaatctgtgatgcggtcgtgatcatgcaaatcttttggctaaagctgaaaccggctgcagcaacaagctagtgctactatttacaccatgcctcctagtcaattacagttgacttcatttaagtcgagacgctgtctcggcct

SEQ ID NO: 1480 - DNA, 874 bp, Pennisetum glaucum
ggaaaaaataatttggcagaaaaacggagaagagcaagcaaggagattgcttggtgggaggagttggtgaggagagagaggtcgcggccatggagaaccttgcgttgctgtgggggatcatcgggccaggcgtggccggggccgtcttcggggctggttggtggttctgggtggacgccgtcgtctgcagcggcgtctcggtctccttcctccactacctcccagggatcttcgcgtcgctggcggcgctcatgttcaactgcgtgaacaaggatgagatcggatacgattattactcgccctacggggacgattcagagtggagagtgaagctctggctttttgttgcatatgttgtttcttttgtctgcctagctggatctgtaggtttattggtgcaagacgcgctgactgacaagggcccatctgtttggactggcgttgctggtgttctgcagtgtgttcttgtattgataagtgggttgatatattggacatgccactctgaagattaagcacataatgttctgagcagatggtttccaatgttggtggtaatcgtttaaaggaaattatttatggcagcgtgtggttctgtgtgatgggagatcatgcctactgtagagtggaacgtctatatgttttgtctgtgcatatctgactgtttttccggaaacgatgcttaacaccacttcacgatttttttttccaacctgtgatgcgtcatgatcatgcatagtacatatccatttatcctgatggggcgacagtaaaactgaaactgatagtgaattgacagtctcatgcaggctgttgtaagttactcctgcctgacgcctcctacatttaatctagatgccgtgtcatcgttacc

SEQ ID NO: 1481 - DNA, 914 bp, Sorghum bicolor
ggaaaaagaagctcggcgaagggagaagggcggaacgacccgacgaggagattgcttggtgggaggagttggtgaggagaggtcgcggccatggagaaccttgctctgctttgggggatcatcggcccgggcgtgtccggcgccatcttcggggcgggatggtggttctgggtggacgcggtcgtttgcagcgccgtccaggtctccttcctccactaccttccagggatcttcgcttcgctggcggcgctcatgttcaattgcgtgaacaaggatgagatcggatacgactattactcgccctacggtgacgattccgagtggagagtgaagctctggcttttcgtggcatatgtcgtttcttttgtctgcctagctggatctgtgggtttactggtgcaagacgcactgaccaacaagggcccttctgtctggactggtgttgctggcgttctgcaatgtgttctcgtgttgataagcggactggtgtattggacatgccattcagaagattaaagggcttaatgtcatgcgcaggcttgcaaagttggtcacaatcgcgtgaagaaaattatttctggtagcatatgattttgtgtgatggaaatggcgtgcactgttcactgctgaatgggatgactagacgttccatctgtgtatatctgacttttgaaaaatgattaaatgatgcttcttaacaccgttgcacgtttttaccccagcttcttgcgagttgtgaatctgtgatgcaatcatgatcatgcaaatcttgtggttaaaactgaaactggcaatgaatacagctcgatatcgcaattgatgaacctgcagcatagtttttgttttcatgtatatttaatgcatcatgtatgtgccgcaagattcgatgtgatggagaattttgtaaatttttg

SEQ ID NO: 1482 - DNA, 721 bp, Saccharum officinarum
aaaaaacaattcggcgaagaagggagaagggcggaacgacccgacgaggagattgcttggtgggaggagttggtgaggagaggtcgcgaccatggagaaccttgctctgctttgggggatcatcggtccgggcgtgtccggcgccatcttcggggctggatggtggttctgggtggacgcggtcgtttgcagcgccgtccaggtctccttcctccactaccttccagggatcttcgcttcgctggcggcgctcatgttcaattgcgtgaacaaggatgagatcggatacgactattactcgccctacggggacgattccgagtggagagtgaagctctggctttttgtggcatatgtcgtttcttttgtctgcctagctggatctgtgggtttattggtgcaagacgctctgacgaacaagggcccttctgtctggactggtgttgctggcgttctgcaatgtgttcttgtgttgataagcggactggtgtattggacatgccactcagaagattaaagggcgtaatgtcatgtgcaggcttgcaaggttggtcttggtcacaatcgtgtgaagaaaattatttctggcagcatatgattttgtgtgatggaaatgtcgtgcactgttcactgctaaatgggatgactagacatttcatctgtgcatatctgactgttttgaaaaatgatgcttcttaacaccggtgcacgtttttgcccc

SEQ ID NO: 1483 - DNA, 1341 bp, Panicum virgatum
cccagggaattccgagttgggctctcattgggctgaaaattttgatcccagtcacatctcggcccggaacaaaaaaaaactccaggctccacttggaaaaaataattcggcagaaaaacggggaaaggagcaagcaaggagattgcttggtgggaggagttggtgaggagaggtcgcggccatggagaaccttgcgctgctgtgggggatcatcgggccaggcgtggccggggccgtcttcggggctggatggtggttctgggtggacgccgtcgtctgcagtgccgtcccggtctccttcctccactaccttccagggatcttcgcgtcgctggcggcgctcatgttcaactgcgtgaacaaggatgagatcggatacgactattactcgccctacggggacgattccgagtggagagtgaagctctggctttttgttgcatatgttgtttcttttgtctgcctagctggatctgttggtttgttggtgcaagatgcgctgacagacaagggcccatctgtctggactggtgttgctggtgttctgcaatgcgttctcgtgttgataagcgggttgatatattggacatgccactatgaagattaagcgcggaaagttccgagcagatggtttgcaagcaaggctggtcataatcgtgtgaaggaaattatttctggcagcgtatggttctgtgtgatgggaaaccatgcctactgtagagtgggacgggtagatgtttcgtttgtgcatatcttgactgtttatcggaaatgatgcttaacaccagtgcacgtttttcttccaacctgtgatgcgtcctgatcatgcatgtcaagagggtaaaactgaaactgacagttaattggcccagcgtcgcaattgacagtgaattgctgcagtaagttagtattaaatccagatgcccagtgtcgcaattgacagtaaattgctgcagtaactactacgtgacgctgacgcctcctggtcagttccggttgacttcattaaatccagatgccgtgtcatcgttactgctgctgattggtatagtgtcttggtggtaccgaagctgatgtccagctatgacagtcagtgttgtttatgccgaagggctgcgtttccttgtattttttttattttataatccggagacacattgctgaactgccggtacccggctttttctcgtatgttttgctgaagacggcgtagggcccacctgccggctgggcacgatcgcaaccgtgttgtgttgtgtcgatcgagagcatctgaatcccgttacgttcagctcgatagcaatgtgggagtagtataaaaagtttatatggccgcctccg

SEQ ID NO: 1484 - DNA, 1007 bp, Panicum virgatum
gagttggtgaggagaggtcgcggccatggagaaccttgcgctgctgtgggggatcatcgggccaggcgtggccggggccgtcttcggggctggatggtggttctgggtggacgccgtcgtctgcagcgccgtcccggtctccttcctccactaccttccagggatcttcgcgtcgctggcggcgctcatgttcaactgcgtgaacaaggatgagatcggatacgactattactcgccctacggggacgattccgagtggagagtgaagctctggctttttgttgcatatgttgtttcttttgtctgcctagctggatctgttggtttgttggtgcaagatgcgctgacagacaagggcccatctgtctggactggtgttgctggtgttctgcaatgcgttctcgtgttgataagcgggttgatatattggacatgccactatgaagattaagcgcggaaagttccgagcagatggtttgcaagcaaggctggtcataatcgtgtgaaggaaattatttctggcagcgtatggttctgtgtgatgggaaaccatgcctactgtagagtgggacgggtagatgtttcgtttgtgcatatcttgactgtttatcggaaatgatgcttaacaccagtgcacgtttttcttccaacctgtgatgcgtcctgatcatgcatgtcaagagggtaaaactgaaactgacagttaattggcccagcgtcgcaattgacagtgaattgctgcagtaagttagtattaaatccagatgcccagtgtcgcaattgacagtaaattgctgcagtaactactacgtgacgctgacgcctcctggtcagttccggttgacttcattaaatccagatgccgtgtcatcgttactgctgctgattggtatagtgtcttggtggtaccgaagctgatgtccagctatgacagtcagtgttgtttatgccgaagggctgcgtttccttgtattttttttattttataatccggagacacattgctg

SEQ ID NO: 1485 - DNA, 1046 bp, Panicum virgatum
aataatctaaaaagaaagagaggaaatagtgggccgggagatccgattcgtgctagtgtggtttcgtgctggcgacggagcctattctatctgggcctggagagccgatttcagcccaaacaacgaagcggcgcgcccacccttcagccgacaaaactgcgagctgtcgctgcacactccaggctccactaggaaaaaataattcggcagaaaaacggggaaaggagcaagcaagcagattgcttggtgggaggagttggtgatttggtgaggagaggtcgcggccatggagaaccttgcgctgctgtgggggatcatcgggccaggcgtggccggggccgtcttcggggctggatggtggttctgggtcgacgccgtcgtctgcagcgccgtctcggtctccttccttcactaccttccagggatcttcgcgtcgctggcggcgctcatgttcaactgcgtgaacaaggatgagatcggatacgactattactcgccctacggggacgattccgagtggagagtgaagctctggctttttgttgcatatgttgtttcttttgtctgcctagctggatctgttggtttattggtgcaagatgcgctgacagacaagggcccatctgtctggactggtgttgctggtgttctgcaatgcgttctcgtgttgataagcgggttgatatattggacgtgccactatgaagattaagcgcttaaagttctgagcagatgatttgcaagcagggctggttataatcgtgcgaagaaaattatttctggcagcgtatggttcagtgtgatgggaaatcatgcctactgtagagtgggacgggtagatgtttcgtttgtgcatatcttgactgtttatcggaaatgatgcttaacaccagtgcacgtttttcttccaacctgtgatgcgtcctgatcatgcatgtcaaggtggggtaaaactgaaactgacagtaaatttggcccagtgtcgcaattgacagtgaattgctgcagtaagttactatacttttttttatcaaacataactgtcg

SEQ ID NO: 1486 - DNA, 799 bp, Panicum virgatum
ataaataagcggaggagcaagcaagcagattgcttggtgggaggagttggtgatttggtgaggagaggtcgcggccatggagaaccttgcgctgctgtgggggatcatcgggccaggcgtggccggggccgtcttcggggctggatggtggttctgggtcgacgccgtcgtctgcagcgccgtctcggtctccttccttcactaccttccagggatcttcgcgtcgctggcggcgctcatgttcaactgcgtgaacaaggatgagatcggatacgactattactcgccctacggggacgattccgagtggagagtgaagctctggctttttgttgcatatgttgtttcttttgtctgcctagctggatctgttggtttattggtgcaagatgcgctgacagacaagggcccatctgtctggactggtgttgctggtgttctgcaatgcgttctcgtgttgataagcgggttgatatattggacgtgccactatgaagattaagcgcttaaagttctgagcagatgatttgcaagcagggctggttataatcgtgcgaagaaaattatttctggcagcgtatggttcagtgtgatgggaaatcatgcctactgtagagtgggacgggtagatgtttcgtttgtgcatatcttgactgtttatcggaaatgatgcttaacaccagtgcacgtttttcttccaacctgtgatgcgtcctgatcatgcatgtcaaggtggggtaaaactgaaactgacagtaaatttggcccagtgtcgcaattgacagtgaattgctgcagt

SEQ ID NO: 1487 - DNA, 862 bp, Festuca arundinacea
  misc_feature (385)..(385): n is a, c, g, or t
  misc_feature (400)..(400): n is a, c, g, or t
ggcacgagggttggtaggaggagggtttgctgtgccgcggccatggagaacctggcgatgctgtgggggatcatcgggccgggcgtggccggcgcgctcttcggcgccggctggtggttctgggtcgacgccgtcgtctgcagcgccgtcaaggtctccttcatccactacctgcccgggatcttcgcgtcggtgtccgcgctcatgttcaattgcgtcagcaaggaggacctcgggggcgactactactcggcctatgggcggggatgataacgagtggagggcgaagctttggcttttcgttgcatatgttgtttctttcgtctgcctggctgcatcggtgggtttgttggtgcaagatgccttgactgacaagggcccttcngtgtggactggtgtngctggcgttctgcagtgtgttttcgttttgataagtggcttgacttactggacgtgccactcttctgacgattaagcggtcaaatatgttctgagaagacttggatggttggtccaaatctatgtgggttaagggttaaaatgttccgagcagacttggaaggtcgttcaacatctcgcgaagacgtcttgtctaccagtgtgtggttctgtgtaaattatgtgtccacttcgtggcggggaaactggttgcttactgtgtgaataactgactgcttcctgaaatgatccgtagcatcagtacgcgacgtgtttatcctaatttgttgtgaactcctgctgcttgccttgaggttagaatttactataagttggatcacgagctgcatgcagcaaatcgttattgtcaaacctctttagtactggaattcagttgactcaattgttaaagcagatgggcggt

SEQ ID NO: 1488 - DNA, 703 bp, Cenchrus ciliaris
  misc_feature (355)..(355): n is a, c, g, or t
  misc_feature (653)..(653): n is a, c, g, or t
  misc_feature (658)..(658): n is a, c, g, or t
  misc_feature (692)..(692): n is a, c, g, or t
  misc_feature (699)..(699): n is a, c, g, or t
ggtgaggagaggtcgcggccatggagaaccttgcgctgctgtgggggatcctcgggccaggcgtggccggggccgtcttcggagctggatggtggttctgggtggacgccgtcgtctgcagcgccgtctcggtctccttcctccactatctcccagggatcttcgcgtcgctggcggcgctcatgttcaactgcgtgaacaaggatgagatcggatacgattattactcgccctatggggacgattcagagtggagagttaagctctggctttttgttgcatacgtcgtttcttttgtctgtctagctggatctgtcggtttattggtgcaagatgcgctgacagacaagggccnatctgtctggactggcgttgctggtgttctgcaatgtgttctcgtgttgataagtggattgatatattggacatgccactctgaagattaagcgcataatgttctgagcagatggttttcaaggtcggtcgtaatcgattaaagaaaattacatatggcagcgtgtggttctgtgtgatgggaaatcttgcatactgtagagtggaacgtcaatatgtttcatctgtgcatatctgactctttttcggaaaccatgcttaacatcatttcacgtttttttgcttccaacatgtgatgngacangatcatgcatatatccattatcctgacggggtgncggtaanctga

SEQ ID NO: 1489 - DNA, 3180 bp, Oryza sativa
acttcccaccacctcctctccttccctcgctctgctctctccatgcccaggcccgcctcgcctcctcacgcgagccaccgctgtcgccgcaccatcatactgtcgtcgccatcctcctctcgctccggtcgatgcatccgccaacgaggaggccgggaccgtcggatccggtgaccccggcctcattgtcggtggatccggccgcccggaggcgaggggagaccggctatcaccctctctactcttctccttctacgtccggcaccgctacaacgacggccgcgcggatcgcgtgaggcaacgggtggctgctcccttctcttctcccttctatctccactattcctttgcagatcggcggaggcctgcaacaacaacggccgcgcgggcgagcaatcgaggaggccgggaatcaccagatccggaaggacggcggcccgattcggagagggagcaacccgatctgtgtcattgaggctcattgtaagtgtcgacggcggccgttccttcacagtgatccagggtcgttgggtctgttgagctcggtatcgacggcagcagtagctcgggcaagatggaagaaacgtgttagacacggcctcctccgagagcatacaccagcgacgtgcaggaggccgaggccaaagccgatcttccccaaccccatctggcattataacttgtaagtttttgttctttttggtgttcttggtagaccgatgaaaatggtgatggtctatcgtgcaaattgatgaaggtagggatgatatgatgtgtatattgagtatgaatgcatatgcacttttgcgtgtgtagatgtaatacatgttcttgagcactttacaggttttgtggtggtgtttattactgactgacaaaaatctgagatgcatgttcagttatttacagtgatacacatgaatgcggatagatagaatgctattgtttttctcttctatgagacctcttaagtactaatctattgaattgtttgatactatatcatatttcatatgtattcatctattttgattcaaagatatacgagatcccaacaacgcatccactatcgaccaggtacaaaagcttgatttgttgaatgcttgcttccagcaatgtatcatgctctctatttccattggtgatgtgtagggattgggagcagattcattcgcaggtcagcaagctagctgaaaatttggtgagaggcgacagttggtagcgagaaggtcagcctgatggtgcagaactctggcttgaggaagacatgcttcagtgtttctccatgcaccgacaacactatcatcctgccaccacaacacacaaatctggcgatgcttccacctgcatctgcatgcccctggctccctgcatacaagaaaaaagagtattcttttcctgtctcggtaatgcacttggctaagaaagttggtgggcagtaagctgctcatgcttcttgatcaccaagttgctcatgctccttgatcagaacataaatggttaattaaagatgcacatgagaaaggctcgattatgcctggtgttatggtgctgaattgctgatcaaaaaaaccggtggtaatgttgtaccgttttggtattggttgatatttcacaaaggttgcaggcctcttgctattgacagatgagtgagcaaacatggatggtgatggtattctgacatctcaatgtgaaccagtcaaccagtacagagttgatcgctaatccatgtcatggactctaaaagcaaatggtaagcttggtgtgatgcttgctttggtagatggagctgagttcttcagtaatagatgtgttcatggccttcaggattttatggcaggaaagctcccataagcttcttgggaggtgcctacttgaatgactgggagaaccatctaacaacaatatttcattaggttagactgcagcagtaatgaaaggtgctgatgatggatcatttaggatattgtgtgctttgccagcgtttcaggtccggatgcggcatccacgtgggcaggccgttaccatgaagatcatgccatcggattagttgtccatgtgcatagatcaaagaaaaaaagaagaagcatctcttgcgtcgtctcgactcgagaaatcgagagaagacaccccaaaaaaaaatcggagaaaaaggcgacaaggaagccgaggggattgcttcgtcgacgaggagggagttggtggtggaggagaggtcgccgccatggagaatcttgcgctgctttgggggatcatcgggccgggagtcgccggtgcggtcttcggcgccgggtggtggttctgggtcgacgccgtcgtctgcagctccgtccaggtctccttcctccactacctacccgggatattcgcgtcgctggccgcgctcatgttcaacgccgtgaacaaggatgagatcggatacgactattactcgccctacggggacgattccgagtggagggtgaagctttggctttttgtggcgtatgttgtctctttcgtctgcctagctggatcagtgggtatgttggtgcaagatgccttgacagacaaaggcccttctgtgtggactggtgttgctggtgttctgcaatgtgttcttgtattgataagtgggttgatatattggacgtgtcactctgaggactaagggccagaatgttgcaagacttccgagggtgaaaggtcgtggtgataatgctccgaagaaatcttttctgccagtgtcaatgtgattttgtgtacaaaaaatatgctcatttcgtgttgggaagacgggatgtccatttgtgcataactgattactttctgaaatgatccttaacattggtacgtgtttgtcatattttcttctgaagttttggtttctgaatcttctgatgctctatcttgaggttagatctgaaactgaattactatgagctaagaaactgccacagtgccgtggatggtgctccctaacaagttattaccacctcgcctagggcgtgacaaatttcaattgactccaactgcagatgcggctgccgctgattctatcaaggtgcttgtaatcagtaccaaaaataacttcttggtgggtttcttttggggattgcaatagtgcatcagttgattgtactaatctttacatctctatctttattataaaaagcccatggttcccctttggttaagggg

SEQ ID NO: 1490 - DNA, 1811 bp, Eragrostis curvula
  misc_feature (432)..(432): n is a, c, g, or t
ggggcctctcccttgtgtgaaaaaaagggagagcaacgagattgcttgggtgggaggagttggtgaggacggagaggtcgcgaccatggagaacctggctcttctgtgggggatcatcgggccgggcgtggccggcgcggttttcggcgccggctggtggttctgggtggacgccatcgtctgcagcgcagtccaggtctccttcctccactaccttcctgggatcttcgcgtcgctggcggcactcatgttcaacgcggtgagcaaggatgagatcggatacgactattactcgccctacggggacgattccgagtggagagcgaaactttggctgttcgtggcctatgttgtttcatttgtctgcctagctggatctgttggtttgttggttcaagatgccctgacagacaagggtccgtctgtttggantggtgttgctggtgttctgcaatgcgttcttgtgttaataagtgggttaatatattggacgtgccactctgaggaatattaaagatcaaaaacacaaaatgttctggcagatgtgcaaggttggtctcagtcttgtggggggaaattatttgaccattgtatgttcttgtgtgaacaaaaatcatgcccgctgtagtgtggaccagatcggatgtttcatctgtgcatatctatctgctgtctgaatgatgcttaacgctagcgctgtccccaaatcttgagatgcatcttgcatatcttctagttaaactgaaactgacgatcaattgtcagcttgaaagttgcatgttgcaattgacggtcttctgccgttgtgtcgtctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaattttttctgttttaacccccgtgttaaaaaaattccccgcgccccccgggggggggggaaaattgaaactccagccccatttcccctaaaatggaaaaaaaaaaaaaaccgggggcggtttttaaaaaaatgtggtttggtttgttgtttattatatatataatttcccaaattgtctttttaacctgtagtttaaacataatgaaaaaaatatccctttataccatctgatatactttttggaatcttattccttaaacaggttgttcaaaaataaaaacaaaatatatatttgttacttgctatataaaaattcaaataaataaagaacataaatctttgatataatataactttataaccaaatttcctacttaccatatattgtaataagaaattcttaaattcctgcagcctctctttcattattagacacatattttttatagcaactccttattagacaaaacaaaagcaacgtattcaaaatgaataattcttaacatttacctaaaccagaaagaaaacatcacaacaaaattcccaaccatatctaataggatacattatatcacacattatatcaaatactcgttcttaaacttactcttcttctcatctcctctccacatatagatattttaaggactataaaacagacagaggttctataacgttgcaaatttgtatataattcaacattctataatttcattaaaaagaaataatgcaacctttaattctcaatattttactatacgattaagcctaaatttatttcataattaggctgtctttataactttgattcaatcctataacacagaaatcacattttgcatttaatcatctccattctaatctaattcaccactctttaagcctatttcaagtattggcttg

SEQ ID NO: 1491 - DNA, 539 bp, Allium cepa
attagaacataatttagcacagcgagtaaatcaaaggcagaatcccaaatggaccacaattgcggtctgatgtgggaaataatgggcccaggcgtcgccggagcagtcttcggcgccggttggtggttctgggttgatgccgtcgtctgcagctccgttaaagtctcatttctccattatttgccagggatttttgcttcgctggctgctctgatgttcaattgcgtgaataaagaggatatcagttatgattactctccttacggcgattctgagtggaggataaagctgtggcttttcatagcatatgtggtgtcatttgtgtcccttgctgggtcagtaggcttgcttgtacaagatgcactcaccgataaaggcccctctgcctggactggcgttgctggtattcttcagtgtgtctttgttctcatcagtggtctcatgtactggacttgccattctgaagagtaagacagaagtcatggtttggcggtctagcttttgtataaacttgtgcttttgtataaacttgtgtgcta

SEQ ID NO: 1492 - DNA, 650 bp, Elaeis guineensis
agcgagcgaggccatggacaacctgtcgctgatgtgggagatcatgggacccggcatcgccggcgccgtgttcggggccggctggtggttttgggtcgacgccgtcgtctgcagcgccgtcaaggtctccttcctccattacctccctggaatcttcgcgtctctggcggctctcatgttcaattgcgtcaacagagacgatgtcagctacgattactactctccctatggggacagcgaatggaggttgaagctctggctctttgttgcatatgttgtgtcctttgtctctcttgctgcagcggtaggtttgctaatacaagacgccctcacagacaagggcccttctgtgtggacaggggttgctggtgtccttcaatgtgtgtttgtcttgatcagtgggctgatctactggacgtgccattcagaagattgagataaaatcttttccacatttgaagtggacatgtaaagataaagcgaccgtggacttggtcactgacaaataaaaacagaaaaagaaagagccaagaaaaaagggaaaagaaaagaaccttgtgtagttttatcattttgtatgtcaatagcattctgtaaatgaaggagatgctgcgatgctcacatgggtctcgaattaatcgttatgcttc

SEQ ID NO: 1493 - DNA, 744 bp, Musa acuminata
cgcgtctttgccaaagctgatagccggcggaagacgcaacagagctcgggcggagggcggagggcgacaggagaggcgatggacaacctggggttgatgtgggagatcatggggccggggatagctggcgccgtgttcggcgcagggtggtggttctgggttgacgccgtcgtctgcagcgccgtcaagatctcgttcctacattacctccccggaatttttgcgtcgcttgcggctctcatgttcaactgcgtcgacaagaatgagatcggctacgattactactcaccttacggagagaccgaatggagggtgaagctctggctttttgtggcatatgttgtgtcatttgtttctttagcgggggcagtaggcctgcttgttcaagatgctctcacagagaagagcccctcggtgtggacaggagttgctggtgttttgcagtgtgtgtttgttttgataagtgggctgatatattggacttgtcattccgaagattaagtggtaagatcaagaagaatgtttgtgctcaggtctgcaataacatggatttttctgtgggaagccctttcatgagtaattaatgtagaatatacagtcaaatggtttacttagaagtactttgcatctaaagagtttgattgtttgcatacgtgtgtatgtgtaattggatctctatatgttacaagctcacttgcaatttgaaatgctgcaagtgttgcccttctattagttttagatggc

SEQ ID NO: 1494 - DNA, 571 bp, Elaeis guineensis
tttaaaagagagagaggattagagatcagagagaaacagggttcagcgagcgagcgagcgacgcgaatccatggacaatctgtcgctcatgtgggagatcatgggccctggtattgctggcgccgtgttcggcgccggctggtggttttgggttgacgccgtcgtctgcagcgccgtcaaggtctccttcctccattacctccccggaatcttcgcgtccctggcggctctcatgttcaattgcgtcaatagagacgatgtcagctacgattactactctccatacggggatagcgaatggaggttgaagctttggctttttgttgcatatgtcgtatcctttgtctctttagctgcagcagtgggcttgctaatacaagactctctcacagataagggcccttctgtgtggacaggtgttgctggtgtccttcaatgcgtgtttgtcttaatcagtgggctgatttattggacctgtcattctgaagattgagatgataaaatctgttccacgtttgaagcggacatgtaaagatgaagagaccatgaacttgtcattgaacaaataaaa

SEQ ID NO: 1495 - DNA, 971 bp, Ananas comosus
gagtagagagaaagagagagagaaaggggagtcgaaagtgaagaagacgacgccgtcgacgacgacgacgacgacgacgacgacgacgacgccatggacaacaacctctcgctgatgtgggagatcatgggccccggcatcgccggcgccgtgttcggcgccgggtggtggttctgggtcgacgcagtcgtgtgtagcgccgttaaggtctccttcctccactacctcccggggatcttcgcctctctcgcggcgctcatgttcaattgcgtcagcagggacgatgttagctacggttcctactccccctatgatgatacggagtggagggtgaagctttggctctttgtggcgtacgttgtgtcttttgtctctttagccggggctgtgggtttattaatacaggatgcactaacagacaagggtccctctgtttggactggagttgctggcgtcctgcaatgcgtctttgtgctaataagtgggttgatatattggacttgccattctgaagattgaattgaagggttctctctcgttgccaaaatggaagtttaaaggtgaatccattataaactttgtcaggggcacaaatgaagtgatcactatagcgtgtgatttgttttatcatttcgtttctttatgagcgtgaatagctgttctgtaaatgaaagaggtgccgtgttgataacttagcatgcaaagtgcttctttgaaactctatcttaactccattgtagattagcagatagtttccgacataatcgccctgtgtatttgtggatatgaaggattgcaatgctttcacttaattattgttttggttttcgtattttatttgaagttttgtagtttttgctcctagagatgatagattttgcttcgagggacccaaaatttggatgaacttttatgtttggtgggattattgctaaggttgtccaatcataggaaaatatgccatagaatgg

SEQ ID NO: 1496 - DNA, 4874 bp, Triticum aestivum
cgtgctctggtcgtccggctgctgccattgttctgaacttctgaaggttcttcgaggatcttaggtttcgtgaatatggcatctcatgctgaaatgacaggaagcaatatgctacgtcttcaaagctttcctagtaatatgggaaaacaaaggagtagttttatctccacaagacaccctcccttgagaaggccacgagtggttcgacattgcctggacctacgtcatctttgccgtttacctaatcaaagggctattgttccaaatatcagaacaatgcctgctctcactgctgcagtatccaggggagttaatagtccattgatagaggcatctggtgatgacatgggattagtttcaaggattattcacttttatcgcaaaccatttcttcaagagagtgaggccaaggagttactcaggaaagtgcaggcaaaggtttcttctaatattattgatataaagactgagcaatgcttcaatgttgagttggaggatgcactaggttctacgaagctcgcaacacttcagtggctcctagcagaaacttatgaacctgacaacttacaaacagggagctttctggaggaggaagtttctaggagcccttactgcttccttgttgaggttggtccccggatgacattttcgacagctttctcaaccaatgctgtctcgatttgtaaagctctatcattaatggaagtaactcgcctggagaggtctagaagatatcttttgtgccttcagcctggtagtgacccacttgatgaaagccaactcaacagctttgctgctttgattcatgacaggatgacagagtgtgtttatcctagcaagctcacatcatttcggtcagatgtagttccagaacctgtcagtgttataccagtcatggaaaagggaagggaagcactggaggaaataaatcttaaaatgggtctggcttttgatgaacaagatatcaagtactacactcacctattcagagatgacatcaaacgcaatccaactaccgtggaactttttgacatagcgcaatcaaacagtgagcacagcagacattggttttttaatggaaagcttgagatagatggagagaccatgccaagtactctgtttcagttagtaaagagccccttgaaggctaaccctaataactctattattgggttcaaggataactcgagtgcaataaaagggactcttgtaaatcacctacgcccagcactaccaggttccacttcaccgctatccctgatgatgcgtgaactaggcattctgttcacagcagaaacccataattttccatgtgctgtggcaccctacccaggagctgaaacaggtgcaggtggccgcataagggacacacatgccactggaaagggctcatttgttgttgcttcaactgctggttattgtgttggaaaccttcaaattgaagaatcatatgcaccttgggaggattcatctttttcatacccatcaaacttagcttctccattgcagattcttattgatgctagcgatggtgcttctgactatgggaacaagtttggcgagcctttaattcagggatttacaagaaattttggttctaggttgccaaacggggagcgccgtgaatggctgaagcctataatgttcagtggggcaattgggcagattgaccatgcacacatatcgaaaggggatccagaaatcggcatgctagttgtgaagattggtggtccagcatacagaattggtatgggtggtggtgctgcctcaagtatggttagtggacagaatgatgcagagctcgattttaacgcagtgcagcggggagatgctgagatggcacagaaattatatcgcgtgatcagggcatgtgtggaaatgggagagaagaatccaatcatcagcattcatgatcagggagctggaggaaactgcaatgtcgtgaaagaaataatctatcctaagggtgctgaaattgatatccgctcaattgttgttggtgatcacacattgtctgtgttggagatctggggtgctgaataccaggaacaagatgcattattggtgaagcctgagagcagaaacctgttgcaatcactttgtgatagagagagagtttcaatggctgtccttggtgaaattgatggtagtggaaagattgttttaattgacagtgctgctgtggagcatgcaatgttgagtggccttcctcctccaccgcctgctgttgatcttgagcttgaaaaggttttaggagatatgcctcagaagacctttgatttcaagcgagttcctcgatcgagtgaacccttagacatagcacccgagattacactgatggatgttcttaagcgagtattgaagcttccctcagtatgttcaaagcgtttcttgaccactaaggttgacagatgtgtgacaggtcttgtggcacaacagcagacggttggcccactgcaactaccacttgctgatgttgctgtagtcgcacagacatacacagatcttactggcggtgcttgtgccattggagaacaaccaataaagggtttacttaatcctgaggctatggcaaggcttgctgttggggaggcattgaccaatctggtttgggctaaagttacatctcttgctgacgtcaaagcaagtggcaattggatgtacgctgcaaagattgatggagagggagcagatatgtatgatgctgctgtcgcaatggctgactgcatgattcaacttggtattgcaattgatggaggaaaggatagtctttctatggcagctcaatgtgatggcgagctagtcaaagctccaggaaatcttgttatcagtgcttatgtgacatgtcctgatataaccttaacggttactccagatctaaagcttgtgaaggacggggttctgttgcatgttgacctggctaaaggaaagcgacgacttggttgttctgctctcgcacaagcgtttgatcaaattggaaatgactgcccagacatagaagatgtcccttacttgaaaaaggtctttgaggttgttcaagaattgctcagcgaacgcctgatttctgctggtcatgacattagtgatggtgggcttattgtcaccattcttgagatggcatttgctggcaactgtggtgttaacctcaacatagaattaaaagataatgaccttcttcaaacactttttgcggaggagcttggtcttgtagttgaagtgcatttggatgaccttgatgtagtgaagcaaaaacttcatgcggcaggggtttctgctaatgtgataggaaaagtaactgcagcaccagaaatagagctgtgtgttgatggtgaggtgcgtttgaaagaaagaacttcagatctcagagatttgtgggaggaaacaagctttcagcttgaggagctacagcggctgaaatcttgtgtcaagcttgagaaagaaggcctaaaaagccgaacatcgccctcatggcatttgtcttttacgcccaaattcacggacaagaaactactgtctgcatcctcgaaaccgaaggttgccatcattcgggaagaagggagcaacagtgatagggaaatgtctgctgcattccatgctgctggttttgaaccgtgggatatcacaatgtcggatctcttgaaccaaaagacttctctaacggaattccgtgggcttgcatttgttggtggatttagctatgcagatgttcttgactcagcaaaaggttgggctgcatctatcaggttcaaccagcccctcatacagcagttccaggagttctacaataggccagacacattcagccttggggtgtgcaatgggtgtcagctcatggctcttcttggttgggtaccaggacccgatattggaggctcgcttggtgcaggtggagacatgtcccagccaaggttcactcacaatgaatctggccgttttgaatgtcggtttatcagtgtggccattggggattctccttctataatgttcaaaggtatggaaggctctacactgggcatttggagtgctcatggtgaaggtagagccttcttcccagatgaaaatgtcttgtctgatgttgtgaaatctaatctggcccctctgaggtactgcgatgatgctaataatgtcacagaggtatatcctttcaaccctaatggctctccgcttggtattgcggccctttgctcccctaatggaaggcaccttgcgctgatgccacacccggagcgttcctttatgatgtggcaatacccatggtatcccaaggagtggcaggttgagaagagtggtcccagtccttggttgcgcatgttccagaatgcaagagaatggtgttcatagataagggaccaaatttgtggcccgtatgtctgcttagagcttgggcattctgctgtagaactgatgtggccatggatcaactcaatactatgcctgtgaaattatcacagtggaagaacttaagtgacagacatcagttctcagttcttgagttgagctggaatatctgcgctacttattcacagtgcttgtacaggggctgcctgcgagcataattatgtctcactagctgaattgagctatatgcttcttctgcaatcattcacctttattatccaataataccattctctagctgtccggcaacataaaatgtatcctgtcagctttctttctgccgagcatatccattttgtagtgttgcccgttacatatttgggattatgttttcagtttggggtatccttaagaggacaacacttgcacattgttgacaaaagctcattgctcgcgagcttaactagcgctgggtagtttgacttgttaacctcgtagcttactttttatttacgggagttaaaacttgtacagta

SEQ ID NO: 1497 - DNA, 4865 bp, Triticum aestivum
aagaaaagaaaaaacgttcgggcagcaaactggacagagtattcgcgggcgaccgcacgagcgcgccgccgccgccgccgcgagtcttctctgccgccgccgcccgtcagccgtcgccagcgaggttcttggagtatcttaggtgtcgtcaatatggcatctcatgctgaaatgacagcaagcaatatgctacgtcttcaaggctttcctagtaatatgggaaaacaaaggagtagttttatatccacaagacacccaccttcgagaaggtcacgagtggttcgacattgcctgaacctacgtcatctttgccgtttacctaatcaaagggctattgttccaaatatccgaccaatgcctgctctcactgctgcagtatccagcggagttaatagtccattgatagaggcatctggtgatgacatggaattagtttcaaggattattcacttttatcgcaaaccacttcttcaagagagtgaggccaaggagttactcaggaaagtgcaggcaaaggtttcttctaatattattgatataaagactgagcaatgcttcaatgttgagttggaggatgcactaggttctacaaagctcgcaacacttcagtggctcctagcagaaacttatgaacctgacaacctacaaacagggagctttctggaggaggaagtttctaggagctcttattgcttccttgttgaggttggtccccggatgacattttcgacagctttctcaaccaatgctgtctcgatttgtaaagctctatcattaatggaagtaactcgcctggagaggtctagaagatatcttttgtgccttcagcctggtagtgacccacttgatgaaagccaactcaacagctttgctgctttgattcatgacaggatgacagaatgtgtttatcctagcaagctcacatcatttcggtcggatgtagttccagaacctgtcagtgttataccagtcatggaaaggggaagggaagcactggaggaaataaatcttaaaatgggtctggcttttgatgaacaagatatcaagtactacactcacctattcagagatgacatcaaacgcaatccaagtaccgttgaactttttgacatagcgcaatcaaacagtgagcacagcagacattggttttttaatggaaagcttgagatagatggagagaccatgccaagtactctgtttcagttagtaaagagccccttgaaggctaaccctaataactctattattgggttcaaggataactcgagtgcaataaaagggactcttgtaaatcacctacgcccagcactaccaggttccacttcaccgctaaccctgatgatgcgtgaactaggcattctgttcacagcagaaacacataattttccatgtgccgtggcaccctacccaggagctgaaacaggtgcaggtggccgcataagggacacacatgccactggaaagggctcatttgttgttgcttcaactgctggttattgtgttggaaaccttcaaattgaagaatcatatgcacttgggaggattcatcttttgcatacccatcaaacttagctcctccgttgcagattcttattgatgctagcgacggtgcttctgactatgggaacaagtttggcgagcctttaattcagggatttacaagaaattttggttctaggttgccaaacggggagcgtcgtgaatggctgaagcctataatgttcagtggggcagttgggcagattgaccatgcacacatatcgaaaggggatccagaaatcggcatgctagttgtgaagattggtggtccagcatacagaattggtatgggtggtggtgctgcctcaagtatggttagtggacagaatgatgcagagctcgattttaacgcagtgcagcggggagatgctgagatggcacaaaagttatatcgcgtgatcagggcatgtgtggaaatgggagagaagaatccaatcatcagcattcatgatcagggagctggaggaaactgcaatgtcgtgaaagaaataatctatcctaagggtgctgaaattgatatccgctcaattgttgttggtgatcacacattgtctgtgttggagatctggggtgctgaataccaggaacaagatgcattattggtgaagcctgagagcagaaacctgttgcaatcactttgtgatagagagagagtttcaatggctgtccttggtgaaattgatggtagtggaaagattgttttaattgacagtgctgctgtggagcatgcaatgttgagtggccttcctcctccaccgcctgctgttgatcttgagcttgaaaaggttttaggagatatgcctcagaagacctttgatttcaagcgagttcctcgatcgagtgaacccttagacatagcacccgagattacactgatggatgttcttaagcgagtattgaagcttccctcagtatgttcaaagcgtttcttgaccactaaggttgacagatgtgtgacaggtcttgtggcacaacagcagacggttggcccactgcaactaccacttgctgatgttgctgtagtcgcacagacatacacagatcttactggcggtgcttgtgccattggagaacaaccaataaagggtttacttaatcctgaggctatggcaaggcttgctgttggggaggcattgaccaatctggtttgggctaaagttacatctcttgatgacgtcaaagcaagtggcaattggatgtacgctgcaaagattgatggagagggagcagatatgtatgatgctgctgtcgcaatggctgactgcatgattcaacttggtattgcaattgatggaggaaaggatagtctttctatggcagctcaatgtgatggcgagctagtcaaagctccaggaaatcttgttatcagtgcttatgtgacatgtcctgatataaccttaacggttactccagatctaaagcttgtgaaggacggggttctgttgcatgttgacctggctaaaggaaagcgacgacttggttgttctgctctcgcacaagcgtttgatcaaattggaaatgactgcccagacatagaagatgtcccttacttgaaaaaggtctttgaggttgttcaagaattgctcagcgaacgcctgatttctgctggtcatgacattagtgatggtgggcttattgtcaccattcttgagatggcatttgctggcaactgtggtgttaacctcaacatagaattaaaagataatgaccttcttcaaacactttttgcggaagagcttggtcttgtaattgaagtgcatttggatgaccttgatctagtgaagcaaaaacttaatgcagcaggggtttctgctgatgtgataggagaagtaactgcagcaccagaaatagagctacttgttgatggtgaggtgcgtttgaaagaaagaacttcagacctcagagatttgtgggaggaaacaagctttcagcttgaggagctacagcggctgaaatcttgtgtcaagcttgagaaagaaggcttaaaaggccgaacatcccctttatggcatttgtcttttacgcccaaattcacagacgagaaactactgtctgcatcctcgaaaccgaaggttgccatcattcgcgaagaagggagcaacagtgatagggaaatgtctgctgcattccatgctgctggttttgaaccgtgggacaccacaatgtcggatctcttgaaccagaaggctgatctaatgaaattccgtgggatcgcatttgttggtggatttagctatgcagatgttcttgactcagcgaaaggctgggctgcatctatcaggttcaaccagcccctcatacagcagttccaggagttctacaataggccagacacattcagccttggggtgtgcaatgggtgtcagctcatggctcttcttggttgggtaccaggacccgatattggaggctcgcttggtgcaggtggagacatgtcccagccaaggttcactcacaatgaatctggccgttttgaatgtcggtttatcagtgtggccataggggtttctccttctataatgttcaaaggtatggaaggctctacactgggcatttggagtgctcatggtgaaggtagagccttcttcccagatgaaaatgtcttgtctgatgttgtgaaatctaatctggcccctctgagatactgcgatgatgctaataacgtcacagaggtctatcctttcaaccctaatggctctccgcttggtattgcggccctttgctcccctaatggaaggcaccttgcgctgatgccacacccggagcgttcctttatgatgtggcaatacccatggtatcccaaggagtggcaggttgagaagagtggtcccagtccttggttgcgcatgttccagaatgcaagagaatggtgttcatagataagggaccaaaattggtggcccgtatgtctgcttagagcttgggcattctgctgtagaactgaacatgatgtggccatggatcaactcaataccatgtctgaaattatcgtgttggaagaactcaagtgacagacagcagccctcagttcttgaatatttctgctacttattctcaatggacagtgcctgtataggtgctgcgtgcgagcatagttatgtttcactagctgaattgagctatatagacttacttactggacaattattcaacctatatccagtgatactatgctctagctgtccggcaaacattaaactaatatcctgtcagcttcttctgctaagcataattactccattttgattacacagaatgtaccctagtcgcccgttacatattcgggattgtatttcagttggacgtaactcaagcggtaaataaac

SEQ ID NO: 1498 - DNA, 4700 bp, Brachypodium distachyon
atgcacatagttgaactgtcacctaatgatactttttttcctgtatgtaataattattatgtgtgtcctccccaggtaaaacaaaggcatagctttatctctgcaagacagtcttccttgagaaggtcacgaatggttagaggttgcttggacctacgtcatttttgctggttacctaatcaaagatttgctctttcaaatacccgaccaatgccagctctcaatgccgcagtatcgagggatgttaatagtccattggtagaggaatctgtcgatgatgtaaaattgttttcaaggattattcacctttaccgcagaccatttcttcaagagagtgagaccaaggatttactcaggaaagtgcaggcaaaggtgtcttctaatattattgacataaaaaccgagcaatgcttcaatgttgagttggaaagtgcactaagttctgagaagctcacagcacttcagtggctcttagcggaaacttatgaacctgagaacttacaatcagggagttttctggaggaggaagttttgaggagcccttattctttccttgttgaggtcggtccccggatgacattttcaacagctttctcgaccaatgctgtctcaatttgtaaagctctatcattaatggaagtaactcgcctggagagatctagaagatatcttttgtgccttcagcctggtagtggcccacttgatgaaagccagctcaacagctttgctgctttgattcatgacagaatgactgagtgtgtttatcctagcaagcttacatcatttcggtcagatgtagttccagaacctgtcagtgttataccagtcattgaaaggggaagggaagcacttgaggaaataaatatcagaatggggctggcgtttgatgagcaagatatcaagtactacactcacctcttcagagatgacatcaagcgcaatccaactactgtggaactttttgacatagcccaatccaatagtgagcacagcaggcattggttttttaacggaaagcttgagatagatggagagaccatggagagaactttgtttcagttagtaaagagtcccttgaaggctaaccctaataactctataattggattcaaggataactcaagtgcaataaaagggaacccagtaaatcatctacgtccagcagtaccaggttctacttcaccgttatcccttatgatgcgtgaacttggcattctgttcacagcagaaacccataattttccatgtgctgtggcaccctacccaggagcagaaacaggtgcaggtggccgtataagagacacacatgcgactggaaagggttcatttgtcgttgcttcaactgctggttattgtgttggaaatcttctaatggaagagtcatatgcaccctgggaggattcatccttttcatacccactgaacttagcttctcctttgcagattcttattgatgctagtgatggtgcttctgactatgggaacaagtttggcgagcctttaattcagggattcacaagaactttcggtatgaggttgccaaatggggagcgccgtgaatggctgaagccaataatgttcagtggagcaatcgggcagattgaccatgcacacatatccaaaggggatccagaaattggcatgctagttgtgaagattggtggtccagcatacagaattggtatgggtggtggtgctgcctcaagtatggttagcggacagaatgatgcagaacttgatttcaatgcagtgcagcgtggagatgctgagatggcacagaaactatatcgcgtgatcagggcatgtgcagaaatgggagagaagaatccaatcatcagcattcatgatcagggagctggaggaaattgcaatgttgtgaaagaaataatttatcctaagggcgcgagtttacacttaactaaaattattgttggtgatcacacactatctgtgttggagatctggggtgctgaataccaggaacagatgcattattggtgaagcctgagagcagaagcctgttgcagtcactttgtgagagagaaagagtttcaatggctgtcctcggggaaattgatggtagtggaaagattgttttgattgacggtgctgctgtggagcatgcgaagttgaatggccttcctcctccactgcctgttgttgatctcgagcttgaaaaggtattaggagacatgcctcagaaaacatttgagttcaagcgagtttctcgatcgagtgagcccttagatattgcacctgaggtcacactaatgaatgttcttaagcgagtattgaagcttccctctgtatgttcaaagcgtttcttgaccacaaaggttgacaggtgtgtgacaggtcttgttgcacagcagcagacagttggccctctccaacttccacttgctgatgtcgctgtaattgcacagacatacacagatcttacaggtggtgcttgcgccatcggagaacaaccaataaagggtttacttaatcctgaggccatggcaaggcttgctgttggggaagcactgaccaatctggtttgggctaaagttacatctcttgccgatgtcaaagcgagcggtaattggatgtatgctgcaaagcttgatggagagggagcggatatgtatgatgctgctgttgcaatggctgattgcatgatagaacttggtattgcaattgatggaggaaaggacagtctttctatggcagctcaatgtgatggcgaggtagtcaaggctccagggaatcttgtcatcagtgcttatgtgacatgtcctgatataaccttgacggttactccagatttaaagcttgggaatgatggggttctgttgcacattgacctgtctaaaggaaaacgccgacttggttgttctgctcttgcacaagcatttgaccaaattggaaatgactgcccagacatagaagatgtttcttacttgaagaaagtgttcgagattgttcaagaattgctcagtgaacgtctgatttcctccggtcatgacattagcgatggtgggcttattgttacaatacttgagatggcatttgctagcaactgtggtgttaacctcaacatagaattaaaagataatgaccttcttcaagcacttttcgccgaggagcttggtcttgttatggaagtgcactcaaaagactatgatgttgtgaagcaaaagcttcaagcagcaggggtttctgctgatgtgatagggaaagtaacagcagcaccggaaatagagctgcttgttgatggtgtggtgtgcttgaaggaaagaacttcagacctcagagatttatgggaggaaacaggattccagcttgaggagctacagcggctgaagtcttgtgttttacttgagaaagaaggcttaaaaagccgaaaaacgccgtcatggcatttgtctttcgctcccgcattcacggacaagaaactattgactgcatcttcaaaaccaaaggttgctatcattcgtgaagaagggagcaatagtgatagggaaatgtctgctgcattccatgctgctggttttgaaccgtgggacatcacaatgtcggatctcttgaatcataaggcttctctaaacgaattccgtgggattgcatttgttggtggttttagctatgcagatgttctagactcagcgaaaggttgggctgcatctatcaggttcaaccagcccctcatacagcagttccaggagttctacaataggccagatacgttcagccttggagtgtgcaatggttgtcagctcatggctcttcttggctgggtgccaggaccagatattggaggctcccttggtacaggtggagacatgtcccagccaaggttcattcacaatgaatctggtcgttttgagtgtcggtttatcagtgtagccataggggactctccttctataatgttcaaaggtatggaaggctctactttgggcatttggagtgctcatggtgaagggagagccttcttcccagatgaaaatgtcttatctggtgttgtcaaatctaatctggctcctctgcgatattgcgatgatgctaataacatcacagaggtctatccctttaaccccaatggttctccacttggtattgcggccctttgctcccctaatggaagacaccttgctctgatgccacacccagagcgttcctttatgatgtggcaatatccatggtatcccaaggaatggcagattgagaagagtggtcccagtccttggttgcgcatgttccagaatgcacgagaatggtgttcatagaaaagttatatgctctccactatgttctccagtatgctgctagtaaagggctgcttaacattgctgagaccctggtagctgtcaacaagaaagcataaggattgattatctttgctgcgttcagtccatctgccgctcccttggtggttatcatttgctctgtcgtataccatctgagatcaaggctcatccgtactatattctgcaactctaccatgattattatggaattttattttctattctgatggggttttttcgaggaggttttctattctgatgttacaattaaacttccaaatttcttgtaataatattccacacatcctctggtttgtaataaagaacctacccttctcttgacttgatactaaacacgtggtttcgtatatgcaagtacgtggctgcatttttctcctcttctcc

SEQ ID NO: 1499 - DNA, 4946 bp, Setaria italica
aaagaaaacgagagcaaagataccctactccgccgccgctcgtctcgatactgtgctggctccgcgttaccgcgccgtcgccgtcaccgccgcaggacaagggcgcgcacccgtggcgctccggcgatccccacgctgccccgttgcatcagtgggattaagaaggtgtctagcagctgcgcgcgtccgcgctccccgccgactgctcggcggcgccgcgagggtgccaccccctgcgcagctggttctttaataatctgacgcttacctgtaatatgtcatatcctggggaaatgacaggaagcaatattatccgtcttcaatgctttcctagcaatatggtaaaccaacgatctggtttcatccctgcaagaaatagaaggtcacgaatgaccaggcactgcttagacccacgacacctttgcagattacctactcaaagggttaatgttccaaatatccgaccactgcctactcccaatgctgcagtatccagggatattaataccccattggttgaggaatctgttactgaggtggaatcgaccccacatgtttttcacttttatcgcaaaccatttctccaagagagcgaatctgaagagctacttaggaaagtacagcaaaaggttgcttgcaacattattgacataaaaactgagcaatgcttcaatgttgaactgcagaaggcactaacttctgagaagcttgcaacactgcagtggctcctatcggagacctatgaacctgagaaattacaaacatgtagctttttggaagacgaagtttctagaagcccttactctgtgattgttgaggttggtccccggatggcattttcaactgctttttcaaccaatgctgtctcaatttgcaaagctctatcactaacagaagtaacccgcttggagaggtctagaagatatcttttgttccttcagcctgggagtggtccgcttgatgaaagtcaactcaacagctttgctgccttgattcatgatagaatgacagagtgtatttatcctagcaagctcacatcatttctggtagatgtagtaccggaacctgtcagtgccataccagtgattgaaaggggaagggaagctttggaagaaataaatgttagaatggggcttgcttttgatgaacaagatatcaaatactacacccaccttttcagagatgacattaaacgcaatcctactaccgtggaactttttgatatagcacaatccaacagtgagcacagcagacattggtttttcaatggtaaacttgtgatagatggagaaaccatggctagaactctgtttcagttagtgaagagtcccttgaaagccaaccccaataactctgttattggatttaaggacaactcgagtgcaatcaaaggatatcaagtaaatcagttacgtcccgcacttccaggttccacttcaccattatcccttatgatgcgtgagcttgacattttatttacagcagaaactcataattttccgtgtgctgtggcgccttatcccggagctgagacaggtgcgggcggtcgtataagagacacacatgccactggacagggttcttttattgttgcttccactgctggttattgtgttggtaatcttcgaattgaagagtcatacgcaccctgggaggattcatctttttcatacccatcaaacttagcctctccattgcagattcttattgatgctagtgacggcgcttctgattatgggaacaaatttggtgagcctttaattcagggttttacaagaaattttggtacaaggttaccaaatggagagcgtcgtgaatggttgaagccaataatgttcagtggagcaatcggacagattgaccatgtgcacatctcgaaaggagacccagaaattggaatgctagttgtcaaaattggtggtccagcctacagaattggtatgggtggtggtgctgcctcaagtatggttagtggacaaaatgacgcagaacttgatttcaatgcggtgcagcgtggagatgctgaaatggctcagaaactgtatcgtgttatcagggcatgtgcggaaatgggagaaaagaacccaatcatcagcattcatgaccaaggagctgggggtaattgcaatgttgtgaaagaaataatctatccaaaaggtgctgaaattgatatccgctcaattgtagttggtgatcacacattgtctgtcttggagatctggggtgccgaatatcaggaacaggatgcattattggtgaagcctgagagcagaagattgttggagtcactttgtgagagggaaagagtatcgatggctgtcattggggaaatagatggcagtgggaaaattgttttgatcgatagcgttgctgtggaacaagccaagttgaatggacttcctcctccaccccctgttgtggaccttgagcttgaaaaggttttaggagatatgccccagaagacctttgaattcaaccgagttactcgattgggtgagcccttagacattgcacctgaggtcacgttaatggatgttctgaagcgagttttgaagctcccttctgtatgttcaaagcgtttcctaacgacgaaggttgacagatgtgtaacaggtcttgttgcacaacagcagacggttggtcctcttcaactaccacttgctgatgtggctgttattgcgcagacatacacagatctgactggcggtgcttgtgccattggagaacaaccaataaagggcttgcttaaccccaaggccatggcaagacttgctgttggggaagcattgaccaatctggtctgggctaaagtcacatcccttgctgatgtcaaagcgagcggtaactggatgtatgctgcaaagcttgatggagagggagcagatatgtatgatgctggtgttgcgctggctgactgcatggttgaacttggcattgctattgatggaggaaaggacagtctttctatggcagctcaatgtgatggcgaagtagtcaaggctcctggaaatttggtgatcagtgcatatgtgacatgtcctgatataactttgacggttactccagatttgaagcttggcgatgatggagtgttgttgcacattgaccttgctaaaggaaagcgtcgacttggttgttctgcactcacacaagcctttgaccaaattggaaatgactgcccagacattgaagatgttccctacttgaagaaagtctttgatgctgttcaggaattactcagcgaacgccttatttctgctggtcatgacatcagtgatggtgggctcattgtcactgttcttgagatggcatttgctggtaactgtggtgttaacctgaatgtaggcttaggagattatgatcttttacaagtactttttgcagaggagcttggcctcgttcttgaagtgcactcaaatgaccttgatgttgtaaagcaaaagcttcatgtggcaggtgtctccgctaatgtaattggcaaagtaactacagcaccagatataggtcttgttgttgatggtgaggtgcgactgaaggaaaaaacttctgatctgagagatctgtgggaggaaacaagcttccagcttgaagagcttcaacgtttgaagtcttgtgtgaagcttgagaaagaaggcttaaaaagccgaacgtcaccttcatggcgtttgtcttttactcctaaattcacagagaagaaaatattgaccacagccacaaaaccaaaggtcgctattattcgtgaagagggtagcaatagtgacagagaaatggctgctgcattccattctgcaggttttgaaccatgggatataacaatgtcagacctcttgactcagaaaatttctctaacagaattccgtgggcttgcatttgttggtggttttagctatgcagatgttctagattcagcaaaaggctgggctgcatctatcaggttcaaccagcccctcatacaacagttccaggagttctacaataggccagacacattcagccttggagtttgtaatgggtgtcaattgatggcacttcttggttgggttccaggaccagatgttggaggttcccttggtgtaggtggtgacatctctcagccgaggttcatccataatgaatctggccgtttcgagtgccggtttaccagtgtagctataggggattctcctgctataatgttcaaaggtatggaaggctctacgttgggcatttggagtgctcatggtgaggggagagcattcttcccagatgaaaacattttatctggtgttgttaagtctaatctagctcctctgagatactgcgatgattataataacgtaacagaggtttatcccttcaaccccaacggttctcctcttggtattgcggccctttgctcccccgatggaaggcacctcgctatgatgccgcaccccgagcgttccttcatgatgtggcagtatccgtggtatcccaaggattggcaggttgagaagagtggccccagtccttggttgcggatgttccagaatgcacgtgaatggtgttcataaaaagcgtgcagggaccaaaattgatagcccatatgatgctatgaagcatgatgaactttctgctgcagaactgatgtgctatggatgatctaattatgtttgcacctatgttaaagtatcagagtatttcaataattaagcgccaaggactggtggccaaggaagcgttgtttggataacttaagttgtcgcgttgagcatggcatgtgttattttgaatatgaggatatacctcctgttctgtttgtcactttgcccgataattatatgccctagtaacaatgtaactaccagttttacgggaaccatttgcatgcccgtgtaacacgaatttttgatcggttgaaccagatggtgctccacggctcaatcatgatcgtggcaaaacttttgcttaagctcatttgactgagg

SEQ ID NO: 1500 - DNA, 4266 bp, Secale cereale
atggcatctcatgctgaaatgacgggaggcaatatgctacgtcttcaaagctttcctagtaatatgggaaaacaaaggcgagttttatctccacaagacaccttcccttgagaaggccacgagtggttcgacattgcctggacctacgtcatctttgccgtttacctaatcaaagggctattgttccaaatatccgaacaatgcctgctctcactgccgcagtatccaggggagttaatagtcccttgacagaggcatctgttgatgacatggaagtactttcaaggattattcacttttatcgcaaaccacttcttcaagagagtgaggctaaggagttactcaggaaagtgcaggcaaaggtttcttctaatattattgatataaagactgagcaatgcttcaatgttgagttggaggattcactaagttctgcgaagcttgcaacacttcagtggctcctagcagaaacttatgaacctgacaacttacaaacagggagctttctggaggaggaggtttctatgagtccttattccttccttgttgaggtcggtccccggatgacattttcgacagctttctcgactaatgctgtctcaatttgtaaagctctatctttaatggaagtaactcgtctggagaggtctagaagatatcttttgtgccttcagcctggtagtgacccacttgatgaaagccaactcaacagctttgctgctctggttcatgacaggatgacagagtgtgtttatcctagcaagctcacatcattccggtcagatgtagttccagaacctgtcagtgttataccagtcatggaaaggggaagggaagctctggaggaaataaatcttaaaatggggctggcttttgatgaacaggatatcaagtactacactcacctcttcagagatgacatcaaacgcaatccaactaccgtggaactttttgacatagcgcaatccaatagtgagcatagcagacattggttttttaatggaaagcttgagatagatggagagaccatgccaagtactttgtttcagttagtaaagagtcccttaaaggctaaccctaataactctattattggattcaaggataactcgagcgccataaaagggacccttgtaaatcacctacgtccatccctaccaggttccacttcaccgttatcccttatgatgcgtgaactgggcattctgttcacagcagaaacccataattttccatgtgccgtggcaccctacccaggagctgaaacaggtgcaggtggccgtataagagatacacatgccactggaaaaggttcatttgttgttgcctcgactactggttattgtgttggaaaccttcaaattgaagattcatacgcaccttgggaggattcatccttttcatacccatcaaacttagcttctccattgcagattcttattgatgctagcgacggtgcttctgactatgggaacaagtttggcgagcctttaattcagggatttacaagaaattttggttctaggttaccaaacggggagcgccgtgaatggctgaagccaataatgttcagtggagcaattgggcagattgaccatgcacacatatcgaaaggggatccagaaattggcatgctagttgtgaagattggtggtccagcatacagaattggtatgggtggtggtgctgcctcaagtatggttagcggacagaatgatgcagagcttgattttaatgcagttcagcggggagatgctgagatggcacagaaattatatcgcgtgatcagggcatgtgcagaaatgggggagaagaatccaatcatcagcattcatgatcagggagctggaggaaactgcaatgttgtgaaagaaataatctatcctaagggtgctgaaattgacatccgctcaattgttgttggtgatcacacattgtctgtgttggagatctggggtgctgaataccaggaacaagatgcattattggtgaagcctgagagtagaaacctgttgcagtcactttgtgagagagaaagagtttcaatggctgtccttggtcaaattgatggtagtggaaaaattgttttgattgacggtgctgctgtggagcatgcgaagttgagtggccttcctccaccaccgcctgttgttgatcttgagcttgaaaaggttttaggagatatgcctcagaaaacctttgaattcaagcgcgtttctcgattgagtgagcccttagacatagcacctgaggttacactgatggatgttcttaagcgcgtattgaagcttccctctgtatgttcaaagcgtttcttgaccactaaggttgacaggtgtgtgactggtcttgttgcacagcagcagacggttggcccgctccaacttccacttgctgatgttgctgtaattgcacagacatacacagatctgacaggtggtgcttgtgccattggagaacaaccgataaagggtttacttaatcccgaggccatggcaaggcttgctgttggggaggcattgaccaatctggtttgggctaaagttacatctcttgctgacgtcaaagcaagcggcaattggatgtatgctgcaaagattgatggagagggagcggatatgtatgatgctgctgttgcaatggctgactgcatgattcaacttggtattgcaattgatggaggaaaggatagtctttctatggcagctcaatgtgatggcgagctagtcaaagctccaggaaatcttgttatcagtgcttatgtgacatgtcctgatataaccttgactgttactccagatctaaagcttgggaaggatggggttctgctgcatgttgacctggctgaaggaaagcgacgacttggttgttctgctcttgcacaagcgtttgatcaaattggaaatgactgccctgacatagaagatgtcccttacttgaaaaaggtcttcgaggttgttcaagaattgctcagtgaacgtctgatttctgccggtcatgacattagtgatggtgggcttattgtcactattcttgagatggcatttgctggtaactgtggtgttaacctcaacatagaatcaaaagataatggccttcttcaaacactttttgcggaagagcttggtcttgtaattgaagtgcatttggatgaccttgatctagtgaagcaaaaacttaatgcagcaggggtttctgctaatgtgataggagaagtaactgcatcaccagaaatagagctgcttgttgatggtgaggtgtgtttgaaagaaagaacttcagacctcagagatttgtgggaggaaacaagctttcagcttgaggagctacagcggctgaaatcttgtgtcaagcttgagaaagaaggcttaaaaagccgaacatcacctttatggcatttgtcttttacgcccaaattcacagacaagaaactactgtctgcatcctcgaaaccgaaggttgccatcattcgcgaagaagggagcaacagtgatagggaaatgtctgctgcattccatgctgctggttttgaaccgtgggacatcacaatgtcggatctcttgaaccagaaggctgatctaatggaattccgtgggatcgcatttgttggtggatttagctatgctgatgttcttgactcagcgaaaggttgggctgcatctatcaggttcaaccagcccctcatacagcagttccaggagttctacaataggccagacacattcagccttggggtgtgcaatgggtgtcagctcatggctcttcttggttgggtaccaggacccgacattggaggctcgcttggtgcaggtggagacatgtcccagccaaggttcactcacaatgcatctggccgttttgaatgtcggtttatcagtgtggccataggggattctccttctataatgttcaaaggtatggaaggctctacactgggcatttggagtgctcatggtgaaggtagagccttcttcccagatgaaaatgtcttgtctgatgttgtgaaatctaatctggcccctctgaggtactgcgatgatgctaataatgtcacagaggtctatcctttcaaccctaatggctctccgcttggtattgcggccctttgctcccctaatggaaggcaccttgcgctgatgccacacccggagcgttcctttatgatgtggcaatacccatggtatcccaaggagtggcaggttgagaagagtggtcccagtccttggttgcgcatgttccagaatgcaagagaatggtgttcgtaga

SEQ ID NO: 1501 - DNA, 4558 bp, Triticum aestivum
gcagtatccaggggagttaatagtccattgatagaggcatctgtcgatgacatggaattagtttcaaggattattcacttttatcgcaaaccacttcttcaagagagtgaggccaaggagttactcaggaaagtgcaggcaaaggtttcttctaatattattgatataaagactgagcaatgctttaatgttgagttggaggattcactaagttctgcgaagcttgcaacacttaagtggctcctagcagaaacttatgaacctgacaacttacaaacagggagccttctggaggaggaggtttctatgagtccttattccttccttgttgaggttggtccccggatgacattttcgacagctttctcaaccaatgctgtctcgatttgtaaagctctatcattaatggaagtaactcgcctggagaggtctagaagatatcttttgtgccttcagcctggtagtgacccacttgatgaaagccaactcaacagctttgctgctttgattcatgacaggatgacagagtgtgtttatcctagcaagctcacatcatttcggtcagatgtagttccagaacctgtcagtgttataccagtcatggaaaagggaagggaagcactggaggaaataaatcttaaaatgggtcttgcttttgatgaacaagatatcaaatactacactcacctattcagagatgacatcaagcgcaatccaactacagtggaactttttgacatagcgcaatcaaacagtgagcacagcagacattggttttttaatggaaagcttgagatagatggagagaccatgccaagtactttgtttcagttagtaaagagtcccttgaaggctaaccctaataattctattattgggttcaaggataactcgagtgcaataaaagggactcttgtaaatcacctacgcccagcactaccaggttccacttcaccgctatccctgatgatgcgtgaactaggcattctgttcacagcagaaacccataattttccatgtgctgtggcaccctacccaggagctgaaacaggtgcaggtggccgcataagggacacacatgccactggaaagggctcatttgttgttgcttcaactgctggttattgtgttggaaacctacaaattgaagaatcatatgcaccttgggaggattcatctttttcatacccatcaaacttagcttctccattgcagattcttattgatgctagcgatggtgcttctgactatgggaacaagtttggcgagcctttaattcagggatttacaagaaattttggttctaggttgccaaacggggagcgccgtgaatggctgaagcctataatgttcagtggggcaattgggcagattgaccatgcacacatatcgaaaggggatccagaaattggcatgctagttgtgaagattggtggtccagcatacagaattggtatgggtggtggtgctgcctcaagtatggttagtggacagaatgatgcagagctcgattttaacgcagtgcagcggggagatgctgagatggcacagaaattatatcgcgtgatcagggcatgtgcggaaatgggagagaagaatccaatcatcagcattcatgatcagggagctggaggaaactgcaatgtcgtgaaagaaataatctatcctaagggtgctgaaattgatatccgctcaattgttgttggtgatcacacattgtctgtgttggagatctggggtgctgaataccaggaacaagatgcgttattggtgaagcctgagagcagaaacctgttgcagtcactttgtgatagagagagagtttcaatggctgtccttggtgaaattgatggtagtggaaagattgttttaattgacagtgctgctgtggagcatgcaatgttgagtggccttcctcctccaccgcctgctgttgatcttgagcttgaaaaggttttaggagatatgcctcagaagacctttgctttcaagcgagttcctcgatcgagtgagcccttagacatagcacccgagattacactaatggatgttcttaagcgagtattgaagcttccctcagtatgttcaaagcgtttcttgaccactaaggttgacagatgtgtgacaggtcttgtggcacaacagcagacggttggccctctgcaacttccacttgctgatgttgctgtggttgcacagacatacacagatctgactggtggtgcttgtgccattggagaacaaccaataaagggtttacttaatcctgaggctatggcaaggcttgctgttggggaggcattgaccaatctggtttgggctaaagttacatctcttgctgacgtcaaagcaagtggcaattggatgtacgctgcaaagattgatggagagggagcagatatgtacgatgctgctgtcgcaatggctgactgcatgattcaacttggtattgcaattgatggaggaaaggatagtctttctatggcagctcaatgtgatggcgagctagtcaaagctccaggaaatcttgttatcagtgcttatgtgacatgtcctgatataaccttaacggttactccagatctaaagcttgtgaaagacggggttctgttgcatgttgacctggctaaaggaaagcggcgacttggttgttctgctctcgcacaagcgtttgatcaaattggaaatgactgcccagacatagaagatgtcccttacttgaaaaaggtctttgaggttgttcaagaattgctcagcgaacgtctgatttctgctggtcatgacattagcgatggtgggcttattgtcaccattcttgagatggcatttgctggcaactgtggtgttaacctcaacatagaattaaaagataatgaccttcttcaaacactttttgcggaggagcttggtcttgtaattgaagtgcatttcgatgaccttgatgtagtgaagcaaaaacttcatgcggcaggggtttctgctaatgtgataggagaagttactgcagcaccagaaatagagctacttgttgatggtgaggtgtgtttgaaagaaagaacttcagacctcagagatttgtgggaggaaacaagctttcagcttgaggagctacagcggctgaaatcttgtgtcaagcttgagaaagaaggcttaaaaagccgaacatcaccctcatggcatttgtcttttacgcccaaattcacagacaagaaactactgtctgcatcctcaaaaccgaaggttgccatcattcgtgaagaagggagcaacagtgacagggaaatgtctgctgcattccatgctgctggttttgaaccgtgggatatcacaatgtcggatctcttgaacaaaaaggcttctctaacggaattccgtgggattgcatttgttggtggatttagctatgcagatgttcttgactcagcaaaaggttgggctgcatctatcaggttcaaccagcccctcatacagcagttccaggagttctacaataggccagacacattcagccttggggtgtgcaatgggtgtcagctcatggctcttcttggttgggtaccaggacccgatattggaggctcgcttggtgcaggtggagacatgtcccagccaaggttcactcacaatgaatctggccgttttgaatgtcggtttatcagtgtggccataggggattctccttctataatgttcaaaggtatggaaggctctactttgggcatttggagtgctcatggtgaagggagagccttcttcccagatgaaaatgtcttatctgatgttgtcaattcaaatctggcccctctgaggtactgcgatgatgctaataacgttacagaggtttatcctttcaaccctaatggctctccgcttggtattgcggccctttgctcccccaatggaagacaccttgctctgatgccacacccggagcgttcctttatgatgtggcaatacccatggtatcccaaggagtggcaggttgagaagggtggtcccagtccttggttgcgcatgttccagaatgcaagagaatggtgttcatagagaagggaccaaattggtagctcgtatgtgtgcttagagcttgggcattctgctgtagaactgaacatgatgtggccatggatcaactcaataccatgtctgaaatgttcgggttggaagaacgaaagtgacagacagcagctctcagttcttgaatatttctgctacttattctcaatggacagtgcctgtataggtgctgcgtgcgagcatagttatgtttcactagctgaattgagctatatgcttcttctgcaattattcacctatatccatcatccagtgatattatgctctagcagtctagctgtccggcaacataaaatatatcctgtcagctttcgttctgcggagcatatccattttgtagtattacacagaaatgtaccatgtcgccggttacatattcgggattgtactttcagtttggtgtaacctcaagaaggtaataacacttagacagggtggacaaaagctataactcctggattcatggaattgaggaaggtct

SEQ ID NO: 1502 - DNA, 4211 bp, Secale cereale
gcagcaaactggacagagtattcgcgggcgacctcacgagcgcgccgccgccgccgccgcccgtcagccgtcgctagcgaggttctcggagtatcttaggtttcgtgaatatggcatctcatgctgaaatgacaggaagcaatatgctacgtcttcaaagctttcctagtaatgtgggaaaacaaaggagtagttttatatccacaagacacccttctttgagaaggtcacgagtggttcgtcattgcctgaacctacgtcatctttgccatttacctaatcaaagggctacagttccaaacatccgaccaatgcctgctctcactgctgcagtatccaggggagttagtagtccattgatagaggcatctgtcaatgacatggaattagtttcaaggattattcacttttatcgcaaaccatttcttcaagagagtgaggccaaggagttactcaggaaagtgcaggcaaaggtttcttctaatattattaatataaagactgagcaatgcttcaatgttgagttggaggatgcactaggttctacggagctcgcaacacttcagtggctcctagcagaaacttatgaacctgacaacttacaaacagggagctttctggagaaggaagtttctaggagcccttactgcttccttgttgaggttggtccccggatgacattttcgacagctttctcaaccaatgctgtctcaatttgtaaagctctatcattaatggaagtaactcgcctggagaggtctagaagatatcttttgtgccttcagcctggtagtgacccacttgatgaaagccaactcaacagctttgctgctttgattcatgacaggatgacagagtgtgtttatcctagcaagctcacatcatttcggtcagatgtagttccagaacctgtcagtgttataccagtcatggaaaagggaagggaagcactagaggaaataaatcttaaaatgggtctggcttttgatgaacaagatatcaagtactacactcacctattcagagatgacatcaagcgcaatccaactactgtggaactttttgacatagcgcaatcaaacagtgagcacagcagacattggttttttaatggaaagcttgagatagatggagagaccatgccaagtactttgtttcagttagtaaagagccccttgaaggctaaccctaataactctattattgggttcaaggataactcgagtgcaataaaagggactcttgtaaatcacctacgcccaacactaccaggttccacttcaccgctatccctgatgatgcgtgaactaggcattctgttcacagcagaaacccataattttccatgtgccgtggcaccctacccaggagctgaaacaggtgcaggtggccgcataagggacacacatgccactggaaagggctcatttgttgttgcttcaactgctggttattgtgttggaaaccttcaaattgaagaatcatatgcaccttgggaggattcatcttttgcatacccatcaaacttagcttctccattgcagattcttattgatgctagcgacggtgcttctgactatgggaacaagtttggcgagcctttaattcagggatttacaagaaattttggttctaggttgccaaacggggagcgccgtgaatggctgaagcctataatgttcagtggggcaattgggcagattgaccatgcacacatatcgaaaggggatccagaaattggcatgctagttgtgaagattggtggtccagcttacagaattggtatgggtggtggtgctgcctcaagtatggttagtggacagaatgatgcagagctcgattttaacgcagtgcagcggggagatgctgagatggcgcagaagttatatcgcgtgatcagggcatgtgcggaaatgggagagaagaatccaatcatcagcattcatgatcagggagctggaggaaactgcaatgtcgtgaaagaaataatctatcctaagggtgctgaaattgatatccgctcaattgttgttggtgatcacacattgtctgtgttggagatctggggtgctgaataccaggaacaagatgcattattggtgaagcctgagagcagaaacctgttgcagtcactttgtgagagagagagagtttcaatggctgtccttggtgaaattgatggtagtgggaagattgttttaattgacagtgctgctgtggagcatgcagtgttgaatggccttcctcctccaccgcctgctgttgatcttgagcttgaaaaggttttaggagatatgcctcagaagacctttgatttcaagcgagttcctcgatcgagtgagcccttagacatagcacccgagattacactgatggatgttcttaagcgagtattgaagcttccctcagtatgttcaaagcgtttcttgaccactaaggttgacagatgtgtgacaggccttgtggcacaacagcagacggttggccctctgcaacttccacttgctgatgttgctgtagttgcacagacatacacagatcttactggtggtgcttgtgccattggagaacaaccaataaagggtttacttaatcctgaggctatggcaaggcttgctgttggggaggcattgaccaatctggtttgggctaaagttacatctcttgctgacgtcaaagcaagtggcaattggatgtacgctgcaaagattgatggagagggagcggatatgtatgatgctgctgtcgcaatggctgactgcatgattcaacttggcattgcaattgatggaggaaaggatagtctttctatggcagctcaatgtgatggcgagctagtcaaagctccaggaaatcttgttatcagtgcttatgtgacatgtcctgatataaccttaacggttactccagatctaaagcttccgaaggacggggttctgttgcatgttgacctggctaaaggaaagcggcgacttggttgttctgctctcgcacaagcgtttgatcaaattggaaatgactgcccagacatagaagatgtcccttacttgaaaaaggtctttgaggttgttcaagaattgctcagcgaacgtctgatttctgctggtcatgacattagcgatggtgggcttattgtcaccattcttgagatggcatttgctggcaactgtggtgttaacctcaacatagagttaaaagataatgaccttcttcaaacactttttgcggaggagcttggtcttgtaattgaagtgcatttggatgaccttgatgtagtgaagcaaaaacttcatgcggcaggggtttctgctaatgtgataggagaagtaactgcagcaccagaaatagagctgcttgttgatggtgaggtgtgtttgaaagaaagaacttcagacctcagagatttgtgggaggaaacaagctttcagcttgaggagctacagcggctgaaatcttgtgtcaagcttgagaaagaaggcctaaaaagccgaacatcaccctcatggcatttgtcttttacgcccaaattcacagacaagaaactactgtctgcatcctcgaaaccgaaggttgccatcattcgggaagaagggagcaacagtgatagggaaatgtctgctgcattccatgctgctggttttgaaccgtgggacatcacaatgtcggatctcttgaaccagaagacttctctaacggaattccgtgggcttgcatttgttggtggatttagctatgcagatgttcttgactcagcaaaaggttgggctgcatctatcaggttcaaccagcccctcattcagcagttccaggagttctacaataggccagacacattcagccttggggtgtgcaatgggtgtcagctcatggctcttcttggttgggtaccaggacccgatattggaggctcgcttggtgcaggtggagacatgtcccagccaaggttcactcacaatgaatctggccgttttgaatgtcggtttatcagtgtggccataggggattctccttctataatgttcaaaggtatggagggctctactttgggcatttggagtgctcatggtgaagggagagccttcttcccagatgaaaatgtcttgtctgatgttgtcaattcaaatctggcccctctgaggtactgcgatgatgctaataacatcacagaggtctatcctttcaaccctaatggctctccgcttggtattgcg

SEQ ID NO: 1503 - DNA, 5542 bp, Oryza sativa
gccgtaggaggggctgtgcggcccaacaaggcccatccgcaaagcacgcgacgcgatttgcggaaaaaggccaatttgttcgggaatctcctttttgtgtccgagatgcgcggatggaagcggcgggatcaacgagagccgtcgattgaaaggcgccccgtcattctcgcggatacccacgctcgcccttcccgcgccgccaccgccaccaccgccgccgccgccatcccacccagccacctcctccccgaccgccgccgtagccctccgcgacgccgtcgtcctcctccgcgcgctgcttaccggcctcccaccgcttcctcgagcgtgagctccggcagtcgctgtcccctcctcccgctgcccaactcgaaacaaagcctgcgagcgagggagcgcttggccgcgccgtcctccctccttcacctgtactggatttgtcggcgttgatacggacctggactgattggttccctccaccgatcgtccttttttcacaaaatagatccttggatttcttgaaacatggtatctccgggtgaaatgtcagtaagcaatccattacgcttccaaggctttccttgtaatgtgggaaaaagaaatgttttcattgctgcaaggagttctggactgggaaggtcgcgaattgctcaacagtgctttcagcaacatcatatttgttatccaggtgttcgaagagcttcagttcctaatgtccgaatgctgccagctcctggtgctttggtttccaggggggttgacagttcattggttcccaaaactggtaatgcatcagaagctggagttattcagttatatcgtataccatatcttcaagagagtgaaacaattgagctactcaggcaagttcaagcaaaggtttcttctaatattgtgggtataaagactgaacaatgcttcaacattcaattggacaatgcattaactccagagaagcttgcaacacttcagtggctcttagcagaaacctatgaacctgataagttacaagcacaaagctttttggaggaggaaatctctaggagcccttatagtgtcattgttgaggttggtccccggatgactttttcaacagcgttctcgaccaatgctgtctcaatatgtaaatctctctcgttgatggaagtaactcgcttggagagatcaaggagataccttttgtgcctggatcctggcaatggtccacttgatgaaagccagcttaatgactttgctgctttggttcatgatagaatgacagagtgtgtttatcctaacaagctcacatcatttcattcagatgtagttcctgaacctgtccgtattgttccagtcattgaaaggggaagggaagctttggaagaaataaatgtgaagatgggacttgcttttgatgaacaagatatcaagtactatacccacctcttcagagatgacatcaaaaggaatccaaccactgttgaactttttgatatcgcacaatccaatagtgaacacagcaggcattggtttttcaatggaaagcttgtgatagatggagaaaccatgccgaaaaccttgtttcagttagtgaagagtcccctgaaggccaaccccgataataactctgtcatcggattcaaggacaactcaagtgcaataaagggatacccagcaaatcagctgcgcccaacaattccaggctccacttcaccattatctgttatgatgcgtgagcttgatattttattcacagcagaaacccataattttccatgtgctgtggcaccttacccaggagctgagacaggtgcaggtggtcgcataagagacacacatgccaccggaaagggttcttttgttgttgcttctactgctggctattgtgttggtaatctccgaatggaaggttcatatgcaccctgggaggatccatccttttcatatccgtcgaatttggcctcccctttgcaaattctggttgatgctagcgatggtgcttctgactatgggaataagtttggtgaacctctaattcagggctttactagaaattttgggatgaggctgcttaatggggaacggcgtgagtggctgaagccaataatgtttagtggggcaatcgggcaaatcgatcatgcacacatatctaagggggatccagagattgggatgctagttgtgaagattggtggcccagcatacagaattggtatgggtggtggtgctgcctcaagcatggttagtggacagaatgatgcagagctcgatttcaatgcagtgcagcgtggagatgctgaaatggcacaaaaactatatcgtgtggtcagggcatgtgcagaaatgggagagagcaaccccattatcagcattcatgaccagggtgctggaggaaattgcaatgtagtgaaggaaattatctatcctaagggtgctgaaattgatatacgatcaattgttgtcggtgatcatacattgtctgtcttggagatatggggtgctgagtaccaggaacaagatgcacttctggtgaagcctgagagcagaagcctgttagagtcactttgtgaaagggaaagggtttcaatggctgtcattggtacaattgatggatgtggaaagattgttttgattgacagtgctgctatggagcatgccaagataaatggccttcctcctccaacccctgttgaggatcttgaacttgaaaaggttctaggagatatgccccaaaagacctttgaattcaagcgagtgtctctagtcagcgagcccttagacattgcccctggagtaacaatcatggatgctctgaagcgagtattgagtcttccgtccatatgttctaagcgtttcttaaccacaaaagttgacaggtgtgtgacaggtcttgttgcacaacagcagacagttggacctctccaacttcctctcgcagatgtggctgtgattgcacagacatatactgacttgacaggtggtgcctgtgccattggagaacaaccagcaaaaggtttacttaatcccaaggccatggcaagacttgctgttggggaggccttgactaatctggtctgggctaaagtttcatcactttctgatgtcaaagcaagtggtaactggatgtatgctgcaaagcttgatggagaaggtgcagatatgtatgatgctgctgttgcattggctgactgcatgattcaacttggtattgcaatcgatgggggaaaggacagtctttccatggcagctcaatgtgatggtgaggttgtcaaggctcctggaaatctggtcatcagtgcttatgtgacatgtcctgatataacattgacagtaactcctgatttgaagcttggcaatgatggagttttgctgcacattgacctgggcaaaggaaagcgcaggcttggtggttctgctcttgcacaggcttttgatcaaattggaaatgactgcccagacattgatgatgttccctacttaaagaaagcttttgaggccgttcaggaattgcttagtcagcgccttatctcagctggccatgacattagtgatgggggtcttattgtgagtgttcttgagatggcatttgctggtaattgcggtgttaagctgaacattgactcagaagattcgggccttcttcaagcactctttgccgaggagcttggccttcttcttgaagtgcacttgaaagatctcagtgttgtgaagcaaaagcttgaagcaggaggcatttccgctaatgtaattggacaagttacagcatcaccagatattgagctagttgttgatggcaggctgcatctcaaggaaaaaacttcagatctcagggatatctgggaggaaacaagcttccagcttgaggggctacaacgcctgaaatcttgtgtcagacttgagaaagaaggactaaagcacagaacatcaccatcgtggtctttgtctttcactcccaaatttacagatgaaaaactgctgactgcttcctcaaagccaaaagttgccatcattcgtgaagaagggagcaatggtgatagggagatggctgctgcattctatgctgctggatttgaaccatgggatatcacaatgtcagacctcttagctgggaagtcttctctagaggagtaccgtgggattgcatttgttggtggttttagctatgcagatgttcttgattcagctaaagggtgggctgcatcaatcaggtttaatcagcccctcatacagcagttccagaatttctataataggccagatactttcagccttggagtgtgcaatggttgtcagctaatggctcttcttggctgggtaccaggatcagatgtcggaagttctcttggttcaggtggggacatgtcccagccaagatttattcacaatgaatctggtcgttttgagtgtcggtttacaagtgtctctatagggacctctcctgctatcatgttcaaaggaatggaaggttctacactgggcatttggagtgctcatggtgaggggagagctttcttcccagatgaaaatgttctagctagtgttgtgaactctaacctggctcctgtgcggtactgtgacgatgctaataacattaccgaagtctacccgttcaatcccaatggctctccccttggcattgcagccctttgctcccctgatggaagacatcttgctatgatgccacacccagagcgttgcttcatgatgtggcaatatccatggtatcccaaggaatggcagcttgagaagtgtggtcccagtccctggctgcgcatgttccagaatgccagagaatggtgtttgtagtgcaggtacctaattgatggccatatgatgaatataaaagcttggagctgtggactcatttggataccgaaacgtggtgatatcagatgctggtgcgatgcgctcagcagtcagcattgttgttactgaggatcgaataaatgggttcagcgaaataattaaaagcagattttatgattctttcttgcagctctgaatcttgctgctggtttgaaactaggaatcctgtaaggctagtagtgttttattaggcagaggtgaggaggcctcaggcctgcaatgctgttaatgagaataatcctgttggccctgcagtgctgctttgagaatactatagcagaacaggacacatgcccataatgtgttgttcgattgtcccatgatactgtcatctttcttctatggctatccgttttccaccatttgtcctcatgcttttaccatgcatgcattctgaatgatatcattaatctggagtagataatgtcctgataggttgatagtgagttagtgacatcggattgtactgtaaccgatactagttgatgcagtattatggcaggcttctgctgggtttgtcaactgggaaggaggcagcgccaattcgacaaggatatattatgtattcaaagttgctcattggtcaagcctgtaggagtatctatttacctttggactctgcagttgcatactctcttattaatagtatctgtcggggttgatgatcctgcagggtgcaggatgcagggagttcctt

SEQ ID NO: 1504 - DNA, 6750 bp, Oryza sativa
actcgtttcattctcgctcgctgtcgcccgccccttcccgcgccgccaccgccgccgccgccgccgccgccgccatcccactagcccaccacctcctccgcgcgctgctaccgccagccctcccaccgcttactctttctgtccacctcccgctgcgtcacgggtacacctcgaaccgctcagccgccgttcctatctccccggtccccctttatatattatctcccgttgcttgctgtcaagaatcgaatccaatagacttcaagttcgatcaaatcatcctttttttttcttcacaaaagtgatccttggatttcttcaaacatggcatctccgggtgaaatgtcagtaagcaatccattacgcttccaaggctttccttgtaatctgggaaaaagaaatggtttcattgctgcaaggagttctggactgagaagatctcagcagtgcttccatagacacctttgttggccaggtgttcgaagagcttcagttcctaatgtccgattgctgccaactcctggtgctttggtttccaggggacttgacagttcattggttcacaaatctgataatgcatcagaagctggagttattcaattatatcgtataccatatcttcaagacagtgagacaattgagctgctcaggcaagtgcaagcaaaggtttcttctaatattgtgggtataaagaccgaacaatgcttcaacattcaattggataatgcattagcttcagagaagcttgcaacactgcagtggctcttagcagaaacctatgaacctgataagttacaagcacaaagctttctggaggaggaagtcgctaggaacccttatagtgtcattgttgaggttggtccccggatgactttttcaacagcgttctcaaccaatgccgtctcaatatgtaaatctctctcattgatggaagtaactcgcttggagagatcaaggagataccttttatgcttggatcctggctatggtccacttgatgaaagccagcttaacgactttactgctttggttcatgatagaatgacagagtgtgtttatcctaagaagctcacatcatttcattcagatgtagttcctgaacctgtccgtattgttccagtcattgaaaggggaagagaagctctggaagaaataaatgtgaagatgggacttgcttttgatgaacaagatatcaagtactatacccacctcttcagagatgacatcaaacggaacccaaccactgttgaacttttcgacattgcacaatccaacagtgagcacagcaggcattggttttttaatggaaagcttgtgatagatggagagaccatgccgagaaccttgtttcagttagtgaagagtcccctgaaagctaaccccgataataactcagtcatcggatttaatgacaactcaagtgcaataaagggatatccagcaaatcagctacgcccaacagttccaggctccacttcaccattatctgttatgatgcgtgagcttgatattttattcacagcagaaacccataattttccatgtgctgtggcaccttatccaggagctgaaacaggtgcaggtggtcgcataagggacacacatgccactggaaagggttcttttgttgttgcttctactgctggctattgtgttggtaatctccgaattgaaggtgcatatgcaccctgggaggatccatccttttcatatctgtcgaatttggcctcccctttgcaaattcttattgatgctagcgatggcgcttctgactatgggaacaagtttggtgaacctctaattcagggatttactagaaattttgggacgaggttgcttaatggggaacggcgcgagtggctgaagccaataatgtttagtggggcaatcgggcaaattgaccatgcacatatatctaagggggatccagaaattggcatgctagttgtgaagattggtggcccagcatacagaattggtatgggtggtggtgctgcctccagcatggttagtggacaaaatgatgcagagctcgatttcaatgcagtacagcgtggagatgctgaaatggcacagaaattatatcgtgtggtcagggcatgtgcggaaatgggagagagcaaccctatcatcagcattcatgaccagggtgctggaggaaactgcaatgtggtgaaggaaataatctatcctaagggcgctgaaattgatatacgatcaattgttgtcggtgatcatacattgtctgtcttggagatatggggtgctgagtaccaggaacaagatgcacttctggtgaagcctgagagcagaagccttttagagtcactttgtgaaagggaaagggtttcaatggctgtcattgggacaatcaatggatgtggaaagattgttttgattgacagtgctgctgtggagcatgcgaagttaaatggccttcctcctccaacccctgttgaggatctcgagcttgaaaaggttctaggagatatgccccaaaagacctttgaattcaagcgagtctctgtagtcagtgagcccttagatattgcccgtggagtaacaatcatggatgctctgaagcgagtattgagtcttccatctgtatgctctaagcgtttcttaaccacaaaagttgacaggtgtgtgacaggtcttgttgcacaacagcagacagttggacctctccaacttcctcttgcagatgtggctgtgatcgcacagacatacactgatctaacaggtggtgcctgtgccattggagaacagccaacgaaaggtttacttaatcccaaggccatggcaagacttgctattggggaagccttgactaatctggtttgggctaaagtttcatcactttctgatgtcaaagcaagtggtaactggatgtatgctgcaaagcttgatggagaaggtgcagatatgtatgatgctgctgttgcattggctgactgcatgattcaacttggtattgcaattgatgggggaaaggacagtctttccatggcagctcaatgtgatggtgaggtcgtcaaggctcctggaaatctggtcatcagtgcttatgtgacatgtcctgatataacattgacggtaactcctgatttgaagcttggcaaggatggagttttgctgcacattgacctcagcaaaggaaagcgccggcttggtggttctgctcttgcacaggcttttgatcaaattggaaatgactgcccagacattgatgatgtcctgtacttgaagaaagcctttgaggccgttcaggaattgcttggtgagcgtcttatttcagctggccatgacattagtgatggaggtcttattgtgagtgttcttgagatggcatttgctggtaattgcggtgttaagctgaacattgactcagaagattctagccttcttcaagcactatttgccgaggagcttggccttctacttgaagtgcatttgaaagatctgagtgttgtgaaacaaaagcttcaagcaggaggcatttccgctaatgtaattggaaaagttacagcatcaccagatattgagctggttgttgatggcaggctgcatcttaaggaaaaaacttcagatctcagggatatctgggaggaaacaagcttccagcttgaggggctacaacgtctgaaatcttgtgtcagacttgagaaagaaggattaaagcacagaacatcaccatcatggtctttgtctttcactcccaaatttacagatgaaaaactgctgactgcatcctcaaagccaaaagttgccatccttcgtgaagaagggagcaatggtgatagggagatggctgctgcattctatgctgctggattcgaaccatgggatatcacaatgtcagacctcttagctgggaagtcttctctagaggattaccgtgggattgcgtttgtcggtggttttagctatgcagatgttcttgattcagctaaaggttgggctgcatcaatcaggtttaaccaacccctcatacagcagttccagaatttctacaataggccggacactttcagccttggggtgtgcaatggttgtcagctaatggctcttcttggctgggtaccaggatcagacgttggaggttctcttggttcaggtggggacatgtcccagccaagatttattcacaatgaatctggtcgttttgagtgccggtttactagtgtctctataggggcctctcctgctatcatgttcaaaggaatggaaggttctacaatgggcatttggagtgctcacggtgaggggagagctttcttcccagatgaaaatgttctagctagtgttgtaaagtctaacctggctcctgtgcggtactgtgacgatgctaataacataactgaagtctacccattcaatcccaatggctctccacttggcattgcagccctttgctcccctgatggaagacatcttgctatgatgccacacccagagcgttgcttcatgatgtggcaatatccatggtctcccaaggattggcagcttgagaagagtggtcccagcccctggctgcgcatgttccagaatgctagagaatggtgttcataatgcagaagcttggagctatggactcttttggatacttaaaccttgctggttcgatgcactcagcagtcagcattgttgttaccgaggatcgaataagtgggttcatcgaaataattaaaagcagattctgtgattcttgcttgcagctttgagttttgctgctggtttgaaactaggaatcctgtaagggtagtagtgttttattaggcagaggcgaggaggcctcaggcctgcaatatgctggtaatgagaataatcatgttggcgctgcagtgctgctttgggaattctttgactagcagaagaggatacatgcccgtaattaaatgtaatgtgttgttcgattatccggtgatactaaatgtcatctttcttctgtggctatccttttcaggttctgctattggatgcgcagcaatttgcagtcctgctgttgatgaaccgtattgtcgaaggtaatatgggattatggattgttgattttacaggtgtagatttacatttgattgtacgcttgtttaccggttactgtcagtggcttttgggggttttgtgttgttgtttgaccacccaacccaacaccaagaggtttcatttcaccgtgcgatcgatacatatggggatagacacaagagaattggagaagtcaaaaagttttttaagcatttgggatgaattagtaatagaacttgtgtgctgagttgtttcagggactaaatatcttgtgtgctggattgtcgtgcacttgtgttcaaataatgcaggtagaagtagaacaaggcacttggggcaggaggacacaaattgtagaatgcgtcgtttgattgttttgttcaaagcggttggcgccaaactccttccatctgaacaactcgccaatctgattactccctctccgtctacatatatatacccccacacccacatcgttcaagataagctgagacaaaatcgatcggaggtcgaaatggtgcgcgccatcgggcccctgctcctgctcgcccacgtgctcgtgttcgtggtgtccattgcggcggcggcggcgcccgtgcgacggccacgctgcgacgccggcgaccgcgccgcgctactcgccgtgaaggcggccttcaacaacgcgtcctacttccagtcctggacgcccgacatcgcctgctgccactggtacggcgtcgactgcggcggcgacgactacgactacgaccccaccgacggcgaccgcgtcctcagcctcgccatcatacgcgatgacaacgtcaccggcggcataccaggcgacgccatcgcccgcctcacccgcctccaggagctcatgttcttcaaggtccccggcgtcaccggccccatccccgccgcgctcgccacgctcaccgccctcagggagctcaccatctcccgcaccgccctctccggctccatcccttccttcatcggcgacaagttcaccgcgctccagtctctcgacctctccttcaactcgctcaccggcgccatcccggcgagcctcgccaagcccccgaagctcatctccatcgacctcagccgcaaccagctcaccgggagcatcccgcggctgctgctgagcaaggccgggcagcaagcgttcctgacgctgtcacacaacaacctgtccgggaggatcccggcggcgttcggcgccgtcaacttcgtgcagatcgacctgtcgcgaaaccagctcaccggcgacgcgtcgatgctgttcgggtcggggaagaaggagctcggcagcgtctacctgtcgcgcaacgcgctgagcttcgacatgtcggagctgcggctgccggagcggctgagcttcctggacgtgagccacaacgccatccgcggcggcatcccggcgcaggtggcgaatctgagcaacctgcagctgctcaacgtcagctacaacaggatgtgcggcgaggtgcccaccggcggcaacatggcgaggttcgacgcctactgcttccagcacaacaagtgcctctgcggtgcgccgctcgccgcctgccattgatgtttgatccagaccttgaaactgtaaccactactgtactgtagtaataatcactgagcaataccaaaaactataggataaattaatgaagaagcaaccagctaatgctaataattaaggtccattcttgatgaacatgagtgaaatttagtgtcaatcaa

SEQ ID NO: 1505 - DNA, 4329 bp, Triticum aestivum
aagcttgcaacacttaagtggctcctagcagaaacttatgaacctgacaacttacaaacagggagccttctggaggaggaggtttctatgagtccttattccttccttgttgaggttggtccccggatgacattttcgacagctttctcgactaatgctgtctcaatttgtaaagctctatctttaatggaagtaactcgcctggagaggtctagaagatatcttttgtgccttcagcctggtagtgacccacttgatgaaagccaactcaacagctttgctgctctggttcatgacaggatgacagagtgtgtttatcctagcaagctcacatcattccggtcagatgtagttccagaacctgtcagtgttataccagtcatggaaaagggaagggaagcactggaggaaataaatcttaaaatggggctggcttttgatgaacaagatatcaagtactacactcacctcttcagagatgacatcaaacgcaatccaactaccgtggaactttttgacatagcgcaatccaatagtgagcacagcagacattggttttttaatggaaagcttgagatagatggagagaccatgccaagtactttgtttcagttagtaaagagtcccttaaaagctaaccctaataactctattattggattcaaggataactcgagcgcaataaaagggacccttgtaaatcacctacgtccagcactaccaggttccacttcaccgttatcccttatgatgcgtgaactgggcattctgttcacagcagaaacccataattttccatgtgccgtggcaccctacccaggagctgaaacaggtgcaggtggtcgtataagagacacgcatgccactggaaaaggttcatttgttgttgcctcaactgctggttattgtgttggaaaccttcaaattgaagaatcatacgcaccttgggaggattcatccttttcatacccatcaaacttagcttctccattgcagattcttattgatgctagcgacggtgcttctgactatgggaacaagtttggcgagcctttaattcagggatttacaagaaattttggttctaggttgccaaatggggagcgccgtgaatggctgaagccaataatgttcagtggagcaattgggcagattgaccatgcacacatatcgaaaggggatccagaaattggcatgctagttgtgaagattggtggtccagcatatagaattggtatgggtggtggtgctgcctcaagtatggttagcggacagaatgatgcagagctcgattttaatgcagttcagcggggagatgctgagatggcacagaaattatatcgtgtgatcagggcatgtgcagaaatgggggagaagaatccaatcatcagcattcatgatcagggagctggaggaaactgcaatgttgtgaaagaaataatctatcctaagggtgctgaaattgacatccgctcaattgttgttggtgatcacacattgtctgtgttggagatctggggtgctgaataccaggaacaagatgcattattggtgaagcctgagagtagaaacctgttgcagtcactttgtgagagagaaagagtttcaatggctgtccttggtgaaattgatggtagtggaaaaattgttttgattgacggtgctgctgtggagcatgcgaagttgagtggccttccgccaccactacctgttgttgatcttgagcttgaaaaggttttaggagatatgcctcagaagacctttgaattcaagcgcgtttctcgatcgagtgagcccttagacatagcacccgaggttacactgatggatgttcttaagcgagtattgaagcttccctctgtatgttcaaagcgtttcttgaccactaaggttgacaggtgtgtgacaggtcttgttgcacaacagcagacggttggccctctccaacttccacttgctgatgttgctgtaattgcacagacttacacagatcttacaggtggtgcttgtgccattggagaacaaccgataaagggtttacttaatcctgaggccatggcaaggcttgctgttggggaggcattgaccaatctggtttgggctaaagttacatctcttgctgacgtcaaagcaagcggcaattggatgtatgctgcaaagattgatggagagggagcagatatgtatgatgctgctgtcgcaatggctgactgcatgattcaacttggtattgcaattgatggaggaaaggatagtctttctatggcagctcaatgtgatggcgagctagtcaaagctccaggaaatcttgttatcagtgcttatgtgacatgtcctgatataaccttgactgttactccagatctaaagcttgggaaggatggggttctgttgcatgttgacctggctaaaggaaagcgacgacttggttgttctgctctcgcacaagcatttgatcaaattggaaatgactgcccagacatagaagatgtcccttacttgaaaaaggtctttgaggttgttcaagaattgctcagtgaacgtctgatttctgccggtcatgacattagtgatggtgggcttattgtcactattcttgagatggcatttgctggtaactgtggtgttaacctcaacatagaatcaaaagataatgaccttcttcaaacactttttgcggaagagcttggtcttgtaattgaagtgcatttggatgaccttgatctagtgaagcaaaaacttaatgcagcaggggtttctgctgatgtgataggacaagtaactgcagcaccagaaatagagctacttgttgatggtgaggtgcgtttgaaagaaagaacttcagacctcagagatttgtgggaggaaacaagctttcagcttgaggagctacagcggctgaaatcttgtgtcaagcttgagaaagaaggcttaaaaagccgaacatcccctttatggcatttgtcttttacgcccaaattcacagacaagaaactactgtctgcatcctcgaaaccgaaggttgccatcattcgcgaagaagggagcaacagtgatagggaaatgtctgctgcattccatgctgctggttttgaaccgtgggacatcacaatgtcggatctcttgaaccaaaaggcttctctaacggaattccgtgggatcgcatttgttggtggatttagctatgcagatgttcttgactcagcgaaaggttgggctgcatctatcaggttcaaccagcccctcatacagcagttccaggagttctacaataggccagacacattcagccttggggtgtgcaatgggtgtcagctcatggctcttcttggttgggtaccaggacccgatattggaggctcgcttggtgcaggtggagacatgtcccagccaaggttcactcacaatgaatctggccgttttgattgtcggtttatcagtgtggccattggggattctccttctataatgttcaaaggtatggaaggctctacactgggcatttggagtgctcatggtgaaggtagagccttcttcccagatgaaaatgtcttgtctgatgttgtgaaatctaatctggcccctctgaggtactgtgatgatgctaataacgtcacagaggtctatcctttcaaccctaatggctctccgcttggtattgcggccctttgctcccctaatggaaggcaccttgcgctgatgccacatccggagcgttcctttatgatgtggcaatacccatggtatcccaaggagtggcaggttgagaagagtggtcccagtccttggttgcgcatgttccagaatgcaagagaatggtgttcatagataagggaccaaaattggtggcccgtatgtctgcttagagcttgggcattctgctgtagaactgatgtggccatggaccaactcaatactatgcctgtgaaattatcacggtcgaagagctcaagtgacagacatcatttctcagttctttgagctggaatatctgtgctacttattctcaattggacagtgcctgtacaggcgctgcctgcgagcataattatgtttcactagctgaattgagctatatgcttcttctgcaaccattcgccttatccaataataccatgctctagctgtccggcaacataaaatgtatcctatcagctttctttctgctgagcatatccattttgtagtgttgcccgttacatatttgggattatggtttcagtttggggtatccttaagaggacaacatttacacattgttgacaaaagctcattgctcgcgagcttaactagcgctgggtagtttgacttgttaaccttgtagcttac

SEQ ID NO: 1506 - DNA, 4952 bp, Sorghum bicolor
ggcatctttgccttccctttttctcctccccttttctctcgcgctcgcagcggcggcggctgcttctccagttctccgtctcctgcttcaccgcaagcttgtctcctcgtattcggcgcgccgccggggaacactcccggcctccgcccgagcgaagcgaagcgtagtggagcggagcggagcggagcgttccggccgcgcctccgaggagttcatttcacggtgctgttgtcctactcgtcctttttcccgtctggcttgactggcgcgttgattcctgcgtctttcgttgatctcccattctcttttgacaagaaataaaaaataaaaatcctgtggtttgggatggcatcacctggccaaatgacggcaagcaatctgttacggactgaaggctttcctggaaatatgggaaaaagatgtggtttaattcctgcgagaagtcttgggtcaagaagattgcgaatgactcaacactgcttccatcaacagcatatttgttggccacgtctacaaagagttatgactcgtaatatccgattgccatcatctcctggggccgtggcatccaaggggtttgacagtccattagttgagaaacctgatactgcgttggatgttggaattattcacctgtaccgtatcccatttcttcaaggaagtgaaaccatggagctgctcaggaaagtgaaggcgaaggtttctgctaatattgttgatatactgactgagcagtgcttcaacattcaattggacaatccactcactcctgagaagctttcaacgcttcattggctcttagcagaaacttatgaacctgagaagttgcaaactaggagctttctggaggatgaagaatctagaaattcttgtactgtcattgttgaggttggtccccggatgacattttcaacagcattctcgaccaatgctgtctcaatttgtaaatctctctcgttagtagaagtaacacgactggagagatcaagaagataccttttgtgccttgagcctggtagtgacccacttgatgaaagtcagctcaaagaattcactgcattggttcatgatagaatgacagagtgcatttatcccaacaagctcacatcatttcaatcagatgtagttcctgaacctgttcatgttgttccagtcattgaaaggggagaaaaagcattggaagaaataaatgtgaggatgggacttgcttttgataaacaagatattgactactatacacacctcttcagagatgatattaaacgcaatccaactaccgtggaactttttgatattgcacaatccaatagcgaacatagcagacattggttttttaatggaaagcttgtaatagacggagagatcatgccagccactttgttccagttagtgaagagtcccctgaaagccaaccccaataactctgtcatcggattcaaggataactcgagtgcaataaaaggattcccagtaaatcagctacgcccaacaattccaggtttcacttcaccattatccattatcatgcgtgagctagatattttattcacagcagaaacccataattttccatgtgctgttgcaccataccctggagctgagacaggtgcaggtggacgtataagggacacacatgccactgggaagggttcatttgttgttgcatccactgctggttactgtgttggtaatcttcgaattgacaattcaaatgcaccctgggaggacccttcattttcttacccagtgaatctggcctctccattgcaaattcttgttgatgctagtgatggtgcatctgactatgggaacaaatttggtgagcctctaattcagggatataccagaacatttggaatgaggttgctaaatggggagcggcgtgaatggttgaagcctataatgttcagtggagctatagggcaaattgaccatgcacacatatcaaaggatgacccagaaattggcatgctagttgtgaagattggtggtccagcgtaccgaattggcatgggtggtggtgctgcctcgagtatggttagtggccagaatgatgcagagcttgatttcaatgcagtacagcgtggagatgccgagatggcacagaaattgtatcgtgtagtcagggcatgtgcagaaatgggagagagcaatcctatcatcagcattcatgatcagggtgcaggaggaaattgtaatgttgtgaaggaaataatatatcccaagggagctgaaattgatatccgttcaattgttgttggtgatcatacattgtctgtcttggagatatggggtgctgagtaccaggaacaggatgcactacttgtgaaacctgagagcagaagcctgttagaatcgctttgtgagagggaaagagtttcaatggctgtcattgggaaaattgatggctgtggaaaaattgtgttgattgatagcgctgctgtggagcattcaaagctgaatggcctccctcctccaacccctgttgaagaacttgagcttgaaaaggttttaggagatatgcctcagaagacctttgagttcaggcgtgtttctcaagtcacagagcctttagacattgcacccggggttacactactagatgctctgaagcgagtattaaggctcccatccgtttgttcaaaacgtttcttgaccactaaggttgataggtgtgtgacaggtcttgttgcacaacagcagacagttgggcctctccaactcccgcttgctgatgtggctgtgattgcacagacgtacacagacctaacaggtggtgcttgcagcattggagaacaaccaataaagggtttgcttaatcctaaggccatggccagacttgctgttggggaggccttgactaatcttgtttgggctaaggttacatcacttgctgatgtcaaagcaagcgggaattggatgtatgctgcaaagcttgatggcgaaggtgcagatatgtatgatgcagctgttgcattggctgactgcatgattgaacttggtattgcgatagatgggggcaaggacagtctttccatggcagctcaatgtgatggtgaagtcgtcaaggctcctggaaatctggtcatcagtacttacgtgacatgtcctgatataacattgacagtaacccctgatttgaagctcggtaaggatggagttcttctgcatattgatcttgctaaaggaaatcgccgtctcggtggttctgctcttgcacaagcatttgatcaaattggaaatgattgcccggacattgatgatgttctgtacttgaagaaggtatttgaggccattcaggaattgctcagtcaacgtcttatttcagcaggtcatgacataagcgacggtggccttattgtgagtgttcttgagatggcatttgctggtaactgtggttttaagctcgacatagacttagaagataggagccttattgaaggactttttgcagaggagcttggcctcattattgaagtacactcaaaatatctcaacattgtgaagcaaaagcttgaaatagcaggcatttccgctaatgttattggagaagttactacttcaccagaaatagaagtttttgttgatggtaatctgcatctcaaggaaaaaacttcggatctcagggatctgtgggaggaaacaagcttccagcttgaggagctacaacgtctgaaatcttgtgtcaaacttgagaaagaaggactaaaatgcaggacatcaccatcatggtctctgtcttttacccccaaattcacagatgggaaactgctgactgcttcctcgaaaccaaaggttgccatcattcgtgaagaagggagcaatggggacagggagatggctgctgcattccacgctgctggatttgaaccatgggatattacaatgtcagacctcttggctgggaagtcttctctcaaggagttccgtgggattgcgtttgttggtggtttcagctatgcagatgtgctggattcagcgaaaggctgggctgcatcaatcaggtttaaccaacccctcattcagcaattccaggacttctaccataggccagacacatttagccttggagtatgtaatggttgtcagcttatggctcttcttggctgggtgccaggaccacgtgttggaggttctcttggtacaggtggagatatgtcccagccgagatttattcacaatgaatctggtcgttttgagtgccggtttaccagtgtgtccattggcgattctcctgctattatgttcaaagggatggaaggttccaccttgggtgtttggagtgctcatggcgagggaagagctttcttcccagatgaaaatgttctagctactgttgtgaagtctaatctggttcctgtgcggtattgtgatgattctaacaatattactgagacctatcccttcaatcctaatggttctccactaggtatagcagccctttgctcacctgatgggaggcacctggctatgatgccgcatccagagcgttgcttcatgatgtggcaatatccctggtatcccaaggaatggcaggttgagaagagtggccccagcccttggctgcgaatgttccagaatgctagagaatggtgttcgtagtgcagggcagcttcctgctgcaaggatgtagtcaccgaggcaccagctgttagagtgtatggataattgatggttgtatggccccatttgatgacccctttttggcggaataaatgtgttttcaccatcaaacacattatcttgtaataaatgtatcaaaaatgaaattttgaaaaatggagaactgtttggttttcgctagtcggtgagggcccagatcttgagtccatatcctgatgatggttatcaatgacacgatgaataccccatcctgccatccatggatcagcatgtcatcgcttgtcctttttcttgcatataagattaaatttactcttattcgtccgggg

SEQ ID NO: 1507 - DNA, 4566 bp, Setaria italica
taaaaaccattgggtttgggatggcatcacctggacaaatgatggcgagcaatctgttacgcaccgaaggctttcctggaaatatgggaaaaaaatctggtttaattgctgcgagaagtcttggatcaaggagattgcgaatgactcgacactgctttcatcaacagcatctttgttggccacgtgcactgagagttgcggttcataatatccgattgtcgtcatgtcctggtgccgtggtatcgaaggggtttgatagtccattagttgacaattctgatactgcattggatgttggaattattcatctctaccgtataccatttctccaagaaagtgaaaccatggagctgcttaggaaagtgaaggcgaaggtttctgctaatattgttgatataatgaccgagcagtgcttcaacgttcaattggacaatccacttacttctgagaagctttcaactcttcactggctcttagcagaaacttatgaacctgagaaattgctaacgaggagctttctggaggaggaagtttctggaagttcttgtactgtcattgttgaggttggtcccagaatggcattttcaacagcattctcaaccaatgctgtctcaatatgtaaatctctctcattagtagaagtgactcgactggagaggtcaagaagataccttttgcgccttgagcctggtagtggcccacttgatgaaaatcagctcaaagaatttgttctattggttcatgacagaatgacagagtgtgtttatcccaacaagctcacatcatttcagtcagaggtagttcctgaacctgtccgtgtagttcccgtcattgaaagaggaaaagaagcattggaagaaataaatgtgaagatggggcttgcttttgataaacaagatattgactactatacacatctcttcagagacgatattaaacgcaatccaactactgtggaactttttgatattgcacaatccaatagtgaacatagcagacattggttttttaatggaaagcttgtaatagatggagaaaccatgccaaacactttgttccagttagtgaagagacccttgaaggccaacctcaataactctgtcattggattcaaggataactcgagtgcaataaaaggattcccagtaaatcagctacgcccaacaattccaggttccacttcaccattatccattatgatgcgtgagcttgatattttattcacggcagaaacccataattttccatgtgctgttgcaccataccctggagctgagacaggtgcaggtggccgcataagagacacacatgccactggaaagggttcttttgttgttgcttccactgctggttactgtgttggtaatcttcgcattgacaatgcgtacacgccctgggaggacccttcattttcttacccagtgaacctagcctctccattgcgaattcttgttgatgctagtgatggtgcatctgactatgggaacaagtttggggagcctctaattcagggatataccagaacatttgggatgaggttgctaaatggggagcggcgtgaatggttgaagccaataatgttcagtggagctattgggcaaattgaccatgcacacatatcaaagggtgatccagaaattggcatgctagttgtgaagattggtggtccagcatacagaattggtatgggtggtggtgctgcctcgagcatggttagtggccagaatgatgcagagttggatttcaatgcagtacaacgtggagatgctgaaatggcacagaaattgtatcgtgtggtcagggcatgtgcagaaatgggagagaacaaccccatcatcagcattcatgatcagggcgcaggaggaaattgtaatgttgtgaaggaaataatatatcctaagggtgctgaaattgatatccgctcgatcgttgttggtgatcatacattgtctgtcttggagatatggggcgctgagtaccaggaacaggatgcactacttgtgaaacctgagagcagaagcttactggaatcgctttgtcagagggaaagagtttcaatggctgtcattgggaaaattgacggctgtggaaaaattgtgttgattgatagtgctgctatggagcatgccaagttaaatggtctccctcctccaacccctgttgaagaacttgagcttgaaaaagttctaggagatatgcctcagaagacctttgagttcaagcgtgtttctcaagtcacagagcctttagacattgcaccagaggtaacactactggatgctctgaagcgagtattaaggctcccctctgtgtgttcaaagcgtttcttgaccacaaaggttgataggtgtgtgacaggtcttgttgcacaacagcagacagttgggccactccaacttccacttgctgatgtggctgtgattgcacaaacgtacacagaccttacaggtggtgcttgcagcattggagaacaaccaataaagggtttgcttaatcctaaggccatggccagacttgctgttggggaagccttgactaatcttgtttgggcgaaggttacatcacttgctgatgtcaaagcaagtgggaattggatgtatgctgcaaagcttgatggcgaaggtgcagatatgtatgatgcagctgttgcacttgctgactgcatggttgaacttggtattgcaatcgatgggggaaaagacagtctttccatggcagctcaatgtgatggtgaggtcgtcaaggctcctggaaatctggttattagtacttatgtcacatgtcctgatataacattgacagtaactcctgatttgaagctcgggaaggatggaattcttcttcatattgaccttgctaatggaaatcgccgtcttggtggttctgctcttgcacaagcatttgatcaaattggaaatgattgcccggatgttgatgatgttgggtacttgaagaaagtattcgaggccattcaggaattgatcactcaacgtcttatttcagcaggccatgacataagtgatggtggccttattgtgagtgctcttgaaatggcatttgctggtaattgtggttttaagctggacatagacttggaaggtaggagccttcttgaaggactttttgcagaggagcttggccttgttattgaagtgcactcagaatatctcgatatcgtgaagcaaaagcttgaagcagctggagtttccgctaatgtaattggagaagttactagctcaccagaaataaaagtttttgttgatggcaatctgcatctcaaggaaaaaacttcggatctcagggatctctgggaggaaacgagtttccagctggaggagttacaacgcctgaaagcttgtgtcaaacttgagaaagaaggactgaaaatcagaacatcgccatcgtggtctctgtctttcactcctaaattcactgatgagaaactgttgattgcatcctcgaaaccaaaggtcgctatcattcgtgaagaagggagcaatggggacagggaaatggctgctgcattccatgctgctggattcgaaccatgggatatcacgatgtcagacctcttggctgggaagtcttctctaacagagttccgtgggattgcatttgttggtggtttcagctatgcggatgtgctggattcagcgaaaggttgggctgcatcaatcaggtttaaccaacccctcattcagcaatttcaggatttctaccataggccagacactttcagccttggagtatgcaacggttgccagcttatggctctgcttggctgggtgccaggatcagatgttggaggttctcttggtataggtggagatatgtcccagccgaggtttattcacaatgaatccggtcgttttgagtgtcggttcaccagcgtgtccattgggaattctcctgctatcatgttcaaagggatggaaggttctaccttgggtgtttggagtgctcatggcgagggaagagctttcttcccagatgaaaacgttcttgctactgttgtgcagtctaatctggctcctgtgcgatattgcgatgatgctaacaatataactgaaacctatcccttcaatcccaatggttctccactaggcattgcagccctctgctcccctgatggaaggcacctcgccatgatgccacacccagagcgttgcttcatgatgtggcaatacccatggtatccaaaggaatggcaggttgaggagagtggccccagcccttggctgcggatgttccagaatgctcgggaatggtgttcatagtgcagcttgccggaattcggttacaagttggactagtatttcaggagtgcagacgtgcaatgtctggctgcagagatttggcgtcactggctattgttggtttatggctatctggtctcatttgaggacctcttttggcgaaataattgtatttgactgatcaataatcaattgttgaattgctcgaattcgaaatactgacgaatggatgacagcctgttcggtcagggcctggaacttaagtgttcgctaatcctataataacgttactgagcctggtgaatttgtc

SEQ ID NO: 1508 - DNA, 4975 bp, Panicum virgatum
gccggccgtcgccttgagcccccagctgctagcggtcgtcgcctccagttgccagcggccagcgcccgaccgctcggcgctcgtcgcttgcgcccccgcgcgcaggccgcgtcgcgctcgcggctcgagcacgcgcaagggccagacttcggtcgcctgccgcgcgcgccgagcaagcgcagccgcgcagggccgcagggggcagggttgccgtgctgcacagggctgccgcgcacgtgcactcgcacacaaagcagagcaagaagccagcctgagaagtgaaccaaggtctcctgttcatttcgtcactaaaaatctttgggtttgagatggcatcacctggccaaatgacggcaagcaatctgttacacaccaaaggctttcctggaaatatgggaaaacaatatggtttaattggtgctcgaagtcttgggtcaagaagtctgcgaatgagtcaacgctgctttcatcagcagcatctttgttggccacgtgcacaaagagttatggttcgtaatatcagaatgtcatcatctcctggcactgtggtatccgaggggtttgacagtccattagttgagaaatctgattctgcattgaatggtggaattattcacttgtaccgtataccatttcttcaagaaagtgaaaccatggagctgcttaagaaagtgaaggccaaggtttctgctaatattgccgatataatgactgagcagtgcttcaacattcagttggacaatccacttactcctgagaagctttccacgcttcactggctcttagcagaaacttatgaacctgagaagttgcaaactaggagctttctggaggaggaagtgtctagaatttcaagtgctgtcattgttgaggttggtccccggatgacattttcgactgcattctcatccaatgctgtctctatctgtaaatctatctcattagtagaagtggctcgactggagagatcaagaagatatcttttgcgccttgagcctggtagtgacccgcttgatgaaagtcagctcaaagaattctctgcgttggttcatgatagaatgacagagtgtgtctatcccaacaagctcacatcatttcagtcagatgtagttcctgaacctgtccgtgttgttccagtcattgaaaggggaaaagaagcattggaagaaataaatgtgaagatggggcttgcttttgataaacaagatattgactactatacacacctcttcagagacgatatcaaacgcaacccaactactgtggaactttttgatattgcacaatccaatagtgaacacagcagacattggttttttaatggaaagcttttaatagatggagaaaccatgccaaacactttgttccagttagtgaagagacccttgaaggccaaccccaataactctgtcattggattcaaggataattcgagtgcaataaaaggattcccagtaaatcagctgcgtccaacaattccgggttccacttcaccattatccatcatgatgcgtgagcttgatattttattcacagcagagacccataattttccatgtgctgttgcaccataccctggagccgagacaggtgcaggtggccgtataagagacacacatgccactgggaagggttcatttgttgttgcttccactgctggttactgtgttggtaatcttcgaattgaaagttcatacgcaccctgggaggacccttcattttcttacccagtgaacctagcatctccattgcaaattcttgttgatgctagtgatggggcgtctgactatgggaacaagtttggtgagcctctaattcagggatataccagaacatttgggatgaggttgctaaatggcgagcggcgtgagtggttgaagccgataatgttcagtggagctattgggcaaattgaccatgcacacatatcaaagggtgatccagaaattggcatgctagttgtgaagattggtggtccagcatacagaattggtatgggcggtggtgctgcctcaagtatggttagtggccagaacgatgcagagcttgatttcaatgcagttcagcgtggagatgctgagatggcacagaaattgtatcgtgtggtcagggcatgtgcagaaatgggagagaataaccccatcgtcagcattcatgatcagggtgcaggaggaaattgtaatgttgtgaaggaaataatatatcctaagggtgctgaaattgatatccgctcagttgtcgttggtgatcatacattgtcggtcttggagatatggggtgctgagtaccaggagcaggatgcactacttgtgaaacctgagagcagaagccttctggagtcgctttgtcagagggaaagggtttcaatggctgtcattgggaaaattgatggctgtggaaaaattgtgttgattgatagcgctgctgtggagcatgccaagttgaatggccttcctcctccaaaccctgttgaagaacttgagcttgaaaaagttctaggagatatgcctcagaagaccttcgagttcaagcgtgtttctcaagtcacagagcctttagaaattgcaccagaggtaacactgctggatactctgaagcgagtattaaggctcccatccgtctgttcaaagcgtttcttaaccacaaaagttgataggtgtgtgacaggtcttgttgcacaacagcagacagttgggcctcttcaaatcccgcttgctgatgtggctgtgattgcacagacatacacggacctcacaggtggtgcttgcagcattggagaacagccaataaagggtttgcttaatcctaaggccatggctagacttgctgttggggaggccttgactaatcttgtttgggcaaaggttacatcgcttgctgatgtcaaagcaagcgggaactggatgtatgctgcaaagcttgacggtgaaggtgcagatatgtatgatgcagctgttgcattggctgactgcatgattgaacttggtattgcaatagatgggggaaaggacagtctttccatggcagctcaatgtgatggtgaggtcatcaaagctcctggaaatctggttattagtacttatgtcacatgtcctgatataacattgacagtaacccctgatttgaagcttggtaatgatggaattcttctgcatattgacctcgctaaaggtaatcgccgtcttggtggttctgctcttgcacaagcatttgatcaaattggaaatgactgcccagacattgatgatgtgccgtacttgaagaaagtatttgaggccattcaggaactgattactcaacggcttatttcagcaggccatgacataagtgatggtggccttattgtgagtgtccttgagatggcatttgctggtaattgtggtttaaagctggatatagacttggaagataggagccttcttgaaggactttttgcagaggagcttggtctcgttattgaagtgaaatcacaatatctcaatgtcgtgaagcaaaagcttgaagcagcaggcgtttccgctaatgtaattggagaggttactagctcgccggatatagaagtttttgttgatggcaatctgcatctcaaggaaaaaacttcagatctcagggatctctgggaggaaacgagcttccagcttgaggagtcacaacgcctgaaatcttgtgtcaaacttgagaaagaagggctaaaaagcagaacgtcaccatcatggtctctgtccttcacttccaaattcacagatgagaatcttttgattgcatccttgaaaccaaaggtcgctatcattcgtgaagaagggagcaatggtgacagggaaatggctgctgcatttcatgctgctggatttgaaccatgggatatcacaatgtcagacctcttggctgggaagtcctctctaacggatttccgtggaattgcatttgttggtggtttcagctatgcagatgtgctggactcagcaaaaggctgggctgcatcaatcagatttaaccaacccctcattcagcaattccaggatttctaccataggccagacactttcagccttggagtatgcaatggttgccaacttatggctcttcttggctgggtgccaggatcagatattggaggttctcttggcttaggtggagaaatgtcccagccaaggtttattcacaacaaatctggtcgttttgaatgtcggtttaccagtgtgtccattgggaattctcctgcaatcatgttcaaagggatggaaggttctaccttgggtgtttggagtgctcatggtgagggaagagctttcttcccagatgaagatgttctagctactgttgtgaagtctaatctggctcctgtgcgatattgcgatgatgctaacaatataactgagacctatcccttcaatcccaatggttctccactaggcattgcagccctttgctcccctgatggaaggcaccttgccatgatgccacacccagagcgttgcttcatgatgtggcaatatccatggtatccaaaggaatggcaggttgagaagagtggccccagcccttggctgcggatgttccagaatgctcgagaatggtgctcgtagtgcagcttgtcacattacgcttacaagttgggcaaggatttcggagtgcagacgttcaggcccagctgcaggaattttgcgtggattctgggctactggctgtggatggtatggctgtctcatgccatttgggacctcctttggcgaaataattgtatttggctgaccaataatcaaatgttgaaaagctcaattttgaaatgttgaagaatgtatgactgcctggtcggtcagggccaacttaaccatgtactgctggtggtcgctaatgattacagtaattgtaataagtggattaagaaggcatcatgccatctgccttttttttgcgcggtagtttatcgagcatacttgttgccttgtcttgcctttttttttttaataaggac

SEQ ID NO: 1509 - DNA, 5525 bp, Panicum virgatum
ccactaccgcgtcgtcttctcttcacccgcctccgcccaccgggagtccaacactgcttggccagctgcgctcccgcgtcgcctcaccctacgctgcccaacctgccactgccccacccccacccccggccccctcctgtagggtcggcagctataaaagcccctaccaactcggaaatctaagttccgttgttgcccttcaccacctcggccgccggccgctctccccaccaaccacctcttgtcgaccaccctctccccctctcttgggtcgctggcgccgcccaccggagcatgaggagaaagaaggcccttcaggcgatggattcaagttttgtcacgcgggcgacattgcggctagacggactacgggtgatggatccatgtgatggtgggctcgatccgatcggaaggctcgcgccggcgaagaaggggaagaagcatcatcattgcgtggcacttgacaccactactcgtcagcaaactgggccaaaacaaagcaggccgcctaacccggcaccgaggccgaatttgttgtcgtgggctcagcggcgcgtacgcgggctggcccaactgcgcattgcaccctaaagcggaaagcatctaccgccccactctcctccaccaccctttttctgctcgcgctcgcggcggcggcggcggcggcggctgctcgtgtcgtccactcttcccccgccttgcccgcgagtttcgcctcggcgccgccggcgaacactcgctgtcagccgcggcggtcctccgctcggctggactggcgatttgctgcgtcttccgttggtctcctgttcgtttctaaaaaaatctttgggtttgagatggcatcacctggccaaatgacgtcaagcaatctgttacacaccaaaggcttccctggaaatatgggaaaacgatatggtttaattggtgctacaagtcttgggtcaggaaggctgcgaatgagtcaacgctgctttcatcagcagcatcttttctggccacgtgcacaaagagttaaggttcttaatatccggatgtcatcatctcctggcgctgtggcatcaaaggggtttgacagtccattggttgagaaatctgattctgcactgaacggtggaattattcacttgtaccgtgtaccgtttcttcaagaaagtgaaaccatggagcttcttaagaaagtaaaggccaaggtttctgctagtattgctgatataatgactgagcaatgcttcaacattcagttggacaatccacttactcctgagaagctttctacacttcactggctcttagcagaaacttatgaacctgagaagttgcaaactaggagctttctggaggaggaagtgtctggaagttctagtgctgtcattgttgaggttggtccccggatgacattttcgactgcattctcatccaacgctgtctctatctgtaaatctatctcattagtagaagtgactcgactggagagatcaagaagatatcttttgcgccttgagcctggtagtgacccacttgatgaaattcagctcaaagaattcgctgcgttggttcatgatagaatgacagagtgcgtttatcccaacaagctcaaatcatttcagtcagatgtagttcctgaacctgtccgtgttgttccagtcattgaaaggggaaaagaagcattggaagaaataaatgtgaggatggggcttgcttttgataaacaagatattgactactatacacacctcttcagagactatatcaaacgcaacccaactactgtggaactttttgatattgcacaatccaatagtgaacacagcagacattggttttttaatgggaagcttttaatagatggagaaaccatgccaaacactttgttccagttagtgaagagacccctgaaggccaaccccaataactctgtcattggattcaaggataattcgagtgcaataaaaggattcccagtaaatcaactgcgcccaacaattccgggttccacttcaccattatccatcatgatgcgtgagcttgatattttattcacagcagagacccataattttccatgtgctgttgcaccataccctggagccgagacaggtgcaggtggccgtataagagacacacatgccactggaaagggttcatttgttgttgcttccactgctggttactgtgttggtaatcttcgaattgaaagttcatacgcaccctgggaggacccttcattttcttacccagtgaacctagcctctccattgcaaattcttgttgatgctagtgatggggcgtctgactacgggaacaagtttggtgagcctctaattcagggatataccagaacatttgggatgaggttgctaaatggcgagcggcgtgagtggttgaagccgataatgttcagtggagcgattgggcaaattgaccatgcacatatatcaaagggtgatccagaaattggcatgctagttgtgaagattggtggtccagcatacagaattggtatgggtggtggtgctgcctcaagtatggttagtggccagaatgatgcagagcttgatttcaatgcagttcagcgtggagatgctgagatggcacagaaactgtatcgtgtggtcagggcatgtgcagaaatgggacagaacaaccccatcatcagcattcacgatcagggtgcaggaggaaattgtaatgttgtgaaggaaataatatatcctgagggtgctgaaattgatatccgttcaatagttgttggtgatcatacattgtcggtcttggagatatggggtgctgagtaccaggagcaggatgcactacttgtgaagcccgagagcagaagccttctggagtcgctttgtcagagggaaagggtttcaatggctgtcattgggaaaattgatggctgtggaaaaattgtgttgattgatagtgctgctgtggagcatgcgaagttgaatggcctccctcctccaaaccctgttgaagaacttgagcttgaaaaagttctaggagatatgcctcagaagaccttcgagttcaagcgtgtttcacaagtcacagagcctttagacattgcaccagaggtaacactgctggatgctctgaagcgagtattaaggctcccatccgtctgttcaaagcgtttcttaaccacaaaagttgataggtgtgtgacaggtcttgttgcacaacagcagacagttgggcctcttcagatcccgcttgctgatgtggctgtgattgcacagacatacacagacctcacaggtggtgcttgcagcattggagaacaaccaataaagggtttgcttaatcccaaggcaatggctagacttgctgttggggaggccttgactaatcttgtttgggcaaaggttacatccctcgctgatgtcaaagcaagtgggaattggatgtatgctgcaaagcttgacggtgaaggtgcagatatgtatgatgcagcagttgcactggctgactgcatgattgaacttggtattgcaatagatgggggaaaggacagtctttccatggcagctcaatgtgatggtgaggttgtcaaagctcctggaaatctggttattagtacttatgtcacatgtcctgatataacattgacagtaacccctgatttgaagctcggtaatgatggaattcttctgcatattgacctcgctaaaggaaatcgccgtcttggtggttctgctcttgcacaagcatttgatcaaattggaaatgactgcccagacattgatgatgttccatacttgaagaaagtattcgaggccattcaggaactgatcactcaacgtcttatttcagcaggccatgacataagtgatggtggccttattgtgagtgtccttgagatggcatttgctggtaattgtggtttaaagctggatatagacttggaagacaggagccttcttgaaggtctttttgcagaggagcttggcctcattattgaagtgaattcagaatatctcaatgttgtgaagcaaaagcttgaagcagcaagtgtttctgctaatgtaattggagaggttactagctcaccggatatagaagtttttgttgatggcaatctgcatctcaaggaaaaaacttcagatctcagggatctctgggaggaaacgagcttccagcttgaagagttacaacgcctgaaatcttgtgtcaaacttgagaaagaagggctaaaaagcagaacgtcgccatcatggtctctgtccttcactcccaaattcacagatgagaatcttttgattgcatcctcgaaaccaaaagtcgctatcattcgtgaagaagggagcaatggtgacagggaaatggctgctgcattccatgctgcaggattcgaaccatgggatatcacaatgtcagacctcttggctgggaagtcctctctaatggatttccgtggaattgcgtttgttggtggcttcagctatgcagacgtgctggactcagcaaaaggctgggctgcatcaatcaggtttaaccaacccctcattcagcaattccaggatttctaccataagccagacactttcagccttggagtatgcaatggttgccagcttatggctcttcttggttgggttccaggatcagatattggaggttctcttggcttaggtggagaaatgtcccagccaaggtttattcacaatgaatctggtcgttttgaatgtcggtttaccagtgtgtccattgggaattctcctgcaatcatgttcaaagggatggaaggttctaccttgggtgtttggagtgctcatggtgagggaagagctttcttcccagatgaaaatgttctagctgcagttgtgaagtctaatctggctcctgtgcgatattgcgatgacggtaacaatataactgagacctatcccttcaatcccaatggttctccactaggcattgcagccctttgctcccctgatggaaggcaccttgccatgatgccacacccagagcgttgcttcatgatgtggcaatatccatggtatccaaaggaatggcaggttgagaagagtggccccagcccttggctgcggatgttccagaatgctcgtgattggtgttcgtagtgcagcttggcacattacgcttacaagttgggctaggattttggagtgcagacgttcaggcccggctgcagggatttggcgtgggttctgggctactagctgtggatggtatggctgtctcatgccatttgagacctcctttagtgaaataattgtatttggctgaccaataatcaaatgttgaaaagctaaaatttgaaatgtggaagaatgtatgactgcctggtcggtcagggccaacttaaccatgtactgctggtggtctctaatgattacaataattgtaataagtgggttaaggcatcatgccatctgtattttttgcagggtagtttagcgaacatatttgcctcatcttgccttttttatatttatctgattacatttcatggaacttccgtttagattgcaatcaccattatttgagatttg

SEQ ID NO: 1510 - DNA, 4031 bp, Setaria italica
atgacgggcagcaatattattcatcttcgatgctttcctagcaatatgttatgcacccaccaaagatctggtttcatccctggaagaaacagaaggtcacgaatgactccgtactgcttagacctacgacacctctgccaattacctactcaaagtgttaatgttccaaatatccgaccactgcctacttccactgctgcagtatccaggggtattaacaccccattggttgaggaatctgttagtgagccatttctccaagagaacgaatatgaagagctacttaggaaagtacaggaaaaggttgcttgcaacattgttggcatcagaactgagcagtgcttcaatgttgaactggagaaggcactaactcctgagaagcttgcaacacttaagtggctccttgcggaaacttatgaacctgagaaattacaaacatgtaggtttttggagggtgaggtatgtggaagcccttactctgtgattgttgaggttgggccccgtatggcattttcaactgctttttcaaccaatgctgtctcaatttgcaaagctctatcactaacagaagtagcccgcttggagaggtctagaagatatcatttgtcccttcagcctgggactttgctgcatgatagaatgacagagtatgttcatcctggcaagctcacatcatttcagtcagatttagtaccagaacctgtgagtgccataccagtgattgaaaggggaagagaagctttggaagaaataaatgttaaaatggggcttgcttttgatgaacaagatatcaaatactacacccaccttttcagagatgacatcaaacacaatcctactactgtggaactttttgatatagcacaatccaacagtgagcacagtagacattggtttttcaatggtaaacttgtgatagatggagaaaccatggctagaactatgtttcagttagtgaagagtcccttgaaggccaaccccaataattctgttattggatttaaggataattcaagtgcaatcaaaggatatcaagtaaatcagttacatccagcactaccgggttccacttcaccactatcccttatgatgcgtgagcttgacattttatttacagcagaaacccataattttccatgtgctgtggcaccttatcctggagctgagactggtgcaggtggtcatataagagacacacatgcaaccggaaggggttcttttgttgttgcttccactgctgagtcaaatgcaccctgggagaatccatctttttcatacccgtcaaacttagcctctccattgcagattcttattgatgctagtgacggtgcttccgattatgggaacagatttggtgagcctctaattcagggttttacaagaaattttggtacaaggttgccaaatggagagcgtcgtgaatggctgaagccaataatgttcagtggagcaatcggacagattgaccatgcacacatcttgaaaggagacccagaaattggaatgctggttgtcaaaattggtggtccagcctacagaattggtatgggtggtgagcttgatttcaacgcggtgcagcgtggagatgccgagatggctcagaaactgtatcgtattatcagggcgtgtgcagaaatgggagagaagaacccaatcatcagcattcatgtccaaggagctggggaaaattgcaatgttgtgaaagaaataatctatccaaaaggtgctgaaattgatatacgctcaattgttgttggtgatcacacattgtctgtcttggagatttggggtgccgaatatcaggaacaggatgtattattggtgaagcctgagagcagaagattgttggagtcattttgtgagagggaaagagtttcaatggctgtctttggggaaatagatggtagtgggaaaattgttttgaccgacagtgctgctgtggagcaagccaagttgactggactcccttctccaccccctgttgtggatcttgaacttgaaaaggttttaggagatatgcctcagaagaccttcgaatttaaccgagttcctcgattaggtaaacccttagacattgcacctgaggtcatggtaatggatgttctgaagcgaattttgaagctcccttccatatgttcaaaacgtttcttgacgacgaaggttgacagatgtgttacaggtcttgttgcacaacagcagacagttggtcctcttcaacttccacttgctgatgtggctgttattgcgcagacatatacagatctgactggaggtgcttgtgccattggagaacaaccaataaagggcttacttaaccccaaggccatgggaaggcttgctgttggtgaagctttgaccaatctggtctgggctaaagtttcatcccttgctgatgtcaaagcgagcggtaactggatgtatgctgcaaagcttgatggagagggagcagatatgtatgatgctggtgttgcgctggctgactgcatgattgaacttggcatcgctattgatggaggaaaggacagtctatctatggcagctcaatgtgatggcgaagtagtcaaggctcctggaaatttggtgatcagtgcttatgtggcatgtcctgatataactttgacagttactccagatttgaagcttgtgtttgaccaaattggaaacgactgcccagacattgaagatattccctacttgaagaaagtctttgatgctgttcaggagttgctcagtgaacgccttatttctgccggtcatgacatcagtgatggtgggcccattgttactgttcttgagatggcatttgccggtaactgtggtgttaacctgaacataggcttaggagattatgatcttttaccagtacttttcgcagaggagcttggtctcattcttgaagtgcactcaaatgaccttaatgttgtaaagcaaaagcttcatgcggcaggtgtttccactaatgtaattggcaaagtaactacagctcaacaaacagatcttgttgttgatggtgaggtgcgactgaaggaaaaaacttcagatctcagagatctgtgggaggaaacaagctttcagcttgaggagcttccgcctttgaagtcttgtgtcaagcttgagaaagaaggcttaaaaagccgaacatcaccttcatggcgtttgtcttttactcccaaattcacagagaagaaactattgaccacagccataaaaccaaaggttgctattattcgtgaagagggtagcaacagtgacagagaaatgtctgctgcattccatgctgcaggttttgaaccatgggacataacaatgtcagatctcttgactcagaaaatttctctaactgaattccgtgggcttgcatttgttggtggttttagctatgcagatgttctggattcagcaaaacgttgggctgcatctatcaggttcaatcagcccctcatacaacagttccaggagttctacaataggccagacacatttagccttggagtttgcaatgggtgtcaactcatggcacttcttggttgggttccaggaccagatgttggaggttcccttggtgtaggtggagacatttctcagccaaggttcattcacaatgaatctgggcgttttgagtgccggtttaccagtgtggctataggggattctcctgctataatgtttaaaggcatggaaggctctacgttgggcatttggagtgctcatggcgaagggagagcattcttcccagatgaaaacattttatccggtattgttaagtccaacctagctcctctgagatactgcgatgactctaacaatgtaacagaggtctatcccttcaatcccaatggttctccacttggtattgcggccctttgctcccctgatggaatgcatctcgctatgatgccacaccccgagcgttccttcatgatgtggcaatatctgtggtatccaaaggagtggcaggttgaaaagagtggccccagtccttggttgcgcatgttccaaaatgcacgtgaatggtgttcataaaaaggtaa

SEQ ID NO: 1511 - DNA, 4839 bp, Zea mays
ggcggcgggcggcggctgcttctccgtctcctacttccccgcaaacttgtctcgtattcctagcgcagccggggaacactcccggcctccgcccgagcggagcggagcgtttcgtccgcgccgctgactccgaggagttcgtttcgccgcgctgtctccctgaatcctaatcgtccttttcgcgtttggctcgactgacgcgttgattcctgcttctttcgttggtctcccattctttttttacaagaactaaaaaaataaaaattctttgggttgggatggcatcacctggccaaatgacagcaagcaatctgttacggactgaaggctttcctggaaatatggtaaaaatatgtggtttaaatcctgcgagaagtcttggatcaagaagattgcggatgactcaacactccttccatcaacagcatctttgttgcccacgtctgcaaagagtaatgactcataatatccgattgttgtcatctcctggggccgtggcatccaaggggtttgacagcccattagttgagaaacctgatactgcatcggatgttaaaattattcacttgtaccgtataccatttcttcaagaaagtgaaaccatggagctgctcaggaaagtgaaggcgaaggtttctgctaatattgttgatatactgacagagcagtgcttcaacattcaattggacaattcactcactcctgagaaacttacaatgcttcattggctcttagcagaaacttatgaacctgagaagttgcagactaggagctttctggaggatgaagtatctagaaattcttgtactgtcattgttgaggttggtccccggatgacattttcaacggcgttctcgaccaatgctgtctcaatctgtaaatctctctcattagtagaagtgacacgattggagagatcaagaagataccttttgtgcctagagcctggtagtgacccacttgatgaaggtcagctcaaagaattcactgcattggttcatgatagaatgacagagtgcatttatcgcaataagctcacatcatttcaatcagatgtagttcctgaacctgtctgcattgttccagtcattgaaaggggagaagaagcattgaaagaaataaatgtgaagatgggacttgcttttgataaacaagatattgactattatacacacctttttagagatgatatcaaacgcaatccaactactgtggaactttttgatattgcacaatccaacagcgaacatagcagacattggttttttaatggaaagcttgtaatagacggagagaccatgccaaccactttgttccagttagtgaagagtcccctaaaagccaacctcaataactctgtcattggttttaaggataactcgagtgcaataaaaggattcccagtaaatcagctacgcccaacaattccggggttcacttcaccattatccattatcatgcgtgagctagatattttattcacagcagaaacccataatttcccatgtgctgttgcaccataccctggagccgagacaggtgcaggtggccgtataagggacacacatgccactggaaagggttcttttgtcgttgcttccactgctggttactgtgttggtaatctgcgaattgacaattcaaatgcaccctgggaagatccttcattttcttacccagtgaatctggcttctccattgcaaattcttgttgacgctagtgatggtgcatctgactatgggaacaagtttggtgagcctctaattcagggatataccagaacatttgggatgaggttgctaaatggggagcggcgtgaatggttgaagcctataatgttcagtggagctatagggcaaattgaccatgcacacatatcaaagggtgacccagaaattggcatgctagttgtgaagattggtggtccagcatacagaattggtatgggcggtggtgctgcctcgagtatggttagtggccagaatgatgcagaacttgatttcaacgcagtacagcgtggagatgctgagatggcacagaaattgtatcgcgtagtcagggcatgtgcagaaatgggagagagcaatcctatcatcagcattcatgatcagggcgcaggaggaaattgtaatgttgtgaaggaaataatatatcccaagggagctgaaattgatatccgttcaattgttgttggtgatcatacattgtcggtcttagagatatggggtgctgagtaccaggaacaggatgcactacttgtaaaacttgagagcagaagcctcttagaatcgctttgtgagagggaaagagtttcgatggctgtcattgggaaaattgatggcagtggaaaaattgtgttgattgatagcgctgctgtggagtattccaagctgaatgacctccctcctccaacccctgttgaagaacttgagcttgaaaaggttttaggagatatgcctcagaagaccttcgagtttaggcgtgtttctcaagtcacagagcccttggacattgcacctggggtaacactattagatgctctgaagcgagtattaaggctcccatctgtgtgttcaaaacgtttcttgaccactaaggttgataggtgtgtgacaggtcttgttgcacaacagcagacagttggtcctctccaactcccgcttgctgatgtggctgtgattgcacagacgtacacagacctaacaggtggtgcttgcagcattggagaacaaccaataaaggggttgcttaatcctaaggccatggccagacttgctgttggggaggccttgactaatcttgtttgggctaaggttacatcacttgctgatgtgaaagcaagcgggaactggatgtatgctgcaaagcttgatggtgaaggtgcagatatgtatgatgcagctgttgcattggctgactgtatgattgaacttggtattgcaatagatgggggaaaggacagtctttccatggcagctcaatgtgatggtgaagtcatcaaggctcctggaaatctggttatcagtacatacgtgacatgtcctgatataacattgacagtaacccctgatttgaagcttggtgaggatgggattcttctacatattgatctcgctaaaggaaatcgccgtcttggtggttctgctcttgcacaagcatttgatcaaattggaaatgactgcccggacattgatgatgttctgtacttgaagaaggtatttgaggccattcaagaattgctcagtcaacgtcttatttcagcaggccatgacataagtgatggtggccttattgtttgtgttcttgagatggcatttgctggtaactgtggttttaagcttgacatagacttagaagataggagccttattgaaggactttttgcagaggagcttggcctcattattgaagtacactcgaaatatctcaacattgtgaagcaaaagcttgaaatagcaggcatttctgctaatgttattggagaagttactaactcaccagaaatagaagtttttattgatggcaatctgcatctcaaggaaaaaacttcagatctcagggatctgtgggaggaaacaagcttccagcttgaggagttacaacgtctgaaatcttgtgtaaaacttgagaaagaaggattaaaatgcaggacatcaccatcatggtctctgtcttttaccccaaaattcacagatgggaaactgttgactgcttccttgaaaccaaaggttgccatcattcgtgaggaagggagcaatggggacagggaaatggctgctgcattccacgctgctggatttgaaccatgggatattacaatgtcagacctcttggctgggaagtcttctctcaaggagttccgtgggattgcatttgttggtggtttcagctatgcagatgtgctggattcagcgaaaggctgggctgcatcaatcaggtttaaccaacccctcattcagcaattccaggacttctaccataggccagacacgtttagccttggagtgtgcaatggttgtcagcttatggctcttcttggctgggtgccaggatcaggtgttggaggttctcttggtacaggtggagatatgtcccagccgaggtttattcacaatgaatctggtcgttttgagtgccggtttaccagtgtgtccattggcgattctcctgctattatgttcaaagggatggaaggttccaccttaggtgtttggagtgctcatggtgagggaagagcttttttcccagatgaaaatgttctagctactgttgtgaagtcaaatctggctcctgtgcggtattgtgatgattctaacaatattactgagacctatcccttcaaccctaatggttctccactgggtatagcagccctttgctcacctgacgggaggcacctggctatgatgccgcatccagagcgttgcttcatgatgtggcaatatccatggtatcccaaggaatggcaggttgagaagagtggccccagcccttggctgcgaatgttccagaatgctagagaatggtgttcatagtgcagggaagcttcctgctgcaaggatgtagtcatccaggcaccggctgctacgagtatatggatgattggtggttgtatggcccaattgatgacccctttttggcagaataaatgtgttttgaccatcaatacattatcttgtaataatgtatcgaatttggaattttgaaaatggagaaccgtctggtttccgaagtcggaaggcctcagatatgactccactagtttaaaacatttactagtggaaaagaaatgagtgggttaattaataatgcaaaaggtacattgggaagacactgtac

SEQ ID NO: 1512 - DNA, 5532 bp, Sorghum bicolor
gtacggctgcgctccccctcggccgaacagctattgcggtagtgccgccgccgccgccgccgccgccgcgtgcgctctctttctctcccggtctctctctcgcgcggcgacgagccgacgactgcgctaccgccgcagctgccgccgccgtacgccagaggcccaggtcttcatccggctcttcgctagcagcgagctcccacctgatctcccattcatttttttttaaataaaaaacccgtgggtttgggatggcatcacctgtccaaatgatggcaagcaatctattacgcacagaaggcttttctggaaatatgggacaaagatatggtttaattgctgcaagaagtcttggattaagaaggttgcgaatgactcaacattgcttccatcaacaacatctttgttggcgacatgtacaaagtggtgtggttcataatatccgatcatcatcatctcctggggctgttgtatccaaggggtttgacagcccattagttgagaaacctgatacttcattggatgttggaattattcacttgtaccgcgtaccatttcttcaagaaagtgaaaccatggagctgctcaagaaagtgaaggcgaaggtttctgctaatattgttgatatactgaccgagcagtgcttcaatattcaattggataatccactcacccctgagaaactttcaacgcttcattggctcttagcagaaacttatgaaccagataagttgcaaagtaggagctttctggaggaggaagaatctagtagttcctatgctgtcattgttgaggttggtccccggatgacattttcaacggcattctcaaccaatgctgtctcaatttgtaaatctctctcattagtagaagtgagcagactggagaggtcaagaagataccttttgcgccttgagcctggtagtgatccacttgatgaaagtcagctcaaagaatttgctgcattggttcacgatagaatgacagagtgcatttatcccaaaaagctcacatcatttcagtcagatatagttcctgaacctgtccgtgttgttccagtcattgaaagaggagaagaagcattggaagaaataaatgtgaagatggggcttgcttttgataaacaagatattgactattatacacacctgttcagagatgatattaaacgcaatccgactacagtggaactttttgatattgcacaatccaatagcgaacatagtagacattggtttttcaatggaaaacttgttatagatggacagaccatgcctgccactttgttccagttagtgaagaggcctctgaaagccaaccccaataactctgtcatcggattcaaggataactcaagtgcaataaaaggattcccagtaaaccatctacgcccaacaattccaggttccacttcaccattatccatcatgatgcgtgagcttgatattttattcacagcagaaacccataattttccatgtgctgttgcaccatacccgggagccgagacaggtgcaggtggccgtataagagacacacatgccactggaaagggttcttttgttgttgcttccactgctggttactgtgttggtaatcttcgaattgacaattcaaatgcaccctgggaggacccttcattttcttacccagtgaatctggcctctccattgcaaattcttgtcgatgctagtgatggtgcctctgactatggtaacaagtttggtgagcctctaattcagggatataccagaacatttgggatgaggttgccaaatggggagcggcgtgaatggttgaagcctataatgttcagtggagctattgggcaaattgaccatgcacacatatcgaagtgtgatccagaaattggcatgctagttgtgaagattggtggtccagcatacagaattggtatgggcggtggtgctgcctcgagtatggttagtggccagaacgacgcagagcttgatttcaatgctgtacagcgtggagatgctgagatggcacagaaattgtatcgtgtggtcagggcatgtgcagaaatgggagagaataaccctatcattagcatccatgatcagggcgcaggaggaaactgtaatgtcgttaaggaaataatatatccaaagggtgctgaaattgatatccgttcaattgttgttggtgatcatacattgtcggtcttggagatatggggtgctgagtaccaggaacaggatgcgctacttgtgcaacctgggagcagaagcctgttagagtcgctttgtgatagggaaagagttccaatggctgtcattgggaaaattgatggctgtgggaaaattgtgttgattgatagcgctgctgtagagcatgccaagttgaatggcctccctcctccaccccctgttgaagaacttgagcttgaaaaagttttaggagacatgcctcagaagacctttgagttcaagcgtgtttctcatgccacagagcctttagacattgctcctgaggtaacacttttggatgctctgaagcgagtattaaggctcccatctgtgtgttcaaagcgtttcttgaccacaaaggttgataggtgtgtgacaggccttgttgcacaacagcagacagttgggcctctccaacttcctcttgctgatgtggctgtgattgcacagacatacacagacctaacaggtggtgcttgcagcattggagaacaaccaataaagggtttgcttaatcctaaggccatggccagacttgctgttggggaggccttgactaatcttgtctgggctaaggttacatcactttctgatgtcaaagcaagtgggaattggatgtatgctgcaaagcttgatggcgaaggtgcagatatgtatgatgcagctgtcgcattggctgactgcatgattgaacttggtattgcaatagatgggggaaaagacagcctttccatggcagcccaatgtgatggtgaagtcgtcaaggctcctggaaatcttgtcatcagtacttatgtgacatgtcctgatataacattgacagtaacccctgatttgaagcttggtaatgatggaatccttctgcatattgacctctctaaaggaaatcgccgtcttggtggttctgctcttgcacaagcatttgatcaaattggaaatgattgcccagacattgatgatgttctgtacctgaagaaggtatttgaggccattcaggaattgctcagtcaacgtcttatttcagcaggccatgacataagtgatggtggccttattgtgagtgttcttgagatggcatttgctggtaattgtggttttaagcttgacatagacttggaagataggagcctccttgaaggactttttgcagaggaactcggccttgttattgaagtgcactcgaaatgtctcaatatcgtgaagcaaaagcttgaagcaacaggcatttctgctaatgtaattggagaagttacttgctcaccagaaatagaagtttttgttgatggcaatctgcatctcaaggaaaaaacttcagatctcagggatctctgggaggaaacgagcttccagcttgaggagttacaacgtctgaaatcttgtgttaaacttgagaaagaaggattaaaatgcagaacatcgccgtcatggtctctgtcttttactcccaaatttacagatgagaaactgttgattgcttcctcaaaaccaaaggtcgctatcattcgtgaagaagggagcaatggggacagggaaatggctgctgcattccatgctgctgggtttgaaccatgggatatcacaatgtcagacctcttggctgggaagtcttctctaacagagttccgtgggattgcgtttgttggtggttttagctatgcagatgtgctagattcagcgaaaggttgggctgcatcaatcaggtttaacaaacccctcattcagcaatttcaggatttctatcacaggccagatacgttcagccttggagtatgtaatggttgtcagcttatggctcttcttggctgggtgccaggatctgatgttggaggttctcttggtaaaggtggagatatgtcccagcccaggtttattcacaatgaatccggccgtttcgagtgccggtttacgaatattagtcccagcccagggtttattcacaatgaatccggccgtttcgagtgccggtttacgagtgtgtccattggggattctcctgctatcatgttcaaagggatggaaggttctaccttgggtgtttggagtgctcatggcgagggaagagctttcttcccagatgaaaatgttctatctactgttgtgaagtctaatctggcacctgtgagatattgcgatgattttaacaacataaccgagacctatcccttcaatcctaatggttctccactaggtattggagcactttgctcccctgatgggaggcaccttgctatgatgccgcatccagagcgttgcttcatgatgtggcaatacccatggtatcccaaggaatggcaggttgagaagagtggccccagcccttggctgcggatgttccagaatgctagggaatggtgttcatagtgcagggcagtgtctggattcagcaatgtgatcatcgccggggtactggctgttacgagtatggatggttgttctcattcgatgacccccttttttgcggaataagtgtttgaccagcagtgcgttatccaatagctgatattgagtttcaagtttgaaaatttaaaaatggaaaactgcctggttgtcgcatagcctgtcaggacgcctgatctgactctctgtcttgctgatggttgccaaagatataataactgtcatctcacatcagtgaatttcccaagtaacacacagaatgcttgatgtgttacccgaattaaatgcttatgcgatgtttaagtttttgtgctatctgcctgatgatgagtaagtttggactcagttgagataatttttctggtgctgtggcaaattcttggggtctcatattactccactagcgtttcactattccatgtgtctaacagttcaaaagaaccctgtgcttggtggctggcgaggctgggtctacttgacgaataaggggcatcctatttcaaagatgctgcaaggtgcttctctacggattgcttgtctgatggcacgcttaagaatcaatacagcttgttacaaagctagcttgtatacagacatccatggttggttcacagcttgtctgatgtatgcttgtccatattttcctccgtgaatgaaggcaagcactcgccccaaatggatggattttctggctgttccttatctttgacatctacacaattgattactgttgtagtgctgtgctccattctttgcctatgattaggcttgtccttggaccttagagtttggatcgcattattacaaaactctaactcctcttttgacaccttcgtcaacggattagcattagtaagcacaggcaatagaataacacgtgttacaatttttctgtagatcaacgcgaaggtgccctagatttttg

SEQ ID NO: 1513 - DNA, 3049 bp, Panicum virgatum
ggcgctgcaatccgacaagagacctggccattattctcccagaaaaaccaatctttttgccccctcaccgtccctgtccgagctgaattcctctgcctcctccttctcatccgtccccttcaccacgaggtgggcaggtgggcagcgcctctccgcgtgcggtccgtgtgcgcgcgcgggtccggtccctcctccgtcctcccggacgcgaatcgctgggcagcggtgaacaggagaccgaggcggccattgaaactccgccttcgattggggtgctgaggggggtcggaggctcgtcgccgggtgcttgggttgatgttgggagcgcgcgaatcggctcaagttctgatcttggcgagtctggaatcacgggattctttggaggttttgtcctgagctttcaaggctacaggacggtgctgctgattcgtctgaaaccatggagactacgagctcaacaaatgagcataccggtagggggacaatgtgggagctggaaaggaatctcgatcagcccatggatgcagaggccgggagattgaggaacatgtacagggaaaagacctacccaacacttgtactgttacaactagctttccaaagccttggcgtggtgtttggagatttaggcacatcacctttatatgtcttctacaacattttccctcgtgaaatagaagacacggaacaagttattggagcactctcgcttattatttactcccttactctgattccacttgttaaatacgtcttcattgtcttgagagcaaacgataatggccaaggtggaacatttgctctttattcactgctttgccggcatgcaaagataaacactattcctaatcagcatcgaacagatgaagacctaacaacatacagccgccacatatatgatgagaaatctcttgctgcaaagatcaaaagatggttagaggggcaccaattcagaaagaatgcaattcttattcttgttctttttggtacttgtatggcagttggagatggaatcctcactcctgccatatcagttctttctgcgactggaggaatacaagtggaagagcccaaaatgagaaatgatgtgggttgtcatcgtctctgtgggtcatattgattggattattcagcatgcagcactttggcactgataaagtcagctggctttttgcaccaatagtatttgtttggtacattctcattggaatcctgggcgctgtaaacatatccaaatacgatcaatctgtcctcaaggcgtttaatcctatttatgtctatcggtactttaagcgagggaagactagctgggcttctttaggaggaattatgctcagcattacagggacagaagcactgtttgctgatctttcatatttccctgtacaagctattcagattgctttcaccgtggttgtgtttccatgccttcttttgcagtatactggccaagctgcctatatagctcagaacagaagtagtgtggtccatgctttctattattcccttccagattctgtacgttggccatcattcattgttgcaacagctgctgcagtagttgctagccaagccactatatcgatgacgtattcgattatcaagcaagcactcgctctaggttgtttccccagagtgaggatcatccatacgtccaaaaagtatctaggccagatatacagtcctgatatcaattggatccttttgatattctgcattgctgtcactgctggatttaaaaaccaaagtcagatagcaaacgcatatggtactgctgtgataatggttatgcttgtgacaacatttctcatggtccccataatgctgctggtgtggcgcagccactggagcttggttgttcttttcaccgcgctgtcattggttgttgaaattccatacttctctgctgtggtgcggaagatcgatcagggtggatgggttcctcttgtgtttgccgtcgccttcctcatcatcatgtatatatggcactatggtacactcaagcgctacgaatttgagatgcacagcaaggtgtccatggcatggatcctaggccttggtccaagccttggtctggtcagggtgcccggtatgggcctggtgtacactgagctggccagtggcgttcctcacatcttctcgcacttcatcaccaacctcccggccatccactccactctggtcttcgtctgcgtgaaataccttcctgtctacactgtgccaccggatgaaaggttccttgtgaagcggatcggtcccaagaacttccacatgttccggtgcgtggcgcggtatggctacaaggacatccacaagaaggatgatgacttcgagcagatgctctttaacagcctgatgctctttgtccggctggagagtatgatggaagagtacacggactctgatgagtacagcacccgtgagctgaaccaggcaggcaacgctaacccaagaatcaatggcatcaacgccagttcaaacatggatctcagctacacatcccatgactccattatacaggtgcagtccccaaaccatacggggaacagccaggcgatgtcgtcgggccagacataccagactgtgggtgatgagatcgcgttcctgaacgcgtgcagggaagctggggtggtgcacatcctcgggaacacgatcatcagggctcgcagggactcagggttcctcaagaagtttgccatcaactacatgtatgctttcctcaggaagatctgcagggagaacagtgtcatcttcaatgttccccatgagagcctactgaatgttgggcaagtgttctatgtgtaagcactgaaagtaatcacaagtagataaacacccagaagtcagaactactggagagaagatagctagctgtattctgttcatagcttataggagcctttgttgaaacaattgtacagcatcatgtgggaccatttggagcctgatcaatacttcaatagcggtcatgttcgtcgtgtagaacttgtgctgtatgcatatgtgtagtagctggttgttaaatccacagtgattttaccgcgtaccg

SEQ ID NO: 1514 - DNA, 3142 bp, Panicum virgatum
gctgctcatcctcaattattgagcgcaaactgacgcgagcgaaattgcgacgagttccaacgaatttcggtccactccatcggcgctgcaatccgacaagagacctggccattattctcccagaaaaaccaatctttttgccccctcaccgtccctgtccgagctgaattcctctgcctcctccttctcatccgtccccttcaccacgaggtgggcaggtgggcagcgcctctccgcgtgcggtccgtgtgcgcgcgcgggtccggtccctcctccgtcctcccggacgcgaatcgctgggcagcggtgaacaggagaccgaggcggccattgaaactccgccttcgattggggtgctgaggggggtcggaggctcgtcgccgggtgcttgggttgatgttgggagcgcgcgaatcggctcaagttctgatcttggcgagtctggaatcacgggattctttggaggttttgtcctgagctttcaaggctacaggacggtgctgctgattcgtctgaaaccatggagactacgagctcaacaaatgagcataccggtagggggacaatgtgggagctggaaaggaatctcgatcagcccatggatgcagaggccgggagattgaggaacatgtacagggaaaagacctacccaacacttgtactgttacaactagctttccaaagccttggcgtggtgtttggagatttaggcacatcacctttatatgtcttctacaacattttccctcgtgaaatagaagacacggaacaagttattggagcactctcgcttattatttactcccttactctgattccacttgttaaatacgtcttcattgtcttgagagcaaacgataatggccaaggtggaacatttgctctttattcactgctttgccggcatgcaaagataaacactattcctaatcagcatcgaacagatgaagacctaacaacatacagccgccacatatatgatgagaaatctcttgctgcaaagatcaaaagatggttagaggggcaccaattcagaaagaatgcaattcttattcttgttctttttggtacttgtatggcagttggagatggaatcctcactcctgccatatcagttctttctgcgactggaggaatacaagtggaagagcccaaaatgagaaatgatgtggttgtcatcgtctctgtggtcatattgattggattattcagcatgcagcactttggcactgataaagtcagctggctttttgcaccaatagtatttgtttggtacattctcattggaatcctgggcgctgtaaacatatccaaatacgatcaatctgtcctcaaggcgtttaatcctatttatgtctatcggtactttaagcgagggaagactagctgggcttctttaggaggaattatgctcagcattacagggacagaagcactgtttgctgatctttcatatttccctgtacaagctattcagattgctttcaccgtggttgtgtttccatgccttcttttgcagtatactggccaagctgcctatatagctcagaacagaagtagtgtggtccatgctttctattattcccttccagattctgtacgttggccatcattcattgttgcaacagctgctgcagtagttgctagccaagccactatatcgatgacgtattcgattatcaagcaagcactcgctctaggttgtttccccagagtgaggatcatccatacgtccaaaaagtatctaggccagatatacagtcctgatatcaattggatccttttgatattctgcattgctgtcactgctggatttaaaaaccaaagtcagatagcaaacgcatatggtactgctgtgataatggttatgcttgtgacaacatttctcatggtccccataatgctgctggtgtggcgcagccactggagcttggttgttcttttcaccgcgctgtcattggttgttgaaattccatacttctctgctgtggtgcggaagatcgatcagggtggatgggttcctcttgtgtttgccgtcgccttcctcatcatcatgtatatatggcactatggtacactcaagcgctacgaatttgagatgcacagcaaggtgtccatggcatggatcctaggccttggtccaagccttggtctggtcagggtgcccggtatgggcctggtgtacactgagctggccagtggcgttcctcacatcttctcgcacttcatcaccaacctcccggccatccactccactctggtcttcgtctgcgtgaaataccttcctgtctacactgtgccaccggatgaaaggttccttgtgaagcggatcggtcccaagaacttccacatgttccggtgcgtggcgcggtatggctacaaggacatccacaagaaggatgatgacttcgagcagatgctctttaacagcctgatgctctttgtccggctggagagtatgatggaagagtacacggactctgatgagtacagcacccgtgagctgaaccaggcaggcaacgctaacccaagaatcaatggcatcaacgccagttcaaacatggatctcagctacacatcccatgactccattatacaggtgcagtccccaaaccatacggggaacagccaggcgatgtcgtcgggccagacataccagactgtgggtgatgagatcgcgttcctgaacgcgtgcagggaagctggggtggtgcacatcctcgggaacacgatcatcagggctcgcagggactcagggttcctcaagaagtttgccatcaactacatgtatgctttcctcaggaagatctgcagggagaacagtgtcatcttcaatgttccccatgagagcctactgaatgttgggcaagtgttctatgtgtaagcactgaaagtaatcacaagtagataaacacccagaagtcagaactactggagagaagatagctagctgtattctgttcatagcttataggagcctttgttgaaacaattgtacagcatcatgtgggaccatttggagcctgatcaatacttcaatagcggtcatgttcgtcgtgtagaacttgtgctgtatgcatatgtgtagtagctggttgttaaatccacagtgattttaccgcgtaccttttttttgcgaaaa

SEQ ID NO: 1515 - DNA, 3819 bp, Panicum virgatum
acgcgagcgaaattgcgacgagttccaacgaatttctgtccactccatcggcccggcaatccgacaagagacctgccattattctcccagaaaaaaccaatcttttttccccacacatgacacaccatccctgtccgagctgaattcctccttcccatccccttcaccacgaggtgggcaggcgggcagcgcctctccgcgtgcggtccgtgtggcgtccggtcctcctccgtcctcccggacgcgaatctctgggcagcggtggataggagtccgaggcggccattgaaactccgccttcgattggagtgctttcgtggggtcggagggtcgtcgccgggtgcttgggttgatgttgggagcgcgcgaatcggctcaagttctgatcttggcgagtctggaaccacgggattctttgggggtttttgtcctgagctttcaagtttagcagctgattctgtcttccattaggctacaggacggtgctgctgattcgtctgaaaccatggagactacgagctcaacaaatgagcataccggtagggggacaatgtgggagctggaaaggaatcttgatcagcccatggatgcagaggccgggagattgaggaacatgtacagggaaaagacctacccaacacttgtattgttacaactagctttccaaagccttggcgtggtgtttggagatttagggacatcacctttatatgtcttctacaacattttccctggtgaaagtgaaataaaagacacagaacaagttattggagcactctcgcttattatttactcccttactctgattccacttgttaaatacgtcttcattgtcttgagggcaaacgataacggccaaggtggaacgtttgctctttattcactgctttgccggcatgcaaagataaacactattcctaatcagcatcgaacagatgaagacctaacaacatacagccgccacatatatgatgagaaatctcttgctgcaaagatcaaaagatggttagaggggcaccagttcagaaagaatgccattcttattctcgttctttttggtacttgtatggcagttggagatggaatcctcactcctgccatatcagttctttctgcgactggaggaatacaagtggaagagcccaaaatgagaaatgatgtggttgtcatcgtctctgtggtcatattgattggattattcagcatgcagcactttggcactgataaagtcagctggctttttgcgccaatagtatttgtttggtacattctcattggaatcctgggcgctgtaaacatttccaaatacgatcgatctgtcctcaaggcgtttaatcctgtatatgtctatcggtactttaagcgagggaagactagctgggtttctttaggaggaattatgctcagcattacagggacagaagcactgtttgctgatctttcatatttccctgtacaagctattcagattgctttcacggtggttgtgtttccatgccttcttttgcagtatactggccaagctgcctatatagctcagaacagaaatagtgtcgtccatgctttctattattcccttccagattctgtacgttggccatcattcattgttgcaacagctgctgcagtagttgctagccaagccactatatcaatgacgtattcgatcatcaagcaagcactcgctctaggttgtttccccagagtgaggatcatccatacgtccaaaaagtatctaggccagatatacagtcctgatatcaattggatccttttgatattctgcattgctgtcacagctggatttaaaaaacaaagtcagatagcaaacgcatatggtactgctgtgataatggttatgcttgtgacaacatttctcatggtccccataatgctgctggtgtggcgcagccactggagcttggtcattcttttcactgcgctgtcattggttgttgaaattccatacttctctgctgtggtgcggaagattgatcagggtggatgggttcctcttgtgtttgccggcgccttcctcatcatcatgtatgtatggcactacggtacactcaagcggtacgaatttgagatgcacagcaaggtgtccatggcatggatcctaggccttggtccaagccttggtctggtcagggtgcccggtatgggtctggtgtacactgagctggccagtggcgttcctcacatcttctcgcacttcatcaccaacctcccggccatccactccactttggtcttcgtctgcgtgaaataccttcctgtctacactgtgccaccggatgaaaggttccttgtgaagcggatcggtcccaagaacttccacatgttccggtgcgtggcgcggtatggctacaaggacatccacaagaaggatgacgactttgagcagatgctcttcaacagcctgatgctctttgtccggctggagagtatgatggaagagtacacggactctgatgagtacagcacccgtgagctgaaccaggcaggcaacgccaacccaagaatcaatggcaccaatgctggttcgaacatggatctgagctacacatcccatgactccatcatacaggtgcagtccccaaaccatacggggaacagccaggtgatgttatcgggccagacgtaccagaccgtgggtgacgagatcgcgttcctgaacgcgtgcagggaagccggggtggtgcacatcctcgggaacacgatcatcagggctcgcagggattcggggctcctcaagaagattgccatcaactacctgtatgctttcctcaggaagatctgcagggagaacagtgtcatcttcaatgttccccatgagagcctactgaacgttgggcaagtgttctatgtgtaagcactgaaagtaaccaaaagtagataaacagcctcagaagtcagaattactggagagaagatagctagctgtattttgttcatagcttataggagcctttgttgaaagaattgtacagcatcatgtgtgaccatttggagcccgatcaatacttcaatagtggtcatgttcgttgtgtagaacttgtgctgtatgcatatgtgtagtagctggttgttaaatccagagtgattttgccgcgtaccttggccagttttcccagtaagatccaagatacagccgtcagacatatgatgcgcaatctgctgctcatgaagccggagtttgctcatgtcttatgggcgagcaagaagatctgtactgtttcgagaaagactgatcaggatatgtgccgataaatgcaagagaaaccctactaggaagtgtcgccaagggtcaggtttggctctacaaaatagattaagaactctctcagtgcctccggaggtaccagaatggccggccggccggccgtcagtgcaaaagcagggccactcaacaaatctgcctagaataatcgagtccatgggtcatgattcatgaatcatgtcaaggtactaagtattattgcccccggctgttgtcagaaacgagctatagcaccaaactctcgcctgatctgttttcactggttgattgaccatgtaggacttgcgtgcatttattcagtcttgtttagattcaggctgtagtctgtactttatatgtattgtactgtatccaaattttaatgtcaattcagttcaattttttaatgtcaatgtatttcagtttcactagaaaggcacgcggctttgccgcgcagggcctgtatctcatgttgtagtattgtagttgatacttgatacagacttaaattcatgtatatagtaattattgtatgtaagtaaatatgctttttttaa

SEQ ID NO: 1516 - DNA, 3304 bp, Sorghum bicolor
gccattagcatttgattattgctgctgctcctctattattgagccgcaaacgcatcgcatcgcgatcgcaacgagctgcaaccaaatcctgtccactccatcagctctgcaatccgacaagagatttgcccattgttattctcctactagaaaaaccgatcgcatccgtccccatcctctctccgccgcggggttggcaggcagcgcctctccgcgtgtggtccgtgtgcgaggggtcgggtgtccggtcctcctcccctccgtgcagcgcatgcgcggcagccggcagcggcgtctcttcttgccggtcccgcccgcgaatctctgcgccgcggtggataggaggaggaagtcgaggacgccataggaaaaagaaaaacacaaatccagcttggaatgctttcggagactgggggctcgtcgccggctgcctggactgatgctgggagcgtgcgaatttccgctcaagttttgatcttagcgtgctcttgagtctggaatcccgccattcattgggggctttgttcttgagtttacaaggctgcaaggccgtgctgctgattagtttgaacccatggagactactagcacaacaaatgagcagcctggtaggggggcaatgtgggagctggaaaggaatctcgatcagcccatggatgcagaggccgggagattgaggaatatgtacagggaaaagacctaccctacaattgtgctgttacaactagctttccaaagcctcggtgtggtgtttggggatttaggcacatcgcctttatatgtattctataacattttccctcgtgaaatagaagacacggaacaagttattggagcactctcgcttattatttactcccttaccctgattccacttgttaaatacgtcttcattgtcttgagggcaaacgataatggccaaggtggaacatttgctctttactcactgctttgccggcatgcaaagataaacattattccgaatcagcatagaacagatgaagacctaacaacatacagccgccacacatatgatgagaaatctcttgctgcaaagattaaaagatggttagaggggcaccaaatcaggaagaatgccattcttattcttgttctttttggtacttgtatggcagttggagatggaatcctcactcctgcaatatcagttctttctgcaactggaggaatacaagtggagcagcccagaatgagaaatgatgtggttgtcatcgtctctgtggttatattgattggattattcagcatgcagcactttggtactgataaagtcagttggctttttgctccaatagtatttgtttggttcatactcattggagtcctgggcgccgtaaacatttccaaatacgatcaatctgttctcaaggcttttaatcctatttatgtatatcggtactttaagcgagggaagactagctgggcttctttaggaggaattatgcttagcattacagggacagaagcattgtttgctgatctttcatatttccctgtacaagctattcagattgctttcacggtggttgtgtttccatgccttcttttgcagtatacgggccaagctgcctatatagctcagaacaaagaccatgtctcccatgccttctatttttcccttccagattctgtactttggccatcattcattgttgcaacagctgctgcagtagttgctagtcaggcaactatatcgatgacctattcaattatcaagcaagcacttgctctagggtgcttccccagagtgagaattatccatacttccaagaaatatctaggccaaatatacagtcctgatattaattggatccttttgatattctgcatcgctgtcactgctggatttaaaaaccaaagtcagatagcaaatgcatatggtactgctgtgataatggttatgcttgtgacaacatttctcatgatccccataatgctgctggtgtggcgcagccactggaccttggtcattcttttcaccacgctgtcattggttattgaaattccatacttcactgctgtggtgcggaagatcgatcagggtggttgggttccacttgtgtttgctgttgccttcctcatcatcatgtatgtatggcactatggtacactcaagcggtatgaattcgagatgcacagcaaggtatccatggcgtggatcctaggccttggcccaagccttggtctggtcagggtgcctggtgtaggcctggtttacaccgagctggcgagtggtgtccctcacatcttctcacacttcatcaccaatctccctgccatccactccactctggtcttcgtctgtgtgaaataccttcctgtttacactgtgccactagatgaaaggttccttgtgaagcgaattggtcccaagaacttccacatgtttagatgtgtggcgcggtatggctacaaggacatccacaagaaggatgacgacttcgagcagatgctctttaacagcctgatgctctatatcaggctggagagtatgatggaagagtacacggattctgatgactacagcacccgtgagctgaaccaggcaggcaacgccaaccaaagaatcaatggcatcagcaccagttcaaacatggatctcagctatacatcccatgactccattatacaggtgcagtccccaaatcatatagggaacagccaggttgtgtcatcaggtcagatgtaccagactgtgggcgacgagattgcgtttctgaacgcgtgcagggacgctggtgtggtgcacatcctagggaacacgattgtcagggcccgtagggattcagggttcatcaagaagtttgctatcaactacatgtatgctttccttaggaagatctgcagggagaacagtgccatcttcaatgttccccatgagagccttctgaatgttgggcaggtgttctatgtgtaagcactgaaaccaaatacatgtagatgagagttcagcttcagaaccactcgagataatctagctgtgttttgtacttttgttcgtaggtcatataggagtacaatagttgaaagaattgtacagaaaacagcatcatgaccatttcgagcctgatcaatagtggacagtggtcatgttcatcatgtagaacttgtactgtatgcacatctgtaatagctggtggttaaatccagagtaattttggcgcttcattagtaattgcagtatgctgagttgagattacgcaaataagttttatttgtctattccatggtgcaagaagttgagatttgtttgccgagtgtttgtttagaccaagggtttgtg

SEQ ID NO: 1517 - DNA, 3006 bp, Zea mays
caacgagatgcaaccaaatccccgtccactccaccagctctgcaatccgacaagagatttgccaattatttctcctagaaaaaccgatcgcatcagtccccatcctcttcgccgtggggtcggcaggcagggcaaggctaggcagcgcctctccgcgtgtggtccgtgtgcgagggtccgctcctcctcccctccgtgcacccggagggcagcggcgtctcttcttcctggtcgaatctccccgcggctgtgaataggaggaggtcgacgacgccatagcaaaaaacaaatccttggaatgctttcggagggtcggggattcgtcgccggctgcctgcactgatgcttggagcgcgcgaatctgctcaagttttgatcttggcgtgctcttgagtctggaatccgggcattcattggggctttgttctcagtttgcaaggctgcaaggccgtgctagtttgaacccatggagactactagcacaacaaatgaacagactgataggggggcgatgtgggagttggaaaggaatctcgatcagcccatggatgcagaggccggcagattgagaaatatgtacagggaaaagtcctaccctacacttgtgctgttacaacttgctttccaaagccttggtgtggtgtttggggatttaggcacatcacctttatatgtcttctccaacattttccctcatgaaattgaagacacggaacaaattattggagcactctcgcttgttatttactcccttaccctgattccacttgttaagtacgtgttcattgtcttgagggcaaatgataatggccaaggtggaacatttgctctttactcgttgctttgccggcatgcaaagataaacactattccgaatcagcatagaacagatgaagaactaacaacatacagccgccacacatatgatgagaaatctcttgctgcaaagatcaaaaggtggttagaggggcaccaattcagaaagaatgtcattcttattcttgttctttttggtacttgtatggcagttggagatggaatcctcactcctgcaatatcagttctttctgcaactggaggaatacaagtggaagagaaaaaaatgaaaaatgatgcggttgtcatcgtctctgtggtcatattgattggattattcagcatgcagcactttggtactgataaagtcagttggctttttgcgccgatagtatttgtttggttcatactcattggagtcctgggcgctgtaaacatttccaaatatgaccaatctgttctcaaggcttttaatcctatctatgtatatcggtactttaagcgagggaagactagctgggcttctttgggaggaattatgcttagcattacaggaacagaagcactgtttgctgatctctcatatttccctgtacaagctattcagattgctttcacggtggttgtgtttccatgtcttcttttgcagtatacaggccaagctgcctatatagctcagaacaaagatcatgtctcccatgccttctatttttcccttccagattctgtactctggccatcattcattgttgcaacagctgctgcaatagttgctagtcaggcaactatatcgatgacatattcgattatcaagcaagcacttgctctagggtgcttccccagagtgagaattatccatacttccaagaagtatctaggccagatatacagtcccgatattaattggatccttctggtattctgcattgctgtcactgctggatttaaaaaccaaagccagatagcaaatgcatacggtactgccgtgataatggttatgcttgtgacaacatttctcatgatccctataatgctgttggtgtggcgcagccactggaccttggtcatcctgttcaccgtgctgtcactgtttgttgaaattccgtacttcaccgctgtggtgcggaagatcgaccagggtggctgggttccacttgtgtttgctgttgccttcctcatcatcatgtatgtatggcactatggtacgctcaagcggtatgagtttgagatgcacagcaaggtgtccatggcatggatcctaggccttggtccaagcctcggtctggtcagggtgcctggtgtgggcctggtgtacaccgagctggcaagtggtgttcctcacatcttctcacacttcatcaccaacctccctgccatccactccaccctggtctttgtgtgtgtgaaataccttcctgtctacactgtgccactggatgaaaggttccttgtgaagcgaattggtcccaagaacttccacatgtttagatgcgtggcgcggtatggctacaaggacatccacaagaaggatgatgacttcgagcagatgctcttcgacagcctgatgctattcgtcaggctggagagcatgatggaagagtacacggattctgatgagtacagcacccgtgagacgaacctgtcaggcagcgccaacccaagaatcaatggcatcagcgccggttcaaacatggatctcagctacacatcccatgactccattatacaggtgcagtccccaaattatacggggaacagccaggcggtgtcaccaggtcagctgtaccataccgtgggcgacgagattgcgttcctgaacgcgtgcagggacgccggggtggtgcacatcctcgggaacacagtcatcagggcccgcagagattcagggttcatcaagaagattgctatcaattacttgtatgctttccttaggaagatctgcagggagaacagcgccatcttcaatgttccccatgagagcctactgaatgttgggcaggtgttctatgtgtaagcactaaaaccaaacacatgtagtagatgagagttcagcttcggaaccactggagagaatctagctgtgttttgttcataggtaataggagtataatagttgaaagaattgtacagcaaaacagcatctttaatgtgaccatttggagcctgatcagtagtggctagggctggacg

SEQ ID NO: 1518 - DNA, 3411 bp, Oryza sativa
ctaaaggccaaccaaatggtgccaaatctagcaatttctccccactccacccagaagaaaaccgtgaagaaattctccggagagaaaaaatccaatcttttctcccccgagcacacatccctgtccggaataatgctcccacgcgaattcctaacatctcaccatctcttcctcatatccacaagccagcgtatgggtgatgtgttcttgatgatccccaaggacggacctgtccggcgaatctacaaagtggtgagtaggaaattgtggtaaaaaatcccccttttgccgatggtttcggaggattgctgttctggggagaagttttgatctcgccggcctgttttgtgtgagcccgtgaagcttcgaaccccagagaatttctcgcctcttcgcatgcggagagttgcaagcttgtaaaaaactactgttgattgatctgaagtctgaacccatggagaccagaacaaatgagtattcccgtaagggggcaatgtgggagctggaaaggaatcttgatcaacccatggatgcagaggctggaagactcaggaatatgtacagagaaaagacctatccaacaattttactgctacggctagctttccaaagccttggtgtggtatttggagacttaggcacatcacctctatatgttttctacaatatctttcctcatggaatagaagatacagaacaagttattggagcactctctcttataatttactcccttacactcattccacttgttaaatatgttttcattgtcttgagagcaaatgacaatggccaaggaggaacatttgccctttattcactgctttgccgtcatgcaaagataaatattattccaaatcaacatagaaccgatcaagatctaacaacatacagtcgccgcacatatgaagaaaagtctcttgctgccaaaatccaaagatggttagaggggcaccaattcagaaagaatttaattcttattcttgtactatttggaacttgtatggctgttggagatggaatactcactcctgccatatcagttctttctgcgactggtggaatacaagttgaagaaggcagaatgagaaatgatgtggttgtaattatctccgtgctgatattgattggactgttcagcatgcagcactatggtactgataaagtcagctggctctttgcaccaatagtatttgtttggttcatactcattgggattcttggtgctgtaaacatttgcaaatatgaccattcagttcttaaggctttcaatcctgtctatgtatatcgttactttaaacgagggaagactagttggacttctttaggtggaattatgctcagcataacaggcacagaagcattgtttgctgacctttcgtattttcctgtacaagctattcagattgctttcactgtggttgtgttcccatgccttcttctgcaatatactggtcaggctgcgtttatagctgcaaacacaaaccaagtcagccatgccttctatatctcccttccagctcctatactttggccagcatttgccgttgcaacagcagctgcaatagttgctagtcaggccactatatctgcaacatattcgattatcaagcaagcacttgccctagggtgctttccccgagtgaagatcatccatacttccaagaagtatctcggccagatatacagccctgatattaactggatcctcatggttttctgcatagctgtcactgcagggttcaaaaaccaatcccagattgcaaatgcatatggtactgctgtgatcatggttatgcttgtgacaacatttctgatgatccccatcatgctgctggtgtggcgaagccattggaccctggtcgtcgccttcaccgtgctgtcattgcttgtggagatcccctacttctcggccgtcgtgcgcaagatcgatcagggaggatgggttccgctggttttcgcggcaggcttcatgatcatcatgtatgtctggcactacggcaccctgaagcggtacgagtttgagatgcacagcaaggtgtccatggcctggatcctggggcttggtccgagccttggccttgtcagggtccccggcattggcctggtctacaccgagctcgccagcggtgttcctcacatcttctcgcacttcatcaccaacctcccggcgatccactcgacgctggtgttcgtctgcgtcaagtacctcccggtgtacaccgtgccaccggatgagaggttcctggtgaagcggatcggccccaagaacttccacatgttccggtgcgtggcgcggtacgggtacaaggacatccacaagaaggatgacgacttcgagaagatgttgttcgatagcctgattctgttcgtgaggctggagagcatgatggaggagtacagcgactccgacgagtacagcaccctgatgatgagcctcccaaataacccagggatcagcaatggcggcgtgaccaccaccggcaccaacaatgtcatggaggtgatgagctgcacgtcgacccatgactccattgtgccggtgaactccaggtccgacgacacgggcagcagccaggtgatgccggcgtcggggcagatggcgttccagagcgtcggcgacgagatcgcgttcctgaacgcgtgcagggacgccggggtggtgcacatcctcgggaacacggtgatcagagctcgcagggattcagggttcgtcaagaagattgtcatcaactacatgtatgctttcctgaggaagatctgcagggagaacagtgccatcttcaatgtgcctcatgagagcatgctcaatgttgggcaggttttctacgtgtaatgtaatcttagtagcactagattgtaaactaaacatgcatgtgattgtatcattcagaccgacttgggaaagtgatttcatccctcgaggggatattccctcgttttatgcatgccacctaaatagtcataattttttttaaaaaaaattggaagatagattaatatgaaataaatcactctatataaacatggcgaggggaggctgcaggtgaagcttggacggcgaggcaacacggtggtgaagcgggaggcgtcggtcgagcaccacgacggcagcaaccggcggcacgctggacatgttcaagcgactggctgctagccggggagccaatgaataaacttaattggttcagggttcctgatgcaaattcctaattccttctcattttacatattactagtactagaaaataagtgtggtcgttggcgcgccattttcatgagccccatgtgtaatcttttttttttaacgactcacactagacggtgcgaagttctattgatagaacaggaaaaaaattacaagattacaaccctgaaaggttgtaaccaggaaaaaggaaaaaatatacc

SEQ ID NO: 1519 - DNA, 2716 bp, Secale cereale
ggcgcccatcccgccggaaccggccgagctcctcacctgtggcggcggcggcggcggcggtgtctctccgtcctcgccggaaccggccgggctcattgcgaagcacggttgacgaggtgtcgctggtcccctgtggcagtttgtgacatacttctgctgctgattgactggcctgaagtctgaagtctgaacctcatggagaccgtttcgacgaatgaggacaccggcaagggggcgatgtgggagctggagaagagccttgatcagcccatggacgcagaggccgggagactgaggaacatgtacagagaaaagacctacccaacagttttgatgctacaactagctttccaaagccttggtgtggtgtttggggatttaggcacatcgcctctttatgttttctacaacatctttcccgaggagatagaagacacggagcaaattatcggggcactctcgcttattatctactcgcttactctcattcccctcgttaaatatgtttttatcgtcttgagggcaagcgataacggccaaggtggaacttttgctctttattcattgctttgccggcatgcaaagataagcattattcccaatcaacataaaactgatgaagacctgacaacatacagccgtcagacatatgatgagaagtctcttgctgcaaagatcaaaagatggttagaggggaaccaattcagaaagaatgtcatccttattcttgtcctttttggtacttgcatggctgttggagatggaattctcactcctgctatatcagttctttctgcaactggtggaataaaggtcgaagaacccagaatgggaaatgatgtggttgtaatagtctccgtggtgatactgattggactgttcagtatgcagcactatggcacagacaaagtcagctggctttttgcaccaatagtatttgtttggttcatacttattggagtcctgggggctgtaaacatttatacatatgataggtcggttctcaaggcgttcaatcctatttatgtatatcgttattttaagcgagggaagactagctgggcttctctaggaggaattatgctcagcataacagggacagaagcactattcgccgacctttcatattttcctgtgcaagctattcagattgctttcaccacggttgtgttcccatgtcttcttttgcaatatactggtcaagctgcctatatagccacgcacaaagacaaagtctcccactccttctatttttctcttccagcgcgtatactttggccagcatttgccgttgcaacagctgctgcaatagtttctagccaggcaaccatttccgcgacgtactcaattatcaagcaagcgcttgcggtgggatgcttccccagggtgaagatcatccatacatcgaagaagtatcttggccagatatacagtcctgatattaattggatcctcatgattctctgtattgcggtcaccgctggattcaagaaccagtcccaaattgcaaatgcttatggtacagctgtgataatggtcatgcttgtgacaacatttctcatggtccccataatgctgctggtatggcgcagccattgggccttggtcgtcctcttcacgacgctgtcactggtcatcgagatcccgtacttgaccgccgtcatgaagaagattgaccagggcggctgggttcctctcgtgtttgccgcggccatcctcctcatcatgtacgtgtggcattacggcacgctcaagcgctacgagttcgagatgcacagcaaggtgtccatggcgtggatcctgggcctcggcccgagcctcggcctggtccgggtgcccgggataggtctagtgtacacggagctggcgagcggcgtcccccacatcttctcacacttcatcaccaacctcccagcgatccactccaccctggtgttcgtctgcgtcaagtacctgccggtgtacacggtgccgctggacgagcggttcctggtgaagcggattggccccaagaacttccacatgttccgctgcgtggcgcggtacggctacaaggacatccacaggaaggacgacgacttcgagaagatgctattcagcagcctgctactcttcgtccggctggagagcatgatggaggagtactcggactccgatgagtacagtgccctggaccagcaggagctggtcgacgaggcgagcagcgacgccaggtccgccgccgacctcagctacgcctcacgcgactccatcgtgccggtgcgctccccgaaccgcctgggggccatgtcgtcggcgcagactacaacggcgaccccggggttcgagaccgtgggcgacgaggtcgcgttcctgaactcgtgcagggacgccggggtcgtgcacatccttgggaacaccgtcatcagggctcgcagggactcggggccgctgaagaagctcgccatcgactacctctacgccttcctgaggaagatctgcagggagaacagcgccatcttcaatgttccccatgagagcctgctgaatgttgggcaggtgttctatgtgtagctaaactggatgtaaatgactgtgtttgtgtgtagattattttgcaggagaactctatagaaatgatgactaattgattttacatatctggaacatgtagattttagtactaataaaatggcacatgtacattttagtaataaaatggcaaatttcagcgcaa

SEQ ID NO: 1520 - DNA, 2456 bp, Secale cereale
ctgctgctgattgactggcctgaagtctgaacctcatggagaccgtttccacgaatgaggacaccggcaagggggcgatgtgggagctggagaagagcctcgatcagcccatggacgcagaggccgggagactgaggaatatgtacagagaaaagacctacccaacagttttgatgctacaactagctttccaaagccttggtgtggtgtttggggatttaggcacatcgcctctttatgttttctacaacatctttcccgaggagatagaagacacggagcaaattatcggggcactctcgcttattatctactcgcttactctcattcccctcgttaaatatgtttttatcgtcttgagggcaagcgataacggccaaggtggaacttttgctctttattcattgctttgccggcatgcaaagataagcattattcccaatcaacataaaactgatgaagacctgacaacatacagccgtcagacatatgatgagaagtctcttgctgcaaagatcaaaagatggttagaggggaaccaattcagaaagaatgtcatccttattcttgtcctttttggtacttgcatggctgttggagatggaattctcactcctgctatatcagttctttctgcaaccggtggaataaaggtcgaagaacccagaatgggaaatgatgtggttgtaatagtctccgtggtgatactgattggactgttcagtatgcagcactatggcacagacaaagtcagctggctttttgcaccaatagtatttgtttggttcatacttattggagtcctgggggctgtaaacatttatacatatgataggtcggttctcaaggcgttcaatcctatttatgtatatcgttattttaagcgagggaagactagctgggcttcgctaggaggaattatgctcagcataacagggacagaagcactattcgccgacctttcatattttcctgtgcaagctattcagattgctttcactacggttgtgttcccatgtcttcttttgcaatatactggtcaagctgcctatatagccacgcacaatgacaaagtctcccactccttctatttttctcttccagcgcgtatactttggccagcatttgtggttgcaacagctgctgcaatagtttctagccaggcaaccatttccgcgacgtactcaattatcaagcaagcgcttgcggtgggatgcttccccagggtgaagatcatccatacatcgaagaagtatcttggccagatatacagtcctgatattaattggatcctcatgattctctgtattgcggtcaccgctggattcaagaaccagtcccagattgcaaatgcttatggtacagctgtgataatggtcatgcttgtgacaacatttctcatggtccccataatgctgctggtatggcgcagccattgggccttggtcgtcctcttcacgacgctgtcactggtcatcgagatcccgtacttgaccgccgtcatgaagaagattgaccagggcggctgggttcctctcgtgtttgccgcggcgatcctcctcatcatgtacgtgtggcattacggcacgctcaagcgctacgagttcgagatgcacagcaaggtgtccatggcgtggatcctgggcctcggcccgagcctcggcctggtccgggtgcccgggataggtctagtgtacacggagctggcgagcggcgtcccccacatcttctcacacttcatcaccaacctcccagcgatccactccaccctggtgttcgtctgcgtcaagtacctgccggtgtacacggtgccgctggacgagcggttcctggtgaagcggattggccccaagaacttccacatgttccgctgcgtggcgcggtacggctacaaggacatccacaggaaggacgacgacttcgagaagatgctattcagcagcctgctactcttcgtccggctggagagcatgatggaggagtactcggactccgatgagtacagtgccctggaccggcaggagctggccgacgaggcgagcagcgacgccaggtccgccgccgacctcagctacgcctcccgcgactccatcgtgccggtgcgctccccgaaccgcctgggggccatgtcgtcggcgcagactacaacggcgaccccggggttcgagaccgtgggcgacgaggtcgcgttcctgaactcgtgcagggatgccggggtcgtgcacatccttgggaacaccgtcatcagggctcgcagggactcggggccgctgaagaagctcgccatcgactacctctacgccttcctgaggaagatctgcagggagaacagcgccatcttcaatgttccccatgagagcctgctgaatgttgggcaggtgttctatgtgtagctaaactggatgtaaatgactgtgtttgtgtgtagattattttacaggagaactctatagaaa

SEQ ID NO: 1521 - DNA, 3069 bp, Brachypodium distachyon
gttccaaatcatctccactcctctcagctcctccacatcaatcacgtttataatccgacaaccaaacctgcgcctcgagaagcaaaattccatttgctcggcttaaaaatccaatcttgtgcccccgcccggcggcgcacatccaccccccaccccaccggagccgaacgagtccattacgccgtacataccggcgaggcggcggcccctcttcttccccgcctcaccccctcctatatgggcgacgaggtctccacggtccctgggggcgggtgttcgtcacgcggttgcacgtggtgagcagggaagcgagggcaacgcgactcgatcttggcaatgggtctcgtgggactggcgctctaggttctgaacgagcgaccacgggcctttggcaagttttgggctttcggcgcactctccgtgagcttgggatccgaggatcgtcagtttgtaagatactgctgccaattggtctgaactcatggagaccatttcaagttcaacaaatgagcatccgcataagggggcaatgtgggaactggaaaggaatattgatccgcctatggatgcagaggccgggagactcaggaatatgtacagacaaaagacctacccgacaattttgctgctacaactagctttccaaagccttggtgtggtatttggagatttaggcacatcacctctttatgtcttctccaacatctttcctcatgaaatagaagacacggagcaaattattggagcactgtcacttattatctactcccttactctcattccacttgttaaatacgttttcattgtgttgagggcaaatgataacggccaaggtggaacatttgctctttattcactgctttgtcggcatgcaaagataaacatcattcccaatcaacatagaaccgatgaagagctaacaacatacagccgtcatacgtacgatgagaaatctcttgctgcaaagatcaaaagatggttagaggggcaccaattccgaaagaatgccattcttattcttgtactttttggtgcttgcatggctgttggagatggaattctcactcctgccatatcagttctttcggcaactggtggaatacaagtggaagaacccagaatgataaacgatgtggttgtaatagtctctgtggtgatattgatcggattgttcagcatgcaacactatggtactgataaagtcagctggctatttgcaccgatagtattcatttggttcatacttattggagttctgggagcggtgaacatttatacatatgataggtcggttcttaaggcgttcaatcctatttatgtatatcgttactttaagcgagggaagactagctgggcttccctaggaggaattatgctcagcataacagggacagaagcactatttgcagacctttcatattttcctgtgcaagctattcagattgctttcactacggttgtgttcccatgccttcttttgcaatatactggacaggctgcctacatagccacatacaaaaaaaatgtctcccatgctttctattattctcttccagatcgtatactttggccagcatttgccgttgcaacagctgccgcaatagtttccagccaggcaactatatccgcgacgtattcaatcatcaagcaagcgcttgcagtgggatgcttccccagagtgaagatcatccatacctccaagaagtatcttggccagatatacagtcctgatataaattggattcttatggttctctgcatagctgtcaccgctggatttaaaaaacagtcccaaattgcaaatgcatatggtactgctgtgataatggttatgcttgtcacaacatttctcatgatccccataatgctgctggtatggcgcagccactggaccttggtcgtcctcttcaccgtgttttcattggtcgtggagatcccgtacttgactgccgttatgcggaaaatcgaccagggtggttgggttcctcttgtgttcgccgtggccatcctccttgtcatgtacgtttggcattacggcacactcaagcgctatgagttcgagatgcacagcaaggtgtccatggcatggatcttaggccttggcccgagccttggtcttgtcagggtacccgggatagggctggtgtacacggagctggcgcgcggtgttcctcacatattttcgcacttcatcaccaacctcccagcgatccactccgctctggtgttcgtatgcgtcaagtacctcccggtatacaccgtgccaacggacgagaggttcctggtgaagcggatcggccccaagaacttccacatgttccgctgcgtggcgcggtacgggtacaaggacatccacaagaaggacgacgacttcgagaagatgctcttcgacagcctgctgctcttcgtccggctggagagcatgatggaggagtacacggactcggacgaatacagcgccttggcggaccagcaggagctgaacgaagtgagcagcaacgccaggtccatcgccgagctcagcagctacgcctcccatgactccatcgtgcctgtgcgttctccggagaacaacaatggacgggtcatgttgtcggggcagacgacgacggcggcgttcgagacggtgggcgacgaggtggccttcctgaactcatgcagggacgccggggtggtgcacatcctcgggaacaccgtcatcagggcccgcagggactcggggctggtgaagaagatcgccatcaactacctgtacgccttcctgaggaagatctgcagggagaacagcgtcatcttcaatgttccccatgagagcctgctcaatgttgggcaggtgttctatgtctagtttattaaactggatgtaatgtaaattcagtcaccagtgtgtgtagattatttataggagaactgtatgtacagagatgatttttgcatatctgggaaagtgtaaatctggatgaattgagtaagtttcagtgtagcgcgattcagatacaactctgaatcaaacttttgcaaaacagagtttcagatacaaatctttatcgagttgcacttcaattattc

SEQ ID NO: 1522 - DNA, 2632 bp, Triticum aestivum
acatacttctgctgctgattgactggcctgaagtctgaacctcatggagaccgtttcgacgaatgaggacaccggcaagggggcgatgtgggagctggagaagagccttgatcagcccatggacgcagaggccgggagactgaggaatatgtacagagaaaagacctacccaacagttttgatgctacaactagctttccaaagccttggtgtggtgtttggagatttaggcacatcgcctctttatgttttctacaacatctttcctgagaagatagaagacacggagcaaattatcggggcactctcgcttattatctactcgcttactctcattccactcgttaaatatgtttttatcgtcttgagggcaagcgataacggccaaggtggaacttttgctctttattcattgctttgccggcatgcaaagataagcattattcccaatcaacataaaaccgatgaagacctaacaacatacagccgtcagacatatcatgagaagtctcttgctgcaaagatcaaaagatggttagaggggcaccaattcagaaagaatgtcattcttattcttgtactttttggtacttgcatggctgttggagatggaattctcactcctgccatatcagttctttctgcaactggtggaataaaggtcgaagagcccagaatgggaaatgatgtggttgtaatagtctccgtggtgatactgattggactgttcagtatgcagcactatggcacagacaaagtcagctggctttttgcaccaatagtatttgtttggttcatacttattggaatcctgggggctgtaaacatttatacatatgataggtcggttctcaaggcattcaatcctgtttatgtatatcgttattttaagcgagggaagactagctgggcttccctgggaggaattatgctcagcataacagggacagaagcactgtttgctgacctttcatattttcccgtacaagctattcagattgctttcactacggttgtgttcccatgtcttcttttgcaatatactggtcaagctgcctatatagccacgcacaaagacaaagtctcccactccttctatttttctcttccagagcgtatactttggccagcatttgtcgttgcaacagctgctgcaatagtttctagccaggcaaccatttccgcgacgtactcaattatcaagcaagcgcttgcggtgggatgcttccccagggtgaagatcatccatacatcgaagaagtatcttggccagatatacagtcctgatattaattggatcctcatgattctctgtattgccgtcaccgctggattcaagaatcagtcccagattgcaaatgcttatggtacagctgtgataatggtcatgcttgtgacaacatttctcatggtccccataatgctgctggtatggcgcagccattgggccttggtcgtcctcttcacggcgctgtcactggtcgtcgagatcccgtacttgaccgccgtcatgaagaagattgaccagggcggctgggttcctctcgtgtttgccgcggccatcctcctcgtcatgtacgtgtggcattatggcacgctcaagcgctacgagttcgagatgcacagcaaggtgtccatggcgtggatcctgggccttggcccgagcctcggcctggtccgggtgcccgggataggtctggtgtacacggagctggcgagcggcgtcccccacatcttctcacacttcatcaccaacctcccggcgatccactccaccctggtgttcgtctgcgtcaagtacctgccggtgtacacagtgccgctggacgagcggttcctggtgaagcggattggccccaagaacttccacatgttccgctgcgtggcgcggtacggctacaaggacatccacaggaaggacgacgacttcgagaagatgctattcagcagcctgctgctcttcatccggctggagagcatgatggaggagtactcggactccgatgagtacagtgccctggaccagcaggagctgatcgacgaggcgagcagtgacgccaggtccgccgccgacctcagctacgcctcccgcgactccatcgtgccggtgcgctccccgaaccgcctgggggccatgtcgtcggcgcaggctacaacggcgaccccggggtttgagaccgtgggcgacgaggtcgcgttcctgaactcgtgcagggacgccggggtcgtgcacatccttgggaacactgtcatcagggctcgcagggactcggggccgctgaagaagctcgccatcgactacctctacgccttcctgaggaagatctgcagggagaacagcgccatcttcaatgttccccatgagagcctgctgaatgttgggcaggtgttctatgtgtagctaaagtggatgtaaatcactgtgtttgtgtgtagattattttacaggagaactctacagaaatgatgattaattgattttacatatctggaatatgtagattttagtactaataaaatggcacatgtaaattttagtaataaaatggcaaatttcagtgctgtgcaaattcagatacgaatctgaaacaaattatggaattaagatgcgaatacatatcatattatagtc

SEQ ID NO: 1523 - DNA, 1677 bp, Panicum virgatum
gctgattcagcgagtcagggaatcccgattgctccggagcgcccccgtcgcctttttcaaccgcccccgtccgtgacaggtcgcccacgcgcgccagtagtcttgccaatggactcgtcgcgttccccccgcctgctcctcctcctcctgcccgccctcctcgccccgtcgtcggcgggggtcatccggctgccgagcgggaaggcgggggcgcgggcgtgcgccgcgccgccggaccccgccgcgtacgaccgccccgtcatcggcatcgtctcgcacccgggggacggcgcgggcggcaggatcagcaacaccaccgccacctcctacatcggcgcctcctatgtcaagttcgtcgaggccgccggcgcgcgggtcatcccgctcgtctacaacgagcctgaggagcgcctcctcgagaaactgagtttggtgaatggtgtgctgttcactggtggatcagagaagcaaggtgtatattttgagacaataaaaaaagtgtttcagtatgttttggacaggaatgacgcaggcgaaccatttcctttatttgctcaatgcctaggctttgagcttgtaagcatgattgtcagcaaggacaataatatcttggagacgtttgacgcccacgatcaagcatctactcttcagtttcccagctattcttttgagggcacagtgtttcaaagatttgactctgacctcatcaagaaagttagcaccagctgtcttgtcatgcaaaatcacatgtatggtatatcgccaaagcgtttgcgagagaatgatgaactatcaagtttcttcagagtcttgactacatcgtctgatgaaaacggcaaggtctacgtctcaactgtacaagcaaataaatatccaatcacttgcacgcagtggcatcctgagaaagccatttttgagtggagaaaaccaatgatcccacacagtgaagacgcagtacaagttactcaacattttgctaatcattttatcagccaagctcgcaagtctcccaacaggcctcctgcagacaaggtgctcgataacctgatctacaactacaatcccacatttagtggaaaaacctcgaaatcttttgaggtggtttacatattctcctgagacggaagcaggcgcgggagggtcttcctgaaccagcatagcattgttattgtagtgtggttgtgtatccatcatactcggaagacgggagcctatagattctgggcttcctgtattgctttactcttgccgccatattggtgagcactgctgctatttgtgcacttcgcgccaccatcgcatattcaccttcggcaggagcatttatgtactgaactgaacatgccttgaagagtatgcatgtatatatgtgagaatttggtgcccaagagtctccaaatctgatggatgtttgaaaattgaaaggctggcttggcccaattgatagttgaatgctctgagatcgatctgattgatgaaatcatcagaacactcacgcttcaggtgaaagggagctaaactcatgctttcattgttgcagaagagcatttgacgaggtgtaaatcttctcctaagattgaagcagatgcctcagggtcttctggaagcaccgctgcaacatctgtaattaacccttgttaattcacaatattcatctctgaatctactttgagtgca

SEQ ID NO: 1524 - DNA, 1253 bp, Saccharum officinarum
cacagacacaggcgggcgacgcacgccagccagtgttgccaatggactcgcgctgcccccacctgctcctgctcctccccctcctcctcccgccgtcgtcgggggtggcggcggcggcgggggtcatccggctgccgacgggcgggagagcgggggccctggcctgcgcgccgcgggaccccgccgtgtacgaccgccccgtcatcggcatcgtgtcgcacccgggggacggcgcgggcggcaggatcagcaacaccaccgccacctcctacatcggcgcctcctacgtcaagttcgtcgaggccgccggcgcgcgcgtcatcccgctcgtctacaacgagcccgaggagcgcctccgcgagaaactgagtttgctgaatggagtgctattcactggtggatcagagaagcaaggtgtatattttgagacgataaaaaaagtgtttcagtatgttttggacaagaatgacgcaggtgaaccatttcctttgtttgcccaatgtcttggctttgagcttgtaagcatgattgtcagcaaggacaataatatcttggagacgtttgatgcccagaatcaagcatccactcttcagtttcccagctatgctttggagggctcagtgtttcaaagatttgaccctgacctcatcaagaaagtcagcaccagctgtcttgtcatgcaaaatcatagatatggtatatcaccaaagcgatatcgagagaatggtgcactatctagtttcttcaaaatcttgactacgtcgcccgatgaaaacggcaaggtctatgtctcaactgtacaagccaataactatccaatcacttgcacgcaatggcatcctgagaaagccattttcgagtggaggaaaccaatgattccacacagcgaagatgcagtacaggttactcaacattttgccaatcattttatcagccaagcacgcaagtctccaaacaggcctcctgccgacaaagtgctggataacttaatttacaactacagcccaacatttagcggaaaaaaatcgaaatcgtttgaggaggtctacatctttgcctgagactgaagtggacgcctgggtgtcttcaggaatcagcactgcattgctattgtatggggggccattgtattgtgattgtgtattacgcgtggtacctggaagtgtacagacttcttggactgcctgtattgcagtaacctatatataagcaggaataataatgtaatgaactgaaaaatacttgtacagaga

SEQ ID NO: 1525 - DNA, 1277 bp, Panicum virgatum
  misc_feature (803)..(803): n is a, c, g, or t
  misc_feature (883)..(883): n is a, c, g, or t
  misc_feature (926)..(926): n is a, c, g, or t
  misc_feature (934)..(934): n is a, c, g, or t
  misc_feature (952)..(952): n is a, c, g, or t
  misc_feature (1078)..(1078): n is a, c, g, or t
  misc_feature (1165)..(1165): n is a, c, g, or t
cctgcccgccctcctcgccccgtcgtcggcgggggtcatccggctgccgagcgggaaggcgggggcgcgggagtgcgccgcgccgccggaccccgccgcgtacggccgccccgtcatcggcatcgtctcgcacccgggggacggcgcgggcggcaggatcagcaacggcaccgccacctcctacatcggcgcctcctacgtcaagttcgtcgaggccgccggcgcgcgggtcatcccgctcgtctacaacgagcctgaggagcgcctcctcgagaaactgagtttggtgaatggtgtgctattcactggtggatcagagaaacaaggtgtatattttgagacaataaaaaaagtgtttcagtatgttttggacaggaatgacgcaggtgaaccatttcctttatttgctcaatgcctaggctttgagcttgtaagcatgattgtcagcaaggataataatatcttggagacgtttgacgctcataatcaagcatctactcttcagtttcccactattcttttgaaggcacagtgtttcaaagatttgactctgacctcatcgagaaagttagcactagctgtcttgtcatgcaaaatcacagatatggtatatcaccaaagcgtttgcgagagaatgatgaactatcaagtttctttagactcttgactacatcacctgatgaaaacggcaaggtctatgtctcaactgtacaagcaataaatatccaatcacttgcacacagtggcatcctgagaaagccatttttgagtggagaaaaccaatgatcccacacagtgaagangcagtacaagttactcaacattttgctaatcattttatcagccaagctcgcaagtctcccaacaggcctcctgcagacanggtgctcgataacctgatctacaactacaatcccacatttagnggaaaaanctcgaaatcttttgaggnggtttacatattctcctgagacagaagcagacggaagcaggcgcgggagggtcttcctgaaccagcatagcattgttattgttgtgtgggctgtgtaatccatcatactcggaagcctatagattntgggctttcctgtattgctttacttttgccgccatattggtgagagctgctgctatttgtgcacttcgcgcgaccatggcctattcnccttcggcaggagcatttatgtactgaactgaacatgccttgaagagttgtatgtatatatgtgagaataggtatctaagagtctccaaatctgatggacgtttgagaattg

SEQ ID NO: 1526 - DNA, 1465 bp, Pennisetum glaucum
acaggtgacaggccacggcacgcacaattgcacagacggccgcttcacgccagtgcccgcccggtcttgccaatggacgactcgtcacgcgccccccacctgctcctccccctcctccttgccgccctcctagtcctcgccccgtcgtcgcgcgcggcggcggagccgggggtcatccgtctgccgagcgggaaagcaggggcgcgggcgtgcgccgcgccgccggaccccgccgcggggtacgaccgccccgtcgtcggcatcgtctcgcacccgggggacggcgcgggcgggaggatcagcaacggcaccgccacctcctacatcggcgcctcctacgtcaagttcgtcgaggccgccggcgcgcgggtcatcccgctcgtctacaacgagcccgaggatcgcctgctcgagaaactgagtttggtgaatggtgtgctgttcactggtggatcagagaagcaaggtgtatactttgagacaattaaaaaggcgtttcagtatgccttggacaagaatgacgcaggtgaaccatttcctgtgtttgctcaatgcctaggctttgagcttgtaagcatgattgtcagcaagaccattggagcaaagtgctgcggtcttctgttccaagaagatatcattatttctgttcagtttgccaaaactgggcagtgggcactaattgttgttttcctatggtgctaggacaataatatcttggaaatgtttgacgccgagaatcaagcatctactcttcagtttcccagctattttttcgagggtacggtgtttcaaagatttgaccctgacctcatcaagaaagtcagcaccagctgtcttgtcatgcaaaatcacagatatggtatttcaccaaagcgtttccgagagaatgatgaattatcaagtttcttcagaatcctgactacatcgcctgatgaaaatggcaaggtctatgtctcaactgtacaagcaaatcaatatccaatcacttgcacgcagtggcatcccgagaaagccatttttgagtggagaaaaccaatgataccacacagtgaagaagcagtacaagttactcaacattttgctaatcattttatcagccaagctcgcaagtctcccaacaggcctcctgcggacaaagtgcttgataacctgatctacaactacagccccacatttagcggaaaaacctcaaaatcttttgaggaggtttacatcttctcctaagactcgagcatgcgccagactgccagagggtcctcctgaaccagcattgcattgctgatgtgttaaggctgtgtattcttcatacctgtattgttttactcctgtcgccaatatgcaatggtgggcgctggcgcgctgctgtattattgtggacttgagccaccatcgccttcagcaggaacatctatcatctgtgtactgaattgatacataccttgaagagtaatatgtatatatgtga

SEQ ID NO: 1527 - DNA, 1423 bp, Zea mays
aacaaatgttgcttgcaaatgttcgtgacttcgtgtggtccctagtgagggctggagcgaaaccgcccgctgtctcgcgtccgtcagacagcacgcacagacgcaggcgggcgacgcacggcagtgttgccaatggactcgcgctgcccccatctgctactgctcctccctctcctcctcttggccgccctcctgcccccgccgtcgtcgggggtgccggaggtcatctggctgccgacgagcgggggagcggggcccttgtcctgcgcgccgccggaccccgccgtgtacgaccgccccgtcatcggcatcgtctcgcacccaggggacggtgcgggcggcaggatcagcaacaccaccgcgacctcctacatcggcgcctcctacgtcaagttcgtcgaggccgccggctcgcgcgtcatcccactcgtctacaacgagcccgaagaccgcctcctcgagaaattgagtttgttgaatggagtgctgttcactggtgggtcagagaaggaaggtgtatattttgacacgataaaaagagtatttcagtatgttttggacaagaatgatgcaggtgaaccatttcctttgtttgcccaatgtcttggctttgagcttgtaagcatgattgtcagcaaggacaataatatcttggaggcatttgacgcccaggatcaagcatcaactcttcagtttcccagctatgctttggagggttcagtttttcaaaggtttgacactgacctcatcaagaaagtcagcaccaactgtcttgtcatgcaaaatcacagatatggtatatcaccaaggcgatatcgagagaacgatgcactatcaagtttcttcaaaatcttgactacatcacctgatgaaaacggcaaggtctatgtctcaactgtacaagccaataattatccaatcacttgcacgcaatggcatcctgagaaagccatttttgagtggaggaaaccaatgatcccacacagcgaagatgcagtacaggttactcaacattttgccaatcattttatcagccaagcacgcaagtctccaaacaggcctcctgccgacaaagtgctggataacttaatttacaactacagtccgacatttaccgggaaaaaatcgaaatcgtttgaggaggtctacatcttctcctgagactggattgaacgcctgagtgtcttcaggaatctgtagttctgcactacattgctattgtagtgtaaccgtgcattagtattacccgtggtaccagaagttgtatttgtatagattcgttggactgcctgtattgcagtaacctttccaccgtatgggtggctctatagaatgcctataagcagcgcaataataatgataatgtaagactgaaaaaaaatacttgtatggagattttctgaatttaaaagtttctccaaat

SEQ ID NO: 1528 - DNA, 1400 bp, Sorghum bicolor
cacgtacacacgcacaacacaagcgggcgacgcacggacactgttgccaatggactcgcgctgccccaacctgctgctccccctcctcttccttgccgccgccctcgccccaccgtcgtcggaggcaacagcggcaccggcaggggtcatcaggctgcggacgagcgggaagcgggggctgcagcctgcgccgccggcgccggcggaccccgccgtgtacgaccgccctgtcatcggcatcgtctcgcacccgggtgacggcgcgggcggcaggatcagcaacaccaccgcgacctcctacatcgccgcctcctacgtcaagttcgtcgaggccggcggcgcgcgcgtcatcccgatcatctacaatgagcccgaggagcagctgctcgagaagttgagtttggtgaatggcgtactgttcactggaggatcagcgaagcaaggcctatattttgagacaattaaaaaagtctttcagtatgttttggacaagaatgacgcgggcgaacaatttcctttgtttgctcaatgtcttggctttgagcttgtaagcatgattgtcagtaaggacaataatatcttggagaaatttgacgccctgaatcaagcatctactcttcagtttcccagttatgatttcgagggctcagtgtttcaaaggtttgaccctgacctcatcaagaaagtcagcaccagctgtcttgtcatgcaacagcatagatatggtatatcaccaaggcgactgcaagagaaagatgcactgtcaagtttcttcaaaatcttgactacatcacctgatgaaaacggcaaggtctatgtctcaactgtacaagcccacaagtacccaatcacttgcacacaatggcaccctgagaaagccatttttgagtggaggaacccagtgattccacacagcaaagatgcagtacaggttacccaacattttgccaatcattttatcagccaagcacgcaagtctccaaacagacctccggccgacaaggtgcttgattacctgatttacaactacagcccgaccggaaaaaaattgaaatcgtttgaggaggtctacgtcttctcctgaggctgacgaagatggacgcctgagtgccagcactgcatagtattgtgattgtgtattcatcctaccacctgaaagtgtacggattccttgcatttcctgtattgcagtacgtatgttggaaaaataagtgggaagaataatgtactgaactgaaactaccttgtgcggagactactctgaattccaggggaaggttgaatgaatgctccaggacctgattcatgaaatcgatcgaaactgaaagttgaatgtacggggataagctctctatggccattcccaaatgcatgtgttgctacttgctatagttcggctg

SEQ ID NO: 1529 - DNA, 1451 bp, Brachypodium distachyon
cttctggcgtgcagcaagcagaagccgacagtccaaatggcttctccccatctgctcccctttctccccctcctcctcctcctcgccccctcgtcggcggcgacgggcgtcatccagcttcccagcgcccgggcctgcgccgcgccgccggaccccgcggtgtacgaccggccggtgatcggcatcgtgtcgcacccgggcgacggcgcctccgggaagatcagcaatgggacggccacctcctacatcgccgcttcctacgtcaagttcatcgagtccgccggcgcccgcgtcatcccgctcatctacaacgagcccgaggagcgcctcctcgagaaactgagtttggtgaatggtgttctgtttactggtggatcacagaagagtggtatatatttcgaaactataaaaaaagtgtttcagtacgtcgtggacaagaatgatgcaggagttatacttccattattcgcgcagtgccttggtttcgagcttataagcatgatagtgagcaaggacaataatattctggagtcattcagcgcctcaaatcaagcatcaactcttcaatttccaaattattcttcacttgagggatcagtatttgaaagatttcatcctgatctcatcaagaaactcagcaccagttgtcttgtcatgcaaaatcacaaatatggcatatctcctaagagattgcgagagaatggggccttgtcaagcttcttcagaattctgactacatcacctgatgaaaatggggaggtttatgtctcaaccgtacaagcacagaaatatccgatcacttgcactcagtggcatcctgagaaagccatttttgagtggggtaaaccaatgattccacacagtgaggatgcggtacaagtgactcaaaattttgccaactattttgtcagccaagcacgcaagtccccaaacagacctcctgctgacaaggtgctggataacctgatttacaactacagccctacgttttcggggaaaacctcgaaatccttcgacgaggtctacatattctcctaagatcggagcagatgcttgtatgcttgctgatgtcagaagggtgagataaggagatatactgctgtatgcttagtcgcttaccaatgtaagaaggatgagaacttcagttcattacagaaattgtaaagtttgactgtgtatatccggggttcaggggcagggtcagtagctgtgttgtttctccgaataaataaaagcatcctcccccaaactgtattcatgtattgttaaatctcccacatctgccattcagttaccttttcctcctcacatcgaagaagaactgccaactgggcgttctttacgtgaaagatgtgcgtatagatgattcaaaaagaaattgataccatgaaatcttttttttttgtgagtgaaattgataccatgaaatcgacagggtgcgctttcaaatt

SEQ ID NO: 1530 - DNA, 1579 bp, Oryza sativa
aattaaaaaggtataatctcaaaccgatgcgtcatttgcatatctcagataattatctcgtctcactttgccaccaacaactttctccttcctcctcacatctcgcgtcgcgtgagacgcactcctcacgcacgggagcagcagcgatgggttctcctcctccccatcgcctgctcctcctcctcgcggtcgccgccgtgctccaccgctcggcggcggcggcggagggggtcatccggctgccgagggggagggcgtgtgcggcgccgacggaccccgcggcgtacgaccggccggtgatcggcatcgtgtcgcacccgggggacggcgcgggcgggagggtcagcaacggcacggccgcctcctacatcgccgcctcctacgtcaagttcgtcgagtccgccggggcgcgcgtcgtcccgctcatctacaacgagcccgaggagcgcctcctcgagaaactgagtttggttaacggtgttctgtttactggtggttcggtgaagagtggcccatattttgagaccataaagaaagtgtttcagtatgtcttggacaagaatgatgcagggattccatttccactttttgcacagtgtcttggttttgagcttgtaagcatgattgtcagcaaggacaataatatcttggagtcattcagtgccacaaatcaagcatctactcttcaatttcccaattactcttcacttgagggatcagtatttgaaagatttgatcctgatctcatcaagaaactaagcaccagttgtcttgtgatgcaaaaccacaaatatggtatatcacccaagacattgcgagagaatgttgccttatcaagtttcttcaagattctgacaacctcacctgatgaaaatggcgaggtctatgtctcaaccgtgcaagcaaacaaatatcctatcacatgcactcagtggcatcctgagaaagctatttttgagtttggtaaacaaatgattccacacagcgaggaggcagtacaagtgacacaaaattttgccaactattttatcagccaagcccgcaagtcccagaacagacctcccgcagacaaggtgttggacaacctgatttacaactacagccctacgtttattgggaaaaaatcgaaatcgttcgacgtggtctacatcttctcctaatggccaacctgatcattgaaagtcttcgctattgtattctacatggagtgcttcactgtgtatgagtatatatgtgtccattgtctaccattgtgctgcattgccgttgccgctgtaatttatcagacgaatcaagagcggatttcgctccctgctttggaaggaggtcccagctgtttgatccgcggtcacattattcgtttcggacccttggaaattaaacagcaaatatagttgttggcccaactgagcccgcttttcatatggacactaatgcccaattaggcccgttaaaatttggttcgtgatctagtaaacccgtgaactaaaaagtaaacccaagtaactttgctggtatcctatctctatctcttctcttctctctactcttataaaaattgaagatgtttttgctggta

SEQ ID NO: 1531 - DNA, 1408 bp, Pseudoroegneria spicata
  misc_feature (6)..(7): n is a, c, g, or t
  misc_feature (209)..(209): n is a, c, g, or t
  misc_feature (325)..(325): n is a, c, g, or t
  misc_feature (541)..(541): n is a, c, g, or t
  misc_feature (1036)..(1036): n is a, c, g, or t
  misc_feature (1038)..(1038): n is a, c, g, or t
  misc_feature (1200)..(1200): n is a, c, g, or t
  misc_feature (1353)..(1353): n is a, c, g, or t
  misc_feature (1379)..(1379): n is a, c, g, or t
cacagnncacatggcttctcctccccggcacctgctccccctcctcctgctcgccctcctcgccccctcctcgtcggcggccccgggcgtcatccggctgccgcgcgccggggcctgcgccgcgccggcggacccggccgtctacgaccgccccgtgatcggcatcgtcacgcacccgggcgacggcgcggccgggaggatcgacaacngcacctccacctcctacatcggtgcctcctacgtcaagttcgtcgaggccggcggcgcccgcgtcatcccgctcatctacaacgagcccgacgagcgcctcctcgagaaactcagnttggtgaacggtgtgctgtttactggtggatcagtaaagaggggtccatattttgagacgattaagaaagtgtttcagtatgtcttggacaagaatgatgcaggagtgccatttccattgtttgcacagtgtcttggctttgagcttgtaagcatgattgtgagcaaggacaataatattttggagtcattccacgcctcagatcaagcatcaacncttcagttccccaattattcttcacttcagggatcagtatttgaaagatttcatcctgatctcatcaagaaactcagcaccagttgtcttgtcatgcaaaatcacaaatatggtatatctccaaagagattgagagagaatgatgcattatcaagtttcttcaagattctgactacatcccctgatgaaaatggtgaggtttacgtctcaaccgtcgaagcacagaaatatccgatcacttgcactcagtggcaccctgagaaagccattttcgagtggcgtaaaccaatgatcccacacagcgaggatgcagtacaagtgacacaaaattttgccaactactttatcagccaagcccgcaagtcgccaaacaggccccctgccgacaaggtgctggacaacctgatctacaactacatccctacattttccgggaaaacctcgaaatccttcgagttggtgtacctcttctcctgaggctggagccgacgcttntngccgcggttcttctcttactgtactgtgcatgtacagtactgtgtaccatgtgttgtattattgtactgatgagaccttaggttcagtggtgtagatcatttgtagacttgattgccggtatcagagttcaggaggagcagcgtcagtagctgtgatgtttnggttttcggagtgaataagagcatcctcctccgaggtgttgttcatcttgtattataacagtagtcagtacgttcgtcattggctgatgctcagttcagtagtatagatcatttgtaaacttggttgtcagtgtcagcgttcaggaggagcgncagtaattgtgatgtttgccattttnggaataaaaataagagcatcctcttccta

SEQ ID NO: 1532 - DNA, 1490 bp, Triticum aestivum
ccacgcgtccgatcctcctctcgagtccagccacgaggcgataacaaaagcgacctgcttgaagcgaccctactcccagccggcacagtccaattgtccacagctccacatggcttctccccggcacctgctccccctcctcctcctgctcgccctcctcgccccctcctcgtcggcggcggcgccgggcgtcatccggctgccgcgcgccggggcctgcgccacgccggcggacccagccgtctacgaccgccccgtgatcggcatcgtcacgcacccgggcgacggcgcggccgggaggatcgacaacggcacctccacctcctacatcggcgcctcctacgtcaagttcgtcgaggccggcggcgcccgcgtcatcccgctcatctacaacgagcccgacgagcgcctcctcgagaaactcagtttggtgaacggcgtgctgtttactggtggatcagtaaagaggggtccatattttgagacgattaagaaagtgtttcagtatgtcttggacaaaaatgatgcaggagttccatttccattgtttgcacagtgtcttggctttgagcttgtaagcatgattgtgagcaaggacaataatattttggagtcattccacgcctcagatcaagcatcaactcttcagttccccaattattcttcacttcagggatcagtatttgaaagatttcatcctgatctcatccagaaactcagcaccagttgtcttgtcatgcaaaatcacaaatatggtatatctccaaagagaatgcgagagaatgatgcgttatcaagtttcttcaagattctgaccacatcccctgatgaaaacggtgaggtttacatctcaaccgtcgaagcacagaaatacccgatcacttgcactcagtggcatcctgagaaagccattttcgagtggggtaaaccaatgatcccacacagcgaggacgcggtacaagtgactcaaaattttgccaactattttatcagccaagcccgcaagtctcccaacaggcctcctgctgacaaggtgctggacaacctgatctacaactacagccctacattttccgggaaaacctcgaaatccttcgagttggtgtacctcttctcctgaggctggagccgacgcttgcagccgcggttcttctctcactgtgctgtacattacagtattgtgtaccatgtggtgtattattgtactgatgagaccttcggttcagtggtgtagatcatttgtaaccttgattcagagttcaggaggagcagcgtcagtagctgtagtgtttcggttttcggagtgaataagagcatcctcctccgaggtgttgttcatcttgtattatcacagtagtcagtacgttcgccattgactgatgctcagttcagtggtacagatcatttgtaaacaatggttgtcagtatcagcgttcaggaggagcgtcgctagttgtgacgtttgccattttcggaataaaaataagagc

SEQ ID NO: 1533 - DNA, 1301 bp, Avena sativa
ctcctcctcctcttccactgctcctcctgctcctgctcgccttcctcgccccctcgtcggcggtcccgcccgtcatccggctgccgcgcgccggggcctgcgcggcgccggcggaccccgccctgtacgaccggccggtgatcgggatcgtcacgcacccgggcgacggcgcggccgggaggatcgacaacggcaccgccacctcctacatcggcgcctcctacgtcaagttcgtcgaggccggcggcgcgcgcgtcatcccgctcatctacaacgagcccgaggagcgcatcctcgagaaactgagtttggtgaatggtgtgctgtttactggtggatcagtgaagaggggtccatatttcgagacaatcaaaaaagtgtttcagtatgtattggacaagaatgatgcaggaattccatttccattgttcgcgcagtgtcttggtttcgagcttgtaagcatgattgtgagcaaggacattaatattttggagtcattccacgcctcaaatcaagcatcgactcttcagttccccaattattcttcacttgagggatcagtatttggaagttttcagcctgacctcatcaagaaactcagcaccagttgtctggtcatgcaaaatcacaaatggggaatatctccaaagagatatcgagagaatggtgccttatcaagtttcttcaagattctgactacatcccctgatgaaaatggcgaggtttatgtctcaactgtagaagcactgaaatatccaatcacttgcactcagtggcatcctgagaaagccatttttgagtggggtaaaccaatgattccacacagtgaggatgcagtacaagtgactcaaaatttcgccaactattttatcagccaagcccgcaagtctccgaacaggcctcctgccgacaaggtgcaagacaaccttatttataacaacccccctacattttccgggaaaacttcgaaatccttcgagcaggtgtacctcttctcctaagactggaggcgatgattgcaactggaagtattgtactgctgtacttgtgtatcctgtactgttgtgctgtactgatgagaccttcagttcagtagtagtagatcattgtagacttgattttgtgggtatccgcatacagtagtagctgtggtgtttgcttttgtcggagtaataaggagcaatcctccaaactgtattcatctgtattactcaagctcgttgtcacttggtttttactgctggtgctaataccagtaggttttctgtgcatgtcttcaattgataaacttcgtgatggtg

SEQ ID NO: 1534 - DNA, 1539 bp, Secale cereale
tcccggcgcgaaccacatgctcctattattattcagtaaatcctcctctccagtccagccacgaggcgataacaaaagcgacctgcttgaagcgagcccactcccagccggcacagtccaattgtccacgactccacatggcttctcctccccggcacctgctccccctcctcctcctgctcgccctcctcgcgccctcctcgtcggcggcgccgggcgtcatccggctgccgcgcgccggggcctgcgccgcgccggcggacccggccgtctacgaccgccccgtgatcggcatcgtcacgcacccgggcgacggcgcggccgggaggatcgacaacggcacctccacctcctacatcggcgcctcctacgtcaagttcgtcgaggccggcggcgcccgcgtcatcccgctcatctacaacgagcccgacgagcgcatcctcgagaaactcagtttggtgaatggtgtgctgtttactggtggatcagtgaagagcggtccatattttgagacgattaagaaagtgtttcagtatgtcttggacaagaatgatgcaggaattccatttccattgtttgcacagtgtcttggctttgagcttgtaagcatgattgtgagcaaggacaataatattttggagtcattccatgcctcagatcaagcatcaactcttcagttccccaattattcttcacttcagggatcagtatttgaaagatttcatcctgatctcatcaagaaactcagcaccagttgccttgtcatgcaaaatcacaaatatggtatatctccaaagagattgagagagaatgacgcattatcaaatttcttcaagattctgactatatcccctgatgaaaatggagaggtttatgtgtcaaccgtcgaagcacagaactatccgatcacttgcacccagtggcaccctgagaaagccattttcgagtggcgtaaaccaatgattccacacagcgaggatgcagtacaagtgacacaaaattttgccaactactttatcagccaagcccgcaagtcgccaaacaggccccctgccgacaaggtgctggacaacctgatctacaactacatccctacattttccgggaaaacctcgaaatcctttgagttggtgtacctcttctcgtgaggctggagccccaacgcttgcagccgcggttcttctcttactgtattgtacatgtacatgtacagtattgggtaccatgtgttgaattgttgtactgatgagaccttcggtgcagtggtgtagatcatttgtagacttgattgccggtatcagagttcaggagtcaggaggagcagcgtcagtagctgtggtgtttgggttttggagtgaataagagcatcctcctccgaggtgttgttcatcttgtaatataacagtatatggtcagtacgttcgccattggctgatgctcagttcagtagcacagatcatttgtaaacttggttgtcagtgtcagcgtccaggaggagcgtcagtagttgggatgtttgccattttcggaataaaaata

SEQ ID NO: 1535 - DNA, 1562 bp, Secale cereale
ccagtccagccacgaggcgataacaaaagcgacctgcttgaagcgagcccactcccagccggcactgtccaattgtccacgactccacatggcttctcctccccagcacctgctccccctcctcctcctgctcgccctcctcgtcccctcctcgtcggcggcgccgggcgtcatccggctgccgcgcgccggggcctgcgccgcgccggcggacccggccgtctacgaccgccccgtgatcggcatcgtcacgcacccgggcgacggcgcggccgggaggatcgacaacggcacctccacctcctacatcggcgcctcctacgtcaagttcgtcgaggccggcggcgcccgcgtcatcccgctcatctacaacgagcccgacgagcgcctcctcgagaaactcagtttggtgaatggtgtgctgtttactggtggatcagtgaagagcggtccatattttgagacgattaagaaagtgtttcagtatgtcttggacaagaatgatgcaggagttccatttccattgtttgcacagtgtcttggctttgagcttgtaagcatgattgtgagcaaggacaataatattttggagtcattccatgcctcagatcaagcatcaactcttcagttccccaattattcttcacttcagggatcagtatttgaaagatttcatcctgatctcatcaagaaactcagcaccagttgccttgtcatgcaaaatcacaaatatggtatatctccaaagagattgagagagaatgatgcattatcaaatttcttcaagattctgactatatcccctgatgaaaatggagagatttacgtctcaaccgtcgaagcacagaactatccgatcacttgcacccagtggcaccctgagaaagccattttcgagtggcgcaaaccaatgattccacacagcgaggatgcagtacaagtgacacaaaattttgccaactactttatcagccaagcccgcaagtcgccaaacaggccccctgccgacaaggtgctggacaacctgatctacaactacatccctacattttccgggaaaacctcgaaatcctttgagttggtgtacctcttctcgtgaggcaggctggagccgacgcttgcagccgcggttcttcacttactgtattgtacatgtacatgtacagtattgggtaccatgtgttgattgttgtactgatgagacctttggtgccgtggtgtagatcatttgtagacttgattgccggtatcagagttcagggggagcagcgtcggtagctgtgatgtttcggttttcggagtgaataagagcatcctcctccgaggtgttgttcatcttgtattataacagtatatagttagtacgttcgccattggctgatgctcagttcagtagcacagatcatttgtaaacttggttgtcagtgtcagcgttcaggaggagcgtcagttgttgtgacgtttgccattttcggaataaaaataagaacatcctcttcctaacttactgtactatttattttctgtaagatgctcactttgaatctcaagtcggggggggg

SEQ ID NO: 1536 - DNA, 5685 bp, Panicum virgatum
cggcgagccaagcaagaccgaccttgtggcctggctacggctgggaacccgagtgggccccctcagtcagcgagccggagtcgcgagcccgtctcgcgcgctccgttccattccgttcccatctcgcccgtctcccgtcgcgtcaccgtcacgccccccggagtacaaatttctaaagcactaccagtaccagtctctctctctctctctccctctcctctcctctctcttcctctgctctccgcggcgctgctgcttcctcgccacgccacagctgagcgaaccccacccaatccaatccctctcgtcttcgcttcctccccctcgccggagcccgccgctcaccggagcctaggtaggatggaggaggagccgctggccgcccgcgccgggaggtaggggcggggggcgcggccgatcggcgggggtgggagggaggggaatgagggcgccgcaggagcgcaccatgagggatctctacgatcgcacgcgccacaaggatctcgcggcccccgaggaaccagcggaagggcgcggcggaggacgcgcggaggggtcgggacaccgcgaactggtcgccaagatggaggacaaggctgcggtaaggaaaagagtggtatcaagcaacaacactcgtgtgaaggcagagtcaggcacatgtaatgtctgttatgctccttgctcctcttgcctgcaccgaagtcttgcagttgaggattcaaatgctgaatgcgcatcatctcaaacatgctccacaaggtcagaagtaagaaacaattcacttgttcgctgtgagaaagggctccgcaataaaggaggagaaaatgacgatgagttcagtgcaacctctggtcatgtttcttactctgtaactggtggaaataataaagtgttcgcaagatcgtccattgcagatgactcttcagaggttgacatgccagcaaaacgtaggaggctattaaatcaagatacaagactatctagagcagaacaccatgatgacagcaactcgtgtgttactggtacatcagcagaaggaaaggttcacgtggataggaaaaaactatcgacttctgcatccagtcgagatttgactgctaatgatcctaaagacaacagcatggcatgccacagcaggttaagaaatcaatgtgttgatgaatctaagaaaggatctgatgttcgtgatttgcgtcctagtgcatctggtagattgtttcctgcagattctccttctatttcgaccaaaaagttgctgcgaacccagtcttctgtcagtgcatcggacagattatctcctaacaagcaagatcatgagtctggtaaagcgcatgataatttatctcatcaagattgtgaaaaggtttctctttcaaagaataacatagaacagcgacgaggtggaaaattgaacacttgtgtacatgatggtgataaccagggcatgctggcaggttacagtaacggaaatgaaaataaagacggtttctcatcgaaggatctcgacaatggcaccttatgcccaaaagatgaaattcaagaacctgctggcatccaatctagtgatggtgttactaggaatgagggtgacaaaaaagattgggatcaagattgttcattggatatatgtagtgatggaaagttgaatatacaacatgatatggcgacagagggtgggaattcggaagggttgatagatgttaacgtttgtgatatatgtggagatgttggtagggagtatcttctggctacatgtactagatgccttgagggggcggagcatacttactgcatgcaggtgaagttggataaggttccagacggtgaatggttatgtgaagaatgcgagcatagggaagatcagaacaatacgagaagtaaccatggtgtcatggcggttaatatgtccgaaggaaagaaccaaagttcagaaagtcgaagcaagcctaaggcattgcagattgttgtgcctgaattggatgctccacaaagcacatgcagcacaccaacagctgttcagtgtgatggtaagaataaaaagttgcatttagcttcagctgatactcaaacacggaaattaaaggttgccaccccaactgctgaaagactggatgtgaagagcaaaaaattattgagcattgcgaaccgtaacaagctgcaagttcttacatccgatttggatgcacgatctcacagtaatggaacaccaacgtctggaggctcaaacaagaagagtcaaagttcagaatttttgttaaaccgcaagaagttgcgggtttctactgatatggagtcaccattgtcaagtgaaggactacgtagtccacctatatcatgtaagagacaggtagagaatacttcatcccccaagcctaggctcttcaagacggacagtcttagaaaacatgatgtcatctctcatgagaactcatttaagaaagcaaacaagggaggtttatcttcagttgataatgctccagtgagaactactcaagcaggcaaaagttctcaggtcttttcacggtcatattccatgggaaacatggtgaatgctaaaacaccagttccctcgccaagaggtttatcaaagcaactgtctttcaacaacactaacaacggaccaaaggtcaagcagttggttgaaggggtgtctcgcaagttgaaacctgcgaaatattccccaagagatcctagagataaaggccccatcagaaagcttgtacaatctggatctttcaaacgtgagggtgcagtttgcttagatgctggctcatcaaaacaaaagcaaacatttcatttgtctcaagatgaaaaaccagtaatattgaagccagtgaaggaaaaaaatttaatagaaagaagagcttcctttagttttaaaaaaccaaacattccttcatctccaaggcctgacagttgtatgaagttaggtgagagaaaaattgaccaggacatttcaaagtctgtgccaagcatacttaaaagtagtaaaagacctggaaatgttgaaaagaagcagagctctgatttgtcaaagggcgacaatgacaagcaagatgttactgtacatccaaaaccaatgggagttgtttctggtaaagatgcacatgcacatgcaatgaagatatctgatccaccagttccatcccaatgtgttaaaaaggatagctcaaatgatgttgaggatgatgatttgtttgtttcagtgaaaaatagtaacagaatgccaaatgggtctgcagagatggttcctacaatatctactgccacaacttgtgaatcagatttgcgagatgtggcaagagcaagcacctctgaagattcagctcctaaagtggtatgctaccaacaaaagcttttggaaattacaggagatgactcctgtaaaattgtagaggtggttcaaactttaggagatatatcgaatgagattccacatggtgttcagatggcacacaatctatacccccctaacgatatattggataaacctgatttgaagcaggaagcttttgtttatcagtcttcagctcttgaaaatcctctaagagatttagttattccagagctgtcttacatctggcagggtagatttgaggtttcaagacatggaaattctcctgaaatgtttgatgggtttcaggcttacttgtctacttgtgcctcgtccaaagcacgtgaaataagtgaacaattacctaacaaaattcagctagcagaagtcccgcggcactcctcatggccactgcaatttaaggaagtaaatccaactgaagataatattgctctttttttctttgctaaagatgttgaaagttatcgaatggcatacggtaaactcttggaaaacatgcttcttggtgatttatcccttacagcaaatattagtggtactgaacttctcatttttccatctgataaattgccagagaggagtcaacgttggaatggctcacttttcttttggggcattttttatgcccggaaagcaagtagcccaacagaagttcctctgagtgagacaaatagttgcccattagaacaaatcactggacctgttatcctgcatgatatgggttcccctaaggcacttcaatctttgggtatagatttgaatgagtgccccaatgatgatatatctgacccagttatttcacttgaatcagagagtgagaagtctggtgcatctgtagatcataatattttgttggagtccaaacaagaggataggaaggtgaatgcaagtgaaatacattatgaagaaactgcgggcacaaaaaaaattgtaccggagcatcccactgcaactccccatggaactcagcctcccacattatcaacaggagaagatcatgacatgattccagactatccaactgttgcaaaaggtagcacaagaacagcagatacaaacaaaatggaggaagaagataagaacaaagctctcttctgtgttgcacagcaaccaggtgcaatcaggttaatctcagatgagataaaacctaagaaacatggaattctgccctccatagaagtatcaaaactccattttattggatcaaagatatgcggtggtccaagcgaatcaattccaaattcagatatgagttctttggatcctgacctcatctacaaaaggcagaagacttcttatggaaaaaactctacttgcagttttggagatgaaatgccacctagcaaatgcttgtccaagatacaccccttaccggctggacagcatacaccatttgatgatttacagtatagttacaggggtcccccagatcctggctcccttaaaaaatcagcacctgatcatatcatccatgttctttcatctgacgatgaagatttcccagaacctagtactagcttaaataaggcatcactgaaggcagatgagagctcctcccctttattgtcactttccctatctatggtagcaacgaagcataatctttctggttcagatattgtagatgatgaaccactgtctctatctcttgggctccctagtgttgtggaagggagtagggctctggagatgaagcaatttctgcccgagaagccaggcataaacacttagtgttttttttaggtttgcgagtgtacagttttgtgctatgtttagctgtatggagtttagacagggtagaagtatggtatagcttttaaattatgaatattttacctttttttctcactgttatatgcatctgctgctgttgatagtgatgctggtctgatgatgtttattgcctactgtattttatgtgatatatggtgttagtttcccatgaactctattcgtatgacataaaaaaaaggatatatcagaatgtggatgtctataaattcaattttgcatgattgaacttgcactttctagctcgatgtaactcttaggtgcgccccaatttgcatgtgcaatgtgtcatgaccacaaaggcagttatgcgtaagttacgtttgccaatcattacaatattacacttcttgttatttggtgtattctgcattccattataccatgtgggaagtatctgagtaactttctgtcagggttgaacattaattctatgctactctatggtatgtttctttttttttctctctatagcatcttatcaatgtttgcttgcagctggcaaccttatccattaattctgtatttgaaaggttttg

SEQ ID NO: 1537 - DNA, 5036 bp, Panicum virgatum
gctggccggccgcgccgggaggtaggggcggggggcgcggccgatcggtgggggtgggagggaggggaatgagggcgccgcaggagcgcaccatgagggatctctacgatcgcacgcgccacaaggatctcgcggcccccgaggaaccagcggaagggcgcggcggaggacgcgcggaggggtcggggcactgcgaactggtcgccaagatggaggaaaaggctgcggtaaggaaaagagtggtatcaagcaacaacactcgtgtgaaggcagagtcaggcacatgtaatgtctgttatgctccttgctcctcttgcttacaccgaagtcttgcagttgaggattcgaatgctgaatgtgcatcatctcaaacatgctccacaaggtcagaagtaagaaacaattcacttgttcgtagtgagaaagggctccgcaataaaggaggagaaaacgacgatgagtttagtgcaacctctggtcatgtttcttactctgtaactggtggaaataataaagtgtttgcaagatcgtccattgcagacgactcttcggaggttgacatgccagcaaaacgtaggaggctattaaatcaagatacaagactatctaaagcagaacaccatgatgacagcaactcgtgtgttactggtacatcagcaggaggcaaggttcacatggataggaaaaaactatcgacttctgcatccagtcgagatttgactgctaatgattataaagacaacagcatggcatgctacagcagtttaagaaatcaatgtgttgatgaatctaagaaaggatctgatcttcgtaatttgcgtcctagtgcatctggtagattgtttcctgcagattctccttctatgtcgaccaaaaagttgctgcaaaccaagtcttctgtcagtgaatcgagcagattatctcctaagaagcaagatcatgagtctgggaaagcacatgataatttatctcatcaagcttgtgaaaaggtttctctttcaaataataacatagaacagcgacgaggtggaaaattgaaccctgatggtgtcaaccagggcacgctggcaggttacagtataggaaatgaaaataaagacggtttctcatcgaaggatctggacaatggcaccttatgcccaaaagatggaattcaagagcctgctggcatccaatctaatgatggtgttactaggaataagggtgacaaacaagattgggatcaagattgttcaatggatatatgtagtgatggaaagttgaatatacaacatgatatgacgacagaaggcgggaatttggaaggcttgatagatgttaacgtttgtgatatatgtggagatgttggtagggagtatcttctggctacatgtactagatgccttgagggggcggagcatacttactgcatgcgggtgaagttggataaggttccagatggtgaatggttatgtgaagaatgccagcttagggaagatcagaacaatacaagcagtaaccatggtgtcatggcggttaatatgtctgaaggaaagaaccaatgttcagaaagtcaaagcaagcctaaggcattgcaaattgttgtgcctgaattggatgctccgcaaagcacatacagcacaccaacagctgatcagtgtgatggtaagaataaaaagttgcatttagcttcagctgatacacaaacacggaaagtaaaggttgccaccccagctgctgaaagactggatgtgaagagcaaaaaattattgggcattgcaaaccgtaacaagatgcaagttcttacatccgatttggatgcacgaccacacacttatggaacaccaacgtctggaggctcaaacaagaagagtcaaagttcagaatttttgttaaaccgcaaggagttgcgggtttccactgatatggagtcaccattgtcaagtgaaggactacggagtccacctatatcatgtaagagacaggtagagaatacttcatcccctaagcctaggctcttcaagacggacagtcttagaaaacatgatgtcatctctcgtgacaactcatttaagaaatcaaacaagggaggtttatcttcagttgataatgccccagtgagaattactcaagctggcaaaagttctcaggtcttgtcacggtcatattccttgggaaacatggtgaatgctaaaacaccagttccctcgccaagaggtttatcaaagcaactgtctttcaacaacaccaacaatggaccaaaggtcaagcagttggttgaaggggtgtctagtaagttgaaacctgcgaaatattccccaagagatcctagagataagggccccattagaaagcttgtacaatctggatctttcaaacgtgagggtgcagtttgcttagatgctggctcatcaaaacaaaagcaaacatttcctttgtctcaagatgaaaaaccagtaatattgaagccagtgaaggaaaagaatttaatagaaagaagagcttcctttagttttaaaaaaccaaacattccttcatctccaaggcctgacagttgtatgaagttaggggagagaaaaattgaccaggacatttcaaaatctgtgccaatcatacttaaaagtagtagaagacctggaaacgttgaaaagaagcagagctctgatttgtcgaagggtgacaatgacaagcaagatgttactgtacatccaaaaccaatgggagttgtttctggtaaagatgcacatgcaatgaagatatctgatccaccagttccatcccaatgtgtcaaaaaggatagctcaaatgatgttgaggatgaagatttgttcgtttcagtgaaaaatggtaatagaatgccaaatggatctgcagagatggttcctacaatatctacggccacgacttgcgaatcagatttgctagatgtggcaagagcaagcacctctgaagattcagctcctaaagttgtatgcttccaacaaaagcttttggaaagcacaggagatgactcctgtaaaattgtagaggtggctcaagcttcaggagatataaatatgttgaatgaggttccacattgtgttcagatggcacacaatctataccccactaacaataaattggataaacctgatttgaagcagcaagcttttgttgatcaatcttcagctcttgaaaatcctctaagagacttagttattccagagctgtcttacatctggcagggtagctttgaggtttcaagacatggaaattcccctgaaatgtttgatgggtttcaggcttacttgtctacttgtgcctcgtccaaagcacatgaaataggtgaacaattacctgacaaaattcagctagcagaagtcccgcggcactcctcatggccaccgcaatttaaggaagtaaatccaactgaggataatattgctctttttttctttgctaaagatgttgaaagttatgcaatggcatacggtaaactcttggaaaacatgcttcttggtgatttatcccttacagcaaatattagtggcactgaacttctcatttttccatctgataaattgccagagaggattcaacgttggaatggcttacttttcttttggggcgttttttatgaccggaaagcaagtagcccaacagaagttcctctgagtgagagaaataattgctcattagaacaagtcactggacctgttatccggcatgatatgggatcccctaaggcacttcaatctttgggtatagatctgaatgagtgccccaatgatgatatatctgacccagctatttcacttggatcagagagcgagaagtctggtacatctgtagatcataatattttgttggagtccaaacatgaggatatgaaggtgaatgcaagtgaaatacatcatgaagaaacggcagacacaaaagaaattgtaccggagcatcctactgcagctccctatggaactcaacctcccacattatcaacaggaggtcatgacatgattccggactatccaactgctgcaaaaggtagcacaagaacagcaggtagaaacaaaatggaggaagaagatcagaatgaagctgtcttctgtgttttacagcaaccaggtgcaatgaggtcaatctcaaatgagacaaaacctaagaaacatggaattctgccctccatagaagtatcgaaactccattttattggatcaaagatatgcggtggtccaagcgaatcaattctgaattcagatacgagttctctggatcctgacctcacctacaaaaggcagaagacttcttatgaaaaaaactctacttgcagttttggagatcaaatgccacctagcaaatgcttgtccaagatacaccccttaccagctggacagcatacaccatttgatgatttacagtgtagttacaggggtccctcagatcctggctcccttaaaaaatcagtacctgatcgtatcatccatgttctttcatctgatgatgaagattccccagaacctagtactagcttaaataaggcatcactgaaggcagatgagagctcctcccctttattgtcactttccctatctatggtggcaacgaagcgtaatctttctggttcagatattgtagatgatgaaccactgtctctatctcttgggctccctagtgttgtggaagggagtagggctccggagatgaagcaatttctgccggagaagccaggcattaacacttagtgttttttaggtttgcgagtgtatagttttgtgctatgtttagctgtatggagtttagacagggtagaagtatggtatagcttttaaattatgaatattttgcctttcttctcactgttatatgcatctgctgctgttgctagtgatgctggtctgatgatgttattgcctaccgtattttatgtgatatatggtgttagtttcccatgaactctattggtatgacataaaaaaggatatatatatcagaatgtggatgtctataaattcaattttacatggttgaacttgcactctgtagcacgatgtaattcttcggtgcgtcccatcttgcat

SEQ ID NO: 1538 - DNA, 2271 bp, Zea mays
attgtacttccactactaaaaaatgtgattgatcactcgtttatcggcaaagatgtttctttgggagtgaataccgagaggctgagatcaccactgacggccgctgcagccacacggtttgcgtataaataagtagtcagtcgctcatcttgttccttgtgaacatcgcagtgctgtagcctccttcgtcttgagcgagcatggagatgtcagccatggaggaagccctccccaaggcgatggagaggaggaagggaggcctcagaaccattccgttcatcatcttaaacgagatattcgagaaggtggccacgttcgggctgtcggccaacatgatcctgtacctcaccgagcggtatctcatgaccaacgcctttgccaccgtcgtcctctacttctggcatgccttctccaacttcctgcccatcttaggcgccgtgctcgccgacgcccgcctcggccggttccgggtcatcaccctcggctcctgcgttagcctcttcgggatgtgcctgctgtggctgacggcgatccttccggtgtacaagaacaccccggagtgcgcgccggggcggccggtagggtgcgcggtgctgccgtggcagctgccgctcctcttcacgtcgttcgcgttcatgtccctcgggtcgggcggcatccggccctgcacgctggcgttcggggccgaccagctggacaagcgggacaacagcgccaataacgtgaggacgctgcagaccttcttcaactggtactacacggtgctgggcctctccatcgtgttcgcgtccaccgtcatcgtgtacatccagcaggccaggggctgggtcgtcggcttcgccgtgcccgtcgtgctcatggtcaccgcgctcacgctgttcctcctgggctcgcccttctacatcaaggcggcggccaacagcagcgtcgtcatcggcttcgtgcaggtgctcgtcgccagctacaataaccgccacgagcccttgccgccggagactgccgactcctcgagcttctacaacaaagcaggctgcaaacctaggactcccacgaacaagctaatgtacttgaaccgggcttgcgtgctcaggaacccgagcaaggagatcagccccgacggggcggcgtgcgatccgtggaggctgtgcacggtgcagcaggtggaggacaccaaggccgtcatccgcgtgcttccgatatggtcgacggggatcatgccgggcgtggtcgtcgggcagcagatgttcccgacgctgcaggcgaagacgatggagcggagggtgggcaagctggagatcccccctgcctccttcggcgtcttcgccatcctgacgctcaccgtctgggttgccgtgtacgaccgcgtgctggtgcggcccctgtcccggctcaccggccacgcgcgcgggctcagcctgcggcagcggatgggcgccggcctggtgctcttcgccgtggccatggccgtggccgcgcacaccgagagcgtccgccgagccgccgcgctcgccgaggggctccgcgactccaacccgctgacgggggagcgcccggtgcgcatgtcggccatgaatctggtgccgcagcactgcctcacggggctcgccgagggcctgaacctgatcgggcagatcgagttctactactccgagttccccaagaccatgtccagcataggggtgtccctgctcgcgctcggcctcgggtttggcgccgtgctgggcagcgccatcgtcggggtcatcgacgcggggacccggagcggcggcagccacgacggctggctgccgagcaacctgaacagggggcactacgactactactacttggtactggcggtgctatgcgccgccaacgtgctgtacttcgcagtgtgtggctgggcatacggcgacgaggggcaaaaccgggtggtggccgccgacgccgcggtggacgacgtcgacgacaaggaggaggagcaaaaggcggtaatcatctaggcttaggccacggtggactttgagcagagcactaggaacagtatagcgttgatctgggatgatctcttgctctagtgtgtacctcgtacatatgctaatcaatatggtgacatttcaagagtagataatcttgaaatgttaatatggacagtaagtactgtcgtgtagcgtgtcaaaaatgccgcatgcattctctcttccgaattaggaggtagagagaacttcagtgatccagtattccagtggtcgcccactcgcccatacgttaacccactttgactttctcatt

SEQ ID NO: 1539 - DNA, 2361 bp, Sorghum bicolor
attgtacttccaatgctaaaaaaaaatgctcttgatcactcatttgtcgacaaagatttatctttgggactgggagtgagtaccgagaggctgagtcgctgagatcactcctgacggccgctgcaatcacacgggtttgcgtataaatagttcagtcgccccatcttgtagcttgtgcatatatagtgttgtagcctcgctccctccgccttgagcgagcgagcatggaggtctcagccatggaggatgccttccccaaggcgacggcgaggaggaagggaggcctcagaactatccccttcatcatctcgaacgagatcttcgagaaggtggccacgttcgggctgacggccaacatgatcctgtacctcatcgagcggtacctcatgtccagcgctgtcgccaccgaggtcctctacttctggaacgccatctccaacttcctgcccatcttcggcggcgtcctcgccgacgtccgcctcggccggttccgcgtcatcgccctcggctcctgcgtcagcctctgcgggatgtgcctgctgtgcctgacggcgatcctcccggtgtacaagaagaccccggagtgcgcggcgggaagcggctgcgtggtgctgccgtggcagctgccgctgctgttcacgtcgttcgcgctcatgtcgctcgggtcgggcggcatccggccctgcacgctggcgttcggggccgaccagctggacaagcgtgacaacagcgccaagaacgtgaggacgctgcagaccttcttcaactggtactacacggtgctgggcctctccatcgtgttcgcggccaccgtcatcgtgtacatccagcaggccaggggctgggtcgtcggcttcgccgtgcccgtcgtgctcatggtcaccgcgctcacgctcttcctcctcggctcgcccttctacgtcaaggaggcggccgacaggagcgtcatcatcggcttcgtgcaggtgctcgtcgccagctacaagaaccgccgcgagcccttgccgccggagaccgccgactcctcgagcttctacaacaaagcaggatgcaagcccaggactcccacgaacaagctaaggtacttgaaccgggcctgcgtgcttcggaacccgggcaaggtggacggggcggcgtgcgacccgtggcggctgtgcacggtgcagcaggtggaggacgccaaggccgtcatccgcgtgctcccgatatggtcgacggggatcatgcccggcgtcgtcgtcgggcagcagatgttcccgacgctgcaagcgaagacgatggagcggagggtgggcaagctggacatccccgcggcctccttcggcgtcttcgccatcctgacgctcaccgtctgggtggccgtgtacgaccgcgtgctggtgcggcccctgtcccggctcaccggccacgcgcgcgggctcagcctgcggcagcggatgggcgccggcctggcgctcttcgccgtggccatggccgtggccgcgcacaccgagagcgtccgccgagccgccgcgatcgcccaggggctcctcgaccgcggcaaagagaaagaggagccggtggtgcacatgtcggccatgaagctggtgccgcagcactgcctgacggggctcgccgagggcctgaacctgatcgggcagatcgagttctactactcggagttccccaagaccatgtccagcatcggggtgtcgctgctcgcgctcggcctcgggttcggcgccgtgctgggaagcgccatcgtcggggtcatccacgcggggaccgcctggctgccgagcaacctgaacgaggggcactacgaccgctactacttggtcctggcggtgctgtgcgcagccaacgtggtgtacttcgtggtgtgtggctgggcgtacggcgaggaggggaagaaccgggtggtggccgccgacgccgccgcggcggaggacgaccaggaggaggaggaggagcacaaagcgggcatcatttaggctttaggccacggtggactttgagcagagcacccaggaaaagtatggcgttgatccgagatggtctctttgctctagtgtgaatctaggtcgtacctcgtatatatgctgctaacttatatttatatggtgacatctcaagagaaagtaatcttgaaatgttgaaaatggacagtatgtaagtactgttgtgaattgtgatgcgagtctagaatgtcgcatgcattttacgtgcattcttccttcggaattcagagatggagagaactccagtgattggtcgcccgtacgttacccacttccccccttgccctcacgcctcagtctcccacagtcccacccctcaagctcaatgccactgccaaagtgccaagtgccagctgctcct

SEQ ID NO: 1540 - DNA, 1517 bp, Panicum virgatum
gcggcggggatcacgcgcggagcaaagaggccgcggggatgatggcgctccacgaggccctccgcaacgtctgcctcagctcggactggacgtactccgtcttctggaccatccgtcctcgcccgcgctgccgcggcggcaacgggtgcaaagtcggcgacgacaacggcagcctgatgctgatgtgggaggacgggttctgccggccgcgggtggcggagtgcctggaggacatcgacggcgaggacccggtgcgcaaggccttcatcaagatgtccatccagctctacaactacggagaagggctgatgggaaaggtggcctctgataaatgtcacaaatgggtcttcaaggaaccttctgaatgcgagcccaacatctccaactactggcagagctctttcgatgcacttcctcccgaatggaccgatcagttcgcatcaggcatccagaccatagctgtgatccaagccgggcatggcctcctgcagctgggctcctgcaagattatacccgaggacctgcacttcgtgctgcggatgcgacacatgttcgagtcgctgggctaccagtcgggcttcttcctctcccagctcttctcctcctcgcggggggcctcgccgacgccgccgttcccgctcaagcagcccgcgccgccggccgcgcggcccccgccgcagctcttcaactggccgggccaccagccgccgcagctcccgccggccgcgggcgcgtcgccgctcttcccgccgggcccggccgccgcgttccacgcgtccgcggcgcgcccgatgccgccgttccctggcccgggcggcgggaaggacgaggcccacatgttccacctcccgccggggcaccacgggggcaagccgccgcacatggacgagcagcagcaggcgatgggcccgggcggcggggaggcgcccgacggcgacctccggtggcccaacggtctgtccttcttcaccgcgctcaccgggcgcgcggacgacgcgaagctgctgttcggcgggcccggcggcggcggcggcggcggcgcggacgaccgacgagaaggcggcggcggacgccgcgcagaccgggcacggcggggccgagaacgtggaggagtacctgagcctggagagccactcgaacaaggcgaggagggtggagagcgccgcccagacccagagcaccaagttcaagcggagcttcacgttgccggcgcggatgagctcctcggcgtcgacgtccccgtccgtgtcggcctcgacggcgccgcagcagcaagggatggagtaccgaggcccgcacgagggcggcgtctactcggacctgatggagacgttcctggagtagctctcgtccgtggcatgcatgcatggtcgatcgaacggtggttaaacttcttcaaggtcgccacgagaagcgcacgttttgtttcgttctccttttttctctcgctccctgctcccaagctatgtttaaggttttgagttttaatcgcatatgtttaattagattttcattca

SEQ ID NO: 1541 - DNA, 2285 bp, Sorghum bicolor
aaaaaaaaaaaacccaccacaaaacatgcatgaggtgcggtgagcaagggcagtgagagtgcggcaggggccgtcgcctttcgttttaccctccccctgcccaagttaaaaacagcaatcagagagagacatggccgcaaacggagagagagccacaggggaaggctagcaataagctatagaggaggcttcgggcgcgcggcctcactgtctagctagctagtctctcggtctgggtggggagaaagaccaggggagggagagcgcgggggcgatcaaaaagggctaccggcaggccgagagtagccgctagctagctgctatagccgccgagctcgatccgccgactccgactccgactccgacagcgcgcgcccagggtatactagctcaagtgtttttacggcgggcgcgcgagtgagataaagaggggcggggatcgagcgcggtgtcgcgagcaggcggggaagctagcgagggagcggaagaagtggaaatggtgggctccggcgcggctgcgggcggaggaggggatcacgcgcggagcaaagaggccgcggggatgatggcgctccacgaggccctccgcaacgtctgcctcagctccgactggacctactccgtcttctggaccatccgtcctcgcccgcgctgccgcggcggcaacggctgcaaggtcggcgacgacaacggcagcctgatgctgatgtgggaggacggattctgccggccgcgggtggcggagtgcctggaggacatcgacggggaggacccggtgcggaaggccttcatcaagatgtccatccagctctacaactacggagaagggctgatgggaaaggtggcctctgataaatgtcacaaatgggtcttcaaggaaccttctgaatgcgagcccaacatctccaactactggcagagctctttcgacgctcttcctccggaatggaccgatcagttcgcatcaggcatccagaccatagccgtgatccaagccgggcatggcctcctgcagctgggctcttgcaagattatacccgaggacctgcacttcgtgctgcggatgcgacacatgttcgagtcactgggctaccagtcgggcttcttcctctcccagctcttctcgtcctcgcggggcgcctcgccgacgccgccgttccccctcaagcagcagccgcctccggccgccgcgcgtgctccgcagcagctcttcaactgggcaggacaccaccagccgcagctcccgccgtcgccgggcgcgggagcgtcgccgctcttcccgcccggcccgggcgcgtttcacccgtcgtcagccgcgcggtcaatgccgccgtacccaggcggcggcaaggacgagggcggccacatgttccacctcccagcggcgcaccatggcagcagcaagccaccgcacatggacgagcaccagcagacgatgggccccggtggcgaagcgcccgacggcgagctccggtggcccaacgggctgtccttcttcaccgcgctcaccgggcgagcggacgacgcgaagctgctgtttggtggccccggcggaggagccggcgccgcggacgacgagaaggcggcggcggacaacgcgcagaccgggcacggcggggccgagaacgtggaggagtacctgagcctggagagccactccaacaaggcgaggaaggtggagagcgccgcccagagcaccaagttcaagaggagcttcacgttgcccgcgaggatgggctcgtccacgtcgccgtcgccgtccccgtccgtgtcggcttccacggcgccggcgccgccacagcagcaagggatggagtaccgagggccacacgagggcggcgtctactcggacctcatggagacgttcttggagtagctagctactagatccgtacgtagcatgcatgatcgatcggttcgatatgccaccacgcgagaagcgtacgcttttgtttctcatcatcctcccatctcccaagctttgtttcaggtttggagttttaatcgcatatcatgtttaattagatttttttttcttttcatcgttttttttttggggtctcttctactagtagttgtagcagctcgatcgtaatgggggaaaaaaacttgatggatacatgcatgcatgcatgcatgcaaagaagggcatgagtctgcttccatgatggctggcaatgcaattctatggtgcaacagccatgatggcgaggtacaatgatatgcaacacccaataatatgggcttttcgcgccaaaagctaaatcttggtcacaacactgttg

SEQ ID NO: 1542 - DNA, 2148 bp, Zea mays
aggccgcaaacggagaagagacacgggagagagggagggctcgctagctaaacaataaccctcactctctactctctagctagctagcctctcagctcagctgtggtggggagaaagaccggaccggaggagagggcgatcaagaaaggttaccggccggcctagaggtagctgctagagccgccgagctcgatcgtccgactccgagagctagcttccgcttccgcttccgcccagggcagtagaagcgtttttacggcaacgctagctatagctagcgctgagagagagagaggtggaagtaacaaggccggtagagcaggcggaagcgagggagcggcagctgcaggcaggggtgggggcagcaaaatggtgggctccggcgcggctgggggcggagcggatcacgcgcggagcaaagaggccgcggggatgatggcgctccacgaggccctccgcaacgtctgcctcagctcggactggacgtactccgtcttctggaccatccgtcctcgcccgcggtgccgcggcgggaacgggtgcaaggtcggcgacgacaacggcagcctgatgctgatgtgggaggacggcttctgccggccgcgggtggcggagtgcctggaggacatggacggcgaggacccggtgcgcaaggccttcatcaagatgtccatccagctctacaactacggagaagggctgatgggaaaggtggcctctgataaatgtcacaaatgggtcttcaaggaaccttctgaatgcgagcccaacatctccaactactggcagagctctttcgacgcacttcctccggaatggaccgaccagttcgcatcaggcatccagaccatagctgtgatccaagccgggcatggcctcctgcagctgggctcctgcaagattatacccgaggacctgcacttcgtgctgcggatgcgacacatgttcgagtcactcggctaccagtcgggcttcttcctctcccagctcttctcgtcctcgcggggcgcctcgccgacgccgacgccgccattcccgctcaagcagccgccagcagctccggccgcgcgcgccccgccgcagctcttcagctggccgggccaccaccagccgcagcagctcccgtcgcccgcgggagcgtcgccgctcttcccgcccggcccgggcgcgttccacccgtcctccgcgcgcccaatgccgccgttcccaggcggcaaggacgagggccacatgttccacctcccgccagcggcgcaccacggcaccaacaagcagccgccgcagcacatggacgagcaccaccaccaccagcagcagccgatggtgggggccggcggcgacgcgcccgacggcgacctccgctggcccaacgggctgtccttcttcaccgcgctcaccgggcgcgcggacgacgcgaagctgcttttcggcggccccggcgctggcgctggcgctgcggacgacgacgacaaggcggcgccggacgcgcacggcggggccgagaacgtggaggagtacctcagcctggagagccactccaacaaggccaggaaggtggagagccccgcggcccagagcaccaacaagttcaagaggagcttcacgttgcccgcgcggatgagctcgtcctcgtccacgtcagcgttcccgtccgtgtcggcctccacggcgccgccgcagcagcagcaagcagggatggagtatcgagggccgcacgagggcggcgtctactcggacctcatggagacgttcttggagtagctatagctagctagatcccgtagcatgcatgatcgatcggttcagggtcacacactacgacaagcgtacgctgctttttgtttctcaccgccctccgtcccaagctttgtttcaggtttggagttttaatcgcataatatgtttaattagatttgtgtgtgtatttttttaattttcatcgtgtttcccccctattccagtagttgtcgtagctgctagctagatcgtaatgcacaaaaaaaatggtggagtacatgcatgcatgcatgcaagaagagcatgagttgcttccattatcatgactggctggcaactctgtggtgcaaccgccatggcgccatgatgaggaggtacaatgatatgcaacacccaataatatgggctttt

SEQ ID NO: 1543 - DNA, 2038 bp, Hordeum vulgare
caagccaaggactgcaagacagaccgagcgtctgcgtctgcgtctgcgtctgcgtgtgtgtgtgagagagagagtgagaggtagtagctcgctcagcgaagctacgagcccgcccacagtccctctggactggactctctctctccacggggagaaaaaacccaagaagcgatcaaaaagagcctcggccgggtagctagaaggcgcaccctacccctagcccccccgagctccgagggtttttacgacgccaagggagggagggaaggagagagaggtaagaagggggggaaaatggtgggctcgggggcggcaggagggggaggaggggatcacgcgcggagcaaagaggccgcggggatgatggcgctccacgaggcgctccgcaacgtctgcctcaactcggactggacttactccgtcttctggaccatccgtcctcgcccgcggtgccgcggcggcaacgggtgcaaggtcggcgacgacaacggcagcctgatgctgatgtgggaggacgggttctgccggccgcggatggcggagtgcctggaggacatggacggcgaggacccggtgcgcaaggccttcagcaagatgtccatccagctctacaactacggagaagggctgatgggaaaggtggcatctgataagtgtcacaaatgggtcttcaaggaaccttctgaatgcgagcccaacatcgccaactactggcagagctcttttgatgcccttcccacggaatggacggaccagttcgcctccggcatccagaccatcgccgtgattcaagctggccatggcctcctgcagctgggttcttgcaagatcataccggaggacctgcacttcgtgctgcggatgcgacacatgttcgagtcactgggctaccagtcaggcttcttcctctcgcagctcttctcctcctcccggggcacctcgtccacgccctccttcccgctcaagcagccgccgccgccggcgcgcccgcccccgcagctcttcaactggccgggccagccgcagctcccccacgccgccgcctcgcccctgttcccgccgggaccggccgcgttccacccgtccgcgcggtcgtcgatgccgcattacccgggcaacaaggacgagagccacatgtaccacctcgcgccgtctcagcatggcaagccgccgcacatggacgaacaccagcaccaccagcagcagatggcgcccggggagacgcccgacggcgacctcaagtggcccaacgggatgtcattcttcaccgcgctcaccgggcgctcagatgacccgaagcttttgttcggcggtcccggaggtggaggtggcggcgcggacgacgggaagccggcgcaggacgcgcagacagggcacggtggtgcggagaacgtggaagagtacctgagcctggagagccactcgaacaaggcgaggaggatggagagcgcccagagcgccaagttcaagaggagcttcacgttgccggcgaggatgagctcgtccaactcgccgtccccgtccgtgtcggcctcgacggggccggcgccgccgccgcagcagcagcaagggatggagtacagagcgcagcacgagggcagcgtctactcggacctcatggagacgttcttggagtagcaacaacgcatgcacgcgtcgaccgaccgatcatccctacgacgacaagcgtacggactttacgttttcttgttcccactttttgttttgttccaaccaagctatacgttgaagctcttttagcgtcaggttttggagtttgcttccgcttcattagatcatgtaaccttttttttttccctcccttctagcttcgtacgtgtctcgatcgatctagtcgtagctagctagctcctagtgcaagaactgaatacacgcatgcatgcatgcatgcagagatgggcatgagtttgcttccatgatggctggcaagttcttatatggtgcaatgatggtgatgtacaatgatatatgcaacacccaataatacgctcttttccttccgaaagttcagttgctg

SEQ ID NO: 1544 - DNA, 1875 bp, Secale cereale
gactcgacgcccgcctttgcctgccccttggtaagggaggggaggagggcgcgcctcccgagctccgagcgcgaccacaagggtttttacgacgcccgcctttgcctgccccttggtaagggaggggaggagggggggaaatggtgggctcgggggcggcaggagggggaggaggggatcatgcgcggagcaaagaggccgcggggatgatggcgctccacgaggcgctccgcaacgtctgcctcaactcggactggacttactccgtcttctggaccatccgtcctcgcccgcggtgccgcggcggcaacgggtgcaaggtcggcgacgacaacggcagcctgatgctgatgtgggaggacgggttctgccggccgcggatggcggagtgcctggaggacatggacggcgaggacccggtgcgcaaggccttcagcaagatgtccatccagctctacaactacggagaagggctgatgggaaaggtggcatctgataagtgtcacaaatgggtcttcaaggaaccttctgaatgcgagcccaacatcgccaactactggcagagctcttttgatgcccttcctacggaatggactgaccagttcgcctcaggcatccagacgatcgctgtgatacaagccggccatggcctcctgcagctgggttcctgcaagatcataccggaggacctgcacttcgtgctgcggatgcgacacatgttcgagtcactgggctaccagtcgggcttcttcctctcgcagctcttctcctcctcccggggcgcctcgtccacgccgtcattcccgctcaagcagccgccgccggcgcgcccgcccccgcagctcttcaactggccgggccagccgcagctcccccacgccgccgcgtcgcccctgttcccgccggggccggccgcgttccacccgtccgcgcggtcgtcgatgccgcattacccgggcggcgggggcaacaaggacgagagccacatgtatcacctcgcgccgtctcagcatggcaagccaccacacatggacgagcaccaccagcaccagcagcagatgcagcccggggagacgcccgacggcgacctcaagtggcccaacgggctgtccttcttcaccgcgctcaccgggcgctcggatgactcgaagcttttgtacggcggccccggcggcggcggtggtggaggcggcggcggtggcggtgcagacgacgggaagccagcgcaggacgcgcagacagggcacggcggcgcggagaacgtggaggagtacctgagtctggagagccactcgaacaaggcgaggaggatggagaacacccagagcgccaagttcaagaggagcttcacgttgccggcgaggatgagctcgtccaactcgccgtccccgtcggtgtcggcctcgacggggccggcgccgcagcagcagcagcagcaagggatggagtacagagcgcagcacgagggcagcgtctactcggacctcatggagacgttcttggagtagcaacgcaacacaacgcatgcatgcgtgcctcgatcgatcgtccctacgacgacaagcgtacggactttatgttttcttgttcccaccttttgttttgttccaaccaagctatgttcaagctcttttagcgtcaggtttggagtttgcttcggcttaattagatcatgtaaaccttttttcttctagcttcgtgtctcgatcgatctagtcgtagctagctagctcgtagtgcaagaactgatacatgcatgcgtgcgtgcgtgcatgcatgcagagatgggcatgagtttgctactgtgatggctggcaagctatatggtgcaatgatgatgtacaatgatatgcaacacccaataatacgctcttt

SEQ ID NO: 1545 - DNA, 1954 bp, Brachypodium distachyon
atagccttcaggcttcaggccgtccatctctctctcgctcgtctcccccgagagaaaaacccaagaagcgatcaaaaagagaccggccggatagctagaaggcgctacctagctaccacctctagccttccgagctccgggcaaggccaccacacacacagagcagaagggtttttacaccgcccgggtgaggtagagaaggagggtgtgtgtgagtgagagagagataagggaggaaaaaaatggtgggctcgggggcggcagggggaggaggggatcacgcgcggagcaaagaggccgcggggatgatggcgctgcacgaggcgctccgcaacgtctgcctcaactcggactggacgtactccgtcttctggaccatccgtcctcgcccgcggtgccgcggcggcaacggctgcaaggtgggcgacgacaacggcagcctgatgctgatgtgggaggacgggttctgccggccgcgggtggcggagtgcctggaggacatcgacggcgaggatccggtgcgcaaggccttcagcaagatgtccatccagctctacaactacggagaagggctgatgggaaaggtggcatctgataaatgtcacaaatgggtcttcaaggaaccttctgaatgcgagcccaacatcgccaactactggcagagctcttttgacgctcttccgacggaatggaccgatcagtttgcctcaggcatccagaccatagcagtgattcaagctggccatggcctcctgcaacttggctcgtgcaagatcataccggaggacctgcacttcgtgctgcggatgcgacacatgttcgagtcgctgggctaccagtcgggcttcttcctgtcccagctcttctcctcctcccggggcacgtcgccgtcgccgtcgtccttcccgctgaagcagcagccgcccgcgcgcgcagtaccgccgcagctcttcaactggccgggaggccagccgcagcagcagctcccccacgccgcctcgccgctcttcccgcctggcccggccgcgtcgttccacccgtcggcgcgctcgccgatgccgcatttcccgggcggcggcgccaaggacgagagccacatgtaccaccacctcccgccgtcgtctcactctcaccacgccaacgaacaccaccaccaccaccagcagcagatgggggaggcgcccgaaggcgacctcaagtggcccaacgggctgtccttcttcacggcgctcacgggccgcgcggacgacgcgaagctcctgttcgaagggggaggcgacgggaagcagcagcaggacgcggcgcagacggggcacggcggcgccgagaacgtggaggagtacctgagcctggagagcaactcgaacaaggcgaggaggatggagagcgcccaggcccagagcaacaagttcaagaggagcttcacgttgccggcgaggatgagcgcgtccacgacgtccacgtccccctccgtgtcggcatcgacgggcccggcaccgccgcagcagcagcagcaaggaatggatcagtacagagcagaaggtggcgtctattcggacctaatggagaccttcttggagtagcacgtacgcacgcgtgattgatcgtattatcagtactgatccttagatgatcaagtacgtgcacggccgccggacttattgttgtttttcttgtttcccacttttgttttttctctccctccaagctatgtttaagctccttttagcatctggtttggaatttgcttctgtttaattagatgatcatgtaatgcttcggggctcgatctagctagtcgtagctcgtagtgcagaaactttgatacatgcatgcatgcatgcaaagatgggcatgagtttgcttccatgatggctggcaagttatatggcgcgatgatggtgatgtacaatgatatgcaacacctaataataagctcttttcctgtcaaaag

SEQ ID NO: 1546 - DNA, 1761 bp, Zea mays
ctcaggttctcaagaaagaccctgcagggagagcgatcaaaaaggctgccggcacggccgggtagcagctacaactacaagctggcctatagctagctagctagctatagctgctacagccgccgagctcgatcctcggactcggactgcaacgaggaaggagaggaaatggtgggctccggcgcggatgggggcggcggaggggatgacgcgcggagcaaagaggccgcggggatgatggcgctccacgaggccctccgcaacgtctgcctcgactcggactggacctactccgtcttctggaccatccgtcctcgcccgcgctgccgcggcggcaacgggtgcatggtcggcgacgacaacggcagcctgatgctgatgtgggaggacggcttctgccggccacgggtggcggagtgcctggcggacatgagcggcggcgaggacccggtgcggaaggccttcatcaagatgtccatccaactctacaactacggagaagggctgatgggaaaggtggcctctgataaatgtcacaaatgggtcttcaaggaaccttctgaatgcgagcccaacatctccaactactggcagagctccttcgacgcacttcctccggaatggactgatcagttcgcatcaggcatccagaccatagctgtgatccaagccgggcatggcctcctgcagctgggctcttgcaagattatacccgaggacctgcacttcgtgctgcggatgcgacacacgttcgagtcgctgggctaccagtcgggcttcttcctctcccagctcttctcgtcggcgcggggcgcctcgccgacgccgcctcctccggccgcgcgtcccccgccggcgcagcttttcaactggccgggcgcccaccagccgcagctcttcccgcccggtccgggcgcgttccaccacccgtcggcgcgggcgatgccgccattgttcccaggcggcggcaaggacgagggccacatgttccacattccaccggcacaccatggcagcaagccactgcacatggacgagctccagcaccggcaccagcagacgatgggggccggtggcgaggcgcccgacggtgaactccggtggcccaacgggctgtccttcttcaccgcgctcaccgggcgagacgacgacgcgaagctgctattcggtggccccggcgccgcggacgacgagaaggcggcgccggacgcgcagaccgggcacggcggggctgggaacgtggaggagtacctgagcctggagagccactcggacaaggcgccgagcaaggtggagaacggcgcccagcacagcaccaagtccaagaggagcttcacgttgcccgcgcgggtgagctcgtccacgaccacgtccccgtccgtgtcggcctccacggcgccgcaagggatggagtaccgagggacgcacgagggcggcgtctactcggacctcatggagacgttcttggagtagctagctagatccgtagcatgcatgatcggttggttcaagccttcaaggtcactacaacaacaagtgcacgcttctttttttttcttttcctcaccgccctcccaagtcccaagctttgttttaggtctggagttttaatcgcataatatctttaattagagaattttttccccctcttcttatagttgcattgcagcagctcgatcgtaacgctaaaaaaaacctttgatggatacatgcatgcatgcaagcaagaagggcatgagtttgcttccatgatggctggca

SEQ ID NO: 1547 - DNA, 1239 bp, Panicum virgatum
attagttctgttctttgcaactggcctgacaacccggcatcgttaggtgcgggcccagagcggcggcgtgttcagctggtgcacacctgcagcaggcggcgccggctatataaggccgtcgtctacaagtttccttgtgcgccgagacgtggctgcaggcgcacgagaggtgatcgagcattcgagccgacgcgcgcgcagcaagtagcaccgtacccgagtttctcgccatgggcggcagcaagcacatcgtgctcgtccacggcgcgtgcctcggcggctggtcctggttcaaggtggccacccggctccgcgccgcggggtaccgcgtggacgcgccggacctggcggcgtcgggcgccgacccgcggccgctccgcgaggtgcccacgttccgggactacacggcgccgctgctggacctcctcgcggcgctcccggccggggaccgcgtggtgctcgtcggccacagcctcggcggcctgagcgtcgccctggccgccgagctgttcccggacaaggtcgccgccgccgtgttcctctgcgccttcatgcccgactgcgccgcgcggccgtcgcacgtgctcgagaagttcgtggaggggaagtggctggactggatggacacggagatgaagccgcaggacgcggagggcaagctccccacgtccatgatgttcgggccccggatcctgcgggagaagttctaccagctctgctcgcccgaggacatcaccctggcgtcgtccctgatgcgggtgagctcgatgttcgtggaggacctggccgcccagcagccgttcaccgcgggcgggtacggctcggtgcgcagggtgtacgtggtgtgctcggaggactacggcatcgtggaggggttccagcgctggatggtggagaacaacccggtggaggaggtgagggagatcgccgccgaccacctggtgatgctctccaggcccgacgagctggcgcggtgcctcgccgacatcgccgacaagtacgcgtgatgaatgatgatgatgaggaagatcgatgctcgatctgccgctgcgtggatgcatggtgttctgttgtgatcagctttcttttctttcttaatcaaaaaagaaaccttggagaactcgagcctgttgtttcgaaatgagattgaagttcacggtgtggcgagcaattgaccaatcgtggatgtttattaacgaggctaccccaacacttgtcgttgcgaatccgcacagaaga

SEQ ID NO: 1548 - DNA, 1251 bp, Panicum virgatum
cgtaagccccctttcatgcgattggtggttcggttcgttgcaacttgcctggaaaccctgcatcgttaggtgcgggcccagatcgagcggcgtgttcagctgctgcccacctgcactactgccgcgcgcacaggcggcgccggctatataaggccgtcgtctacaagttttcttctgcgccgagacgtggctgctgcaggcgcacgagaggtgatcgagcattcgagccgacatcgcgcgcggtaagcagcaccgtatcgtaccctttctcgccatgggcggcggcagcaagcacatcgtgctcgtccacggcgcgtgcctcggcggctggtcctggttcaaggtggccacccggctccgcgccgcggggcaccgcgtggacgcgccggacctggcggcgtcgggcgtggacccgcggccgctccgcgaggtgcccacgttccgggactacgcggcgccgctgctggacctcctcgcggcgctccccgccggggaccgcgtcgtgctcgtcggacacagcctcggcggcgtgagcgtcgccctggccgccgagctgttcccggacaaggtcgccgccgccgtcttcctctgcgccttcatgcccgactgcgccgcgccgccgtcgcacgtgctcgagaagttcgtggaggggaagtggctggactggatggacacggagatgaagccgcaggacgcggagggcaagctccccacgtccatgctgttcgggccccggatcctgcgagagaagttcttccagctctgctcgcccgaggacatgaccctggcgtcgtccctgctgcgggtgagctcgctgttcctggaggacctggccgcccagcagccgttcaccgagggcggctacggctcggtgcgcagggtgtacgtggtgtgctcggaggactacgccatcgtggaggggttccagcgctggatggtggagaacaacccggtggaggaggtgagggagatcgccgccgaccacctggtcatgctctccaggcccgaggagctggcgcggtgcctcgccgacatcgccgacaagtacgcgtgatagaatagaatgatgccacgtagcagctgcatgcatgctgaggaagatcgatgctcgaaccgccgcggcgtggatgcatggtgttctgctgctgcgttcagttttcttttctttcttttatttattatttttaataaaaaagaagctttcggtggctcgaggctgttgttgtgttcgaaatggaagttttctcatga

SEQ ID NO: 1549 - DNA, 2031 bp, Zea mays
ggtgttatggccgatgacctgaaggtgctgggcctatggacgagcccgtttgtgatccgagtccgcatcatgctcaacctcaagggcctggcgtacgagtacgcggaggaggacctcggcaacaagagtgcgctcctgctcagctccaacccggtgcacaagaccgtgcttgtgctgctccacgcgggtcgccccgtaaacaagtcccagatcatcctgcagtacatcgacaaggtctgggcggggactaggccgaccgtgctgcgggataacctcccacgggtgacaccatggcggagaagggaaagcagatctgagccagcagatgctgttggccaaaccacccggctctctgcctcagggaaggaggcttcagctcagcctctgtccatgcctgtcttcatgggaccgaggacgaggcaccaaggaagaaggcacgccttggataggggcaagttaccgggccgccatattgttcctcaggcagcaaaagagaagttgaaagagatagataggcttgccagggagcagaaagcagaggagcgtcaaaagcagaggggaaaagaacctgatgtggaggcaaggatagagataccagaagagagaggatcagcactccgccgtatgtacgacgacatgatgaacggaatcatcagggagacgaaggccaccgaggaaggcaaggacctgctcgacatgctgctcgactggatgcgggagcattggccgctagcggaggacgatgacagcaggatcagtgacactgacatcgccgccaaggagtgcgaggtggacaggaattgctttaaagacaagcttatcctccctaagtcgtccctcgataaacataaacataaactgtacagtctatataaacccgtcaccctcctcatagacccagccgcgtcgcgccgcacaagaggtgagggcacgcgcacggcgcataagagctgggggttgccaagtgttcatccacaaccacaaacatcacgaatggatgctcccgcggcggccgagggctgcggcaagcacattgtgctcgtccacggcgcgtgcctgggcggctggtcctggtacaaggtggccaccctactccgcgcggcggggtaccgcgtcgacgcgccggacatggcggcgtcgggcgccgacccgcggccgctgcgggaggtgcccacgttccgggactacaccaggccgctgctggacctcctcgcgtcgctgccagacggggaccgcgtcgtgcttgtcggccacagcctcggcggcgtgaacgtcgcgctggccgccgagacgttcccggacaaggtctccgccgtggtgttcctctgcgccttcatgccggactgcacggcgcggccgtcgcacgtgctggaaaagttcattgaggggaagtggctggactggatggacacggagatgaaaccccaggaccaggatggcgagggcaagctccccacctccatgctgttcggaccccggatcatccgagaaaagttcttccagctctgctcgcccgaggacctgacgctgtcggcgtctctgatgagggtgagctccatgttcgtggaggacctggcgctccggcaaccctacagcaaggaaaggtacggctcggtgcgcagggtctacgtcgtgtgcacggaggactacgccatcgtggaggggttccagcgctggatggtggataacagccccgtggacgaggtgaaggagatcgcggcggaccacgtcgtgatgctctcccggcccgacgagctggtgcgctgcctcactgacatcgccgacaagtacgcttgacggcgccgctgttctagcacgtgtgtgtgtgctgcctctcggtcggtcgagctcgagcctcagcatgcatgtcgatcgccgatcgtggtgtttttaatttgttgcattcggtttgttttttccctgctgttctcgaatcgggatggaccagaattctcgccgcgtggtgtgaatcttgtataattaataatgctattgaggcttgctaataatctgtgttcgccgggggcaaaa

SEQ ID NO: 1550 - DNA, 1354 bp, Panicum virgatum
tttctctaaaaataagttctataggtgtcatggacggttgaactctgaacttgaatcaccccactccactaggccaccggacagccgaagagcgaagatggtggcgtcagcagcacccttcaccagcggcttcctctgcccgaccaccaaaccaaggacgccaccgctcccgtcctcctcctcccgaccgtctcgctcccgcctccacttccgcatccgatcccccgaccccaagaacccagcggcggcgcccgtctcctctcgcatggaggcggcccagccccagacgcgcgacgcccagggaagggcggagtcggccatgaagctgctgttcgtggagatgggcgtcggctacgaccagcacggccaggacatcaccgccgccgccgtgcgcgcctgcaaggacgccatctcctccaactccatccccgccttccgcggcgggtctatacccggagtgaacaccgaccagatgaagctgcagatcaagctcggcgtgccgaggtcgacgcagcacttgctggatgctgagagagtcaaagccgtcttcccctatggcgagattatcagcttcgaggttgtcgacggcggcatgatctgttcaagcggcgtgtgcctggaagcaatgggggacaagaacgacgactgctacatagtcaacgctgcagtttacgtcggctactgatgtaatgtaatcctggaggaagagttttgctttcatctggaacagtaggaatcggacaggcctcgtccacaataagcacacgccattgctgtaacggctgcacatcattggtgtcgtgctgggtctatttgcatatgtccgccctcctcttccagtcacagcacgcccagttggttcccgagtatctgcatgcgacccttgatcactcctgcggccgatctgtttgactgcattgcaggcgtgtacgccgcgggtgccttggttcttggactaccgtgacagcatagggagccatgcacactgcccggccgccggggtcctgccgtcctggtcgatctggggaatgctggtagcggagtagtctttgacagcgcagcagccgcagctgcagccgccgacgactgctgctgcagcgccgtgtccttgtgagttgggagggctggactggtggcggctgagcgcgtctgcctggaaggctggagtgcctgcggccggcaccgtagcttggtcaacttcgccatccacggcgcctcagcgcggccgcctgatcagctgctctggtagtgacactcgatgaacagcggggtttcgttttctgttaaccgcgcgctgttgttcgaacaatatgtcatgtcaatgccgattttcactcgtaacaatttgtccatc

SEQ ID NO: 1551 - DNA, 804 bp, Pennisetum glaucum
ccacaccccatctattccacatttccactagacaagccgaagatggtgacgtcagcagcacccttcaccagcggcttcctctacccgaccaaaccaaggacggcaccgctcccgtcctcctccaccacctcccgatcgtctcactcccgcctccacttccgcatccgatcccccaatccaaagaacccggcggtggcgcccgtctcctcccgcatggaagcggcccagccccaggacgcccagggaggtgcggagtcggccatgaagctgctgttcgtggagatgggcgttggctacgaccagcacggccaggacatcaccgccgccgccgtgcgcgcctgcaaggacgccatctcctccaactccatccctgccttccgcggcgggtctatacccggggtgaacacagaccagatgaagctgcagatcaagctcggcgtgccgaagtcgacgcagcacttgctggatgctgagagagtcaaagccgtcttcccctatggcgagataatcagcttcgaggttgtcgatggtggcatgatctgttcaagcggtgtgtgccttgaagcaatgggggacaaaaacgatgattgctacatagtcaacgctgcagtttacgttgggtactgatgtaattcagaaaagcttcagaaaatcacctggaacagtagaaattggacatgcctcctctattccgcgagtagagatgttttcctataccttaataagaaattaagcatggcattgctgaaataagtgcacttggtgtcgtatcgtattcggtctaatgcctaccctcgtctttcg

SEQ ID NO: 1552 - DNA, 717 bp, Panicum virgatum
atcaccaaggacgccaccgcccccgtcctcctcctcccgaccgtctcgctcccgcccccacttccgcatccgatcccccaaccccaagaacccagcggcggcgcccgtctcctctcgcatggaggcggcccagccccagacgcgcgacgcccagggaagggcggagtcggccatgaagctgctgttcgtggagatgggcgtcggctacgaccagcacggccaggacatcaccgccgccgccgtgcgcgcctgcaaggacgccatctcctccaactccatccccgccttccgcggcgggtctatacccggagtgaacaccgaccagatgaagctgcagatcaagctcggcgtgccgaggtcgacgcagcacttgctggatgctgagagagtcaaagccgtcttcccctatggcgagattatcagcttcgaggttgtcgacggcggcatgatctgttcaagcggcgtgtgcctggaagcaatgggggacaagaacgacgactgctacatagtcaacgctgcagtttacgtcggctactgatgtaatgtaatcctggaggaagagttttgctttcatctggaacagtaggaatcggacaggcctcgtccacaataagcacacgccattgctgtaacggctgcacatcattggtgtcgtgctgggtctatgtatgcctgccctcgccttccggtcacggcatgcccagttggttcccgagc

SEQ ID NO: 1553 - DNA, 801 bp, Zea mays
agtctgcatcaccaactattccactagtaggtctaaattagtagccaagatgacgtcagcagcatcgttccccagcagcctcttccccttcccgaccagagcaagcacgccaccgcttccgtcgtcgtcctcccgaccgtctcactcccgcccccacctccgcatccgatctccgaaacctaataatccaacggtcgcgcccgcgtcctctcggatggaggtggcccagccccaggcgagcaacgcccagggaggggcggagccggccatgaagctactgttcgtggagatgggcgtcggctacgatcagcacggccaagatatcaccgccgccgccgtgcgcgcctgcaaggacgccatcacctccaactccatccccgccttccggggcgggtccattccaggagtgaacacggaccagatgaagctgcagatcaagctcggagtgcctaggtcgacgcagcacttgctggatgctgagagagtcaaggccgtcttcccctatggcaagataatcagctttgaggtcgttgacggtggcatgatctgttcaagcggcgtgtgcctggaagcaatgggggataagaacgatgactgctacatagtcaacgctgcagtgtatgtcggctactgatgtactgtagtacctggaatggaacagtagagattggttatggttcctccgttatagaaaaaaaaaactgctacctccgtcctaaaataaaatagttgatattttttcttcatagaagccaaatattgtaaactttgactaaaaattactccctccaatttttttta

SEQ ID NO: 1554 - DNA, 1320 bp, Sorghum bicolor
cgggccggtcgcatattgcgaagaacctacacgtcaaaatgtcaatccgactgcgtttagttctgctgatttctgaaccttgcgacactactagtaggaagccaaagatggcgtcagcagcagcgttccccagcagcctcttcctcttcccgaccagaccaagcacgccaccgctcccgtcgtcctcctcccgaccgtctcactctcactcccgcccccacctccgcatccgatctccaccaatccctaattatccagcggccttgcccgcgtcctctcggatggaggtcgcccagggaggggcggaggagccggccatgaagctgctgttcgtggagatgggcgtcggctacgatcagcacggccaggacatcaccgccgccgccgtgcgcgcatgcaaggacgccatcacctccaactccatccccgccttccgcggcgggtccattcctggagtgaacaccgaccagatgaagctgcagatcaagctcggggtgccgaggtccacgcagcacttgctggatgctgagagagtcaaggccgtcttcccctatggcaagataatcagctttgaggtcgttgacggcggcatgatctgttcaagcggcgtgtgcctggaagcaatgggggataagaacgatgactgctacattgtcaatgctgcagtttatgtcggctactgatgaaattccggaagagttgctttcacctggtacctggaacagtagagattggttatggctcctcaattttagaaaactgctcctactacagatgatttcgtgccgcaataataagccaataagcatgcagctgctatcagcattcccaattcatttccatgcgcgcttggtcactcttgcaaattgcaatccatccatcgcgcaggtttccatcgcgcagatgcgttggcttcatggcttgggtatcagaacttccgagccctgttgtgcacgctgcccggcgggcgggtgctggattgcttgtcatcgttttttggggacggcaatgcaggcctttgacagtgctgcaggctgccgacggtcgacggctgctgctgcaccgccgagtcctcaacgaactcgttgccagatcgttgccggggcgtgcatccacgcacgcagtccgcttaggcgccgaatccatccaatgatccaaccaacagtttctttcttttttggcaatacgctgaacgtgtttagttgcctaagaggcaattggagtttgcattcttgaaatttgccaaaaaccttaaaaattgctctccaacagttttgcatttgacttatatatattggcaaacttggcatttgatggacc

SEQ ID NO: 1555 - DNA, 1694 bp, Panicum virgatum
ccagcccaccaccaccacaagcaccgcgtcgtccacaccacctgccattgccgcgccgagctcagcctctagctgcgccaggagggcgcccgcctccctccctgccgacgccggtgtgatggagctgcacaagtactggggcgtggggggccgccggtgcggcggctgcgaggcggccccggcggcggtgcactgccgctcgtgccccgccgggggcgcgttcctctgcacggcgtgcgacgcgcgcccggggcacgcgcggctgggccacgagcgcgtgtggatgtgcgaggtctgcgagctggcgcccgccgccgtcacgtgcaaggccgacgccgccgtgctctgcgccgcctgcgacgccgacatccacgacgccaacccgctggcgcgccgccacgcgcgcgtccccgtcgcgcccatcggctcggaggccgcggccgctgccgtggaggccatgctgttcgggaccggcgagccggccgcgtccgaggccgaggagccgcagaacgcggcggccgggcacaaccaccagcacgcgctgaacctcaacgtggaggccaaggacatgaagctggactacctcttctccgacctggacccctacctcagcgtcgatatcccgcgcttccagcacgccgacagcgtcgtccccagcggcgtcggcgccggagcagccggcaccgtcgagctggacttcacgtgcggcatcggcgtcaagccctcctcatacagctcctacacggcaacatccctcgcccacagcggctcctcttctgaggtcggcgtggtgccagaggccttctgcggcggcggcgggagcttcgagctcgacttcacaaggcccaagcctcaagcctacatgccgtacaccgcgactcctcagagtcacagcgtgtcgtcggtggacgtggaggtggtgccggagcggggggacatgatggcggcggcgaggccggtgccgctggtgggggagagccgggaggcgcggctgatgcgctaccgggagaagcggaagaaccggcggttcgagaagaccatccggtacgcgtcccggaaggcctacgccgagacgcggccgcggatcaagggccggttcgccaagcgcgccgaccacgacgccgacgacgccgaggccgaggccgccgtgccgtcgccggcgtcgtacgtgctcgacttcggctacggcgtcgtgcccagcttctgaacgacgacgatccactgctagaaaatctatcattagtgtcattagtgggaaccctcggtttctaccgtttccaaccggtaccgttcctccagtactaagtgtgactgagtaccggtcagctggtccggtactaaacagtccgtttaggtactaaactgctggccacgccagcagctaggccgagtagtttagtaccggttggtaataccaacagatactaaacgatttttttctttttgatgctttatatttgttctctttttctttcaatttcaattaattatattaatagtcgtactcgcagcgatttgtgtatttgtactcgtactcgtattgtgtattcgtactcgtactcatatctagaattcgtatttgtatatggagcaaagcaaataaaaaaaattatatacatacatggataaaagaaatgttagaaattatatacatacatggataaaagacaataatatttacaagtatgaattct

SEQ ID NO: 1556 - DNA, 1688 bp, Saccharum officinarum
ccaccgctgccattgccgcagccagccgagcctcgtagccgccgcgccagccaggagaagcaggcgagaggcgcctgctgcttgctgacgacctcggtcggtcgatggagctgcacaagtactggggcgtggggggccggcggtgcggcagctgcgaggcggccccggcggcggtgcactgccgcacgtgcgtcggtggatcgttcctctgcacgacgtgcgacgcccgccccgcgcacgcgcgcctgggccacgagcgcgtgtggatgtgcgaggtctgcgagctggcccccgccgccgtcacgtgcaaggccgacgccgccgtgctctgcgccgcctgcgacgccgacatccacgacgccaacccgctggcgcggcgccacgcgcgggtccccgtcgcgcccatcggctccgaggccgccgccgcggccgtcgaggccatgctgttcgggaccggcgaggcggccgccgcgtccgaggccgacgagcataacgcggcggcggcagagcagcagcagcacgcgcacgcgcacgcgctgaacctcaacgtggaggccaaggacatgaagctggactacctcttctctgagctggatccctacctcagcgtcgagatcccgcgattccagcacgccgacagcgtcgtccccaacggcgccggcgccgccgccgtcgagctggacttcacgtgcggcatcggcgtcaagcactcctcctatagctcctacacggccacctccctcgatctcgcgcatagcggctcctcgtcggaggtcggcgtggtgccagaggccttcggcggcggcggcgggagctttgagctcgacttcacaaggcccaagcctcaggcctacatgccatacaccgcgactccccagagccacagcgtgtcgtcggtggacgtggaggtggtgccggagcggggagacttgccggcggtgaggccggtgccgctgatgggggagagccgggaggcgcggctgatgcggtaccgtgagaagcggaagaaccggcggttcgagaagaccatccggtacgcgtcccggaaggcctacgccgagacgcggccgcggatcaagggcaggtttgccaagcgtgccgaccacgacggggacgccgacgccgacgacgctgaggccgaggccgccgtgccgtcgtcgtacgtgctcgacttcggctacggcgtcgtgccgagctttgcatgatctctcgatcgtcggccccaacgcgcgcgcgcatgggcgccggcagcgcgcttgaaccggcacggcatggcacgccgttgcgcgcggaccttgtacttgtatcaatgtatagggaggagtagcaatcccatcccatgtactctctttttgagcaagcccttgcgtaaactagcgatgtataatttgtatgtatactactagtaagaaactgcagtagccgctactactgaatcatgaatctatcgcacaagttgtcgtaaacttgtgctagttacagtagtaccaatgtaccatgcatgtgatcctagattggccatgctttcgaccaagccgatcttcaaatgtttggcacacaatcgagcgtgtatggtcttaactgtatgtcaggaagtatttctcttcgttgaacagtaaggttcgtttcgatacaggtgctaccatatgtatgcaggcaacagctgtgatagaatacttctaatgcag

SEQ ID NO: 1557 - DNA, 1567 bp, Panicum virgatum
cgacaccacctgccatcgccgcgccgagctcagcctctagctagctgcgccaggagggcgcccgcctcgctccctccctgccgacgccagtgcgatggagctgcataagtactgggggcgtggggggccggcggtgcggcggctgcgaggcggccccggcggcggtgcactgccgctcgtgccccgccaccgccgggggcgcgttcctctgcgctgcgtgcgacgcgcgcccggggcacgcgcggctgggccacgagcgcgtgtggatgtgcgaggtctgcgagctggcccccgccgccgtcacctgcaaggccgacgccgccgtgctctgcgccgcctgcgacgccgacatccacgacgccaacccgctggcgcgccgccatgcgcgcgtccccgtcgcgcccatcgggtccgaggccgccgcctccgccgtcgaggccatgctgttcgggaccggcgacggcgacccggccgcgcccgaggccgaggagccgcaggacgcggcggccgggcacgggcacgggcagctccagcaccaccaccagcacgcgctgaacctcaacgtggaggccaaggacatgaagctggactacctcttctccgacctggacccctacctcagcgtcgacatcccgcgcttccagcacgccgacagcgtcgtccccagcggcgtcggcgccggagccgccgccggcgccgtcgagctggacttcacgtgcggcatcggcgtcaagccctcctcgtacagctcctacacggcaacatccttcgcccacagcggctcctcctctgaggtcggcgtggtgccggaggccttctgcggcggcggcgccgggaccttcgagctcgacttcacccggcccaagcctcaagcctacatgccgtacaccgcgactcctcagagccacagcgtgtcgtcggtggacgtggaggtggcggcggcggagcggggggacatggcggcggcgaggccggtgccgctggtgggggagagccgggaggcgcggctgatgcgctaccgggagaagcggaagaaccggcggttcgagaagaccatccggtacgcgtcccggaaggcctacgccgagacgcggccgcggatcaagggccggttcgccaagcgcgccgaccacgacgccgacgacgccgaggccgaggccgccgtgccgtcgccggcgtcgtacgtgctcgacttcggctacggcgtcgtgcccagcttctgatcgatcgacgacggtccggcgggcggcggcgcgcctgacccggcactggcgcgcgcgccttgtgtacttgtatcgatgcatgatgtataggggaggaatagtaaatcccatgtactactctctttttggagctgtgctagccttgcgcacgctagtgatgtataatttgtatactacgcgctgctacttactactagcatgttcttgctggaattagccccggctatttttgaatcaaatctatgcaagaaatttgtaacggtagccgctactgagaacgaaccccacgattcatcatcttaagtcatggataagtctattttacaacctcgaactagtcaaga

SEQ ID NO: 1558 - DNA, 2073 bp, Sorghum bicolor
actacatgtagcgcgccccatcaccaccatgcgctgcctgcctccactaccacgccgcgctgcctccccagtcccctcccctccctccccaccaccaccaccaccacaagaaccgcgtcggcagacaccaccgctgtcattgccgcggccaggcgcgccagccaggagaaaggcgggaggcgcctgctgtgcttagccgcttgctgacctcgctcgttcgatggagctgcacaagtactggggcgtgggtggccggcggtgcggcagctgcgaggcggcgccggcggcggtgcactgccgcacgtgcgtcggcgggtcgtcgtcgttcctctgcacgacgtgcgacgcgcgccccgcgcacgcgcgcctggcccacgagcgcgtgtgggtgtgcgaggtctgcgagctggcccccgccgccgtcacgtgcaaggccgacgccgccgtgctctgcgccgcctgcgacgccgacatccacgacgccaacccgctggcgcgccgccacgcgcgggtccccgtcgcgcccatcggctccgaggccgccgccgcggccgtcgaggccatgctgttcgggaccggcgacgcggccgaggccgacgaccagcacaacaacgcggcggcggcggccgagcagcatcagcatcagcaccacgctcaccacgcgcacgcgctgaacctcaacgtggaggcgaaggacatgaagctggactacctcttctctgagctggatccctacctcagcgtcgagatcccgcgcttccaccacgccgacagcgtcgtccccaacggcgccggcgctgccggcgccgtcgagctcgacttcacgtgcggcatcggcgtcaagcactcctcctacagctcctacaccgccacctccctcgatctcgcgcatagcggctcctcgtcggaggtcggcgtggtgccagaggccttcggcggcggcggcggcggcggcggcgggagctttgagctcgacttcacaaggccaaagcctcaggcctacatgccatacacggcgactccccagagccacagcgtgtcgtccgtggacgtggaggtggtgccggagcggggagacttgccggcggtgaggccggtgccgctgatgggggagagccgggaggcgcggctgatgcggtaccgtgagaagaggaagaaccggcggttcgagaagaccatccggtacgcgtcccggaaggcctacgccgagacgcggccgcggatcaaggggaggtttgccaagcgcgccgaccacgacggcgacggcgacgccgacgacgccgaggccgaggccgccgtgccgtcgtcgtacgtgctcgacttcggctacggcgtcgtgccgagcttctgatgatctcgatcggcccaccccggccggcggtcccaacgcgcgcgcatgcatgcatggccgccacggaacgccgcgcgcgcgcgcgcgccttgtacttgtatcaatgtatagggaggagtagtaatcccatgtactctctttttgagcaagcccttgcgtaaactagccatgtataatttgtatactactggtaacaagctgcagtagccgctactaatgacccatgaatctactatcgcactagttgtcgtaaacttgtgctagttactggtacagtagtgccatacatgcatgatccaaacttgggccttgtttagttttcaaaaaaattcgattttgtgacatatcgaatctttattaaatatagataaaaataaatattaattacaaagtttatgtataatttacgagatgaattttttagtctagttaatctataattagacaacaattactaaatacaaatatctaaaatcagaaaaaaaaatgccaactgaacaaggcccgccatgcatgctgtttcgaccaaccgatcttcaaatgtttggcgcaacaatcgattgtagtaggtcttaactgcatgctgtttcgaccaaacagatcttcaaatgtttggcgcaacaatcgattgtagtaggtcttaactgtatgtaaggaagtattatttctgtgagaaacagtggtggacctaggatttggttaggactggggctaaatcttag

SEQ ID NO: 1559 - DNA, 1474 bp, Zea mays
gctgcgctgcctccctccactactacgccagccactctgccttccctcccccaccaccacaagaaccgcttcaccattgccgcgtccagctgagcctcctcttagccgcgtccagccaggagaaggcgggcgcgcacacctgctgcttggtgaccacgttcgatggagctgcacaagtactggggcgtggggggccggcggtgcggcagctgcgagggggccccggcggcggtgcactgccgcacgtgcgttggtggatccttcctctgcacgacgtgcgacgcccggcccgcgcacgcgcgcctgggccacgagcgcgtgtggatgtgcgaggtctgcgagctggcccccgccgccgtcacgtgcaaggccgacgccgccgtgctctgcgccgcctgcgactccgacatccacgacgccaacccgctggcccggcgccacgcgcgggtccccgtcgcccccatcggctccgaggccgccgccgcggccgtggaggccatgctgttcgggaccggcgaggcggccgcttccgaggccgacgagcagcacgcggcggccgagcacgcgcacgcgcacgcgcacgcgctgaacctcaacgtggaggccaaggacatgaagctggactacctcttctctgaactggatccctacctcagcgtcgagatcccgcgcttccagcacgctgacagcgtcgtccccaacggcgccggcgctgccgtcgagctggacttcacgtgcggcatcggcgttaagcactcctcctacagctcctacacggccacctccctcgctcatagcggctcctcgtcggaggttggcgtggtgccagaggccttcggcggcagcggcagcggcggcgggagctttgagctcgacttcacaaggcccaagcctcaggcctacatgccatacaccgggactccccagagccacagcgtgccatccgcggacgtggaggtggtgccggagcggggagacttggctgcggtgaggccggtgccgctgatgggggagagcagggaggcgcgcctgatgcggtaccgtgagaaaaggaagaacaggcgcttcgagaagaccatccggtacgcgtcccggaaggcctacgccgagacgcggccgcgaatcaagggccggtttgccaagcgtgctgaccacgacggggacgccgacgccgacgccgacgccgacgccgaggccgaggccgccgtgccgatgtcatatgtgctcgacttcggctacggcgtcgtaccgagcttttgatgtgcccgggcccaacacgcgcgcacatggccggccgcgcgcttgaaccggcatggcacgccgctgcgcgcgcgccttgtacttgtatcgatcgatgtatagggaggagtagtaatcccatgtactctctttttgagcaagctcttgcgtaaactagtgatgtataatttgtactactatagtaagaaactgcagtagccgctgctaatggatc

SEQ ID NO: 1560 - DNA, 1691 bp, Pennisetum glaucum
tttcgggggtagcacaaaaaggaaatcgggaagaggacgaagacttccgtggccgcggagtagctgctgctgctgctgcagtgctgcttgggttcgtaggttaggaggatcaggaagaagggcggagaaaggtcaaaggctcgcgcaatcgcccggcgccttctcgccgccttcgccttcctccccgcctaccccgtacgtccttccccccctcatttaactacggcgccgcctcctgttcgtgtaatccggccgagcgccaccgcttccccttcccccctccctctacggttaccacccacctgagggcgtctcgctcaactggttgcgcgcgcggcgctccgcctccgctgctacttgcagaaactgcttctaggtttcctgctttttttctgtgggcatatctgcaaccgaatcggtaaagatgggttcctgcttgggaaagaatgctgaacaagctgttcaaggcgatcaagatgtacacagcgtgaaggtcttttcttacaatgagttgagaaaggctacacaagacttcagtggcgcaaataagattggcgagggtggttttggttctgtcttcaggggagtgcttaaagatgggacagtagttgcagtgaaagtactgtctgctacttcaaggcaaggcatccgggagtttctgactgaacttacagcaatatctgacatcaagcatgaaaatctcgtcactctaatcggttgctgcgctgaaggctctcacagaatccttatttacaattaccttgagaacaacagccttgcacagacattgctaggagctagatatagtaacattcgattcaactggcggtcacgtgtcaaaattgctgtgggtgtcgcccgtggacttgcgtttctccatgaggaaatccggccacccattatccaccgggacataaaggccagcaacattcttcttgacaaggatctcaccccaaaaatttctgattttgggttggctaggctcctgccacccaatgcaactcatgtgagcacccgagttgcaggcacattaggctacttggctcctgaatatgcaatccgaggtcaagtgacaaagaagtccgacatctatagttatggagttcttctcttagaaattgttagtggaagatgcaacaccaatacaagattaccttctgaagatcaattccttcttgagaggacatgggcactctatgaggaagaacgtttggaagagatcatcgatttcgacatcggtgacgacctggacgtcgaggaggcatgccgtttcatgaagattggcctgctatgcacacaggacgcaatggcacgtcgtcccaacatgaccaatgtcgtccggatgcttacaggagagaagagaatcaacgtagacaagatcaccagacccgccatgatcaccgactttgcggatctcaaggtcagcaacaaggagccaagatcaagtgagacacgctctcccacgactgcacccacgacgaaatcgttcaccactacagaaccattctcatcgtcagaaacgcacacgcagtcatccatgtgaaattctgaacttcagaagcattctctcttgtttttttctccctcagcttgtatattgtgtgaattgtgataggaagttcaggctccgtgcaatttttttttgaagagtttcttgtttgatttgtcatgaggaaagatctcataggcag

SEQ ID NO: 1561 - DNA, 2354 bp, Panicum virgatum
atccacttctgaattggatttgggacatataaaatcgcctttcacatgtttcgtctcagttttggcgttgcttcatgtgccatatgcccatatatgttagttcctctagcaacaagtacgatttgggacatactttggcgttgcttcatgtgccatatgcccatatatgttagttcctctagcaacaagtacgatttgggacatactccgtagaaatcactgcaaactgtgcctgtacgaccaggaagccatctgcttagttccgtggcgtcttcaacgtttcagcaacctcgttttcctggtagttcaccgtgaatcgggatgcaaatttacattctgtatgtcgatgtcagatggttatcactggcaactggtatttgccatctagctagctaattttcacactccaagggaggcgattggtccaccgcccgcgttaggtcgcgagtaattgcgacagtccttgtttcatttcttcaaaccggtgagcaaattgggggctgacttcttccttgacctggctaaagcctccttgcagctgaagcctgaaatatcttagctcggtggtttcacattttgacgtctttctatcttgtacgacatgtggacttttacagtagtaacctaatagttcgaatgcggtaaatggtaaggtagcttaaaaacgtactgtcaatgtgtttccacattgctggtccttttctctcaagtggtccaattgtccactccaaaacacaaatctttgtttatgctacaattgccatgtgagtccaactgctaaccggcagtaccagttgtaattgtactttactttcttttaggttgatttactaatcccaattgatattactgaaatctctgctgatggtcaacatatctttattttttcagaaactccttataagttcctgcttttctctgtgggcgcatctgccactgtattggtaaagatgggttgctgctttatgtttggaaagaaagctgaacaggccgttcagggcgatgatgatgtacatagtgtgaaagtcttctcttacaatgagttgagaaaggctacacaagatttcagtggtggaaataagattggcgagggtggttttggttctgtcttcaggggagtgcttaaagatgggacagtagttgcagtgaaagttctatctgctacatcaaggcaaggtatccgggagtttttgactgaacttacagcaatatctgacatcaagcacgaaaatctggtcactcttatcggttgctgcgctgaaggctctcacagaatccttgtttacaattaccttgagaacaacagccttgctcagacattgctaggaaccaggtatagtaacattcggttcaactggcggacacgcgtcaaaattgctatgggtgttgcccgtggacttgcatttctccatgaggaaatccgacctcccattatccaccgggacataaaggcgagcaacattcttcttgacaaggatctcacccccaaaatttctgattttgggttggcgaggctcctaccacccgatgcaactcatgtgagcacccgagttgccggcacattaggatacctggctcctgaatatgcaatccgaggtcaagtgacaaagaagtccgacatctatagttatggagttcttcttttagaaattgtcagtggaagatgcaacactaatacaagattaccttctgaagatcaattccttcttgaaaggacatggggactccacgaggaaggacgtttggaagagatcattgatatcgacataggggacgacctggatgtcgaggaggcatgccggttcttgaagattggcctgctatgcacgcaggacgcaatggcacgtcgtcccaacatgaccaatgttgtccggatgctcacaggggagaaaaggatccccgtagacaagatcactaggcccgccatgatcactgactttgcagatctcaaggtcagcagcaaggagcaaagatcaagtgagacacgctctcccaccacaaaatcgttcaccacaacagaacatttctcgtcgtcggaaacgcccacgcagtcatccatgtgaaattctggatgccagaagcttctctttttccccagtttgtatattgtgtgaattgtgatagatgggccaggttacatgcaatttttgaagagtttcttgtttcatttgttatgaggaaagatctcataggtagcttattgcttctttgtatgctgtaaatatttcgaaacaaagatgtcttcctttgcgcgttggaaacaacttcagtttttgctcaaaaagatgataagcttattgcctcaaatgaaaagatggaacacctgccgtccttgctccaaaaaaaaaacttaa

SEQ ID NO: 1562 - DNA, 1312 bp, Panicum virgatum
atgggttgctgctttatgtttggaaagaaagctgaacaggccgttcagggcgatgatgatgtacatagtgtgaaagtcttctcttacaatgagttgagaaaggctacacaagatttcagtggtggaaataagattggcgagggtggttttggttctgtcttcaggggagtgcttaaagatgggacagtagttgcagtgaaagttctatctgctacatcaaggcaaggtatccgggagtttttgactgaacttacagtaatatctgacatcaagcacgaaaatctggtcactcttatcggttgctgcgctgaaggctctcacagaatccttgtttacaattaccttgagaacaacagccttgctcagacattgctaggaaccaggtatagtaacattcggttcaactggcggacacgcgtcaaaattgctgtgggtgttgcccgtggacttgcatttctccatgaggaaatccgacctcccattatccaccgggacataaaggcgagcaacattcttcttgacaaggatctcacccccaaaatttctgattttgggttggcgaggctcctaccacccaatgcaactcatgtgagcacccgagttgccggcacattaggatacctggctcctgaatatgcaatccgaggtcaagtgacaaagaagtccgacatctatagttatggagttcttcttttagaaattgtcagtggaagatgcaacactaacacaagattaccttctgaagatcaattccttcttgaaaggacatggggactccacgaggatggacgtttggaagagatcattgatatcgacataggggacgacctggatgtcgaggaggcatgccggttcttgaagattggcctgctatgcacgcaggacgcaatggcacgtcgtcccaacatgaccaatgttgtccggatgctcactggggagagaaggatccccgtagacaagatcactaggcccgccatgatcactgactttgcagatctcaaggtcagcagcaaggagcaaagatcaagcgagacgcgctctcccaccacaaaatccttcaccacaacagaaccattctcgtcgtcggaaacacccacgcagtcatctatgtgaaattgtggatgccagaaggttctctttttctttttccagtttgtatattgtgtgaattgtgatagatgggccaggttacatgcaatttttgaagagtttcttgtttcatttgttatgaggaaagatctcataggtagcttattgcttctttgtatgctgtaaatatttcgaaacaaagatgtcatcctttgcgcgttgg

SEQ ID NO: 1563 - DNA, 1964 bp, Sorghum bicolor
gactcgctccgtcgccgcgccccaccccgccatttctcatttatttaagccgcccgcaaccgccaaggcacttccggaaaaacaaatcgatcgagcgcgaggacgaaggggaaggagacttgtgcggcggagtagctgctcgcttcacacgggtgaggaggaggaggaggaggagcagagctgcggccgggggcgaggaaaagtcaaaggctcgcaatcctcccccggcgccttctcgtcaccttctccttcttcctcgtctgctccgcctaccccgcacgtttcgcttcccctcttttaacaacgcccgccaccgccacctccgcagtcgagcagagcgcgcctcctctccctccctctctccctctctttcgctgcccacttgcggctgtctcgctcgctgaactggttgcgccgtagcggccggggagctgcgctccgcctctcctccacagaaactgctgttgagtctctagcttctctgtgggcgcatctgcaattgtgttgataaagatggcctgctgctttctgtttggaaagaaagctaaacaagctgttgaaggcgatgaagatctacacagcgtcaaagtattttcttacaacgacttgagaaaggctacacaagatttcagtggcgcaaacaagattggcgagggtggttttggttctgtcttcaggggagtgcttaaagatgggacagtagtagcagtgaaagttctatctgctacttccaggcaaggcatccgcgagtttctgactgaacttacagcaatatctgatatcaagcatgaaaatctcgtcactcttattggttgctgcgctgaaggctctcacagaatcctagtttacaattaccttgagaacaacagccttgcacagacattgctaggatccagatacagtaacattcggttcaattggcgggctcgtgtcaaaattgcagttggcattgcccgtggacttgcatttctccatgaggaaatccgtcctcccattatccatagggacataaaggcaagcaacattcttcttgacaaggacctcaccccaaaaatttccgatttcgggttggcaaggctcctaccacccaatgcgacccatgtgagcacccgagtagcaggcacattaggatacttggctcctgaatacgcaatccgaggtcaagtgacaaagaagtctgatatctatagttatggtgttcttcttttagaaattgttagtgggagatgcaacaccaacacaagattacctagtgaagatcaatttctccttgagaggacatgggtactctatgagcaaggacgtttagaagaaatcgtagatatcgacatcggcgatgacctggatgttgaggaggcatgccggttcttgaagattggcctgctatgcacacaagatgcaatggcccgtcgtcccaacatgaccaatgtctttcggatgctctcaggggagaagagaatcaacatagacaagatcaccaggcctgccatgatcactgattttgcagatctcaagatcagcaacaaggagcaaaggtcaggcgagacacgctctcccacgacggctcccacgacgaaatcattcaccagcacagaaccgttctcatcgtcagagacgcccacacagtcatccatgtgaaattgtgggcgtaagaagcagatatttttttttgtttcagtttgtatagtgtgtgaatgtggtaggtgggctaggttacatgaattttttgatgagtttgttgtttgtttcgttatgaggaaagatctcataggtctcttattgcatctttgattctgtaaatatttcaaaatgaagatgatcgagataagctttgcacgattctcattctcgaactacttggagtcttggactgctacaacttcagtgattatttgtatcagttcaccttgtatctcttggatttttgtcccagagaatacgaacgatagttgcttatctttgca

SEQ ID NO: 1564 - DNA, 1895 bp, Zea mays
ccggccgtcgccgccacggctcccacaacccaacaccgccatttctttttttaaaaccagtcgcctcgccagtcgccccacccgccatttatatttgttaagccgccgaaaccgccaaggaacggacggaaaacaaaccgaggcgagaacgagagctgggagggaaatttgtgcggcggagtagctgctggattcacacgggtgagggttgagcaagagacggggaggaggagcttgggggcgaggacaagtcaaaggacaaaggctcgcactcccccggcgccttctcgtcagcttctcccccttcgtcgtcttcgtctgctccgcccgcctaccacgcacgttttcgcttcccctcttttaacaacgcccagcaccgccgcctccgcagtcgagcagagcgcccctccctcttcctccctccccctctttctcgctcgcctcccacttgcgggcgtctcgctgaactggttgcgccgtaccagctgcgctccgtctccacagaaactgcttccaagtctctagctctctgcgggtgcatctgcggttgtatttgtaaagatgggttgctgctttatgttcggaaagaaagctaagcaggccgttgaaggcgatgaagatctacatagcgtcaaggtgttttcttacaacgacttgaggaaggctacacaagatttcagtgacgcaaacaagattggcgagggcggtttcggttctgtcttccggggagtgcttaaagatgggacactagtggcagtgaaagttctatctgctacttcaaggcaaggcgtccgcgagtttctgactgaacttacagcaatatctgatatcaagcatgcaaatctcgtcactcttatcggttgctgcgctgaaggctctcacagaatcctggtttacaattacctcgagaacaacagccttgcgcagacattgctaggatccagatacagtaacattcggttcaattggcgggctcgtgtcaaaattgcagttggcattgcctgtggacttgcgtttctccatgaggaaatccgtcctcacattatccatagggacataaaggcaagcaacattcttcttgacaaggacctgaccccgaaaatttcggatttcgggttggcaaggctcctaccacccaacgcgacgcatgtgagcacccgagtagcaggcacattaggatacttggctcctgaatacgcaatccgtggtcaagtgacaaagaaatccgatatctatagttatggtgttcttcttttagaaattgttagtgggagatgcaacaccaacacaagattacctagtgaagatcaattcctccttgagaggacatgggcactctatgaggaagggcgtttagaagacatcatagatattgacatcggcgatgacctggatgttgatgaggcatgcaggttcatgaagattggcctgctatgcacacaagatgcgatggcgcgtcgtcccagcatgaccaatgtcgttcggatgctctcaggggagaagagaatcaacgtagaccagatcactaggcctgccatgatcactgattttgctgatctcaagatcagcaacaaggagcaaagaccaggcgagacacgctctcccacgacaactcctacgacgaaatcattcaccaccaccgaaccattctcgtcgtcagagacgcccacgcagtcatccatgtgaaagtgtgggcgtaagaagcagttttttttgttgttgtttttagtttgtatagtgtgtgaatgtggtagatgggccaggttacatgaattttttttgaagagtttattgtttgttttgttatgaggaaacatctcataggtctcttattgcatctttgttgctgtaaatatttgaaaatgaagatggtcaagataagctttgcacgattc

SEQ ID NO: 1565 - DNA, 2050 bp, Zea mays
gcccgcgcccgcgggcacggtgaagaaaccatgccggccgtcgccgttacggctctcccggaccaaccaaacccctccatttatgtaacgccgccgcaaccgccaagccaaggacaaggcaggcactcccggaaaaacaaatcgaggcgaggacgaggggactcgtgcggtggagcagctgatctcgctgcgcttcacacggccacgggtgagcggtgagcctaagcactgacgaagaggaggagcaaagcaacttggggctgggggcggcgagaagtcaaaggctcgcgatcccctaccctcgaggcgccttctcctccttccttccttcaatccttcctcgtctgctccgcctaccccgcacgtttcgctccctctcttttaacaacgcccaccaccgccgcagtcgagcagagcggcggcccctcctctccctccctctcccacggctgcagggccgcttctctacctccactccatctgtagagaattttctcctccccacttgcgggcgtctcgctgaactggttgcgccgccgccgtaccggttggggaggctgcgctccgtctccacagaaactgcttttcctctctgcgggcgcatctgcgactgcgattgcgttggtaaagatggcctgctgctttctgtttggaaagaaagcgaaacaaaccactgaaggcgatgaagatctacatagcgtcaaggtattctcttacagcgagttgagaaaggctacgcaggatttcagcggcgcgaataagattggcgagggcggtttcggttctgtcttcaggggagtgcttaaagatgggacagtggtggcggtgaaagttttatctgctacttcaaggcaaggcatccgcgagtttttgactgagcttacggcgatatccgacatcaagcatgagaatctggtcactctgatcggttgctgcgccgaaggatctcgcaggatccttgtctacaactacctcgagaacaacagccttgcgcagacattgctaggatccaggcacagcaacatccggttcaactggcacgcccgcgccagaatcgctgtcggcgttgcccgtgggctcgcgtttctccacgaggagatccgtccccccatcatccacagggacataaaggcgagcaacattcttctcgacaaggacctcacccccaagatctccgacttcgggctggcaaggctcctgccgcccaacgcgacccatgtcagcacccgagtggcaggaacattagggtacttggctcctgaatacgcgatccgaggccaagtgacgaagaagtccgatatctatagctatggggttcttcttttagagattgtaagtgggagatgcaacaccaacacgagattacctagcgaggaccagttcctccttgagaggacatgggcactctacgagcaaggacgtctagaggacatcgtggacatggacatcggcggcgaccgggacgtcgaggaggcgtgccggttcctgaagatcggcctgctgtgcacgcaagacgcgatggcgcgccgtcccaacatgaccaacgtcgtccggatgctctcgggggagaggaggatcagcgtagagaagatcactaggcccgccatgatctccgatttcgcggagctcaaggtcagcagcaaggagcgaaggccgggcgaggcacgctcgcccacgacggctcccaccacgaaatcgttcaccaccacggagccgttctcgtcgtcggagacgcccacgcagtcgtccatgtgaagtcgtgggcgtacgacgcatttttttttttggtttagtttgtatagtgtgtggacgtgttaggtgggcagggttacaggttttttttttgagtttcttgtttgttttgctgtgaggaaagatctcgtaggcctcttattgcatctttgatcatgtaaatatctgtaaacgaagatgatcaagataagctttgcacgacggttctcattgtcgaactactttggactgctgcaactcggtgattatttggatcagttcaccttacatcttttgggtttttgtcccacagaatacg

SEQ ID NO: 1566 - DNA, 1695 bp, Brachypodium distachyon
atccgggcaggatagcagagcgcaggaggaggaagaaaagtcaaagactcgcgtggtgctcttcagctccttcgagccaccttcttcttctccttccctcctcgcttgctccgcctactcccccctctcgccctcccatcctctcttatttgcgcccgccaccgccgcctctgactcccaacaccgactgatcctcttcacccactggtcgtctgattgcttcgtcgccttcgccacaggccgcgagctaagctctccatctgcagaaattccttcaagtttgttgctaagatgtcttgttgctttctgtttggaaagagagctcaacatgttgttgaaggcgatgatgatgtacatagcgtgaaggtattttcttacaacgagttgagaaaggcgactcaagatttcagtggggcaaataagattggagagggtggttttggttccgtgttcaggggtatgcttaaagatggcacattagttgcagtgaaggtgttgtcagctacttcaaggcaaggtgtccgagagttcttaactgaactcacagcaatttctgacatcaagcatgaaaacctagtcactcttgtcggttgctgtgctgaagggtcccataggatccttgtttacaattatcttgagaaaaacagcctttcacagacattgctaggctccagctatagcaacattcagttcaactggagggctcgtgtcaaaattgccgtgggtgttgcccgtggacttgcatttcttcacgaggaaatacgtcctcccattatccaccgggacattaaagcgagcaacattctgcttgacaaggaccttacccccaaaatttctgatttcggattagcgaggctcctccctccaaatgcaactcacgtgagcacccgagttgcgggcacattaggatacttggctcctgaatatgctatccgaggtcaagtgacaaaaaagtccgatatatatagttttggagttcttctgttagaaatcgtcagtggcagatgcaacaccaacacaagattgcctcatgaagatcaatttctacttgagaagacatgggcactctatgagcaaggacatctagatgagatcgtagatgtcgatataggcgatgacctggatgtcgaggaggcatgcctattcttgaaagttggcctcctatgcacacaagacgcaatggcacgccgaccccacatgacaaccgttgtcagaatgctcacagggtctaagaacatctccatggagaagattactaggcccgccctgatcaccgattttgccgaactcaaggtcagtagcaaaccacaaggagcaagcgagacgcgctcctacccatcgagatccttcaccaccacagaagtgacggaaccgttctcatcatcggagacaaccacacagacatcaatgtgaaaagttggaattagtgttgctcgatttgtacattgcagtgtgatagatgaatgcaatttttggaggaatttctttgttttctttacaaggagaggttggacagcaacctgttgcttgcttccttgtacgatgtaaatatttggaaatgaagattgatcaagataatcttttgcatgacttacatttctgaactaccactgtccagcaatgctgctacttcgttttaagtgcgtgacacatggggcttgcctgattgcctgaatgagttcgtccttcattatt

SEQ ID NO: 1567 - DNA, 1894 bp, Oryza sativa
ccgacttctccttccacgctagctagctcaaaccaccacacgaggcggcctctgatctctatatttgtttagaaatattaggagagaagcaaaaaaaaaaatcggaggaggaggagcttagagagagaagtcaaagactctctccttctcgtcaccttcttcctccccacgccgcgctctcctcccctcttaaaccactagcgccgcctccgcgctctctcctgcctcctctcctcgcctctcctcaccctgtgggttggtcggcgtgtagctgcttgctttgctctcactgccggggctcgatctgcttgctctgcagaaattctttccaattcattgcttcttgtggcctgtgggcacctctacaatttgatttcagatggattgctgctttatgttcagaaaaaaacaacctgttgaaggtgatgatggtgaacatagagtgaagatattttcttacagtgagttgagaaaggctacccatgattttagtggggcaaataagattggagagggtggttttggctctgtgttcaggggagtgcttagagatgggacaaccgttgccgtaaaggtgctgtctgctacttcaagacaaggcgtccgagagttcttgactgaacttacagcaatttctgacatcaagcatgaaaacctcgtcacacttattggttgctgtgctgaaggatctcataggatccttgtttacaattatcttgagaacaacagtcttgcacagacattgctaggatctaggggtagcaacatccggttcgattggaggacccgtgtaaaaattgctgtgggtgttgctcgtggaattgcatttttacatgaggaaattcgccctccgattatccaccgtgacataaaggcgagcaacattcttcttgacaaggacctcaccccaaaaatttctgatttcggattggcaaggctccttccacccaacgcaactcatgtgagcacccgagttgcaggcacattaggatacctggcacctgaatacgctatccgaggccaggtgacaaagaaatccgacatctatagcttcggtgttcttctactggaaatcgttagcggcagatgcaacaccaacacaagattgccttatgaagatcaatttcttctcgaaaggacatgggtacgctacgagcaagaacgcctggctgagatcatcgatgctgacctggggaatgacctggacgtcgacgaggcatgccggttcctgaagattggcctgctatgcacacaggacgcaatggcgcgccgccccaacatgagcaccgtcgtcaggatgctcaccggggagaagcacttctcggtgcaccggatcaccaggccggccatgatcaccgacttcgccgacctcaaggtcagcagcagccagcagaaggagaacgagacaacacggtcatccaacatgagatcgttcagcaccactgatgaaacggagcctttctcatcgtcagagacgccgacgcagacgtctatctgaaaaaaaaaaacaagaagaagaactggaaatgtggagacaggactagtgttttttttgtgtttgtatattattgctccgaaaggggataggattacgttcaatttttttttctctttttggagagagtttcgtgtttgtttgatttttgtgacgaggagatgtttaagataggcagcgtattgcttctcgatctgggtgtaaatatctcgaaatgaagatgttcaaagcctcaaagataagctctgcacgattcacatctctgagttgtcatcagtctatcaaatttttctctgcaacgaactaacaaaccacttgaccaaatcatacacaaaaattgtctgaactcaaatatatttcagaaatgagatcttagctcgaagctgtacgtatgccatg

SEQ ID NO: 1568 - DNA, 1851 bp, Triticum aestivum
taacccccttcctttccggttttaccgtaaactaaaacaacaacggagcggaggaaggagtacgtacgacgcacgacgagagggtcggcggggtgggggtggaggtgaggtgagcggcagcagcaggagtaggaagaagaggaacgggagggaggagaaagtcaaagcctcgtgccgtggtgctcccgagatccttctcaccgccttcttcctcttcatatccttctccgcctactcctccccctccaccctccccctcctctgctcttaaccgccgccttgtacgccaccgcctcctctcgccttgcctcgtcctcacccactgctcggcgccgtcgtcgttgtttatcaccgggagggagccaggctcgatcgatcaatcctcctcggcgccgctatctatctatctgcaagaaattccttctagtttgttgtcaacatggattgctgctttatgttcggacggagatctcaacatgctgttgaaggcgatgatggtgaacatagtgtgaaggtcttttcttacaacgagttgagaaaggcaactcaagatttcagtggggcaaacaagattggagagggtggttttggttccgtattcaggggaatgctcaaagacggcacactaatcgcagtgaaggttctgtcagccacttcaaggcaaggtgtccgagagttcttaactgaacttacagcaatttcagacatcaagcatgaaaacctcgtcacgcttgtcggctgctgtgctgaagggtcccataggatcctcgtttacaattatcttgagaaaaacagcctttcacagacattgctagggtctggctacagcagcatccagttcaactggagggctcgtgtcaaaattgccgtgggcgttgcccgtggacttgcatttcttcatgaggaaatccgtcctcacattatccaccgcgacataaaagcgagcaacattcttctcgacaaggacctcaccccgaaaatttctgattttggattggcgaggcttcttcctgccaatgcaactcatgttagcacccgggtggcaggcacattaggatacttggctcctgaatatgctatccgaggtcaagtgacgaagaagtctgacatctatagttatggggttcttctcttggaaatcgtcagtggcagatgtaacaccaacacaagattgccttgtgaagatcaattcctccttgagaagacatgggcattctatgagcaagagcgtctagaagagatcatagatgccgacatagacgaagacctggacatcgaggaggcatgccggttcctgaagatcggcctgctatgcacacaggacgcaatggcgcgccgcccccacatgcccaccgtcgtgaggatgctcacgggaagcaagagcatctccatggagaagatcaccaggccagccatgatcaccgactttgcggagctcaaggtcagcaccaaaccgcacggagcgaaccaggcgcggtccaacacgtcgagatccttctccaccacggagatatcggagcccttctcgtcgtcggagaatcacacgcagacatctgtatgaagagttggacaggaaattagcgccgttcgatttgtacattgtcgtggtgatagatatgcctgcaatttttggaggatatattgctttgttttttttgttttttcttttttgattccacgaggaggggttgggttaatggggcaacctgtcgtttgcttgttgtgtacgatgtaaatatctggaggtggagatgatcaacataggttcttgcaagatatgattcacatctctgaaccactactgtgttgcattgccgtcagacttcagtgttcactgttatgatgactgac

SEQ ID NO: 1569 - DNA, 1482 bp, Secale cereale
gcgcccgccaccgccgtcttgtacgccaccgtctcctctcgcccacccactgcctggcgctcactgccggctcacatcgatcggcgctgctatctatctatctatctgcaagaaactccttcttgttagttgtcaacatggattgctgctttatgttcggaaggagatctcaacatgctgttgaaggcgatgatggtgaacatagtgtgagggtcttttcttacaacgagttgagaaaggcaactcaaggtttcagtggggcaaataagattggagagggtggtttcggttccgtattcaggggaatgctcaaagacggcacattaatcgcagtgaaggttctgtcagccacttcaaggcaaggcgtccgagagttcttaaccgaacttacagcaatttcagacatcaagcatgaaaacctcgtcacgcttgtcggctgctgcgctgaagggtcccataggatcctcgtttacaattatcttgagaaaaacagcctttcacagacattgctagggtctggctacagcagcatccagttcaactggagcgctcgtgtcaaaattgccgtgggcgttgcccgtggacttgcatttcttcatgaggaaatccgtcctcacattatccaccgcgacataaaagcgagcaacattcttctcgacaaggacctcaccccaaaaatttctgattttggattggcgaggctccttcctgccaatgcaactcatgttagcacccgggtggcaggcacattaggatacttggctcctgaatatgctatccgaggtcaagtgacgaagaagtctgacatctatagttatggagttcttctcttggaaatcgtcagtggcagatgtaacaccaacacaagattgccttatgaagatcaattcctccttgagaagacatgggcattctatgagcaagagcgtctagatgagatcatagatgccgacatagacgaagacctggacatcgaggaggcatgccggttcttgaagatcggcctgctatgcacacaggacgcaatggcacgccgcccccacatgcccaccgttgtgaggatgctcacgggaagcaagagcatctccatggagaagataaccaggccagccatgatcacggactttgcggagctcaaggtcagcaccaaaccacagggagcgagccaggcgcggtccaacacatcgagatccttctccaccacggaaatatcggagcccttctcgtcatcggagaaccatacgcagacatctgtgtgaagagttggagagaaaattagcggcgttcgatttgtacattgtcgtggtgatagatatacctgcaattttttaggatatatatttgtttgtttgtttgttttttctccacgaagagaggttggatgatagagcaacctgtcgcttgcctgcttgctttgtacggtgtaaatatctggagatgatcaagtaaagcctttgcaatgattcaaaaaaaaaaaaactg

SEQ ID NO: 1570 - DNA, 1684 bp, Hordeum vulgare
gggaggagacctgcacgcacgcagaggctgaggctgaggcgagcggcaggagttggcggaggaacgctagggagggaaagtcaaagcctcgtggtgctccagagatccttctcgccgccttcatatcctcctcctactcctcccccctcctcctcatcctcctcctcctctattcataaccgcgcccgccaccgcctcctctcgcctcacctcgtcctcaccaactggtcggcgtcgtcgtcgttgtttgtcagctggtcgctagcacagggagccagccaggctcgatcgatcctcctcggcgctgctatctatctatctatctgcaagaaatatcttctagtttgttgtcaacatggattgctgctttatgttcggaaggagatctcagcatgttgttgaaggcgatgatggtgaacatagtgtgagggtcttttcttacaacgagttgagaaaggcaactcaagatttcagtggggcaaataagattggagagggcggttttggttccgtattcaggggaatgctcaaagacggcacattagtcgcagtgaaggttctgtcagccacttcaaggcaaggtgtccgagagttcttaacggaacttacagcaatttcagacatcaagcatgaaaacctcgtcacacttgtcggttgctgcgctgaagggtcccacaggatccttgtttacaattatcttgagaagaacagcctttcacagacattgctagggtctggctacagcagcatccagttcaactggagggctcgtgtcaaaattgccgtgggcgttgcccgtggacttgcatttcttcatgaggaaatccgtcctcacattatccaccgcgacataaaagcgagcaacattcttctcgacaaggaccttaccccgaaaatttctgatttcggattggcgagacttcttcctgccaatgcaactcatgttagcacccgggtggcaggcacattaggatacttggctccagaatatgctatccgtggtcaagtgacgaagaagtccgacatttatagttatggagttcttctcttggaaatcgtcagtggcagatgtaacaccaacacaagattgccttatgaagatcaattcctccttgagaagacatgggcattctatgagcaagaacgtctagatgagattatagatgccgatatagacaatgacctggacatcgaggaggcatgccggttcttgaagatcggcctgctatgcacacaggacgccatggcccgccgtccccacatgcccaccgtcgtgaggatgctcacaggaagcaagaacgtttccatggagaagatcaccaggccagccatgatcaccgactttgcggagctcaaggtcagcaccaaaccgcaaggagcgaaccaggggcgccccaacacgtcgagatccttctccaccacggaaatatcggaggagcccttctcgtcggagaatcacacgcaggcatctgtatgaagaagtggacagaaaattagcgtcgctcgatttgtacattgtcgtggtgatagatatgcctacaatttttggaggatatatttgttggttttttttttccttcacgagaagaggttggataatagagcaacccgttgcttgctttgtacggtgtaaatatctggagacgatcaagtaaagcctttgaaatgtttcacatctctgaac

SEQ ID NO: 1571 - DNA, 2445 bp, Sorghum bicolor
gccggcgtgggcttgtggtgtgtgtgaaaaggtcgcagccggcgacccggcgaaaagccgggatggtaaagcaacgtcgccaccccaccgcaagcgctgcgcaacgcaaagaggcgctgccgggcggggtccggacctccgacgcgagcgggcggagcagcgcgagccggacgaccagggcaccaccagtccaccaccaacaagcaacaagtagccagccagccagctacagccagaacgcaacacggcacgcacagcacagggccggagagagagagagagaggggggaagcccgaagcgaagcgagcacaagaggccaccgcagcggccaggcggcgagcgagacacctccacacgtctctccccctccttcccttccccttccgtttccttcccgtccctgctcacacctctgtagctgcgcccgaccgaaccccctaccccccgtggaggaatcctccccccgatgcggcgccgatagggaccggtggaggagcgggaatggcggggcacggcgagaagcggcgccggacgggaggggcccacgaggaggagccggaggaggaggaccgcatctcggaccttcccgacgtactgcgcctgcagattctcagcctgctgccgctcaaatcggccatccgcaccggcgcgctctcctcgcggtggcgccgcctctgggcgtaccgctggccggagccgtcctcggttaccatccgcctcccgcccggcggcggcgcggcgggggcgggggcggtggcggctgcggcggcgcgcgcggaggcgctcgcggggatcgaccgccgcgggcgccgccgcgtcgacggcttctccctctccttccatggcgggcagctcacgcaggcggacctcaaccgctgcgtccactacgccgcggcgtgcgaggccgaggacctgcacctccgcgtcgacggcggcgcgggcgccggccggggctcccgcggtggcacgcgccgccccgggatgctctccgtgcagttccccgtggggagcccgctgctcgcgcgcctgtcggtgcgcgggctcaacctcacggccgtcaacaacgccatggtcgtcacgctcgaggtgatccacctccactccgtcttcctcaccgacgccgcgctgcgccggatggtcgccgcctgcccccgcctccgggagctcgacctccgttactgccgccgcctgcgccgcgtcgacttcagcaacgtcggggtgcccaacctcaggagcttcaccgtcgtcgactgctcccgcaccaccgagctgcgggtcccggtcgcgctccgcctccggtccttccgcttcagcggcgccttcctctccagcaacatcctctctggcgccaagggctctcttgagcatctctacctctgctctggcgggccagagaccggccttcccacaaccaacttgctgtacgcagttcctcgcctatcgaacctcactgtcctcaccctctgcagcattgccctccagtatgtttcttccacagccaaggctgtaacggagagcaacctgcatagtctgagggagctccatttgctcatgttcgggatggccaactccaaccttgctgacatctatagcttcctcaagacctgcccgtgtcctcagttggagcgcctctttgtgcagctcccgacaaataccggtgatgcattcacggagaatttcttgaaggtggcggaggaggacccaccaaaaggtggattagaaaacctttgcttagccaagatgacaaatttcaaggggcaccgtaatgagatgcaactagtaggatttctgcttagaaagtctagtagtctgaagaaactatttctgattgctcctaaggaggatcaccctcaaggactccgcaagattcagtcagatatgctgcctgatcttctaaaaaaagaaatattgcatctggaaagagcttcagcaaatacccagatatttttcagtgagcctgatgctcagacccagccattgcattcggaggtctttgtcaggttttagcttgaaatgagcaaatgttgtagtagtccagtttctgctcctatagttttagatttctagctgttagataacagacatggggaaaaagtgtctgcaaggcatacacagtttgatatatgttttctttttgcaattcatattacattattactaaggaagtcactcatgcatagtggttgaaatgcgagctgttctgatctgccacattttcttcttctcatccctctcttcgctccctgtttgtgttcatgatctctttggagttggcttataataagttgcttttgtacataaccaaccatctattggaacacaaccaccttcattttatctggcaccttacaatatgtgtggaactacttctaattcagtgaggtggattaattttgttgtacaattgaattggtaggctaactatgtagttctagatagatgga

SEQ ID NO: 1572 - DNA, 1230 bp, Pennisetum glaucum
cggaggaatctatggcggcgtcgacgtcagcggcggcggcggcggcggcggcacccccgtcctcctgcgagatcgcgcgcatcacggaggacctcctcgcggcgtcgatcgcccgcgccacgccgcgggacgccagccgcgccgccgcggtgtcgccggccttccgcgccgccgccgactccgacgccgtgtgggcctccttcctgccgggcgacctcccgccgctcgccgacggggagctcccccccgcgccgccgtcgaagaaggcgctcttcatgcgcctcaccgacagcaacaggcccgtcctcctcgccgaccgcctcatgagcatgtggttggacagggacaccggcgccaagtgctacatgctgtcggcgagggcgctcggcatcgtttggggcgacacgccgcagtactggcagtggatccctctcgctgactccaggttctcagaaggtgccgagctcctggatgtttgctggttggaaatacgtggcaagatacattgcaagatgctctcgcggaactcaacttacgccgtgtacatggtgttcaagatatccgatgaatcctatgggctggattatccaccccaggaggctgcagttgccatcggggaaaacaaattcactcgtcaggtttgcctcctaggccatgaggatgagggtgagggctcagaagaggtgcctcagaactaccgatctcttatggttccagcaatcaggcggaggttaacgagaagacaccgtcctttgcctcctggagtgactgtgcctaagaaaaggggtgacggctggatggagatggaaatgggtgagttcaacaatgaagaaggtgacgatggtgaggtgtcaatcagtctcacggagataaaaggaggccgctggaagaaaggtcttattgtgcagggcattgaagttagagcaaagaaataaaactgtgagagtgggatatcgtcattgcacatccaaataaggatatatgcatgtgttttgcagcattgtgttggtggacaatgtgcttttgtagctgctagctacgtactgataaatgggtggtgtctccaggttcttgagggtgggaaactgcagttttgtacaaattatggtgtgatgatgtctcagagcagttaggacttgtatgcttaatgactggcaacgtttggttccggaaacatgtggactgcttttgtgaatgaaagattctgatccacatcagaattcatattag

SEQ ID NO: 1573 - DNA, 1806 bp, Panicum virgatum
cggggggattgagccttatgatcggcccgccttggtgcttaagctcatccgacgacgtctccggacggaagaccgcgtgtccagcgagaatcacaaaaatcccacagcgatgatgactcggcgagcacgcgtgcgcctaaacgtcattacgtcatccaccgacccacagctggcgaaccaaccgaaaccgaccaccctcgctacgtcattacgtcatccaccgacctccgggacccacatgccatccactcaggctcagagatctcgtcttactgtggcctccaatgaaatggggccccaaatcagcaacgcttagcccctaagcctccgcgtttccgcctctcccacctataaatccgccaccccttgtctactatactcttgaatgaattcttcctctacccgtttctagaccgcatccccccgaatcgaatccatcgaaagggggcggacgaatctatggcggcgacgacggcacccccctcctgcgagatcgcgcgcctcccggaagacctcctcgcggcgtcgatcgcccgcaccacgccgcgggacgcttgccgcgccgccgcagtctcgccggccttccgcgacgcggccgactccgacgccgtctgggcccgcttcctgccgcgtgacctcccgccgctcgccgacggggagctctcccccgcacctccgtcgaagaaggcgctgttcatgcgcctcaccgacagccccgtcctcctcgccgacggcctcatgagcacgtggttggacagggagaccggcgccaagtgctacatgctgtcggcgagggcgctgtgcatcatttggggcgatacgccgcagtactggcgctggatccctctcaccgactccaggttctcagaaggtgctgagctccgggttgtttgctggttggaaatacgtggcaagatacactgcaagatgctctcgcaaaactcaacttataccacttacatggtgttcaagatttctgatgaatcctatgggctggattctccactccaggaggctgcagttatcattggggaaaacaaattcactcgtcaggtttgcctccaaggtcatgagaatgagggtgaggatgaagaagaggtgcctcagaattaccgatctcttatggttccagacatccgacgaaggttaaggagaagaaactgtcgtattcctcctggagtgattgtgcctaagaaaagggctgatggctggatggagatagagatgggtgaattcaagaatgaagaaggtgaagatggtgaggtgtctatcagtctcatggagacaataggaggcaactggaagaaaggtcttattttgcagggcattgaaattagagcaaagaaataagactgggagggtgggatatagtctttgcacatcaaagtaaataaataaggtgttctgcagcatcttgcgttggtgtgcgatgtgctgtgtttagcaacgagctgcaaactacactctaaaggtgtgtccaggttctttagggaaaacaaagtactgcagttttgtacaaattatggtgtcccagatcagttagtgcttgtctgcttgataactggcaacgtttggttcagaaaatgtaactaggtattgctgttaattggtgttccgactcccgggaccctggaccttgtttgtaagttgcgagctgcttttggaaatgaaaggatccaatgttatcatcatatttgctgttaattatgttccaactcccgggacactggaccttgtttgtaagttgcgagctgcttttggaaatgaaagatttggatccaatgtcatcatcatatttgaatcgaa

SEQ ID NO: 1574 - DNA, 1982 bp, Panicum virgatum
aaccagagccttaaagctcatccgacgacgtctccgggcggaagaccgcgtgtccagcgagaatcacaaaaatcccacagcgatgatgactcggcgaccacgcgtgcgcctaaacgtcattacgtcatccaccgacccacagctggcgaaccaaccgaaactgaccaccctctctacgtcattacgtcatccaccgacctccgggacccacatgccatccactcaggctcagagacctcgtctcgctttctcgtctttactgtatttccttagcctccaatgaaatggagccccaaatcagcaacgcttagcccctaagcctccgcgtttccgcctctcccacctataaatccgccaccccttgtctactatactcttgaatgcattcttcctctacccgtttctagaccgcatccccccgaatcgaatccatcgaaagggggcggaggaatctatggcggcgacgacggcacccccctcctgcgagatcgcgcgcctcccggaagacctcctcgcggcgtcgatcgcccgcaccacgccgcgggacgcttgccgcgccgccgcagtctcgccggccttccgcgacgcggccgactccgacgtcgtctgggcccgcttcctgccgcgtgacctcccgccgctcgccgacggggagctctcccccgcgccgccgtccaagaaggcgctgttcatgcgcctcaccgacagccccggcgtcctcctcgccgacggcctcataagcacgtggttggacagggagaccggcgccaagtgctacatgatctcggcgagggcgctgtgcatcatttggggcgatacgccgcagtactggcgctggatccctctcactgactccaggttctcagaaggtgctgagctccgggctgtttgctggttggaaatacgtggcaagatacactgcaagatgctctcgcaaaactcaacttataccgcttacatggtgttcaagatttctgatgaatcctatgggctggattctccactccaggaggctgcagttatcattggggaaaacaaattaactcgtcaggtttgcctccaaggtcatgagaatgagggtgaggatggagaagaggtgcctcagaattaccgatctcttatggttccagccatcggacgaaggttaaggagaagaaaccgtcgtatgcctcctggagtgattgtgcctaagaaaagggctgacggctggatggagatggagatgggtgaattcaagaatgaagaaggtgaagatggtgaggtgtctatcagtctcatggagacaagaggaggcaactggaagaaaggtcttattttgcagggcattgaaattagagcaaagaaataagactgggagggtgggatatagtctttgcacatcaaagtaaataaacaaggtgttctgcagcatcttgcattggtgtgcgatgtgctgtgtttagcaacgagctgcaaactacactctaaaggtgtgtccaggttctttagggaaaacaaagtactgcagttttgtacaaattatggtgtcccagatcagttagtgcttgtctgcatgataactggcaacgtttggttcagaaaatgtaactgccctgtttagttcccaacaaattttctatagtactcgtcacatcaaatgttcggacacatgcacggagcattaaatgtaattaaaaaaattactaattacatagtttaactaattagtacagaatggatcttttaagtctaattagtcaatgattgggcattagttgtcaaaaaacaacgaaagtattgtagtgtcgaaacccaaatattttcgcgaagggcctagatattgctgttaattggtgttccgactcccgggaccctggaccttgtttgtaagttgcgagctgcttttggaaatgaaagagttggatccaatatcatcatcgtatttgctgttaattgtgttccgactccagggacactagaccttgtttgtaagttgcaagctg

SEQ ID NO: 1575 - DNA, 1233 bp, Panicum virgatum
cccgtttctagaccgcatccccccgaatcgaatccatcgaaagggggcggaggaatctatggcggcgacgacggcacccccctcctgcgagatcgcgcgcctcccggaagacctcctcgcggcgtcgatcgcccgcaccacgccgcgggacgcttgccgcgccgccgcagtctcgccggccttccgcgacgcggccgactccgacgtcgtctgggcccgcttcctgccgcgtgacctcccgccgctcgccgacggggagctctcccccgcgccgccgtccaagaaggcgctgttcatgcgcctcaccgacagccccggcgtcctcctcgccgacggcctcataagcacgtggttggacagggagaccggcgccaagtgctacatgatctcggcgagggcgctgtgcatcatttggggcgatacgccgcagtactggcgctggatccctctcactgactccaggttctcagaaggtgctgagctccgggctgtttgctggttggaaatacgtggcaagatacactgcaagatgctctcgcaaaactcaacttataccgcttacatgttgttcaagatttctgatgaatcctatgggctggattctccactccaggaggctgcagttatcattggggaaaacaaattaactcgtcaggtttgcctccaaggtcatgagaatgagggtgaggatgaagaagaggtgcctcagaattaccgatctcttatggttccagccatccgacgaaggttaaggagaagaaaccgtcgtatgcctcctggagtgattgtgcctaagaaaagggctgacggctggatggagatggagatgggtgaattcaagaatgaagaaggtgaagatggtgaggtgtctatcagtctcatggagacaagaggaggcaactggaagaaaggtcttattttgcagggcattgaaattagagcaaagaaataagactgggagggtgggatatagtctttgcacatcaaagtaaataaataaggtgttctgcagcatcttgcattggtgtgcgatgtgctgtgtttagcaacgagctgcaaactacactctaaaggtgtgtccaggttctttagggaaaacaaagtactgcagttttgtacaaattatggtgtcccagatcagttagtgcttgtctgcatgataactggcaacgtttggttcagaaaatgtaactgccctgtttagttcccaacaaattttctatagtacccgtc

SEQ ID NO: 1576 - DNA, 737 bp, Pennisetum glaucum
gtctccatccactcgccttgtgcgctccgcagccgatcgagcaggaagagcggcgagcgagaggaacagggagtgagagcggcagagcgtcgtcctacatggccgccggcggcggcatggtgttcgagccccacgccggcgcgggcggcggcgacgtcgtgttctgcgtcgccatcgcgctcctgacgctcctctccacggtcatcttcgcggcggccggcgaagggaagaggccgcggcggggcggccgcgggagcggcgccaacgggccggtgttcgtcggcgggaagggctgcggctgcggcgggtgccgcgcgggcgccggcgtctgcggcacctacctctcctgatcgatcgacccacgcgcaccagcagggggcaccggccgccgcgtcgacgcggcctctgcggtcggctcgccggcgcgcgcgcgctgctgtacattcacacggacacggcacggcgaagcgtgtaaaaataaagccttcctccgctgtgcagctcaagccatggcggcggcggcggctgctgctgctgctgctcttagctttttccattttccttttgattttctttctgaggactctgcccctgcttggatatcaccgatcagcccctgcttagactaatatcaaacatcatgctgtaattgttgccattccaatcatctaaaagagatggatcgctttttcttgaggatttccttcctctgaataaacatcagcgttgctattttc

SEQ ID NO: 1577 - DNA, 549 bp, Panicum virgatum
ctcgacggcgagggagcgtgagaggtcgctgcgtatggcaggaggcggcggcatggtgttcgagccccgcgcgggcgtcgcgggcggcgacgtcgtgttctgcgtcgccatcgcgtgcctctcgctgctctccctgatcatcttcgcggcggccggctcctcctccgcggggggcgggggcaagcgcgggcgcgcgagcgggccggtgttcgtcggcgggaagggctgcggctgcggcgggtgccgcgcgggcgccggcgtctgcggcacctacctctcctgaccgagcacgcgccaccgcgtcaacgcagccgccggcgatcggcagaccacaccacgcgcgcaggctcgccggcgtgcgcggccgctgtacatacccacacgcgcacggcacggcacggcgaagcgtgcaaaaatacgcagcggggaagctttgctccgccgtgcccaaggctgctgctcttgtattcctttcccctttgatttgtatctgaggacatccctgcctggataccatcagcgttgttcctgctaaccaagtaaaacatc

SEQ ID NO: 1578 - DNA, 1816 bp, Panicum virgatum
cccctcctaccccgcgagctcgcgcagacagcggcgccgcccccctcctctcctctccgtccgttcgccgccgcccgctgctgccgcggcaccctatggccctgactgggcggctcctcgcggtagccgccctctccatcctctgtttgctggggctggtgcgcgattcagaggctgcatttgctcagacccacttgccgcctcaccggatcgttcacgcaggggaaaatgacggcggcctcatgccggaactcccgcccggcggcctcatgcccatgccggagctctcccccagcggttccccgaagccatttgttcccttcctggcgcctgctccgctcgcgcccttctttaacaacagcacgccaaagctctcagggaaatgcacattgaacttcaccgctgtcgataaactgatgaccaccacagctgtcgactgcttcacctcgtttgcacctttcttggccaatgttatttgctgcccccagcttcaggcaacactgaccatcctcatagggcagtctagcaagcagacagggtctcttgcgttggatcccaccgttgccaactattgcctgtcggatgtccaggagctgctgttgagccagggcgccagcgataatctccacagcctttgctcggtccacctctcgaatgtcaccgagggatcatgccctgtcagcactatggattcgtttgagagtgtcgttgactcgtccaagctccttgaggcctgtcggaagatcgaccctgttaacgaatgctgcagccagacatgtcagaatgctataaacgaggctgcccagaaaatctcatccaaggatggaggcttgacgagctactctgtgagccccaaaattgatagttgcaggaacgttgttctcagatggttgtcaagcaggcttgatccaccgtctgcaaagcaaatgctgaggcagatatctaactgcaatgtcaatggagtttgcccgctaagctttcctgacacaagtaaggtggcaaaagagtgtggtggaacaatcaagaacagcactacatgttgcaaggctatgttaagttatgtagcccatttgcaaaagcaaagcttcataacaaacttgcaagctttaaattgtgcttcgtttcttggtgcaaagttgcaaaagatgaacgtcagcacgaatgtctatagctcttgtcaaataacactaaaggatttttcacttcaagttggatctcaagaatctggatgcctccttccaagtatgccttcggatgcatcctttgaccacatttctgggattagtttcacatgtgatctgaatgataacatcgcggccccatggccatcgtccacgcaagcaccatcctcatcatgcaataaatctgtcaatatcccagagcgacctgccgcaacatcggcacagaatggtgggaaccacaagaatctgaggctaaggctgctggtttctttggcctcccttgttctggtgctcttgatacaagcttagcgtggtccagtttggcagatggcaattattgatattcattcaggagagctaactggaggtggcagtgaagtttttgctcctaggttcacatgtgtttttgttatctcctggtagctatatattagtgcacgtaatttgttgtaaggcatatataatataatgatagcaataatttatattggttttgtatagcgagaaagtggggtggtgagatgctaaatgcgcatgcatattgttcaattcatattattggtgcctcaggaagtctgatactgatagatggatcatgtgatggtggcgttcttgttaagtatttatttgtccac

SEQ ID NO: 1579 - DNA, 2296 bp, Zea mays
aggcggagtcaaacaaaagaaaggtgctatttctccgggtgtcctaaacgatttcgcggtgctcgtgcttcgctgcccactttctccacttcctcctcctcgcgagctcagctcgcgcaccgccgcagacagcgccgccgccctctcctcctccccttccgctttgccgccacccactgctgccggccgccgcaggcaccccatggccccgaccgggcggctcctcgcggtagccgccctctccttcctatgtctgcaggggccgtggggagattcaggcagcgcatttgctcagagccagccgccgcttcaccggaccgttcgcgcagaggcaaatgacggcggcggcctcatgccggagctcccgcccagcggcctcatgcccatgccggagctctcacccagcggctctcccacgccatttgtccccttcctggcgcccgctccgctcgcgccattctttaacaacagcacgccaaagctctcaggaaaatgcacgctgaactttaccgctgtcgacaaactcatgaccaccacagctgtcgactgcttcacctcgtttgctcctttcctggccaatgtcatctgctgcccgcagcttcaggcaacactgaccatcctcatagggcagtctagcaagcagacagggtctctcgcattggatcccacggtggccaactactgcctgtccgatgtccaggagctgttgctgagccaaggcgccagcgacaaccttcacagcctctgctcggttcacctctctaatgtaaccgagggatcctgccctgttagcaccgtcgatgcgtttgagagcgccgttgattcgtccaagcttcttgaagcctgtcgcaagattgactctgttaatgagtgctgcagccagacatgtcagaatgcgataaatgaagctgcccagaaaatctcgtccaaggacgcaggtttgacgagctacaccgggagtcccaagactgacagctgtaggaatgttgttctgagatggttgtcaagcaggcttgacccacggtccgcgaaggaaatgctgaggcagatttccaactgcaatgtcaatggagtttgtcctctaagctttccagacacaagtaaggtggcaaaagagtgtggtggaacaatgacgaacagtactgcatgttgcaaggcaatgttaacttatgtagcccatttgcaaaagcaaagcttcataacaaacttgcaagctttaaattgtgcctctttccttggggcaaagttgcaaaagatgaatgtcagcatgaatgtctatagctcttgtcaaataacattaaaagatttttcactgcaagttggatctcaagaatctggatgcctccttccaagtatgccctctgatgcatctttcgacagcacttctgggattagcttcacatgcgatctgaatgacaacatcgcagccccatggccatcttccatgcaagcaccatcttcatcgtgcaacaagtctgtcaatatcccagagcgacctgctgcgacatcggcacaaagtggtgtgaaccacaagaacctaaagctaagactgcttgcctctttggtctcccttcttctggtgctcttggtacaagtttagcaaggtccagttgccctattatcgcgatgattcgttcaggagagctaactggaagtcagtgaagcgctgagttttttgcgatctcgcggtcgcatcgaagtgtagtaggtttcacgtgtattttattttattttattttttgaatctcctggtagcaattagtgtagtttgttgtaaggaatatatgtataatataatgatagtagtaacttatattcatttgtatagcgagaaagaacgtctggtggacggattccagcattgtttaacacaatgtttattgtttactaattgatgtgtttgatgttgatagacggatcatttggtgctgttcaacattacataccgtctagttttctttagcttggtgtctgctgctcatggcacaagatggttatgcttgattcctgtactgaacggtgctacgttgctctgaataattggttacttaatttttttcaggctggtctatctgacacgtcttatcatatacaaaagcagtaaattaatggaactaagtggtgtttggaagcaaatatcagatatttgaatggactattaaatattaaatataatcgtgcttgctgttgatattcagacgtacacaaacttgtttaaaataccatgtactatttgtggtttcagatactagtagtactattagtttagtttaatcagcatcgacatttccatgtg

SEQ ID NO: 1580 - DNA, 2268 bp, Sorghum bicolor
aagagacgtgctatttctccgggtgcactaaacaatttcgtagtgctcgtgcttcctccttccaaagcgagctgcctgcccactttctccacttcctactcctcgcgagctcacgcagacagcgccgccgtcgccccctccccttcttccccttccgcttcgccgccgctcactactgctgccgactaccgcgccaccctatggcgcctgccgggcggctcctcgcggtagccgccctctccttcctctgtttgcaggggctgtggggcgattcaggcagcgcattggctcagagccagccgccgcttcaccggatcgttcgcgcagaggcaaatgacggcggcggcggcggcctcatgccggagctcccgcccagtggcttcatgcccatgccggacctctcaccctcacccagcggctccccgaggccatttgttcccttcctggctcccgcaccactcgcgcccttctttaacaacagcacgccaaagctctcagggaaatgcacactcaactttaccgctgtcgacaaactcatgaccaccacggctgtcgactgcttcacctcgtttgcacctttcttggccaatgtcatctgctgcccgcagcttcaggcaacactgaccatcctcatagggcagtctagcaagcagacagggtctctcgcattggatcccacggtggccaactactgcctgtcggatgtccaggagctgttgttgagccaaggcgccagtgataatctccatagcctttgctcggttcacctctcgaatgtaactgaggggtcctgccctgttagcactgtggattcgtttgagagcgtcgttgattcgtccaagctccttgaggcctgtcggaagatcgactctgttaatgagtgctgcagccagacatgccagaatgcgataaatgaagctgcccagaaaatctcgtctaaggatggaggtttgacgacctaccctgggagccccaaggttgacagttgcaggaacgtagttctgagatggttgtcaagcaggcttgacccacagtccgcgaaggaaatgttgaggcagatatctaactgtaatgtcaatggagtttgtccgctaagttttccagacacaagtaaggtggcaaaagagtgtggtggaacgatgaagaacagtactgcatgttgcaaggctatgttaacttatgtagcccatttgcaaaagcaaagcttcataacaaacttgcaagctttaaattgtgcttctttccttggggcaaagttgcaaaagatgaatgttagcacgaatgtctatagctcttgtcaaataacactaaaagatttttcacttcaagttggatctcaagaatctggatgcctccttccaagtatgccctctgatgcatctttcgacagcacttctgggattagcttcacatgtgatctgaatgacaacattgctgctccatggccatcttccatgcaagcaccatcttcatcatgcaacaagtctgtcaatatcccagagcgacccgctgcgacatcggcacaaaatggtgtgaaccacaagaacctgaagctaaggctgcttgcttctttggtctcccttcttctggtgctcttggtacaagtttagcaagatccagttgccctatcatggagatgattcattcaggagagctaactggaagtgtcagtgaagcgctgagtttttgcgatcttgtggtcgcatcaaagtgttgtaggttcacatgtgttttattttttgaatctcctggtagcagttagtgtaatctgttgtaaggcatatatatatataatataatataatgatagtaataatttatattcatttgtatagcgagaaagaacgtcagtgtttctaaagatgcgaaatgtgcatgaggatttggtgggagggaattttgttgtccgatggaggagagctacactggaatggattccaccattgtttaacataatgtttattgtttaattgatgtgtttgtctgtttgatatgagaaaattgctatgatgcctcagcaagtaaatttgatagacggatcatttgatgcccttcaacattgcatattgtctagtttgattttagcttagtgtctgctcctcacggcacaaaatggttatgcatgattcctgtactgaacggtgctatgttgctccgaataattggttacttaattattcaggctctgatctatctgaactgaaatcagttggttatgctagctgtgcgtgtattgaatcatttgaatgtctaaatgctgttggggtc

SEQ ID NO: 1581 - DNA, 1389 bp, Pennisetum glaucum
cccccttcctggcgcctgctccgctcgcgcccttccttaacaacagcacgcccaagctctcagggaaatgcacattgaacttcaccgccgtcgataagctgatgaccaccacggctgtcgactgcttcacctcgttcgctcctttcctggccaatgtcatctgctgcccccagcttcaggcaacactgaccatcctcataggccagtccagcaagcagacggggtctctcgcgttggatcccaccgccgccagctactgcctgtcggatgtccaggagctgctgctcagccaaggtgccagcgacaacctccgcagcctttgctcggttcacctctcgaatgtcaccgaggggtcatgtcccgtcagcaccgtggatgcgtttgagagcgtcgtcgactcgtccaagctcctcgaggcctgtcgaaagatcgacactgttaacgagtgctgcagccagacatgtcagggtgctgtgaacgaggctgcccagaaaatctcgtccaaggatggaggtttcacgagctacaccgggagcccgaaaattgatagttgcaggaacgttgttctcagatggttgtcgagcaggcttgacccgccgtccgcaaagcaaatgctgaggcagatatctaactgcaatgtcaacggagtttgcccactaagctttccagacacaagtaaggtggcaaaagagtgtggtggaataatcaagaacagtactacatgttgcaaggctatgttaagttatgtagcccatttgcaaaagcaaagcttcataacaaatttgcaagctttaaattgtgcttctttccttggggcaaagttgcaaaagatgaatgtcagcacgaatgtctatagctcttgtcaaataacactgaaggatttttcacttcaagttggatctcaagaatctggatgccttcttccaagtatgccttcagatgcatcctttgaccgcatttctgggattagcttcacatgcgatctgaatgataacattgcggccccatggccatcttccatgcaagcaccatcctcatcgtgcaataaatctgtcaatattccagagcgacctgccgcaacatcagcacaaaatggcgtgaaccacaggaacctgaggctaagcctgcttgtttccctagtctcccttgttctggcgctcgcggtacgagtttagttgcagtccagtttggcagttattcaggagagctaactggaagtgtcggcgaggaggttgaagttttttgcgatccggtggtcgcatcaaagtgttgtaggatcacaagtgttttttttgtaatctcctggtagctatatatatatatatattagtgtaattgttgtaaggcatataatacaatgatagcaataatttatattcgtttttgtac

SEQ ID NO: 1582 - DNA, 1868 bp, Triticum aestivum
tcacactcacacacaagcagcggctccgtccctccctctccggcctccgctctttcttcctcctcctcgttgccgcagccgcagccgcctccgcccgccttcgccgtgcgctacggccggcgtatgggacccgcaggccggctgtccgtggcggccgctctcctctcctgcctatgtttacatgggctgttggggaattccgggcaggcatttgctcagggcccgccggtgctccaccggatcgaccacgccgaggaagatgacgacagcggcggcctcatgccggagctctcgcccaccggctccccccagcccttcgtccccttcctcgcgcctgcccctctcgcgcccttctacaacaactctacgcccaagttgtcaggcaaatgctcactgaacttcactgccatcaatggcctgatgaccaccacggccgtcgattgcttcgcctcattcgctccgttcctcgccaatgtcatctgctgtccccagctccaggccactctcaccatcctcataggacagtccagcaagcagacggggtccctcgctttggatcccactcttgccaactactgtctctctgacgtccagcagctgctcatgagccagggtgcgagtgataatctccacagcatttgctccgtccacctctccaatgccaccgaggggtcgtgccccgttagcaccgtcgacgcgtttgagagcgtcgtcgactcatcaaagctcctcgaggcctgccggaaggtcgaccctgttaacgagtgctgcagccagacatgccagagtgctataagtgatgctgcccgcaaaatctcttccaaggacgctgcgttgacaagcgacactgccagtcccaaagttgacagttgcaggaacgttgtacttagatggttatccagcaggcttgagccatcatccgcaaccaaaatgctcaggcagatatcaaactgtaatgtcaatggagtttgcccactaagcttcccagacacaagtaaggttgcaaaggagtgtggtggtacagttaaaaacattactgtatgctgcaaggcgatggacagttacgtatctcacttgcaaaagcaaagtttcataacaaatttgcaagctttgaattgtgcctcagtccttggggcaaaattgcaagagatgaaggtcagcacaaatgtttatagctcatgccaagtaacattgaaggatttctcacttcaagttggatctcaagaatctggatgccttcttccaagtatgccctctgatgcatcatttgacccttcttctgggattagtttcacatgtgatctgaatgataacatagctgccccatggtcgccttctttgcaagcatcggcttcgacatgcaataaatcagctgctcctggtccaacaatcccagagaggcctgcagcaacatcggcgcagaacggtgtcaaccacaacagactggagcttagcctagccgtctgctttggcgcccttgtggccactattttactgcaagtctagttcaccttagtttgtcaaattatccagagtttgaggagagctgattggaactgtgaaccgcggagtttttgtgcgtgcttggtcatcgcatcagagcattgtaactggtagctattagtgtaatttgttgtaagccacagaatgatagtgaatgcaacactgactctaatttattactattatgccttttgtatagcgagtagtgaaggttccataattctgcatgacaacttggatagacttgattttgttgtctaatggtttgtcactttattaatgatttttatcattggttcacctttatattgtttgttttattgttgttattaattataattataattaatgaaggcctcaacaag

SEQ ID NO: 1583 - DNA, 5002 bp, Sorghum bicolor
atctgtctgtgagccccccttttctctctctacagcactgtactgcacactggttgtccctttctctctcttaaatctcgtcatcacatcaaccgttcctggaatactccctcccattgcttcgcgctcgcggcatctactgctgctcctcttcctctgcctccgcgtcgccgccgggcgatctctctggccgcgtccgctccgccgagatcgattccacccaccgctctcgcccgcgtccgcccactgtccccgccgcagcaagattcgcccggttccttcagccctcatcccggtgcgccgcgccggcgcctgcccactcacctcaccgggcctaaaaattccgtctttttttttaacggtctccggttcgggtgctgccatgcgccgcggcgacgggaaggacgccgtgattccgcgcccgccttcctgccgccgcacgtgaggttgagatctcggggcggcgatctcgtggcggcgccaccatgccgtctctgcagctgctgcagctgacggaccgcggccgggggcttctcgcttccaggaggaggacgctcgccgttgtctccggcgcggtgcttgccggtggagctctggcgtatgcccgctcgagccagagccggcggaggaggcgttccgaggctaatcacggtggtgaaaccagtgcattggccaccaatggggatggtgccggcggtggattggctgcagcaaagcagaaaaggagtggcctcaaatctctgcatttcctcgctgctatcctactcaagaagattggtcccagtggcacgcgcttccttctcggcttggtattaacagcggtgctacgtacagctgtggggcatagattagcaagagttcaaggttttttgtttaaagcagcatttcttcggcgcgtcccaacatttacacgcttgatcatagaaaatcttatgttgtgtttcctccaatccacactgtatcagacctcaaaatacttaacaggctctttaagtttgcgtttcaagaaaattttaacagatatcgcccatactgattactttgagaatatggtttactacaagatctcacatgtggatcatcggatatcaaatccggagcaaaggattgctagtgatatcccaaagttctcttctgaactaagtgaacttgtacaggatgatctggctgcagttgcagaagggttaatatacacctggcgtctctgttcttatgctagtccaaaatacgtgttctggattatggcatatgtgctagttgccggtggggtaataaggaacttctctcctgcttttgggaagctgaaatctacggaacagcaactagaaggagactatcgtcaacttcattcacgattaagaacacatgctgagagtgtggcattttatggtggtgagaacagagaagcatctcatattatgcagcggtttgaggctcttgttgagcacctgaatcttgtgcgtcatgaaaactggtggtttggcatgattcaagatttctttctgaagtattttggtgccactgtggcagttgtccttattatagaacctttcttctctggcaaccttagacctgattcatctacccttggaagggctgaaatgttgagcaatcttcgatatcacacaagcgtgatcatttcactgtttcagtctcttgggatcctttctatcagcacacgacgtttaaatatcctgagtggctatgcagaccggatccgtgaattattggatgtttcacgtgagctgtctggggtttgtgatagatcactgaatcacaattctcctggaaattatgtcagtgaagcaaaccatatagaattttcagatgttaaggtagtcacacctgcaggtaatgttttggttgatgatttgactctccgggtagaaactggttctaatcttttgatcactggtcccaatggtagcggaaaaagctcccttttccgggtccttgggggtctatggccactggtatctggctacattgttaaacctggtgttggttcagatctaaataaggagatcttttatgttccgcaaagaccatacacagctgttggaactctacgtgaacagctaatctatcctcttacggcagatcaggagattgaaccacttacctatgatggaatggtggaccttctaaagaatgttgacctggaatatttgcttgaacgctatcctcttgataaggaagttaactggggtgatgagctgtccctcggcgagcagcaaagattgggaatggccaggttattttaccataagccaaagtttgccatccttgatgagtgcactagtgccgtgacaactgatatggaagaacgtttttgcaaaaaggttcgagctatgggtacatcctgcataacaatatctcatcgaccagctttagttgcatttcatgatattgttttatccttggacggtgaaggaggttggaatgtccagcatagaagggatgactcatccttttccactgaagaatctgatttttcatcatcagaaactgatcgtaaatctgacgcactgactgttcaaagggcttttatgagcagggcaaagagcaatgcttcattggggtccaaggatcattcatactgtacagaggttatagcaacttccgctaaggtggaaatagaacatgcagcacggcgaattccacatttacgatgtcacccaagacctttgcctctcagagtagctgcaatgctaaaaatactagttcctagactatttgataaacaaggcgggcagttgcttgctgttgctgttcttgttttctctcgtacatggatctctgatcgtattgcttcattgaatgggacaactgtgaagtttgtcttggaacaggacaaagctgcctttattcgcttgattggtgtcagtattctacaaagtggtgcaaattcttttgtggcaccatctctgaggacccttactgcaaaacttgcccttggatggcgaattcgcatgaccaatcatttgcttcgatattatttgaaaagaaatgcattctacaaggtattcaacatgtcaggtaaaagtattgatgcagaccaaagattaacacttgatgtagacaagttgaccactgaccttgccggcctagttactggaatggtaaaaccgctagttgacattctttggtttacatggagaatgaagctattatctggacgaagaggagttgctatactgtatgcttacatgttactgggtttgggctttctgagagctatatcccctgacttcggtcatctctcaggccaagaacaagaacttgaaggaacattcaggttcatgcactcgagactgcggacacatgctgaatcaattgctttctttggtggtggttcaagagaaaaggcgatggttgaggctaaattcgtcaagttaattaaccactcaaagattcttttgaggaaacagtggctttatggtattgttgatgattttgtaacaaagcaacttccgcacaatgtaacgtggggtctgagtctgttgtatgctttggagcacaagggagacagagctttaacatcaactcaaggagagttggcacatgccctgcggttcttggcttcagtggtctcacagagcttcatagccttcggtgacattcttgagttacataagaagttccttgaactttctggtgggattaaccggatctttgagcttgaggagtttacacgcttcgcacaaagaaatactgcggtgtctcccaatgccatcagtgcagcctcagaagaaattatttcatttcatgaagtggacattgtaacaccatcacagaagctattggctagaaaactctcgtgcaatgttgtacaagggaaaagccttcttctgaccggtcccaatggtagtggaaagagttctatttttagagtgctcagggatctgtggcccaccttctctggcagagttaccaagccctcagaagggatgtttcatgttcctcagcggccatataccagccttggtactctgcgggatcagatcatataccctctctcaagggaggaagcgaagataaaagttctttcattacatagatctggtaacaattctagtgcctctgtcctgctggatgatcacctgaagacaattctagagaatgtccggctgctgtatctcctagaaagagaagggtgggattctacaccaaactgggaagatgttctgtcgttaggagaacaacagaggcttgggatggctcgtttgtttttccatcatcctaagtttggtatcctcgacgagtgcaccaatgctacgagtgttgatgttgaagagcatctgtacaggcttgcaactagcatgggcataactgtgatcacttcctcacaaaggcctgctttgatacccttccatgccttggagctgaagcttattgacggcgaagggaactgggagctatgtgcgatccagcagtgaatgatggtacccattaggagttgatgccatcaaatgcactgtcagctgcatgtacaaaagcaagcggctagccccattgccattgtgtatagacaatgtagacggtggcagcattgctatgttggaaggtgttgtattcttgtcagaatctgcctcacgttgaggagcagcaaagccgtgttagtgaaatgaagtgagagggcacgtgattgtgagccatggtttgtggtgggggttcgttcgcctcgaggtgttttggacttgagttgctacatagtagctggatagtagagcagatgggttgtgagttagaagctgtgtatctattgactcattgccttatattgattctgtttagtagatgtatatgacagacatggtaataaataaatataatgtggaattgtggctgttgctgcggtgcagccatcagaaattgaatcaggttgattgggaaattgttcaacggtaagctgcatgcagcgtagaggctgtgtatgtctagaaaacaaccgcctgcatataaataacaactgaaaataaattgtagtgttatttgagct

SEQ ID NO: 1584 - DNA, 4718 bp, Zea mays
ccattgcttcgcgttcgcggcatctactgctgctcctctgctcggccccgcgtcgccgtcgggagatctctccggccgccgagatcgattccacgcgccgctctcgcctgcctccgctcactgtccccgctgccgcaggattcgcccgccctgccggtgcgccggtggttctctacggcgtcttccggttcgggtgccgccatgctccgtggcgacgggggagggacgccgtgattccttgcctggccgccggtcgccgcacgtgaggctgagatctcggggagctcgccgtctcgcggcgccgccaccaccatgccgtctctgcagctgctgcagctgacggaccgcggccgggggcttctcgcttccaggaggaggacgctcgcctttgtctccggcgcggtgcttgccggtggagctctggcgtacgcccgctcgagccagagccgccggcggaggaggcgcccggaggcgagtcgcagcggcggagccggtgcattggccgccaatggggatggtttcagccagaacggtgccggcggtggattggctgcagcggaccagaggaggagtggcctcaaatctctgcatttcctcgcttctatcctactcaagaagatggggcccagtggcacgcgctaccttctatgcttggtattaacatcggtgctgcgtacagccgtagggcatagattagcaagagttcaagggtttttgtttaaagcagcatttcttcggcgcatcccaacatttacacgcttgatcatagaaaatcttacgctatgtttcctccaatcaacattatatcagacctcaaaatacttaacaggctctttaagtttgcgtttcaagaaaattctaacagatatcgcccatgctgattactttgagaatatggtttactacaagatctcacatgtggatcatcggatatcaaatccggagcaaaggattgctagtgatatcccaaagttctcttctgaactaggtgaacttgtacaagatgatctggctgcagttgcagaagggttaatatacacgtggcgtctctgttcttatgccagtccaaaatacgtgttctggattatggcatatgttctagttgctggtggggtaataaagaacttttctcctgcttttgggaagctgaaatctacagaacagcaactagaaggagactatcgtcaacttcactcgcggttaagaacacatgctgagagtgtggcattttatggcggtgagaacagagaagcatctcatattatgcagcggtttgaggctcttgttgagcacctgaatcttgtgcgtcatgaaaactggtggttcggcatgattcaagatttctttctgaagtattttggtgctactgtggcagttgtccttattatagaacctttcttctctggcaaccttagacctgattcatctacacttggaagggctgaaatgttgagcaatcttcgatatcacacaagcgtgatcatatcactgtttcagtctcttggaatcctttctatcagcacaagacgtttaaatattctaagtggctatgcagaccggattcgtgagttattggatgtttcacgtgagctgtctggggttcgtgatagatcactggatcacagttctcctggaaattatgtcagtgaagcaaaccatatagaattttcagatgttaaggtagtcacacctgcaggtaatgttttggttgacgatttgactcttcgggtagaaactggttctaatcttttgatcactggtcccaatggtagcggaaaaagctccctttttcgggtccttgggggtctatggccactggtatctggccacattgttaaacctggtgttggttcagatctaaataaggagatcttctatgtcccgcaaagaccatacacagctgttggaacactacgtgaacagctaatctatcctcttacggcagatcaggggattgaaccacttacatatgatggaatggtggaccttctaaagaatgttgacctggaatatttgcttgaacgctatcctcttgataaggaagttaactggggtgatgagctgtccctcggtgaacagcaaagattgggaatggccaggttattctaccataagccaaagtttgccatccttgatgagtgcactagtgctgtgacaaccgacatggaagaacgtttttgcaaaaaagttcgagctatgggtacatcctgcataacaatatctcatcgaccagctttagttgcatttcatgatattgttttatccttggacggtgaaggaggttggaatgttcagcatagaagggatgattcgtccttttccaccgaagaatctgatttttcatcatcagaaactgatcgtaaatctgacgcactgactgttcaaagggcttttatgagcagggcaaagagcaatgcttcattggggtccaaggatcatccatattgtacagaggttatagcaacttcccctgaggtggaaatagaacatccagcacggacacctcgaattccacatttacgatgtcacccaagacctttgcctctcagagtagctgcaatgctaaaaatactggttcctagactatttgataaacaaggcgggcagttgcttgctgtcgctgtacttgttttctctcggacatggatctctgatcgtattgcttcgttgaatgggacaactgtgaagtttgtcttggaacaggacaaagatgcctttattcgcttgattggtgtcagtattctacaaagtggtgcaaattcttttgtggcaccatctctcaggacccttactgcgaaacttgcccttggatggcgaattcgcatgaccaatcatatgcttcgatattatttgaaaaggaatgcattctacaaggtattcaacatgtcaggtaaaagcattgatgcagaccaaagattaacacttgatgtagacaagttgaccactgaccttgctggcctagttactggaatggtaaaaccgctagttgacattctttggtttacatggagaatgaagcttttatctggacgaagaggagttgctatactgtatgcttacatgctactgggtttgggctttcttagagctatatcccctgacttcggtcatctctcaggccaagaacaagaacttgaaggaacattcaggttcatgcactcgagactgcggacacatgctgaatcaattgctttctttggtggtggttcaagagaaaaagcgatggttgaggctaaattcgtcaagttaattaaccactcaaagattcttttgaggaaacagtggctttatggtattgttgatgattttgtaacaaagcaacttccacacaatgtaacgtggggtctgagtctgttgtatgctttggagcacaagggagatagagctttaacctcaactcaaggagagttggcacatgctctgcggttcttggcttcagtggtgtcacagagcttcatagccttcggcgacattcttgagttacataagaagttccttgaactttctggtggcattaaccggatctttgagcttgaggagtttacacgcttcgctcaaagaaatactgtggtgtctcccaatgccatcagtgcagcctcaaaagaaacgatttcgtttcatgaagtggacattgtaacaccatcacagaagctattggctagaaaactctcgtgcgatgtggtacaagggaaaagccttcttctgaccggtcccaatggtagtggaaagagttctatttttagagtgctcagggatctctggcccaccttctctgggagagttaccaagccctcagaagggatgtttcacgttcctcagcgcccatataccagcctaggtactctgcgggatcagatcatataccctctctcaagggaggaagcgaagataaaagttctttcgctacatagatctggtaacaattctagtgcctccatgctgctggatgatcacctgaagacaattctagagaatgttcggctggtgtatcttctagaaagggaagggtgggattctacaccaaactgggaagatgttctgtcgttaggggaacaacagaggcttggaatggctcgtttgtttttccatcatcctaagtttggtatcctggacgagtgcaccaatgctacgagtgttgatgtcgaagagcatctgtacagacttgcaactagcatgggcataactgtgatcacttcctctcaaaggcctgctttgatacccttccatgccttggagctgaagctcattgacggcgaagggaactgggagctatgtgcgatccagcagtgagtgatggtgcccattaggagttgatgccattaaatgcaccatcagctgcatgtacaaaagcaagcagctagcacattgccattgtttgtgtatggacaacgtagacagtggcagcgttgctatgttggaagatgctatattcttgtcatagtctgcctcaggttgagcagcaaagcattgtgatgatgtatgattgtgagccatgcatggtagctgaatcctgatattagcttttagatagtggacatgattgtgagccatgcatggtagctgaatagcagagcagaagggttgtgtgttagaagctgtacctattgattcattacattatattgattctgcgtagcagatgtatattacaggcaagcaaaatataaataaatacgatgtggaattgtggatgctgctgccatgcagacatcagaaaa

SEQ ID NO: 1585 - DNA, 4447 bp, Triticum aestivum
ctttggcctatgcccggtcaagccagagccagcggaggaggcgttcggaggcaaattatggcagcgaagccagtgaattggccaccaaaggggatgggttgagtcagaatggtagattggctgcaacaaagcgtaaaatgagtgggcttaaatctttgcatttcctaactgctatcctgctgaagaagattggtcccaatggcacacgcttccttctaggcttggtattaacagcggtgctgcgtactgctgtggggcatagattggcaaaagttcaaggctttttgtttaaagcagcatttcttcggcgtgtcccaacatttacacgcttgatcatagaaaaccttatatttgtttcctccaatccacattatatcaaacatcaaaatacttgacagggtctttgagtttgcgtttcaagaaaattttaaccgatatcgttgatgctgattactttgagaatatggtttattacaaaatgtcatatgtggatcatcgagtatcaaatccagagcaaaggattgctagtgatatcccaaagttctcttctgaactaagtgagcttgtacaggatgatctggctgcggttgcagaagggctaatatacacctggcgtctctgttcgtatgctagtccaaatacatggtctggattatggcatatgtactagttgctggtggggtgataaggaaattttctcctgcttttgtaaaactgaaatccacggaacaacaactggaaggagactatcgtcaactacattcacgattaagaacacatgcggagagtgtggcattttatggtggtgagaacagagaagcatctcatattatgtagaggtttgaggctcttgttgggcatctgaatcttgtgcgtcatgaaaactggtggttcggcatgattcaagatttctttctgaagtattttggtgccactgtggcagttgtccttatcattgaaccattcttctctggcaaccttagacctgattcatcaacccttggaagggctgaaatgttaagcaatcttcgatatcacacaagtgtaatcatatcgttgtttcagtcccttgggattctttctatcagttcaagacatttaaatatcttgagtggctatgcagaccgaattcgtgagttattggatgtttcacgtgagctgtctggtattcgtgataaatcattgaatcacaattctccttctggaaattatatcagtgaagcaaaccatatagaattttctgatgttaaggtagtgacacctgcaggtaatatcttggtcaacgatttgacactccgggtagaaactggttcaaatcttttgaacactggtcccaatggtagcggaaaaagctcccttttccgggtccttgggggtctgtggccactggtatctggccacattgttaaacctggtgttggttcagatctgaataaggagatcttttatgtcccccaaagaccttacacagctgttgggacactacgtgaacaactaatctaccctcttacagaagatcaggagattgaatctcttacctatgatggcatggtggaccttctaaagaatgttgacctggaatacttgctagaacgctatcctcttgataaggaagttaactggggtgatgagctgtcccttggtgagcaacaaagactgggaatggccaggttattctaccataagccaaagtttgccatacttgatgagtgcactagtgctgtaacgactgatatggaagaacgtttttgcaagaaggttcgagctatgggtacatcttgtataacaatatctcatcgcccagctttagttgcatttcatgatattgttttgtccttggacggtgaaggcgactggaatgttcagcacagaagggaggactcttccttttccactgaagagtctgattttcaatcattagaaactgatcgcaaatctgatgcactgactgttcaaagagcttttatgagaagggcaaagaacaatccttcgttggggtccaaggaccattcgtactctacagaggtcatagcaacttcccctaaggtggaaatagaacatgcagtacggacatctcgggttccacatttgcgatgccacccaagacctttgcctctcagagtagctgcaatgctcaacatactagttcctaaacttcttgataaacaaggcgggcagttgcttgctgttgctgtacttgttttctctcgtacatggatctctgatcgtattgcttcattgaatgggacaactgtgaagtttgtcttagagcaggataaagttgccttcattcgcttgattggtgtcagtattctacaaagtgctgcaaattcttttgtggcaccatctcttaggaccttacctctaaacttgcccttggatggcgaattcgcttgaccaatcatttgcttcgatattatttgaaaagaaatgcattctacaaggtattcaacatgtcaggtaaaactattgatgcagaccaaagattaacacttgatgtagacaagttgaccactgatcttgctggcctagttactggaatggtaaaaccagtggttgacattatttggtttacatggagaatgaagctcttgtcaggacgaagaggagttgctatactatatgcttacatgttactgggtttgggcttcctgggagcagtatcccctgactttggtcgtctctcgggccaagaacaagaacttgaaggaacattcaggttcatgcactcaagactgcggacacatgctgaatcaattgcttttttggtggtggttcaagagagaaagctatggttgaggctaaattcgtaaagttacttaaccactcaaagattctcttgaggaaacagtggctttatggtattgttgatgattttgttacaaagcaacttcctcacaatgtgacatggggtcttagtctattatatgctttggagcacaagggagacagagctttgacctcaactcaaggagagctggcacatgctctacgattcttggcttcagtggtttcacagagcttcatagcctttggcgacattcttgagttacataagaaattccttgaactctctggtgggattaaccgtatctttgagcttgaggagcttacatgtgccgctcaaaggaataccatggtgtcttccaatgccatcagtgcagcctcagaagatattatttcaattcatgaagtggacaccataacaccatcacagaagctattggctagtaaactgtcatgcaatgtagtacaagggaaaagccttcttctgactggtcccaatggtagtggaaagagttgtatatttagagtgcttagagatttgtggcccaccttctctgggagagttatcaagccctctgaagggatgttccatgtccctcagcgtccatataccagcctaggtactctgcgggatcagatcatataccctcgctcacgggaggaagcagagatgaaagttctctcactacatcaagctggcaacaaggctagtgcttccatcctgcttgatgatcacctgaagacaattctagagaatgtgcggctggtgtatcttctagaaagagaagggtgggattctacaccaaactgggaagatgttctgtcactaggggaacaacagaagcttgggatggcccgtttgtttttccagcatcctaagtatggcatcctcgacgagtgcaccaatgctactagtgttgatgttgaagaacatctgtacaggcttgcaactaacatgggcataactgtgatcacttcctcacaaataagtgcttcgataatccctgtgacaacacaaaatttcttatattggcgaactgttaatgtttagaggcctgctctgatacccttccatgtcttggagctgaagctcattgatggtgaagggaactgggagctatgttcgatccgccagtgagtgatgccatacctgagcgactgagctgatgctaccatgtgcgccagtcacctgcatgtacaaaagcaagtagatatcgcattgccatttgcctatggatggataacagacagtggcagtgttggtgtcctgaaagacaaccatattcttgtcaaaatatgtttggcgtagaacaacaaattactcatagtttagcttacatcaaggagaaggttggtgcatgattgtgatccacgaatgatgtgtggcgaggtttaacttgtagaggtgtttccgagttgcagtaggtggacagcagaagagacatgtaaattagcagatacctattgattcattagattgcattgtattagattctgtgtagtgtagtagacaaatatgctatcacaggcaaatcaataaataatgtggatgctgcacggctagcgttgtttagattagaggctgtactgtatgtgacaaaaaagcatctggctgcatgcatgtaaatggcaataatttgctgaagtcttgctccttttt

SEQ ID NO: 1586 - DNA, 4918 bp, Oryza sativa
gaagaaaagttttggatgggtttgcaaaatgcagagagagaagaaggaggaggaggaggaagagtttgtggcgaggaggcttccaaatcagtcgctatcatacatctccctcccttaaatctcatcaacccccccaaaatttgttactttcggagtatatttatttactagcgcgacagtgccaatttcgcggcatctactgcttctgctgctgcatgctcctcctcgtcgccggcgatctatctcgccgccctgcctccgccgagatcgacatccagcggcgatgatgctttgcggcggcgccttgattccgcgctcgacaatctactgtttttatagataagatcttcagtgagcgagatgccatccctgcagctgctgcagttgacggagcgtggccggggactcttggcctcaaggaggaaaactcttgcggttgtttctggcgcgctgcttgccggaggagctttggcgtatgcacgctcaagccaaggccaacggagaaggcgttcagagggtgacgatgccaccactgcattggccaggaatggggacaggatgggccaaaatggtgtggatggtagattggccggaacaaagcgaagaaaaggtggcctcagatctcttcatttccttgctgccatcctactgaagaagattggaccaaatggcacccgctaccttcttggcttgacgttaactgcggtgttacgtactgctgtgggacatagattagcaagagtccaaggctatttgtttagggcagcatttcttcggcgtgttccaacctttacacgcctaatcatcgaaaacctaatcttatgctttcttcaatccgccgtataccagacctcaaaatacttaacagggtctttgagtctgcgcttcaagaaaattttgacagatcttgtccatgctgattattttcagaatatggtttactacaaaatttcacatgtggatcatcgaatatcaaacccagagcaaaggattgctagtgatattccaaagttctgttctgaactaagtgaacttgtacaggatgatctagctgcagttgcagaaggattaatatacacctggcgtctctgttcttatgcaagtccaaaatacatgctctggattgtgggatatatactagttgcgggtggagcaattagaaatttctcccctgctttcggaaagctgaaatccacagaacagcaactcgaaggagattatcgtcagcttcattcacgattaagaactcatgctgagagtgtggcattttatggtggtgagaacagagaagcatattatatcatgcagcgtttccaggctcttattgggcacctgaattgtgtactccatgaaaactggtggttcggcatgattcaagatttctttctgaagtattttggtgcaactgtagcagttgtcctcattattgaacctttcttctctggccacctcagacctgattcatccacacttggaagggctgaaatgttaagtaatcttcgataccacacaagcgtaatcatatcactgtttcagtctcttgggatcctatctataagcacaagacgtttaaatattctaagtggctatgcagaccgcattcgtgagttactggatgtttcacgtgaactgtctggggttcgtgataaatcgttaaatcataattcctctgctggaaattatatcagtgaagcaaaccatatcgaattctcgggtgttaaggtggtgacgcctgctagcaatgtcttggttgatgatttaactctccgagtagaaaggggttctaatcttttgatcactggtccgaatggtagcggaaaaagttctctttttcgggtccttggaggcttatggccattagtttctggtcatattgtcaaaccgggtgttggctctgatcttaataaggaaattttctatgtcccgcaaagaccatacacagctgttggtacacttcgtgaacagctaatttatcctcttacagcagatcaggagattgaaccccttagctacgatggcatggtggaccttctaaagaatgttgacttggaatacttgctagaacgctatcctcttgataaggaagttaactggggtgatgaattgtcccttggtgagcaacaaagattaggaatggcaaggttattctaccataaaccaaagttcgccatccttgatgagtgtactagcgctgtgacaattgatatggaagaacgcttttgcaaaaaggttcgagcaatgggaacatcatgcataacgatatctcatcgcccagctttagttgcgtttcatgacattgttttgtctttggatggtgaaggagggtgggatgtccagcacagaagggatgactcatccttttctactgaagagtctgactatacattattggaaactgatcgtaaatctgatgcgcttactgttcaaagggcatttatgggcagggcaaagagcaatgcttcatcaaggtccaaagaacattgctacactacaaaggttatagcaacttctcccaagttggaaatagaacaaacaatacaaacacatagagtcccgcatttacggtgcttcccaaggcctctgcctgccagagtagctgcaatggtcaaaatattggttcctaagctacttgacaaacaaggagggcagttgcttgctgttgcactacttgttttctctcgaacttggatctcagaccgaattgcttcactgaatgggacaactgttaagtttgtcttggagcaggacaaagctgcatttattcgtctgattggtatcagtgtcctgcaaagttctgcaaattcttttgtggccccatctttgagaacccttactggaagacttgcccttggatggcggattcgcctgaccaatcatttgcttcaatattatttgaaaagaaatgcattctacaaggtattcaacatgtcaggtaaaagtattgatgcagaccaaagattaacacttgatgtggataaattgaccaccgaccttgctggcttagttactggaatggtaaaaccacttgtcgacattctttggtttacatggagaatgaagcttttgtctgggcgaagaggagttgctatcttgtatgcttacatgctgctaggtttgggcttcctgagagctgtatccccagactttggtcatcttgctgggcaagaacaagagcttgaaggaactttcaggttcatgcactcgagactgcgaacgcatgctgaatcaattgctttctttggtggtggatcaagagagaaagctattgttgaggctaaattcatgaaattgcttgaccactcaaagattctgttgagaaagcagtggctttatggtattgttgatgattttgtaacaaagcaactccctcacaatgtaacatggggtcttagtttgttatatgctctagagcacaagggtgacagagctttgacttcaactcaaggagagttggcacatgctctgcggttcttggcatctgttgtgtcacaaagtttcatagcctttggtgacattcttgacttacacaaaaagttccttgaactttctggtgggattaaccggatttttgagcttgaggagcttcttcgtgtatctcaaagggatacttttgtgccttccgatgccactagtgcagaagaaaccatttcatttcacgaagtggatattgtaacaccatcgcagaaactgttggctagcaagctgtcgtgcaatgtggtacaagggaaaagccttcttctgactggccccaacggtagtggaaagagctctattttcagagttctgagagatttatggccagtgtgttctgggagagttaccaaaccttcagatgggatgtttcatgttcctcagcgtccatataccagcttgggtactctgagagatcagatcatataccctctctcaagggaggaagcagagatgaagatttgttcgttatacaatgatggtaacgggtctagtgcttctaatctgctggatgatcacctgaagacaattctagtgaatgttcggttggtctatcttctagaaagagaaggatgggactcaacttcaaactgggaagatgttttatcgttgggagaacagcagaggcttgggatggcccgtttgtttttccaccatcctaaatttggtattcttgacgaatgcacgaatgctacaagcgttgatgttgaagagcatttgtacaagctagcaactagcatgggcatcactgtgattacttcctcgcaaaggccagctttgatccccttccattccttggagctgaaactcatcgacggagaaggaaactgggagctatgcgagatccaccaatgatttgtctgaccggttcgcatttctcggcattcggcttcccagtcccagctgctggcctgctgctgcttgttgatgtcaggctgtctagaagtgtgtacaattgcaaagcagctgttgtgagtgaaaagtacaggttttcagtctcattgtctttgaagaaagaaaaaaaaaagaccttgtcgacaatttggcgtagaacatggcatttgtagtttagttcatacggaggtaggtgatgggagttgcagggatgagcatagagagatgtggtatttgtttttaagtagataataaatgataaggtgatagtacagtacagatcttccggcattgttaatattaattcgataagtaataatgtggcttccttcttgctgccatcaagttatggcatataatgtatgaaaatattgcatgtaaatgcctagtgattcttgaatattgggtttgaagttgtatcagagtatcagactgctgcttcttgtccccttcttgcaactgcgttatcgattcttcaagctttgggtttgtttgtctttacaatgctggttcctcatgaatgcctgtgtaataaattattgctcttggagat

SEQ ID NO: 1587 - DNA, 5044 bp, Brachypodium distachyon
tgcttttgcaagttgcaattcagttgcaagagttctctttgcttttcatcctctctctctctaaatctctctttcagtctcgctgtcaccacacactctctcttgtcttaaaaccgcatcaacttctctcatcttcccttctgttgtttcttgtttctccacccgcctcgcctcctctttgcttcgcggcatctacctccggcgatctccccacggcccaccacttcctccaagatcgaggtacccgcccccttcttcctccccggattgcgccttctccaacacggccgccccaaattggcccacctcctctgcttcctctccgatgcagggcagcggcggcgacgatgcgctgcggcggccaagggaggcgggctccggttaccccgcggaggttcgcgtgtcgctgctttaggtagcaagatcttcttcttcttcttcttcttcccctccggcgactcgcgtgcgcctgacctgctgctccgcggaggcggcggtcttccggcagcggaggagagatgccgtctctgcagctgctgaagctgaccgagcatgggcgggggctcctggcgtccaggaggagaaccctggctgttgtttccggggcgctggtcgctggcggggctttagcgtatgcgcggtcggcccgaggccggaggaggagaagcggttcggaaggtggtgatgatggtgatgcattggcgaggaatgggggaaggttgggtcaaaatggtgtggatggtaggttggctgggacgaagcggaggaagagtgctttgaaatctttgcatttcctggctgctatcctgctcaagaagattggcccgaatggcacgcgctaccttcttggcttgatgttaacagccgtgctgcgtactgctgtggggcatagattagcaaaagtacaaggctacttgtttaaagcagcatttcttcggcgtgttccaacctttacgcgcctaattatagaaaatctaatcttatgctttctccagtcagcagtataccagacctcaaaatacttaacagggtctttgaatttgcgcttcaagaaaattttaacagacctcgtccatgctgattattttcagaatatggtttactacaagatctcacacgtggatcatcgaatatcaaacccagagcaaaggattgcgagtgatattccaaagttctgttctgaacttagtgaacttgtacaggatgatttggctgcagttgcagaagggttgatatatacctggcgtctctgttcttatgctagtccaaaatacatgatttggattctggcatatatactagttgctggtggagcaattagaaatttcactcctgcttttggaaaactgaaatccacagagcagcacctagaaggggagtatcgtcaactccattcacgcttaagaactcatgctgagagtgtggcattttatggtggcgagaacagagaagcatctcatattatgcagcggttcaaggcacttgttaggcacttgaatcatgtaatccatgaaaactggtggtttggcatgattcaagatttctttctgaagtactttggtgccactgtagcagttgtcctaattatcgaaccgttcttctctggcgaccttagacccgattcatctaccctaggaagggctgatatgttgagtaatcttcgataccacacaagcgtcatcatatcattgtttcagtctctcgggaccctctctatcagtactaggcgtttaaacatcctgagtggctatgcagaccgaattcgtgagttgctagatgtttcacgcgagctgtctggggttcgtgatagatcgttgaatcacaatttttctgctggaaattatatcagtgaagcaaaccatatagaattttcaggtgttaaggtggtgacacctgctgggaatgttttggttgacgatttaactctccgagtagaaacgggttctaatctcttgatcactggtcccaatggtagtgggaaaagctcccttttccgtgtccttggggggctatggccactggtatctggtcatattgtcaaacctggtgttggttctgatcttaacaaggaaatcttttatgtcccacaaagaccatacactgctgtcggcacacttcgcgaacagctaatctatcctcttacagctgatcaggagattgaaccacttagctatgatggcatgatggaccttctaaagaatgttgacctggaatacttgctacaacgttatcctcttgacaaagaagtcaactggggtgatgagctatctcttggtgagcaacaaagactaggaatggccaggctgttctaccataagccaaagtttgccattcttgatgagtgtactagtgctgtgacaattgatatggaagaacgtttttgcaaaaaggttcgagcgatgggaacgtcatgcataacaatatctcatcgcccagctttagttgcatttcataatattgtcctgtccttggatggtgaaggaggatgggatgttcagcacagaagggatgactcatcctttagcaccgaagagtctgactttacatcactggagactgatcgtaaatcagatgccctaactgttcaaagggcttttatgaacaagtcaaagagcaatgcttcattaagggccaaggaacattcttattctacaaaggttatagcaacttcccccaaattggaaacagaacaaacagtgcgaacacctctaattccacacttacaatgctccccaaggcctctacctctgcgagcagcttctatgcttaaaatattggttcctaaattacttgacaaacaaggagggcagttgcttgctgtcactctacttattttctcccgcactgtgatctcggatcgtattgcctcgttgaatgggacaactgtgaagtttgtcttggagcaggacaaagctgcttttattcgtctggttggtgttagcgtgctgcaaagtgctgcaaattcttttgtcgcgccatctttgagaacccttaccgcaagacttgcccttggatggcgaattcgcatgaccaaccatttgcttcaatattatttgagaagaaatgcattctacaaggtattcaatatgtcaggtaaaagtattgatgcagaccaaagattgacacttgatgtggataagttgagcactgaccttgctggcttggttactggaatggtaaaaccactagtcgacattctttggtttacgtggagaatgaagcttttgtcgggacgaagaggagttggtatattgtatgcttacatgttactaggtttgggctttctgagagctgtatcccctgactttggtcatcttgcaagtcaacaacaagaacttgaaggaacattcaggttcatgcactcgaggttgcggacacacgctgaatcaattgctttctttggtggtggttcaagagaaaaagctatggttgaagctaaattcatgaaattgcttaaccactcaaaggttatgttaagaaaacaatggctttatggtattgttgacgattttgtgacaaagcaactcccacacaatgtgacatggggtctgagtttgttatatgctctggagcacaagggagacagagctttgacttcaacacaaggagagttggcacatgctctgcggttcttggcatctgtggtgtcacaaagcttcatagcctttggcgacattcttgagttacataagaaattccttgaactttctggtggggttaaccggatctttgagcttgaggagattctacgtgcagctcaaagggatactgtggtgccttccagtgccattagttcagcatcagaagaaattatttcattccatgaagtggatattgtgacaccaacgcagaagctattggctaacaagctgtcatgcaatgtggtacaagggaaaagccttctcctgactggccccaatggtaccgggaagagttctgtttttagggtgctcagaaatttatggcccgtcttttctgggagagttaacaagccttctgaaggggtgttccatgttcctcagagtccatataccagcttgggtactctgagggatcagatcatataccctctatcaagggaggaagcagagataaagattctttcgttacataaggctggcaacatgtctagtgctcctgagttgctagatgatcacctgaagacggttcttgtgaatgtccggttggtctatcttctagagagagaaggttgggactctaccccaaactgggaggatgttttgtctctcggagaacagcagaggcttgggatggctcgtttgttcttccaccatcctaaatttggcatcctcgacgagtgcacaaatgccacgagtgttgatgttgaagagcatttgtacaggctagcaactagcatgggcataactgtgatcacttcatcacaaaggcctgctctgatacccttccattcagtggagctaaagctcatcgacggcgagggaaactgggagctctgcgagatccaacattgattgacaccaccggttaaagatatcttggctcgccgtcatctgcgtgataataggagatgctaccgctgcaatctgttcataccagctggtcgccctcacgatagcatctggaagctgaagcagcctgtacaattaattacaaagcagctcgaaaacaagaaagaagaagaattcttgtcgcgaattcaatagagaacttggcaatcttagtctagtcatacgtgatttattagcaggattgaatttgaatggtcaggggggtggttgtaaaactggctaggattcagaggtgttctggaggtgtggataaggtagactaaagtagagaatgatgcagcagtacatatctcaaagtagttgttaattaattcatccaacctattattgatttgattccatacttagtgcagtatattcttaacaatggaataatttggggagcggatttatgcacctgggggcattcacgctctgaacctgagccgtcaatcttcgtgttttgggatctaagctaccacctctgttaaaaaaatacaaggcgtatttccttt

SEQ ID NO: 1588 - DNA, 4166 bp, Secale cereale
ttttttactcccccaatcctcttctcctctgttcctctacccgcttcccggcatctaccgcccccaccgccggggatctctccgcctccgccgagatcgagttgaccaccccgcaagattcccctccctcgactgtgcgccccaatccgcccgccggcccgcggcgatctccgcggaggcggctgtgctcccgtcccggtgccggcggacgcacgcagggctcagcgacgatgcgccgcgaggacgggagaagggcctcggtcccgcggcggctggcgcgtcgctgccgtagatagcaagatcttccccccctccggcggcgcgcccggcccgctgctccggggaggtcgcgcctcgcggcctgccgctccggggagatgccgtccctgcagctgctgcagctcaccgagcgtgggcgggggctcctggcgtcccggaggaggacgctggcggtcgtctccggcgcgctggtcgccggcggggcgttggcgtacgcgcggtcgggccggggccaaaggaggagaggccgtccggaagccgccaacaacggtgacgatgcattggccaggaatggggaaaggccgggccacaacggcacggatggccggttggccgggacgaccaagcgccggaagagcgcgctcaagtccttgcatttcctggccgctatcctgctcaagaagattggccccaacggcacgcgataccttcttggcttgatgttgaccgccgtgctgcgtactgctgtggggcacagattagcaaaagttcaaggatttctgtttaaagcggcatttcttcggcgggttccgacctttacacgcctaattatagagaatctgatcttgtgcttcctccaatcagcagtataccagacatcgaaatacttaactgggtctctgaacttgcgcttcaagaaaattttaacagacctcgtccatgccgattatttccagaatatggtttactacaagatctctcatgtggatcatcgaatatcaaacccggaacaaaggattgcgagtgatattccaaagttctgttctgaacttagtgaacttgtacaggatgatttggctgcagttgcagaagggctgatatatacctggcgtctctgttcttatgctagtccaaaatacatgctttggattctgggatatatactagttgctggtggagcaattagaaatttctcccctgcttttggaaagatgaaatccacagagcagcatttagaaggggagtatcgtcaacttcattcacgcttaagaactcacgctgagagtgtagcattttatggtggtgagcagagagaagaataccatattatgcagcgattccgagctcttgttgggcacttgaagcatgtactccatgaaaactggtggttcggcatgattcaagatttctttctgaagtactttggtgccactgtagcagttgtccttattatcgaaccgttcttctccggcgaccttagacctgattcatctaccctaggaagggctgatatgttgagtaaccttcgataccacacgagtgtgatcatagcactatttcagtctctcggcaccctctctatcagctctaggcgtttgaatatcctgagtggctatgcagaccggattcgtgagctactagatgtttcacgtgagctgtctggggtccgtgatagatcattgaatcacaattcctctgctggaaattatatcagcgaagcaaaccatatagaattttcaggtgttaaggtggtgacacccgctgggaatgttttggttgacgatttaactctccgagtagaaactgggtctaatcttttaatcaccggtcccaatggtagtggaaaaagctccctttttcgggtccttggtggcctatggccactggtatctggccatattgtcaaacctggtgttggttctgatcttaacaaggaaatcttttatgtcccacaaagaccatacacagctgttggcacacttcgcgaacagctaatctatcctctgacagcagatcaggagactgaaccgcttagctatgatggcatggtcgaccttctaaagaatgttgacctggaatacttgctagaacgttatcctcttgacaaggaagttaactggggtgatgagctatcccttggcgagcaacaaagattaggaatggccaggctgttctaccataagccaaagttcgctattcttgatgagtgtactagtgctgtgacaattgatatggaagaacgtttctgcaaaaaggttcgagcgatgggaacatcatgcataacaatatctcatcgtccagcgttagttgcatttcataatattgttctgtcattggacggtgaaggagggtgggatgttcagcacagaagggatgattcatccttttacactgaagagtctgaacttacatcactggaaactgaacgtaaatcggatgccctaactgttcaaagggcttttatgaacagggcaaagagcaatgcttcattaaggtccaaggattcctactctacaaaggtcatagcaaattcccccaagttggaaacaggacatacagtacgaacacctgtagtcccacatttacaatgctccccaaggcctctccctctgagagcagctgcaatgctcaaaatattggttcctaaattacttgacaaacaaggagggcagttgctttctgttgctctacttattttctctcgcactgtgatctcggatcgtattgcttcactgaatgggactactgtgaagtttgtcttggagcaggataaagctgcttttgttcggttggttggcgtcagtgttttgcagagtgctgcaaattctttcgtcgcaccatctctgagaacccttacttcaagacttgcccttggatggagaattcgcttgaccaaccatttgcttcaatattatttgagaagaaatgcattctacaaggtattcaatatgtcaggtaaaagtatagatgcagaccaaagactaacacttgatgtggataagttgaccactgaccttgctagcttggttactggaatggtaaagccactagttgacattctttggtttacatggagaatgaagcttttgtccggccgaagaggagttggtatattgtatgcctacatgttactaggattgggtttcctgagagctatatcccctgacttcggtcatcttgcaagtgaggaacaagaacttgaaggaacattcaggttcatgcactcaagactgcggacacatgctgaatcaattgctttctttggtggtggttcaagagaaaaagctatggttgaggctaaattcatgaagttgcttaaacactcaaaggttctgttgagaaaacaatggctttatggtattgttgatgattttgtgacaaagcaactcccacacaatgtgacatggggtctgagtttgttatatgctctggagcacaagggagacagagctttgacttcaacacaaggggagctggcacatgctctgcggttcttggcatcagtggtgtcacaaagcttcatagccttcggtgacattcttgagttacataagaaattccttgaactttctggtgggattaaccggatctttgaactcgaggagattttgcgtgtagctcaaaaggataccccagtgccttccagtgccattactgcagcctcagacgaaattattgaattccacgaagtggatattgtaacaccatcgcagaagctattggctaggaagctgtcatgcagtgtggtacaagggaaaagccttcttttgaccggccccaatggtaccgggaagagctctgtttttagggtgcttagagatttatggcctgccttttctgggagagttaccaagcccgctgaagggatgttccatgttcctcagagtccatacaccagcttgggaacccttcgggatcagatcatataccctctgtcaagggaggaagcagagatgaagattctttcattatataaatctagcaacaggtctagtgctcctgagttgctagatgagcacctgaagacggttcttgtgaatgtccggttggtctaccttctagagagagaaggttgggactctaccccaacgtgggaagacgttttatcgctgggagaacagcagaggcttgggatggctcgtttgttcttccaccatcctaaattc

SEQ ID NO: 1589 - DNA, 5282 bp, Setaria italica
ccgccggcgatccccgatcggcgacactcagtttagctgtacatatctgaccaaagaggccaacctagcaacaatgtcatcgcttcagttactgcagctaacagaacgcgggcgcaaccttttgtcttcaagaaggagaacacttgcagttgtttctggtgcactacttgctggcggaactttagcatatacccagtcaggccgatggaataaacaacagaaagaaaatgcttgcagcgatggaaatgcacataccgggactaaagacagaaatggtcaaaatggtattgatggtaaattggttaaaccaaggaaaaagaaaagtggattgaagtccttacattttctggccgccatcttacttaagaagattggtccgaatggatcaaattaccttcttggcttgataataacagcagtcttgcgtacagctgttggccacagattagcaaaagtacaagggtatttgttcagagctgcattccttcggcgagttccaacctttacacatctgattattgaaaatcttcttctatgctttctccaatccacaatatatcagacgtcaaagtacttgacagggtcattaggcttgcgcttcaagaaaattttgacggatcttgtccatgctgattattttgagaacatggtgtactacaagatctcgcatgttgatcatcggatctcaaacccagagcaaagaattgcaagtgatataccaaagttctgctcggaactaagtgaccttgtacaagatgatctggcagcaattgcagaagcgttaatatatatctggcgcctctgctcttatgcaagtccgaaatatgtattgtggattctggcatatgttataggtgctggtggtacaattagaaaattttctcctgcttttggtaagctgaagtctatggaacaacagctagagggggaatatcgccaggtccattcacgattgagaacacatgccgagagtgtggcattttatggtggtgaaaacagagaagcatcgcatattatgcagcggtttggggcacttgttaagcacttgaatgttgttctccatgaaaactggtggtttggcatgattcaagattttcttctgaagtatcttggtgccactgtgggagttatcctaattatcgaacctttctttgcggggaatcttagacctgaatcatccaccttaggacgggcagagatgttgagcaatctccgataccacaccagtgtgataatatcactatttcagtctcttgggaccctttctatcagttcaaggcgcttaaatattctcagtggctatgctaatcgtattcatgagttactggaggtctcccgtgagctatctggtgttcgtgatagattgatgactcaaaattcttctgctgcaaattatatcagcgaggcaaattatatagagttttcaggtgttaaggtggtgacaccctctgggaatgttttggttgatgatttgacgctccgattggagtcaggctctaacctgttgatcacaggccccaatggtagtggaaaaagctccctattccgtgttcttggtggtctgtggccgctggtatctggtcatattgtcaaacctggtgttggttctaatctcaacaaggaaatattttatgtgccccagagaccatatacagctgttggaacacttcgtgaccagttgatctatccgcttacagcagaccaggaaactgaaccactcaactatagtggcatggtggatcttctaaagaatgttgatctagaatacttgctagaacgctatcctcttgataaggaagttaactggggtgatgaattgtctcttggcgagcagcaaagattaggaatggctagactgttctatcataaacccaagtttgctatcctggatgaatgcactagtgctgtgacaattgatatggaagaacgtttctgcaaaagggttcgagcaatgggcacatcatgcataacaatatctcaccgtccagcattagttgcatttcatgaaattgttttatccttggatggtgaaggagggtggaatgtgcaggacaacagaaatggttcatccttctcccctgaagtagaggttgatgtgttgaagtcatcagaaactgatcgcaaatctgatgcacttactgttcaaagggcttttgtcaccagcacaaagggcaatgcatcatcaaagctcaagaagcagtcctattcaacagaggtgatagcatcttcccctagtatggagatagaacatacagtacaagcacctatcgtaacacaattgaaatgctctccaagacctttgcctgtcagagttgctgcaatgtctcaaatactggttccaaagctgtttgataaacaaggagggcagctacttgcagtggcagtactagtattttcccgtacttggatttcggatcgtatagcttcactgaatggaacaagtgtcaagtatgtcttggagcaggacaaagctgccttcattcgtttgactggcataagtgtgctgcaaagtgccgcaaattctatcgtgtcaccctcactaagaaatcttacttcaagaattgcccttggatggcggattcgcatgaccaaccatctacttcaatattatttgaaaagaaatgctttttacaaggtattcaacatttcgggcatgaatatggatgcagaccaaagaataacacatgatgtagagaagttgaccaatgatcttgctggcttggttactggaatggtgaagccactagttgacattctttggtttacatggagaatgaagcttttgtctgggcgaagaggagttgctatactatatgcttacatgttcctaggtcttggttttctaagagctgtgtcccctgacttcggtgatcttgcaaaccaagaacaagaacttgaaggcacattcagattcatgcactcaagattgcggacacatgctgagtcaatagctttctttggtggtggatcaagggaaaaagctatgattgatgctaaattcacaacatggctcaaccactcaaaggttctattgagaaaaaagtggctttacggtatttttgatgatttcgtgacgaaacaactacctcataatgtgacatgggggcttagtttgttatatgctttggagcacaagggagaccgagctttgacttcaacccaaggagagctggcacatgccctgcggttcttggcgtctgtggtgtcacaaagcttcatagcatttggtgatattcttgaattgcacaagaagttccttgaactttctggtggtattaacagaatatttgagcttgaggagcttcttcaggcagcacaaagcaatcctgctgtgccttctgatgctattaaggccgcctccgaagaaatcatctccttccgtaatgtggatattgtaacaccatcacagaagctattggctagccaattgtcttgtgatgtatctcaaggaaaaagccttcttgtgaccggtccaaatggtagtggaaagagttccatttttagggtgctccgaggtttgtggcccattgcttctggtagacttaccaagccatccgaaggaatttttaatgtccctcaacgtccatatacttgtcttggaaccttgagggatcagatcatataccctctctcacgggaggaggcagagttgaagatgctttcacacgaaacaagtgacaagtctgcagcttccaagatgttggatgatcacctgaagatgattctagagaatgttcgcttggtgtatcttctagaaagagaaggttgggatgctactcctaactgggaagatatcctatccttgggggaacagcagaggctggggatggctcgtttattctttcactgtcctaaatacggcatccttgacgagtgcactaatgccacaagtgtggatgttgaggagcatttgtacaggttagcaaccaacatgggcataacagtcatcacatcctcacaaaggcctgctctgattcccttccattctttggaactgaaactcatcgatggcgaagggaagtggaagctatgtgccatccaccaataaccatgctgtcagctgacctttatcgttagttacctgtcatcagttgtataaagagctgttgtcgtcccttgttgcttcatcggtggctgtctttagaagccaggaaggaaattggaatgatgcacgcagaatgtgtggtttcggtttaagatttcttttttggttttcagaaattttgaaatacggaagggaagaaatatacggcagtgttaggagggaaaggttttagatgggtttctggagctgcagcctccaatgggatagcatgtatagtacatagtccggcctgattgatttttatacgaaatacagaataagttggcggtgccatgccgtgtagaaatgattatttgtatcaaagtggatggatacgggcacgaagtgccttgtaaatggcaactgatttacagaaaattcatctctcctttttttttgcattgatgaattgccatacacagcaaatagcctgcttttttagctgcaacttctgttgcctccctagtcggttccttcagatcagaagctagacctgctgggagagcaggatgagcagtccctgcgggccgacgaggatctcgttgaggaagctgacgagtccgaaccagacgacgggcgtgacgtcgacgccgccgagcggtgggatgaccctgcgggtgacggcgaggaatggctcggtgggcgcgtaggccagcacgtaggggaactccgtgacggggagcctcgggtaccacgacatgacgatccgcaggatgaagaggaagccgaacgccgacagcgccggccccgccacgcccgccaccgtcttcgccgtcgccgggtccagctcgcccagcaccgccaacgccgccgaagacgaagcatggcatggcagcactgctagtgtgctgctcatcgtcgtcgccgctgcggcgacggcacccaataggccaccgcgtgctcgcgtcgttacagggacctggccatcgctgcagcgtctttctgatgagtgggtgccgagttcctgaaattgatggaacattcagtagttgagctccagtgaactgaaaaggttcggcaacgatccggctctagtacggagtagtaacattgttactgaccttgttgtggccggcagcgacgacgaggcacctcctgctcgcagagacgatcgaatacacggtcctgggcatggaaggtttgggagccaaaagcaacgaagcctccatgagaggcaagcaagcaagcagcagctctg

SEQ ID NO: 1590 - DNA, 4847 bp, Oryza sativa
gttttatagcgtggtgggagtggggagaccagaccaggaaaggagacggagacccgattcgttcccacctcctcgccgcccaccgctctccatctcctcttcttcctcctcctcctcctctcgtcgtcctcgtcgccgtctcgtcttctatttatttaggagtatttttttttcatctatctatctgtatctatctataccccccgcctccccgatttttcttcttcttcctcctcttacctcgcgtcgccgccgcgggcgtcagcgctcgcgtcccccgtgtctcgtttcgtccatcacaactcgctctccgtgcggcggcggcggcggcgatccccgatcgggcgactccggcgattgcgagaggcggtctttcttaatcttcaatattttcttagagctaaacggttatattttggtgtcttcttagcaacaatgccatctcttcagttattgcaactgacagagcacggacgcaaccttttgtcttcgagaaggagaactcttgcagttgtttctggtgcgttacttgcgggtggaactttagcatatgctcactcagctcggcgccaaaaacgtcaggaagaatattctcatagtgatgcaagtacacagaccacgggtaatcagagcatttgtcaaaatggtgttgatggtaaattggtaaaaacaaggaaaaagaaaaatgggttgaaatccttacaatttctggctgctattttgcttaaaaagattggtccaaatggaataaatcatcttctcggcttgatgataacagctgtgttacgtactgccgttggccacagattagcaaaagttcagggctatctattcagggttgcatttcttcggcgtgttccaacctttacacgcctgattatcgaaaatcttcttttatgcttccttcagtccacaatatatcagacctccaagtacttgacagggtccttaggtttgcactttaagaagattttgacagatcttgtccatgctgattactttgagaacatggtttactacaaactctcgcatgtagatcaccggatctcaaatccagaacaaaggattgctagtgatattcctaagttctgctcggaactaagtggactcgtacaggatgatctgactgcagttgcagatgggttaatatacatctggcgcctctgctcttatgcaagtccaaaatatgttctctggattctggcatatgtacttggtgctggtggtgcaattagaaagttttctcctgcttttgggaaattaaaatccatggagcaacagctagaaggggaatatcggcaggtccattcacgtttgagaacccatgctgagagtgtggcgttttatggtggtgagaacagagaagcatcgcacatcatgcagaggtttcaggctcttgtgaagcatttgaatgttgttcttcatgaaaactggtggtttggcatgattcaggattttcttcttaagtatcttggtgccaccgttggagttatcttgattgttgaacctttctttgctggaaaccttaaacctgaatcatccactttaggacgggcagagatgttgagcaatcttcggtatcatactagcgtcataatatcattatttcagtctcttggaaccctttctatcagttcaagacgcttgaatcttctcagtggctatgcagatcgtattcgcgagttactggatgtttcacgtgagctatctggggttcgtgatctatctatgaataaaaaatcttctgtagacaattatatcagcgaagcaaattatatagaattttcgggtgttaaggtggtgacaccctcagggaacgtcttggttgatgatttaactcttcgggtagagtcgggttctaatcttttgataactggtcctaatggtagtggaaaaagctcccttttccgggttcttgggggactgtggccacttatgtcaggccacattgtgaaacctggtgttggctctaatcttaacaaagaaattttttatgttccccagcgaccatatacagccgttggaacacttcgggaccagcttatctatccacttacagcagaccaggaaactgaaccacttagctatggtggcatggtggatcttctaaagaatgtggatctggaatatttgctagaacgctaccctcttgataaggaagttaactggggtgatgaattgtctcttggagagcaacaaagattgggaatggcccggctgttctaccataggccaaagtttgccatcctggatgaatgcactagtgctgtgacaactgatatggaagagcgtttctgcaaaagggttcaagcaatgggcacatcatgcataacaatctctcatcgtccagcattagttgcatttcatgacatcgttttgtctttggatggagaaggagggtggacagttcaggaaaatagaaatggctcctttatctctgctgaaccagagtttgatgcattgaactcatcagaaactgatcgtaaatctgatgcacttgctgttcaaagggcttttattgccaacacaaagggtaatgctttaatgggccccaaggatcattcttattctacacagctcatagccacttctcccaatatggaaatagaacacacagaacggtcaaatctagttccacaattacagtgctcaccaagacctttgccactccgagctgctgcaatgtcaaaaatactggtccctaaattatttgataagcaaggtgggcagttgcttgcagtggcattgcttgttttctctcggacttggatttcagatcgtatagcttcactgaacggaacgagcgttaagtatgtcctggagcaggacaaagctgccttccttcggttaattgggattagtgtgctgcaaagtgctgcaaattcaattgtgtcaccatcactaagaaaccttacttcaaagattgcccttggctggcgaattcgcatgaccaaccatctacttcaatattatttgaaacgaaatgctttttacaaggtatttaacatgtcaggcatcgatattgatgcagaccaaagaatcacacatgatgtggagaagttgaccaatgatcttgctggcctagttaccggaatggtgaaaccacttgttgacattctttggtttacatggagaatgaagattttgtcagggcgaaggggagttgctattttgtacgcatacatgttgctaggtcttggttttctaagagctgtttcccctgactttggtgatcttgcaaatcaagaacaagaacttgaaggaacattcaggttcatgcactcaagattgcggacacatgctgagtcaatagctttctttggtggtggatcaagggaaaaagctatggttgaagctaaattcacaacgatgcttaaccactcaaggactcttctgagaaaaagatggctatatggtatttttgatgatttcgtgacgaagcagctacctcacaatgtgacatgggggcttagtttgttatatgctttggaacacaagggggaccgagctttgacttcaactcaaggagagttggcacatgcacttcgattcttggcatctgtggtgtcacaaagctttatagcttttggtgatattcttgagttacataaaaaattccttgaactgtccggtggtattaatagggtgtttgaactcgaagagcttctacagacatctcaaagcaatgctgccatgccctctaatcctattattgcggcatcggaagaaattatttccttccatgatgtggatatcgtaacgccatctcaaaagctattggctacccagttatcttgtgatgtatctcaaggaaaaagccttcttgtgactggcccaaatggcagtggcaagagctccatttttagggtgctccgaggtttgtggcccatcgcttcagggaggcttaccatgccgtctgatggcatctttcatgttccgcaacgtccgtatacttgtctaggaaccttgagggatcagatcatatatcccctctctcatgaggaggcagagttgaaggttctttcattatacaaatcaggtgacaaggcaataacttctgggtcactggatgatcacctgaagacaattctagagaatgttcgattggtctatcttctagaaagagaagggtgggatgctactcctaactgggaagatattctatccttgggagaacagcagaggctaggcatggctcgtttgttcttccactgtccaaaatttggtatcctagacgagtgcaccaatgccacaagtgtcgatgttgaggagcatttgtacaagatagcaactagtatgggcataactgtcatcacctcgtcacaaaggcctgctctgatacccttccattcgttggagctgaaactcatcgatggtgaaggaaagtgggaactatgtacaatcaaccaataattgatgtggccaacttgaatttttgacgagttttcatcaagtgcctattcaccagtggctgcctttacaagccatgaagaaaataccaattcacattaggagacttgcatactttcacgcagcatatgcgcttatacgagattcttttttccttggttagaggtttgagatatagcaaaacaacatacaggagttgtagagtggaaaggtagatattgacttgtagcccctaagaagatagatagcgtagtacataatttgtccttccagcctaattgattggcttgtagcaattgtaacacggagcacgaagtgtgcccttgcaaatgttagctcttttatatagaaaaaatatcttttattttgttatttcggtgttatgtttttttgttccatgtcagttcagctatatactagtttgaagtttgaacttt

SEQ ID NO: 1591 - DNA, 4797 bp, Sorghum bicolor
ggccaaccagatagagggagaccgaccgtggggacgagggacccgactggctctgaccccaagtaaccaatccgctgtgcctgggacgtgcgtgttctgttcagttcagttcacacggcacttgcacacacatgtcgtaccgattcgaattctgtccattgcgctgcacggtagcagtagacaatcttgcttctcggtgttttgcttgtctctagttgatcattcagatgcccgtacagctcagttgttctagctagctttatatatattatatctggtcgaagagggccagtctagcaacaatgtcatcacttcagttattgcaactaacagagcgcgggcgcaaccttttgtcttcaagaaggagaacaatcgcaattgtttctggggcagtacttgctggtggaactttagcatatgcccagtcaggtcgatggaaaaagcatcaggaagtaaattcttgcagtgacgcaaactcacatagcagtaataacggaagaactagtcagaatggaattgatggtaaattggttaaaacaaggaaaaagaaaagtggactgaagtccttacattttctggctgctattttacttaagaagattggcccgaatggaacgaattaccttattggcttgatattaacagcagtcttgcgtacagctgttggccacagattagcaaaagtacaagggtatttattcagatctgcattccttcggcgtattccgacctttacacgtctcattatcgaaaatctttttctatgctttctccaatccacattatatcagacgtcaaaatacttaacaggatccttaggcttgcacttcaagaaaatcttgacagatcttgtccatgctgattattttgagaacatggtgtactacaagatctcacatgttgatcatcgaatctcaaacccagagcaaaggattgcaagtgacataccaaagttctgctcagaattaagtgaccttgtacaagatgatctggctgcaattatagaagggttaatatacatctggcgcctatgctcttacgcaagtccaaaatatgtattatggattctggcatatgtcttaggtgctggtggtacaattagaaaattttctcctgcttttggcaagctgaagtctatggaacaacagctagagggggaatatcgccaactccattcacgattgagaacccacgctgagagtgtggcgttttatggtggtgagaacagagaagcatcacatattaagcagcggttccgggcacttgttaaacacttgaatgttgttcttcatgaaaactggtggtttggcatgattcaagattttcttctgaagtatcttggcgccactgtgggagttatcctaattattgaacctttctttgcggggaatcttaaacctgaatcatccaccttaggacgggcagagatgttgagcaatcttcgctaccacaccagcgtgataatatcactatttcaatctcttggaaccctttctattggttcaaggcgcttaaatattctcagtggttatgctaatcgtattcatgaattactggatgtctcgcgtgagctatctggtggtcgtgatagattgattactcaaaattcctctgatggaaattatatcagtgaggcaaattatatagagttttcaggtgttaaggtggtgacaccttctgggaatgtcttggttgataatttgaaccttcatttggagtcaggctctaatctgttgatcactggtcccaatggtagtggaaaaagctcccttttccgtgttcttggtggtctgtggccgatggtatctggtcatattgtcaaacctggtgttggttccaatctcaacaaggaaatattttatgtgccccagagaccatatacagctgtcggaacacttcgcgaccagttaatctatccactcacagcagaccaagagactgaaccactcagctatggtggcatggtggatcttctaaagaatgttgatctggaatacttgctagaacgctatcctcttgataaggaagttaactggggtgacgaattgtctcttggtgagcagcaaagattaggaatggctagactgttctatcataagccaaagtttgctatcctggatgaatgcactagtgctgtgacaactgatatggaagagcgcttctgcaaaagggttcgagcaatgggcacatcatgcataacaatatctcaccgtccagcattagttgcatttcatgaaatagttttatccttagatggtgaaggagggtggaatattcaggacaacagaaatggttcttccttctctcctgaacttgagtttgatgtgctcgagtcatcagaaagtgatcgcaagtctgatgcacttactgttcaaagggctttcatcaccagcacaaagggcaattcatcaatgaagcccaagaagctgtcctattcaacagaggtcatagcatcttcgcccattgtggagatagaacatacagtacaatcatctattgtcacacaattgcaatgctctccaagacctttgcctgtcagagttgctgcaatgtctcaaatactggttccaaagctatttgataaacaaggagggcagctgcttgcagtggcgctacttgtattctcccgcacttggatttcagatcgtatagcttcattgaatggaacaagtgttaagtatgtcttggagcaggacaaagctgccttcattcgtttggctggcatcagtgtgctgcaaagtgcagctaattccatcgtgtcaccctcactgaggaatcttacttcaagaattgcccttggatggcggattcgcatgaccaatcatctgcttcaatattatttgaaaagaaacgctttttacaaggtattcaacatttcaggtatgagtatggatgcagaccaaagaatgacacatgatgtagagaagttgaccaatgatcttgctggcttgctcactggtatggtgaagccactagttgatattatttggtttacatggagaatgaagcttttgtctgggcgaagaggggttgctatactgtatgcttacatgttcctaggtcttggttttctaagagctgtgtcccctgactttggtgatcttgcaaacaaagaacaagaacttgaaggcacgttcaggttcatgcactcaagattgcggacacatgctgagtcaatagctttctttggtggtggatcaagggagaaagctatgattgacgctaaattcacgacattgctcaaccactcgaaggttctattgagaaaaaaatggctttatggtatttttgatgattttgtgacgaaacagcttcctcataatgtgacatgggggctgagtatgctatatgctttggagcacaagggagaccgagctttgacttcaactcaaggggagctggcacatgctctgaggttcttggcatctgtggtgtcacaaagcttcatagcgtttggtgatattcttgagttacacaagaagttccttgaactctctggtggtattaacagaatatttgagcttgaggagcttctacaggcatcacaaagcaatcctgtcgtgccttctgatgctataaatgccacttctgaagaaataatttccttccgtggcgtggatattgtaacaccatcacagaaactattggctagccaattgtcttgtgatgtatctcaagggaaaagccttcttgtgactggtccaaatggtagcggcaagagttctatttttagggtgctccgaggtttgtggcccattgcttctggtagacttaccaagccatctgaaggaatttttaatgttcctcaacgcccatatacttgtcttggaaccttgagggatcaagttatataccctctctctcatgaggaggcaaagttgaagatgctctcatatgaaacaagtgacaagtctaccgcttccaagatgttggatgatcacctgaagacgattctagagaatgtccgcttggtgtatcttctagaaagagaaggctgggatgctactcctaactgggaagatattctgtccttgggagaacagcagaggctggggatggctcgtctgttctttcactgtcctaaatatggcatcctcgacgaatgcactaatgccacaagtgtggacgttgaagagcatttatacaggctagcaaccaacatgggcataacagttatcacatcctcacaaaggcctgctctgattcccttccattccttggaactgaaactcattgatggcgaaggaaagtgggagctttgttccatccaccaataaccaatgccatcagctgattttcatcgttagctacctgtcagttgtacaaagtactgttgtcaccaatttatgcttcatcagaggaggcaattacaagttgcaaagcacatgaagagactcgtccactcggggtgcagagtgtgtgacggagccttactttttgttgaagattttctctcttttttttctctccccctttgaatttttttgcgatacagaagggaggaaggaaatatacaccagtcagtgttaggaggaaaggttatagatgggaacattggggctgcaggcttcagcgggatagcatagtacatagtcctagcatgatatgtcagcctgattgatttttatacgagagagacagagcgagcggttcagagcagaactgaaatcaaatggtggcgtgtggaaatatttatggtctgtatcaaaatggacaaggcacgaagggtgcctttgtaaatgacaactaatttataggaaattaatctctctctctctctctctctctctctctctc

SEQ ID NO: 1592 - DNA, 4260 bp, Triticum aestivum
atgctgacagccgtgctgcgtactgctgtcgggcatagattagcaaaagttcaaggctttctgtttaaagcggcatttcttcggcgtgttccaacctttacacgcctaattatagaaaatctgatcttatgctttctccaatcagcagtataccagacctcaaaatacctaactgggtctctgaacttgcgcttcaagaaaattttaacagacctcgtccatgccgattatttccagaatatggtttactacaagatctctcatgtggatcatcgaatatcaaacccggagcaaaggattgcgagtgatataccaaagttctgttctgaacttagtgaacttgtacaggatgatctggctgcagttgcagaagggttgatatatacctggcgtctctgttcttatgctagtccaaaatacatgctttggattctgggatatatactagttgctggtggagcaattagaaatttctctcctgcttttggaaagatgaaatctacagagcagcacttagaaggggagtatcgtcaacttcattcacgcttaagaactcatgctgagagtgtagcattttatggtggtgagaagagagaagaatatcatattatgcaccgattccgagctcttgttgggcacttgaagcatgtactccatgaaaactggtggttcggcatgattcaagatttctttctgaagtactttggtgccactgtagcagttgttcttattatcgaaccgttcttctccggcgaccttagacctgattcatctacactaggaagggctgatatgttgagtaaccttcgataccacacgagcgtgatcatagcactatttcagtctctcgggaccctttctatcagctctaggcgtttgaatatcctgagtggctatgcagaccggattcgtgagttactagatgtttcacgtgagctgtctggggtccgtgatagatcgttgaatcacagctcttctgttgggaattacatcagcgaagcaaaccatatagaattttccggtgttaaggtggtgacacctgctgggaatgttttggttgatgatttaactctccgagtggaaactggatctaatctattaatcaccggtcccaatggtagtggaaaaagctccctttttcgggttcttgggggcctatggccactggtatctggccatattgtcaagcctggtgttggttccgatcttaacaaggaaatcttttatgtcccacaaaggccatacacagcagttggcacacttcgcgaacagctaatctatcctctcacagcagatcaggagactgaaccacttagctatgatggcatggtggaccttctaaagaatgttgatctggaatacttgctagaacgttatcctcttgacaaggaagttaactggggtgatgagctatcccttggcgagcaacaaagattaggaatggccaggctgttctaccataagccaaagtttgctattcttgatgagtgtactagtgccgtgacaattgatatggaagaacggttttgcaaaaaggttcgagcgatgggaacatcatgcataacaatatctcatcgcccagcgttagttgcatttcataatattgttttgtcattggacggtgaaggagggtgggatgttcagcacagaagggatgactcatccttttacactgaagagtctgaacttacatcactggaaactgaacgtaaatcggatgccctaactgttcaaagggcttttatgaacagggcaaagagcaatgcttcattaaggtccaaggattcctactctacaaaggtcatagcaaattcccccaagttggaaacaggacaagcagtacgaacacctgtaatcccacatttgcaatgctccccaaggccgctccctctgagagcagctgcaatgctcaaaatattggttcctaaattacttgataaacaaggagggcagttgctttctgttgctctacttattttctctcgcactgtgatctcggatcgtattgcttcactgaatgggactactgtgaagtttgtcttggagcaggataaagctgcttttgttcggttggttggcgtcagtgttctgcagagtgcggcaaattctttcgtcgcaccatctctgagaacccttacttcaagacttgcccttggatggcgaattcgtttgaccaaccatttgcttcaatattatttgagaaaaaatgcattctacaaggtattcaatatgtcaggtaaaagtatcgatgcagaccaaagactaacacttgatgtggataagttgacaactgaccttgctagcttggttactggaatggtaaagccactagttgacattctttggtttacatggagaatgaagcttttgtccggccgaagaggagttggtatattgtatgcttacatgttactaggattgggtttcctgagagctatatcccctgacttcggtcatcttgcaagtgaggaacaagaacttgaaggaacattcaggttcatgcactcaaggctgcggacacatgctgaatcaattgctttctttggtggtggttcaagagaaaaagctatggttgaggctaaattcatgaaattgcttaaccactcaaaggttctgttgagaaaacaatggctttatggtattgttgatgattttgtgacaaagcaactcccacacaatgtgacatggggtctgagtttgttatatgctctggagcacaagggagacagagctttgacgtcaacacaaggagagctggcacatgctctgcggttcttggcatcagtggtgtcacaaagcttcatagccttcggtgacattcttgagttacataagaaattccttgaactttctggtgggattaaccggatctttgaactcgaggagattttgcgtgtagctcaaaaggataccccagtgccttccagtgccattactgcagcctcagacgaaattattgaattccatgaagtggatattgtaacaccatcgcagaagctattggcgaggaagctgtcatgcagtgtggtacaagggaaaagccttcttttgactggccccaatggtaccgggaagagctctgtttttagggtgctcagagatttatggcctgccttttctgggagagttaccaagccctctgaagggatgttccatgttcctcagagtccatacaccagcttgggaacccttcgggatcagatcatataccctctgtcaagggaggaagcagagatgaagattctttcattatataaagctagcaacaggtctagtgctcctgagttgctagatgaccacctgaagacggttcttgtgaatgttcggttggtctatcttctagagagagaaggttgggactctaccccaaactgggaagacgttttgtcgctgggagaacagcagaggcttgggatggctcgcttgttcttccaccatccaaaattcggcatcctcgacgagtgcacaaacgccacgagtgttgatgttgaagagcatctgtacaggctagcaacaaacatgggcataactgtgatcacttcgtcacaaaggcctgctcttatacccttccactctgtggagttaaagctcatcgacggcgagggaaactgggagctgtgcgagatccagcattgattgacgcccccagctagagttttatcagatctcagtcacttacgccaatgcagaagatgctgctgctgctgctaccgcagcgatttgttcatatcgggtcgctctcacagaccgtctggaagatgtagcagcctgtacaactgtgaagcaggccggaaaaagaagaagaatccgcttcaggaactcggcgcagaacattgcaatcatagtctaattacaccgaatttagtaacagctgaacgagcaggggccggcggtaaatcagttacttaggattgggaggtgtttcggtttggaggtgtggagtgaagtaggaagagagtgtagaacagcagtacataatctcagagcagctgttgatgtgaattcatcagacctattattgattgattccatgctagtgcagtacatatggaataaatttggctgttgttgccatcatctccgttcgtcgtcgtcatcaaaaactgtgtaaacagaaggaagcaaatggtgcaatacggtattggttgttgacatcaccaaactacaattgcatgtttctttttacattctccatgtgcatggatgatcatgtgtttggttgtatagaactagcaaaagggactgtatgttgcaactgaa

SEQ ID NO: 1593 - DNA, 4133 bp, Hordeum vulgare
ggtgctgcgtactgctgtcgggcatagattagcaaaagttcaaggctttctatttaaagcggcatttcttcggcgtgttccaacctttacgcgcctaattatagagaatctgatcttatgctttctccaatcagcagtataccagacctcaaaatacttaactgggtccttgaacttgcgcttcaagaaaattttaacagacctcgtccatgccgattatttccagaatatggtttactacaagatctctcatgtggatcatcgaatatcaaatccggagcaaaggattgccagtgatattccaaagttctcttctgaacttagtgaacttgtacaggatgatttggctgcagttgcagaagggttgatatatacatggcgtctctgttcttatgctagtccgaaatacatgctttggattctggcatatatactagttgctggtggagcaattagaaatttctctcctgcttttggaaagatgaaatccacagagcagcacttagaaggggagtatcgtcaacttcattcacgcttaagaactcatgctgagagtgtagcattttatggtggtgagaagagagaagaatatcatattatgcagcgatttcgagctcttgttgggcacttgaagcatgtactccatgaaaactggtggttcggcatgattcaagatttctttctgaagtactttggggccactgtagcagttgtccttattatcgaaccgttcttctccggtgaccttagacctgattcatctaccataggaagggctgatatgttgagtaaccttcgataccacactagcgtgatcatagcactatttcagtctcttgggaccctctctatcagctctaggcgtttgaatatcctgagtggctatgcagaccggattcgtgagttactagatgtttcacgtgagctgtctggggtccgtgatagatcgttgaatcacagctcttctgttgggaattacatcagcgaagcaaaccatatagaattttctggtgttaaggtggtgacacccgctgggaacgttttggttgacgatttaactctccgagtagaaactggatctaatcttttaatcaccggtcccaatggtagtggaaaaagctccctttttcgggttcttggaggcctatggccgctagtatctggccatattgtcaaacctggtgttggttccgatcttaacaaggaaatcttttatgtcccacaaagaccatacacagctgttggcacacttcgcgaacaactaatctatcctcttacagcagatcaggagactgaaccacttacctatgatggcatggtggaccttctaaagaatgttgatctggaatacttgctagaacgttatcctcttgacaaggaagttaactggggtgatgagctatcccttggcgagcaacaaagattaggaatggccaggctgttctaccataagccaaaatttgctattcttgatgagtgtaccagtgctgtgacaattgatatggaagaacgtttttgcaaaaaggttcgagcgatgggaacatcatgcataacaatatctcatcgcccagcattagttgcatttcataatattgttttgtcattggacggtgaaggagggtgggatgttcagcacagaagggatgactcatccttttacactgaagactctgaacttacatcactggaaactgaacgtaaatcggatgccctaattgttcagagggcctttatgaacagggcaaagagcaatgcttcattaaggtccaaggattcctactctacaaaggtcatagcaaattccaccaagttggaaacaggacaaacagtacgaacacctgtaatcccacatttacaatgctccccaaggcctctgcctctgagagcgactgcaatgctcaaaatattgattcctaaattgcttgacaaacaaggagggcagttgcttgctgtcgctctacttattttctctcgcactgtgatctcggatcgtattgcttcgctgaatgggaccactgtgaagtttgtcttggagcaggataaagctgcttttgttcggctggttggcgtcagtgttctgcagagtgctgcaaattcttttgtcgcaccatctctgagaacccttacttcaagacttgcccttggatggcgaattcgcttgaccaaccatttgcttcaatattatttgagaagaaatgcattctacaaggtattcaatatgtcgggtaaaagtatagatgcagaccaaagactaacacttgatgtggataagttgaccactgaccttgctggcttggttactggaatggtaaaaccactagttgacattctttggtttacatggagaatgaagcttttgtccggccgtagaggagttggtatattgtatgcttacatgttactaggattgggtttcctgagagctatatcccctgactttggtcatcttgcaagtgaggaacaagaacttgaaggaacattcaggtttatgcactcgaggctgcggacgcatgctgaatcaattgctttctttggtggtggttcaagagaaaaagctatggttgaggctaaattcatgaaactgcttaaccactcaaaggttctgttgagaaaacaatggctttatggtgttgttgatgattttgtgacaaagcaactcccacacaatgtgacatggggtctgagtttgttatatgctctggagcacaagggagacagagctttgacttcaacacaaggagagctggcacatgctctgcggttcttggcatcagtggtgtcacaaagcttcatagctttcggcgacattcttgagttacataagaaattccttgaactttctggtgggattaatcggatctttgaactcgaggagattctgcgtgtagctcaaaaggataccccagtgccttccagtgccattagtgcagcctcagacgaaattattgaattccatgaagtggatattgtaacaccatcccagaagctattagctaggaagctgtcatgcagtgtggtacaagggaaaagccttctcttgactggccccaatggtaccgggaagagctctgtttttagggtgctcagagatttatggcctgccttttctgggagagttaccaagccctctgaagggatgttccatgttcctcagagtccatacaccagcctgggaactcttagggatcagatcatataccctctgtcaagggaggaagcagagatgaagattctttcgttatataagtctagcaacaggtctagtgcccctgagttgctagacgatcacctgaagacggttcttgtgaatgttcggttggtctatcttctagagagggaaggctgggactctaccccaaactgggaagacgttttatcgctgggagaacagcagaggcttgggatggctcgtttgttcttccaccatcctaaattcggcatcctcgacgagtgcacaaacgctacgagtgttgatgttgaagagcatctgtacaggctagcaacagacatgggcataactgtgatcacttcgtcacaaaggcctgctcttatacccttccactccgtggagcttaaactcatcgatggtgaggggaactgggagctatgcgagatccaacattgattgacaccaccagctagagtttttatctgctctcagtcacttatgccatacagaagatgcgctactgtagcaagttgttcataccgggtcgccctcccgaccatctggaagcaggagcagcatgtacaactgtgaatcctcatcaggtattcggcactgaagatggcagtcagtctagttataccaaatttagtaacaaactgaatgagcaggggacggaggtaaaactggttgcttaggattgagaggtgtttcgatttggaggtgtgaagtaggatgagagtgtagaacagcagtacataatctctctcagagcagctgttgatgtgaattatcaaacctattattgattgattccatgctagtgcagtacatatggaataaatttggctgttgttgccatcatctttgtcgttcgtctttgtcatctaaagatgtgtaaacaaaaggaagcaaatgacggaatacgttattggttgttgacatcaccaaactacaattgcatgta

SEQ ID NO: 1594 - DNA, 4470 bp, Brachypodium distachyon
atattgatgctgtattgtgacaggcggcgcccttgcttggcggcatttgtgtcttgttcatctttaggacttctgtacagcttttagccttctgcttggagaggagaatctagcaacaatgtcttctcttcagttgttgaaactaacagagcaaggccggaaccttttgtcttcaagaaggaaaacacttgtaattgtttctggtgcactacttgccggtggaactttaacatatgcccagtcatgtcgacggaagaaataccgggaagaaaattctcgtggtgacgcaagtacacataccaggaataaagagagcaatggtcaaaatggtgttgatggcaaattggtaaaaccaaggaagaagaaaaatctattgaaatccttacattttctggctgctattttacttaagaagattggcccgagcggaacaaattaccttcttggcttgatgttaacagcagtgatacgtacagccatcggccacagattagcaaaagttcaagggtatttgttcagatctgcgtttcttcggcgtgttccgaccttcatgcgcctaattattgaaaatcttcttttatgcttccttcagtccacagtatatcagacctcaaagtacttgacaggatctttaggcttgcgcttcaagaaaattttgacagatctcatccatgctgattactttgagaatatggtttactacaagatctcacatgtagatcatcggatctcaaacccagagcaaaggattgctagtgatattccaaagttctgctcagaactaagtgaactcgtacaggatgatctgattgcagttgcagatgggttaatatacatctggcgcctctgctcttatgcaagtccaaaatatgtcctctggattctggcgtatgtacttggtgctggtggtacaattagaaaattttctccttcttttggaaagttgaaatccacagaacaacagttagaaggagagtatcggcaggttcattcacgattgagaacccatgccgagagtgtggcattttatggtggtgagaacagagaagcatcacacatcatgcagcggttccaggctcttgtgcggcacttgaatgttgttcttcatgagaactggtggtttggcatgattcaagattttcttctgaagtatcttggtgccactgtgggagtcatcttgattgttgaacctttctttgcgggaaatcttaaaccggatacatctactttaggacgggcagagatgttgagcaatcttcgatatcacacaagtgtgataatatcattatttcagtctcttggtaccctttctatcagttcaaggcgtttaaatcttctcagtggctatgcagaccgtatccatgagttactggaagtttcacgtgatctatctggggttcgtgatagatcaattagtcaaaattcttctgtcagaaactatattagtgaggcaaactatattgaattttcaggtgttaaggtggttacaccctctgggaatgtcttggttgatgatttaactcttcgggttgaatcgggttctaatcttttgatcactggccccaacggtagtggaaaaagttcccttttccgcgttcttgggggtctgtggccacttgtgtctggccacattgtcaaacctggtgttggttctaatcttaacaaggaaatcttctacgtcccacagcgaccatatacggctgtcggaacacttcgcgaccagctaatctatccacttacggcagatcaggaaactgaaccactaagttacagtggtatggtggatcttctaaagaatgttgatctagaatacttgctagaacgctaccctctcgataaggaagttaactggggtgatgaattgtctcttggtgagcaacaaagattgggaatggccagattgttctaccataagccaaagtttgccatcctggatgagtgtactagtgctgtgacaactgatatggaagaacgtttctgcaatagggttcgagcaatgggcacatcgtgcataacaatatctcatcgtccagcattagttgcatttcatgatattgttttgtccttggatggtgaaggagggtggaaagttcaagataacagaaatggctccttccttcctactgaatcagagtttgatgtattgaagtcatcagaaactgatcgtaaatctgatgcacttgctgttcaaagggcttttagggccaatacaaaggacaatgctttttccggttcgaaggaacattcttattcaacacaggtcatagctacttcccccaatatggaaatagaacccacagaacaaccgcgtctgatcccacagttacagtgctcaccaagacctttgcctgtcagagcagctgctatgtctaaaatattggttcctaaaataattgataagcaagggggacaattgcttgcagtggcactacttgtgctttctcgaacttggatatcagatcgtatagcttcgctcaatgggactagtgttaagtatgtcctggagcaggacaaggctgccttccttcggttgattggagtcagtgttatgcaaagtgctgcaaattcaattgtagcaccgtcattgagaaaccttacttcaaggatagctcttggatggcgaattcgcatgaccaaccatctacttgcgtattacttgaaaagaaatgctttttacaaggtatttaacatgtcaggcatgaatattgatgcagaccaaagaataacacgtgacgtggagaagttgaccaatgatcttgccggcttagttactggaatggtgaaaccactagttgacattctctggtttacatggagaatgaagcttttgtctgggagaagaggagttgctattttgtatgcatacatgttgctagggcttggttttctaagagccgtttcgcctgacttcggtgatcttgcaaaccaagaacaagaacttgaaggttccttcaggttcatgcactcaagactgcggacacatgccgagtcaattgctttctttggtggtgggtcaagggaaagagctatggttgaagctagattcacaacactgcttaaccactcgaaggttcttttgagaaaaaaatggctttatggcatttttgatgatttcgtgacgaagcagctgcctcacaatgtgacatggggactgagtatgttatatgctttggaacacaagggggacagagctttgacttcaactcaaggagagttagcacatgcgctgcggttcttggcgtctgttgtgtcacaaagctttatagcttttggtgacattctggagttgcataaaaaattccttgaactttctggtggtatcaataggatctttgaactcgaggagcttctacatgcatcccaaagcaatgctgccatgccctcgaatgctagcagtgtggcatctgaagaaattatttcattccgggatgtggatattgtgacgccatcgcaaaagctattggctagccaattgtcttgtgatgtatctcaaggaaaaagtcttcttgtgactggtccaaatggcagtggcaaaagttccatttttagggtgctccgaggtttgtggcccatagcttctggaagacttgccatgccttctgaagggatattccatgtttctcagcgtccatatacttgtcttggaaccttgagggatcagatcatatatcccctctctcgcgaggaggcagagttgaagatggtttcgttggtcaaaacaagtgacaggtttaccacttccgggtcgctggatgatcacctaaagacaattctagagaatgttcgcttggtctatcttctcgaaagagaaggttgggatgctactcctaattgggaagatattttatccttgggagaacagcagagactgggcatggctcgcttgttcttccactgccctaaatttggtatccttgatgagtgcaccaatgctacaagtgtcgacgtcgaggagcatttgtacagactggcgactgacatgggtataactgtggtcacctcctcacaaaggcctgctttgatacccttccattcatcagaactgaaactcatcgacggcgaagggaagtgggagctatgtgcaatcaaccagtagcgctgccctcaacctcaattttggatcagcttttagttactctcagctgtatactgacttacagtatgatagtctttagttacaaagccagggaggcgaggccaaatatgggatagagcgaaacaatatatacacaagttgtagaagggaaattttagcatcgtacataatctatctttgctgttcccatacagaatatacgcaatgagatgatgaagtttgccatcgaaatcgaatggtggcatgttgcagttattgttattgattgtataaacacgggcgcgaagtgcgccctccctttgtaaatgacaactgacagaaatagtatatcttggtgatgccttcgcctttcaccgcgtttgttctatgttgac

SEQ ID NO: 1595 - DNA, 4788 bp, Triticum aestivum
gtcgggggacggacggacgaccgcgtaccgcccggtttcgttgtccaccaccgcaccaccactcccccctcccgacttcctcctcccctcgccgtcgccgtccttttatttatctatcccttggacacaacggtgctgtattgtgacaggcggtgcccttgcttggcgacgtttgtgttttgttgatcgtcaaaaggctttccatacaacttagccctctgtttttgctagctgtctatatctgtttggagagggcaatctagcaacaatgtcatctcttcagttattgcaacttacggagcatggacggaaccttttttcttcgagaaggaggacgcttgcagttgtttctggcgcactacttgctggtggtactttagcatatgcgcagtcaggtcgacggcggaaacatcgggaagaaaatcattctaatgatggaaatgtacatagcaggagtaaagagaacattagtcaaaatggtgttgacggtaaagtggttaaaccaaggaaaaagaaaatttattgaaatccttacatttcctggctgctattttgctcaagaagattggcccaagcggaacgaattaccttcttggcttgatgttaacagcagtgttacgtacagccattggtcacagattagcaaaagttcaagggtatttgttcaaatccgcgtttcttcggcgtgttccgaccttcacacgcctaatcattgaaaatcttctattatgctttctccagtccacggtatatcagacctcaaagtacttgacaggatccttaagcttgcgcttcaagaaaattttgacggatctcatccatgctgattactttgagaatatggtttactacaagatctcacatgtagatcatcggatttcaaacccagagcaaaggattgctagtgatattcctaagttctgcgcagggctaagtgaccttgtacaagatgatctgattgcagttgcagatgggttaatatacatctggcgcatctgctcttatgcaagtccgaaatatgttctctggattctggcatatgtacttggtgctggtggcacaattagaaaattttctccttcttttgggaagttgaaagccatggaacaacaactagaaggggaatatcgccaggttcattcacgactgagaactcatgctgagagcgtggcattttatggtggtgagaacagagaagaatcacacattatgcagcggttccaggctcttgtgcggcacgttaatgttgttcttcatgagaactggtggtttggcatgattcaggattttcttctgaagtatcttggtgccacagtgggagttatcttgattgtcgaacctttctttgcgggagatcttaagcctgatacatctactttaggacgggcagagatgttgagcaatcttcgatatcacacaagtgtgataatatcattattccagtcccttggcaccctttctaccagttcaagacgtttaaatcttctcagtggctacgcagaccgtattcatgagttactggatgtttcacgtgagctgtctggggttcgcgacagatcaatgaaccgaaattcttctgccaaaaattatattagtgaggcaaactatatagaattttcaggtgttaaggtggtgacaccctctgggaatgtcttggttgatgatttaactctcagggtggagtcgggttctaatcttttgatcactggtcctaacggtagtggaaaaagctctcttttccgtgttcttgggggtctgtggccacttgtatctggccacattgtcaaacctggtgttggttctaatcttaacaaggaaatcttttatgtcccccagcgaccatatacagctgtcggaacacttcgcgaccagttaatctatccacttacagcagatcaggaaaccgaaccacttagctatggtggtatggtggatcttctaaagaatgttgatttagaatacttgctagaacgttaccctctcgacaaggaagtgaactggggtgatgagttgtctcttggtgagcaacagagattgggaatggccagattgttctaccataagcccaagtttgccatcctggatgagtgtactagtgctgtgacgactgatatggaagaacgtttctgcaatagggtccgagcaatgggcacgtcatgcataacaatatctcaccggccagcattagttgcttttcatgatgtcgttttgtccttggatggtgaaggagggtggaaagttcaagataacagaaatggttccttccttcctactgaatcggagtttgatgcattgaagtcatcagaaactgaccgtaaatctgatgcacttgctgttcaaagagcttttagtgctaatacaaaggaaaatacgttatcgggccccaaggaacattcttattcaacacaggtcatagctacttcacccaatatggaaatagaatccacagaacagccacatctgatcccacaattgcagtgctcgccgagacctttgcctgttagagttgctgcaatgtctaaaatactggttcctaaaatcattgataagcaaggagcgcaattgcttgcagttgcagtactcgtactttctcggacttggatatctgatcgtatagcttcactgaatgggactagtgttaagtatgtcctggagcaggacaaggctgccttcattcgactgatcgggaccagtgtaatgcaaagtgcagcaaattcaattgtggcaccatcactgagacaccttacttcaaagattgctcttggatggcgaattcgcatgaccaaccatctacttgcgtattatttgaaaagaaatgctttttacaaggtattcaacatgacaggcatggagattgatgcagaccaaagaataacacgtgatgtggagaagttgaccaatgatcttgctggcttagtaactggaatggtgaaaccatcagttgacattctttggtttacatggagaatgaaacttttatctgggagaagaggagttgctattttgtacgcatacatgttgctagggcttggttttctaagagccgtttcccctgatttcggtgatctttcaaaccaagaacaagaacttgaaagttctttcaggttcatgcactcaagactgcggacacatgctgagtcaattgctttctttggtggtggatcaagggaaagagctatggttgaagctaagttcgcaactttgcttaaccactcgaagattcttttgaggaaaagatggctttatggtattttcgacgatttcgtgacaaagcagctgcctcacaatgtgacatggggattaagcctgttatatgctttggaacacaagggggaccgagctttgacttcaacgcaaggagagttagcacatgccctgcggttcctggcatctgtagtgtcacaaagtttcatagcttttggtgacattctcgagttgcataagaaattccttgaactttctggtggtgtcaataggatatttgaactcgaggagcttctaaaggcatctcaaagcaatgctgtcatgccctcaaatgttatcagtgtgccatctgaagaaactatttccttccgtaatgtggatattgtgaccccatcgcaaaagctattggctagccaattgtcttgtgatgtgtctcaaggaaaaagccttcttgtcactggtccaaacggcagtggcaagagttccatttttagggtgctccaaagtttgtggcctgtagcttccggaaggctcaccgtgccatctgaagggatatttcacgttcctcagcgcccatatacttgccttggaaccttgagagatcagatcatatatcctctctcacgtgaggaggcagagttgaagatgcttacattgtccaaaacaagtgacaggtctagatcgctggacgatcacctgaggacaattctagagaatgttcgcttggtctatcttctcgaaagagaaggttgggatgctactcccaattgggaagacattttgtccttgggagaacagcagaggctaggcatggcccgcctgttctttcactctcctaagtttggcatccttgacgagtgcaccaatgctacgagtgtcgatgtcgaggagcatttgtacaggctagcaactgacatgggtataactgtggtcacttcctcccaaaggcctgctctcatacccttccattcgttggaactgaaactcatcgacggcgaagggaagtgggagctgtgttcaatcaaccactagtcactgcctgtcgccctaatttttgaccggctttagctactctcagctgtatactgacttacagtacaaatagtcattagctgctgcttcaacaaacagaggctgcctgtagaagccagggaggcatgcagcacccaattggagatagatcagaacaatatacatacatgggttgtaggagggaaatgttttttctctttccaaggaggatagtatggtatataatcttgttctcatacagaatacacagcgagatgacatttgccgccgaaatcagatggtggtgggtgtaacgattatttgtataaacacgggcgcgaagcgtgcccccttgtaaatggcaactagttcaaatccatcttcctgatgatgcctttgtcttgcactgtgcttttagttctgcgtcgaccgagtcgccttctgattagggatctcttctgtttggggtgttgccacatcgattttgtgatgagttcatacctaaagcaaattcggaatggtttcacaattcatcgtttagtactgtcaaattgttgcaacctgtgcatcttt

SEQ ID NO: 1596 - DNA, 4300 bp, Hordeum vulgare
aacaatgtcatctcttcagttattgcaactaacagagcatgggcggaaccttttttcttcgagaaggaggacgcttgcagttgtttctggtgcactgcttgctggtggaactttagcatacgcgcagacaagtcgacggaggaaacatcgggaagaaaatccttgtaatgatgcaaatgtacatagcaggagtgaagagaacattagtcaaaacggtgtcgatggtaaagtggtaaaaacaaggaaaaagaaaaatttattgaaatccttacatttcctggctgctattttacttaagaagattggtccaagcggaacaaattaccttcttggcttgatgttaacagcagtgttacgtacagccattggtcacagattagcaaaagttcaagggtatttgtttaaatccgcgtttcttcggcgtgttccgactttcacacgcctaatcattgaaaatcttctattatgctttcttcagtccacggtatatcagacctcaaagtacttgacaggatccttaagcttgcgcttcaagaaaattttgacggatctcatccatgctgattacttcgagaatatggtctactacaagatctcacatgtagatcatcggatttcaaacccagagcaaaggattgctagtgatattcctaagttctgcgcaggactaagtgaccttgtacaagatgatctgattgcagttgcagatgggttaatatacatctggcgcatctgctcttatgcaagtccgaaatatgttctctggattctggcatatgtacttggtgctggtggcacaattagaaaattttctccttcttttgggaagttgaaagccatggaacaacaactagaaggggaatatcgccaggttcattcacgactgagaactcatgctgagagcgtggcattttatggtggtgagaacagagaagaatcacacattatgcagcggttccaggctcttgtgcggcacttgaatgttgttcttcatgagaactggtggtttggcatgattcaagattttcttctgaagtatcttggtgccacagtgggagttatcttgattgtcgaacctttctttgcgggagatcttaaacctgatacatctactttagggcgggcagagatgttgagcaatcttagatatcacacaagcgtgataatatcattattccagtcgcttggcaccctttctaccagctcaagacgtttaaatcttctcagtggctatgcagaccgtattcacgagttactggatgtttcacgtgagctatctggggttcgcgacaggtcgatgagtcgaaattcctctgccaaaaactatattagtgaggcaaactatatagaattttcaggtgtcaaggtggtgacaccctctgggaatgtcttggttgatgatttaactctccgggtggagtcgggttctaatcttttgatcactggtcccaacggtagtggaaaaagctctcttttccgtgttcttgggggtctgtggccacttgtatctggccacattgtcaaacctggtgttggttctaatcttaacaaggaaatattttatgtcccccagcgaccatatacagctgttggaacactgcgcgaccagttaatctatccacttacagcagatcaggaaaccgaaccacttagctatggtggtatggtggatcttctaaagaatgttgatttagaatacttgctagaacgctaccctgtcgacaaggaagttaactggggcgatgagttgtctcttggtgagcaacagagattgggaatggccagattgttctaccataagcccaagtttgccatcctggatgagtgtactagtgctgtgacgactgatatggaagaacgtttctgcaatagggtccgagcaatgggcacgtcatgcataacaatatctcaccgaccagcattagttgcttttcatgatgtcgttttgtccttggatggtgaaggaggatggaaagttcaagataacagaaatggctccttccttcctactgaatcggagtttgatgcattgaagtcatcagaaactgaccgcaaatctgacgcacttgctgttcaaagggctttcagtgctaatacaaaggaaaatactttatcaggccccaaggaccattcttattcaacacaggtcatagccacttcccccaatatggaaatagaatccacagaacaaccacatcttatcccacaattgcagtgctcgccgagacctttgcctgttagagttgctgcaatgtctaaaatactggttcctaaagtcattgataagcaaggggcacaattacttgcagttgcactactagtactatctcggacttggatatctgatcgtatagcttcactgaacgggactagtgttaagtatgtcctggagcaggacaaggctgccttcattcgattgatcgggaccagtgtaatgcaaagtgctgcaaattcaattgtggcaccatcactgagacaccttacttcaaagattgctcttggatggcgaattcgcatgacaaaccatctacttgcatattatttgaaaagaaatgctttttacaaggtatttaatatgacaggcacagatattgatgcagaccaaagaataacacgtgatgtggagaagttgaccaatgatcttgctggcttagttactggaatggtgaaaccatcagttgacattctttggtttacatggagaatgaagcttttatctgggagaagaggagttgctattttgtacgcatacatgttgctagggcttggttttctaagagccgtttcccctgatttcggcgatctttcaaaccaagaacaagaacttgaaagttctttcaggttcatgcactcaagactgcgaacacatgctgagtcaattgctttctttggtggtggatcaagggaaagagctatggttgaagctaagttcgcaactttgcttaaccactcgaagattctattgaggaaaagatggctttatggtatttttgatgatttcgtgacgaagcagctgcctcataatgtgacgtggggattgagtttgttatatgccttggaacacaagggggaccgagctttgacttcagcgcaaggagagttagcacatgctctgcggttcttggcatctgtagtgtcacaaagtttcatagcttttggtgacattctcgagttgcataagaaattccttgaactttctggtggtgtcaataggatctttgaactcgaggagcttctaaaggcatctcaaagcaatgctgtcatgccatcaaatgttatcagtgtgccatctgaacaaactatttccttccgtgatgtggatattgtgaccccatcgcgaaagctactggctagccaattgtcttgtgatgtgtctcaaggaaaaagccttcttgtcactggtccaaatggcagtggcaaaagttccattttcagggtgctccaaagtttgtggcctgtagcatctggaaggctcactgtgccatctgaagggatatttcacgttcctcagcgtccatatacttgccttggaaccttgagggatcagatcatatatcctctctcacgtgaggaggcagagttgaagatggttacattatccaaaacaagtgacaggtctacaccgctggacgatcacctgaggacaattctagagaatgttcgcttggtttatcttctggaaagagaaggttgggatgctactcccaattgggaagacattttgtccttgggagagcagcagaggctaggcatggctcgtctgttctttcactctcctaagtttggtatcctcgacgagtgcaccaatgctacgagtgtcgacgtggaggagcatttgtacaggctagcaaccgacttgggtataactgtggtcacttcctcccaaagacctgctctcatacccttccattctttggagctgaaactcatcgatggtgaaggaaagtgggagctgtgttcaatcaaccactagttgtcgtcatagccctaatttttgatcggctttagttaccatacagtacaatagtcactaggtgctgcttcaacaaacagaggaagcacccaattggagatagagcagaacaatatacaagggttgtagaagggaaatcctatttttttttttccaaacaggatagcatggtacataatcttggttctcattatagaatacacagtgagacgatatttgccgccaaaattgaatggccgcagggtgtagctattatctgtataaacaagggcacgaagcgtgcccttttgtaaatgtcaactggttcaaatccatcttcctgatgtt

SEQ ID NO: 1597 - DNA, 4401 bp, Secale cereale
ttggtgtatattactatgtttgtttgtatacgtcaaggcttccactacaacttgtccgttctgttttttctttgtctcgtctgttatctgtttggtagagggcgaatctagcaactatgtcatctcttcagtattgcaactaaccgagcatgggcgcaacctcttttcttcgagaaggaggacgcttgcagtgtttctggcgcactgcttgctggtggtactttagcatatgcgcagtcaggtcgacggatgaaacatcgggaagaaaatcattgtaatgatgcaaatgtacataccgggagtaaagagagcattagtcaaaatggtgttgacggtaaagtggttaaaccaaggaaaaagaaaaatttattgaaatccttacatttcctggctgctattttacttaagaagattggcccaagcggaacaaattaccttcttggcttgatgttaacagcagtgttacgtacagccattggtcacagattagcaaaagttcaagggtatttgttcaaatccgcgtttcttcggcgtgttccgaccttcacacgcctaatcattgaaaatcttctattatgctttcttcagtccacagtacatcagacctcaaagtacttgacaggatccttaagcttgcgcttcaagaaaattttgacagatctcatccatgctgattactttgagaatatggtttactacaagatctcacatgtagatcatcggattacaaacccagagcaaaggattgctagtgatattcctaagttctgcgcaggactaagtgaccttgtacaagatgatctgattgcagttgcagatgggttaatatacatctggcgcatctgctcttatgcaagtccgaaatatgttctctggattctggcatatgtacttggtgctggtggcacaattagaaaattttctccttcttttgggaagttgaaagccatggaacaacaactagaaggggaatatcgccaggttcattcacgactgagaactcatgctgagagcgtggcattttatggtggtgagaacagagaagaatcacacattatgcagcggttccaggctcttgtgcggcacgtgaatgttgttcttcatgagaactggtggtttggcatgattcaggattttcttctgaagtatcttggtgccacagtgggagttatcttgattgttgaacctttctttgcgggagatcttaaacctgatacatctactttaggacgggcagagatgttgagcaatcttcgatatcacacaagtgtgataatatcattattccagtcccttggcaccctttctaccagttcaagacgtttaaatcttctcagtggctatgcagaccgtattcatgagttacttgatgtttcacgtgagctatctggggttcgtgacagatcgatgagccgaaattcttctgccaaaaattatattagcgaggcaaactatatagaattttcaggtgttaaggtggtgacaccctctgggaatgtcttggttgatgatttaactctccgggtggagtctggttctaatcttttgattactggtcctaacggtagtggaaaaagctctcttttccgtgttcttgggggtctgtggccacttgtatctggccacattgtcaaacctggtgttggttctaatcttaacaaggaaatcttttatgtgccccagcgaccatatacagctgttggaacacttcgcgaccagttaatctatccacttacagcagatcaggaaactgaaccacttagctatggtggtatggtggatcttctaaagaatgttgatttggaatacttgttagaacgataccctctcgacaaggaagttaactggggtgatgaattgtctcttggtgagcaacagaggctgggaatggccagattgttctaccataagcccaagttcgccatcctggatgagtgtaccagtgctgtgacgactgatatggaagaacgtttctgcaatagggtccgagcaatgggcacgtcatgcataacaatatctcatcgtccagcattagttgcttttcatgatgtggttttgtccttggatggtgaaggagggtggaaagttcaagataacagaaatggttccttccttcctactgaatcagagtttgatgcattaaagtcatcagaaactgaccgcaaatctgacgcacttgctgttcaaaaggcttttagtgctaatacgaaggacaatacttcatcaggccccagggaacattcttattcaacacaggtcatagctacttcccccaatatggaaatagaatccacagaacaaccacatctggtcccacaattacagtgctcgcccagacctttgcctgttagagttgctgcaatgtctaaaatactggttcctaaaatcgttgataagcaaggggcgcaattgcttgcagttgcactacttgtgctatctcggacttggatatctgatcgcatagcttcactgaatgggactagtgtaaagtatgtcctggagcaggacaaggctgccttcattcgattgatcgggaccagtgtaatgcaaagtgcagcaaattcaattgtggcaccatcactgagacaccttacttcaaagattgctcttggatggcgaattcgcatgaccaaccatctacttgcatactatttgaaaagaaatgctttttacaaggtatttaacatgacaggcatggagattgatgcagaccaaagaataacacgtgatgtggagaagttgaccaatgatcttgctggcttagtaactggaatggtgaaaccatcagttgacattctttggtttacatggagaatgaagcttttatctgggagaagaggagttgctattttgtatgcatacatgttgctagggcttggttttctaagagccgtttccccggacttcggtgatctttcaaaccaagaacaagaacttgaaagttctttcaggttcatgcactcaagactgcggacacatgctgagtcaattgctttctttggtggtggatcaagggaaagagctatggttgaagctaagttcgcaactttgcttaaccactcgaagattcttttgaggaaaagatggctttatggtattttcgacgatttcgtgacaaagcagctgcctcacaatgtgacatggggattgagtctgctatatgctttggaacacaagggcgaccgagctttgacttcaacccaaggagagttagcacatgccctgcggttcttggcatctgtagtgtcacaaagtttcatagcttttggtgacattctcgagttgcataagaaattccttgaactttctggtggtgtcaataggatctttgaactcgaggagcttctaaaggcatctcaaagcaatgctgtcatgccctcaaatgttatcagtgtgccatctgaagaaactatttccttccgtaatgtggatattgtgaccccatcgcaaaagctattggctagccaattgtcctgtgatgtgtctcaaggaaaaagccttcttgtcactggtccaaacggcagtggcaagagttccatttttagggtgctccaaagtttgtggcctgtagcttctggaaggctcaccgtgccatctgaagggatatttcacgttcctcagcgcccatatacttgccttggaaccttgagggatcagatcatatatcctctctcacgtgaggaggcagagttgaagatggtcaaaacgggtgacaggtctacgtcgctggacgaccacctaaggacaattctagagaatgttcgcttggtctatcttctcgaaagagaaggttgggatgctactcccaattgggaagacattttgtccttgggagaacagcagaggctaggcatggctcgtctgttctttcactctcctaagtttggtatccttgacgagtgcaccaatgctacgagtgtcgatgtcgaggagcatttgtacaggctagcaactgacatgggtataactgtggtcacttcctcccaaaggcctgctctgatacccttccattcgttggaactgaaactcatcgacggcgaagggaagtgggagctgtgttcaatcaaccactagtcactgcctgtcgccctaatttttgaccggctttagctactctcagctcagctgtatactgacttacagtacaaataggcattagctgctgcttcaacaaacagaggctgcctgcagaagccagggaggcatgcagcaccaaattggggattagatcagaacaatatacatacatgggttgtagaagggcaatgttttctcttcttctttccaacaggaggatagtatgggtatataatcttgttctaatacagaatacacagtgagatgacatttgccgccgaaatcggatggcggtgggtgtaacgatttattcgtataaacacg

SEQ ID NO: 1598 - DNA, 4307 bp, Secale cereale
gctgtctgtatctgtttggagagggcaatctagcaacaatgtcatcgcttcagttattgcaactaaccgagcatgggcgcaaccttttttcttcgagaaggaggacgcttgcagttgtttctggcgcactacttgctggtggtactttagcatatgcgcagtcaggtcgacggaggaaacatcgggaagaaaatcattgtaatgatgcaaatgtacataccgggagtaaagagagcattagtcaaaatggtgttgacggtaaagtggttaaacccaggaaaaagaaaaatttattgaaatccttacatttcctggctgctattttacttaagaagattggcccaagcggaacaaattaccttcttggcttgatgttaacagcagtgttacgtacagccattggtcacagattagcaaaagttcaagggtatttgttcaaatccgcgtttcttcggcgtgttccgaccttcacacgcctaatcattgaaaatcttctattatgctttcttcagtccacggtacatcagacctcaaagtacttgacaggatccttaagcttgcgcttcaagaaaattttgacagatctcatccatgctgattactttgagaatatggtttactacaagatctcacatgtagatcatcggattacaaacccagagcaaaggattgctagtgatattcctaagttctgcgcaggactaagtgaccttgtacaagatgatctgattgcagttgcagatgggttaatatacatctggcgcatctgctcttatgcaagtccgaaatatgttctctggattctggcatatgtacttggtgctggtggcacaattagaaaattttctccttcttttgggaagttgaaagccatggaacaacaactagaaggggaatatcgccaggttcattcacgactgagaactcatgctgagagcgtggcattttatggtggtgagaacagagaagaatcacacattatgcagcggttccaggctcttgtgcgacacgtgaatgttgttcttcatgagaactggtggtttggcatgattcaggattttcttctgaagtatcttggtgccacagtgggagttatcttgattgttgaacctttctttgcgggagatcttaaacctgatacatctactttaggacgggcagagatgttgagcaatcttcgatatcacacaagtgtgataatatcattattccagtcccttggcaccctttctaccagttcaagacgtttaaatcttctcagtggctatgcagatcgtattcatgagttactggatgtttcacgtgagctatctggggttcgtgacagatcgatgagtcgaaatttatctgccaaaaattatattagcgaggcaaactatatagaattttcaggtgttaaggtggtgacaccctctgggaatgtcttggttgatgatttaactctccgggtggagtctggttctaatcttttgatcactggtcctaacggtagtggaaaaagctctcttttccgtgttcttgggggtctgtggccacttgtatctggccacattgtcaaacctggtgttggttctaatcttaacaaggaaatcttttatgtgccccagcgaccatatacagctgttggaacactccgcgaccagttaatctatccacttacagcagatcaggaaactgaaccacttagctatggtggtatggtgtatcttctcaagaatgttgatttagaatacttgctagaacgataccctctcgacaaagaagttaactggggtgatgaattgtctcttggtgagcaacagaggctgggaatggccagattgttctaccataagcccaagttcgccatcctggatgagtgtaccagtgctgtgacgactgatatggaagaacgtttctgcaatagggtccgagcaatgggcacgtcatgcataacaatatctcatcgaccagcattagttgcatttcatgatgtggttttgtccttggatggtgaaggagggtggaaagttcaagataacagaaatggctccttccttcctactgaatcagagtttgatgcattaaagtcatcagaaactgaccgcaaatctgacgcacttgctgttcaaaaggcttttagtgctaatacaaaggacaatacttcatcggcccccagggaacattcttattcaacacaggtcatagctacttcccccaatatggaaatagaatccacagaacaaccacatctgatcccacaattacagtgctcgcccagacctttgcctgttagagttgctgcaatgtctaaaatactggttcctaaaatcgttgataagcaaggggcgcaattgcttgcagttgcactacttgtactatctcggacttggatatctgatcgtatagcttcactgaatgggactagtgtaaagtatgtcctggagcaggacaaggctgccttcattcggttgatcgggaccagtgtaatgcaaagtgcagcaaattcaattgtggcaccatcactgagacaccttacttcaaagattgctcttggatggcgaattcgcatgaccaaccatctacttgcatattatttgaaaagaaatgctttttacaaggtatttaacatgacaggcatggagattgatgcagaccaaagaataacacgtgatgtggagaagttgaccaatgatcttgctggcttagtaactggaatggtgaaaccatcagttgacattctttggtttacatggagaatgaagcttttatctgggagaagaggagttgctattttgtacgcatacatgttgctagggcttggttttctaagagccgtttccccggacttcggtgatctttcaaaccaagaacaagaacttgaaagttctttcaggttcatgcactcaagactgcggacacatgctgagtcaattgctttctttggtggtggatcaagggaaagagctatggttgaagctaagttcgcaactttgcttaaccactcaaagattcttttgaggaaaagatggctttatggtattttcgacgatttcgtgacaaagcagctgcctcacaatgtgacatggggattgagtctgttatatgctttggaacacaagggcgaccgatctttgacttcaacccaaggagagttagcacatgccctgcggttcttggcatctgtagtgtcacaaagtttcatagcttttggtgacattctcgagttgcataagaaattccttgaactttctggtggtgtcaataggatctttgaactcgaggagcttctaaaggcatctcaaagcaatgctgtcatgccctcaaatgttatcagtgtgccatctgaagaaactatttccttccgtaatgtggatattgtgaccccatcgcaaaagctattggctagccaattgtcttgtgatgtgtctcaaggaaaaagccttcttgtcactggtccaaacggcagtggcaagagttccatatttagggtgctccaaagtttgtggcctgtagcttctggaaggctcaccgtgccatctgaagggatatttcacgttcctcagcgcccatatacttgccttggaaccttgagggatcagatcatatatcctctctcacgtgaggaggcagagttgaagatggtcaaaacgggtgacaggtctacgtcgctggacgaccacctaaggacaattctagagaatgttcgcttggtctatcttctcgaaagagaaggttgggatgctactcccaattgggaagacattttgtccttgggagaacagcagaggctaggcatggctcgtctgttctttcactctcctaagttcggtatcctcgacgagtgcaccaatgccacaagtgtcgacgtcgaggagcatctgtacaggctagctactgacatgggtataactgtggtcacttcctcccaaaggcctgctcttatacccttccattcgttggaactgaaactgatcgacggcgaaggaaagtgggagctgtgtgcaatcaaccactagtcgttgccgtcaaccttaatttttgatcggctttagttactcagctgtatactgacttacagtacaatagacaccttgctgcttgaaatagaagcagcacccagttggagttggagatagagcagaacaatatacaggggttgtagaagggaaatcctattctttccaaacaggatagcatggtatgtataatcttgttctcatacagaccacaaagtgaggcggcatttgccgccgaaatcggatggcggcaacatgtacgtagcaatgatttgtatgaacactggtgcgaagcgtgccctttgtaaa

SEQ ID NO: 1599 - DNA, 4131 bp, Triticum aestivum
caaaagttcaaggcttctgtttaaagcggctattcttcggcgggtcctaaccttacaggcctaattataagaaaatctgatcttatgctttctccaatcagcagtataccagacctcaaaatacttaactgggtctctgaacttgcgcttcaagaaaattttaacagacctcgtccatgccgattatttccagaatatggtttactacaagatctctcatgtggatcatcgaatatcaaacccagaacaaaggattgcgagtgatataccaaagttctgttctgaacttagtgaacttgtacaggatgatttggctgcagttgcagaagggctgatatatacctggcgtctctgttcttatgctagtccaaaatacatgctttggattctgggatatatactagttgctggtggagcaattagaaatttctcccctgcttttggaaagatgaaatctacagagcagcacttagaaggggagtatcgtcaacttcattcacgcttaagaactcatgctgagagtgtagcattttatggtggtgagaagagagaagaatatcatatcatgcagcgattccgagctcttgttgggcacttgaagcatgtactccatgaaaactggtggttcggcatgattcaagatttctttctgaagtacttcggtgccactgtagcagttgtccttattatcgaaccgttcttctccggcgaccttagacctgattcatctacactaggaagggctgatatgttgagtaaccttcgataccacacgagcgtgatcatagcactatttcagtctctcgggaccctttctatcagctctaggcgtttgaatatcctgagtggctatgcagaccggattcgtgagttactagatgtttcacgtgagctgtctggggtccgtgatagatcgttgaatcacagctcttctgttgggaattacatcagcgaagcaaaccatatagaattttctggtgttaaggtggtgacacctgctgggaatgttttggttgatgatttaactctccgagtggaaactggatctaatcttttaatcaccggtcccaatggtagtggaaaaagctccctttttcgggtccttgggggcctatggccgctagtatctggccatattgtcaaacctggtgttggttccgatcttaacaaggaaatcttttatgtcccacaaagaccatacacagctgttggcacacttcgcgaacagctaatctatcctctcacagcagatcaggagactgaaccacttagctatgatggcatggtggaccttctaaagaatgttgatctggaatacttgctagaacgttatcctcttgacaaggaagttaactggggcgatgagctatcccttggcgagcaacaaagattaggaatggccaggctgttctaccataagccaaagtttgctattcttgatgagtgtactagtgctgtgacaattgatatggaagaacgtttttgcaaaaaggttcgagcgatgggaacatcatgcataacaatatctcatcgcccagcgttagttgcatttcataatattgttttgtcattggacggtgaaggagggtgggatgttcagcacagaagggatgactcatccttttacactgaagagtctgaacttacatcactggaaactgaacgtaaatcggatgccctaactgttcaaagggcttttatgaacagggcaaagagcaatgcttcgttaaggtccaaggattcctactctacaaaggtcatagcaaattcccccaagttggaaacaggacaaacagtacgaacacctgtaatcccacatttgcaatgctccccaaggcctctccctctgagagcagctgcaatgctcaaaatattggttcctaaattactggacaaacaaggagggcagttgctttctgttgctctacttattttctctcgcaccgtgatctcggatcgtattgcttcactgaatgggactactgtgaagtttgtcttggagcaggataaagctgcttttgttcggttggttggcgtcagtgttctgcagagtgctgcaaattctttcgtcgcaccatctctgagaacccttacttcaagacttgcccttggatggcgaattcgcttgaccaaccatttgcttcaatattatttgagaagaaatgcattctacaaggtattcaatatgtcaggtaaaagtatcgatgcagaccaaagactaacacttgatgtggataagttgaccactgaccttgctggcttggttaccggaatggtaaaaccactagttgacattctttggtttacatggagaatgaagcttttgtctggccgaagaggagttggtatattgtatgcttacatgttactaggattgggtttcctgagagctatatcacccgactttggccatcttgcaagtgaggaacaagaacttgaaggaacattcaggttcatgcactcgaggctgcggactcatgctgaatcaatcgctttctttggtggtggttcaagagaaaaagctatggtcgaggctaagttcatgaaattgcttaaccactcaaaggttctgttgagaaaacaatggctttatggtattgttgatgattttgtgacaaagcaactcccacacaatgtgacatggggtctgagtttgttatatgctctggagcacaagggagacagagctttgacttcgacacaaggggagctcgcacatgctctgcggttcttggcatcagtggtgtcacaaagcttcatagcctttggcgatattcttgagttgcacaaaaaattccttgaactttctggtgggattaaccggatctttgagctcgaggagactctgcgtgcagctcaaaaggatgctctggtgccttccagtgccattagtgcagcctcagacgaaattattgaattccatgaagtggacattgtaacaccatcgcagaagctattggctaggaagctgtcatgcagtgtggtacaagggaaaagccttcttttgactggccccaatggtaccgggaagagctctgtttttagggtgctcagagatttatggcctgccttttctgggagagttaccaagccctctgaagggatgttccatgttcctcagagtccatacaccagcttgggaacccttcgggatcagatcatataccctatgtcaagggaggaagcagagatgaagattctttcattatataaagctagcaacaggtctagtgctcctgagttgctagatgaccacctgaagacggttcttgtgaatgtccggttggtctaccttctagagagagaaggttgggactctaccccaaactgggaagatgttttgtcgctgggagaacagcagaggcttgggatggctcgtttgttcttccaccatccaaaattcggcatcctcgacgagtgcacaaacgctacgagtgttgatgttgaagagcatctgtacaggctagcaacaaacatgggcataactgtgatcacttcatcacaaaggcctgctcttatacccttccactccgtggagttgaagctcatcgacggcgagggaaactgggagctgtgcgagatccagcactgattgacgccgccagctagagttttatcggctctcacttacttacgccacacagaagatgctgctgctgctactgcagcgatttgttcatatcgggtcgccttcacagaccgtctggaagctgtagcagcctgtacaactatgaagcaggccggaaaagaagaagaagaatccgcttcaggaactcgacgcagaacattgcaatcatagtctagctacaccgaatttagtaacagctgaacgagcaggggccggcggtaaatcagttacttaggattgggaggtgtttcggtttggaggtgtggagtgaagtaggaagagagtgtagaacagcagtacataatctcagagcagctgttgatgtgaattcatcaaacctattattgattgattccatgctagtgtagtacatatggaataaatttggctgttgttgccatcatctccgttcgctgtcgtcatcaaaaactgtgtaaacaaaaggaagcaaatggtgcaatacggtattggttgttgacatcaccaaactacaattgcatgtt

SEQ ID NO: 1600 - DNA, 1150 bp, Pennisetum glaucum
ggtatacgagcaatgcacgatttgccaaacgaaccgtatcccatgaacagcaacacgattcgttcagacttttgagtctagcttaatttttgccagacgaagctctagatctagtcaaggtccgtccccgcctccttcgcgctcctgcgccgcccgcctcaccgcaagcttccggcagccggctctacagcccgacgacgtgaaggaagatggtccgggaggtggccgagagctgcgtcgacggggtggtcatggagatggtagcggcctactgcggccgcttctacgctgccaagccggagctcgcggcccgccgcatcgaggccatcggcttccaggtcggtcaccagctctccgagagatataccatggagcgccctcgatttagtgatcatcttgaagcaatcaaatttatctgcaaagacttttggtcagaactattcaaaaagcagattgataatctgaaaacaaatcacaggggtacatttgtccttcaagataaccgtttccggtggcttactcgtgtttctctagatccatctgcagagagcaccgacgcaactgacaatgactctgcaccattgggtgatactgcagcccaaacaacaagcatgcttctgtattttccatgcgggttgattagaggtgccttgaccaacttaggactttcatgttctgtctctgcagatatgtcaaaccttccagcatgttcatttgtggtgcgcataaagacatgaactgcgagaaatgatacaaacacagtattaagtgctggcttgtggttcaagtcatttgacacctccttgttttcattgtctttaaatgaaatcccttcttcgccttcatagccatgtaaccgagattgggtgttactttatgttgcatgttagtaatattctctctggaagatcggttgctactttatgttacatcttccttttgtgcagatcatatttggatgtagtcaattataggtcctgtttgaaattcagttttttctcgattatgcaggagagctatgtatctttgtattaagaggaaatgaaagatcaaattacagagacttatgtatgtaaaatcactgctcaggtccatcttcgaattggatcgttgctatcagatgaggataagccactggcgtatgcagagc

SEQ ID NO: 1601 - DNA, 1595 bp, Panicum virgatum
gcgagtcgccgggctgatgcaagggcaacgaggcgaaaacgcccgctcccagcccgacgcgagcgataacagcgagggtttcttccttgtccggatcctatgtgccttccctcctcttgacttcacatcgctcgccctctcccatcaaatcgagccttcctgtgcgcaaaatcgagttcctctgctccaaatcgaagattaaatccccccaaatcgagtccccgaccatcaaatcgagttcctgcgaggtcgctggcgccgtgggttcctgccgcctacgaggtgctgctgattgtcctgcctcttccctccgctacctgggccgcacctgcactagcctccacaccgcacgcatccggcaccgcgattcgggagccggtgctacagccagacgcccagacgccgtgatctccccgtcttcctctcctgtcctgcgctgcgcaatcgggaggccaccgacgaggaagcagggcaacgaagatggtccgggaggttgcggagagctgcgtcgatggggtggtcatggagatggtagcggcgtactgcggtcgcttctacgccgtcaagcccgagctcgctgcccgccgcatcgaggccattggtttccaggtcggccaccagctctccgagagatataccatggagcgccctcgatttagtgatcaccttgaagcaatcaaatttatctgcaaagatttttggtcagagctgttcaagaagcagattgataatctgaaaacaaatcacaggggtacctttgtccttcaagataaccgtttccggtggcttactcgtgtttctctagatccatctgcagagagcacagatgcaactgacaatgactctgcaccattgggtgatactgcagcccaaacaacaagcatgcttctgtatttcccatgcgggttaataagaggtgccttgaccaacttaggaatttcgtgctccgtctctgcagatatgtcaaaccttccagcatgttcctttgtggtgcgcataaagacatgaactgtgagaaatgatacaagtacaatgttgaagtgctagcttatggttcaagtcatttgacacctaccggttttcagtgtctcggaatgacttttccttcttcccttcataaccttattccagagatcgggtgtaactcttatgtgatttttttcatctatcaaagtggagcactttcatgttccttttgtataaatcatatttggatgtagtcaatcataggtcctgtttgaaattcaggaacgtacgaatcctacatgaattgaagtgtttactctgaagttctcgttaaatgtgtatgctttcagacaggctatcagaatcctggtggagctatccgtgaagggactgtaggttttgcttgcgcaacacttggtgcagccacaaataccaactatgggcaacacagtatgaacgtcatcatcataatctactaactgtgcgacagagtatgaacgtcatcaactcatcatttgtaagatatttagtttaattatcttgtcctcagtgtcatttagaatggaaaaaatatttgctaagaccgttttaagacatttgtttaattatctaatcctaagtgttatttt

SEQ ID NO: 1602 - DNA, 1231 bp, Oryza sativa
tgggactatacgtaattgcagatacaaattatagggttcaggtacaaatccgatcctattatagggttcaggtacaaatccgatcctatcaagtgcgtgcgtgcgagggattgtggcttgataggatcgtccggacctgacgggagaaggcgtgggttcgtgcgacgggacctcgattcgtccatccagcttccactacccctccgcgcgctgcctagatctttcctctctctcgcaccctcttattggcggaggaggaggagggatggtgcgggaggttgcggagagctgtgtcgacggggtggtgatggagatggtggcggcctactgcggccgcttctacgccgccaagccggagctcgccgcccgccgcatcgaggccatcggcttccaggtcggccaccagctcacggagagatataccatggagcgccctcgatttagtgatcatcttgaagcaatcaaatttatctgcaaagacttttggtcagagctattcaagaagcagattgacaatcttaaaactaatcataggggaacatttgttcttcaagataaccgtttccggtggcttactcgtgtttctatagatccatctgtagagagcatggatgcaactgacaatgactctgcaacactaggggatagcgcagcccaaacaacaagcatgcttctgtactttccatgcgggataataagaggtgccttgaccaatttgggtatttcgtgttctgtcactgcagacatgtccaaccttccagcatgttcttttgttgtgcgcataaaaacatgagctgcagattttatgcctgcttgttcgatcaagcggtttgaacattaaagagtgcaagcacgcaatagcctgggaaatacgccttgtagctgctcctttttctttctctttgttcttagaggcacctctttacttactgacttcatcataccttcctttgtgcacatcttaagattgggtgtaattttgtgattcgtgtgaacaagagaagacaaaatgtaatatttctcctgagatactggctagagccatgtaattttgttgtctagcagtggagaatgttttatcttgtatgtgatgcccgcgcacagtcacgatttacctgtttttatggtttcatttttatggtttcatcgatttaccctgtttaggggtgtttggtttgtaacttggacgttgtggaaacaatagatcatagctgatagttttgttgtttgt

SEQ ID NO: 1603 - DNA, 1064 bp, Secale cereale
gactagtacctaggtgttcctgtgtattttcctttatttttcctagacaatcctgtgtattttccgtacgcatcacttcttttttccatcatcgccacgtagtttcggactctcggcccggtcgatctctccacggcgcaacccacaaggcgcgtgggaggtcacgattgccgaccgatcctttccgccgctcagctcgctacctagatctctcttccacaggggaagtcgccgaggaggagggaggacgagagtatggggcgagaggtgtcggagagctgtgttgatggggtggtgatggagatggtggctgcctactgcggccgcttctacgccgccaagccggagctcgccgccggtcgcattgaggccatcggcttccaggttggccatcagctctccgagagatatacgatggagcgccctcgatttactgatcatcttgaggcaatcaaatttatttgcaaagatttttggtcagaactgttcaagaagcagattgacaatctgaaaacaaatcataggggtaccttcgttcttcaagataaccatttccgatggcttactcgtgtttctctagatccagcagtagagagcactgatgcaactgagaatgactctgggtcattaggtgattctgcagcccaaacaaccagcatgcttttatattttccatgtgggttaataagaggtgctctcacaaacttgggaattccgtgtgctgtctcggcagatatgtcaaaccttccagcatgttcttttgtggtgcgtataaagacatgatctgcgagaaatagaacaagtcagatatgaatacctgcctgtggttcaagtattttggacggtaaactaagaatgttcagatattttacttgactgtattgtagtgttccgctatggtcaaatttcaaatatttgttgttattccatgatgaggtactgtaaaatattcagtctggagaatgcacgtagctatccaatcttcatctgaccgtgttgggtttttattgtcacatgatagtttggatgttacttaccgaaactcttaagctctgtacttacta

SEQ ID NO: 1604 - DNA, 1094 bp, Triticum aestivum
tgccgtgtattttccctacgcatcacttcttttttcagcatcgccacgtagtttcggactctcggcccggtcgatctctccacggcgcagcccacaaggcgcgtggggggtcccgactcccgaccgatcctttccgccgctcagctagctacctagatctctcttccacaggggaagtcgccgaggaggagggagggcgagagtatggggcgggaggtgtcggagagctgcgttgatggggtggtgatggagatggtggctgcctactgcggccgcttctacgccgccaagccggagctcgccgccggtcgcattgaggccatcggcttccaggttggccatcagctctccgagagatatacgatggagcgccctcgatttactgatcatcttgaggcaatcaaatttatttgcaaagatttttggtcagaactgttcaagaagcagattgacaatctgaaaacaaatcataggggtaccttcgttcttcaagataaccatttccggtggcttactcgtgtttctctagatccagcagtagagagcactgatgcaactgagaatgactctgggtcattgggtgattctgcagcccaaacaacaagcatgcttttatatttcccatgtgggttaataagaggtgctctcacaaacttgggaattccgtgtgctgtctctgcagatatgtcaaaccttccagcatgttcttttgtggtgcgcataaagacatgatctgcgagaaatagaacaagtcagatatgaatgccggcctgtggttcaagtattttggacggtaaactaagaatgttcagatattttacttgactgtattgtagtgttcctctatggtcaaatttcaaatatttgttgttattctgtgatgcaaggtactgtaaaatatttggtctggcgaatgcacgtagctatccaatttttcatctgaccgtgttggtttctttttattgtcacatgatagtttggatgttacttaccgaaactcttaagctgtgtacttactactacatccatcgcacgctagaaaagaaagatggatgtgctagggttggtcaatgccatcgtggataagggtcctt

SEQ ID NO: 1605 - DNA, 1534 bp, Hordeum vulgare
cgtagtttcggactctcggcccggtcgatctctccacggcgcagcccacaagggcgtgggggtcccgactcccgatcgatcctttccgccgctgagctcgctacctagatctctcttccactgcggaagtcgccgaggggagggaggacgagagtatggggcgggaggtgtcggagagctgcgttgatggggtggtaatggagatggtggctgcctactgcggccgcttctacgccgccaagccggagctcgccgccggtcgcattgaggccatcggcttccaggttggccatcagctctccgagagatatacgatggagcgccctcgatttactgatcatcttgaggcaatcaaatttatttgcaaagatttttggtcagaactgttcaagaagcagattgacaatctgaaaacaaatcataggggtaccttcgttcttcaagataatcatttccgatggcttactcgtgtttctctagatccagcagtagagaacactgatgcaactgagaatgactctgggtcattaggtgattctgcagcccaaacaacaagcatgcttttatatttcccatgtgggttaataagaggtgctctcacaaacttgggaattccatgtgctgtctctgcagatatgtcaaaccttccagcatgttctttcgtggtgcgcataaagacatgatctgagagaaatagaacaagtcagatatgaatctcgcctgtggttcaagtattttggacagtaaagtaagaatgttcagatattttacttgactgtattgtagtgttccttatatggtcaaatttgaaatatttgttgttattctgtgatgcaaggtactgtaaaatattcagtccgtgttgggcttttatcgtcacaacgataatttggatgctacttacggaaccccttaagttgttcacttattactacatccatcacatgctagaaaagaaaggtggacatgctggggttggtcgatggacttcaggaactgtgtccatacacatacatgcgtgcgtattgagatgctctgacatacttaacagaggcaccaaaataaatcacctcctattagtaaggtttcctggaaaatgctttgcttgcaggcaaaccctaacggctgccactatccttccttcatccttaacttcctgcctgccacaggaggaagtcagcgaccaaagattgtttttcaatggtggtggtgggtttgcctccttccaccggtgtgggtgtcgacacttcgctctctctcattaggctggttgtctccgggtgaaagcctagatttgatttcggactggggatgtcggcgtcctggaagtcgttcctgtgttgagagcattatttgtggagacctggcttggaggttctgttgacgtcgttcctgtgttgagagcattatttgtggagaaccggcttggaggttctgttgcatttctttggtgctcgcagctatcctgaattgttcatcggggtgttatagtccaatacagctttctcaggagttgtctgagtttcgcaaccta

SEQ ID NO: 1606 - DNA, 849 bp, Avena sativa
ggcagtccacaagggtgccagactcgtcgtcccgacttccgatcgtgccttttccgcccgccagctcgctagctagatctctcttccacaggggaagtcgccgaggagggaaggaggcgagataggagggccaggggatgggacgggaggtgtcggagagctgcgtcgatggggtggtgatggagatggtggccgcctactgcggccgcttctacgcctccaagccggagctcgccgctggccgcattgaggccatcggcttccaggtcggccaccagctctccgagagatacacaatggagcgccctcgattcagtgatcatctcgaggcgatcaaatttatttgcaaagacttttggtctgagcttttcaagaaacagattgacaatctgaaaacaaatcataggggtacttttgttcttcaagataaccatttccggtggcttactcgtgtttcactagaaccatctgtagagagcactgatacaactgagaacgactctgcatcattaggcgattctgcagcccaaacaacaagcatgcttttatatttcccatgtgggttaataagaggtgctctgacaaacttgggaatcccgtgtgctgtctctgcagacatgtcgaaccttccagcatgttctttcgtggtgcgtataaagacatgatctgcgagaaattgcacaagcagaatatgaatcccttcctgtggtttaagtattttggacagtaaagaagtgaggaggtcagatattttagtagattgtattttacttgttcctcctatgttcgaatctcaaatatttgctgtaattctttgatagctgcataatgtataatattcggtctgga

SEQ ID NO: 1607 - DNA, 991 bp, Oryza sativa
tgaggagaagttgaacccatccaaacagcttccttcctcccccctcctggctccgctcgctggatctctcctctttctctctcgcaccctctccccggcgaggtaggagggatggggcgggaggtggcggagagctgcgtcgacggggtggtcatgcagatggtggcggcctactgcggcggcttctacgccgccaagccggagctcgccgcccgtcgcatcgaggccatcggcttccaggtcggccaccagctcaccgagagatatactatggagcgccctcgatttagtgatcatcttgaagcaatcaaatttatctgcaaagacttttggtcagagttattcaagaagcaaattgacaatctgaagactaatcataggggcacatttgttcttcaagataaccatttccggtggcttactcgtgtttctgtagatccatctgtagagagcatggatgcaactgagaatgattctacaacactaggtgatagcgcagcccaaacaacaagcatgcttctgtactttccatgcgggataataagaggtgccttgaccaatttggggatttcttgttctgtcactgcagacatgtccaaccttccagcatgttcttttgttgtgcgcataaagacatgagctgcaataaatgatttgaataccattatatgcatgcttgtggtataaagtggtctgtacattcaaggaggggggaaacccgccgtgtagctggtcttttttttttttcctttcccctcttgttcttactggcacatgtttacttttcctcatacctgccttgtgcgcttattaagattggtgtaattctgtgatccaaaatgttgacaagggaagacaaatgtaatatttctcctgagagactggctatagctaacttttgttgtctagcagtggagagtgatttataatttattttgctgacttatattttctatattaaataaaaatatatacatttagaattacctaa

SEQ ID NO: 1608 - DNA, 1367 bp, Brachypodium distachyon
taaaaccgtaaaatcaaatgtcatgttcttacacttttacagtagttttgatcggtaaaaatgtaaacggaccgggatcccttagtgcgtcatggtgacgtgtagctactgacatgtgggccctatcatctccaaaactgctgctcactaaaaattctactcctaaaaaacaaaaatactccaccacgcgcctcgcatgttctgccgccgtccggtcgtctcctcgatctccttcgccggtgcctcgtccgatctcgcccatcaggaccaagctactgctgccgactcctaactgaatctctcggtctttttggctccacccccataggccatagcgagatctctcacgcagagccgacgaggaggaagaggagatcgagctgcgaggagatgggccgggaggtggcggagagctgcctagatggggtggtgatggagatggtgtccgcctactgctcccgattctatgccgccaagccggaacttgccgccggccgcatcgaggccatcggcttccaggtcggccaccagctttccgagagatatacaatggatcgccctcgatttagtgatcatctggaagcaattaaatttatctgcaaagacttttggtcagagctattcaagaaacagattgacaatctgaagactaatcacaggggtacctttgttcttcaagacaaccatttcccatggctaactcgtgtttctctagacccatctatggagagcacagatgcaactgagagtgactctgcatcattaggtgatactgcagcccaaactacaactatgcttttgtatttcccatgtgggatcatcagaggggccttgaccaacttgggaattacatgtgctgtctccgcagacatgtcaaaccttccagcatgttcttttgttgtgcgcatcaaaacctgaactatgaccaacatgcacaatatggattacttgcttgtgagtttgctacttggatagaagtggcccaggtataaatatgtgatccgtgattatgatcacaagagatgaggaagtataatgttacttctgtagctatctggtttcttatcagtttggtgaaaaacatatcctgtattctcgttagttgttgcctagtcactgtaacagttcatatgatcacaagagatgagaggtataatattacgtctggagctatctggtttcttagcagtttggtgaaaaacatatcctgtatttccattagttgttgcctagtcactgtaacagttcttttaacaatgccactatgacaccatgatttttgtgtagatcattttaagcttataaatctgtcttacaaaatgaaagccatctgaaacctttggtgtcagacagaagcataaccatgc

SEQ ID NO: 1609 - DNA, 1325 bp, Zea mays
ctctaaataatcgtaaagtgacgaaatctaattctcatagcataattccaaatttctttgtgaacaaaatcccacccaatcgctgtcgttcgacaccgtcaacggcggccgcgcgctcacgtcccggcggccacgggccgtgacagactcgagcccgtccgccgccttcgccgcgccgcctccgcctcctccatcgcacgccgactccgctgcctccatccgcgcacgtccgcctccactgtctccatccgctcgggagccgccgccctccgcgctaggcctcgcctccgtctggtctggattcttcgacatctctgggcgctccgcgtcgccgacttctcgcaggcggagagtgagcatccttgatagacctgatggctatcgcagagagctgtgttgatgcggtggtcatggagatggtggcagtctactgcggtggcctctacaccgccaaaccagagcttgctgcccgccgcatcgaggccatcggcttccaagtcgggcaccagctctctgagagatataccatggagcgccctcgatttagtgatcatcttgaagcaatcaagtttatctgcaaagatttttggtcagagctgttcaagaagcagattgacaatctgaaaacaaatcacaggggtacctttgtccttcaagataaccgttttcggtggcttactcgtgtttctctagatccacgtacagagaacacagattcaactgaaaatgattctgcagcattgggtgatactgcagcccaaacgactaccatgcttctgtatttcccatgcgggttgataagaggtgccttgaccaacttaggaatttcgtgttctgtctctgctgacatgtcaaaccttccagcatgttcgtttgtggtgcgcataaagacatgaactgtgaggaatgatacaagtacagtacgaagattcgacagtatctgcttgtggttcaagccgggttgaacattgaagatagcagagtttgggcatgcattagatgtattgtggtactgcagaaatattctgtgtagctgttggtttctgtttccgtttcttccagcagttacctgttttcactacctcaattgtttccccacctcttcgtgaccgtattccagagtttaggttggccattcctgcactctaggtagccgccactggcaccatttgtgagagttaaactatggttgttggttgcattatctctgtggcctgtgatagcacccttaaagcatgattcttgccatgattcgtgtgctagtactcttctaagcatgatttttgctaccatgattaattgattgtgaagtgcaaattgaataa

SEQ ID NO: 1610 - DNA, 1521 bp, Sorghum bicolor
gtaaaatattttgtaactaaacaaggcctgagttgctccgaactcgaaaatcaactttttcggccagcagggggcgagccgcttctgctggccttttctcccacccgcgccagcgcccatccgcccacgcccgcacggccgcacggcacctccctccgccgcccccatcctccttccgcccgtgagcagcaggcgagcccaagaaactgcagtagacggcaggcacccacgcaaatcaaacgtgctcaccttcgcgagtcgtcgtcactcctgcgtccggccatcggtcacctccgccgcccttgacttcgccggatcgacgccgtacgccttaaatcgagccgtctctgagcagatcgacacgacatcatcgataaacctgatggctatcgcggagagctgtgttgatgcggtggttatggagatggtggctgtctactgcggtggcctctacgccgccaagcctgagcttgctgcccgccgcattgaggccatcggcttccaggtcgggcaccagctctctgagagatataccatggagcgccctcgatttacgtgatcatcttgaagcaatcaaatttatctgcaaagacttttggtcggagctgttcaagaaacagattgacaatctgaaaacaaatcataggggtacctttgtccttcaagataaccgttttcggtggcttactcgtgtttctctagatccatatacagagaacacagactcaactgaaaatgattctgcagcattgggtgatactgcagcccaaacaacaaccatgcttctgtatttcccatgcgggttgataagaggtgccttgaccaacttaggaattccgtgttctgtctctgctgacatgtcaaaccttccagcatgttcgttcgtggtgcgcataaagacatgaactgtgagaaatgatacaagtacagtatgaagatctgacagtacctgcttgtggttcaagcgggttgaacattgaaaacaacagagtttgggcatgcattagatgtatcgtggtactgcattttagcctgggaaatacgctgtggagctgttgatttctgtttacttttcctccagcaattacctcatttcactatctcaaaattattttcccaccttctattcatgaccatatttccagagttaggtttgttattactgcactgtaggtagccaccactggcaccattgtgagagataactatggttgttggttgtattaggttgtatccctgtggcctgtgtttggttacctggctttatgagctagaactcttcttaaagcatgtttcttgccatggttcgtgggctagcactctaactaataaagcatgattgttgccatggcttgcgatctcgggtatagcgggcagcgctcttatatttgcaacaagttcagtaggccgtaaatttttgttgccccattctttcaacagacatgatcttgctgtgaagttcgataacaagctaaagttatgtgttgtcttcagggtaattaatatagagttgaatcggtc

SEQ ID NO: 1611 - DNA, 1318 bp, Zea mays
aaacaccacttcttaccgattagtagaaaaaaaaactcctcggccccagcattttcgtgcaaggggcgagccgccagctactgctggccttttccctcacacaagtcacacgcacacccgctagcccccgtcccccgtcccgcccgtaccttcctccgccgcctccgtcctcgttccaaccgtgggcagcaggcaggcccaagtatctgcagtagattggtggagaggaagaagacggcaggcacccacgcagatcaaacgtgctccgccacccttggtttcggcgaatcggcgccgtacgccgtaaatcgagccgtctccgagcagatcgacgcgctgcatagcaattcgacccgtctccggccaaatcgacgtccagagctgcaaattgacccatctccgcgctgacctccgcttgtgcctgccgaggagcgccgaagttacgcccttctcgtgaagacatccttgataaacctgatggctatcgcggagagctgtgttgatgcggtggtcatggagatggtggctgtctactgcggtggcctctatgccgccaagccagagcttgctgcccgccgcattgaggccatcggctttcaggttgggcaccagctctctgagagatataccatggagcgtccacgatttagtgatcatcttgaagcaatcaaatttatctgcaaagacttctggtcagagctgttcaagaaacagattgacaatctgaaaacaaatcataggggtacctttgtccttcaagataaccgttttcggtggcttactcgtgtttctctagatccatatacagagaacagagattcaactgaaaatgattctgcagcattgggtgatacagcagcccaaacaactaccatgcttctgtatttcccatgtggattgataagaggtgccttgactaacttaggaattccgtgttctgtctctgctgacatgtcaaaccttccagcatgttcgtttgtggtgcgcataaagacatgaactgtgagaaacgatacaagtacagcatgaagatctgacagtacctgcttctggttcaagcgggttgaacattgaagacagcagtatttgggcatgcattagatgtatcgtggtactgcatttagccccgtttgttttttgttttcttttcctccaggaattacttgttttcactatctcaaaatgactttcccgcaacctcctcatgagagcatgtacaaccccatttaagggctaagtgaaaaaatacaaaatacgggctcttcgcgaagaatccgtcttatcatgactttctatacacgtcttttagctgtattta

SEQ ID NO: 1612 - DNA, 1118 bp, Brachypodium distachyon
tttcctatccgacggacattcacctaacaaaccaaaaacgaaccttgctgaacatctcgggcttttcggctccaaccccctaggaggccctagcgagatctctcgctcggagcaaacgaggagtctggggaagaggagagctgctaggggatgggccgggaggtggcggggagctgcctagacggggtggtgatggagatggtgtccgcctactgcggccgcttctatgccgccaagccggagcttgccgccggccgcatcgaggccattggcttccaggtcggccaccagctctccgagagatatacaatggaccgccctcgatttactgatcatctggaagcaatcaaatttatctgcaaagatttttggtcagagctattcaagaaacaaattgataatttgaagactaatcacaggggtacctttgttcttcaagataactgtttcccatggctaactcatgtttctctagacccatctatggaaagcacagatgcaactgagagtgaccctgcattattaggtgatactgcagcccaaacaacaagcatgcttttgtatttcccatgcgggatcatcagaggggccttgaccaacttgggaattccatgtgctgtctctgcagacatgtcaaaccttccagcatgttcttttgttgtgcgcatcaaaacctgaactatgagttgatacaagcataatatgtacctgctaattgggtttacatttacttgaacagaagtggccaggtatggttatgtgatccatgattatgatcccaagagatgatgaagtacaatattatttccgtagctatctggttttcttagctgtaaaaacattttctgtattttatttgtggttacttagtcaccttaacagttgactctttttacaataagatcattgtttatgtctagactgttttaagctggcaaaattaccatataaaatgagagctgaattctatggtgccagaggcaaaagaaattttgataaaaaaacagaagcaaatgggaaattaggatttttcactagattcattgtaataggggatttgaccaatgaaaaggccgtgccactgtcatctgcgcgttccattttctcaattttggctt

SEQ ID NO: 1613 - DNA, 1038 bp, Elaeis guineensis
gagggacccggtgcgagaggcaagcgaccgagaccgaaagagcgagagggagaagggggcttggaggtgtcggagatggggagggaggtggcggagagctgcgttgatggcgtggtcatggagatggtgtcggcgtactgcaaccgcttctactcgtcccagcccgagctcgccgcccgccggatcgaggccatcggcttccaggtcggtcaccagctctccgaaagatatacaatggagcgccctaggtttactgatcatctggaagccatcaagttcatctgcaaggatttctggtcagagctattcaagaaacaaattgataacttgaaaactaatcacaggggtacttttgtgctgcaagataaccagtttcggtggcttactcgcatatcaattgatgcatcaccagacaatgtggacgcatctccgcaggatgactcattgccagctcctaataacgcagctcaattcacaagcatgcatctctacttcccatgtggaatcataaggggggcacttaccaacttaggaattccatgtgctgtttctgctgacatatccaaccttcctgcatgttcatttgtggtacgtataaaagcttaaggtatgctttgtttggagcagatatatggtggaagggccgctccaaggcattcagaagaactatatgtcaaagttgtttccatttaaatcatttgacttgaatccatgtaatttgtcttatttcgtgcgatagatgttgtggtcacaattagaaactgtcggtcttattttctttaatatcagcaatattttgtttggtttgaaaattgtaacattggcgttagattgagatgcatatttttgagtctatggatgcaaatactgaactgtaaacagttacgtttcttctagtttggcttcttggctcacctccgactagaacatccgcgaggctattgcctattgccatggttattacttgtaaccagcccttggattgcataggcaatcaagtcaaggcttggaatgttttccagaaattttatcttcaac

SEQ ID NO: 1614 - DNA, 1370 bp, Aristolochia fimbriata
tgcagaggaagcagaagagagatcgttgaactcgttgtactcttgcttataagaacagaaaggaaaagctgaaattttggggagaatggggagggaagtggctgaaagttgtgtggacagcgtggtcatagaaatggtctctgcctactgctcacgcctttactccacccaccctgaaatcgcggcccgaagaattgaggcaattgggtttcaggtcggacaccagctctctgaacggtatacaatggagcgccctcggtttagtgatcatttagaggcaatcaagtttatttgcaaggatttctggtccgagcttttcaaaaagcaggttgacaacctcaaaaccaatcacagaggcacttttgtattgcaagacaataggttccgatggttgactcgggtgtcttacgatccaactccagcaaactcagatgtatctcctgcctctgacccttcacaagttgttgataaggctgctcaagcaactagtatgcatttatacttcccctgtgggatcattagaggagcactgactaatttggggattccttgtgctgtatctgcagacatatcaaacctccctgcatgttcctttgtagttcgcataaaagtttgattgctggatgctgacgatgaaaacgagtgagagagaggtgttttctcagttccaatcattcatgtaagctaaggttgtgttgttgcatgagacagaatagatccttgttttacaatgattagccaaagtttttgggtgcatttgatgaaccatgtctttctcatcgaggactacttgccactggacctggaacttctatttggatacccagccgcagtagtgagactgaaactttaacgtggaccctttcatttccatccatgtctactttaatcagccgaagtagtgaattgaagcagctgagttgggtttctagggcggggtaaaaaaatgttctatgattgtagcatgatctcacagggtcaaaaaatgttcttagattgttgtacaaggttgggattgcaagagaggtttggactgtgattgtaaactgggttgggtcaaagagggttgagtttgtgtggtgggttgggtttggtttgtgggttggaccgggtttataggatggtgttgagctagtacggcaggttgggtttgttgggtgtgtctatgagacatgtgtctatgagacacatttgcccggtgcttaccgtgctttagagggggagattaagtttctaggttgaggttgtaggggatgggtcaaaagtttttctttcccttattacatgagttttggggctagtaattataaaacttacaagaagaacgcaatttctttttgtaagttttataattactagccccaaaactc

SEQ ID NO: 1615 - DNA, 1102 bp, Cucumis melo
gtcgtcctttagtagttgaatctagactgagggcggaatcaaggcagtgactcgatcgatcttctctcattctccatcttgttcttgatttccttcccaattctatcgaattgagcttcttcagctttctacaattccactttggtcgaaggtaaaaacacatggggagagaggtagcagagagttgcgttgacagtctattgacggaaatggtttccacttattgccatcgattctacgccaataagccggagctagccgcccgtcggatcgaggcaattggttatcaggttggccatcagctctccgaacggtatacgatggagcggcctcggttcactgatcatcttgaagcaatcaaatttatctgcaaggacttctggtctgaactcttcaaaaagcaaatagacaacttgaaaacaaatcatagaggcacctttgtcttgcaagataatcgattccgctggcttactcgcatgtcggtggatcctcaaaatgaatcacaagataattctgcagatggtgaaaacaaggcagctcaagcaacaagcatgcatctatatttcccatgcggaatcattagaggtgctctttcaaatttgggaattccttgtgcggtttctgctgatatttcaaatcttccagcatgttcatttgttgttcgtataaaggcctgatgagaagtgtatcaaaaagtagagattttatctttgggatatgaagacatgatagatccttaacaccactctccagttgcaatcctttctgtcctgtttccttttttgctttctctattcctctatcttctcctagttcatgaaactcttagcacaaaaatctgttggacaaacgtttgtgtatgtatgaaagtcaatagcgatttcttttcagaatttcatgactgtagagatagttgaggtttattttatattttaccatttgggaggattgattcatatgctatgaatctgtaatgatcacctatctggattgttaaggttctatgggtttcgagatgattaaaatattgtagggttgatcattcatgagattgttgtagacatgtgtaaacctatctaaacagttatggagacaaaaaaaa

SEQ ID NO: 1616 - DNA, 914 bp, Cucumis sativus
aaggcagtgacccaatcgatcttctctcatcctccatcttgtttttgatttccttcccaattccgtcgaagtgagcttcttcagctttctacaattccactttgatcgaaggtaaaaacacatggggagagaggtagcagagagttgcgttgacagtcttttgacggaaatggtttccacttattgccatcgattctacgccaataagccggagctagccgcccgtcgcatcgaggcaattggttatcaggttggccatcagctctccgaacggtatacgatggagcggcctcggttcacggatcatcttgaagcaatcaaatttatctgcaaggacttctggtccgaactcttcaaaaagcaaatagacaacttgaaaacaaatcataggggcacctttgtcttgcaagataatcgattccgctggcttactcgcatgtcggtggatcctcaaaatgaatcacaagataattctgcagatggtgaaaacaaggtagctcaagcaacaagcatgcatctatatttcccatgcggaatcataagaggtgctctttcaaatttgggaattccttgtgcggtttctgctgatatttcaaatcttccagcatgttcatttgttgttcgtataaaggcctgatgagaagtgtatcaaaaagtagagattttatctttgggatatgaagacttggtagatccttaacaccaccctccagttgcaatcctttctgttttgtttccttttctgctttctttattcctctatcttctcctagttcacaaaactcttagcacaaaaatctgttggacaaacgtttgttgtatgaaagtcaatagcgaatacttttcagaatttcatgattgtagagatacattgaggtttattttatattataccatttgggaggattggttca

SEQ ID NO: 1617 - DNA, 2988 bp, Sorghum bicolor
acgtaaaaaacccgggacgggacgggacggagccgggaggagacgtttttcaccgcggcgcgggggcaggcaggaaggacgcaggcaggaaaacagacaggaggccgcataaaacgcagcctcccgcggatcccccccagttttcccttccttcttctttccttccttatttctcgtctcacactcgcagttcccccccttctctctccctctcctcctctgtgtggcctcgccgcggaggagccaccaaggaaggaggaggacccgaggccgaggagcgagcgagcgagcgccgagccgccgggcctcggaagcatcgaccgaccgacggcagcggcagcggcagcggtgccatgaggctgctcgtccccgacggcgcgcgccggcagcggctgctccagtgcgaggcgcgggccccgtcgcccgcgccgccctccccgtcgccgtccacgtcgctggccaggacggtcgtggtggggatcaggcgcgacgccgccagccgcgagctgctcacctgggcgctcgtcaaggtcgccaatgcaggcgaccgcgtcgtcgcgctccacgtcgccaccgccgacgccgacggattgctcgtggggctggacgagcggagcagggccgcggactcgctcgcctccgtgctcgccgtctacgacggcttctgcaacctcaagcagattaatttggagctcaaggtctgtggaggatcatctatccggaaaactctggtcaaagaagcagctgcttgtggcgcagcacatctcatccttggtgtcgcgaacaattcccggtcctttggatcctccttcacatcagttgccaagtactgctcaaagagagttccagccagctgctcggtccttgcagtgaacaatggcaaagtcgtttaccataaagatgccggtcacggattgcaacacgaactgtaccaaagcactagcgcaatacctgagacaccaaggaggagctaccggaagctcttgtcgagcatgataggggacaaactctgggatgagaatggaaaggacaaaaggtgcatgtctcgtgccatcaccatgccaatgaggtctccagcgcggccaaaagaagtttcactagcattggtcccggtgaagggttgccggcacgaatcgccagaagtagcaactggctggcccctcctaaggaagaagttcttgccagaccggaaagcttccgtgcctgacaagtcgaagatgtctgtggtgcagtgggcaatgcggctcccaggcaggtattcagctgtatcaccagtccattcagagtacagaaccacaagaccagactccacgagcgccagtcatgtcctccgtgaccgtgtggttgttccctcgaggagcaattcagggaagtcttgtgtagtgatcgaagaattggagaaggaaactccagaggaactgaccttgctcaaagagaagttctcatccatttattcttcattcagttacagtgagcttgcaaagatcacctctgatttctcgcaagagtgtgtagttggacaaggaggcactagtcaagtttatagaggctgtttggcaaatggcaaggagctagcagtgaagatcctgaagtattctgatgaggtactgaaggagtttgtgacagagattgagattctcagttctctcaaccacaagaatgtgatatccctcgttggtttctgcttcaagaatgatgaccttctgttagtgtatgagtacttgcaaagaggcagcctcgaagagatactgcatggtgaaaaagaatgcaagagcatatttggttggactgagaggttcagcgtggctgtgggagttgctcatgctctggattatctgcatagtgataacaacagtcgcccagtgatccatagggatgtcaagtcatcaaatattctcatctcagaatgctttgaaccaaagttatcggactttggtctcgcagtctgggctgctgatgtaacttcccagatgacatgcaatgatgttgcaggaacttttggatacttagctcctgaatacttcatgcatggcaaggtgaacaacaaaattgatgtgtatgcttttggtgttgtccttctggagctcatctctggcaggaaaccgctttgcactggttgtccaaaagggcaggagagcctagtgatgtgggcaaattccatcgtacaagaaggaaagctcacacaacttgtagatccgaacttgcccactgaaggccataccgatgaagttgagaggatgacccttgctgcgtccctctgcatcagacaagcacctcagagccgtcctgaaattgatgttgttctgaagcttctggaaggtgacaacgatatcctcaagtgggcaagatcacaagtcgggttgtcatgcgagagcagcgacagcgacgaatttgtgatgacaccgccagcgccgaggagcaatgccaacatccagtcctacatcaacctcgcatttgatgtcgacgacgactccgcctctgtcagcagtaacgacttcattgcagccaacacctccttggaagagtatctgaagggaagatggagccgatcatcgagctttgactgaccgatacatggcagagttaccccttattagtgtatagatctttttcttttcttcttctaatttaagtctcaattttgcgccttggatgagagttggcacatgcaatgccctccaccaggaaatcctttgattatgtcttagttctttttttttttcgttttcttttgggggtctgtcttactctctgaagagacaccctgttgttttactgtctgaagagactcatcatacccaggtagtctcatccaaagggatggcaaataaagtaggaattatatgaaatgaaactgtgggtttctttccacacccaaatcaatcatctttgttctgtacaaagtgtccttgttcaagactatggtttatcaaggaaaaatagattgtttgtgtgcctgctgtgaaaagtgaattttgccagcgtttt

SEQ ID NO: 1618 - DNA, 2892 bp, Zea mays
atatatttaattagatagtgattaatcagttgcggtatgcgttagctacggagaaaaaaataccgagttgcagaggtgttggatcgaagcaaggtagcggcaggcgcaaccgggctggagacgagcagaaaagaaaagaaaaaaagccgcgagcagacagcagacaggaaacgggaccggacgggacgtttttcaccgcaggggaggaggcaggagggcccaacgtcaaagaaacaggaggccgcataaaacgcagcctcccgcggatccccctacttttctttcttctttctcatctcagttgcagttcccctctctctcctctgccgtagcgaggcaggcaagccaccaagtccgagcctcggaggcatcgaccaacgccggcggcagcggcgccatgaggctgctcgtccccgacggcgcgcgccgccagcggttgctccagtgcgaggcgcccccgtcgccctcgccgccttccccgtccccgtacccgtcgtcgtccccgtccaggacggtcgtggtggggatcaggcgcgacgccgccagccgcgagctgctcacctgggcgctcgtcaaggtcgccaatgctggggaccgcgtcgtcgcactccacgtcgccaccgcggccgccgccgacggtttgctcgtgagactggatgagcgcagcagggccgcggactcgctcgcctccgtgctcgccgtctacgacggtttctgcaacctcaagcagattaatttggagctcaaggtctgtggagggtcatctatccggaaaactctggttaaagaagcagctgcttgtggcgcagcacatctcatccttggtgtcacgaacaattcccggtccttcggatcctccttgacatcagttgccaagtactgctcaaagagagttccagccagctgctcggttcttgcagtgaacaatggcaaagtcgtttatcataaagatgctggtcacgggttgcaacatgaactgtaccaaagcaataccacgatacctgagacaccaaggaggagctaccggaagctcttgtcgaccatgataggggataaactctgggatgagaatggaaaagacagaaggtgtgtgtctcgtgccgtcaccatgccaatgaggtctcccgcacggccaaaagaattttcactggcattagtcccggtgaagggttgccaacacgaatcgccagcggtagcaactggctggcccctacttaggaagaagttcttgccagaccggaaagcttctgcgcctgacaagtccaagatgtctgtggtgcagtgggcaatgcggctcccaagcaggtattcagcagtatcgccagtccattcagaatacagaaccacaaaaccggactccacgagcgccagccatatcctccgtgaccgtgtgattgttccctcaaggagcaattctggaaagtcttgtgtagtgattgaagaattggagaaggaaactccagaggaactgacgttgctcaaagagaaattctcatccatttattcttcattcagttacagtgaacttgcaaagatcacctctgacttctcaccagagtgtgtagttggacaaggaggcactagtcaagtttacagaggctgtttggcaaatggcaaggagctagcagtgaagatcctgaagtattctgatgaggtactgaaggagtttgtatcagagattgagattgtcagttctctcagccacaagaatgtgatatccctcgttggtttctgcttcaagaatgatgaccttctgttagtgtatgagtatttgcaacgaggcagcctggaagagatactgcatggtaaaaaagaatgcaagagcatatttggttggactgagaggttcagcgtggctatgggagttgctcgtgctctggattatctccatagtgataacaacagtcgtccagtgatccatagggatgtcaagtcatcaaatatcctcatttcaaaatgctttgaaccaaagttatcggactttggtctcgcagtctgggctgctgatgtgacatctcagatgacatgcaatgatgttgcaggaactttcggatacttggctcctgaatacttcatgcatggcaaggtgggcaacaaaatcgatgtgtatgctttcggtgttgtacttctggagctcatctctggcaggaaaccactttgcactggttgtccaaaagggcaggagagcctagtgatgtgggcaaattccatcatacagggaggaaagctcagacaacttgtagatccaaacttgcccactgaaggccatgtcgatgaagttgagaggatgacccttgctgcgtccctctgcatcagacaaacacctcagaaccgtcctgaaattgatgctgttctgaagcttctccacggtgacaatgataccctcaagtgggcaagatcacaagtcgggttgtcatgcgagagcagcgatatcgatgaatttgtgatgacaccgccagcgccgaggagtaacaccaacatccagtcctacatcaacctcgcctttgatgtcgatgacgactcagcctctgtcagcagcaacgacttcattgcagccaacacctccttggaagagtatctgaagggaagatggagccggtcgtcgagctttgactgacggacccatggtcagagttaaccctttattagtgtatagatcgttcttgttcttcttctaatttaagtttcaattttgcgccttggatgagagttggcacctgcaatgccctccaccaggaaatcctttgattatgtcttagttatttttttccttttcttttgggggtccctcttactctctgaagaggcaccctgttgttttactgtctgaagagacttatcatactcaggtagtctcatccaaagaggtgacaaataaagtcgggatcatac

SEQ ID NO: 1619 - DNA, 2204 bp, Pennisetum glaucum
attaatttggagctcaagatctgcggaggatcgtcaattcgcaaaactctggtcaaagaagcagcttcctgtggcgccgcccatctcatcctcggtgttgcccagaattcccggtcttttggatcctcttccacatcagttgccaagtactgctcaaagagagttccggtgggctgctcggtccttgcagtgaacaacggcaaagttgtttaccataaagacgggggccatgggatgcaacatgaactgtaccaaagcacaatacctgagactccaaggaggagctaccggaagctcttgtcatccatgataggagagaagctttgggatgaacatggaaaggacagcaggtctatttctcgtgccgtcaccatgccaatgaggcctcccccctcatccatgcccatgaggtctcccgcacgatcaaaagaagctgcactagcattggttccggtgaaagcttgccggcgcgaatcagcagaagtagcaactggatggcccctcttgaggaagaagttcttgccagaccggaaagcttccctgcctgacaagtccaaaatgtccgtggtgcagtgggcgatgcggctaccgagtaggtattctggagtttcaccagtccattcggaatgcagaaccacaagaccagactccttgagtaccagtcatattctccgtgaccggttggttgttcctttgaggagcaattcaggaaaatcttcagtagtaatcgaagaattggacaaggaaactccagaggaactgaccttgctgaaagagaaattctcatcaatttattcttccttcagttacagtgaacttgcaaagatcacctcagatttctcaccagagtgtgtagttggacaaggtggcaccagtcaagtttatagaggctgtttggcagatggcagagagctagcagtgaagatcctgaagtattctgatgaggtgctgaaggagtttgtctcagagattgagattgtcagctctcttaggcacaagaatgtcatttccctcgttggtttctgtttcaagaatgatgaccttctgttagtgtacgagtacttgcaaagaggcagtctggaagagatactgcatggtgaaaaagaatgcaaaaacaaatttggttggactgagagattcagcgtggccgtcggagttgctcatgctctggattacctccatggtaatgacaacagtcgtccagttatccatagggatgtcaagtcatcaaacatcctcatctcagagtgctttgagccaaagttatcggattttggtctcgcagtctgggctgctgatgtgacatctcaaatgtcatgcaatgatgttgcaggaacttttggatacttagctcctgaatacttcatgcatggtaaggtgaacaacaaaattgatgtgtatgcttttggcgtcgtccttcttgagctcatctcgggcaagaaaccactctgcaatggttgtccaaaagggcaggagagcctagtgatgtgggcaaattccatcatacaaggagggaagctcacacaacttgtagatcccaacttacgtactgaaggccataccaatgaagttgagaggatgacccttgctgcttccctctgcattagacaagcacctcagaaccgtcctcaaattgatgctgttctgaagcttctcgaaggggacaacgatattctcaagtgggcacgatcgcaagtcggactagcatacgaggtcgatggcgatgaatgtgtgatgacaccaccagcaccagggagcaacgccaacatccagtcctacatcaacttagcattcgatgtggatgatgacgccgcttctgtcagtagcaccgacttcatcgcggccaacacctccttggaagagtatctgaagggaagatggagcaggtcgtcaagcttcgactgacagatccctggcagagtcacccccttgttagtgtatagatcttttctctaactttaagttacctatttttgcgccttggatgagagttggcacatacaaatgccctccaccaggaatttcatttgatgacgtatggcttaggtttttttatgtggggtctttttcctctctaaaaggaccccctttttactgtctgatgaagagacttgtcatacccaggtattctcatccaaagggttgagaaataaagtgtaggaggcatatgaaattgtgggtttcttcccataccaaaataaatc

SEQ ID NO: 1620 - DNA, 2744 bp, Panicum virgatum
ccgcataaaacgcagcctcctcccgcggatccccccatttcgcagttccagctctctctctctctcaaaccaagaacaagcgagcgacctcgggctcggggggcgcgcgcacgcccgccatgaggctgctcgtcccggacggcgcgcggcgccagcggctgctgcagtgcgaggcgcgcgcgccgccgcccccgcgccgccggcggcggcggggggaggaggaggaggaggagggaggacggtggtggtggggatcaggcgggacgccgccagccgggagctgctcacctgggcgctcgtcaaggtcgccaatgccggggatcgcgtcgtcgcgctccacgtcgccgccacgtcgccgccgccgccgacggattgctcatggggctggatgagcggagcagggccgcggattcgctctcgtcggtgctcgccatctacgacggtttctgcaacctcaagcagattaatttggagctcaaggtctgcggaggatcatctattcgcaaaactctggtcaaagaagcagcttcctgtggcgctgcacatctcatcctcggtgttgccaagaattccaggtccttcggatcctcctccacatcagttgccaagtactgctcaaagagagtcccggcaggctgctcggttcttgcagtgaacaatggtaaagttgtttaccataaagatgcgggccatgggatgctacctgaattataccaaagcacaatacctgagacaccaaggaggagctaccggaagctcttgtcgtccatgattggggagaaactttgggaggaacatggaaaggacaacaggtccatttctcgtgccatcaccatgccaatgaggtctcccgcgttgccaaaagaagtttcactagcattggttccggtgaagggttgccggcgcgaatcacaagaagtagcaactggctggcctctcctgaggaagaagttcttgccagaccggaaagcttccctgcctgacaagtcaaagatgtctgtggtgcagtgggcgatgcggctgccgagtaggtattcagcagtttcaccagtccattcggaatgcaacagaaccacaagaccagactccatgagtaccagtcatattcttcgtgaccgggtggttgtcccattgaggagcaattcaggaaagtcttctgtagtaatcgaagaattggagaaggaaactccagaggaactgaccttgctcaaagagaaattcccatccatttattcttccttcagttacagagagctggcaaagatcacctctaatttctcaacagagtgtgtaattggagaaggtggtactagtcatgtttacagaggctgtttggcaaatggcagggagttagcagtgaagatcctgaagtattctgatgaggtactcaaggagtttgtatcagagattgagattgttagttctctcagacacaagaatgtgatatccctgatcagtttctgcttcgagaatgatgaccttctgttagtgtacgagtacctgcaaagaggcagcctggaagagatactgcatggtgaaaaaggatgcaagaatatatttggttggactgagaggttcagtgtggctgtgggagttgctcatgctctggattatctccacggtaatgacaacagtcatcaggtgatccatagagatgtcaagtcatcaaacatcctcatctcggactgctttgagccaaagttatcggactttggtctcgcagtctgggctgctgacgtgacatctcagatgacatgcaatgatgttgcaggaacttttggatacttggctcccgaatacttcatgcatggcaaggtgaacaacaaaattgatgtgtatgcttttggtgtcgtccttcttgagctcatctcgggcaggaaaccactttgcactggttgtccgaaagggcaggagagcctggtgatgtgggcaaattccatcatacaaggaggaaagctcgcacaacttgtagatcccaacttacctactgaaggccgctctgatgaagttgagaggatgacccttgctgcttccctctgcatcagacaagcacctcagaaccgtcctcaaattgatgttgttctgaagcttctcaaaggcgacattgatatactcaagtgggcacgatcacaagtcggactgtcatacgaggttgacgctgatgaatgtgtgatgacaccaccagtaaaagggagtaacgccaacatccaatcctacatcaacctcgcattcgatgtggatgacgactctgcctctgtcaccagcaccgacttcatcgcagccaacacttccttggaagagtatctgaagggaagatggagccggtcctcgagctttgactgacagatccatggcggagctatcccttgatagtgtatagatcccttcttttatttaagttgcattacatttttgcgccttggatgtgagttggcacatgcgatgccctccaccaggaatttcatttgatcatatatggcttagttactgctttttttatgtggggtcttttttccctctccgatgggaccctttttactgtctgaagagtgaacagactcgtcatacccagttattctcatccaaagggttgagaaataaagtaggaggcatatgaaattgtgggtttcttcccgcaccgaaatgtataatctttgttctatatacactgctcgcacctcagggttagatgttaaaagtaatcatctgtatgcctgctctgaacaaaaaaaggaactctgcca

SEQ ID NO: 1621 - DNA, 2241 bp, Panicum virgatum
agacaaaaaaggaaatgaaatgaaacacatgctgggccgatttctcccggcgcctctgtagtctgtacagcccagcccacccaatgagcccgcgaggaaatggagcaggggaaacaaaatctcgtcatctccctcgattccttcctctccagcacgagcccgaagcgacgatgatttccctgcttcgccgcgccctcgccccctccccgccgccggccgcctcgcggtggcggcggaccctcctcgcggcgctcctctccccgccgccggcccctcccggccccgtgcgccgcgcgccggcgcaggagccgccgcggcggtcgttccgcggcacgccgagcccgctgtggttcagggccaccgcagcctcgtgggctgggtctggactggacgcgggcgtggcgtcgggggaggacggcgggctggagatcgcgaagctgggcatctccgggcggatcgtggagaagctcgccgcgcggggcatcaccaggctcttccccatccagagggctgttcttgagccagcaatgcaaggaaaagacatgattggccgtgctcgaacaggaactgggaagaccttggcttttggtattcctattatggacaggattattagctacaatgagaagaatggaagcagtaggaatcctttagccatagtcttggcgccaacaagagaacttgctcggcaggttgagaaggaatttagagaatctgctccgttggacactctctgtgtctatggaggtgttcctatcaatcagcaaatcagagttcttaactatggtgttgacatagtggttgggactccaggtcgaattattgatcttttgagaagaggtgttttaaacctttcagagatccagtttttggtactagatgaagctgatcagatgctggctgtgggtttcgatgaagatgttgaggtgatcatggagcagttgccacagaaccgtcagagtatgctgttctctgcaacaatgcctagttggataagaaaaatttcaaacaagtacttaaaggatccagttataattgaccttgttggtgactcagaccagaaattgccagaaggaatctctctctattccattgcctctgacaactttgggaagccatcacttcttggtccattgattaaagagcatgctaagggtggaaaatgcattgtgtttactcagactaaacgagaagcagatagattggcatatgctatgggcaggagttatccatgtcaggcgctacatggggatatttcacagaatcaaagagagaggacactctcaggatttcgcgatggccgcttcaatatccttgtggcaactgatgttgcagctcgtggattagacattcccaatgttgatctggtggtacattatgagattccaaatacctcagagttgtttgttcacagatctgggagaactgcacgagcagggaagaaaggcagtgcaattttgatatatacatatgagcaaactagagctgtaagggtcattgagcaagatataggatgcaggttcacagagcttccaaagatggcagttgcagatgaggctgcagacatgtttaatgtcatgagagatactcgctctagatcagttggaagcagaagaacgggtgggtcttttggccgtgaaagttatggtggcttcggaaatcaccgctccagagcctttggtgattttgacagttttggtggttcgtttgatcgtggtggtgggttcagcgactctggttcgagatatcgtggtgggtctggaggtttcagaagaccttccaatgagtttggcaggtctagttttggtcgttctgatagatttggcgacttcggagaaggggatttcagcaggcacgacagctctgactttggccgttcccggagctccgatgatccaggctcctcacgttatggcagaggatccggtggctttggcgcttcagatttcggcaacttcggcggcttcaaggattccaagcgatgagtggaatattggttttcttgtacagttctgaaccttttctaactcctgttgttccttccatgcctgagagaacaagataccggttttgttgcgcttgtcacctaatcacgagtagtttggttgtgtagggtttgcttcagaacaaatgttgtagttgtaatttgtttatgtgcctactgacaactgtatgttttgatcccgttctcgttaataaatctgataaaactaaacccttttttggtttctgttaatgtac

SEQ ID NO: 1622 - DNA, 2191 bp, Sorghum bicolor
ccttccaggtctccccgacgtcgaggttttagctccaccacgagctcccactgaccgccaccgccgcgatgatctccctgctccgccgcgcactcgcctcgtctccggccgccacctgccggaggcccctcctcgccgcgctcctctctccgccatcggcacctcccggcccatgccaggcgcccacgccagggtcgccggcgccgccgaggcgggcgctccacggctcgccgaaccccctggggttcaggtccacccccgcgtcgtggaccaggcccggaccgggggaaggcgtgggcgtggatacgggggctgaggaggggctggagatcgcgaggctgtggatctcgccgcggatcgtggagaagctcgcggcgcggggcatcaccaagctcttccccatccagagggctgttcttgagccagcaatgcaaggaaaagacatgattggccgtgctcgaacagggacagggaagaccttggcttttggtattcctatcatggacaagatcctcagtcacaacgagaagaatggtaacggtaggaatcctttagccatagtcttggctccaacaagagaacttgctcggcaggttgagaaggaatttagagaatctgctcccttggacaccctctgtgtctatggaggtgtgcctatcaatcagcaaatgagagttctcaactatggtgttgacatagtggtcggaactccaggtcgtattattgatcttctcagaaggggtgttttaaacctttcacaaatccagtttgtggttctagatgaagctgatcagatgctggctgtgggtttcgatgaagatgttgaggtgatcatggagcagttgccgcagaaccgtcaaagtatgctgttctctgcaacaatgcctagttggataagaaagatttcgaacaagtacttaaatgatccagttataattgaccttgttggtgactcagaccagaaattacctgaaggaatctctctctattccattgcctctgataacttcgggaagcaatcaattcttggtcctttgattaaagagcatgccaatggtggaaaatgcattgtgtttactcaaactaaacgggatgcagatagattggcatatgtcatgggaaggagttatccatgtcaggcactacatggggatatttcacagaatcaaagagagaggacactctcaggatttcgtgatggtcgttttaatatccttgtggcaactgatgtcgcagctcgtggattggacatacccaatgttgatctagtggtacattatgagattccaaatacctcggagttatttgttcacagatctgggagaactgcacgagcagggaagaaaggcagtgcaattttaatatacacatatgagcagactagagctgtaagggtcatcgagcaagatataggatgcaggttcacagagcttcccaagatgccagtttcagatgaggctgcagacatgtttaatgtcacgagagatactcgctctagatcagctggaagcagaagaacgggcggaccttttagccgtgaaggttatggtggctttggagaccatcgttccagcagttttggtgattttggtggttcctctgaccgcagtggtggattccgtgactcaggttcaaggtaccgcggtggatctggaggtttgagacgatcgtccagtgagttaggcaggcctagtttcagtcgttctgatagatttggcgactttggagacagtgacttcagcagacgtggtaacactgactttggtcgttcccggagctctgatgattcaggctcctcacgttatggcagaggttctagtgggttcggcacttcaggttccggcaaccttggtggcttcaaggattccaagcgatgaatgggataggggtttcttgtacagctctgagccttttctaacacccgttgtttcttccttgcctgagcaaaccagcagcagcacttcattgtgctttagcccctgatcaggagtagtttggtcgtgtagtgtagggttgtttcagaacttttgttctttgaagcaaggttgtttcgtaacctgtatcactgtatgttgatatgttctgattctgttctctttaataatccgatgaaaggatggcttttggtttcttttcatgtaccgtaccagtgtattgcttgtagagttgttccatgatctcaactgtcaca

SEQ ID NO: 1623 - DNA, 1737 bp, Sorghum bicolor
ccccgtgaccgaccctgtcttctccgttccgcctctgccctccgctcgcgctcgcgtcggcgtcggcgtcctccatccatctccattttcttgcaatgtccaagacctgagtgagagagcttctcagtccatggaggtgtcgtcgaggctccaaagcctcctcaggcccctcctactctgccgctcccgcgccgcagggagagccttccaaaccctagctcttcgctccccgccgccgccgccgccgcctcctccgcgcctcccatcttccttcctcctccgaacgcgccgtctaccgccttcccatccgtatggcgccccatcccgcgtcctcttccaccgccccttcgcctccgtctccccggctcccgcccccgttccagggagtgaccacctcaactccaaggaccagggacccccgcccgcgcccttgcctccgccgccgccagaggatctcgcctccgaagacgagtcctactaccacgagcacctcctcgaggtggcgcaggagaaccagtcacgggtcgtccccgtcaaggcattcttcctatgcaccagcatcgacctgcggagcctccagtcccagaattccttcaatgtcatcccaccgacatcgcgtgccaccaactacgttgtccttagatactacgatgtcaagggagaccccgagggttttaagtctggcgtcatagatgagagccattgccactacatggtcgttttccaatatgggtccattgtgctgttcaatgtttctgatcatgaagcagatggatacttgaaaattgttgagaagcatgcatcgggtttacttccagagatgagaaaggacgattatgctgttgttgagaagcccaccttagagacatggatgcaaggtggtcttgactatattgtgcttagggatctgagtattgatgggatccgtacaattggaagtgtcctgggtcagagtattgctcttgactactatatccgtcaagtggatggaatggtagctgagttcacagatatcaatcgtggaatggaaaaaaccggtaccttcactatggagaggaagaagcttttccagcttgtagggaaggctaactctaacttggctgatgttattcttaagcttggactctttgagaggtcagacatagcatggaagaatgcaaactatgctcaaatctgggaataccttcgagatgaatacgagctaactcagagatttggaaaccttgattttaagttgaaatttgttgagcacaacatcaggtttcttcaggagatccttcagaacaggaagtcagattttctggaatggcttatcatcatcctgatcagtgttgagatcttgatatctgtttataacataatacaggagcagatgtaggcctttgttccatcctgaacacgagttgcatatgtcttgactctggattttgtgccaccctgccgttggcacagcctcagtttgtaaagaaacatacgtactagagagactggatccgactcgaaatggtaaacgatggtcgcacacaacatataatttgattgttctcctctgacttgatttggtaatcgcacagcacaaacgctattgtaaagcaggatgtaggagttgtacttttggtggtaagtcttgctcatcggcctttcctaattttcttttctttttccgtttctacttccctgtgtaaaaatgagattaggaatttttttagctaatgacaaagaccaagtaaatttaag

SEQ ID NO: 1624 - DNA, 1558 bp, Zea mays
tccaaagttgaacgtgagctcgagatagaacatggcccagctcagccccgagccgaccctgtcttctccgttcagcctccgccctccgctctgcctctgcgtcttccaccctttgccatttgcttgcaatgtctaatacctgagtgagagagcttcctcagtccatggaggtgtcgtcgaggctccaaagcctcctcagacccttcctactctgccgctcccgcgccgcagggatgaccctccaaaccctagctctttgctccccgccgcctcctccgcgcatcccatcttccttcctcctccgaacgcgccgtctacctcctccctttccccatggcggcccatcccgtcttcttttccacagcaccttcgcctccgtctccccggcccccgcccctgctccagggagggaccacctcaactccaaggaacagggacccccgcccgcgcccttgcctccgccaccgccagaggagctcgcctccgaagacgagtcctactaccacgagcaccttctcgaagtggcgcaggagaaccagtcacgggtcgtccccgtcaaggcattctttctatgcaccagcatcgacctgcggagcctgcagtcccagaattccttcaatgtcattccacccacatcgcgtgccaccaactacgttgtccttagatactacgatgtcaagggagaccccgagggttttaagtctggtgtcatagatgagagccattgccactacatggtcgttttccaatatgggtccattgtgctgtttaatgtttctgatcatgaagcagatggatacctgaaaattgttgagaagcatgcatctggtttacttccagagatgagaaaggatgactatgctgttgttgaaaagcctaccctagagacatggatgcaaggtggtcttgactatatcgtgcttcgggatctgagtattgatgggatccgtacaattggaagtgtcctgggtcagagtattgctcttgactactatatccgtcaagtggatggaatggtagctgagttcacagatatcaaccgtggaatggaaaaaactggtaccttcactatggagaggaagaagcttttccagcttgtagggaaggccaactctaacttggctgatgttattcttaagcttggactctttgagaggtcagacatagcgtggaagaatgcaaactatgctcagatctgggaataccttcgagatgaatacgagctaacccagagatttgggaaccttgattttaagttgaaatttgttgagcacaacatcaggtttcttcaggagatccttcagaacaggaagtcggattttctggaatggcttatcatcatcctgatcagtgttgagatcttgatatctgtttataacataatacaggagcagatgtagggctttgttccatcctgaacacgagatgcatatgttttgaccgtggattctgtgatgccctgctgccgttggcacaacctcgatttgtaaagaaacatacgtactagagactggatccgattcgacctctatactccttataaattaattcctcagac

SEQ ID NO: 1625 - DNA, 1595 bp, Pennisetum glaucum
acctccacctccacctccattccgcggtccccgccttcctccgttgctctgcttggaattgcaatgtggcggaagacttgagtgagagagccgagttagagtcgagtaggccgcccatggaggtatcgtcgaggctccaaagcctcctgaggcccctcctccgcctcccctcccgcaccacaggtagagccctccaaaccctagccccggtccccgggagggaccacctcgactccaaggaccagggaccctcgcccgcgcccttgcccccgccgccgccggaggagctcgcctctgacgacgaggcctactaccacgagcaccttctcgaggtagcacaggagaaccagacacgggttgtccccgtcaaggcgttcttcctgtgcaccagcatcgacctgcggagcctccagtcccagaattccttcaatgtcatcccacccacatcgcgtgccaccaactacgtcgtccttagatactacgatgtcaagggagaccccgagggttttaagtctggtgtcatagatgagagccattgtcactacatggtcgttttccaatatgggtccatcgtgctgtttaatgtttctgatcatgaagcagatggatacctaaaaattgtcgagaagcatgcatcaggtttacttccagagatgagaaaggatgattatgctgttgttgagaagcctaccttggagacgtggatgcagggtggtcttgactatattgtgcttagggatctgagtattgatggaatccgcacaatcggaagtgtcctgggtcagagtattgctcttgactactatatccgtcaagtggatggaatggtagctgagttcacagatatcaatcgtggaatggaaaaaactggcaccttcactatggaaaggaagaagcttttccagctcgtagggaaggccaactctaacttggcagatgttattcttaagcttggactctttgagaggtcagacatagcgtggaaaaacgcaaactatgctcagatctgggaataccttcgagatgaatatgagctgacccaaagatttggaaaccttgacttcaagctgaaatttgttgagcacaacatcaggtttcttcaggagatcctgcagaacaggaagtcggatttcctggagtggcttattatcatcctgatcagtgtggagatactgatatctgtttataacatcgtccaggagcagatgtagtgccgcgtgtaaacacgaagcggcaaaggtgtttctgcccatgtggattttttgcgttacccaaatgcgccgcttggcagccccggtcatcagtttgtaaaaggaatagtactagatgaatgaagtgtctaaattgaagaagtcactgcgttttttttgcaagtactgtagtggttgttggtttggtgactgcgcgtccacaagcaggtgaagaagaaaactagagggagtggagaacaattttaacgaaaaacgtcatctacagtgattgagaagatttcaacaggaaatatgaatgtatggtttcatgtcatcctgtaccaccatgcaattttggccaacatccacgtagccaccctgcaaggcaaggcagcatgcggcccg

SEQ ID NO: 1626 - DNA, 1698 bp, Brachypodium distachyon
gggcgcagtagcatcatcacgatcaacgtaagccccaagacaaaaatgaaaaatcaatccccattccatggctctcttcttcttcttcttcttcttcctcctcctctcgtcgtcctcaccagtccacctccactagcacacaacctccgccggccatatggagctctccaggatgcgtaccttggagaggcgcatcctccggcctctcctcctcctccccgcgcgctccaggaccttccaaaccctcgcccgctcccctcctccccgcatcccctctctcctcctcctactccgcacgcgccacctccctcctccacgtagcgcctctctcccgctgctccgctccttcgcctctgtctccccgggaagggacctccgctgcaacgacgacggcctcccgcctgcgcctctcccgccgccgccgcccgaggagcttgcctccgacgacgacgcctactaccaggagcagctgctcgagtacgcccaggaggaccagacccgcctcgtccccgtcaaggcctacttcccctgcaccagcatcaacctcaagagcctccagtcgcagaattccttcaatgtcatcccacccacatcacgtgccaccaactatgtcgtcctcagatactatgatgtcaagggagacccggagggttttaagactggtgtcatagacgagagccattgccactatatggtggttttccaatatgggtccattgtgctgttcaacgtttctgatcatgaagcagatggatacctaaaaattgttgagaggcatgcttcagggttacttccagagatgagaaaagatgattatgctgtcgttgagaagcctaccttggagacgtggatggaggggggacttgactttattatacttaaggacctgagtatcgatggtattcgtacaattggaagtgtccttggtcagagtattgctcttgactattatatccgacaagtggatggaatggtagctgagttcacggatataaatcgtggaatggaaaaaactggtaccttcactatggagaggaaaaagcttttccagttggtaggaaaggctaactctaacttggcagatgtcattcttaagcttggactttttgagaggtcagacatagcttggaagaatgcaaactatgctcagatttgggaattccttcgagacgaatacgagttaactcaaagatttggaaatcttgattttaagttgaagtttgttgagcacaacatccggtttctccaggagatccttcagaacaggaagtcagattttctggaatggttgatcatcatcttgattagtgtggagatcttgatatctgtttataacattgttcatgagcaaatgtaggtaaacatgagaggaggcagagtcaagtcagtgagtagcacgaatggatagtgaaattttcggtaggattccttgtaaagaatgcttggatccgattctacatgcaccgataaatcatctcatagttttaggctgtcctgattcgccatccatgtttgttgttcagcgcatgccagtcgtgttggctaacaaacaaatagagtagcagtgaaatgcgggtgaaagtgaaggcgcacctagtagtgaacggaaattgaatgaacaggacgctacggggacggagaattgccggggatggcgatgggaccaattttgatctaattttcgtcgcaatcggccag

SEQ ID NO: 1627 - DNA, 1426 bp, Leymus cinereus x Leymus triticoides
cgccgcccccgcctccgcctagggcagaggagctcatggagctctccaggatccggaccttcgagaagcgcctcctccggccgctcctctccctgcccgcgcgctccagggcgttccagaccctggcccgctccacccctccgcccccccgcgccccctccctcctcctcctgctccgcacgcgccacttccctccccatccccatcccccccgccgcgcctcgctgccgcccctccgctccttcgcctccgtctccccggccccggccccggggaaggacctccagggcaacagcaacgacgacgagggcctcccgcccgcgcctctcccgccgccgcccgaggagctcgggtccgacgacgacgcctactaccaggagcagctgctcgagtatacgcaggaggacgacacccgccttgtccccgtcaaggcctacttcccctgcaccagcatcaacctcaagagcctccagtcgcagaattccttcaatgtcatcccgcccacttcgcgtgccaccaattatgtcgtcctcagatactacgatgtcaagggagacccagagggttttaagaccggtgtcatagatgagagccattgccactatatggtagttttccaatatgggtccatcgtgctgttcaatgtttctgaccatgaagcagatggatacctaaaaattgtcgagaggcatgcttcaggattactgccagagatgagaaaagatgattatgccgttgttgagaagcctaccttggagacgtggatggaaggtggactcgattttatcatactcaaggatctgagtattgatggtattcggacaattggaagtgtccttggtcagagtattgctcttgactattatatccggcaagtggatggaatggttgctgagttcacggatataaaccgtggaatggaaaaaactggtaccttcactatggagaggaaaaagcttttccagttggtcggaaaggctaactctaacttggcagatgtcattcttaagcttggactttttgagaggtcagacattgcttggaagaacgcaaactatgctcagatctgggagttcctccgggacgagtacgagctaacccaaagattcggaaacctcgatttcaagctgaaattcgtcgagcacaacatccggttcctccaggagatcctccagaacaggaagtcggacttcctggagtggctgatcatcatcctcatcagcgtggagatcttgatatctgtgtataacattgtccaggagcagatgtaggcgatagcgagggaccaatacgttgttggtgagagtgagccacgaaaccacatgttttgtccgtgagttttttcattccattccttaccccagtaggagcccctgtaaagaatgcttattctggacccgatcctacatgcaccgatgaatgatca

SEQ ID NO: 1628 - DNA, 1759 bp, Triticum aestivum
ccgcctagggcagaggggctgcccatggagctctccaggatccggaccttcgagaagcgcctcctccggccgctcctctccctgccgtcgcgctcccgggcgttccagaccctggcccgcgcctcccctccgccgccccgcgccccctccctcctcctcctgctccgcacgcgccacctcgctccccatccccaccgccgcgcctcgctgccgcccctccgctccttcgcctccgtctccccggccccgtcggcccccgggaaggacctccagggcagcaacggcaacgacgacgacgacggcctcccgcccgcgcccctcccgccgccgcccgaggagctcggctccgacgacgacgcctactaccaggagcagctgctcgagtacgcgcaggaggacgaggcccgcctcgtccccgtcaaggcctacttcccctgcaccagcatcaacctcaagagcctccagtcgcagaattccttcaatgtcatcccgcccacttcgcgtgccaccaattatgtcgtcctcagatactatgatgtcaagggagacccagagggttttaagactggtgtcatagatgagagccattgccactacatggtagttttccaatatgggtccatcgtgctgttcaatgtttctgaccatgaagcagatggatacctaaaaattgtcgagaggcatgcttcaggattactgccagagatgagaaaagatgattacgccgttgttgagaggcctgccatggagaagtggatggagggtggacttgattttattatacttaaggatctgagtattgatggtattcggacaattggaagtgtccttggtcagagtattgctcttgactattatatccggcaagtggatggaatggttgctgagttcacggatataaaccgtggaatggaaaaaactggtaccttcactatggagaggaaaaagcttttccagttggtcggaaaggctaactctaacttggcagatgtcattcttaagcttggactttttgagaggtcagacattgcttggaagaacgcaaactatgcgcagatctgggagttcctccgggacgagtacgagctaacccaaagattcggaaaccttgatttcaagctgaaatttgttgagcacaacatccggttcctccaggagatcctccagaacaggaagtcggacttcctggagtggctcatcatcatcctcatcagcgtggagatcttgatatctgtgtataacattgtccaggagcagatgtagagcgaaggcgagagaaccaatacgttgttggtgagagtgagcgagggagggagcgagaccatcgtcagagccacgaacgaaccacactgttttgtccgcgagttttttggttccatttcttccccccggtagaagcccctgtaaagaattcttaattcggacccgatcctacatgaatgatcacgttaggcttagcgcacttgctttgtccggaggtagtgttgctgctgttgcctagtggaattgtgggatgcggatgagtgagtgtggccgaggtagtaactgggcggcgtgtgactggcacgcgatggcgatgggtcctctttcgcgttcgtggctgaaacttgaaaggtgggcgtgtgattgattgggcgatgttggcttgaaggggcgcgtgcagggcataagccacgttcacattctgacaaccaccggaactattttttgggatcggaatgagcttggaactataccatggatctaatctgccggggaa

SEQ ID NO: 1629 - DNA, 1791 bp, Oryza sativa
caccaccacaaagcgcacaggaacaggaagggaggggggccgccgccgccgtcatactcatatcatatcttcttcttcttctccaaaaaaatactagtgtaatgtgtgatttgtgagagatgatggagctgtgtaggattcgaaccttccagaagagcctactgaggcccctcctcctcctccagcatgccccttgtagaaccctccaaaccctagggcggtccccttcgccctcggtgttccggcccccccgccgccgccccccgctcctcctcctcctcctccgctcctccttcgcctccgtctctccgggtccggcccccgggagcgggacaggcgaatgccccccgcccccgcccgcgcccttgccgcccgacgagctcgcctccgacgacgacgcctactaccacgagcacattctcgaggccacgcaggaggaccaaagtcgcctcgttccagtcaaggcctacttcccctgcaccagcatcaacctcaagagcctccagtcccagaattccttcaatgtcatcccccccacttcgcgtgctaccaactacgtcgtcctcaggtactacgatgtcaagggagacccagagggttttaaggctggcatcatagatgaaagtcattgccactatatggtggtgttccaatatgggtccattgtgctgtttaatgtttctgatcatgaagcggatggatacctgaaaattgttgagaagcatgcatcaggcttacttccagagatgagaaaagatgattatgctgttgttgagaagcctaccttggagacatggatgcagggtggacttgacttcatcatactcagggacctaagtatcgatgggattcgtacaattggaagtgtccttggtcagagtattgcccttgactattatatccggcaagtagatggaatggtagctgagttcacggatataaatcgtggaatggaaaagactggtaccttcactatggaaaggaaaaagcttttccagttggtaggaaaggctaactctaacctggcagatgttattctcaagcttgggctttttgaaaggtcagacattgcttggaagaacgcaaactatgctcagatttgggaataccttcgagatgaatatgagttaacccaaagatttgggaaccttgattttaagttgaaatttgttgagcacaacattcgttttcttcaagagatccttcagaacaggaagtctgattttctggaatggcttatcataattttgattagtgtggagatcctgatatctgtttacaacattgttcaggagcaaatgtagctgactattgtgggaatccttgctggggctgaaacctcgtcagaaccactgtggcacgaaccacgaatgacacgttctgtcttgtggatttttcaatggatcaagtaagagccttgtatatgcgtaaaatggttcatcacattgcattgtccataacgcaatggcttggtttagcgctttaatttatggtgccaggacgttgcagaatctgagaacccaccgcttactagtagagaaagggtaaagaaaagattggtagccgtgttgctggacgatactcctatctttggcaatgtcagcttttgcggtcgattaagaaaggggtctggttttaggacgttgaaccgactactatagcaactgctaggtgcccatgcgtgtttaccaaaattgaaaatcgatccaaatgttttcaattggctttagtagaaaatttagcgtacacttcatattttattgattttctacaagctatattaaataacgg

SEQ ID NO: 1630 - DNA, 4358 bp, Panicum virgatum
ttgcgaaccaggccgggcaattcgtccctctcggctattcccgttgagttcccctccccacttcgcctcgcccccctccctcttctcctcttgctttcgcgagaggcggctgcggctcgccgagacagactcctacccccgactccggcgcgtcagccagcacattcgggctagggttccggccatggaggacgacgagtacgaggaggggatggagatgggctacggcgggcaccaccagcaccgcggcggccacgcggggtacgcggaggatgaggacgaggtagggtacggcggcggggacggggacgagatggacgaggatggggacggggacgccgagcagcgggacgaggaggagatcacccaggaggacgcctgggccgtcatctccgcctacttcgaggagaagggcctcgtgcgccagcagctcgactccttcgacgagttcatccagaacaccatgcaggagattgtcgacgagtccgccgacatcgagatccgccccgagtcgcagcacaaccccggccgccaggctgagttcgccgagactcttcacaagatcagctttggtcaaatctacctcagcaagccaatgatgacagaggctgatggagagacagctactttgtttccaaaatcggcaaggctcaggaacctgacttactctgcgccactgtatgttgatgtgtcatacagagtaatgaagaaaggacatgactgtgaggaagttacagagactgcagattatccaaaagtgttcatcgggaaggttccaatcatgttgcgttctagttactgcacactatatcaacaatctgagaaggatctgactgaacttggggagtgtccttatgaccaaggcggttatttcattatcaatggaagcgaaaaggttcttattgcccaagagaagatgagcaccaaccatgtctatgtttttaagaagaggcagcctaataaatatgcatatgtggctgaagtccgttctatggctgagaaccagaacaggccagccagcagcatgtttgtacggatgctttcacgagcaggagcaaaagggggttcatccggtcaatatatccgtgctactctgccctatattcgtgcggacattcccattatcattgtttttcgagcattagggtttgttgctgacaaagatatactggagcacatatgttatgacttctcagatacacaaatgatggagttgctacgcccatccctggaggaagcttttgtcattcaaaatcaacaggttgctctggactatattggaaagcgtggcgctacagttggtgttactagagagaaaagaattaagtatgcaaaagaaatacttcaaaaggaaatgttgcctcatgttggtgttggggaattctgtgaaactaagaaggcatactattttggatacattattcaccgactactgatgtgtgctcttggtcgaagagctgaggatgaccgagatcattatggcaacaaaaggctagatcttgctggtccattgcttggagggctgtttagaatgcttttcaggaagttaacaagggatgtcagatcttatgtgcaaaagtgtgtggataatggaaaggaagttaatttgcaatttgctataaaagcaaaaactgttaccagtggcttgaagtattcccttgctactggaaactggggacaggctaaccaagctggaaccagagcgggggtttctcaggtgcttaatcgcctgacctatgcttctacactatcacatctccggaggctgaactctcccattgggcgtgaaggtaaattggcaaaaccccgccagttgcataattctcattggggaatgatgtgtcctgctgaaacaccagaaggacaagcttgtggcttggtgaaaaatcttgccctgatggtatatatcactgttggttctgctgcaaatccaattttggaatttttggaggaatggggcacagaaaattttgaggagatatcaccggccgtcattccacaagctgctaagatttttgttaatggttgttgggttggaattcataggaatgctgacttgttggtgaagacccttcggcgtctaagaagacagattgatgtcaacactgaagttggtgtggttcgtgatattcgtcttaaagaacttagactctacacggattatggtcgatgcagtcgtccgttgtttattgttgagaaccagagattgctcatcaagaaggcgcatatccgagcattacaacaaagggagactcctgatgaaggttggcacgaattagtctcaaaaggatatatagagtacatagatactgaagaagaggagactaccatgatttccatgaccataaatgaccttataaatgcgagacagaacccagatgaggcgtattctgagacatacacgcattgtgagattcatccttcattgatacttggtgtttgtgcgtcaattattccttttcctgatcacaaccagtcacctcgtaatacatatcaatctgctatgggaaagcaagccatgggaatttatgtcaccaactaccagttaagaatggacacattggcctatgttctatactacccacaaaagcctttagttactacacgtgctatggaacatttgcacttcagacaattaccagcgggcattaatgcaattgttgcgattgcttgctactctggttataaccaagaagattcagttattatgaatcaatcttccatagatcgtgggttcttccgatcactgtttttccgctcttacagagatgaggagaagaagatggggacacttgtcaaagaggaatttggtcgcccaaatagggaaaatactatgggaatgcgccatgggtcatacgataaactagatgatgatggccttgcaccaccaggaacaaggatctctggtgaagatgtcattattgggaagacatctcctattccacaagatgacgctcaagggcaagcttctaggtactcgaagcgcgatcatagtacttctctgcgtcacagtgaaagtggcatggtagatcaggttctgttaacaacaaatgctgatggtcttagatttgtcaaggttagaatgcgatcagttcgcataccacaaattggagacaagtttagcagtaggcatggacaaaaaggaactgttgggatgacttatacgcaagaggacatgccatggacaattgaaggcatcacacctgatattattgtgaatccacatgctattccatcccgtatgactattggacagctgattgagtgtattatgggtaaagttgcagctcacatggggaaggaaggagatgcaactccgtttactgatgttactgtggataacatcagcaaggctcttcataaatgtggttatcaaatgcgtggatttgaaaccatgtacaatggtcacactggaaggaaattgacagctatgatttttctgggtcccacatattaccaaagactcaagcacatggtggacgacaagatacattcaagaggtcgtggtcctgttcagatactcacccggcaaccagcagaggggcgttcacgtgatggtggtctccgctttggagaaatggaaagggattgcatgattgcgcatggagcagctttctttctgaaggaaagactgttcgaccagagtgatgcatacagagtccatgtgtgtgagaaatgtggtctcattgcaatcgccaacctaaagaaaaactcattcgagtgcaggggatgcaagaacaaaactgacattgtccaagtacacataccctatgcttgtaagcttctgttccaggagctcatggcgatggccattgctcctagaatgctcacccatgatatcaagacagggaaggatcagaagaaacggtgaaccagtatcccatggctcatgcttagctggaccctcgtcgttctagggtgctacattttttggatcagaaggaacggtgaaccagtatcccatggttcatgcttagctggacctcttcgttctagggtgctacattggtggttcataatgtgatcaatttggacttcgttcttcacgaatgacgaacagggcgttcttgtctccatgggtaatcatggccgtgtctatggatttgtcagatctacgcttgcaagcaaacagcatatgagttttgttaattgtgtacattagaaactcactttttcaaagatttgggagacctcaaggtttggacactcagcggggcaacttgggtgcttgctgtaacttcaatgttgacaattgtaacggccactggtggcgtaatttggatctataaacaaggattgctcaaggataagaaaaggaataactttagtccttgctatatttgactgcctctcgtctc

SEQ ID NO: 1631 - DNA, 6781 bp, Oryza sativa
ccaaaattcccaaaccgacttggctttcgctacgcccagcttcggccgcgctccaatatatcgcgttgcggaccaaatcacctccaaaattttttcactcgttttccccttccttccgccgcccctactcgctcggtgttgggcggcgggcgtcccactcccaccacctcgaggcgagggggctagggtttccgccatggaggacgacgagtacgaggaggggatggagatggagatgggcgggcaccaccacccgcaccacggcggcgggtacggcgccgaagagtacggggccgtcggcggggaggagatggaggacgaggaggcggatggggacgcccccgacgaggaggagatcacccaggaggacgcctgggccgtcatctccgcctacttcgaggagaagggcctcgtgcgccagcagctcgactccttcgacgagttcatccagaacaccatgcaggagatcgtcgacgagtccgccgacatcgagatccgccccgagtcgcagcacaaccccggccgccaggccgagttcgccgagacactccacaagatcagctttggacaaatctatctgagtaaaccaatgatgacagaagctgatggagagacagctactttatttccaaaatcggcaaggctccgaaacctaacatactcggcgccactatatgttgatgtatcatacagagttatgaaaaaaggacatgactgtgaagaggttacagaaactatggagtacccaaaagtctttattggaaaggttcctatcatgttgcgttctagttattgcacactgtttcaacagtccgaaaaggatcttacagaacttggagagtgcccttatgaccaaggagggtattttataatcaatggtagtgaaaaagtccttattgcccaggagaagatgagcaccaaccatgtctatgtgtttaagaagaggcagcctaataaatacgcatacgtggctgaagtccgttctatggcagagaaccagaatagacctgctagtagtatgtttgtgcggatgctttctagggcaggcgcgaaagggggttcatctggtcaatatatacgtgctactttgccttatatccgtgcagacattccgatcatcattgtgttccgagcattaggatttgttgctgataaagatatattagagcacatatgctatgatttctctgatacacaaatgatggaattgctacgcccatctttagaggaagctttcgtcattcagaatcagcaggttgctctggattacattggaaagcgtggagctactgttggtgtaactaaagaaaagagaattaagtatgccaaagagatacttcaaaaagaaatgttaccccatgttggtgtgggtgaattctgtgaaaccaaaaaggcgtactactttgggtacattattcatcgtctgctgatgtgcgctcttggtcgaagagctgaagatgacagagatcattatggcaacaaaagactggatcttgcaggtccattgcttggaggactgtttagaatgcttttcagaaagttgacaagggatgtgaggtcatatgtgcaaaagtgtgtggataatggaaaggaagtcaatctgcaatttgctattaaagccaaaaccattactagtgggttgaagtattcccttgctactggaaactggggacaggctaaccaagctggtaccagggctggtgtttctcaggtgcttaatcgccttacctatgcatctacattatctcatctgcggaggcttaactctccaattgggcgtgaagggaaattggcaaaacctcggcaattgcataattctcattggggaatgatgtgccctgctgaaacacctgagggacaagcttgtggtttggttaaaaatcttgcattgatggtgtatatcactgttggttctgctgcaaatcctattttggaatttttggaggagtggggcacagaaaattttgaggagatatcaccagccgtcattccacaagctgctaaaatttttgtcaacggttgttgggttggaattcacaggaaccctgacctgttggtgaagactcttaggcgtttgagaagacagattgatgtcaacactgaagttggtgtggttcgtgatattcgtcttaaagaactcagactttatacagactatgggcgttgcagtcgtccactgtttattgttgaaaaccaaaggcttcttattaaaaagagacatatccgagcgttgcagcaaagggagacacctgaggaaggttggcatgacttagttgcgaaaggatttattgagtacatagatactgaagaggaagaaactactatgatctccatgaccattaatgaccttattggtgcaagacacaatccagaggaggcgtactctgaaacttacacacattgtgagattcatccttcattgatacttggtgtctgtgcctcgattattccttttccagatcataaccagtcacctcgtaatacatatcagtctgctatgggaaaacaagcaatgggaatctatgttaccaactatcagttaagaatggacacattggcctatgtgctatactacccacaaaagcctcttgttactactcgtgctatggaacatttgcacttcagacagttaccagctggcattaatgcaattgttgctattgcatgctactctggatataatcaagaagattcggttattatgaaccaatcttcaatagatcgtggattcttccgatctctgtttttccgctcatacagagatgaggaaaagaagatggggactcttgtcaaagaggagtttggccgtccaaatagggagaatactatgggaatgcgtcatgggtcatatgataaactagatgatgatggacttgcaccaccaggtacaagggtatctggtgaagatgtcattattgggaagacatctcctattccacaagatgatgcccaagggcaagctactagatacacaaagcgtgatcacagtacttcgctgcgccacagtgaaagtgggatggtggatcaggttctcctaacaacaaatgctgatggtttaagatttgttaaggttagaatgcgatcagttcgtataccacagattggggataagtttagtagtaggcatggtcagaaaggaactgtgggaatgacttatacacaagaggacatgccatggactattgaaggcatcacacctgatattattgtgaatccacatgctattccatcccgtatgactattggtcaactgattgagtgtattatgggtaaagttgctgctcacatgggaaaagaaggagatgcaactcctttcactgatgttactgtggataacatcagcaaagcacttcataaatgtggttatcagatgcgtggattcgagaccatgtacaacggtcacactggaagaaaattaactgccatgattttccttggtcctacttattaccagagacttaagcacatggtggatgacaagattcactctagaggccgtggtcctgtgcagatacttaccagacaacctgcagaggggcgctcacgcgatggtggtctccggtttggagagatggagagggactgtatgattgctcatggcgctgcatttttccttaaggaaaggttatttgaccagagtgatgcgtacagagtccatgtatgcgagaagtgtgggcttattgctattgctaatctcaagaagaattcctttgagtgcagagggtgcaagaacaaaaccgacattgtccaagtgcatataccctacgcgtgtaagcttctgttccaggagcttatggcgatggccatcgctcccaggatgctcactcaggataacaaaactgggaaggatcagaagaaacgttgagaccaaatattacatggggcactcgcttgtcgtactatgtcttcgttcatagtcaatacttaaatctaacttgggcttagcggtctgaccccctgaggcagaaagcagtcagtaggccacatcctcgagttatatatatccctggtgtgctgtgcccttggattatgccaaattgacgccatgggcgaagtggtgcaaagaaattttgtttcttgtatactagggatacggattaagggactgtactgaacaatcttttaccgggactaaaatgttgttgtttgtactgtttcttttttatttttttttggcttttggggatactagatcccaactcgaatattgcctgtattggctctaccagcacgatatcaaaattgtttgatgagagatcttgtaagaaaatagtaataatttagtgttaactactgctagctttctgtcgggtgcgtcatgaattagcctcaattacattttttctactgaggcctggatgtacttcgatgttcagagtctagttttaaatggtacaattagtacacactaactgtttcatgtttcaaagtatttctgtggctaataacaacaccttgcttaagaaattttaagtctgttcgcatattcatgtttgtaaacaaaggaacggtcagagtaattgtttcagatcgtgcgctttttcacaaagaaatggagcaatcatgtgtacgccttcaatgaaacgtgtcaaatagcccataagaatcaatagtgtagcttctacgatatccaaaccaatatcattagcttgcacactaaaacatatagcccaaaatccaattgaatgaatcgaattcaattcggagccaaacaagatataattgaatttttgtacaaccaccatgagtaacaccacatctctctcctagtaaaccaaatcaaactccattcgccacccaaaacttgaacacaaaattgtacatcagcatcatcagactgaaattacaaggggtatgctgcgacgaaagtagcaggagggaaggctattatacacgactggaccacgaacaccagccatcggtctctctccagcagttcagaagcaccttgcaaaatcagaactctagatcccaaaaagaaaggaaaaaaaaaagagaggaaagaatagctagtacaataacactattcctttttgccattccaattggatgcaaaaaccacatacaactgcctatccaccagcagccgagtatatacaagtgaagtgaagcctcgtcgatctccagataatctctgtgaattgaattgttttactgtcgtgttcggtaaacagcttggactggacggcgctgttctggatgatcatctgttcatccatcttatctactaccttgctcactttaaatgtttaccttttggcatggctgtgggccactgtctcgcaaacacaaatcactttactctgtgcagaaaaaaataaaaatagcaagatcgcgccgatcgagacttcatatatagatcagattaatcaatatctggccactctactatatccaggcaagagaacctcgatcgttagctgctacttgggggcggccccttgttggagtcggtggtctgtttgcattcagctcctgaatttcatttcaaatgttaccgtgttacgaggaaggtggtagtaccagttagtttacaaacaggaatatctttgcaacaaaatagtattacctgcatccatgtgtcctcaatatgatgctccggagaggtctcaggtgatgtgattgccgggggcaaaggatgaatcagttttggaacgaccacaagatctctgcccaaaactaagatagcaccggcattatttgcagtacctgtgagcataccatgtcaagcaatcgtagaaatccagcaaaaaagtttgaaaaaagaatattttagaataattcataccacaatagtttgttgcagagaaaagagtgatcaggtgaccttgagcaaagcgctcaaagccatccatcacacactcatgcgctcgcacaattagttgaagatcattattgttgcaaaactccataacacgatcaggctgtatgaacagcaaatgttagcttcagagaacaaagggggtcaacaaagggaagacgaattcagaaggttagggttagggaacacaaaccccaaacgtaacaaggccagggcctcgagcatttggtctcaatccttcaacactgtcattctcggttggatcagacctataagcatcataaagagaacatctgaacatggcacataaataaatgctcatggaaggttaaatagcaattattgttgaaatgttttaccatagaagatccataaggacaacagagcctgcttccatggtaattggtctctgaagattctcaatttgctcaacatggttgattgaccgaccaattccaccatgcatacatataattttcttttcgataagtgcagccaaaggaagccagttaaataatctattcattcggtgccatgtccaaataccatctctctcaccctgttttttgagcaaataacatcctcataagcaaaagaggaaaaggttttgttgtaacgtgagatgcagaataaaatagattaccattcgctctatgcactctattcggaagccaaacaaagcattaatatctgcagcttcatgatttccacgaatcaaatgtacattctgaggatactcaacctgaaatgtacaattgtttatatattacgattttaataaatcgtcacaacacagtaagtatatgtggcatcaaggtaagtaggcagcttaataccttcaatgcaagaagaagagtcattgtttctaagctatgctggccacgatccacataatcacccaagaagagataatcaatgtaactgcaggttcatacaaaattatggatcagcacaagacca

SEQ ID NO: 1632 - DNA, 4289 bp, Brachypodium distachyon
cgaaccagatcggcgaaacttccccaattcctcacttcttccttccgcctccgcccctccccatctctcctctctccctctgcagaggtggtgaggcgacacactcataccaccgggctccactagggttgccgttgccatggaggacgacgagtacgaggaggggatggagatggagatgggaggtcaccagcagctccaccaccgggggtacggagctgacgaggaggttgacgggggatacggcggcggcggggacggggtggatatggaggacgaggatgctgagggtgaggaggcgcgggatgaggaggagatcacacaggaggacgcctgggccgtcatctccgcctacttcgaggagaagggcctcgtgcgccagcaactcgactccttcgatgagttcattcagaacaccatgcaggagatcgtcgacgaatccgcggacatcgagatccggcccgagtcgcagcacaatcccggccgacaggccgagtttgccgagacactccacaagatcagctttggtcaaatctatctgagcaaaccaatgatgactgaagctgatggagagacagctaccttattccccaaatcagcaaggctcaggaacctgacatactcagcaccactttatgttgatgtatcatatagagttgtaaagaaaggacatgactgtgaagaagttacagaaactatggagtatccaaaagtcttcattgggaaggttccaatcatgttgcgttctagttactgcacactatttcaacaatctgaaaaggacctcacagaacttggagagtgcccttatgaccaaggaggatattttgtaatcaatggtagtgaaaaggttctcattgcccaggaaaagatgagcaccaatcatgtctatgtgtttaagaagcggcaaccaaataagtttgcatatgtggctgaagtccgttctatggcagagaaccagaatagacctgctagtagcatgttcgttcgaatgctttctcgtgccggtgcgaaagggggctcatctggtcaatatatccgcgctacattgccgtacattcgtgcagatattcccatcatcattgtgtttcgggcattaggatttgttgctgacaaagatatactggagcacatatgttacgatttctctgatacacaaatgatggaattgctacgcccatctttggaggaagcttttgtcattcaaaatcaacaggttgctctggactacattggaaagcgtggtgctacagttggtgtaactcgagaaaaaagaatcaagtatgccaaagagatacttcaaaaggagatgttgccccatgttggtgtcggcgaattctgtgaaactaaaaaggcatactactttgggtatattattcaccgcctattgatgtgcgctcttggtcgaagagctgaggatgacagagatcattacggtaacaaaaggctcgaccttgcaggtccattgcttggaggactgttcagaatgcttttcaggaaattgacaagggatgtgagatcatatgttcagaagtgtgttgataatggaaaggatgttaatttgcaatttgccatcaaagcgaaaactattactagtggattgaagtattccctggctactggaaactggggacaggctaaccaagctggtacaagagccggtgtttctcaggtgcttaatcgccttacctatgcttctacattatcacatctgcggaggttgaactctcccattgggcgtgaagggaaattggcaaaacctcgccaattgcataattctcattggggaatgatgtgtcctgctgaaacacctgaaggacaagcctgtggtttggttaaaaatcttgccttgatggtatatatcactgttggttctgccgcaaatcctattttggaatttttggaagagtggggcacagaaaatttcgaggaaatatcaccagcagtcattcctcaagctgctaaaatatttgtcaatggatgttgggttggaattcataggaaccctgacctattggtgaagacacttcggcgtttaagaagacagattgatgtcaacactgaagttggagtggtgcgtgatattcgtcttaaagaacttcgactctacacggactatgggcgttgcagtcgtccactgtttattgttgatggccagaggcttctcattaagaagaaacatatccgagcattgcagcagagggagactcctgacgaaggttggcatgacttggttgccaaaggatttatagagtacatagatacagaagaggaagagactactatgatttctatgactataaatgaccttgttagtgcaagaaataatccacaggaggcgtattctgagacttacacgcattgtgagattcacccttcactgattcttggtgtgtgtgcgtcgattattccttttcctgaccacaatcagtcacctcgtaatacatatcagtctgctatgggaaagcaagccatgggaatatatgttaccaattatcagttaagaatggatacattggcgtatgttctgtactaccctcagaagcctcttgttactactcgtgctatggagcatttgcacttcaggcagttacctgctggcattaatgcaattgttgctattgcatgctactctggatataaccaagaagattcggttatcatgaatcaatcttcaatagaccgtggatttttcagatcgctatttttccgctcttacagagatgaggaaaagaagatgggaactctcgtcaaagaggaatttggtcgtccaaatagggagaacactatgggaatgcgccatgggtcctacgataaactagatgatgatggacttgcacctccaggaacaagggtttctggggaagatgtcattattgggaagacatctcctattccacaagatgacgctcaagggcaagctactagatactcgaagcgtgatcatagtacttctctgcgtcacagtgaaagtgggatggtggatcaggttcttttaacaacaaatgctgatggtttaagatttgtcaaggttagaatgcgatctgttcgcataccacaaattggagataagttcagcagtaggcatggtcagaaaggaactgttggaatgacttacacacaagaggacatgccatggacaatcgaaggcatcacgcctgatatcattgtgaatccacatgctattccgtcccgtatgactattggtcaactgatcgagtgtattatgggtaaagttgcagctcacatgggaaaggaaggagatgcaactcctttcactgatgttactgttgataacatcagtaaagcacttcacaaatgtggatatcagatgcgtggatttgagaccatgtacaacggtcacactggtagaaaattgactgctatgattttcctaggtcccacttattaccagcggctcaagcacatggtggatgacaaaattcactctagaggtcgtggtcctgtccagatactgaccaggcagccagcagaggggcgctcacgtgatggtggtcttcgttttggagaaatggagcgggattgcatgattgctcatggtgctgcatttttcttgaaggaaagattattcgaccagagtgatgcttacagagtacatgtatgtgaaaagtgtggactcattgcgattgctaatctcaagaagaattcctttgaatgcagaggctgcaagaacaagacagacattgtccaggtacatatcccatacgcttgtaaactcctcttccaggagctcatggctatggccattgctcccaggatgctcacccatgatatcaagtctgggaaggatcagaaaaaacgctgagcttgattgtttgtattcggggtgtgcctaactggagctatttgccatgtagtcatttggattttccctcgataccctattgcgggactactgtagtatgtgtgcgattgttctgatttgtacttcggttctgatgcactactatggaatgtgcattttcggagggatgtccttctgatgcctgttctgactaaatcaaaacgcaagccatgaagtgacataggttcttgtacattaggaattcattaacaggacaagtaaactgcccgtctgtgatgatcccgttatctggagacatcattttcttccagttttggctttcttgactcaaaaaatgcttgtattaatcagtgatgttcgatgcatttattacgttgaccttctacgaaacaacaattactagcaaattcatatgggataagctgcggagagctcctctgaagggcagtcttttttaagggaa

SEQ ID NO: 1633 - DNA, 4051 bp, Zea mays
cgctctgtccatggaggatgacgagtacgaggatgggatggacatgggctacggcgggcatcaccagcgcggcggcggccacgcggggtacggcgcggaggaggacgacgagatggggtatggcgaggggggtggggacggggacgagatggaggaggaggcggatggggacgccgagcagcaggaagatatcacgcaggacgacgcctgggccgtcatctccgcctacttcgaggagaagggcctcgtgcgccagcagctcgactccttcgatgagttcatccagaacaccatgcaagagattgtcgatgagtccgccgacatcgagatccggcccgagtcgcagcacaaccccggccgtcaggccgagtttgccgagactctgcacaagatcagctttggtcaaatctatctcagcaagccaatgatgactgaagccgatggagagacagctactttatttccaaaatcagcaaggctcaggaacctgacatactctgctccactgtatgttgatgtgtcatacagagtaatgaagaaaggacatgactgtgaggaagttacagagactgctgagtatccaaaagtgtttattgggaaggttccaatcatgttgcgttctagttactgcacactgtatcaacagtctgagaaggatctcactgaacttggggagtgtccttatgatcaaggtggttatttcattatcaatggaagcgaaaaggtccttattgcccaggagaagatgagcaccaaccatgtctatgtttttaagaagaggcagcctaacaaattcgcatatgtggctgaagtccgctccatggctgagaaccagaacagaccagccagcagcatgtttgtacggatgctttcacgagcaggagcaaaagggggatcatctggtcaatatatccgtgctactctgccttatattcgagcggacattcccattattattgtatttcgagcattaggatttgttgccgacaaggatatactggagcatatatgttatgacttttctgatacacaaatgatggaattgctacgtccatccctggaggaagcttttgtcattcaaaatcaacaggttgctctggactacattggaaagcgtggcgcaacagttggtgtcactcgagaaaagagaattaaatacgcaaaggaaatacttcagaaggaaatgttgcctcatgttggtgttggggaattctgtgaaactaagaaggcatactattttgggtatattattcaccgcctactgatgtgcgctcttagtcgaagagctgaggatgaccgagatcattatggaaacaaacgactagatcttgctggtccactgcttggagggctgtttagaatgtgtgtagataatggaaaggaagttaatttgcaatttgctataaaagcaaaaactattaccagtggtttgaagtactcccttgctactggaaactggggacaggctaaccaagctggaaccagagcaggggtttctcaggtgctcaatcgcctgacctatgcttctacactttcacatctccggaggcttaactctcccattgggcgtgaaggaaaattggcaaaaccccgccagttgcataattcgcattggggaatgatgtgtcctgctgaaacaccagaaggacaagcttgtggcttggtgaaaaatcttgccttgatggtatatatcactgttggttctgccgcaaatccaattttggaatttttggaggagtggggcacagaaaattttgaggagatatcaccagccgtcattccacaagctgctaaaatttttgtcaatggttgttgggttggaattcataggaaccctgacctgttggttaagactcttagacgtttaagaagacagattgatgtcaacactgaagttggtgtggtgcgtgatatccgtcttaaagaacttcgactctacacggattatggacgctgcagtcgtccattgtttattgttgagggccagaggctgctcatcaagaaggcgcatatccgagccttgcaacaaagggagactcctgatgaaggctggcatgaattggtctcaaaaggatatatagaatacatagacactgaagaagaggagactaccatgatctccatgaccataaatgaccttcaaaatgcaaggcacaacccagaggaggcttactctgaaacttacacgcattgtgagattcatccttcattgatacttggtgtttgtgcgtcgattataccttttcctgatcacaaccagtcacctcgtaatacatatcagtctgctatgggaaagcaagccatgggaatttatgtcaccaactaccaattaaggatggacacgttggcctacgttctatactacccacaaaagcctctagttactactcgtgctatggaacatttgcacttcagacagttaccagctggcattaatgcaattgttgctattgcttgttattctggatataatcaagaagattcagttattatgaatcaatcttccatagatcgtgggttctttcggtcactatttttccgctcttacagagacgaggaaaagaagatgggcacacttatcaaagaggaatttggtcgtccaaatagggaaaatactatgggaatgcgccatgggtcatatgataaactagatgatgatggccttgcaccacctggaacaagggtctcaggggaagatgtcattattgggaagacatctcctattccacaagatgacgctcaagggcaagcttctagatactcaaagcgtgaccatagtactgctctgcgtcacagtgaaagtggcatggtagatcaggttctgttaacaacaaatgcggatggtctaagatttgtcaaggttaggatgcgatctgttcgcataccacaaattggcgacaagtttagcagcaggcatggacaaaaaggaactgttgggatgacttacactcaagaggatatgccatggacaatcgaaggcattacacctgatattattgtgaatccacatgctattccatcccgtatgactattgggcagctgattgagtgtattatgggtaaagttgctgctcagatggggaaggaaggcgatgccactccattcacggatgtgactgtggataacatcagcaaagctcttcataaatgtaattatcaaatgcgtggatttgagacaatgtacaatggtcacactggaagaaaactgactgcgatgattttcctgggccccacatattaccaaagactcaagcacatggtggatgacaagatacattcgagaggacgtggtcctgtgcagatactcacccggcaaccagcagaggggcggtctcgtgatggaggtctccgctttggagaaatggaaagggattgtatgatcgcacatggagcagctttcttcctgaaggaaaggctgtttgaccagagtgacgcatacagagtccatgtatgcgagaaatgtggtctcatcgcaattgctaacctaaagaaaaactcgttcgaatgcaggggctgcaagaacaagactgacattgtccaagtacacataccctatgcttgtaagcttctgtttcaggagcttatggcaatggccattgctcccagaatgcttacccatgatatgaagacagggaaggatcagaagaagcgctgaacgtgtatcacgtgagatgtaaccagaactcatgccccgttgctatattcctggatcctggttcacacaatagtaccctgttgaggaactttgtggtcacttcttttctgatttggacttcggttcttcgcgatcgatggagggctgttactatctcttgatggattattatcctatctgtgctcgtgttgcctgaagatcagtgctagcagatcgtcgagttaattttgtacattaggaatgtgttgtaatgtattaatctgtgcgagtagaaagatttttgactaaaggtgtcaatttggaggtgtaactgtacgttaatactaaacgcgatgccattgcaatttcagttttattttgaaatacatggggttttagtggcatgtctctaaacta

SEQ ID NO: 1634 - DNA, 4046 bp, Secale cereale
cccatccccatccccgagcgcctctagggttgcggctcgctccggcgatggaggacgacgaatacgaggaggggatggagatggatatgggagggcaccagcacctccagcaccgggggtacggagctgaggaggaggttgaggggggatacgccggcggcggggacggggaggacgaggaggaggaggcgcgggacgaggaggagattacccaggaggacgcctgggccgtcatctccgcctacttcgaggagaagggcctcgtgcgccagcagctcgactccttcgacgagttcatccagaacaccatgcaggagatcgtcgatgagtcggccgacatcgagatccgccccgagtcgcagcacaaccctggccgccaggccgagttcgccgagacactccacaagatcagctttggtcaaatctatctgagcaaaccaatgatgactgaagctgatggagagactgctaccttgttccccaagtcagcaaggcttaggaatctgacatactcagcaccactttatgtagatgtatcatacagagttgtaaagaaaggacatgactgtgaagaagttacagaaactgcggagtacccgaaagtcttcattggaaaggttccaatcatgctgcgttctagttactgtacattgtttcaacaatctgaaaaggatcttacagaacttggagagtgcccttatgaccaaggaggatattttgtaatcaacggcagtgaaaaggttctcattgcccaggagaagatgagcaccaaccatgtctatgtgtttaagaagaggcaaccaaataagtttgcatatgtgggtgaagtccgttcaatggcagagaaccagaacagacctgctagtagcatgtttgttcggatgctttcccgagctggcgcgaaagggggttcatctggtcaatatatccgtgctactctgccctacattcgtgcagatattcccatcatcattgtgtttagagcactaggatttgttgctgacaaagatatactggagcacatatgttacgatttctccgatacacaaatgatggaattgctgcgcccatctttggaggaagcctttgtcattcaaaatcagcaggttgctctggattacattggaaagcgtggtgctacagttggtgtaactcgagaaaaagaataaagtatgcgaaagagatacttcagaaggaaatgttgccccatgttggtgtaggcgaattctgtgaaactaaaaaggcatattactttgggtatattattcaccgcctgttgatgtgtgctcttggtcgaagagctgaagatgacagagatcattacggtaacaaaaggcttgaccttgcaggtccattgcttggaggactgttcagaatgcttttcaggaaattgacgagggatgtgaggtcatatgttcagaagtgtgtcgataatgggaaggaagttaatttgcaatttgctattaaagctaaaaccattactagtggattgaagtattcccttgctactgggaactggggacaggctaaccaggctggcacaagagccggtgtgtctcaggtgcttaatcgccttacgtatgcttctacattatcacatcttcggaggttgaactctcccattgggcgtgaagggaaactggcaaaacctcgccaattgcataattctcactggggaatgatgtgccctgctgaaacacctgaaggacaggcctgtggcttggttaaaaatcttgccttgatggtttatatcactgttggttctgctgcaaatcctattttggaatttttggaagagtggggcacagaaaattttgaggagatatcaccggcagtcattcctcaagctgctaaaatatttgtcaatggttgttgggttggaattcataggaatcctgacctattggtgaagacccttcgtcgtttaagaagacagattgatgtcaacactgaagttggtgtcgttcgtgatattcgtcttaaagaacttcgactctatactgattatgggcgttgcagtcgcccgctgtttatcgttgaaaaccagaggcttctaattaagaagaaacatatccgagcactgcagcaaagggagactcctgatgaaggttggcatgacttggttgccaaaggatttatagagtacatagatactgaagaggaagaaactactatgatctccatgactatacgtgaccttgaaacttcgaggcataacccaggggaggcatattctgagacttacacacactgtgagattcacccttcattgatacttggtgtgtgtgcgtcaattattccttttcctgatcacaaccagtcacctcgtaatacatatcagtctgctatgggaaagcaagccatgggaatctatgttaccaactatcagttaagaatggacacattggcctacgttctgtactacccacaaaagcctcttgttactactcgtgctatggagcatttgcacttcaggcagttaccagctggcattaatgcaattgttgctattgcatgctactctggatataaccaagaagattcagttattatgaaccaatcttcaatagatcgtgggttcttcagatcactatttttccgctcttacagagatgaggaaaagaagatgggaactcttgtcaaagaggaatttggtcgtccaaatagggagaacactatgggaatgcgccatgggtcttatgataaattagatgatgatggccttgcaccaccgggaacaagggtctctggggaagatgtcattattgggaagacatctccaattccacaagatgatgctcaagggcaagctactagatactcaaagcgtgatcatagtacttctctgcgtcacagtgaaagtgggatggtggatcaggttctgttgacaacgaatgctgatggtttaagatttgtcaaggttagaatgcgatcagtgcgcataccacaaataggagataagttcagcagtaggcatggtcagaagggaactgttggaatgacttacacacaagaggacatgccatggacaatcgaaggcatcacaccggatatcattgtgaatccacatgctattccatcccgtatgactattggccagctgattgagtgtattatgggtaaagttgcggctcacatgggaaaggaaggagatgcaactcctttcactgatgttactgtggataatatcagtaaagcactgcacaagtgtggctatcagatgcgtggatttgagaccatgtacaatggtcatactgggagaaaattgactgccatgattttcttaggtccaacttactaccagagacttaagcatatggtggatgacaaaattcactctagaggtcgtggtcctgtccagatactgaccagacagccagcagaggggcgctcacgtgatggtggtctccgttttggagaaatggagagggattgcatgattgctcatggagctgcatttttcttgaaggaaaggttgtttgaccagagcgatgcttacagagtgcatgtttgtgagaagtgtggactcattgccattgccaatctcaagaagaattccttcgaatgcagaggctgcaagaacaaaactgacattgtccaggttcatataccgtacgcatgtaagctcctcttccaggagctcatggcgatggcgattgctcccaggatgctcacccatgaggtcaagggtgcgagggataagcatcgttgagcttgaatgttgtattcaggtgcctgactggagctgttctccggggtaccttgttgtggaacttaagaatgagtacggctcttctgacatggattttggttctgatggctaggcatttttaagagctatcctcctgattgtgttctggatacgtgagacgccagacatgaagttacttaggttctttacattagtattcatttactaacaggactaataatgtgtaccttatctctatgacggatcgatggtaacatcatcttttgacagtcttggcttttaagagctcaacttgaacgatgcttgtatcattgtatgaagatagttgcatgaa

SEQ ID NO: 1635 - DNA, 4249 bp, Sorghum bicolor
gaaaaccccaaaccgacttcggctgttcgtatattgcgaaccaaatcgggcaatcgtgcccaattccgcttcccctcgccacttcgccccgcacccctaccgcgccgtctgtagccctcgggagaggcggctcgccgagacatcgatcccccaccccgctcccagcagcagctcgccactagggctagggctctgtccatggaggatgacgagtacgaggaggggatggagatgggctacggcgggcatcagcagcacggcggcggccacgcggggtacggcgcggatgaggacgacgagatggggtacggcggcgggggcggggacggggacggggacggggaagagatggaggaggaggcggacggggaccccgatctgcgggatgagatcgggcaggacgacgcctgggccgttatctccgcttacttcgaggagaagggcctcgtgcgccagcagctcgactccttcgacgagttcatccagaacaccatgcaggagattgtcgatgagtcagctgacatcgagatccgccccgagtcgcagcacaaccctggccgccaggctgaatttgccgagactctgcacaagatcagctttggtcaaatctatctcagcaagccaatgatgactgaagccgatggagagacagctactttatttccaaaatcagcaaggctcaggaacttgacatactctgcaccactgtatgttgatgtgtcatacagagtaatgaagaaaggacatgactgtgaggaagttacagagactgcagactatccaaaagtgtttattgggaaggttccaataatgttgcgttctagttactgcacactgtatcaacaatctgagaaggatctcactgaacttggggagtgtccttatgaccaaggtggttatttcattatcaatggaagtgaaaaggttcttattgcccaggagaagatgagcaccaaccatgtctatgtttttaagaagaggcagcctaacaaatttgcatatgtggctgaagtccgttccatggctgagaaccagaacagaccagccagcagcatgtttgtacggatgctttcgcgagcaggagcaaaagggggatcatctggtcaatatattcgtgctactctgccttatattcgtgcggacattcccattatcattgtatttcgagcattaggatttgttgcggacaaggatatactggagcatatttgttatgacttctctgatacacaaatgatggaattgctacgcccatctctcgaggaagcttttgtcattcaaaatcaacaggttgctctggactacattggaaaacgtggtgcaacagttggtgtcactcgagaaaagagaattaaatatgcaaaggaaatacttcaaaaggaaatgttgcctcatgttggtgttggggaattctgtgaaactaagaaggcatactattttggatatattattcaccgcctactgatgtgcgctcttggtcgaagagctgaggatgaccgagatcattacggaaacaaaagattagatcttgctggtccactgcttggtgggctgtttagaatgtgtgtagataatggaaaggaagttaatttgcaatttgctatcaaagcaaaaactatcaccagtggcttgaagtactcccttgctactggaaactggggacaggctaaccaagctggaaccagagcaggggtttctcaggtgcttaatcgcctcacctatgcttctacactttcacatctccggaggctgaactctcccattgggcgtgaaggaaaattggcaaaaccccgccagttgcataattcgcattggggaatgatgtgtcctgctgaaacaccagaaggacaggcttgtggcttggtgaaaaatcttgccttgatggtatatatcactgttggttctgctgcgaatccaattttggaatttttggaggagtggggcacagaaaattttgaggagatatcaccagctgtcattccacaagctgctaaaatttttgtcaatggttgttgggttggaattcataggaaccctgacctgttggttaagactcttaggcgtctaagaagacagattgatgtcaacactgaagttggtgtggttcgtgatatccgtcttaaagaacttcgactctacacggattatggacgctgcagtcgtccattgtttattgttgagggtcagaggctgctcatcaagaaggcgcatataatagctttgcaacatagggagactcctgatgaaggctggcatgaattagtctcaaaaggatatatagagtacatagatactgaagaagaggagactaccatgatctccatgaccataagtgaccttcataatgcaaggcacaacccagaggatgcttactctgaaacttacacacattgtgagattcatccttcattgatacttggagtttgtgcatcgattattccttttcctgaccacaaccagtcacctcgtaatacatatcagtctgctatgggaaagcaagccatgggaatttatgtcaccaattatcagttaaggatggacactttggcctatgttctatactacccacaaaagcctctagtcactacccgtgctatggaacatttgcacttcagacagttaccagctggcattaatgcaattgttgctatcgcttgttattctggatataatcaagaagattcagttattatgaatcaatcttccatagatcgtgggttcttccgatcactatttttccgctcttacagagatgaggaaaagaagatgggtacacttgtcaaagaggaatttggtcgtccaaatagggaaaatactatgggaatgcgtcatgggtcatatgataaactagatgatgatggccttgcaccacctggaacaagggtctcaggggaagatgtcattattgggaagacatctcctattccacaggatgacgctcaagggcaagcttctagatactcgaagcgtgatcatagtacttctctgcgtcacagtgaaagtggcatggtagatcaggttctgttaacaacaaatgcggatggtctaagatttgtcaaggttaggatgcgatctgttcgcataccacaaattggagacaagtttagcagtaggcatgggcaaaaaggaactgttgggatgacttacactcaagaggatatgccatggacaatcgaaggcatcacacccgatattattgtgaatccacatgctattccatcccgtatgactattgggcagctgattgagtgcattatgggtaaagttgcggcccagatggggagggaaggcgatgccactccattcaccgatgtgactgtggataacatcagcaaagctcttcatagatgtaattatcaaatgcgtggatttgaaaccatgtacaatggtcacactggaagaaaactgactgcaatgattttcctgggtcccacgtattaccaaagactcaagcacatggtggatgacaaaatacattctagaggacgtggtcctgttcagatactcacccggcaaccagcagaggggcgatctcgtgatggtggtctccgctttggagaaatggaaagggattgtatgatcgcacatggagcagctttcttccttaaggaaaggctgtttgaccagagtgacgcatacagagtccatgtatgcgagaaatgtggtctcatcgcaattgctaacctaaagaaaaactcgttcgaatgtaggggctgcaagaacaagactgacattgtccaagtacacataccctatgcttgtaagcttctgttccaggagcttatggcaatggccattgctcccagaatgcttacccatgatatgaagacagggaaggatcagaagaagcgctgaatgtgtatcacatgagatgtgtaaccggaactcttgctccattgttatattcctggttcacacgatataataccccgttgaggaacttctttgtggtcacttgttttctgatttggagtttggttcttcacgaacaatggacaggccattagtcttttgatccctatctgtgttcgtgttgtctgaggatctgtgccaacagatcgttgagttaattttgtacattaggaatgtgctgcaatgtattaatctgtgtgagtacaaagactttgggggcacaaaggtgccattttggacacttggtgtaactgtacgttaatactaattgctatgccattacaatttcagttttattttgaactacatggagttttagtggcatgtctccaaacta

SEQ ID NO: 1636 - DNA, 3910 bp, Secale cereale
accagcacctccagcaccgggggtacggagctgaggaggaggttgaggggggatacgccggcggcggggacggggaggacgaggaggaggaggcgcgggacgaggaggagattacccaggaggacgcctgggccgtcatctccgcctacttcgaggagaagggcctcgtgcgccagcagctcgactccttcgacgagttcatccagaacaccatgcaggaaatcgtcgatgagtcggccgacatcgagatccgccccgagtcgcagcacaaccccggccgccaggccgagttcgccgagacactccacaagatcagctttggtcaaatctatctgagcaaaccaatgatgactgaagctgatggagagactgctaccttattccccaaatcagcaaggcttaggaatctgacatactcagcaccactttatgtagatgtatcatacagagttgtaaagaaagggcatgactgtgaagaagttacagaaactgcggagtacccgaaagtcttcattggaaaggttccaatcatgctgcgttctagttactgtacattgtttcaacaatctgaaaaggatcttacagaacttggagagtgcccttatgaccaaggaggatattttgtaatcaacggtagtgaaaaggttctcattgcccaggagaagatgagcaccaaccatgtctatgtgtttaagaagaggcaaccaaataagtttgcatatgtgggtgaagtccgttcaatggcagagaaccagaacagacctgctagtagcatgtttgttcggatgctttcccgagctggcgcgaaagggggttcatctggtcaatatatccgtgctactctgccctacattcgtgcagatattcccatcatcattgtgtttagagcactaggatttgttgctgacaaagatatactggagcacatatgttacgatttctccgatacacaaatgatggaattgctgcgcccatctttggaggaagcctttgtcattcaaaatcagcaggttgctctggactacattggaaagcgtggtgctacagttggtgtaactcgagaaaaaagaataaagtatgcgaaagagatacttcagaaggaaatgttgccccatgttggtgtaggcgaattctgtgaaactaaaaaggcatactactttgggtatattattcaccgcctgttgatgtgtgcccttggtcgaagagctgaagatgacagagatcattacggcaacaaaaggctcgaccttgcaggtccattgcttggaggactgttcagaatgcttttcaggaaattgacgagggatgtgaggtcatatgttcagaagtgtgtcgataatgggaaggaagttaatttgcaatttgctattaaagctaaaaccattactagtggattgaagtattcccttgctactggaaactgggggcaggctaaccaggctggcacaagagccggtgtgtctcaggtgcttaatcgccttacatatgcttctacattatcacatcttcggaggttgaactctcccattgggcgtgaagggaaactggcaaaacctcgccaattgcataattctcattggggaatgatgtgccctgctgaaacacctgaaggacaggcctgtggcttggttaaaaatcttgccttgatggtttatatcactgttggttctgccgcaaatcctattttggaatttttggaagagtggggcacagaaaattttgaggagatatcaccggcagtcattcctcaagctgctaaaatatttgtcaatggttgttgggttggaattcataggaatcctgacctattggtgaagacccttcgtcgtttaagaagacagattgatgtcaacactgaagttggtgtcgttcgtgatattcgtcttaaagaacttcgactctatactgattatgggcgttgcagtcgcccgctgtttatcgttgaaaaccagaggcttctaattaagaagaaacatatccgagcactgcagcaaagggagactcctgatgaaggttggcatgacttggttgccaaaggatttatagagtacatagatactgaagaggaagaaactactatgatctccatgactatacgtgaccttgaaacttcgaggcataacccaggggaggcatattctgagacttacacacactgtgagattcacccttcattgatacttggtgtgtgtgcgtcaattattccttttcctgatcacaaccagtcacctcgtaatacatatcagtctgctatgggaaagcaagccatgggaatctatgttaccaactatcagttaagaatggacacattggcctacgttctgtactacccacaaaagcctcttgttactactcgtgctatggagcatttgcacttcaggcagttaccagctggtattaatgcaattgttgctattgcatgctactctggatataaccaagaagattcggttattatgaaccaatcttcaatagatcgtgggttcttcagatcactatttttccgctcttacagagatgaggaaaagaagatgggaactcttgtcaaagaggaatttggtcgtccaaatagggagaacactatgggaatgcgccatgggtcttatgataaattagatgatgatggccttgcaccaccgggaacaagggtctctggggaagatgtcattattgggaagacatctccaattccacaagatgatgctcaagggcaagctactagatactcaaagcgtgatcatagtacttctctgcgtcatagtgaaagtgggatggtggatcaggttctgttgacaacgaatgctgatggtttaagatttgtcaaggttagaatgcgatcagtgcgcataccacaaataggagataagttcagcagtaggcatggtcagaagggaactgttggaatgacttacacacaagaggacatgccatggacaatcgaaggcatcacaccggatattattgtgaatccacatgctattccatcccgtatgactattggccagctgattgagtgtattatgggtaaagttgcggctcacatgggaaaggaaggagatgcaactcctttcactgatgttactgtggataatatcagtaaagcactgcacaagtgtggctatcagatgcgtggatttgagaccatgtacaatggtcatactgggagaaaattgactgccatgattttcttaggtccaacttactaccagagacttaagcatatggtggatgacaaaattcactctagaggtcgtggtcctgtccagatactgaccagacagccagcagaggggcgctcacgtgatggtggtctccgttttggagaaatggagagggattgcatgattgctcatggagctgcatttttcttgaaggaaaggttgtttgaccagagcgatgcttacagagtgcatgtttgtgagaagtgtggactcattgccattgccaatctcaagaagaattccttcgaatgcagaggctgcaagaacaaaactgacattgtccaggtccatataccgtacgcatgtaagctcctcttccaggagctcatggcgatggcgattgctcccaggatgctcacccatgaggtcaagggtgcgagggataagcatcgttgagcttgaatgttgtattcaggtgcctgactggagctgttctccggggtaccttgttgtggaacttaagaatgagtacggctcttctgacatggattttggttctgatggctaggcatttttaagagctatcctcctgattgtgttctggatacgtcagacgccagacatgaagttacttaggttctttatacattagtattcatttactaacaggactaataatgtgtaccttatctctatgacggatcgatggtaacatcatcttttgacagtcttggcttttaagagcttaa

SEQ ID NO: 1637 - DNA, 4421 bp, Vitis vinifera
tctttgagcctgcctctcttctagggttttctgtctccgctaaatcttctctagaaagctgcctacaaaactagaaaattaacgtctagaaacagaaggttcaatttcaatttgaaaaattataaaaattaagcacaggaaaagttgtagctctctggaaaagtaatatatacggattccaagttactagaggatccaactgttaggattttgtgaggtgtgtggaattagggttttgctgtgaagatgtacggtgaagacgagtacgatccaacggtggttgaggaggaggaggatgatgatgaggagatcactcaggaagatgcctgggcggtgatcagtgcctactttgaagagaagggtctggtgaggcaacagcttgattcgttcgacgagttcattcagaatacgatgcaagaaatcgtggacgagtcggccgatatcgagattcgccctgaatcgcagcacaatcccggtcggcagtccgatttccttgagactatctataagataagttttggtcagatatacctgagtaagccaatgatgacagaatccgatggagaaactgctactttatttccgaaagctgccaggttaaggaacttgacctactcagctccattgtatgtcgatgttacaaagaggattataaagaaagggcatgaccttgaagaggtcactgaaactcaggagttcaccaaagttttcattgggaaggttccaattatgcttcgatctagttattgcacagtgtaccagaactcagagaaagatttaactgaacttggagagtgtccttatgatcaaggtgggtacttcattattaatgggagtgaaaaggttctgattgctcaagagaagatgagcaccaatcatgtgtacgtgtttaagaagaggcagcctaacaaatatgcttatgtggctgaggttcggtctatggcggaatcccaaaacaggccaccgagtagcatgtttgtccggatgctttcaaggactagtgccaaagggggatcttcagggcaatatatccgtgctacccttccatatatacggacagaaatcccaataatcattgtgtttcgagcattaggatttgtggccgacaaagatatattagagcacatatgctatgatttttctgatactcaaatgatggagttacttcgcccgtccttagaagaggcatttgttattcaaaatcaacaggttgcattggactacattggtaaaagaggatccactgtgggtgtcacgagggaaaagaggatcaagtatgccaaagagatccttcaaaaggaaatgcttccgcatgtcggtgtgggggaatactgtgagactaagaaagcttactattttggatacatcattcatcggcttttactttgtgcacttggccgaaggccggaagatgatagggatcactatgggaacaagaggctggaccttgctggtcctttacttggaggcctttttcgaatgttattcagaaagttaaccagggatgtgagagcttatgttcagaagtgtgtggataatggaaaagatgttaacttacaatttgcaattaaagcaaaaacaattactagtggtctcaagtactctcttgctactgggaactgggggcaagcaaatgcagctggtactagagcaggagtatcacaggttttgaatcgtttaacctatgcttccactctgtcgcacttacgaaggttaaactcacccatcggtcgtgaaggaaaattggcaaaaccacgacagttgcacaattcgcactggggaatgatgtgtcctgcagaaacacctgaaggacaagcatgtggactagtgaagaatcttgcattaatggtgtacataacagtaggatctgcagcaaatcctattttggagtttttggaggagtggagtactgaaaattttgaggaaatatctcctgcagttattcctcagtcaaccaaaatttttgtgaacggttgctgggttggcattcatcgtaaccctgatctgttggtgaagactttgagacagttgaggaggcaggttgatgtgaacactgaagttggagttattcgtgatatccgtttgaaggaactccgtctttacacagactatggacgctgcagtaggccattgtttattgtggagaaacaaagactgctaataaagaagagagatatccgagccttacagcttagagaatcccctgaggatggtggatggcatgatcttgtgtcaaaaggattcatagagtatgttgatactgaggaagaggagactacaatgatttccatgacaatcaatgatctcatttctgcaaggctcaacccggaggaggcttattctgaaacttacactcactgtgaaattcatccctcattaatattaggtgtttgtgcatctattatcccattccctgaccataaccagtctcctcgtaatacctaccaatcagctatgggaaagcaagccatgggaatttatgtcaccaattaccagttacgaatggatacgttagcctatgttctgtactatcctcagaagccccttgttactacccgtgccatggagcatttgcattttaggcagctgccagctggcataaatgccatcgttgccattgcctgctactctgggtataaccaagaagattctgttattatgaaccaatcatcaattgatcgtggattcttccggtcactattcttccggtcatatagggatgaggagaagaagatggggacactggtgaaggaggattttgggcgtccaaatcgggaaaacaccatgggaatgcgacatgggtcttatgataaattggacgatgatggtcttgcacctcctggcacaagagtctcaggtgaggatgtcattattggcaagaccacacctatttctcaagatgattctcagggacaagcttcacgttatacacggcgtgatcatagcacaagcttacgtcacagtgaaagtggcatggtagatcaggttctgttgacaacaaatgcagatgggttaaggtttgttaaagtacggatgagatcagttagaataccacagattggtgacaaattcagtagtagacatggtcagaaaggaactgttggcatgacttatactcaagaagatatgccatggactgtggaaggcatcacccctgacatcattgtcaacccacatgctattccttctcgaatgacaattggccagcttattgagtgcatcatggggaaggttgctgctcatatggggaaggagggagatgctactcctttcacggatgtcactgtggacaatatcagtaaagctctccacaaatgtggttatcaaatgcgtggttttgagacaatgtacaatggtcatacaggccgacgattgactgctatgatattcctgggccctacttactaccagaggcttaagcacatggtggatgataagatccactcacgtgggaggggtccagtacaaatccttactagacagcctgctgaggggcgatctcgtgatggtggtctccgttttggagaaatggaacgtgactgcatgattgctcatggagcagcccacttcctcaaagaaaggttgtttgaccaaagtgatgcttatagggttcatgtctgtgagcgctgtgggttgattgccattgcaaatctcaaaaagaactcttttgagtgcagaggttgcaagaataaaaccgacattgttcaggtgcacattccatatgcttgtaagctcctcttccaagagctcatggccatggccattgccccaaggatgcttacaaaggaagtgaagccacccaaagatcaaaagaaaaaaggagcatgaaataatacattctagggctgtctaatttgcttgtgaaaatttctggtcattgatggagtcgcgtcttctctggggctgaggatcatgaggatatatttttctagttcttccaaaatggaagagctgacaagtagaggattacaatggtagttttatcatgttaccaactcagtatgtcggaaaattatatgattgctgctgctgctgctgcaaaggactgtttcctgtacacgtagctgcagaacaggcctcagaggtgagggttgctaagcagataaaaagccattgcttcctgaagaacgaagaaattaagagaaatttggggatgagtttgttgttggctcattctcaagcattggtatttcactgactgggcagtgttaaccattttacatgtttgatatgtacataaaacccttgctgttacatttctgattttcgaccgttcaagggttgtttttgttttgccttaagaaggatatctattttaattcacctttacgttcgattttgtaactcatatctagtgattgtggaaagtgagaagttagaattaatgatgattcaaatgtagcaggaaaaaaggatacttt

SEQ ID NO: 1638 - DNA, 3592 bp, Manihot esculenta
ccatggaagacgaccaagaatatgatcagcctatgaatgaggaggaagaagacgatgaagagattacgcaggaggacgcatgggctgtcatctctgcgtattttgaagagaaaggcctggtgcgccaacagctcgattcattcgatgagttcatacagaatacgatgcaggaaattgtcgacgagtcggctgatattgagattcgtcccgagagccagcataaccctggccaccagtctgatttcgctgagacaatctataaaatatgctttggccagatttatttgagcaagcccatgatgacagagtctgatggagaaacagccactttatttcctaaagctgcacggttgaggaatctaacatactcagctcccttgtatgtcgatgtcacgaagagggtcataaagaaaggacatgatggtgaagaagttactgaaactcaagatttcaccaaagttttcattggaaaggttcctataatgcttcgatccagttattgcacattataccagaattcagagaaagatcttacagagcttggggagtgtccttatgatcagggtggatattttattatcaatggaagtgaaaaagtactaattgcccaggagaagatgagcaccaatcatgtttacgtgttcaagaagaggcagccaaacaagtacgcatatgttgcagaagttcggtctatggcagagtcccagaaccggccgcctagtactatgtttgtgcggatgctatcccggactagtgccaaagggggctcttcagggcagtatattcgagctacacttccctatataagaactgaaattccaattattattgtatttcgtgctctggggtttgttgctgacaaagacatattagaacacatatgctatgatttctctgatactcaaatgatggagttacttcggccttctcttgaagaagcatttgtgattcaaaatcaacaggttgcactagattatattgggaagcgtggagctactgttggtgtaactaaggaaaaaaggataaaatatgctaaagagatccttcaaaaggaaatgcttcctcatgttggtgttggagaatattgcgagaccaaaaaagcttactattttgggtatataattcaccggcttctactttgtgcacttggccggagggcagaagatgacagagatcattatggcaacaaaagactagacctcgctggtcctttacttggtggactctttagaatgttattcagaaagttgactagggatgtccgatcttatgtgcaaaagtgtgtagataatggaaaggatgttaatctgcaatttgccattaaagcaaaaacaattactagcggtcttaaatactcactagccactggtaactggggccaagcaaatgcagctggtacaagagcaggagtgtcacaggtgttaaatcgtttgacatatgcatctaccttgtcacacttgcgaagattgaattctccaattgggcgtgaagggaaattggctaaacccaggcagttgcacaattcacaatggggaatgatgtgccctgctgaaacacctgaaggacaagcttgtggattggtgaagaatcttgcattgatggtttacataaccgttggatctgctgcttatcctatcttggaatttttggaggaatggggtactgagaattttgaggaaatatctcctgcagtaattcctcaagctacaaagatttttgtaaatggttgctgggtaggcatccatcggaatcctgatatgttggtcaagacattgagacggctgaggagacgggttgatgtcaacactgaagttggggtcgttagagatattcgtttgaaagagctgcgaatatacacggactatggccgttgcagtcgtcctttgttcattgttgagaaacaaaggcttctcatcaagaagaaagacattcatgccctgcagcagagggaatcttcagaagaaggtggttggcatgatcttgtggcaaaaggatttattgaatacattgacacagaggaagaagagaccactatgatatccatgaccattcatgatcttgtacaagcaaggcttaacccagaggaagcttatgctgatacttatactcactgtgagatccatccgtcactgattttaggtgtttgtgcttcaattattccctttcctgaccataaccaggcaatctccacgtaacacatatcaatctgctatgggaaagcaagccatgggaatttatgtcactaattatcaatttcgaatggatacattggcttatgttctttattatcctcaaaaaccacttgttactacaagagccatggagcaccttcactttaggcaacttccagctggcattaatgctattgttgccattgcctgttattctggatacaaccaagaagattctgtcattatgaaccaatcatcaattgatcgtggattcttcagatcacttttcttccgttcatatagggatgaggagaaaaagatggggacacttgtaaaagaggattttgggcgtccagacagagctaatacaatgggcatgcgtcatggctcttatgataaattggatgatgatggtcttgcacctccaggcacaagagtttcaggtgaggatgtgattattgggaagaccactcctatttctcaggaggatgctcagggacagtctgcacgatatacaaggcgcgatcacagcataagcttgcgccacagtgaaacagggatagtggatcaagttcttctgacaacaaacgctgatggattgaggtttgttaaagtaagggtgaggtctgttcgcatacctcagattggagacaagtttagcagtaggcatggtcaaaagggaactgtgggcatgacttacactcaagaagacatgccttggactgtggaaggcatcactcctgatatcattgtgaatccacatgctattccttctcgaatgacaattggtcagcttattgaatgtattatggggaaggttgcagctcatatgggcaaggagggagatgctactccatttactgacgtcactgtggacaacattagcagggctcttcataaatgtggttatcaaatgcgtgggtttgagaccatgtataatggtcacaccggccggcggcttacagctatgattttccttggccccacttattaccaaaggctgaagcacatggtcgatgacaagatccattcccgtggaaggggacccgttcagatcctcacaaggcaacctgctgaaggacgttctcgtgatggtggccttcgctttggggaaatggaaagggattgcatgatagcacatggtgctgcacattttctcaaggagaggctgtttgatcagagtgatgcctatagggtccatgtttgcgagcggtgtggattgatagctattgcaaatctcaagaagaattcatttgaatgcagaggttgcaagaataagactgacattgttcaggtgcatatcccttatgcctgtaagctgctattccaagagcttatggctatggccatagcaccaaggatgctcacaaaagaggaaaagccatccaaagacaaaaagaaaaagggagcctaatctaatc

SEQ ID NO: 1639 - DNA, 4286 bp, Populus trichocarpa
tcttttgaaactcgaggagtcgttctcttattttctttctagggttccactggacgaacaaatacaaatccaaatccgttagtctaaaaaattaaattaaaacaataaataaaaaataattcaaaccagaaacagaaacaaagaaccagaatccctatggaagaccttgacgagtacgatcaacagccgatgaatgaagatatggaaccagaagaagaagacgctgatgaggagatcacgcaggaagatgcctgggccgtcatttctgcttattttgaagagaaaggcttggtgagacaacaactcgactccttcgatgagtttattcaaaatacgatgcaggaaatcgttgacgagtctgctgatattgagattcggcctgaaagccagcacaatccgggtcaccagtctgattttgctgagactatctacaagatcagttttggccagatatacttgagtaagcccatgatgacagagtctgatggagaaactgcaactttgtttcccaaagctgcaaggttgaggaacctgacatactcggctcctttgtatgtggatgttacaaagagggttataaagaaaggtcatgatggtgaagaagtcactgaaactcaagacttcaccaaagttttcattggaaaggtccctattatgcttcgatcaagttattgcacattataccagaattcagaaaaggatttgacagagcttggcgagtgtccgtatgatcagggtgggtatttcattatcaatggtagtgaaaaggttctaattgctcaggagaagatgagcaccaatcatgtgtatgtgttcaagaagaggcagccaaacaagtatgcatatgtaggagaagttcggtctatggcagagtctcagaaccggccacccagtaccatgtttgtgcggatgctttctcggactagtgctaaagggggctcttcagggcaatacatccgtgctactcttccatacattcgaactgaaattccgattatcattgtttttcgtgctttgggttttgttgctgacaaagacattttggaacacatatgttatgatttcgctgatactcaaatgatggagttgcttcggccatctctggaagaggcatttgttattcaaaatcagcaggttgctcttgactacattggaaagcgtggggcaactgttggtgtaactagggaaaaaaggattaagtatgccaaagagattcttcaaaaagaaatgcttcctcatgttggtgttggagaatactgcgagaccaaaaaagcttattacttcgggtatatcattcaccggcttttactttgtgcacttggccggagggcagaagatgatagggatcattatggaaacaagcggcttgaccttgctggtcctttacttgggggcttgtttagaatgttattcagaaagttgaccagggatgtcaggtcttatgtgcaaaagtgtgttgataatgggaaggatgttaacctacaatttgccattaaagcaaaaaccattaccagtggtcttaaatactcacttgccactgggaactggggacaagcaaatgcagctggaacaagagctggagtgtcacaggtgttaaatagattgacatatgcctctacactgtcacatttaagaagattaaattctccaattgggcgtgaagggaaattggcaaaaccaaggcagctacataattcacaatggggaatgatgtgtcctgctgaaacacctgaaggacaagcttgtggattagtgaagaatctcgcattgatggtatacattacagttggatcagctgcatatcccatcctggagtttttagaagaatggggtaccgagaattttgaggaaatatcccctgcagttattccccaagcaacaaaaatttttgtcaatggtggctgggtgggtatccatcgtgatcctgatatgttggtgaagacattgagacggctgcggagacgggttgatgtcaatactgaagttggggttgttagagatattcgcttgaaagagttgcggatttacactgactatggccggtgcagtcgtcctctattcattgtggagaaacaaaagcttcttataaggaagaaggacatccatgcactacaacagagggaaaccccagatgagggtggctggcatgatcttgtgtcaaagggattcattgaatatattgacactgaggaagaagagaccactatgatatccatgaccatacatgatcttgtacaagcgaggattaatccagaggaagcatattctgatacttacacccattgtgagatccacccatcattgattttaggtgtttgtgcttctatcattccttttcctgaccataaccagtccccacgtaacacttaccaatctgctatgggaaagcaagccatgggaatttatgtcaccaattaccaatttcgaatggatacgctggcttatgttctctattatccccaaaagccacttgttactacaagagccatggagcatcttcattttcggcaacttcctgctggcattaatgctattgttgcgattgcttgttattctggatataaccaagaagattctgttattatgaaccaatcatcaattgatcgtggattctttagatcacttttcttccgttcatatagggatgaggagaaaaagatgggcacacttgttaaagaggattttggtcgcccagacagaagtaacacaatgggcatgcgccatggctcttacgataaattggatgatgatggtcttgcacctcctggcacaagagtttcaggggaggatgtgatcattggaaagacgactccaatcgctcaggaagaagctcagggacagtctgcacgctacacgaggcgtgatcacagcataagtttacgtcacagtgaaactggaatggtggatcaagttctgcttacaacaaatgctgatgggttgaggtttgtgaaagtaagggtcagatctgtccgcatacctcagattggagacaagtttagtagtaggcatggtcaaaagggaactgttggcatgacttacacacaagaagacatgccttggactgtggaaggcatcactcctgatattattgtcaacccacatgctattccctctcgaatgacaattggacagcttatcgagtgtattatgggaaaggttgcagcacatatgggaaaggaaggggatgccacaccatttactgatgtcactgtggataatattagcaaagctcttcacaagtgtgggtatcaaatgcgagggtttgagaccatgtataatggtcacactgggcgccggctgtcagcgatgattttccttggtcccacttattatcaaaggctaaaacatatggttgatgacaagatccattcccgtggaagaggccctgtgcagatcctcacaaggcagcctgctgaaggaaggtcacgtgatggtggtctccgctttggtgagatggaacgagattgcatgatagcacatggtgccgcacacttcttgaaagagaggctatttgaccagagtgacgcatatagagtccatgtctgtgagcgttgtgggttgatagctattgcgaatctcaagaagaattcttttgaatgcagaggttgcaagaacaaaaccgacattgttcaggtgcacattccttatgcctgtaagctactcttccaagagcttatggccatggccatagctcctagaatgcttacaaaagatattaaacaggccaagagccagaagaagaagggagcttaattacttgatgaaggttaagagtgacttccatgctcgcagggcatgttggacgtttataattgactcaaacctacctaataacaatgatgttcttgtataaatattatgtcagtagcaattttgttagcattggatgatgggtgccgttgagtatatagagtatttaatcaactattgcttttctgagcccagtttgtatttcaggtctgtttgtcccactgaaagctctaaattcattttacagagtgtcgtcgattcaagttcaagttagtcacggaactgcttgcaaaatgaacttgtgaaaggttttttaatactcgcactaaaattgctggccgctttttggttgctttgagatttaaatagaaacaggatgtctgctagatcaaaattcatttggttacagaattcttggttgttttattatattattatttttccctaataaatctacttgtaatggaatctgttacgttgcctagtaaattaaccaatttatttattctacctaaataaataaattttgaaactaa

SEQ ID NO: 1640 - DNA, 3881 bp, Gossypium hirsutum
tgtaaacgaaagcaagaaaaattccctgtgcgaaacagaaccttaaagaacccttaaatatggaggacgacagtgagtacgatccacagctaatggaagatgaagacgacgaggagatcacgcaggaagatgcgtgggcggttatctctgcttacttcgaagagaaaggtttggtgcgtcaacagctcgactcgttcgatgagtttatccaaaacacgatgcaggaaattgtcgatgaatcggctgatatcgagatcaggcccgagtcacagcataatcctggtcatcagtctgacttcgctgagactatctataagattagctttggtcagatctatctaagtaagcctatgatgactgagtcggatggtgaaactgcaactttatttccaaaagctgcaaggttgcggaatctcacttactctgctccattgtatgtcgatgtaactaaaagagttattaaaaaagggcatgatggtgaagaagtcactgagactcaagattttaccaaagtgttcatcggaaaggttcctataatgcttcgttcgagttattgcacactatatcaaaattcagagaaggatctgactgagcttggggagtgtccatatgatcaaggtgggtatttcattatcaatgggagtgaaaaagttctaattgcccaagagaagatgagcacaaatcatgtctatgtattcaaaaagaggcaaccaaacaaatacgcctatgtagcagaagttcgatccatggcagagtcccaaaataggccaccaagtaccatgtttgtgcggatgctttcgcggacgagtgccaaagggggctcttcaggccagtacattcgtgctactcttccatatattcgtactgaaattcctatcataattgtgttccgggctttgggatttgttgctgacaaggatatattagagcatatatgctatgacttctctgatacccagatgatggagctgcttcggccttccttagaagaagcatttgtgattcaaaaccagcaggttgcactagattatatcggtaaaagaggagcaactgttggtgttaccagagaaaagaggattaagtacgcaaaagagatccttcaaaaggaaatgcttcctcacgttggtgttggagagttttgcgagacaaagaaagcttattattttgggtatatcattcaccggctgcttctttgtgcacttggccgaagggcagaagatgatagagatcattatggcaacaagaggctggaccttgctggtcctttacttggaggcctctttaggatgctttttcggaagttaactagggatgtgagatcttatgtgcagaagtgtgtggataacggaaaggatgtaaacctgcaatttgctatcaaagcaaaaactattacaagtggtcttaaatactcactcgctactggaaattgggggcaagcaaatgcagctggtacaagagctggagtgtcacaggtgttaaatcgtttgacatatgcctccacgttgtcgcacttgcgaaggctcaattctcctataggacgtgaagggaaattggctaagccacgtcagttgcataactcacagtggggaatgatgtgtccagctgaaacaccagaaggacaggcctgtggacttgtaaagaatcttgccttgatggtgtacataactgttggatcagctgcatatcctattcttgaatttttggaagaatggggtacagagaattttgaggaaatttcacctgcagttattcctcaagctacgaaaatttttgtcaatggttgttgggttggtgtgcatcggaatcctgatatgcttgtaaccacattgagacggctgagaagacgggttgatgtcaacactgaagttggtgttgttcgagatattcgtttgaaagaacttagaatatatactgactatggccgttgcagtcggccattgttcattgtggagaagcaaaggcttctaataaaaaagaaagacatccatgcattgcaacaaagggagaccccagaagacggtggctggcatgatcttgtagccaagggatttattgaatatattgacacagaagaagaggagacaactatgatttccatgaccatcaatgatcttgtccaagcaagaatcaacccagaggaagcttattctgaaacttacacccactgtgaaatccacccttcactgattttgggtgtttgtgcttcaattataccattccctgatcataatcagtccccacgtaatacctatcaatctgctatgggtaagcaagcaatgggtatatatgtcaccaactaccaatttcgaatggatacattggcctacgttctctactatccccaaaagccacttgttactacacgagctatggaacatctccattttcggcagcttcctgctggcattaatgctattgtggccattgcctgctattctggatataaccaagaagattccgttatcatgaatcaatcatcaatagaccgtggattcttccgatcacttttcttccgttcttaccgggatgaggagaaaaaaatggggaccctcgtcaaagaagatttcggccgaccagatagggctaccactatgggaatgaggcatggctcttacgataaattggatgatgatggtcttgcacctcctggaacaagagtttcgggtgaggatgtaattattgggaagaccacacctatttcacaggaggaagctcagggtcaagcatcacgctattcaaaacgtgatcatagcataagcttacgacacagtgagacaggcattgtggaccaggttctattgacaactaatgctgatggattgagatttgtgaaagtaagagtaagatccgttcggattcctcagattggagataagttcagtagtcggcatggtcaaaagggaacggttggcatgacttacacccaggaagacatgccttggactgtggaaggcatcacacctgatatcattgtgaatccacatgctattccttcccgtatgacaatcggtcagcttattgagtgtattatgggaaaagttgccgctcacatgggcaaggaaggtgatgcaactccatttacagatgtcactgtggacaatatcagtagagcacttcataaatgtgggtatcaaatgcgtggtttcgagaccatgtataatgggcacacaggcaggcggcttactgctatgatattcttgggacccacatattaccaacgactaaagcatatggtcgacgataagatccattcacgtggtcggggtcctgttcaaattctaacgaggcaacctgcagagggacgttctcgtgatggtggtcttcgttttggagagatggaacgagattgcatgattgcacatggtgctgcccatttcctcaaggaaagattatttgaccaaagtgatgcatacagagtccacgtttgtgaacgatgtggattgattgctatcgcaaatctaaaaaagaactcgtttgaatgcagaggatgcaagaataaaactgatatagttcaggttcatattccttacgcttgtaaactgctgttccaagagcttatggcaatggcaatcgctccaagaatgcttacgaaggaaccgcccaaagaccaaaagaagaaaggagcgtgagatgcacgtgatctaaaatcaggtcaagctttattgctccttatttagaatcctccctttataataataaacacagtggagattctgaataatcttatgaaattttttatttcactttttattgtctacataaatgttgtactactattagttgaatattacatatattatgtattgctaatcttgaattttttgtgggtgtcattaccaaattttgtaaaaaaaaaaattatatacaaactatactttctt

SEQ ID NO: 1641 - DNA, 4189 bp, Eucalyptus grandis
ctcgcgatctctccctcagcacaatcccgtgcgcgagcggccgcgctgcggagaacttccctcccaaaagaatcgaactccagttcgaacgaacgaacgaacgaacgaacgaactcgcttccgaactcgaaccgctaacgccgtaaagctcaatccgagggggagaatccagggggcgatttagggtttcgaagctcgcggcggccatgatggaggacgagcaggagtacgatccggcgtacgccgagggggagggggaggaggacgacgacgagatcacgcaggaggacgcgtgggccgtcatctcggcctacttcgaggacaagggcctggtgcggcagcagctcgactccttcgacgagttcatccagaacacgatgcaggagatcgtggacgagtccgccgacatcgagattcgccccgagtcgcagcacaaccccggccaccagcccgatttcgccgagaccatatataaaatcaactttggtcaaatatacttgagtaagccgatgatgaccgagtcagatggagaaacggcaactttatttcccaaagctgcaaggttgagaaatctgacgtactcagctcccttgtatgttgatgtttccatgagagttatcaagaagggacatgatggtgaagaactcactgaacctcaggacttgcaaaaagtttttattggaaaggtccctataatgctccgatcaagctattgcacattataccagaattcagagaaggatttgactgaacttggagagtgtccttatgaccaaggtggttattttatcattaatggaagtgaaaaggttttaattgctcaggagaagatgagcaccaaccatgtgtatgtgttcaagaagaggcagcccaataagtacgcctatgttgcggaagttcggtcaatggctgaatctcaaaataggccacccagcacaatgtttgtccgcatgctttctcgcacaagtgccaaagggggatcttcagggcagtatatccgggcgactcttccgtatattcggacagagatccctataataattgtgtttcgagctctgggttttgttgctgacaaggacatactggagcatatatgttatgacttctctgatactaaaatgatggagttgcttcgtccttctcttgaggaagcatttgtaatacaaaatcaacaggttgctctagactacattggtaagcgaggagcgacagttggtgtgactcgagaaaaacgtataaagtatgccaaagaaatccttcagaaagaaatgcttccacatgttggtgttgaagagtattgcgagacaaaaaaagcttattactttggatacatcatccatcggcttcttttatgtgctcttggtcgaaggccagaagatgaccgtgatcactatggcaacaagaggctagatcttgctggacctttacttggaggcttgttcagaatgctttttagaaaattgacaagggatgttaggggatatgtgcagaagtgtgttgacaatggaaaggatgtcaacctccaattcgcaataaaagcaaaaaccataactagtggtcttaagtactcgcttgccacggggaactggggacaagccaatgctgctggaacaagagctggagtgtcacaggtgctgaatcggttaacatatgcttcgacgttgtcacatctgagaagactaaattcaccaataggacgtgaaggtaaattggcaaagccacgacagctgcacaattcgcaatggggaatgatgtgtccagccgagactcctgagggacaagcttgcggactggtgaagaatcttgctttgatggtctatattacagtcgggtcagcagcatatcccatattggaatttttggaagaatggggcacggagaattttgaggaaatttctcctgtggttattcctcaagcgacgaaaatttttgtcaatggttgctgggttggcatccatcgtgatcctgatatgttggtgaaaacgttacgacggttgaggagaagggttgatgtcaatactgaagttggggttgtcagagatatcagattgaaggaactgaggatatacactgattatggacggtgtagtcgtccactgtttatagttgagaaacagagacttctaataaagaagcagcatatacatgcattgcaactgagagaagggagcccggacgatgtggggtggcatgagttagtggctaagggattcatagagtatatcgacactgaggaagaagaaactactatgatttccatgaccattaatgaccttgtgcaagcacggcttaaccctgaggaggcatattcagaaacttacacccactgtgaaatccatccatcattgatcctaggtgtttgtgcttcaatcataccgttccctgaccataaccagtctccacgtaatacgtatcaatcagcaatgggaaagcaagccatgggaatttacgtcaccaactaccaatttcggatggatacattggcatatgtgctatactaccctcaaaagcctcttgttactacacgagctatggagcaccttcacttcaggcagctccctgctggcattaatgccattgtcgccattgcttgctattctgggtacaatcaagaagattccgtcattatgaaccagtcatcaatagatcgtggatttttccgatctctgtttttccgatcatacagggatgaggagaaaaagatggggactctggtcaaagaggatttcggtcgtcctgacagagccaatacaatgggcatgaggcatggctcctatgataaattggacgatgatggccttgcccctcctggaacaagggtttcaggtgaagatgtcattattggaaaaacaactccaatcgcacaagatgatgctcagggacaagcctcccgttattcaaggcgcgatcacagcataagtttacggcacagtgagactgggatagttgatcaggttctgctgacgacaaatgctgatggcttgagatttgtcaaagtaagagtgagatctgttcgaatacctcaaattggggataaatttagcagtaggcatgggcaaaaaggaacagtgggcatgacatacacgcaagaagacatgccttggactgtggaaggcattacacctgatatagtcgtgaacccacatgctattccctctcgcatgacaattgggcagcttattgagtgtatcatgggcaaggttgctgcccacatgggaaaggaaggagatgctactccattcacagatgtgactgtggataacatcagcaaagcgcttcataaatgtgggtatcagatgcgaggattcgagacaatgtataatggtcacactggccggcggctcactgctatgattttcctgggtccaacatattatcagagactcaagcacatggtggatgataagatccattcccgtggtcggggtcctgtgcaaattcttacaaggcagcctgccgagggacgatctcgagatggtggtctccgatttggagagatggaaagagattgcatgattgctcatggagccgctcattttctcaaggagaggttgtttgaccaaagtgatgcgtatagagtccatgtgtgtgaacgctgtggattgattgccattgcaaacctgaagaagaattcttttgagtgcagaggttgcaaaaacaaaaccgacattgttcaggttcacattccttatgcttgtaaattgctcttccaagagcttatgtccatggccatagcacctagaatgctcaccaaggatatcaaaccagcaaaggaccagaagaaaaagggtgcttgaactcgggtagttgagattccatttggttcgattggtcgagcgctgctgttttgtatggccttgtacttataagtgtcaaccatctaattatctgtaatgagggactcggttcttctcggtaaaggacatgtccctgcgatgtaaggcatcagtgttcaggtttgtttgtccaaaggactgaaattttacctagcaaaagaaattgtatgtttagttaaatcaatttgccgagtgaaggcaagatatcccttgtattcgagcctcgatattctcggtgcaaaaaccaattttaattttaatggccggctgtatgtagaatgtcttccggcttaaccggggaactaggatgataccggttcaataggaagttcggcccttgagtccgttgtcca

SEQ ID NO: 1642 - DNA, 4033 bp, Gossypium raimondii
agtccatccgggtcatccatatttaatcgtcccgcttcaccgcccgctcttaatagactcaaattctcccactctctcaagttagggttttactttcaaaatttccctttaaacgaaagcaagaaaaattccctgtgcgaaacagaaccttaaagaacccttaaatatggaggacgacagtgagtacgatccacagctaatggaagatgaagacgacgaggagatcacgcaggaagatgcgtgggcggttatctctgcttacttcgaagagaaaggtttggtgcgtcaacagctcgactcgttcgatgagtttatccaaaacacgatgcaggaaattgtcgatgaatcggctgatatagagatcaggcccgagtcacagcataatcctggtcatcagtctgacttcgctgagactatctataagattagctttggtcagatctatctaagtaagcctatgatgactgagtcggatggtgaaactgcgactttatttccaaaagctgcaaggttgcggaatctcacttactctgctccattgtatgtcgatgtaactaaaagagttattaaaaaagggcatgatggtgaagaagtcactgagactcaagattttaccaaagtgttcatcggaaaggttcctataatgcttcgttcgagttattgcacactatatcaaaattcagagaaggatctgactgagcttggggagtgtccatatgatcaaggtgggtatttcattatcaatgggagtgaaaaagttctaattgcccaagagaagatgagcacaaatcatgtctatgtattcaaaaagaggcaaccaaacaaatacgcctatgtagcagaagttcgatccatggcagagtcccaaaataggccaccaagtaccatgtttgtgcggatgctttcgcggacgagtgccaaagggggctcttcaggccagtacattcgtgctactcttccatatattcgtactgaaattcctatcataattgtgttccgggctttgggatttgttgctgacaaggatatattagagcatatatgctatgacttctctgatacccagatgatggagcttcttcggccttccttagaagaagcatttgtgattcaaaaccagcaggttgcactagattatatcggtaaaagaggagcaactgttggtgttaccagagaaaagaggattaagtacgcaaaagagatccttcaaaaggaaatgcttcctcacgttggtgttggagagttttgcgagacaaagaaagcttattattttgggtatatcattcaccggctgcttctttgtgcacttggccgaagggcagaagatgatagagatcattatggcaacaagaggctggaccttgctggtcctttacttggaggcctctttaggatgctttttcggaagttaactagggatgtgagatcttatgtgcagaagtgtgtggataacggaaaggatgtaaacctgcaatttgctatcaaagcaaaaactattacaagtggtcttaaatactcactcgctactggaaattgggggcaagcaaatgcagctggtacaagagctggagtgtcacaggtgttaaatcgtttgacatatgcctccacgttgtcgcacttgcgaaggctcaattctcctataggacgtgaagggaaattggctaagccacgtcagttgcataactcacagtggggaatgatgtgtccagctgaaacaccagaaggacaggcctgtggacttgtaaagaatcttgccttgatggtgtacataactgttggatcagctgcatatcctattcttgaatttttggaagaatggggtacagagaattttgaggaaatttcacctgcagttattcctcaagctacgaaaatttttgtcaatggttgttgggttggtgtgcatcggaatcctgatatgcttgtaaccacattgagacggctgagaagacgggttgatgtcaacactgaagttggtgttgttcgagatattcgtttgaaagaacttagaatatatactgactatggccgttgcagtcggccattgttcattgtggagaagcaaaggcttctaataaaaaagaaagacatccatgcattgcaacaaagggagaccccagaagacggtggctggcatgatcttgtagccaagggatttattgaatatattgacacagaagaagaggagacaactatgatttccatgaccatcaatgatcttgtccaagcaagaatcaacccagaggaagcttattctgaaacttacacccactgtgaaatccacccttcactgattttgggtgtttgtgcttcaattataccattccctgatcataatcagtccccacgtaatacctatcaatctgctatgggtaagcaagcaatgggtatatatgtcaccaactaccaatttcgaatggatacattggcctacgttctctactatccccaaaagccacttgttactacacgagctatggaacatctccattttcggcagcttcctgctggcattaatgctattgtggccattgcctgctattctggatataaccaagaagattctgttatcatgaatcaatcatcaatagaccgtggattcttccgatcacttttcttccgttcttaccgggatgaggagaaaaaaatggggaccctcgtcaaagaagatttcggccgaccagatagggctaccactatgggaatgaggcatggctcttacgataaattggatgatgatggtcttgcacctcctggaacaagagtttcgggtgaggatgtaattattgggaagaccacacctatttcacaggaggaagctcagggtcaagcatcacgctattcaaaacgtgatcatagcataagcttacgacacagtgagacaggcattgtggaccaggttctattgacaactaatgctgatggattgagatttgtgaaagtaagagtaagatccgttcggattcctcagattggagataagttcagtagtcggcatggtcaaaagggaacggttggcatgacttacacccaggaagacatgccttggactgtggaaggcatcacacctgatatcattgtgaatccacatgctattccttcccgtatgacaatcggtcagcttattgagtgtattatgggaaaagttgccgctcacatgggcaaggaaggtgatgcaactccatttacagatgtcactgtggacaatatcagtagagcacttcataaatgtgggtatcaaatgcgtggtttcgagaccatgtataatgggcacacaggcaggcggcttactgctatgatattcttgggacccacatattaccaacgactaaagcatatggtcgacgataagatccattcacgtggtcggggtcctgttcaaattctaacgaggcaacctgcagagggacgttctcgtgatggtggtcttcgttttggagagatggaacgagattgcatgattgcacatggtgctgcccatttcctcaaggaaagattatttgaccaaagtgatgcatacagagtccacgtttgtgaacgatgtggattgattgctatcgcaaatctaaaaaagaactcgtttgaatgcagaggatgcaagaataaaactgatatagttcaggttcatattccttacgcttgtaaactgctgttccaagagcttatggcaatggcaatcgctccaagaatgcttacgaaggaaccgcccaaagaccaaaagaagaaaggagcgtgagatgcacgtgatctaaaatcaggtcaagctttattgctccttatttagaatcctccctttataataataaacacagtggagattctgaataatcttatgaatttttttatttcattttttattatctataaatgttgtactattattagttgaatattacatatattatgtattgctaatcttgaactttttgtgggtgctattaccaaattttgtaaaaaaaaaaaaattatatacaaactatactttcttctagagtgttataatttttttttacttaagttttttgaaaaatat

SEQ ID NO: 1643 - DNA, 4577 bp, Ricinus communis
gagctaaaaagtcaccgtgcgcatccctttcgaaccagtttgcagcgactctctttttcttttatgttcacaatcgaactctgtaattctcgcgaaaaaccatcgtttagggtttaactgaacgaacactaacaaataaatgaaccattaaactaccaaatgaatttaacaaaatacgtaagaaagaaaaattaaaaaagaaagataaacatacttgtgaacaaaaagttaattgaaataaagagctagggtttctgtaaagatggaggatgatcaggaatacgatcaaaatctaaacgaggactacgaagacgaagacgaagatgagataactcaggaggacgcatgggccgtcatttcggcttatttcgaggagaaaggtctggtgcgacaacagcttgattcgttcgacgagtttattcaaaatacgatgcaggaaatcgtcgacgaatctgctgatatcgagattcgaccggagagccagcataatcccggccaccagtccgattttgccgagactatctataaaataagctttggtcagatatacttgagcaagcccatgatgaccgagtctgacggtgaaactgcaactttatttcctaaagctgcaaggttgaggaacctaacatactcagctcccttgtatgttgatgtgacaaagagggtaataaagaaaggacatgatggcgaagaagtcaccgaaactcaggatttcaccaaagttttcattgggaaggttcctataatgcttcggtcaagttattgcacattgtaccagaattcagagaaagatcttacagaacttggggagtgtccttacgatcagggtgggtattttattatcaatggaagtgagaaggttctaattgcccaggagaagatgagcaccaatcatgtttatgtgttcaagaagaggcagccaaataaatatgcgtatgtggcagaagttcggtccatggcagagtcgcagaatcggccacccagtaccatgtttgtgcggatgctttcccggactagtgccaagggggggtcttcagggcagtacattcgcgctactcttccctatattcgaactgaaattccaattattattgtgtttcgggcccttggttttgttgctgacaaagatatattagagcatatatgttatgatttctctgatactcaaatgatggagttgctacggccttctttggaagaagcatttgtgattcaaaatcaacaggttgcactggactacattgggaagcgtggagcaactgttggtgtaaccaaggaaaaaaggattaagtatgctaaagagatccttcagaaggaaatgcttcctcatgttggtgttggagaatattgcgagaccaaaaaggcttattatttcggatatatcattcatcgacttctcctctgtgcgcttggccggagagcagaagatgacagggatcattatggcaacaagaggctcgaccttgctggtccattacttggtggactttttagaatgttattcagaaagttgaccagggatgtcaggtcttacgtgcaaaagtgtgtagataatgggaaggatgttaatctgcagtttgccattaaagcaaaaaccattactagtggtcttaaatactctcttgccactggaaactggggacaagcaaatgcagctggtacaagagctggagtgtcacaggtgttaaatcgtttgacatatgcttctaccttgtcacacttgcgaagattaaattctccaattgggcgtgaagggaaattggctaaacccaggcagttgcataattcgcaatggggaatgatgtgtccagctgagacacccgaaggacaagcttgtggactggtgaagaatcttgcgttaatggtttacataacggttggatcggctgcatatcctatcttggaatttttggaagaatggggaactgagaattttgaggaaatatctcctgcagttattcctcaagctacaaaaatttttgttaatggttgctgggtgggtatccatcgcgatcctgatatgttggtcaagacattgagacggctaaggagaagggttgatgtcaatactgaagttggggttgttagagatatccgtttgaaagagctgagaatttacaccgactatggtcgttgcagtcgtccattatttattgttgagaaacaaaggcttctcatcaagaaaaaggacattcatgccctgcagcagagggagtcctcagaagagggtggctggcatgatcttgtagcaaaaggatttattgaatatattgacactgaggaagaagaaactactatgatatcaatgaccattcatgatcttgtacaagcacggatcaatccagaagaagcttattctgatacttacacccattgtgaaatccacccgtcattgattttaggtgtttgtgcttcaattattccttttcctgatcataaccagtccccgcgtaatacgtaccaatctgctatgggaaagcaagccatgggaatatatgtcacaaactatcaatttcgaatggatacattggcttatgttctttattaccctcaaaaaccacttgttacaacaagagctatggagcatcttcactttaggcagctaccagctggcattaatgctattgttgccattgcctgctattctggatacaaccaagaagattctgtcatcatgaaccaatcatcaattgaccggggattcttcagatcacttttcttccgttcatatagggatgaggagaaaaagatggggactcttgtcaaagaagattttgggcgtccagatagagctaatacaatgggcatgcggcatggctcctatgataaattggatgatgatggtcttgcacctccagggacaagagtttcaggtgaggatgtaatcattggaaagaccactcctattgctcaggaggaagcgcagggacaatctgcacgttacacaaggcgagatcatagcataagcttacggcatagtgaaacagggattgtggatcaagttcttctgacaacaaatgctgatgggctgaggtttgttaaagtaagggtaaggtctgttcggatacctcagattggagacaagtttagcagtaggcatggtcaaaagggaacagtaggtatgacttacacgcaggaggatatgccttggaccgtggaaggcatcacgcctgatatcatcgtcaatccacatgctattccttctcgaatgactattggtcagcttattgaatgtattatggggaaggttgcagcacacatgggaaaggaaggggatgcaactccattcactgatgttactgtggataacattagcaaggctcttcataaatgtgggtatcaaatgcgtggttttgagacgatgtacaatggtcacactggtcgaaggcttacagctatgatattccttggccccacttattaccaaaggctgaagcacatggttgatgacaagatccactctcggggaaggggccctgtgcaaatcctgactaggcaacctgctgaaggaaggtcacgtgatggtggcctccgctttggggaaatggaacgagattgcatgattgcacatggtgctgcacactttctcaaagagaggctgtttgaccagagtgatgcctatagggtccatgtttgtgagcgatgtggattgatagctattgcgaatctcaagaaaaattcttttgaatgcagaggttgcaagaataagaccgacattgttcaggtacacattccttatgcctgtaagctactcttccaagagctcatggccatggccatagcaccaagaatgcttacaaaagatgtgaaaccaaccaaagaccagaagaaaaagggagcataacgtaatgtggtgactcaactttttagccttcttcgtctgatgatttgtgtgtatagctttactgaggataatatctggatacatggattaagtggcattcaatacaatgcctctgaaagggaagtaaaacttcagcaagctcctggctaaattgggcatcctgcaaatttactttgatgtttctggtcttagagaggtatggaaggaagcaaatatcgttaccaccagctctgagatttgatgtccatgagtgtcagcagagaggagggaagtcgcaacacagcatctctcattaatccatgcttattggatagaaaactcaagaaccttacgtgttatgtagagtatcgtcaatgagacagtttaatttcacctgcaattttgtctgtagtagattttgtgcaagttggtgcatatctaaaggtcaactattcatctttttttgtcttctttccatttcgaggggttcatatggcccgtctaatgtttaaaattcattttcaattagctgctattttcaatctgagcctttcttaaactaattcagtttgattatgtaagattatattgaattattgttccgtcattattactgtcaaaagcagctactcaaaggcaagggaatgtcgattttcgattgaggcttctttatatggaaaataatattaaatttgatctcttgtatgaaactaatctatatcatttattcatttgtatttcgattataatt

SEQ ID NO: 1644 - DNA, 4320 bp, Cajanus cajan
ttcaagaccgtaatttaaaaactaagtaactaacggtaacgttaatccaagagagaagaagcatggatttggaagaggaacaggagtacgatcagcaaatgatggaggaagaagacgacgaggacgaaatcacacaggaggacgcttgggccgttatctccgcatacttcgaagagaaaggcctcgttcgccagcaactcgattccttcgacgagttcatccaaaacactatgcaggaaatcgtcgatgaatctgcggacattgaaattcgacccgagtcgcagcacaatcccggtcaccaatccgatgtcgccgagactatttacaaaatcagcttcggccagatttacttgagtaagccaatgatgacggagtctgacggagaaaccgccactctgtttcccaaggctgctaggttaagaaacctcacctattcagctccattgtacgttgatgtctccaagagggtcatcaagaaggggcacgacggtgaagaggtcaccgagactcaggatttcaccaaagtttttattggaaaggttcctatcatgcttcgatctagttattgcacgttgtaccagaattcggagaaggatttgactgagcttggagagtgtccatatgatcaaggtgggtatttcattattaatgggagtgagaaggttctgattgctcaggagaagatgagcaccaaccatgtctacgtcttcaagaagaggcagcccaacaagtatgcttacgtggctgaagttcggtccatggcggagtcccagaacaggccgcccagtactatgtttgtgcgcatgctctctcggactagttccaaagggggttcttcgggacaatatatacgcgccactcttccatacattcgaactgaaattcccatcattattgtgtttcgagcattggggtttgttgctgacaaagacatacttgagcatatatgctatgatttctcagatactcaaatgatggagttacttcgtccgtccctggaagaagcgtttgtaattcagaatcaacaggttgcacttgactacattgggaaaagaggagcaactgtaggtgtaaccaaagaaaaaagaattaagtatgctaaggagatccttcaaaaggagatgctccctcatgttggtgttggagaatattgcgagaccaagaaagcttactattttggatatatcattcatcggttactattgtgtgctcttgggcggagggctgaagatgatagggatcattatggcaacaaaaggctcgaccttgctggtcctttacttgggggcctttttagaatgctattcagaaagctgacaagagatgtcagggcttatgtacagaagtgtgttgataatgggaaagatgttaatctgcaatttgctatcaaagcaaaaaccatcacaagtgggcttaaatactcacttgctactggtaattgggggcaagcaaatgctgctgggactagagctggagtttcacaggtgctaaatcgtttgacttttgcatccactttatctcacttgcgaagactgaattccccaattggacgtgaagggaagttggccaaaccaaggcagttgcataattcacaatggggaatgatgtgtccagctgaaacacctgaaggacaagcatgtggacttgtcaagaatctggcattgatggtctacataacagttggttcagcagcatatcctattttggagtttttggaagaatggggcacagaaaattttgaggaaatttctcctgctgtgatcccccaagccacaaaaatttttgtaaatggttgctggatgggcatccatcgtgaccctgatatgttggtgagaacattgagaaagctgagacgcagggttgatgttaatactgaagttggggttgtcagagatatccgtcttaaagaattacgcatatatacagattatggtcgctgcagtcgccctttattcatcgtggataagcaaaggcttctcataaagaagaaggatattcatgttttgcaacagagagaatcccctgaagagggtggatggcatgatctggtgtccaagggctttgtagaatatattgacactgaagaagaagagactacaatgatttccatgacgattaatgatcttgtacaagctagactcaatccagaagatgcttattcggatacatacactcattgtgaaatccacccatcactgattttgggtgtatgtgcttccatcataccatttcctgatcacaatcagtccccacgtaatacatatcagtctgctatgggaaagcaagcaatgggaatatatgttaccaactaccagtttcgaatggataccttggcctatgttttatattatccacaaaagccactggttactacaagagccatggagcatcttcatttccgtcaactcccagctggaattaatgccattgtggccattgcctgttattctggttataatcaagaagattctgtcatcatgaatcaatcgtcaatagatcgtggattcttccggtctctgtttttccgttcatatagagatgaagagaagaagatgggaaccctagtcaaagaagattttggtcgtccagatagaactaacaccatgggaatgagacatggttcttatgataagctggatgatgatggtcttgcaccaccaggcacgagagtgtctggtgaggatgttattattgggaagaccacccctatatctcaggaagaggcacaagggcaaaattcacgttactcaaggcgtgatcacagcataagcttacgtcatagtgaaactggaattgttgatcaagttctgctgacaacaaatgctgatggattgagatttgtgaaagtaagagtgagatctgttcgaataccccagattggtgacaagttcagtagtagacatggtcagaaggggacagttggtatgacttatacacaagaagacatgccctggactgtggaaggcattacccctgatattattgtcaatccccatgctattccttctcgaatgacaattggtcagcttattgaatgtatcatggggaaggtggcggcccacatgggtaaagaaggagatgcaactccatttacagatgttactgtggataatatcagcaaagctctacacaaatgtggctaccaaatgcgtggttttgagactatgtacaatggtcatactgggagacgactcagtgccatgattttccttggccctacatattaccaaagactgaagcatatggttgatgacaagatccattctcgtggacggggtcctgtgcagattctcacaaggcaacctgccgagggacggtcacgagatggaggtctccgatttggagagatggaacgagattgcatgatagctcatggagctgctcacttcctaaaggaaagattgtttgatcaaagtgatgcatacagggtccatgtgtgtgagcgttgtgggttgatagctattgcaaatctcaagaagaattcttttgagtgcagggggtgcaagaacaaaactgacattgttcaggtttacattccttatgcttgtaagttgctcttccaagagctaatggctatggccattgctccaagaatgctgacaaaggatatcaaatctgcaaaagaccaaaagaagaagggagcctgataaaacattaatgctctcgagcatttggaacacgcatgctatctaaatccatgaatttgatttgctagtatttttcaagtctgaaattacaggaacctttcaagtgttggaaagtcacaagcgagtagttttgatatattaatcaccgatgcttcccttagcgtctgaggttgatgtagtcccttttgtatttgccgtaactactttattcaaggctgcttgttgctagcgactaataatattactggcattgtatatataattgcagtttttcaatgccgagaacttgttttttatttactgaacagttgtgttagcttaagtttctttgacgtaattttagtgagccccgtcttattaaacatcaattccagctccaattttggggctccttcagttggttttatttttattttttatttttggtggtagggggagaggtcaggaggtgaatatatggattattatgtaagtttcattgcagcgcatgagagctatggtgtgctgtactcattcttcaagttcaattgtaccattgtaccatttaatgcaattagagaatttatttgacaatgtattgtatcacgttgattcgagtggatttttatttaccatttatagttgatagaagttccattacttgtaacatctcctttccttttatgatagttgc

SEQ ID NO: 1645 - DNA, 4081 bp, Populus trichocarpa
tcgaggagtcgttctcttattttctttctagggttccactggacgaacaaatacaaatccaaatccgttagtctaaaaaattaaattaaaacaataaataaaaaataattcaaaccagaaacagaaacaaagaaccagaatccctatggaagaccttgacgagtacgatcaacagccgatgaatgaagatatggaaccagaagaagaagacgctgatgaggagatcacgcaggaagatgcctgggccgtcatttctgcttattttgaagagaaaggcttggtgagacaacaactcgactccttcgatgagtttattcaaaatacgatgcaggaaatcgttgacgagtctgctgatattgagattcggcctgaaagccagcacaatccgggtcaccagtctgattttgctgagactatctacaagatcagttttggccagatatacttgagtaagcccatgatgacagagtctgatggagaaactgcaactttgtttcccaaagctgcaaggttgaggaacctgacatactcggctcctttgtatgtggatgttacaaagagggttataaagaaaggtcatgatggtgaagaagtcactgaaactcaagacttcaccaaagttttcattggaaaggcgagtataatgaattatttatttgtccctattatgcttcgatcaagttattgcacattataccagaattcagaaaaggatttgacagagcttggcgagtgtccgtatgatcagggtgggtatttcattatcaatggtagtgaaaaggttctaattgctcaggagaagatgagcaccaatcatgtgtatgtgttcaagaagaggcagccaaacaagtatgcatatgtaggagaagttcggtctatggcagagtctcagaaccggccacccagtaccatgtttgtgcggatgctttctcggactagtgctaaagggggctcttcagggcaatacatccgtgctactcttccatacattcgaactgaaattccgattatcattgtttttcgtgctttgggttttgttgctgacaaagacattttggaacacatatgttatgatttcgctgatactcaaatgatggagttgcttcggccatctctggaagaggcatttgttattcaaaatcagcaggttgctcttgactacattggaaagcgtggggcaactgttggtgtaactagggaaaaaaggattaagtatgccaaagagattcttcaaaaagaaatgcttcctcatgttggtgttggagaatactgcgagaccaaaaaagcttattacttcgggtatatcattcaccggcttttactttgtgcacttggccggagggcagaagatgatagggatcattatggaaacaagcggcttgaccttgctggtcctttacttgggggcttgtttagaatgttattcagaaagttgaccagggatgtcaggtcttatgtgcaaaagtgtgttgataatgggaaggatgttaacctacaatttgccattaaagcaaaaaccattaccagtggtcttaaatactcacttgccactgggaactggggacaagcaaatgcagctggaacaagagctggagtgtcacaggtgttaaatagattgacatatgcctctacactgtcacatttaagaagattaaattctccaattgggcgtgaagggaaattggcaaaaccaaggcagctacataattcacaatggggaatgatgtgtcctgctgaaacacctgaaggacaagcttgtggattagtgaagaatctcgcattgatggtatacattacagttggatcagctgcatatcccatcctggagtttttagaagaatggggtaccgagaattttgaggaaatatcccctgcagttattccccaagcaacaaaaatttttgtcaatggtggctgggtgggtatccatcgtgatcctgatatgttggtgaagacattgagacggctgcggagacgggttgatgtcaatactgaagttggggttgttagagatattcgcttgaaagagttgcggatttacactgactatggccggtgcagtcgtcctctattcattgtggagaaacaaaagcttcttataaggaagaaggacatccatgcactacaacagagggaaaccccagatgagggtggctggcatgatcttgtgtcaaagggattcattgaatatattgacactgaggaagaagagaccactatgatatccatgaccatacatgatcttgtacaagcgaggattaatccagaggaagcatattctgatacttacacccattgtgagatccacccatcattgattttaggtgtttgtgcttctatcattccttttcctgaccataaccaggcaatccccacgtaacacttaccaatctgctatgggaaagcaagccatgggaatttatgtcaccaattaccaatttcgaatggatacgctggcttatgttctctattatccccaaaagccacttgttactacaagagccatggagcatcttcattttcggcaacttcctgctggcattaatgctattgttgcgattgcttgttattctggatataaccaagaagattctgttattatgaaccaatcatcaattgatcgtggattctttagatcacttttcttccgttcatatagggatgaggagaaaaagatgggcacacttgttaaagaggattttggtcgcccagacagaagtaacacaatgggcatgcgccatggctcttacgataaattggatgatgatggtcttgcacctcctggcacaagagtttcaggggaggatgtgatcattggaaagacgactccaatcgctcaggaagaagctcagggacagtctgcacgctacacgaggcgtgatcacagcataagtttacgtcacagtgaaactggaatggtggatcaagttctgcttacaacaaatgctgatgggttgaggtttgtgaaagtaagggtcagatctgtccgcatacctcagattggagacaagtttagtagtaggcatggtcaaaagggaactgttggcatgacttacacacaagaagacatgccttggactgtggaaggcatcactcctgatattattgtcaacccacatgctattccctctcgaatgacaattggacagcttatcgagtgtattatgggaaaggttgcagcacacatgggaaaggaaggggatgccacaccatttactgatgtcactgtggataatattagcaaagctcttcacaagtgtgggtatcaaatgcgagggtttgagaccatgtataatggtcacactgggcgccggctgtcagcgatgattttccttggtcccacttattatcaaaggctaaaacatatggttgatgacaagatccattcccgtggaagaggccctgtgcagatcctcacaaggcagcctgctgaaggaaggtcacgtgatggtggtctccgctttggtgagatggaacgagattgcatgatagcacatggtgccgcacacttcttgaaagagaggctatttgaccagagtgacgcatatagagtccatgtctgtgagcgttgtgggttgatagctattgcaaatctcaagaagaattcttttgaatgcagaggttgcaagaacaaaaccgacattgttcaggtgcacattccttatgcctgtaagctactcttccaagagcttatggccatggccatagctcctagaatgcttacaaaagatattaaacaggccaagagccagaagaagaagggagcttaattacttgatgaaggttaagagtgacttccatgctcgcagggcatgttggacgtttataattgactcaaacctacctcataacaatgatgttcttgtataaatattatgtcagtagcaattttgttagcattggatgatgggtgccgttgagtatatagagtatttaatcaactattgcttttctgagcccagtttgtatttcaggtctgtttgtcccactgaaagctctaaattcattttacagagtgtcgtcgattcaagttcaagttagtcacggaactgcttgcaaaatgaacttgtgaaaggttttt

SEQ ID NO: 1646 - DNA, 3864 bp, Phaseolus vulgaris
aacatggatttggaagaggaacaagagtacgatcagcaaatgatggaggaagaagacgacgaagacgatatcacgcaagaagatgcgtgggccgttatctccgcctacttcgaagagaaaggccttgttcgtcagcaactcgattccttcgacgagttcatccaaaacactatgcaggaaatcgttgacgagtccgccgacatcgaaattcgacccgagtcgcagcacaatcccggtcaccaatctgatttcgccgagactatttacagaatcagcttcggccagatttacttgagtaagcccatgatgacggagtccgatggagaaaccgccacgttgtttcccaaggctgctaggttaaggaacctcacctattcagctcctttgtatgttgatgtctccaagagggtcatcaagaaggggcacgatggtgaagaagtcaccgagactcaagatttcaccaaagttttcattggcaaggttcctataatgcttcggtctagttattgcacgttgtaccagaattcggagaaggatttgactgaacttggagagtgtccatatgatcaaggagggtatttcattattaatgggagtgagaaggttctgattgctcaggagaagatgagtaccaaccatgtgtatgtgtttaagaagaggcagccgaacaagtatgcctatgtggctgaagttcggtcaatggccgagtcccagaacagaccgcccagtactatgtttgtgcgcatgctctctcggactagttccaaagggggttcttcaggacaatatatacgtgccactcttccttatattcgaactgaaattcccatcattattgtgtttcgagcgttggggtttgttgctgacaaagatattctcgaacatatatgctacgatttctcagatactcaaatgatggagttgcttcgtccttccctggaagaagcgtttgttattcaaaatcaacaagttgcacttgactacattgggaaaagaggagcaactgttggtgtaaccaaggaaaagagaataaagtatgctaaggagatcctccaaaaggagatgctccctcatgtaggggttggagagtattgtgagaccaagaaagcctactattttggatatatcattcatcggctacttctgtgtgcacttggacggagggctgaggatgatagggatcattacgggaacaaaaggctggatctggctggccctctacttgggggtctttttagaatgctattcagaaagctaacgagagatgtcaggggatatgtacagaagtgtgttgataacgggaaagatgtcaatctacaatttgctatcaaagcaaaaaccatcacaagtggacttaaatactcactagctactggtaattggggacaagcaaatgctgccggtaccagagctggagtttcacaggtgctgaatcgtttaacttttgcgtcaactttatctcatttgagaagactgaattccccaataggacgtgaagggaagttggccaaaccaagacagctgcataattctcaatggggaatgatgtgtccagcagaaacacctgaaggacaagcctgtggacttgtgaagaatctggcattgatggtctacataacagttggttcagcagcatatcctattctggagtttttggaagaatggggcactgagaatttcgaggaaatttctcctgcagtgattccccaagctactaagatttttgtaaatggttcctggatgggtatccatcgtgaccctgatatgttggtgagaacattgaggaagttgagacgtcgggttgatgttaatactgaagttggggttgtcagagatatccgtcttaaagaattgcgcatatatacagactatggtcgctgcagtcgtccgttgttcattgtagataaacaaaggcttctcataaagaagcgggatattcatgctttacaacagagggaatcccctgaagagggtggatggcatgatctagtgtccaagggctttatagaatatattgacacggaagaagaagagactacaatgatttccatgacaattaatgatcttgtacaagctaggctcaacccagaagatgcatattccgatacatacactcattgtgaaatccacccttctctaattttgggtgtctgtgcttctatcataccatttcccgatcacaatcagtccccacgtaatacttatcagtctgcaatgggaaaacaagcaatgggaatatatgttaccaactaccagtttcgaatggataccttggcctatgttttatattatccacaaaagccactggtcactacaagagccatggaacatcttcatttccgccaactcccagctggaattaatgccattgtggccattgcctgttattctggttataatcaagaagattctgtcatcatgaaccaatcatcaatagaccgtggattctttcgatctctttttttccgatcatatagagacgaagagaagaagatgggaactctagtcaaagaagattttggccgtccagatagaactaacaccatgggcatgaggcatggttcttatgataagctggatgatgatggtcttgcaccacctggcacaagagtatctggtgaggatgttattattggaaagaccaccccaatatctcaggaagaagcacagggacaagctttacgttacacgaggcgtgatcacagcataagcttacgtcatagtgaaactggaatggttgatcaagttctgctgactacaaatgctgatggattgagatttgtgaaagtaagagtgagatctgttcgtataccacagattggcgacaaattcagtagtagacatggtcagaagggaacagttggaatgacttatacacaagaagacatgccctggactgtggaaggcatcacccctgatattattgtcaacccacatgctattccatcccgaatgacaattggtcagcttattgagtgtatcatgggtaaggtggccgcccacatgggaaaggaaggagatgcaactccttttacagatgttactgtggataatatcagcaaagctctgcacaaatgtgggtaccaaatgcgtgggttcgagactatgtacaatggtcatacagggagacgtctcagtgcaatgattttccttggtcctacatattaccaaagactgaagcatatggttgatgacaagatccattctcgtggacgtggtcctgtgcagatcctcacaagacaacctgctgagggacgctcacgtgatggaggtctccgatttggagagatggaacgagattgcatgattgctcatggagctgctcacttcctaaaggagagattgtttgatcaaagtgatgcatacagggtccatgtgtgtgagcgctgtgggttgatagctattgctaatctcaagaagaattctttcgagtgcaggggttgcaagaacaaaacggacattgttcaggtttacatcccttatgcttgtaagttgctcttccaagagttaatggctatggccatagctccaagaatgcttacgaaggagatcaaatctgcaaaagaccaaaagaagaagggagcctgattaacatgtttgacgtaagccactactcttatatcctgacttcaacatctcgagaatatgaaacgctcatcatttctgaatataccaattttattttatttcattttccaattctgaaattagagaaacctttcaatgtcggattcttcaaatttcgttgtaatccttgagagctacggtttattgtatttgtaacaacagatcctacaacaccaatatttaagttcgattgttatacaagttaatgaaatgagagaatttatttgacaatttctt

SEQ ID NO: 1647 - DNA, 4008 bp, Phaseolus vulgaris
tctgaacccgaacccaaatccccttagctagggctttttcactgtctttgccttctttctttctctctgattccaaccaaataaaacggaacttcaaaaccttaattaaacgttaatctttggagagtgagtgagtgagaaagaagaagaaacatggatttggaagaggaacaagagtacgatcagcaaatgatggaggaagaagacgacgaagacgatatcacgcaagaagatgcgtgggccgttatctccgcctacttcgaagagaaaggccttgttcgtcagcaactcgattccttcgacgagttcatccaaaacactatgcaggaaatcgttgacgagtccgccgacatcgaaattcgacccgagtcgcagcacaatcccggtcaccaatctgatttcgccgagactatttacagaatcagcttcggccagatttacttgagtaagcccatgatgacggagtccgatggagaaaccgccacgttgtttcccaaggctgctaggttaaggaacctcacctattcagctcctttgtatgttgatgtctccaagagggtcatcaagaaggggcacgatggtgaagaagtcaccgagactcaagatttcaccaaagttttcattggcaaggttcctataatgcttcggtctagttattgcacgttgtaccagaattcggagaaggatttgactgaacttggagagtgtccatatgatcaaggagggtatttcattattaatgggagtgagaaggttctgattgctcaggagaagatgagtaccaaccatgtgtatgtgtttaagaagaggcagccgaacaagtatgcctatgtggctgaagttcggtcaatggccgagtcccagaacagaccgcccagtactatgtttgtgcgcatgctctctcggactagttccaaagggggttcttcaggacaatatatacgtgccactcttccttatattcgaactgaaattcccatcattattgtgtttcgagcgttggggtttgttgctgacaaagatattctcgaacatatatgctacgatttctcagatactcaaatgatggagttgcttcgtccttccctggaagaagcgtttgttattcaaaatcaacaagttgcacttgactacattgggaaaagaggagcaactgttggtgtaaccaaggaaaagagaataaagtatgctaaggagatcctccaaaaggagatgctccctcatgtaggggttggagagtattgtgagaccaagaaagcctactattttggatatatcattcatcggctacttctgtgtgcacttggacggagggctgaggatgatagggatcattacgggaacaaaaggctggatctggctggccctctacttgggggtctttttagaatgctattcagaaagctaacgagagatgtcaggggatatgtacagaagtgtgttgataacgggaaagatgtcaatctacaatttgctatcaaagcaaaaaccatcacaagtggacttaaatactcactagctactggtaattggggacaagcaaatgctgccggtaccagagctggagtttcacaggtgctgaatcgtttaacttttgcgtcaactttatctcatttgagaagactgaattccccaataggacgtgaagggaagttggccaaaccaagacagctgcataattctcaatggggaatgatgtgtccagcagaaacacctgaaggacaagcctgtggacttgtgaagaatctggcattgatggtctacataacagttggttcagcagcatatcctattctggagtttttggaagaatggggcactgagaatttcgaggaaatttctcctgcagtgattccccaagctactaagatttttgtaaatggttcctggatgggtatccatcgtgaccctgatatgttggtgagaacattgaggaagttgagacgtcgggttgatgttaatactgaagttggggttgtcagagatatccgtcttaaagaattgcgcatatatacagactatggtcgctgcagtcgtccgttgttcattgtagataaacaaaggcttctcataaagaagcgggatattcatgctttacaacagagggaatcccctgaagagggtggatggcatgatctagtgtccaagggctttatagaatatattgacacggaagaagaagagactacaatgatttccatgacaattaatgatcttgtacaagctaggctcaacccagaagatgcatattccgatacatacactcattgtgaaatccacccttctctaattttgggtgtctgtgcttctatcataccatttcccgatcacaatcagtccccacgtaatacttatcagtctgcaatgggaaaacaagcaatgggaatatatgttaccaactaccagtttcgaatggataccttggcctatgttttatattatccacaaaagccactggtcactacaagagccatggaacatcttcatttccgccaactcccagctggaattaatgccattgtggccattgcctgttattctggttataatcaagaagattctgtcatcatgaaccaatcatcaatagaccgtggattctttcgatctctttttttccgatcatatagagacgaagagaagaagatgggaactctagtcaaagaagattttggccgtccagatagaactaacaccatgggcatgaggcatggttcttatgataagctggatgatgatggtcttgcaccacctggcacaagagtatctggtgaggatgttattattggaaagaccaccccaatatctcaggaagaagcacagggacaagctttacgttacacgaggcgtgatcacagcataagcttacgtcatagtgaaactggaatggttgatcaagttctgctgactacaaatgctgatggattgagatttgtgaaagtaagagtgagatctgttcgtataccacagattggcgacaaattcagtagtagacatggtcagaagggaacagttggaatgacttatacacaagaagacatgccctggactgtggaaggcatcacccctgatattattgtcaacccacatgctattccatcccgaatgacaattggtcagcttattgagtgtatcatgggtaaggtggccgcccacatgggaaaggaaggagatgcaactccttttacagatgttactgtggataatatcagcaaagctctgcacaaatgtgggtaccaaatgcgtgggttcgagactatgtacaatggtcatacagggagacgtctcagtgcaatgattttccttggtcctacatattaccaaagactgaagcatatggttgatgacaagatccattctcgtggacgtggtcctgtgcagatcctcacaagacaacctgctgagggacgctcacgtgatggaggtctccgatttggagagatggaacgagattgcatgattgctcatggagctgctcacttcctaaaggagagattgtttgatcaaagtgatgcatacagggtccatgtgtgtgagcgctgtgggttgatagctattgctaatctcaagaagaattctttcgagtgcaggggttgcaagaacaaaacggacattgttcaggtttacatcccttatgcttgtaagttgctcttccaagagttaatggctatggccatagctccaagaatgcttacgaaggagatcaaatctgcaaaagaccaaaagaagaagggagcctgattaacatgtttgacgtaagccactactcttatatcctgacttcaacatctcgagaatatgaaacgctcatcatttctgaatataccaattttattttatttcattttccaattctgaaattagagaaacctttcaatgtcggattcttcaaatttcgttgtaatccttgagagctacggtttattgtatttgtaacaacagatcctacaacaccaatatttaagttcgattgttatacaagttaatgaaatgagagaatttatttgacaa

SEQ ID NO: 1648 - DNA, 4718 bp, Citrus clementina
cgaaaataaaagatgaaaagcaagctacatcaatacggatttagattcagtacgttgtgagtgtaaaaacgtagtgaggtgcaatttcgaatcccaactgaaggctgaaggaatctcacaacagagctattctcttttagggtttgcgctctggtttccaatttgtgcgaaaatcgtaactctctagagctcttgttataagaagaagatgatggaagacgattatgattacgaagaacaacatcaacaggaggaagaggatgaagaggaggagatcacgcaagaggatgcgtgggcggttatttctgcttatttcgaagaaaagggtttggtgaggcagcagctcgactcttttgacgaatttatccagaacaccatgcaagaaattgttgatgaatccgcggatatcgagattcggcccgaatcccaacataatcccggccaacaatctgattttgccgagaccatctacaagatcagttttgggcagatatatctgagcaaacctatgatgacagaatcagatggagaaactgcgacattattcccaaaggctgcaagattgaggaacttaacctactcagctcctttatacgtggatgttacgaagagggttataaagaaaggccacgatggtgaagaagtcaccgaaacccaagatttcactaaagttttcattggaaaggtacccataatgcttcggtcaagttactgcacactgtatcaaaactctgagaaggatttaacggagcttggggagtgcccgtatgatcaaggtggatattttatcatcaatgggagtgaaaaagttctgattgctcaggagaagatgagcaccaatcatgtctatgtcttcaagaagcggcaacctaacaagtatgcctacgtggcagaagttcgttctatggcagagtcccagaacaggccaccgagcacaatgtttgtacggatgctttctcggactagtgccaaagggggctcttcagggcagtacattcgtgcaacccttccatacattcgtactgaaattcctatcatcattgtttttcgggctttagggtttgtggctgacaaagatatattagagcacatttgttatgacttccaagacacgcaaatgatggaattgcttcggccttcccttgaggaagcgtttgtcattcaaaatcaacaggtggcactcgactacattggaaaaagaggagcaactgttggtgtaactagggataaaaggatcaaatatgccaaagagatccttcaaaaggaaatgcttcctcatgttggtacaggagacttctgtgaaacaaagaaggcttactattttggatatatcattcatcggcttcttctatgtgcacttggccggagggctgaagacgatagggatcattacggcaacaagaggctggaccttgctggtcctttgcttggaggcttgtttaggatgctctttagaaagttgaccagggatgtaagagcttacgtgcaaaagtgtgttgataatgggaaggatgtcaacttgcaatttgcaatcaaggcaaaaaccattaccagtggtctcaagtactcacttgctactggaaactggggtcaagcaaatgcagctggtacaagagctggagtttcacaggtgttaaatcgtctaacttacgcctctactttgtcgcatttgcgaagattaaattctcccataggccgtgaagggaaattggccaaacctaggcaattacataattcacagtggggaatgatgtgcccagctgaaacacctgaagggcaagcttgtggtctggtaaagaatctggcattgatggtgtacataacagttggatcagcagcatatccgattttggaatttttagaagaatggggaacagagaattttgaggaaatttctccagcagttattcctcaagctacaaaaatttttgtcaatggttgttgggttggtattcaccgtgatcctgaaatgttggttaaaactttgagaagattgaggagacgggttgatgtcaatactgaagttggggtggttagagatattcgtttgaaagaattacggatatataccgattacggtcgatgtagtcggccactgtttattgtagagaaacaaaggcttcttataaagaagagagacatcattgctctgcagcagagggaatcccctgaagatggtggttggcatgaccttgtggcgaagggatttatagaatatattgacactgaagaagaagagaccacaatgatttccatgacaattaatgatcttgtacaagcaaggcttcatccagaagaagcttatgctgacacttacacgcattgtgagatccatccatccttgattttaggtgtatgtgcttcaattataccgtttcctgaccataatcagtccccacgtaacacgtatcaatcagctatgggtaagcaagccatggggatctatgtcaccaactaccaatttcgtatggatactttggcgtatgttctctattatcctcagaagccacttgttactacacgagcaatggaacacctccacttcaggcagcttccggctggcattaatgctattgtcgcaatcgcttgctattctggctacaaccaagaagattctgttattatgaaccaatcgtcaattgaccgtgggttctttcgatctcttttcttccgttcatatagagatgaggagaaaaagatggggacccttgttaaagaagattttggacgtccagatagatctaatactatgggcatgcggcatggctcttatgataaattggatgatgatggtcttgcgcctcctggcacaagggtttctggtgaggatgtgatcattgggaagaccactcctatttctcaggatgaagctcaaggacaagcgtcacgctacaccagacgggatcatagcataagcttacgtcacagtgaaacagggatggtggatcaagttttactgacaaccaatgctgatggattgaggtttgtgaaagtgagagttagatctgtccgtataccccagattggagacaagtttagtagtaggcatggtcagaagggaactgtgggcatgacttacactcaggaagacatgccgtggacggtggaaggcatcacccctgatatcattgtgaatccacacgctattccatctcgcatgactataggtcagcttattgagtgcatcatggggaaggttgcagctcacatgggaaaggaaggtgatgctacaccttttactgatgtcacagtggataatatcagcaaagctctacacaaatgtgggtatcaaatgcgtgggtttgagacgatgtacaatggtcacactggcagacgactcactgctatgatattccttggccccacatattaccaaagactgaagcacatggttgatgataaaatccattctcgtggtaggggtcctgtacagattcttacaaggcagcctgctgagggacgatctcgggatggtggccttcgatttggagaaatggagagagattgtatgattgctcatggtgcttcccactttctcaaggagaggttgtttgatcagagtgatgcataccgtgttcacgtatgtgagcattgtgggttaatagctattgcaaatctgaagaagaattcatttgaatgcagaggttgtaaaaacaaaactgatattgtacaggttcacatcccctatgcatgtaagttactgtttcaagagctaatggccatggccatagcaccaagaatgctcacaaaagaggacactaagcaatccaaagatcataagaagaaaggagcttagagcccgtttgggactaaaagtacttatgttggatgttcggcaaccaacttcaaaaggactcatcaaaatttaggagcaccagaggtgctttttgaggtagcacatagatgaatgcttttctactgcagttcctggagtaatctcccaaaattatttaattatttttttttctaaaattctgaaaattaactggactggttagagtagccacaaatagctgtacaggggttcaaattagtttctgatagaggccacaagttatggcagatgctgttagctcatccaaaggaattgaatgctgaaaatgacttggaatatgggcaaaaaatggatagacaatactgttacacgttcctttttcttgtatgatggatcgtagcttttcgggagtaaattgtgtcttttccagagtgatattacagtatatcacgctgataaccttatcagactgcccatgtccgagtcactttgaaaggccagcgaacgtcaagggtggtatatgttcggcttatgcgctgggggacacattcaatcaatttatctcaatgttgaacaagataagccaccaatcaacccagcaacttggttacttgtaattcatatttgacttgcttgcagttgcagtgtccatagtcagttttgactctgaatttctttgatgtgtaaatcctggaagaaaacaaaacagaaggttaatgactgtgatctcattatctcaaccgttctaacaattcccttgtgatctgaaaacctcctgaaattcatcacaattcgattacattttaaaatcgattaaatcagccgatggcacaacttggaacatttgggcatagatcaaaattcttttgagtgaggatattctcactgtgtttttctttttttctagcatttttattttaacaaaataaggatgtccttatta

SEQ ID NO: 1649 - DNA, 3890 bp, Mimulus guttatus
gaaagaatggatatggatgaagaattctacgaacaagggtaccccgatgaagagttcgaggaagaagacgaggaagagataactcaggaggacgcgtgggctgtcatcagtgcttacttcgaggagaagggtttggtgcgccagcagctcgattccttcgacgagttcattcagaacacgatgcaggaaatcgtcgatgaatccgccgacatcgagatccgacccgagtctcagcataaccccggccaccaacccgacttcgctgagactatctataagattagtttcgggcagatttatctcagtaaaccgatgatgacggagtctgatggagagactgctacgttgtttcctaaggctgcaaggctaaggaatttgacatattcagctccattgtatgttgatgtcaccaagagagtcataaagaaaggtcatgatggtgaagaagttacggagactcaggatttcacgaaagtctttattggaaaggttcctattatgctgaggtcaagttattgtacactctatcaaaattctgagaaagatttgacagagttgggagagtgcccatatgaccagggtggttatttcatcatcaatggcagtgaaaaggttttgattgctcaggagaagatgagcaccaatcatgtctatgtatttaaaaagcggcaaccaaacaagtatgcttatgtggctgaagttcggtccatggcggagacccaaaataggccgcctagtacaatgtttatccggatgcttgctcgaactagcgccaaagggggttcatcgggacaatatatacgcgccacccttccatatattcgctctgagattccgattattattgtgtttcgggcattaggatttgttgctgacaaagatatattagagcatatctgctacaattttcaagatactcagatgatggagcttctgaggccctccttggaagaagcattcgtgatccagaatcaacaggttgctctggattacattgggaaaagaggagccactgttggtgttaccagagacagaagaatcaagtatgccaaagagattcttcagaaagaaatgcttcctcatgttggcgtcggggaatattgcgagacaaagaaggcttattattttggttatataatccaccggcttctgctgtgtgcacttggccgaagggcagaggatgatagagatcactatggcaataagcgactggatcttgctggtcctttgcttggtggtctatttcgaatgctattcagaaagttgaccagggatgtgaggggttatgttcagaagtgtgttgataatgggaaggatgtgaatttgcaatttgcaataaaagccaaaacaattaccagtggtctaaaatactcgcttgctactggcaactggggccaagcaaacgcagcgggtacaagagctggagtttcccaggtcttgaatcgcttgacttatgcctctacattgtctcatttacgaagactcaactcccccattggccgtgaaggtaaactggctaaaccaaggcagctacacaattcacagtggggaatgatgtgtcctgcagagacaccggaaggacaagcgtgtggtttggtgaagaaccttgcgttgatggtctatataacagttggttcagcagcatatccaattctagaatttttggaggaatggggtaccgaaaattttgaggaaatttctcctgctgtgattcctcaagcaacaaagatctttgtgaacggttgttgggttggtatccatcgtaaccctgatatgttagtgtctactctcagacgtttgaggagacgtgttgatgtcaatactgaggttggggtggttcgagatattcgtctgaaagaacttcgtatatataccgattatggtcgttgcagtcgtccgttatttattgttgaaaagcaaagacttcttataaaaaagaaggatattcaagcattgcaacaaagggaatctcctgatgatggtggctggcatgacttagttgcgaaaggatttatagaatacatcgatacagaagaagaagaaacaactatgatttccatgacaataaatgatcttgtaagtgcaaggataaatccaggcgaggcttattcagacacttatacacactgtgagattcacccatcgttgatattgggtgtttgtgcttcaatcattccatttcctgatcacaaccagtcaccacgtaacacataccagtccgctatgggtaaacaagccatgggtatttacgtcactaactaccaatttcgaatggacaccttggcttatgtactctactaccctcaaaagcctctcgtgactacacgtgctatggaacatctgcatttcagacagctcccagctggcattaacgccattgttgccatttcttgctactccggttacaatcaagaagattcggttattatgaaccagtcatcgatcgaccgtggctttttccgatcactatttttccgttcgtacagagacgaggagaagaagatgggtaccctagtcaaagaggatttcggccgccctgacagagctaacaccatgggtatgcgtcacggttcttacgataaactggacgacgatgggctagcgccgccaggaactagagtctccggtgaagatgtcatcatcggaaaaacgacccccataacccccgacgaagctcaaggccaagcaaacgcccgctacacaaaacgtgaccacagcacgagcctacgtcacagtgaaaccggcatggttgatcaggtcctgttgaccacaaatgcagacggtttgaggttcgtcaaagttagagttcggtcggttcgaatacctcaaattggagacaagttcagtagtaggcacggtcagaaggggacagtgggcatgacttacacacaggaagacatgccttggactctcgaagggataaatcccgacattatcgtaaatccacacgctatcccttctcgcatgacgattggtcagttgatcgagtgtgttatgggcaaagttgcagcccatatgggcaaagaaggagatgcaactccctttacagatgtgactgtggataatatcagtaaagctttacataaatgtggctatcaaatgaggggctatgagactatgtacaatgggcatactgggaggaagcttacttcgatgatatttttgggccccacttattaccagaggctgaagcatatggttgatgacaagattcactctcgaggaagagggcctgtccagattctgacaaggcagcccgctgaagggcggtcgcgtgacggtggtttaaggtttggtgagatggaaagggattgtatgattgcgcatggtgctgcgcattttctcaaggagaggctttttgaccagagtgatgcttatagaattcatgtttgtgagaagtgtggtttgattgctattgccaacttgaagaagaattcgttcgagtgtagagcgtgcaagaataaaactgatatcgttcaggtgcacattccgtatgcttgtaagctgctattccaggagctgatgtctatggccattgctccgagaatgctgacgaaggatattaaacagtcgaaagagcagaagaagaaaggggcttgattttcgattttggaaatatgacgatgagtttaaaaaccgagcgtatagtttgtttttgaagatgggacggagattttatttgtggaggtgtataagcaaagcttacatgtatttgttgatggaatttgtgtacgattatgttgcgtaatattttctcaagatttgatggactacatatattagcttcaaaacataaatttgttttagtggtgtacaattgaagaattttgtgtttattcatctttgtgttgttatatatggtatatgatttcgatatatatttactgttt

SEQ ID NO: 1650 - DNA, 4080 bp, Mimulus guttatus
agactcagatcctctctctctctagacagagcgacacacacagagagaaacccttgtatctataatttgactacaattggacttcacgaagaaattaaggaatcgttaactgaaaattcgaaagaatggatatggatgaagaattctacgaacaagggtaccccgatgaagagttcgaggaagaagacgaggaagagataactcaggaggacgcgtgggctgtcatcagtgcttacttcgaggagaagggtttggtgcgccagcagctcgattccttcgacgagttcattcagaacacgatgcaggaaatcgtcgatgaatccgccgacatcgagatccgacccgagtctcagcataaccccggccaccaacccgacttcgctgagactatctataagattagtttcgggcagatttatctcagtaaaccgatgatgacggagtctgatggagagactgctacgttgtttcctaaggctgcaaggctaaggaatttgacatattcagctccattgtatgttgatgtcaccaagagagtcataaagaaaggtcatgatggtgaagaagttacggagactcaggatttcacgaaagtctttattggaaaggttcctattatgctgaggtcaagttattgtacactctatcaaaattctgagaaagatttgacagagttgggagagtgcccatatgaccagggtggttatttcatcatcaatggcagtgaaaaggttttgattgctcaggagaagatgagcaccaatcatgtctatgtatttaaaaagcggcaaccaaacaagtatgcttatgtggctgaagttcggtccatggcggagacccaaaataggccgcctagtacaatgtttatccggatgcttgctcgaactagcgccaaagggggttcatcgggacaatatatacgcgccacccttccatatattcgctctgagattccgattattattgtgtttcgggcattaggatttgttgctgacaaagatatattagagcatatctgctacaattttcaagatactcagatgatggagcttctgaggccctccttggaagaagcattcgtgatccagaatcaacaggttgctctggattacattgggaaaagaggagccactgttggtgttaccagagacagaagaatcaagtatgccaaagagattcttcagaaagaaatgcttcctcatgttggcgtcggggaatattgcgagacaaagaaggcttattattttggttatataatccaccggcttctgctgtgtgcacttggccgaagggcagaggatgatagagatcactatggcaataagcgactggatcttgctggtcctttgcttggtggtctatttcgaatgctattcagaaagttgaccagggatgtgaggggttatgttcagaagtgtgttgataatgggaaggatgtgaatttgcaatttgcaataaaagccaaaacaattaccagtggtctaaaatactcgcttgctactggcaactggggccaagcaaacgcagcgggtacaagagctggagtttcccaggtcttgaatcgcttgacttatgcctctacattgtctcatttacgaagactcaactcccccattggccgtgaaggtaaactggctaaaccaaggcagctacacaattcacagtggggaatgatgtgtcctgcagagacaccggaaggacaagcgtgtggtttggtgaagaaccttgcgttgatggtctatataacagttggttcagcagcatatccaattctagaatttttggaggaatggggtaccgaaaattttgaggaaatttctcctgctgtgattcctcaagcaacaaagatctttgtgaacggttgttgggttggtatccatcgtaaccctgatatgttagtgtctactctcagacgtttgaggagacgtgttgatgtcaatactgaggttggggtggttcgagatattcgtctgaaagaacttcgtatatataccgattatggtcgttgcagtcgtccgttatttattgttgaaaagcaaagacttcttataaaaaagaaggatattcaagcattgcaacaaagggaatctcctgatgatggtggctggcatgacttagttgcgaaaggatttatagaatacatcgatacagaagaagaagaaacaactatgatttccatgacaataaatgatcttgtaagtgcaaggataaatccaggcgaggcttattcagacacttatacacactgtgagattcacccatcgttgatattgggtgtttgtgcttcaatcattccatttcctgatcacaaccagtcaccacgtaacacataccagtccgctatgggtaaacaagccatgggtatttacgtcactaactaccaatttcgaatggacaccttggcttatgtactctactaccctcaaaagcctctcgtgactacacgtgctatggaacatctgcatttcagacagctcccagctggcattaacgccattgttgccatttcttgctactccggttacaatcaagaagattcggttattatgaaccagtcatcgatcgaccgtggctttttccgatcactatttttccgttcgtacagagacgaggagaagaagatgggtaccctagtcaaagaggatttcggccgccctgacagagctaacaccatgggtatgcgtcacggttcttacgataaactggacgacgatgggctagcgccgccaggaactagagtctccggtgaagatgtcatcatcggaaaaacgacccccataacccccgacgaagctcaaggccaagcaaacgcccgctacacaaaacgtgaccacagcacgagcctacgtcacagtgaaaccggcatggttgatcaggtcctgttgaccacaaatgcagacggtttgaggttcgtcaaagttagagttcggtcggttcgaatacctcaaattggagacaagttcagtagtaggcacggtcagaaggggacagtgggcatgacttacacacaggaagacatgccttggactctcgaagggataaatcccgacattatcgtaaatccacacgctatcccttctcgcatgacgattggtcagttgatcgagtgtgttatgggcaaagttgcagcccatatgggcaaagaaggagatgcaactccctttacagatgtgactgtggataatatcagtaaagctttacataaatgtggctatcaaatgaggggctatgagactatgtacaatgggcatactgggaggaagcttacttcgatgatatttttgggccccacttattaccagaggctgaagcatatggttgatgacaagattcactctcgaggaagagggcctgtccagattctgacaaggcagcccgctgaagggcggtcgcgtgacggtggtttaaggtttggtgagatggaaagggattgtatgattgcgcatggtgctgcgcattttctcaaggagaggctttttgaccagagtgatgcttatagaattcatgtttgtgagaagtgtggtttgattgctattgccaacttgaagaagaattcgttcgagtgtagagcgtgcaagaataaaactgatatcgttcaggtgcacattccgtatgcttgtaagctgctattccaggagctgatgtctatggccattgctccgagaatgctgacgaaggatattaaacagtcgaaagagcagaagaagaaaggggcttgattttcgattttggaaatatgacgatgagtttaaaaaccgagcgtatagtttgtttttgaagatgggacggagattttatttgtggaggtgtataagcaaagcttacatgtatttgttgatggaatttgtgtacgattatgttgcgtaatattttctcaagatttgatggactacatatattagcttcaaaacataaatttgttttagtggtgtacaattgaagaattttgtgtttattcatctttgtgttgttatatatggtatatgatttcgatatatatttactgttttgattaattctttttttgaaaattatttaaatgtagaatatttgaatttttaagtgaaagttagattccaa

SEQ ID NO: 1651 - DNA, 4730 bp, Citrus sinensis
cgaaaataaaagatgaaaagcaagctacatcaatacggatttagattcagtacgttgtgagtgtaaaaacgtagtgaggtgcaatttcgaatcccaactgaaggctgaaggaatctcacaacagagctattctcttttagggtttgcgctctggtttccaatttgtgcgaaaatcgaaactctctagagctcttgttataagaagaagatgatggaagacgattatgattacgaagaacaacatcaacaggaggaagaggatgaagaggaggagatcacgcaagaggatgcgtgggcggttatttctgcttatttcgaagaaaagggtttggtgaggcagcagctcgactcttttgacgaatttatccagaacaccatgcaagaaattgttgatgaatccgcggatatcgagattcggcccgaatcccaacataatcccggccaacaatctgattttgccgagaccatctacaagatcagttttgggcagatatatctgagcaaacctatgatgacagaatcagatggagaaactgcgacattattcccaaaggctgcaagattgaggaacttaacctactcagctcctttatacgtggatgttacgaagagggttataaagaaaggccacgatggtgaagaagtcaccgaaacccaagatttcactaaagttttcattggaaaggtacccataatgcttcggtcaagttactgcacactgtatcaaaactctgagaaggatttaacggagcttggggagtgcccgtatgatcaaggtggatattttatcatcaatgggagtgaaaaagttctgattgctcaggagaagatgagcaccaatcatgtctatgtcttcaagaagcggcaacctaacaagtatgcctacgtggcagaagttcgttctatggcagagtcccagaacaggccaccgagcacaatgtttgtacggatgctttctcggactagtgccaaagggggctcttcagggcagtacattcgtgcaacccttccatacattcgtactgaaattcctatcatcattgtttttcgggctttagggtttgtggctgacaaagatatattggagcacatttgttatgacttccaagacacgcaaatgatggaattgcttcggccttcccttgaggaagcgtttgtcattcaaaatcaacaggtggcactcgactacattggaaaaagaggagcaactgttggtgtaactagggataaaaggatcaaatatgccaaagagatccttcaaaaggaaatgcttcctcatgttggtacaggagacttctgtgaaacaaagaaggcttactattttggatatatcattcatcggcttcttctatgtgcacttggccggagggctgaagacgatagggatcattacggcaacaagaggctggaccttgctggtcctttgcttggaggcttgtttaggatgctctttagaaagttgaccagggatgtaagagcttacgtgcaaaagtgtgttgataatgggaaggatgtcaacttgcaatttgcaatcaaggcaaaaaccattaccagtggtctcaagtactcacttgctactggaaactggggtcaagcaaatgcagctggtacaagagctggagtttcacaggtgttaaatcgtctaacttacgcctctactttgtcgcatttgcgaagattaaattctcccataggccgtgaagggaaattggccaaacctaggcaattacataattcacagtggggaatgatgtgcccagctgaaacacctgaagggcaagcttgtggtctggtaaagaatctggcattgatggtgtacataacagttggatcagcagcatatccgattttggaatttttagaagaatggggaacagagaattttgaggaaatttctccagcagttattcctcaagctacaaaaatttttgtcaatggttgttgggttggtattcaccgtgatcctgaaatgttggttaaaactttgagaagattgaggagacgggttgatgtcaatactgaagttggggtggttagagatattcgtttgaaagaattacggatatataccgattacggtcgatgtagtcggccactatttattgtagagaaacaaaggcttcttataaagaagagagacatcattgctctgcagcagagggaatcccctgaagatggtggttggcatgaccttgtggcgaagggatttatagaatatattgacactgaagaagaagagaccacaatgatttccatgacaattaatgatcttgtacaagcaaggcttcatccagaagaagcttatgctgacacttacacgcattgtgagatccatccatccttgattttaggtgtatgtgcttcaattataccgtttcctgaccataatcagtccccacgtaacacgtatcaatcagctatgggtaagcaagccatggggatctatgtcaccaactaccaatttcgtatggatactttggcgtatgttctctattatcctcagaagccacttgttactacgcgagcaatggaacacctccacttcaggcagcttccggctggcattaatgctattgtcgctatcgcttgctattctggctacaaccaagaagattctgttattatgaaccaatcgtcaattgaccgtgggttctttcgatctcttttcttccgttcatatagagatgaggagaaaaagatggggacccttgttaaagaagattttggacgtccagatagatctaatactatgggcatgcggcatggctcttatgataaattggatgatgatggtcttgcgcctcctggcacaagggtttctggtgaggatgtgatcattgggaagaccactcctatttctcaggatgaagctcaaggacaagcgtcacgctacaccagacgggatcatagcataagcttacgtcacagtgaaacagggatggtggatcaagttttactgacaaccaatgctgatggattgaggtttgtgaaagtgagagttagatctgtccgtataccccagattggagacaagtttagtagtaggcatggtcagaagggaactgtgggcatgacttacactcaggaagacatgccgtggacagtggaaggcatcacccctgatatcattgtgaatccacacgctattccatctcgcatgactataggtcagcttattgagtgcatcatggggaaggttgcagctcacatgggaaaggaaggtgatgctacaccttttactgatgtcacagtggataatatcagcaaagctctacacaaatgtgggtatcaaatgcgtgggtttgagacgatgtacaatggtcacactggcagacgactcactgctatgatattccttggccccacatattaccaaagactgaagcacatggttgatgataaaatccattctcgtggtaggggtcctgtacagattcttacaaggcagcctgctgagggacgatctcgggatggtggccttcgatttggagaaatggagagagattgtatgattgctcatggtgcttcccactttctcaaggagaggttgtttgatcagagtgatgcataccgtgttcacgtatgtgagcattgtgggttaatagctattgcaaatctgaagaagaattcatttgaatgcagaggttgtaaaaacaaaactgatattgtacaggttcacatcccctatgcatgtaagttactgtttcaagagctaatggccatggccatagcaccaagaatgctcacaaaagaggacactaagcaatccaaagatcataagaagaaaggagcttagagcccgtttgggactaaaagtacttatgttggatgttcggcaaccaacttcaaaaggactcatcaaaatttaggagcaccagaggtgctttttgaggtagcacatagatgaatgcttttctactgcagttcctggagtaatctcccaaaattatttaattatttttttttctaaaattctgaaaattaactggactggttagagtagccacaaatagctgtacaggggttcaaattagtttctgatagaggccacaagttatggcagatgctgttagctcatccaaaggaattgaatgctgaaaatgacttggaatatgggcaaaaaatggatagacaatactgttacacgttcctttttcttgtatgatggatcgtagcttttcgggagtaaattgtgtcttttccagagtgatattacagtatatcacgctgataaccttatcagactgcccatgtccgagtcactttgaaaggccagcgagcgccaagggtggtatatgttcggcttatgcgctgggggagacattcaatcaatttatctcaatgttaaacaagataagccaccaatcaacccagcaacttggttacttgtaattcatatttgacttgcttgcagttgcagtgtccatagtgtcagttttgactctgaatttctttgatgtgtaaatcctggaagaaaacaaaacagaaggttaataatgactgtgatctcattatctcaaccgttctaacaattcccttgtgatctgaaaacctcctgaaattcatcacaattcgattacattttaaaatcgattaaatcagctgatggcacaacttggaacatttgggcatagatcaaaatcttttgagtgaggatattctcactgtgtttttctttatatttttttttctagcattttcatttcaacaaaataaggatgtccttatta

SEQ ID NO: 1652 - DNA, 3977 bp, Petunia hybrida
aaaaaaagagagcgactcccagtaggcggttttgacctatttctccgcttaataaagaacaaaaccccttcttctgttgatgcttcccatttggactccaacatactaaaaactacttaagatctggggtttcatttttttaatacaaaactgagtgaaaatggatatggaagaagagtatgaggagcagcagtacgatatgaataatgaagaagaagaagaagaagaagaggagattactcaagaagatgcttgggctgtaatcagtgcttactttgaagaaaagggacttgttcgtcaacaacttgattcttttgatgagtttattcaaaatactatgcaagaaattgttgatgaatctgctgatattgagatccgacccgaatcccaacataatcccggtcatcaatctgactttgctgagaccatctacaaaatcaattttggtcagatttatttgagtaagccaatgatgacagagtcagatggtgaaactgctactttgttcccaaaggctgcaaggttgaggaacctaacgtattctgcacccttgtatgtggacgttacaaagagagtcatcaagaaagggcatgatggtgaagaagttactgaaactcaagacttcacaaaagtctttataggaaaggttcctataatgcttcgatcaagttactgcacattatatcaaaattcagagaaagatttaacagagcttggagaatgtccactagatcaaggtggatatttcatcatcaatggaagtgaaaaggtcctaattgctcaggagaagatgagcactaaccatgtgtatgtattcaagaagaggcagcctaacaagtatgcctttgttgcggaggtcaggtcaatggcggaatctcaaaaccgcccaccgagtactatgtttgtgcggatgctctcaaggactagtgcgaaagggggttcctcaggacaatatattcgggcgacacttccgtatatccggacagagattcctatcattatcgtgtttcgagctctgggttttgtagcagacaaggatatattggaacatatttgttatgatttcaatgacactcaaatgatggagttgttacgtccctcactggaagaagcttttgtgatacagaaccaacaggttgctcttgattacattggaaagagaggggccactgttggtgttacaaaagaaaagaggataaagtatgccaaagagattctgcagaaagaaatgcttcctcatgttggggtgggagagtattgtgaaaccaagaaagcttattattttgggtatatcatccaccggcttctgttatgtgcacttggccgaagggctgaggatgatagggatcattatggcaataaaagactggatcttgctggtcctttgcttggtggcttgtttcgaatgctctttagaaagttgacaagggatgttagatcttatgttcagaagtgtgtggacaacgggaaggatgtaaatcttcaatttgcgatcaaagctaagaccatcaccagtggtctgaaatactctcttgctactggaaactgggggcaagctaacgcagcaggcactagagctggtgtttcacaggtgttgaatcgtctgacttatgcctctactttatctcacttgcgaaggttgaattctcctataggacgagaagggaaactggccaaaccaaggcaattgcataattcacaatggggaatgatgtgtcctgcagaaacaccagagggtcaagcgtgtgggctggtgaagaatctggctttaatggtgtatattacagttggttcagctgcatacccgattctggagtttctggaagaacggggtacggagaactttgaggaaatttctcctgctgttattccacaggctacaaagatctttgtcaatggtacctggatgggtattcatcgtgatccagacatgttagtgagaacactgagacgacttaggagaagggttgacgtcaatactgaggttggggttgttcgtgatatccgtctgaaggaacttcgaatttataccgactatggtaggtgcagtcgtccattgtttattgtggaaaagcaaaagctgctgattaagaagaaggatattcaacaattgcaacaaagggaaacacccgaagaaggtggctggcatgatctggtggctaagggatacatcgagtacattgacactgaagaggaagaaacaacgatgatcagcatgactattaatgatcttgtgcaagcaagtattaatcctgaggatgcttattctgatacctatactcactgtgaaattcacccatccctaatattgggtgtttgtgcatcaattattccatttcctgatcataatcagtctccccgtaatacttatcagtctgctatgggtaagcaagccatgggaatttacgtcaccaactaccaattccggatggacacattggcctatgttctttattatcctcaaaagccccttgtcactacacgagccatggaacacttgcatttcaggcaactacctgcaggcatcaatgcaattgttgctatttcctgttattctggatacaatcaagaagattccgtcattatgaatcagtcatcgattgatcgtggatttttccggtcactgtttttccgttcatatagagatgaggagaagaagatggggacattggtcaaggaggactttggacgtcctgatagagcttccactatgggtatgcggcatggttcttatgataaattggatgatgatggtcttgcccctccaggaactagagtttctggtgaggatgtaatcattgggaagacaactcctatttctcaggatgatgcgcaagggcaagcctcccgctatacgaggaaagatcatagtaccagtcttcgccacagtgaaactggaatggtagatcaggttcttttaacaacaaatgcagacgggctcagatttgttaaagtgagggttagatcagtccgtattcctcaaattggggacaagtttagcagtagacatggtcaaaagggaacggtcggcatgacatatacacaagaagatatgccatggacgatagaaggcattactcctgatattattgtgaatcctcatgctattccttctcgaatgactattggtcagctaattgaatgtattatgggcaaggttgctgcacacatgggaaaagagggtgatgccactccctttacagatgttactgtggataacatcagcaaagctctccataaatgtgggtatcaaatgcgtggttttgagaccatgtacaatggtcacactgggcggcgtcttccagcaatgatattccttggtcccacatactaccagcggctgaagcatatggttgatgacaagatccattctagaggcagaggccctgtacaaatcctcacaaggcaacctgcggaaggtcggtcacgtgatggtggtcttcgatttggagagatggaacgagattgtatgattgctcatggtgctgctcattttctgaaagagcggttatttgaccaaagcgatgcgtatagagttcatgtttgtgagcgctgtgggctgattgctattgctaacctcaagaagaattcttttgaatgcagaggttgcaagaacaagactgacattgtccaggttcatatcccatatgcatgcaagttgcttttccaggagctcatggctatggctatagctcccagaatgcttacaaaggatgttaagcaggctagagatcaaaagaagaaaggagcttgattgatttggccatactgactactttatcaggactcagtttgtatcccacatatgaggatcaaactgctcgttcatccaggatgtttgtagattaacatgtatcaccttatctatgagaaaaagacccttgtgatgaaacctcggtgcaaggttatggtttgaccaagactcgcatgtaaaatagaacatttatatttatattggaggtttctgttcggatcgc

SEQ ID NO: 1653 - DNA, 4116 bp, Solanum phureja
cttgcctctctgttcttctcttcttctccctttggactcacagagaaaatcagttgaaccagtatttatcttactaaaactaagcagacaggatctgggttccgattttcttggaatcttgaatccatttgaactgttaaaaaaagaaaaagactcaattttgaactgaaagggagaaagaattgttgaatcgggatggatttggaggatgaatatgaaccacagtacaatgttgatgatgatgaagaggagataacccaagaggatgcttgggctgtgattagtgcttactttgaggagaagggtcttgttcgtcaacaactagattcgtttgatgagtttattcagaacacgatgcaagaaattgttgatgaatctgctgatatagagatccgacctgagtcccagcataaccctggtcaccaatctgactttgctgagactatctataaaatcaattttggtcagatttatttgagtaagccaatgatgacagagtcagatggtgaaactgctaccctatttccaaaggctgcaaggttgaggaatctgacatattctgctcctttgtatgtggatgtcacgaaacgagtcatcaagaaaggacatgatggtgaagaagttactgaaactcaggacttcacaaaagtctttattggaaaggttcctataatgctgcggtcaagttactgcacattatatcaaaattctgagaaagatctaacagagcttggagaatgtccattagatcaaggcgggtattttattataaatggaagtgaaaaggtcttaattgctcaggagaagatgagcacgaaccatgtgtatgtctttaagaagaggcaacctaacaaatatgccttcgttgcggaagtcaggtcaatggcagaatctcaaaaccgcccgccaagtactatgttcgtgaggatgctctcaaggactagcgcaaaagggggttcctcgggccaatacattcgagcgacacttccatatatccgtacagagattcctattatcatcgtgtttcgagctctaggttttgttgctgataaggatatattggaacatatctgttatgatttcaatgatactcaaatgatggagttgttacgtccgtcgttggaagaagcttttgttattcaaaaccaacaggttgctcttgactacatcgggaaaagaggggctacagttggtgttacaagggaaaaaaggattaagtatgccaaagagattcttcagaaagaaatgcttcctcatgttggggttggagagtattgtgaaaccaagaaagcttattattttgggtatatcatccaccggcttttgttatgtgcgcttggccgaagggctgaggatgatagggatcattatggaaataagagactggatcttgctggtcctttgcttggtgggctgtttcggatgctctttagaaagttgacaagggatgttagaggctatgtgcaaaagtgtgttgacaatggaaaagatgtaaatctccaatttgcaatcaaagctaagaccattaccagtgggctgaaatactctcttgctactggaaactgggggcaagctaatgcagcgggtacaagggctggtgtttcgcaggtgctgaatcgtctgacttatgcctctactttgtctcacttgcgacggttgaattcccctattggacgagaagggaaactggccaaaccaaggcaattgcataattcacagtggggaatgatgtgtcctgcagaaacaccagagggtcaagcatgtgggctggtgaagaatctagctttaatggtttatataacagttggttcagcggcatatccaattttggagtttttggaagagtggggtactgagaactttgaggaaatttctcctgcagttattccacaggctacaaagatctttgtcaatggtacctgggtgggaattcatcgtgatcctgacatgttggtgagaacattgagacgacttaggagacgggttgacgtcaatactgaggttggggtggtccgtgatatccgtttgaaagaacttcgaatttataccgactatggcaggtgcagtcgtccattgtttattgtggaaaagcaaaggctgatgatcaagaagaaggatattcaaacattgcaacaacgggaatcacctgacgagggtggctggcacgatttggtggctaagggatacattgagtatattgacactgaagaggaagagacaacgatgattagcatgactataaatgatcttgtgcaagcacgccttaatcctggcgacgcttattctgatacctatactcattgcgaaattcacccatcactaatattgggtgtctgtgcatcaattattccatttcctgatcataatcagtctccccgtaatacttatcagtcagctatgggtaagcaagccatggggatttatgtcaccaactaccaatttcggatggacacattggcctatgtgctttattatcctcagaagcctcttgtcacaacacgagccatggaacacttgcattttaggcaactacctgcgggcatcaacgcaattgtcgccatctcctgctattctggatacaatcaagaggattctgtcattatgaatcagtcatcgattgatcgtggatttttccgatctctgtttttccgttcgtacagggacgaggagaaaaagatggggacattggtcaaggaggactttggacgtcctgatagagctactactatgggtatgcgccatggttcgtacgataagttggatgacgatggtcttgcccctccaggaactagagtttctggtgaggatgttatcattgggaagacaactcccatttctcaggatgatgcgcaagggcaagcctctcgctatacgaggaaagatcacagtaccagtcttcgccatagtgaaactggaatggtggatcaggttctattaacaacaaatgctgacgggctcagatttgttaaagtgagggtcagatcagtccgtattcctcaaattggggacaagtttagcagtagacatggtcagaagggaacagtcggcatgacatatacacaagaagatatgccatggaccgtggaaggcattagtcctgatattattgtgaatcctcatgctattccttctcgaatgactattggtcagctgattgaatgtattatggggaaggttgctgcacacatgggaaaagaaggtgatgccactccctttacagatgttactgttgataacatcagcaaagctctgcataaatgtggttaccagatgcgtggttttgagaccatgtacaatggtcatactgggcggcggcttagtgcaatgatattccttggtcccacgtactaccagcgcctgaagcatatggttgatgacaagattcattctagaggcagaggccctgtgcaaatcctcacaaggcagcctgcggaaggtcggtcacgtgatggtggtcttcgttttggagagatggagcgagattgtatgattgctcacggtgctgctcattttctcaaggagcggttatttgaccaaagcgatgcatacagagttcatgtttgtgagcgttgtgggctgatagccattgccaacctcaagaagaattctttcgaatgcagaggttgcaagaacaaaactgatatcgtccaggttcacattccctatgcatgcaaattgcttttccaggagctaatggctatggctatagctccaagaatgcttacaaaggatgtcaagctagccaaagatcaaaagaagaaagcagcttgattaatttagtccattccgagaaaaaagttgcctattttatagattgaaaggtcttattttaccagtagtcagttttgcatccacaatatgtggatctactacttattggttttagaatggttgtagtatctagtgagaacaacatccttatgaacccagcaggtactgtggtttcaaggatggagtaattctcacatgtaaaatataagtaatatttatatctgaagtttctcttcgaaaaactcctgcttttcatgtataagaggctcttcgttagtcttgcatcaaattgaatgagttgaagcttttcagttttgacaatgagaaatgagtgcaactgttttt

SEQ ID NO: 1654 - DNA, 4276 bp, Glycine max
aacacaaaattcaattcaaaaccttaattcaaacctaactaacgtaaacctctctcccgcgagaagaagccatggatttggaagaggaacaggagtacgacgagcaaatgatggaggaagaagacgacgaggaagagatcacgcaggaagacgcgtgggcagttatatctgcatacttcgaagagaaaggcctcgttcgtcaacaactcgattccttcgacgagttcatccagaacaccatgcaggaaattgtcgatgagtcagcagatattgaaattcgacccgagtcgcagcacaatcccggtcaccaatccgatttcgccgaaaccatttacaagatcagtttcggtcagatttacttgagtaagcctatgatgacggagtctgatggagaaaccgccacgttgttccccaaggctgctaggttaaggaaccttacgtattctgctcctttgtatgttgatgtctccaaaagggtcatcaagaagggacacgacggtgaagaggtcactgaggcccaggatttcaccaaagttttcattggcaaggttcctataatgcttcggtctagttattgcaccttgtaccagaattcggagaaggatttgactgagcttggggagtgtccgtacgaccaaggcgggtatttcattattaatgggagtgagaaggttctgattgctcaggagaagatgagcaccaaccatgtctacgtgttcaagaagaggcagcccaacaagtatgcctatgtggccgaagttcggtccatggcagagtcgcagaacagaccgcccagtactatgtttgtgcgcatgctctctcggactagttccaaagggggttcttcaggacaatatatacgtgccactcttccttacattcgaacggaaattcccatcattattgtgtttcgagcattggggtttgttgctgataaagatattctagagcatatatgttatgacttctcatatactcaaatgatggagctgctacgtccttccctggaagaagcgtttgtaattcaaaatcaacaggttgcacttgactacattgggaaaagaggagcaactgtaggtgtgacaaaggaaaagagaattaagtatgctaaggagatccttcaaaaggagatgctccctcatgttggcgttggagaatattgtgagaccaagaaagcttactattttggatatatcattcaccggctactgctgtgtgcacttgggcggagggctgaggatgatagggatcattatggaaacaagaggctggatctggctggtcctttacttggtggtcttttcagaatgctattcagaaagctaacgagagatgtcaggggatatgtacagaagtgtgttgataatgggaaagatgttaatctgcaatttgctatcaaagcaaaaaccatcacaagtggacttaaatactcacttgctactggtaactgggggcaagcaaatgctgcagggactagagctggagtttcacaggtgctgaatcgtttaacttatgcatccactttatctcacttgcgaagattgaattccccaatagggcgtgaagggaagttggccaaaccaagacagctgcataattcacaatggggaatgatgtgtccagcagaaacacccgaaggacaagcctgtggactggtgaagaatctggcattgatggtctacataacagttggttcagcagcatatcctattctggagtttttggaagaatggggcacagagaattttgaggaaatctctcctgcagtgattcctcaagccacaaaaatttttgtaaatggttgctggatgggtatccatcgtgaccctgatatgttggtgagaacattgaaaaagctaagacgtcgggttgatgtgaacactgaagttggggttgtcagagatatccgtcttaaagaattgcgtatatatacagattatggtcgttgcagtcgtcctttattcattgtggataagcaaaggcttctcataaagaagaaggatattcatgctttacaacagagggaatcccctgaagatggcggatggcatgatctagtgtccaagggttttatagaatatattgacacggaagaagaagagactacaatgatttccatgacaattaatgatcttgtacaagctaggatcaatccagaagatgcatattccgatacttacactcattgtgaaatccacccatcactaattctgggtgtatgtgcttccattataccatttcctgatcacaatcagtccccacgtaacacttatcagtctgcaatgggaaagcaagcaatgggaatatatgttacaaactaccagtttcgaatggataccttggcctatgttttatattatccacaaaagccactggtcactacaagagccatggagcatcttcatttccgtcaactcccagctggaattaatgctattgtatccattgcctgttactctggttataatcaagaagattctgtcatcatgaaccaatcgtcaatagaccgtggattctttcggtctctgtttttccgttcatatagagatgaagagaagaagatgggaaccctagtgaaagaagattttggccgtccagatagagctaacaccatgggaatgagacatggttcttatgataagctggatgatgatggtcttgccccaccaggcacacgagtatctggtgaggatgttatcattggaaagaccaccccaatatctcaggaggaggcacagggacaagctttacgttacacaaggcgtgatcacagcataagcttacgtcacagtgaaactggaattgttgatcaagttttgctgaccacaaatgctgatggattaagatttgtgaaagtaagagtgagatctgttcgtataccacagattggtgacaaattcagtagtagacatggtcagaaggggacagtgggtatgacttatacacaagaagacatgccatggactgtggaaggcattacccctgatattattgtcaatcctcatgctattccttctcgaatgacaattggtcagcttattgagtgtatcatggggaaggtggcagcccacatgggaaaagagggagatgcaactccttttacagatgttactgtggacaatatcagtaaagctctacacaagtgtgggtaccaaatgcgtggttttgagaccatgtacaatggtcatacagggagacgtctcagtgcaatgattttccttggccctacatattaccaaagactgaagcatatggttgatgataagatccattctcgtggaaggggtccagtgcagatcctcacaaggcaacctgctgagggacgctcacgagatggaggtctccgatttggagagatggaacgagattgcatgatagctcatggagctgctcactttttaaaggaaaggttgtttgatcaaagtgatgcttacagggtccatgtatgtgagcgttgtgggttgatagctattgcaaatctcaaaaagaattcttttgagtgcagggggtgcaagaacaaaactgacattgttcaggtttatattccttatgcttgtaagctcctcttccaagagttaatggctatggccatagctccaagaatgcttacaaaggaggtcaaaactacaaaccaaaagaagggagcctgataaacttgtttgacgaaagccactattcttatattctgactccaaagctctcgagaatatggatcaaacatggtatctaaatatacaaatttgatttgatattgtttttcaagtctgaaattacaggaacctttcaagtgttgggaaagtcccaagcaaaaatagtttcgatacgttcattcttgacgtttccctttgcgttttctctattcaagggtgcttgttcctagcgactaatattacagagcattgtatatataatggaagcttttcaattccgagagcttgtttcatattcactaagcagagatgggttagaggaagtttgtgttgtgcaattttagcgagccctgtcttagaaagctgtggaaggtactgggtagaagtttcttgtttccaatcaaccatgaattccagctccaattttgggaatccttttgttggtttagggggagatcaagaggcgaatactgtttgagttgtataaaagaagttacctgaattagattatttaaatttcgttgcaatgcttgagagctatggtatattgtacttgtaactcgagactctggcaattttaagttcaattattgtacaaaataatgaaatgagatactttatttgac

SEQ ID NO: 1655 - DNA, 4358 bp, Glycine max
cacacttccgtgtctctattttaagtcccatcacttacataacaaaacaacacaaaattcaattcaaaaccttaattcaaacctaactaacgtaaacctctctcccgcgagaagaagccatggatttggaagaggaacaggagtacgacgagcaaatgatggaggaagaagacgacgaggaagagatcacgcaggaagacgcgtgggcagttatatctgcatacttcgaagagaaaggcctcgttcgtcaacaactcgattccttcgacgagttcatccagaacaccatgcaggaaattgtcgatgagtcagcagatattgaaattcgacccgagtcgcagcacaatcccggtcaccaatccgatttcgccgaaaccatttacaagatcagtttcggtcagatttacttgagtaagcctatgatgacggagtctgatggagaaaccgccacgttgttccccaaggctgctaggttaaggaaccttacgtattctgctcctttgtatgttgatgtctccaaaagggtcatcaagaagggacacgacggtgaagaggtcactgaggcccaggatttcaccaaagttttcattggcaaggttcctataatgcttcggtctagttattgcaccttgtaccagaattcggagaaggatttgactgagcttggggagtgtccgtacgaccaaggcgggtatttcattattaatgggagtgagaaggttctgattgctcaggagaagatgagcaccaaccatgtctacgtgttcaagaagaggcagcccaacaagtatgcctatgtggccgaagttcggtccatggcagagtcgcagaacagaccgcccagtactatgtttgtgcgcatgctctctcggactagttccaaagggggttcttcaggacaatatatacgtgccactcttccttacattcgaacggaaattcccatcattattgtgtttcgagcattggggtttgttgctgataaagatattctagagcatatatgttatgacttctcatatactcaaatgatggagctgctacgtccttccctggaagaagcgtttgtaattcaaaatcaacaggttgcacttgactacattgggaaaagaggagcaactgtaggtgtgacaaaggaaaagagaattaagtatgctaaggagatccttcaaaaggagatgctccctcatgttggcgttggagaatattgtgagaccaagaaagcttactattttggatatatcattcaccggctactgctgtgtgcacttgggcggagggctgaggatgatagggatcattatggaaacaagaggctggatctggctggtcctttacttggtggtcttttcagaatgctattcagaaagctaacgagagatgtcaggggatatgtacagaagtgtgttgataatgggaaagatgttaatctgcaatttgctatcaaagcaaaaaccatcacaagtggacttaaatactcacttgctactggtaactgggggcaagcaaatgctgcagggactagagctggagtttcacaggtgctgaatcgtttaacttatgcatccactttatctcacttgcgaagattgaattccccaatagggcgtgaagggaagttggccaaaccaagacagctgcataattcacaatggggaatgatgtgtccagcagaaacacccgaaggacaagcctgtggactggtgaagaatctggcattgatggtctacataacagttggttcagcagcatatcctattctggagtttttggaagaatggggcacagagaattttgaggaaatctctcctgcagtgattcctcaagccacaaaaatttttgtaaatggttgctggatgggtatccatcgtgaccctgatatgttggtgagaacattgaaaaagctaagacgtcgggttgatgtgaacactgaagttggggttgtcagagatatccgtcttaaagaattgcgtatatatacagattatggtcgttgcagtcgtcctttattcattgtggataagcaaaggcttctcataaagaagaaggatattcatgctttacaacagagggaatcccctgaagatggcggatggcatgatctagtgtccaagggttttatagaatatattgacacggaagaagaagagactacaatgatttccatgacaattaatgatcttgtacaagctaggatcaatccagaagatgcatattccgatacttacactcattgtgaaatccacccatcactaattctgggtgtatgtgcttccattataccatttcctgatcacaatcagtccccacgtaacacttatcagtctgcaatgggaaagcaagcaatgggaatatatgttacaaactaccagtttcgaatggataccttggcctatgttttatattatccacaaaagccactggtcactacaagagccatggagcatcttcatttccgtcaactcccagctggaattaatgctattgtatccattgcctgttactctggttataatcaagaagattctgtcatcatgaaccaatcgtcaatagaccgtggattctttcggtctctgtttttccgttcatatagagatgaagagaagaagatgggaaccctagtgaaagaagattttggccgtccagatagagctaacaccatgggaatgagacatggttcttatgataagctggatgatgatggtcttgccccaccaggcacacgagtatctggtgaggatgttatcattggaaagaccaccccaatatctcaggaggaggcacagggacaagctttacgttacacaaggcgtgatcacagcataagcttacgtcacagtgaaactggaattgttgatcaagttttgctgaccacaaatgctgatggattaagatttgtgaaagtaagagtgagatctgttcgtataccacagattggtgacaaattcagtagtagacatggtcagaaggggacagtgggtatgacttatacacaagaagacatgccatggactgtggaaggcattacccctgatattattgtcaatcctcatgctattccttctcgaatgacaattggtcagcttattgagtgtatcatggggaaggtggcagcccacatgggaaaagagggagatgcaactccttttacagatgttactgtggacaatatcagtaaagctctacacaagtgtgggtaccaaatgcgtggttttgagaccatgtacaatggtcatacagggagacgtctcagtgcaatgattttccttggccctacatattaccaaagactgaagcatatggttgatgataagatccattctcgtggaaggggtccagtgcagatcctcacaaggcaacctgctgagggacgctcacgagatggaggtctccgatttggagagatggaacgagattgcatgatagctcatggagctgctcactttttaaaggaaaggttgtttgatcaaagtgatgcttacagggtccatgtatgtgagcgttgtgggttgatagctattgcaaatctcaaaaagaattcttttgagtgcagggggtgcaagaacaaaactgacattgttcaggtttatattccttatgcttgtaagctcctcttccaagagttaatggctatggccatagctccaagaatgcttacaaaggaggtcaaaactacaaaccaaaagaagggagcctgataaacttgtttgacgaaagccactattcttatattctgactccaaagctctcgagaatatggatcaaacatggtatctaaatatacaaatttgatttgatattgtttttcaagtctgaaattacaggaacctttcaagtgttgggaaagtcccaagcaaaaatagtttcgatacgttcattcttgacgtttccctttgcgttttctctattcaagggtgcttgttcctagcgactaatattacagagcattgtatatataatggaagcttttcaattccgagagcttgtttcatattcactaagcagagatgggttagaggaagtttgtgttgtgcaattttagcgagccctgtcttagaaagctgtggaaggtactgggtagaagtttcttgtttccaatcaaccatgaattccagctccaattttgggaatccttttgttggtttagggggagatcaagaggcgaatactgtttgagttgtataaaagaagttacctgaattagattatttaaatttcgttgcaatgcttgagagctatggtatattgtacttgtaactcgagactctggcaattttaagttcaattattgtacaaaataatgaaatgagatactttatttgacaacgttgatttgtgagttttctatttaccatcga

SEQ ID NO: 1656 - DNA, 4309 bp, Citrullus lanatus
gcagagtcggccattttgggacgcgaaggtcattcgagctcgcgcgaggttcttttctcagaaaccgtacttccttctgtttaccttacaaaaatggacgattacgaagagtatgatcggaatatgaatgacgacgacgatattgaggctatccctgacgatgaagaagagatcacgcaagaagatgcttgggcagtaatttcagcctattttgaagagaaggggttggtccgccagcagctcgattccttcgatgagtttattcagaatactatgcaggaaattgtggacgagtctgcagacatcgagattcgtcccgagtcacagcacaatcccggccaccagtcggatgttgctgagacaatatacaagatcagctttggtcagatatacttgagtaagccaatgatgaccgaatctgatggagagactgcaaccttatttcctaaggctgcaaggttgaggaatctaacatactcagcgcctttgtacgtggatgtctcaaaaagagtcataaagaaaggtcatgatggtgaagaagttactgaaacccaagattttacaaaagtttttattgggaaggttcccatcatgcttcgatcgagttattgcacattgtatcaaaattctgagaaggatctgaccgagctcggggagtgtccatatgaccaaggaggatattttatcatcaatgggagtgagaaggttcttattgcacaagagaagatgagtacgaatcatgtatatgttttcaagaaaagacagcctaacaagtatgcctttgtggcagaagtccggtctatggctgagtcacaaaatagaccacctagtaccatgtttgtacggatgctttctcgaactagtgccaaggggggctcttcaggacaatatatacgtgccactctgccctacattagaaatgagattccaattataattgtgtttcgtgctctaggatttgttgctgacaaagatattctagagcatatatgttatgacttctctgatactcaaatgatggagttgcttcggccttccctggaagaggcttttgttatccaaaatcagcaggttgcactagactatattgggaagagaggatcaacagttggtgtgaccaaggaaaagaggattaagtatgccaaagagatccttcaaaaggaaatgcttcctcatgttggcgtaggtgaattttgtgagacgaagaaggcatattactttggttacataattcaccggctactcttatgtgcccttggccggagagcagaagatgatagggaccactatgggaacaaaagactggaccttgctggtcctttacttggaggcttgtttagaatgctatttagaaagttaacaagagatgtgagaggttacgtacaaaagtgtgttgataatggaaaggatgtcaatttgcaatttgccatcaaagcgaaaactattactagtgggctgaaatattcacttgccactggaaactgggggcaggcaaatgcagctggtacaagagctggagtatcacaggtgttaaatcgtttgacttatgcatcaactttgtctcacttgcgaaggctgaattcacccattggacgagaaggtaaattggccaagcctcggcagttgcataattcacaatggggaatgatgtgtcctgctgaaacacctgaaggacaagcatgtggactggtaaaaaatcttgcattgatggtctatattacggttggatctgcggcatatcctattttggaatttttggaagaatggggcacagagaatttcgaggaaatttctcctgctgtcattcctcaagctacaaaaatttttgtcaatggttgttgggttggaatccatcgggatcctgaaatgttggtgaagactttgagacggctgaggcgacgagttgatgtaaatactgaagttggagtagttagagatatccgtctgaaagaactacggatatatacagattatggtcgttgcagtcgtccattattcattgttgagaaacaaaggcttctcataaagaagaaggatattcatgctcttcaacagagggaatccccagaagatggcggttggcacgatcttgtagcaaagggattcattgagtacatagacactgaagaagaggaaactacgatgatttccatgacaattagtgatcttattcaagcaaggatcaacccggttgaggcttattctgacacctacactcactgtgaaatccatccatcattgattttgggtgtttgtgcttcaattattccatttcccgaccataaccagtctccacgtaacacgtatcaatctgctatgggtaaacaagctatgggaatttatgtcaccaactaccaatttcgaatggatactttggcctatgttttgtattatccacaaaagcctcttgtgactacacgagctatggagcacctccatttcaggcagcttccagctggcattaatgccattgttgccatcgcttgctactctggttataaccaggaagactctgtgatcatgaatcaatcctccattgaccgtggattttttaggtcacttttcttccggtcatacagggacgaagagaaaaagatgggaactcttgtaaaagaagattttggacggccggacaggagtaatactatgggcatgaggcatggctcctatgataaattggatgacgatggtcttgcaccccctggtactagagtatcaggtgaggacgttattattggaaagactactcctatctctcaggaagaagctcagggacaggctgcacgttactcaagacgtgatcatagcattagtttacgtcacagtgaaaatgggattgtagatcaagttctactgactacaaatgctgatggattgagattcgtgaaagtaagagtgagatctgttcgaatacctcagattggggacaagttcagtagtcgacatggtcaaaaagggacagtgggaatgacttacacacaagaagacatgccttggactgtggaaggaatcacccctgatattattgtgaatccacatgctattccttctcgtatgacaattggtcagctcattgagtgtatcatggggaaggtggcagcccacatgggaaaagaaggagatgctaccccatttactgatgtcactgtggataacatcagtaaggctttgcataagtgtggttatcagatgcgtgggtttgaaaccatgtataatggccatacaggccggcggctctcagcaatgatattccttggtccgacctactaccaaaggctgaagcatatggttgatgacaaaatacattcacgtggaaggggtcctgtgcagatccttacgagacaacctgctgagggtcggtcgcgtgatggtggtcttcgatttggggagatggagcgtgactgcatgattgcccatggtgctgctcatttccttaaggagaggttgtttgatcaaagtgatgcttataggatccatgtctgtgagtgctgcggattgatagccattgcaaatctcaagaagagttccttcgaatgtaggggctgcaaaaacaaaactgacatcgttcaggtgtatatcccttatgcttgtaagcttctcttccaagagcttatggctatggcaatagcaccgcggatgttcacaaaggagattaaaccattaaaagaccaaaagaagaaaggatcctgatttccttctatagcttcagcttcttgtcaactctcacatgtattggacgatttctgagctattatattctaacagttggagcctggaggcagtgatgacacgttccctggaggcatagttttgtgagatatgcaggcgcctcaaggtctcagtaatgggttggtagaaatcggatcaaccagccgcccttggaatccattgatggagctatctcttcatcctaagatcaaggtcaagagtacgtgcaatcaactgcttccccttgggcttttactttcattatagagagggatttgttaggttgtatgcagcaggtgacctacccactggtgtccatagaaaccccttttctttttcacttgaatatttgcttcagcatctccggataatatatactagggtagagtatggagatataatgagtttaacgagttttaatagatgaaatttattgtcattatccaacagacgctgaatatcttccatgttagtaaattggatttacccacctcattttcaacttttctgcaacgaagttgtactaaatggtataatttaatgatacaacacagttcttttccacccttttttgtacaccaccgacataaaatatctagtt

SEQ ID NO: 1657 - DNA, 3836 bp, Valeriana officinalis
atctgtagaaattagaaatcctaacttacctggacagtagtaatctcagacaggcgactttcgagaatggatttggaagacgagtatgagaatatagacaatgacgaggaagaggatattacacaggaggatgcttgggctgtgatcagtgcatactttgaggagaagggtttggttcgtcaacagcttgattcattcgatgagttcattcagaacaatatgcaggaaatcgtcgacgaatcagctgatattgagattcggccggagtctcagcacaatcctggacaccagcctgattttgctgagactatatacaagatcagctttggtcaaatttaccttagtaagcctatgatgactgagtctgacggtgaaactgcaacactattcccaaaggctgcaaggctgaggaatctgacatactctgcaccgttgtacgttgatgtctcaaagagagttataaagaaaggacacgatggtgaagaagtcaccgaaactcaggattttactaaagtctttatcgggaaggttcctataatgctccggtcgagctactgtactttatatgaaaattcagagaaggatttgactgagcttggagaatgtccgtacgatcaagggggtagtttattataaatggcagtgagaaagttctaattgctcaagagaagatgagcacaaatcatgtatatgtgtttaagaagaggcaaccgaacaagtatgcatatgtgggtgaagttaggtctatggcagaatctcaaaacagaccgcctagtacaatgttcgtgcgtatgctctcaagaaccagtgccaaagggggctcatctggccagtatatacgtgccacacttccatacattcgaactgagatccctattattattgtgtttcgagcactaggatttgttgccgacaaggacatattagaacatatttgttatgatttttcggatactcaaatgatggagttgttgcggccttcgttggaagaagcatttgtgatacaaaatcaacaggttgcacttgattatattgggaaacgtgggtcaactgttggcgtcacaagagaaaagagaattaaatatgccaaagaaatccttcagaaagagatgcttcctcatgttgggattggagaatattgtgaaaccaaaaaggcatactatttcgggtatattattcaccggcttctattatgcgctcttggccgaagggcagaggatgatagggatcattatggaaataaacgactggatcttgctggttcattgcttggtggtttatttcgaatgttatttagaaagttaacaagggatgtgagaggttatgtccagaagtgcgtcgataatggaaaggatgtaaatctacaatttgcaatcaaggccaaaacaatcaccagtggccttaaatactctcttgctactggaaattggggtcaagcaaatgcagccggtacaagagctggtgtttcacaagtgttaaatcgactgacatatgcatctactttgtctcacttgcggcgactcaattctcctattggacgtgaaggtaaattggcaaaacctaggcagttgcacaattcacaatggggtatgatgtgcccggcagagacaccagaaggacaagcatgtggactggtgaaaaatcttgcattgatggtatacattacagttggatcagcagcatatcctattctagagtttttggaagagtggggcacagagaatttcgaagaaatttctcctgctgttattccccaagctacaaaaatctttgttaatggttgctgggtaggtattcatcgtgatcctgatatgttggtgagaacactcagacggttgagaaggagggttgatgttaatacggaagttggagtggttcgagatattaagctgaaagaactgagaatctacactgattatgggcgttgcagtcgtcctttgttcattgtcgagaaacagaaactcttgattaaaaagaagatattcaagctctgcaacaacgggaatcaccggaagatgctggatggcgtgatttagtagagaaaggttttatagagtatatagatacagaagaggaagaaaccactatgatttccatgactataaatgatcttgtaagcgcaagggacaacccagaggaggcttattctggcacttatacacattgtgaaatccatccatctttgattctgggtgtatgtgcttcaattataccattccctgaccacaaccagtctcctcgtaatacttatcaatcggctatgggtaagcaagcaatgggaatttatgtcaccaacttccaatttcgtatggatacgttggcctatgttctttactatccacaaaagcctcttgttactactcgagcgatggaacatttgcactttaggcaactgccagctggcattaatgcaattgttgctatttcatgctattctggatacaatcaagaggattctgtcatcatgaatcagtcatcaatagatcgtggtttctttcgatcactgttcttccgttcgtacagggacgaggagaagaaaatgggaacacttgtgaaagaagattttggccgtcctgatagagctaataccatgggtatgagacatggatcgtacgataaattggacgacgatggtcttgctcctgctggaactagagtatcgggtgaggatgtaattatcggtaaaacaactcccattgctcaagacgatgctcagggacaagcttccagatatacacgacgtgatcatagcacaagtttacgccatagtgaaacaggaatggttgatcaggtgttgctgactacaaatgcggacggattgagattcgtgaaagtgagagtgagatcagtgaggataccacagataggagataagttcagcagtaggcacggtcagaagggaaccgtggggatgacgtacactcaagaagatatgccttggactgttgaagggataacgccagatattattgtgaatccgcatgctattccatctcgaatgacgatcggtcaacttattgaatgtattatgggaaaagttgctgctcacatgggaaaagaaggagatgccactcccttcaccgatgttactgtggacaatataagcaaagcgcttcacaagtgtggataccaaatgcgtggattcgagacaatgtacaacggccacactggccgtagacttacagctatgattttcctgggtcccacatattaccaaagactgaagcatatggttgatgacaagatccattcccgtggccgtgggcccgttcagattctgacaaggcagcctgctgagggtagatctcgtgatggagggctcagattcggtgagatggagcgagactgcatgattgctcacggtgctgctcatttcctcaaagaaaggctctttgatcagagcgacgcttacagagttcacgtctgtgagatttgcggattggtggctattgctaatctcaagaagaactccttcgagtgccgaggctgcaaaaacaaaactgatattgttcaggtgtacattccttatgcatgtaagctcttgtttcaagagctaatgtcgatggcaatagcacctcgtatgatgactaaagatatcaaacaagccaaagacctcaagaaaaaaggcgcctgaaattcaatatcgacaaaattatttaaattttgatttattatatatatgtggcactgtacacggactttttacgtgggatttattttgaagtattatatctccttaaatcaaagtgtttgagcatgaattcttgcatcattaggttagactttgtctccattgtgttggttgtgtgtgaattattaagcttactctcattata

SEQ ID NO: 1658 - DNA, 3989 bp, Nicotiana benthamiana
cttttccctcttttcctctcttcgccctctggactaacccaagtaaaccactctccgaaccaaatgtacgtgctaacaacactgaaaaagacaaagatcagggcgccaattatgtttggcttttgaatcaatccatttgaactgtaaaaaaaaaagaaaaaagaaactcaaatttaattttgttgaatcaatatggatatggaagaagagtacgaacaacaatacaataatgatgatgatgaagaggaaataacccaagaggatgcttgggctgtcatcagtgcttacttcgaagagaaggggcttgtccgacagcaactggattcctttgatgagtttattcagaacactatgcaagaaattgtcgatgaatctgctgatattgagatccgacccgaatcccagcataaccctggtcaccagtctgactttgctgagacaatctacaaaatcaactttggtcagatttatttgagtaagccaatgatgacagagtcagatggcgaaactgctaccttgtttccaaaagctgcaaggttgaggaatttgacatactctgcgcccttgtatgtggatgttacaaagagagtcatcaagaaagggcatgatggtgaagaagttactgaaactcaggacttcacaaaagtcttcattggaaaggttcctataatgcttcggtcaagttactgcacattatatcaaaattcagaaaaagatctaacagagcttggagaatgtccattagatcaaggtggatacttcattatcaatggaagtgaaaaggtcctaattgctcaggagaagatgagcaccaaccatgtgtatgtatttaagaagaggcaacctaacaagtatgccttcgttgcggaagtcaggtcaatggcagaatctcaaaaccgcccgccgagtactatgtttgtgcgaatgctttcaagaacaagtgcaaaagggggttcctcaggccagtacattcgggcgacacttccatatatacggacagagattcctatcattatcgtgtttcgagctctaggttttgtggctgataaggatatattggaacatatttgttatgatttcaatgatactcaaatgatggagttgttacgtccgtcgttggaagaagcttttgttatacaaaaccaacaggttgctcttgactacatcgggaagagaggggctacagttggtgttacaagggaaaagaggataaagtatgccaaagagattcttcagaaagaaatgcttcctcatgttgggattggagagtattgtgaaacaaagaaagcgtattattttgggtatatcatccaccggcttctgttatgtgcacttggccgaagggctgaggatgatagggatcactatggaaataagagactggatcttgctggtccattgcttggtggcctgtttcggatgctttttagaaagttgacaagggatgttagagcctatgttcagaagtgtgttgacaatggaaaagatgtaaaccttcaatttgcaatcaaagctaaaaccattaccagtgggctgaaatactctcttgctactggaaactgggggcaagctaatgcagcgggtacaagagctggtgtttcacaggtgttgaatcgtctgacttatgcttctactttgtctcacttgcgaaggttgaattccccaataggccgagaagggaaactggccaaaccaaggcaattgcataattcacaatggggaatgatgtgtcctgcagaaacgccagagggtcaagcatgtgggctggtgaagaatctagccttgatggtttatataacagttggttccgcagcatatccaattctggagtttttggaagagtggggtactgagaactttgaggaaatttctcctgccgttattccacaggctacaaagatttttgtcaacggtacctgggtgggaattcatcgcgatcctgacatgttggtgagaacactgagacgacttaggagaagggttgacgtcaatactgaagtcggggtggttcgtgatatccgtttgaaagaacttcgaatttataccgactatgggaggtgcagtcgtccattatttattgtggaaaagcaaaggctgctgatcaagaagaaggatattcaaacattgcaacaacgggaatcacctgaagagggtggctggcatgatctggtggctaagggatacatcgagtacattgacactgaagaagaagaaacaacgatgataagcatgactataaatgatcttgtgcaagcacgccttaatcctgaggaagcttattctgatacctatacccactgtgagattcacccgtcactaatattgggtgtttgtgcatcaattattccgtttcctgatcataatcagtctccccgtaatacttatcagtcagctatgggtaagcaagccatggggatttatgtcaccaactaccaatttcggatggacacattggcctatgtgctttattatcctcagaagcctcttgtcacaacacgagccatggaacacttgcatttcaggcaactacctgcaggcatcaatgcaattgttgccatttcctgctactctggatacaatcaagaggattctgtcattatgaatcagtcatcgattgatcgtggatttttccgatcactatttttccgttcatacagggatgaggaaaagaagatggggacattggtcaaggaggactttggacgtcctgatagagcttctactatgggtatgcgccatggttcttatgataagttggatgatgatggtcttgcccctccgggaaccagagtttctggtgaggatgtaatcattgggaagacaactcccatttctcaagatgatgcacaagggcaagcctctcgctatacaaggaaagatcacagtaccagtctccgccacagtgaaactggaatggtagatcaggttctattaacaacaaatgctgacgggctcagatttgttaaagtgagggttagatcagtccgcattcctcaaattggggacaagtttagcagtaggcatggtcagaagggaacagttggcatgacatatacacaagaagatatgccatggaccgtggaaggcattactcctgatattattgtgaatcctcatgctattccttctcgaatgactatcggtcagctgattgagtgtattatgggaaaggttgctgcacacatgggaagagaaggtgatgccactccctttacagatgttactgtggataacatcagcaaagctttacataaatgtggataccagatgcgtggttttgagaccatgtacaatggtcacactgggcggcggcttagtgcaatgatattccttggtcccacgtactaccagcgactgaagcatatggttgatgacaagattcattctagaggcagaggccctgtgcaaatcctcacaaggcagcctgcggaaggtcggtcacgtgatggtggtcttcggttcggagagatggagcgagattgtatgattgctcacggtgctgctcattttctcaaagagcggttatttgaccaaagtgatgcatatagagttcatgtttgtgagcgatgtgggctgattgctattgcaaacctcaagaagaattcttttgaatgcagaggttgcaagaacaagactgatattgtccaggtccacattccatatgcatgcaagttgcttttccaggagctaatggctatggctatagctccaagaatgcttacaaaggatgtcaaacaagccaaagatcaaaagaaaaaaggagcttgattaatttggctatacggagaaaaaattgcctgctagaaaagcccccttgttttatagatttaaaatcctactttatgagcagtcagttttgcattcacaatatgaggatcaacttcctatgtgttttagaatttttgtagattaacatgtcatcctatatcttatgagaacaagacacatatggacctcagtacagagattacaaagtactggtttgggag

SEQ ID NO: 1659 - DNA, 4223 bp, Aquilegia formosa
agagagagaaaaaaaattccccaaatcgaaaactagggtttttttttcagttaaattgaaaaaaaaaaaaaaaaaatgtatggaggaggagtagaagaagatgaagtaatgatggttggtaataataataataataataataatgatgatatagaattagaagaagaagaagatgaagataatgaagatataacacaagaagatgcatgggcagtaataagtgcttattttgaagaaaaaggtttagttagacaacaattagattcatttgatgaatttatacaaaattcaatgcaagaaattgttgatgaatctgatgatattgttattcgtcctgaatctcaacataatcctggtcgtcaatctgattttcaagagactgtctacaagattagctttgggcagatatacttgagtaaacccatgatgacggaatccgatggagaaactgccactttatttccaaaggcagcacgattgaggaatctgacttactcagctccattgtatgtggatgtcactaaacaagttatgaagaaagggcatgattgtgaagaagtcaccgaacctccagagaccattcccaaagtgtttattggaaaggttccaattatgcttcggtcgagttactgcacactgtttcaaaattctgaaaaggatttaacagagctgggggagtgtccttatgaccaaggtggatacttcattattaatggaagtgagaaggtattgattgcccaggagaaaatgagcaccaaccatgtttatgtgtttaagaaaaggcagcccaacaagtatgcttatgtcgctgaagtccgttcgatggcagaatctcaaaataggccaccgagcagtatgtttgtacggatgctttcacggactagtgcgaaagggggatcttcagggcagtatattcgggctaccttaccatatatcaggacagaaatacctattattattgtgttccgtgcattaggctttgttcccgacaaagatatattggagcatatttgctatgactttgcagacactcagatgatggagttgcttcggccatcccttgaagaagcatttgtgattcaaaacaaacaagtggcattggattacattggcaaaagaggttcaactgtgggtgtgacaagggagaagagaattaagtatgctaaagagattcttgagaaggaaatgctccctcatgtaggtgttggcgaacactgtgaaacaaagaaagcttactatttcgggtacatcatacataggcttctgctttgtgcacttggccgaaggcctgaagatgatagggatcattacggaaacaagcgcctggaccttgctggtcctttacttggaggcttgttccgaatgcttttcagaaagttgacaagggatgtgagagcatatgctcaaaagtgtgttgataatggaaaagatgttaacttgcaattcgcaatcaaggctaagacaattaccagcggccttaaatattcccttgccactggtaattgggggcaagcaaacgcagctggtacaagagcaggggtttcacaggtgctgaatcgcttgacatacgcttctactttatcgcacttgcgaaggttaaactcccctatagggcgtgaaggaaaattggcaaaacccaggcagttgcataattcacattggggaatgatgtgtcctgcggagacacctgaaggacaggcatgtgggctggtgaaaaatcttgccttgatggtttacataacagttggatccgcagcaaatccaattttggagtttttggaagagtggagtactgagaattttgaggagatttctcctggagttattcctcaagctaccaagatttttgtcaatggttgctgggttggcattcatcgtaatcctgagcttttggtcaggaccctgagacagttgaggagacaggttgatgtcaatactgaagttggtgttatccgagatatccgtttgaaggagttgcgattgtatactgattacggtcgctgcagtcgtccattatttattgtggagaagcagcgcttgctgataaagaaaaaggacatcagggccttacaacagcgggagtcaacagaggagattggatggcatgatctcgtgcagaagggatacatagagtatgtggataccgaagaagaagagactacgatgatttcaatgacaataaatgatcttgtaactgctaggctcaatccaggagaggcctattctgagacttacacccattgtgaaatccatccatcgttgatattaggtgtctgtgcttctatcattccatttcctgaccataatcagtctcctcgtaatacataccagtcagctatgggaaagcaagcaatgggaatttatgtcaccaattatcagttacgaatggatacattggcgtatgtcctttactatcctcagaagccccttgttaccactcgtgccatggaacacttgcattttaggcagctgcctgctggcattaatgctattgttgctattgcctgttattctggatataaccaagaagactctgtcatcatgaaccaatcatcaatcgaccgtggattcttccgctcgttgttcttccgttcctaccgagacgaggaaaagaaaatggggacacttgtcaaagaagattttggccgccctaacagggagaatactatgggtatgcggcatggctcatatgataaattggacgatgatggtcttgcgcctcctggtacaagggtctcaggcgaggatgttattattgggaagaccactcccattgctcaggatgaatcccaaggaatagcttcgcgatacacacgacgtgatcacagcacaagtctgcgtcatagtgagagtggaatggtggatcaggtactgttgacaacaaatgcagatgggttgaggtttgtgaaagtaagaatgagatctgttcggatacctcagattggcgataaattcagcagtaggcacggtcaaaaggggactgttggcatgacttacactcaagaagatatgccatggactgttgaaggaattaccccagacattattgttaatccgcatgccattccatcccggatgacaattggtcagcttattgagtgcatcatgggtaaagttgcagctcatatgggaaaggagggagatgctaccccttttacagatgtcacggtggacaatatcagcaaagctcttcacaaatgtggatatcagatgcgtggctttgaaaccatgtacaacggtcacactggtcggcgtttgactgctatgatattcttaggtcctacatattatcagagacttaagcacatggtggatgataaaattcactcacgtgggagaggcccagttcagatcctcacgaggcagccagctgagggtcgctctcgtgatggaggtcttcgatttggagagatggagcgagattgcatgattgctcatggtgctgctcattttcttaaagaacgtttgtttgaccagagtgatgcttatagggttcatgtgtgtgagcgatgtggcttgatagctatagcgaatctaaaaaagaactcgtttgagtgccgtggatgcaaaaacaagactgatattgttcaggttcacataccatatgcatgtaaactccttttccaggaacttatggccatggctatcgccccaagaatgttgaccaaggaagtcaaggataataaaaagaaaggaaagtgatacttttattcaaaatccggatgaatacaaaatatttgggaagcttcactgggctctatcagtgcgcattgtttcagagtaccagtattaaagcaaaaaacagaggaaggtgattttcgtattgccaccacgtcttcttttgctggtgcttccagatgcaatttcagtgcaggcagcaggagttctactggagtagttctatcttgttggaataaagttcagcatcctctgaattccttggcttatctcatttcaatactacagggttctgctatcacacatcgagggtttgtttcttatgtaatctaatcctcatcagaaaaattaatggattctgcagacgcaaaagtagtaaacttagtaaacacagttttgaatgtgaacttgtgtagctgtttgctcatgtaggtactgggcatgtaccagtattctgtcatttcaagcatcatttgtgtagaaccatacagttggattttggatacgttatgaaagtgccatatgaaattcaaaaatttccaatg

SEQ ID NO: 1660 - DNA, 4261 bp, Trigonella foenum-graecum
gtactcaagagcaaaacttgggtacatttctctgctagggtttcgtaactgcgttctttcttttcgcaaattcaacacaaaatcacactcaaaaacacaaaatcaaactcaaaaacacaaaatcaaactaatttgaacttcgaattcgaacattaagatgatgatggatttggaagaagagaatgatttcgatcaacaaatggaagaagaagacgatgaggaagaaatcacacaagaagatgcttgggctgtgatatcagcgtatttcgaagaaaaagggcttgttcgtcaacaactcgattcttttgatgagtttatacaaaatacgatgcaagagattgttgatgaatctgctgatattgaaattcgtcctgagtctcagcataatcccggtcatcagtctgattttgcagagaccatctacaagataagttttggtcagatttacttgagtaagccgatgatgacggaatccgatggagaaactgctacattgtttcctaaggcagctaggttaaggaatcttacttattcagctcctttgtatgttgatgtttctaagagggttattaagaaaggacatgatggtgaagaggtcactgagactcaagatttcaccaaagttttcattggcaaggttcctataatgcttcggtcgagttattgcacattatttcagaattcagagaaggatttgaccgagcttggagagtgtccgtatgatcaaggaggttatttcattattaatggcagtgagaaggttcttattgctcaggagaagatgagcaccaatcatgtctacgtcttcaagaagaggcaacctaacaagtatgcttatgtgggtgaagttcggtccatggcagagtcacagaacagaccacctagcactatgtttgtgcgcatgctctctcgagctagtgccaaagggggttcttcaggacaatacatacgtgctactcttccatacattcgaactgaaattcctatcattattgtgtttcgggcattggggtttgtcgctgacaaggatattcttgaacatatatgctatgactttgcggatactcaaatgatggagttgcttcgtccttccttggaagaagcatttgtgatacaaaatcaacaggttgcacttgactatattggaaaaagaggagcaactgttggtgtgaccaaggaaagagaattaagtatgctaaggacatccttcaaaaggagatgcttccacatgttggtgttggagagtattgtgagacaaaaaaagcgtactattttggatatatcattcaccggctacttctgtgtgcacttgggaggagggctgaagatgatagggatcattacggaaacaagaggctggacctggcaggtcctttacttggcggtctttttagaatgctattcagaaagttaactagagatgtcaggggttatgtgcagaagtgtgttgataatgggaaggatgttaacctgcaatttgctatcaaagcaaaaaccatcacaagtggacttaaatactcacttgctactggtaattgggggcaagcaaatgctgcgggtactagagctggagtgtcacaggtgcttaatcgtttgacttatgcttccactttatcacacttgcgaagattgaattctcccataggacgtgaaggtaagttggccaaaccaaggcagttgcataattcacaatggggaatgatgtgtccggcagaaacaccagaaggacaagcctgtggactggtgaagaatctggccttgatggtttacataacagttggttcagcagcatatcctattctagagtttttagaagaatggggcacagaaaattttgaggaaatttctcctgcggtgattccccaagctacaaaaattttcgtaaatggttgctggatgggtattcatcgtgatcctgatatgttggttagaacattgagaaagctgagacgtcgggttgatgttaatactgaagttggggttgttagagatatccgtcttaaagaactgcgcatatatacagattatggtcgctgcagtcgtcctttattcattgtggataaacaaaggcttctcataaagaagaaggacatccattctttgcaacaaagggaatcctcagaagagggtggatggcatgatcttgtgtccaagggctttatagaatatatcgacacagaagaggaagagactactatgatttccatgacaattaatgatcttgtacaagcaaggctcaatccagaagaagcatattctgatacttacactcactgtgaaatccatccatcactgattttgggtgtatgtgcttccatcataccatttcctgaccacaatcagtcccctcgtaatacatatcaatctgcaatgggaaaacaagcgatgggaatatatgtcaccaactaccagtttcgaatggataccttggcatatgtactgtactaccctcaaaagccgctggtcacgacgagagccatggagcatcttcattttcgtcaacttcctgctggaattaatgccattgtggccatcgcatgttattctggttataatcaagaagattctgtcatcatgaaccaatcatcaatagaccgtggcttctttcggtctctgtttttccgttcatatagagatgaagagaagaaaatgggaactcttgtcaaggaagactttggtcggccggatagagctaacaccatgggcatgaggcatggttcttatgataagttggatgatgatggtcttgctccacctggcacaagagtgtctggtgaggatgttattattggaaagaccactcctttatctcaggaggagcaacaaggacaagctgctcgttactcaaaacgtgatcacagcataagcttacgccatagtgaaactggaatcgttgatcaagttctgttgactacaaatgctgatggattgagattcgtgaaagtaagggtgagatctgttcgaataccacagattggtgacaaattcagtagtagacatggtcagaagggaactgttggtatgacttatacacaagaagacatgccctggacagtggaaggcatcacccctgatattattgtcaatccacatgctataccttctcgaatgacaattggtcagcttattgagtgtatcatggggaaggtggcagcccacatgggaaaagaaggagatgctactccttttacagatgttactgtggataatatcagcaaagctctacacaaatgtgggtaccaaatgcgtggttttgagacaatgtacaatggtcatacagggaggcgtctcagtgcaatgattttccttggtcctacctactaccaaagattgaagcatatggttgatgacaagatccattctcgtggacgagggcctgtgcagattcttacaaggcaacctgctgaggggcggtcacgtgatggaggtcttcgatttggagagatggaacgtgattgcatgattgcccatggagccgctcacttcctaaaggaaagactgtttgatcaaagtgatgcatatagggtccatgtatgcgaacgctgtgggttgatagctattgcaaatctgaagaagaattcttttgagtgtaggggttgcaagaacaaaactgatattgttcaggtttacattccttatgcttgtaagctgctcttccaagagctaatggctatggccatagctccaagaatgcttactaaagaggtcaaagctataaaagaccaaaagaagaaaggagcctaatcagcaagtttgagaaaatcgattccatgctgacttcttcctcgtgtggatcatgcatgacatccgaagatgtatgaattcgattttctttgttttctcaatactgttaaatgagatcggaagaaaccttccaagtgttgggaaatgaagtcatataagcgactaggttgaatgacattcctttaatatgtcaaggatttttgctttctacttcaagaattacaccagaaacaaacctgcacccagtagcctcatcaatatctcacttcgtaaattgcatgtgttttgtatcccccctatgaagtatgggggaggtgtctgtaccgtgaaggtacccgtaccggatatacacctgataactaaacattttttttctttgatgaatggtaacactactcgttcgtactccatttttcctgcttattttgctgagttaaatatgcaattttctcacgtgttaacaaaaattatatagtagaatattatgtgtatgagctttatttattgttgtaactaa

SEQ ID NO: 1661 - DNA, 4391 bp, Amborella trichopoda
aatttcatatcgttttttgaggaaagatgtctggaggagaggatgacgactatgtcaatgaagatgaggaaatcacacaggaagacgcctgggcagttatcagtgcatattttgatgagaagggtcttgttcgacaacaacttgattcctttgatgaatttattcagaatacaatgcaggaaattgtcgatgaatctgctgatattgaaattcgaccagagtctcagcataaccctggcagacaggctgattttgttgagaccatctacaagatcagttttggccaaatttatttgagtaagcctatgatgacggaatcagatggagaaactgccactttattcccaaaggcggcaagattaagaaacttgacctattcagcccctttatatgttgatgtcaccaaacgagtcatcaagaagggacatgaccatgaagaactcgcagagcagcaagaattgacgaaagtttttattgggaaggttcccatcatgttgcgttctagttactgcactttgttccagaactcagaaaaagatctaacagaacttggagaatgtccatacgaccaaggtggttatttcattatcaatgggagtgagaaagtcctgattgctcaagaaaagatgagcaccaaccatgtgtatgtatttaagaaaaggcagcccaacaaatacgcgtatgttgctgaagtaaggtcaatggcagagtcacaaaacaagccacctagcagcatgtttgttcgtatgctttcacgaacaagttcaaaagggggctcgtcaggacagtatatacgggctacactcccttatatccgggcagaaattcctataattattgtgttccgagcattagggtttgttgccgataaagatattctggagcatatttgctacgatttctctgatacccagatgatggagctattgaggccttcattagaagaagcttttgtcattcaaaatcagcaggtagcactggactacattggaaagcgaggatcaactgttggtgttaccaaggagaagagaatcaagtatgctaaagaaattctccaaaaagaaatgttacctcatgttggggtgggggaatattgtgagacaaagaaggcttattactttggatatatcattcatcggcttctcgtatgtgcacttggtcgaagacctgaagatgatcgtgatcattatgggaataaaagactggacctagctggtcccttgcttggaagcctgttccgaacgatgtttcggaagctgacaagggatgtccgatcgtatgttcagaagtgtgttgataatgggaaggaggtaaacctgcagtttgcaataaaagctaaaacaattacaagtggtctgaaatattctcttgctacgggaaactggggccaagcaaatgcagctggtacaagagctggagtttcacaggtcttgaatcgcttgacatttgcatctactttgtctcacttacggaggttgaattctcctattgggcgtgaagggaagttggcaaagccccgacaattgcataattcacattggggcatgatgtgtcctgcagaaactccggaagggcaggcttgtggactggtgaaaaacttggctctgatggtatatattacggtgggttcagctgcaaatcctattctggaatttttggaagagtggagtactgaaaattttgaggaaatatcacctgctgttattccacaagcaacaaagatttttgtcaatggttgctgggtggggattcatcgtaaccctgagctattggtgaaaactctaaggcagttgaggagacaggttgatgttaatactgaagttggtgttatacgagacattcgtttgaaagaactgcgattgtatactgattatggtcggtgtagtcgtcctctgttcattgtggaaaaacaaaggttgctgataaagaagtcagatattcgagcactgcaacaaagggaaagcccagatgaaggttggcatgatcttgtagcaaaaggattcatagagtatgtggacacagaggaggaagagacgacaatgatctcaatgacgatatctgatcttgtgagtgccaggctgaaccctgaagaggcatattctgaaacttacactcactgtgaaattcacccatctctgatattgggtgtctgtgcctcgattattccatttcctgatcataaccagtctcctcgtaacacataccagtctgccatggggaagcaagccatgggcatttatgtgaccaattaccagcttcgaatggatactttggcatatgttctttactatcctcagaagcctcttgttacaacacgtgcaatggaacacctgcactttaggcagctgcctgctggaattaatgcaattgttgcaatttcctgttattcaggatacaaccaagaagattctgttatcatgaatcagtcttcaatagatcggggatttttccgatcattatttttccgttcatacagagatgaagagaagaagatgggaactcttgtgaaagaagactttggtcgtccaaatcgggaaaacactatgggcatgcggcatggttcatatgataagttggatgatgatggtcttgcaccacctggtacaagggtctctggtgaggatgtcattattgggaaaacgaccccaattactcaggaagaaatgcaagggcaggcttcaaggtacacaaggcgtgatcacagcacaagtttgcgccacagtgaaagtgggatggtggatcaggttttattgacgaccaatgctgatggcctcaggtttgtgaaagttagaatgagatcagtgcgcataccacagataggggataaatttagcagtagacatggtcaaaagggaactgtgggcatgacatacacacaggaggacatgccatggacagtggaaggcattacacctgatatcatcgtaaacccacatgctattccctctcgaatgacaattgggcagctgattgagtgtatcatgggaaaggtagctgctcacatggggaaagaaggagatgctacccctttcactgatgtcactgtggacaatatcagcaaagcccttcacaaatgtgggtatcaaatgcgtggctttgagaccatgtacaatggtcacacaggcaggaggttgagtgccatgatattcttgggccctacatattaccagagattgaagcatatggtggatgacaagatccattctcgtgggcgtgggccagtgcagatcctcacgaggcagcctgctgagggaaggtctcgtgatggaggccttcgctttggagagatggagcgtgattgcatgatagcccatggggctgctcacttccttaaggagaggctttttgaccaaagtgatgcctatagggtccatgtttgtgaacaatgtggcttaatcgcgatagccaacctcaagaagaattctttcgagtgcagaggttgtaagaacaagactgacattattcaggtgcacataccctatgcatgtaagctgcttttccaagagctcatggccatggctattgccccaagaatgttcaccaaggaagagaagaaaccaaaagatcataagaagaaaggagcccctggacaaagctagtgcaagcttatatggctaattagcccacgttataagagaatgggatgtcatatgaaactgttctctctcttccaaagccactgccttctctttattgctaagttagaagttcacttgagagaagttttgttatggcagaggccaggatgcaggattctcagaggtattacatgtgatgtaatcagaaaaggaaagaggtttcaaatctaatatgtggcggcagttcagaactcatgaaaggcttttatggccttctttttgatattggtggaagtggaaaactcataggcagggatattcatggagagattttagttatatgcttcacattctgagctttcgttataattcagagtctgagaggtgatgatgtgttccttcttttattcaagagaaaacagctctatttatttaggatttggaggataattatcatggttaaatgtgggataacttgaacttggaagagaggaccaaaggtttaagttaacattagttatgtacctgttttgttttttgggtaagtaattatgtatctgtctggtaagtttattaatcaaagaagaagatgacttccttgtatgatgtttggcaagatgatggaagtccatatgaatcatgttcttgtgaatttcttaatgagggatgggcaattttgagtttagattttttattttatttttgttttttctttccctgattcgtccaaaaccagcgaagggcaacatatgaatgagtatggtcatgtaagcttttaatttttattttttatcaagcatgcgaaattgaaag

SEQ ID NO: 1662 - DNA, 4197 bp, Cicer arietinum
aaccaaaacattagtgtttgcctctgctagggtttcattcactcttttcttaccgcgaattcgaacacaaaaatactgaaaatacaaatactcaattaaacaaaaacaaaaaccagaaactaatttgaacttagaatttgaacactattactgtaataatttgataacattacgatggatttagatgaagaacaagagtacgatcaacaaatgatggatgaagaagacgacgaagaagaaatcactcaagaagatgcttgggctgttatttcagcttacttcgaagaaaaaggtttggttcgtcaacaacttgattcattcgatgagttcattcaaaacactatgcaggaaattgttgatgaatctgcggatattgaaattcgacctgaatcacagcataatccaggtcaccaatccgatttcgcagagacgatttataagataagttttggtcagatttacttgagtaaaccgatgatgacggaatcagatggagaaacctctaccttgtttcctaaggcagctaggttaaggaatcttacttattcagctcctttgtatgttgatgtttctaagagggttattaagaaaggacatgatggtgaagaagtcaccgagactcaggattttaccaaagttttcattggcaaggttcctataatgcttcggtctagttattgcacgttatttcagaattcggagaaggatttgactgagcttggtgagtgtccgtatgatcaaggcggatatttcattattaatggcagtgagaaggttctcattgctcaggagaagatgagtaccaatcatgtctatgttttcaagaagaggcagcctaataagtatgcttatgtggctgaagttcggtccatggcagagtcccaaaacagacctcctagcactatgtttgtgcgcatgctctctcgaactagttccaaggggggttcttcaggacagtatatacgtgctactcttccatacattcgaactgaaattcctatcattattgtgtttcgggcattgggatttgttgctgacaaggatattctagaacatatatgctatgatttctcggatactcaaatgatggagttgcttcgtccttccctggaagaagcatttgtaatacaaaatcaacaggttgcacttgattacattgggaaaagaggagcaactgtaggtgtaaccaaggaaaagagaattaagtatgctaaggatatccttcaaagggagatgcttccacatgttggtgttggagagtattgcgagaccaaaaaagcatactattttggatatatcattcatcggctacttctatgtgcacttgggcggagggccgaagatgatagggatcattacggaaacaagaggctggacctggccggtcctttacttggtggtctctttagaatgctattcagaaagcttactagagatgtcaggggttatgtacagaagtgtgttgataatgggaaggatgttaacctgcaatttgctatcaaagctaaaaccatcacaagtggacttaaatactcacttgctactggtaactgggggcaagcaaatgccgcgggtactagagctggagtgtcacaagtgctaaatcgtttaacttatgcgtccactttatctcacttgcgaagattgaattctcccataggacgtgaagggaagttggccaaaccaagacagttgcataattcacaatggggaatgatgtgtcccgcagaaacacctgaaggacaagcctgtggactggtgaagaatctggccttgatggtttacataacagttggctcagcagcttatcctattctggagtttttagaagaatggggtacagaaaattttgaggaaatttctccggcggtgattccccaagctacaaaaattttcgtaaatggttgctggatgggtattcatcgtgaccctgatatgttggttagaactttgagaaagctgagacgtcgggttgatgttaatactgaagttggcgttgttagagatatccgtcttaaagaactgcgcatatatacagattatggtcgctgcagtcgtcctttattcattgtggataaacaaaggcttctcataaagaaaaaggacattcattctttgcaacaaagggaatctcctgaagagggtggatggcatgatcttgtgtccaagggttttatagaatatatcgacacagaagaggaagagactactatgatttccatgacaattaatgatcttgtacaagcaaggctcaatccagaagaagcatattctgatacttacactcactgtgaaatccatccatcactgattttgggtgtatgtgcttccatcataccatttcctgaccacaatcagtcccctcgtaatacatatcaatctgcaatgggaaaacaagcaatgggaatatatgttaccaactaccagtttcgaatggataccttggcctatgtgttgtattatcctcaaaagccactggtcactacaagagccatggagcatcttcatttccgtcaactccctgctggaattaatgccattgtggccatttcatgttattctggttacaatcaagaagattctgtcatcatgaaccaatcatcaatagaccgtggcttctttcggtcactgtttttccgctcatatagagatgaagagaagaaaatgggaacccttgtcaaagaagattttggtcggccggatagagctaatactatgggtatgagacatggttcttatgataagttggacgatgatggtcttgctccacctggcacaagagtgtctggtgaggatgttattattggaaagaccactcctttatctcaggaggaggcacaaggacaagctgctcgttactcaaaacgtgatcacagcataagcttacgtcacagtgaaactggaattgttgatcaagttctgttgacaacaaatgctgatggattgagattcgtgaaagtaagggtgagatctgttcgaataccacagattggtgacaaattcagtagtaggcatggtcagaaggggacagttggtatgacttatacacaagaagacatgccctggactgtggaaggcatcactcctgatattattgtcaatccacatgctattccttcccgaatgactattggtcagcttattgagtgtatcatggggaaggtagcagcccacatgggaaaagaaggagatgcgactccttttacagatgttactgtggataatatcagcaaagctctacacaaatgtgggtaccaaatgcgtggttttgagacaatgtacaatggtcatacagggaggcgtctcagtgcaatgattttccttggtcctacttactaccaaaggttgaagcatatggttgatgacaagatccattctcgtggacgaggtcctgttcagattcttacaaggcaacctgctgaggggcgttcacgagatggaggtcttcgatttggagagatggaacgtgattgcatgatagcccatggagctgctcatttcctaaaggaaagattgtttgatcaaagtgatgcatatagggtccatgtatgcgaacactgtgggttgatagctattgcaaatctgaagaagaattcttttgagtgtaggggctgcaagaacaaaactgacattgttcaggtttacattccttatgcttgtaagctgctcttccaagagctgatggctatggcaatagcaccaagaatgcttactaaagagatcaaatctataaaagatcaaaagaagaaaggagcatgataagtaaaactttaagaaaaactgccagtcttattctatggcgacttcgtctcgtgaacatcgatcgcgcacggtatctgaagatgtatgaatttgattttatttattttctcatgaccgataaatgagaccaggagcttttcaagtgttgggaaatggtggtttatataggtgagtaggttggatgacattctttttatatgtcaaagattgttccttactaattctacttcacgaaattcacctgaaacaaatctgtaccaaatagctccatgaatacgtcttgttgcttcctatagcatttggcaatgtaattacaaggaaggttctttacaacaaaatgtatctattgaaaagtttagcaggactctaaactttaagctcgtcattctaaagatttactttacatgtcttctgtatcctcctctaataagagtg

SEQ ID NO: 1663 - DNA, 4387 bp, Cicer arietinum
tgaaccccggaaaccaaaacattagtgtttgcctctgctagggtttcatttcactcttttcttaccgcgaattcgaacacaaaaatactgaaaatacaaatactcaattaaacaaaaacaaaaaccagaaactaatttgaacttagaatttgaacactattactgtaataatttgataacattacgatggatttagatgaagaacaagagtacgatcaacaaatgatggatgaagaagacgacgaagaagaaatcactcaagaagatgcttgggctgttatttcagcttacttcgaagaaaaaggtttggttcgtcaacaacttgattcattcgatgagttcattcaaaacactatgcaggaaattgttgatgaatctgcggatattgaaattcgacctgaatcacagcataatccaggtcaccaatccgatttcgcagagacgatttataagataagttttggtcagatttacttgagtaaaccgatgatgacggaatcagatggagaaacctctaccttgtttcctaaggcagctaggttaaggaatcttacttattcagctcctttgtatgttgatgtttctaagagggttattaagaaaggacatgatggtgaagaagtcaccgagactcaggattttaccaaagttttcattggcaaggttcctataatgcttcggtctagttattgcacgttatttcagaattcggagaaggatttgactgagcttggtgagtgtccgtatgatcaaggcggatatttcattattaatggcagtgagaaggttctcattgctcaggagaagatgagtaccaatcatgtctatgttttcaagaagaggcagcctaataagtatgcttatgtggctgaagttcggtccatggcagagtcccaaaacagacctcctagcactatgtttgtgcgcatgctctctcgaactagttccaaggggggttcttcaggacagtatatacgtgctactcttccatacattcgaactgaaattcctatcattattgtgtttcgggcattgggatttgttgctgacaaggatattctagaacatatatgctatgatttctcggatactcaaatgatggagttgcttcgtccttccctggaagaagcatttgtaatacaaaatcaacaggttgcacttgattacattgggaaaagaggagcaactgtaggtgtaaccaaggaaaagagaattaagtatgctaaggatatccttcaaagggagatgcttccacatgttggtgttggagagtattgcgagaccaaaaaagcatactattttggatatatcattcatcggctacttctatgtgcacttgggcggagggccgaagatgatagggatcattacggaaacaagaggctggacctggccggtcctttacttggtggtctctttagaatgctattcagaaagcttactagagatgtcaggggttatgtacagaagtgtgttgataatgggaaggatgttaacctgcaatttgctatcaaagctaaaaccatcacaagtggacttaaatactcacttgctactggtaactgggggcaagcaaatgccgcgggtactagagctggagtgtcacaagtgctaaatcgtttaacttatgcgtccactttatctcacttgcgaagattgaattctcccataggacgtgaagggaagttggccaaaccaaggcagttgcataattcacaatggggaatgatgtgtcccgcagaaacacctgaaggacaagcctgtggactggtgaagaatctggccttgatggtttacataacagttggctcagcagcttatcctattctggagtttttagaagaatggggtacagaaaattttgaggaaatttctcctgcggtgattccccaagctacaaaaattttcgtaaatggttgctggatgggtattcatcgtgaccctgatatgttggttagaactttgagaaagctgagacgtcgggttgatgttaatactgaagttggcgttgttagagatatccgtcttaaagaactgcgcatatatacagattatggtcgctgcagtcgtcctttattcattgtggataaacaaaggcttctcataaagaaaaaggacattcattctttgcaacaaagggaatctcctgaagagggtggatggcatgatcttgtgtccaagggttttatagaatatatcgacacagaagaggaagagactactatgatttccatgacaattaatgatcttgtacaagcaaggctcaatccagaagaagcatattctgatacttacactcactgtgaaatccatccatcactgattttgggtgtatgtgcttccatcataccatttcctgaccacaatcagtcccctcgtaatacatatcaatctgcaatgggaaaacaagcaatgggaatctatgttaccaactaccagtttcgaatggataccttggcctatgtgttgtattatcctcaaaagccactggtcactacaagagccatggagcatcttcatttccgtcaactccctgctggaattaatgccattgtggccatttcatgttattctggttacaatcaagaagattctgtcatcatgaaccaatcatcaatagaccgtggcttctttcggtcactgtttttccgctcatatagagatgaagagaagaaaatgggaacccttgtcaaagaagattttggtcggccggatagagctaatactatgggtatgagacatggttcttatgataagttggacgatgatggtcttgctccacctggcacaagagtgtctggtgaggatgttattattggaaagaccactcctttatctcaggaggaggcacaaggacaagctgctcgttactcaaaacgtgatcacagcataagcttacgtcacagtgaaactggaattgttgatcaagttctgttgacaacaaatgctgatggattgagattcgtgaaagtaagggtgagatctgttcgaataccacagattggtgacaaattcagtagtaggcatggtcagaaggggacagttggtatgacttatacacaagaagacatgccctggactgtggaaggcatcactcctgatattattgtcaatccacatgctattccttcccgaatgactattggtcagcttattgagtgtatcatggggaaggtagcagcccacatgggaaaagaaggagatgcgactccttttacagatgttactgtggataatatcagcaaagctttacacaaatgtgggtaccaaatgcgtggttttgagacaatgtacaatggtcatacagggaggcgtctcagtgcaatgattttccttggtcctacttactaccaaaggttgaagcatatggttgatgacaagatccattctcgtggacgaggtcctgttcagattcttacaaggcaacctgctgaggggcgttcacgagatggaggtcttcgatttggagagatggaacgtgattgcatgatagcccatggagctgctcatttcctaaaggaaagattgtttgatcaaagtgatgcatatagggtccatgtgtgcgaacactgtgggttgatagctattgcaaatctgaagaagaattcttttgagtgtaggggctgcaagaacaaaactgacattgttcaggtttacattccttatgcttgtaagctgctcttccaagagctgatggctatggcaatagcaccaagaatgcttactaaagagatcaaatctataaaagatcaaaagaagaaaggagcatgataagtaaaactttgagaaaaactgccagtcttattctatgccgacttcgtctcgtgaacatcgatcgcgcacggtatctgaagatgtatgaatttgattttatttattttctcatgaccgataaatgagaccaggagcttttcaagtgttgggaaatggtggtttatataggtgagtaggttggatgacattctttttatatgtcaaatattgttccttactaattctacttcacgaaattcacctgaaacaaatctgtaccaaatagctccatgaatacgtcttgttgcttcctatagcatttggcaatgtaattacaaggaaggttctttacaacaaaatgtatctattgaaaagtttagcaggactctaaactttaagctcgtcattctaaagatttactttacatgtcttctgtatcctcctctaataagagtacaatttttaaaaaatacaaagccttttgtttcctctctatacaagtgcttttttgatgaagggcagcgtgtagtttgtttttctttttggttgttcagctatgtttgcattatctgtgcaactgttatgttcattaatccttcaatgattaattatgtttgcattatcttatcttttt

SEQ ID NO: 1664 - DNA, 4480 bp, Glycine max
cttttgaagtgtttttctctctcaaaatcccaacacgcacaacaaaacaacacaaaattcaattcaaaaccttaattcaaacctaattaacgtaacgtaaacctctctcgagcgagtctctcgaagaagccatggatttggaagaggagcaggagtacgacgagcaaatgatggaggaagacgacgacgaggaagagatcacacaggaagacgcgtgggccgttatctccgcgtacttcgaagagaagggcctcgttcgccagcaactcgattccttcgacgagttcatccaaaacaccatgcaggaaatcgtcgacgagtccgcggacatcgaaattcgacccgagtcgcagcacaatcccggtcaccaatccgatttcgccgaaaccatttacaaaatcagcttcggtcagatttacttgagtaagcctatgatgacggaatctgatggtgaaaccgccacgttgttccccaaggctgctaggttaaggaaccttacttattctgctcctttgtatgttgatgtctccaaaagggtcgtcaagaaggggcacgacggggaagaggtcaccgagactcaggatttaaccaaagttttcattggcaaggttcctataatgcttcggtctagttattgcacgttgtaccagaattcggagaaggatttgactgagcttggggagtgtccttatgatcaaggcgggtatttcattattaatgggagtgagaaggttctgattgctcaggagaagatgagcaccaaccatgtctatgtgttcaagaagaggcagcccaacaagtacgcctatgtggccgaagttcggtccatggcagagtcacagaacagacctcctagtactatgttcgtgcgcatgctctctcggactagctccaaagggggttcttcaggacaatatatacgtgccactcttccttacattcgaactgaaattcccatcattattgtgtttcgagcattgggttttgttgccgataaagatattctagagcatatatgttatgacttctcagatactctaatgatggagctgctacgtccttccctggaagaagcgtttgtaattcaaaatcaacaggttgcacttgactacattgggaaaagaggagcaactgtaggtgtaaccaaggaaaagagaattaagtatgctaaggagatccttcaaaaggagatgctccctcatgttggcgttggagaatattgtgagaccaagaaagcctactattttggatatatcattcatcggctactgctgtgtgcacttgggcggagggctgaggatgatagggatcattatggaaacaagaggctggatctggctggtcctttacttggtggtctttttagaatgctattcagaaagctaacgagagatgtcaggggatatgtacagaagtgtgttgataatgggaaagatgttaatctgcaatttgctatcaaagcaaaaaccatcacaagtggacttaaatactcacttgccactggtaattgggggcaagcaaatgctgcagggactagagctggtgtgtcacaggtgctgaatcgtttaacttatgcatccactttatctcacttgcgaagattgaattccccaataggtcgtgaagggaagttggccaaaccaagacagctgcataattcacaatggggaatgatgtgtccagcagaaacacctgaaggacaagcctgtggactggtgaagaatctggcattgatggtctacataacagttggttcagcagcatatcctattctggagtttttggaagaatggggcacagaaaatttcgaggaaatctctcctgcagtaattccccaagccacaaaaatttttgtaaatggttgctggatggggatccatcgtgaccctgatatgttggtgagaacattgagaaagctgagacgtcgggttgatgtgaacactgaagttggggttgtcagagatatcattcttaaagaattgcgtatatatacagattatggtcgttgcagtcgtcctttattcatcgtggataagcaaaggcttctcataaagaagaaggatattcatgccttacaacagagggaatcccccgaagatggcggatggcatgatctagtgtccaagggctttatagaatatattgacacggaagaagaagagactacaatgatttccatgaccattaatgatcttgtacaagctaggatcaatccagaagatgcgtatgctggtacttacactcattgtgaaatccacccatcactgattttgggtgtatgtgcttccatcataccatttcctgatcacaatcagtccccacgtaatacttatcagtccgcaatgggaaagcaagcaatgggaatatatgttaccaactaccagtttcgaatggataccttggcctatgttttatattatccacaaaagccactggtcactacaagagccatggagcatcttcatttccgtcaactcccagctggaattaatgccattgtagccattgcctgttactctggttataatcaagaagattccgtcatcatgaaccaatcgtcaatagaccgtggattctttcggtctctgtttttccgttcatatagagatgaagagaagaagatgggaaccctggtcaaagaagattttggccgtcctgatagagctaacaccatgggaatgagacatggttcttatgataagctggatgatgatggtcttgccccaccaggcacacgagtatctggtgaggatgttatcattggaaagaccaccccaatatctcaggaggaggcacagggacaagctttacgttacacaaggcgtgatcacagcataagcttacgtcacagtgaaactggaattgttgatcaagttttgctgaccacaaatgctgatggattgagatttgtgaaagtaagagtgagatctgttcgtataccacagattggtgataaattcagtagtagacatggtcagaaggggacagttggtatgacttatacacaagaagacatgccctggactgtggaaggcattacccctgatattattgtcaatccacatgctattccttctcgaatgacaattggtcagcttattgagtgtatcatggggaaggtggcagcccacatgggaaaagaaggagatgcaactccttttacagatgttactgtggacaatatcagtaaagctctacacaaatgtgggtaccaaatgcgtggttttgagactatgtacaatggtcatacagggagacgtctaagtgcaatgattttccttggccctacatattaccaaagactgaagcatatggttgacgacaagatccattctcgtggaaggggtcctgtgcagatcctcactaggcaacctgctgagggacgctcacgagatggaggtctccgatttggagagatggaacgagattgcatgatagctcatggagctgctcacttcttaaaggaaaggttgtttgatcaaagtgatgcatacagggtccatgtatgtgagcgttgtgggttgatagctattgcaaatctcaagaagaattcttttgagtgcaggggatgcaagaacaaaactgacattgttcaggtttacattccttatgcttgtaagctcctcttccaagagttaatggctatggcaatagctccaagaatgcttacaaaggaggtcaaaactacaaaccaaaagaagaagggagcctgataaacatgtttgaccaaagccacttgtcttatattctgattaaaagctctcgagaatatggaacaaacatggtatctaaatatacaaatttgatttgataatgtttttcaagtctcaaattacaggaacctttcaagtgttgggtaattcacaagcaaaaatagctttgataccttcattattgatgtttcccgctgcgttttctctattcaagggtgctcattccaagcgactaatgttaccgaccgagcattgtatatataatggaagtttttcaattccgagagcttgtttcttattcactaagcagagatgggttagcagaagtttctgtcgcgtaattctagtgagccccgtcttaaatgctgtgaaaggtcttatacccaatcaaccgagaattccagctccaattttggaaatccttttgttggtttagggggaggtcacccgaattggattatttaaatttagttgcaatgcttgagagctatggtatatggtacttgtaactcgagactctggcaattttaagttcaattcttgtacaatatagtgaaatgagagaatttatttgacaaagttgatttgtgagttttccatttaccatcgaatccggttccatatcaacaacatttttgtttttgtacgaagtttagttataaaccatgtcaacagtttggtttcgtaccaatagcagcagtcagcatatgctcttcattgacttcgttatctcaatggcaatcctggctaaggagttttcatttgtg

SEQ ID NO: 1665 - DNA, 4604 bp, Glycine max
agtccattggccgctcctctcgcctatatatagcactccctccccacaccacatctcatttttccgacacaattatttgggtactcctccctgctagggtttcactcttagcacagtcacacttttgaagtgtttttctctctcaaaatcccaacacgcacaacaaaacaacacaaaattcaattcaaaaccttaattcaaacctaattaacgtaacgtaaacctctctcgagcgagtctctcgaagaagccatggatttggaagaggagcaggagtacgacgagcaaatgatggaggaagacgacgacgaggaagagatcacacaggaagacgcgtgggccgttatctccgcgtacttcgaagagaagggcctcgttcgccagcaactcgattccttcgacgagttcatccaaaacaccatgcaggaaatcgtcgacgagtccgcggacatcgaaattcgacccgagtcgcagcacaatcccggtcaccaatccgatttcgccgaaaccatttacaaaatcagcttcggtcagatttacttgagtaagcctatgatgacggaatctgatggtgaaaccgccacgttgttccccaaggctgctaggttaaggaaccttacttattctgctcctttgtatgttgatgtctccaaaagggtcgtcaagaaggggcacgacggggaagaggtcaccgagactcaggatttaaccaaagttttcattggcaaggttcctataatgcttcggtctagttattgcacgttgtaccagaattcggagaaggatttgactgagcttggggagtgtccttatgatcaaggcgggtatttcattattaatgggagtgagaaggttctgattgctcaggagaagatgagcaccaaccatgtctatgtgttcaagaagaggcagcccaacaagtacgcctatgtggccgaagttcggtccatggcagagtcacagaacagacctcctagtactatgttcgtgcgcatgctctctcggactagctccaaagggggttcttcaggacaatatatacgtgccactcttccttacattcgaactgaaattcccatcattattgtgtttcgagcattgggttttgttgccgataaagatattctagagcatatatgttatgacttctcagatactctaatgatggagctgctacgtccttccctggaagaagcgtttgtaattcaaaatcaacaggttgcacttgactacattgggaaaagaggagcaactgtaggtgtaaccaaggaaaagagaattaagtatgctaaggagatccttcaaaaggagatgctccctcatgttggcgttggagaatattgtgagaccaagaaagcctactattttggatatatcattcatcggctactgctgtgtgcacttgggcggagggctgaggatgatagggatcattatggaaacaagaggctggatctggctggtcctttacttggtggtctttttagaatgctattcagaaagctaacgagagatgtcaggggatatgtacagaagtgtgttgataatgggaaagatgttaatctgcaatttgctatcaaagcaaaaaccatcacaagtggacttaaatactcacttgccactggtaattgggggcaagcaaatgctgcagggactagagctggtgtgtcacaggtgctgaatcgtttaacttatgcatccactttatctcacttgcgaagattgaattccccaataggtcgtgaagggaagttggccaaaccaagacagctgcataattcacaatggggaatgatgtgtccagcagaaacacctgaaggacaagcctgtggactggtgaagaatctggcattgatggtctacataacagttggttcagcagcatatcctattctggagtttttggaagaatggggcacagaaaatttcgaggaaatctctcctgcagtaattccccaagccacaaaaatttttgtaaatggttgctggatggggatccatcgtgaccctgatatgttggtgagaacattgagaaagctgagacgtcgggttgatgtgaacactgaagttggggttgtcagagatatcattcttaaagaattgcgtatatatacagattatggtcgttgcagtcgtcctttattcatcgtggataagcaaaggcttctcataaagaagaaggatattcatgccttacaacagagggaatcccccgaagatggcggatggcatgatctagtgtccaagggctttatagaatatattgacacggaagaagaagagactacaatgatttccatgaccattaatgatcttgtacaagctaggatcaatccagaagatgcgtatgctggtacttacactcattgtgaaatccacccatcactgattttgggtgtatgtgcttccatcataccatttcctgatcacaatcagtccccacgtaatacttatcagtccgcaatgggaaagcaagcaatgggaatatatgttaccaactaccagtttcgaatggataccttggcctatgttttatattatccacaaaagccactggtcactacaagagccatggagcatcttcatttccgtcaactcccagctggaattaatgccattgtagccattgcctgttactctggttataatcaagaagattccgtcatcatgaaccaatcgtcaatagaccgtggattctttcggtctctgtttttccgttcatatagagatgaagagaagaagatgggaaccctggtcaaagaagattttggccgtcctgatagagctaacaccatgggaatgagacatggttcttatgataagctggatgatgatggtcttgccccaccaggcacacgagtatctggtgaggatgttatcattggaaagaccaccccaatatctcaggaggaggcacagggacaagctttacgttacacaaggcgtgatcacagcataagcttacgtcacagtgaaactggaattgttgatcaagttttgctgaccacaaatgctgatggattgagatttgtgaaagtaagagtgagatctgttcgtataccacagattggtgataaattcagtagtagacatggtcagaaggggacagttggtatgacttatacacaagaagacatgccctggactgtggaaggcattacccctgatattattgtcaatccacatgctattccttctcgaatgacaattggtcagcttattgagtgtatcatggggaaggtggcagcccacatgggaaaagaaggagatgcaactccttttacagatgttactgtggacaatatcagtaaagctctacacaaatgtgggtaccaaatgcgtggttttgagactatgtacaatggtcatacagggagacgtctaagtgcaatgattttccttggccctacatattaccaaagactgaagcatatggttgacgacaagatccattctcgtggaaggggtcctgtgcagatcctcactaggcaacctgctgagggacgctcacgagatggaggtctccgatttggagagatggaacgagattgcatgatagctcatggagctgctcacttcttaaaggaaaggttgtttgatcaaagtgatgcatacagggtccatgtatgtgagcgttgtgggttgatagctattgcaaatctcaagaagaattcttttgagtgcaggggatgcaagaacaaaactgacattgttcaggtttacattccttatgcttgtaagctcctcttccaagagttaatggctatggcaatagctccaagaatgcttacaaaggaggtcaaaactacaaaccaaaagaagaagggagcctgataaacatgtttgaccaaagccacttgtcttatattctgattaaaagctctcgagaatatggaacaaacatggtatctaaatatacaaatttgatttgataatgtttttcaagtctcaaattacaggaacctttcaagtgttgggtaattcacaagcaaaaatagctttgataccttcattattgatgtttcccgctgcgttttctctattcaagggtgctcattccaagcgactaatgttaccgaccgagcattgtatatataatggaagtttttcaattccgagagcttgtttcttattcactaagcagagatgggttagcagaagtttctgtcgcgtaattctagtgagccccgtcttaaatgctgtgaaaggtcttatacccaatcaaccgagaattccagctccaattttggaaatccttttgttggtttagggggaggtcacccgaattggattatttaaatttagttgcaatgcttgagagctatggtatatggtacttgtaactcgagactctggcaattttaagttcaattcttgtacaatatagtgaaatgagagaatttatttgacaaagttgatttgtgagttttccatttaccatcgaatccggttccatatcaacaacatttttgtttttgtacgaagtttagttataaaccatgtcaacagtttggtttcgtaccaatagcagcagtcagcatatgctcttcattgacttcgttatctcaatggcaatcctggctaaggagttttcatttgtgcca

SEQ ID NO: 1666 - DNA, 3779 bp, Solanum lycopersicum
ttcttgcctctctcttcttctcttcttctccatttggagacagagaaataatcagttgaaccagtatttatcttactaaaactaagcagacaggatctgggttccgattatcttggaatcttgaatccatttgaactgttaaaaacaagaaaaaggattcaattttgaactgaaaaagggagaaagaattgttgaatcaggatggatatggaggatgaatatgaaccccaatacaatgttgacgatgatgaagaggagataacccaagaagatgcttgggctgtgattagtgcttactttgaggagaagggtcttgttcgtcaacaactagattcgtttgatgagttcattcagaataccatgcaagaaatcgttgatgaatctgctgatatagagatccgtcctgagtcccagcataaccctggtcaccaatctgactttgctgagactatctacaaaatcaattttggtcagatttatttgagtaagccaatgatgacagagtcagatggtgaaactgctaccttatttccaaaggctgcgaggttgaggaatctgacatattctgctcctttgtacgttgatgtcacgaaaagagtcattaagaaagggcatgatggtgaagaggttactgaaactcaggacttcacaaaagtcttcattggaaaggttcctataatgctgcgttcaagttactgcacattatatcaaaattctgagaaagatctaacagagcttggagaatgtccattagatcaaggcggttatttcattataaatggaagtgaaaaggtcttaattgctcaggagaagatgagcacgaaccacgtgtacgtctttaagaagaggcaacctaacaaatatgccttcgttgcggaagtcaggtcaatggcagacactcaaaatcgcccaccaagtactatgttcgtgaggatgctctcaaggactagtgcaaaagggggttcctcgggccaatacattcgggcaacacttccgtatatccgtacagagattcctattattatcgtgtttcgagctctaggttttgttgctgataaggatatattggaacatatttgttatgatttcaatgatactcaaatgatggagttgttacgtccgtcgttggaagaagcttttgttattcaaaaccaacaggttgctctcgactacatcggaaaaagaggggctacagttggtgttacaagggaaaagaggattaagtacgccaaagagattcttcagaaagaaatgcttcctcatgttggggttggagagtattgtgaaacaaagaaggcttattattttgggtatatcatccaccggcttctgttatgtgcgcttggccgcagggctgaggatgatagggatcattacggaaataagagactggatcttgccggtcctttgcttggtgggctgtttcggatgctctttagaaagttgacaagggatgttagaggctatgtgcaaaagtgtgttgacaatggaaaagatgtaaatctccaatttgcaatcaaagctaagaccattactagtgggctgaaatactctcttgctactggaaactgggggcaagctaatgcagctggtacaagagctggtgtttcgcaggtgctgaatcgtctgacttatgcctctactttgtctcacttgcgacggttgaattcccctattggacgagaagggaaactggccaaaccaaggcaattgcataattcacaatggggaatgatgtgtcctgcagaaacaccagagggtcaagcatgtgggctggtgaagaatctagctttaatggtttatataacagttggttcagcggcatatccaattttggagttcttggaagagtggggtactgagaactttgaggaaatttctcctgctgttattccacaggctacaaagatctttgtcaatggtacctgggtgggaattcatcgtgatcctgacatgttggtgagaacattgagacgactcaggaggcgggttgacgtcaatactgaagttggggtggtccgtgatatccgtttgaaagaacttcgaatttataccgactatggcaggtgcagtcgtccattgtttattgtggaaaagcaaaggctgatgatcaagaagaaggatattcagacactgcaacaacgggaatcacctgacgagggtggctggcacgacctcgtggctaagggatacatcgagtatattgacactgaagaggaagaaacaacgatgattagcatgactataaatgatcttgtgcaagcgcgccttaatcctggcgacgcttattctgatacctatactcattgcgaaattcacccatcactaatattgggtgtctgtgcgtcaattattccgtttcctgatcataatcagtctccccgtaatacttatcagtcagctatgggtaagcaagccatgggaatttatgtcaccaactaccaatttcggatggacacgttggcctatgtgctttattatcctcagaagcctcttgtcacaacacgagccatggaacacttgcattttaggcaactacctgcggggatcaatgcaattgtcgccatctcctgctattctggatacaatcaagaggattctgtcattatgaaccagtcatctattgatcgtggatttttccgatctctatttttccgttcgtacagggatgaggagaaaaagatggggacattggtcaaggaggattttggacgtcctgatagagcatctactatgggtatgcgccatggttcgtacgataagttggatgacgatggtcttgcccctccaggaactagagtttctggtgaggatgttatcattgggaagaccactcccatttctcaggatgatgcacaagggcaagcctctcgctatacgaggaaagatcacagtactagtctccgccatagtgaaactggaatggtggatcaggttctattaacaacgaatgctgacgggctcagatttgttaaagtgagggtcagatcagtccgtattcctcaaattggtgacaagtttagcagtagacatggtcagaagggaacagttggtatgacatatacacaagaagatatgccatggaccgtggaaggcattactcctgatattattgtaaatcctcatgctattccttctcgaatgactattggtcagctgattgaatgtattatggggaaggttgccgcacacatgggaaaagaaggtgatgccactccctttacggatgttactgtggataacatcagtaaagctctgcataaatgtggttaccagatgcgtggttttgagaccatgtacaatggtcatactgggcggcggcttagtgcaatgatattccttggtcccacatactaccagcggctgaagcatatggttgatgacaagattcattctagaggcagaggccctgtgcaaatcctcacaaggcagcctgcggaaggtcggtcacgtgatggtggtcttcgttttggagagatggagcgagattgtatgattgctcatggtgctgctcattttctcaaggagcggttatttgaccaaagcgatgcgtacagagttcacgtttgtgagcgctgtgggctgatagccattgccaacctcaagaagaattcttttgaatgcagaggttgcaagaacaaaactgatatcgtccaggttcacattccctatgcatgcaaactgcttttccaggagctaatggctatggctatagctccaagaatgcttacaaaggatgtcaagctagccaaagatcaaaagaagaaaggagcttgatt

SEQ ID NO: 1667 - DNA, 4607 bp, Antirrhinum majus
  misc_feature (31)..(31): n is a, c, g, or t
  misc_feature (219)..(219): n is a, c, g, or t
  misc_feature (426)..(426): n is a, c, g, or t
  misc_feature (604)..(604): n is a, c, g, or t
  misc_feature (682)..(682): n is a, c, g, or t
  misc_feature (1884)..(1884): n is a, c, g, or t
  misc_feature (2036)..(2036): n is a, c, g, or t
caggtagcttttgagaaaaataaagaaaagnctagcgttcacacttcacagcagacaagaaatgtgactagaataaaaaacaaaaatacaattggaaggataaaaaaatgaatcaaaagacttgttccaagtaaagagtatattatattgtctaaaaaaaaaaagtaaagagtatattatagcaatattttgatgttttgttactattttaattttgcnatagatatacaaattcgatgcattaaggaccatactatgatctttttaaccacaaaaacgtgtaagagagatgaaataaatatttacatttctaaaagatagcactttaaccgcctcattcattctctttgcactcatcaagggttcaattcaacacacacacacacacacacacactataaaacggccactcgctctcatttcttntgttcttcctcctcctcctcggacagtaagtaagacacaagtccccccctgtatctaaaattgacttcaattgaaccctaaggaatcgaatttcaatacataaaccctaaaatcagtaatggatttggaggaagagtactacgaacaagagtacaacaacgaagcggaaaacgagaangatgaagaagaagaagaagaggacatatcgcaggaggacgcttgggctgtaatcagcgcttatttcgaggagaaaggnttggttcgtcagcagctcgactcgttcgacgagttcatacagaacactatgcaggagattgtcgacgagtcggccgacatcgagatccggcccgaatcgcagcacaacccgggccaacagcccgactttgctgagactatctacaagatcagttttggtcagatatacctcagtaaacccatgatgacagagtcagatggagaaactgctactttgtttcctaaagctgcaaggttgaggaatttgacgtactcagctccattgtacgtggatgtcagcaagagagtcatcaagaaaggtcacgacggtgaggaagttaccgagactcaggatttcactaaagtcttcattgggaaggttcctataatgcttcgctcgagttattgtacactataccagaactctgagaaagatttaacagagctgggagagtgtccattggaccagggtggttatttcatcatcaacggaagtgaaaaggtgttaattgctcaagaaaagatgagcaccaatcatgtctatgtatttaaaaaaaggcaaccgaacaagtatgcctatgtagcagaagtccgctccatggcggaggcccagaacaggccacctagtacaatgtttgtccgtatgctttcgaggactagtgccaaggggggttcatctggtcaatatatacgtgccaccctcccatatattcgcacagagattcctatcattattgtgtttcgagcgttaggatttgttgcggacaaggatatattagagcatatctgcttcaattcttccgatactcaaatgatggagctgctgcggccctccttggaagaagcgttcgttatccagaatcaacaggttgctctggactacatagggaagagaggatctactgttggtgtcaccaaggagaaaagaattaagtatgcaaaagagattcttcagaaagaaatgcttcctcatgtcggtgttggagaatattgcgagacaaagaaagcttattattttgggtatattatccaccggcttctgctatgtgcccttggccgaagggcagaggacgacagagatcactatggcaataagagactggatcttgctggtcctctgcttggtggcttatttcgcatgctcttcaggaagttgaccagagatgtgagatcttatgtccagaagtgtgtggataacggaaaagatgtaaatctgcaatttgnaataaaagccaaaaccattacaagtggcctgaagtactcacttgccactggcaactggggccaagctaatgcggcgggtacaagggctggagtttcccaggtgttaaatcgcctgacttatgcttctactttgtcacacttgcgaagactcnattcccccatagggcgtgaaggaaaattggctaaaccaaggcagttgcacaactcacagtggggaatgatgtgtcctgcagaaacacctgaaggacaggcatgtgggcttgtaaagaaccttgcgttgatggtttatataacagtcggttccgcagcatatccaattttggaatttttggaagaatggggtaccgagaattttgaggaaatttctcctgctgtgattcctcaagcaacaaaaatctttgtgaatggtttgtgggttggtattcatcgtaaccctgatatgttggtgtcaactttgaggcgtctgagaagacgtgtcgacgtgaatactgaggttggggtggttcgagatattcgtttgaaagaacttcggatatatactgattatgggcgttgcagtcgtccattgtttattgtggaaaaacagaggctgctcattaaaaagaaggatgttcaagccttgcaacaaagagaatctcctgatgatggtggctggcatgagcttgttgcaaaaggatttatagaatatatcgacactgaagaagaagaaacaactatgatttccatgacaataaacgatcttctaagtgcgaaagtaaatccaactgaggcttattcagatacttatactcactgtgaaatccacccatcgctaattcttggtgtttgtgcttcaattattccctttccggatcataaccagtctccacgtaacacataccagtcagccatgggtaaacaagccatgggtatttatgtcaccaactaccaatttcgaatggacaccttggcttatgtgttgtactaccctcaaaagcctctcgttaccactcgagccatggagcatttgcattttaggcaactacctgctggcattaatgccattgttgccattgcctgctactctgggtataatcaagaagattccgtcattatgaatcagtcatcaattgaccgcgggttcttccgatctttatttttccgttcatatagagacgaggagaagaaaatggggactcttgtcaaagaggattttggacgtccagatagaagtaacactatgggcatgcgtcacggttcctatgataagttagatgacgatgggcttgcccctccgggaactagatgttctggtgaggacgtgattattgggaaaaccactcccatatctcccgatgatgcccaagggcaagctgctcgctacacaaagcgtgatcacagtacaagcttacgccatagtgaaactggaatggtggatcaagtccttctgacaacaaatgctgatgggttgcgatttgttaaggtaagggtgagatctgttcgaatacctcaaattggagacaagttcagtagtagacatggtcagaagggaacagtaggcatgacttatactcaagaagacatgccatggaccgtggaaggcatctctccggacattatcgtaaacccacatgctattccttctcgtatgactattggtcagcttatcgagtgcatcatgggtaaagttgcagcacatatgggtaaggaaggagacgctacgccttttactgatgtcacagtggataatatcagcaaagcccttcataaatgtggctaccaaatgcgtggctttgagaccatgtacaatggccatactggaaggagactgtcgtccatgattttcctcggtcctacttactaccagagactgaagcatatggttgacgacaaaattcattctcgtggtagaggccctgtgcagatcctcacaaggcagcctgctgaaggacggtctcgtgatggtggtcttcgatttggtgaaatggaacgggattgcatgattgcgcatggtgccgctcactttctaaaggaaaggctgttcgaccaaagtgatgcctacaggatccatgtctgcgagcagtgtggattgatagccattgctaacctgaaaaagaattctttcgagtgcagaggatgcaaaaacaagactgacattgttcaggttcacattccctatgcttgcaagctacttttccaagagctaatgtctatggctatagctccaagaatgctcactaaagatatcaagcaatccaaagagcagagaaagaaagcagcttgatgtgctcgcggggcttccgtggagcggtcagcagatgctagtgtccttgtcgctgtcatcatattaaaccagggaagcctgagtttttgtaaagctaatgacgggagaatcgacattttctgctacttgaggtctagtaaggaagattgagaaagaagacaggagtggtcgacttgggaccaattaggagaacaattgagtcttagatactgtgggatttgtttctttagagaaacctttactttgagagtgcaaactacgtacatattttttcggatgcactgatatttcctgaaagtgtttactgggatacacaatgttgtttgtatacctattcttgcatgttcgagcacaaattctgaatcagtcgaacatattactgatcatgtaaaatggaaacaactgaaaattgtcaggctcctgtctcttgcttgtgatataaattagagtcatgtcttgg

SEQ ID NO: 1668 - DNA, 4254 bp, Theobroma cacao
tacctcaaaacatttcaaatgcataaggatccgacccgatccgtccgatttactcgtatccgacagtctggttaaccgccttctcttaaaaccggccttcacataaaatgaccaagaaaagttttatttctttcggaacaccattcactcacccttgtcccactctcacctagggttttactcgaaattttccctccacataaaagcaagacgaacagcgccaaaccaaagaaaaaccgtagctatggaggacgacagtgagtacgatccgcaacttatggacgacgaagacgacgaggagatcacgcaggaagacgcgtgggcggttatctcagcttacttcgaagaaaaaggtctggtgcgtcaacagctcgactcgttcgatgaatttatccaaaacactatgcaagaaatcgtcgacgaatcggccgatattgagatcaggccagagtcacagcacaatcctggtcaccagtccgactttgctgagactatctataagattagctttggtcagatctaccttagtaaacctatgatgaccgagtcagatggtgaaactgcaactttatttccaaaagctgcaaggttgaggaatcttacttactcagctccattgtatgtcgatgtaactaagagagttataaagaaagggcatgatggtgaagaagtcactgagactcaggattttactaaagtgttcattgggaaggttcctataatgctccggtcaagttattgcacactatatcaaaattcagagaaggatctgaccgagcttggggagtgtccatatgatcaaggtgggtatttcattatcaatgggagtgaaaaggttctaattgctcaggagaagatgagcacaaatcatgtctatgtcttcaaaaagaggcagccgaacaaatatgcctatgtggcagaagttcggtccatggcagagtcccagaataggccaccaagtaccatgtttgtgcggatgctttctcggactagtgccaaagggggctcttcggggcagtacattcgtgctactcttccatatattcggactgaaattcctatcataattgtctttcgggctttgggatttgttgctgacaaggacatattagagcatatatgctatgacttctccgacacccagatgatggagttgcttaggccttccttagaagaagcatttgtgattcaaaaccagcaggttgcactagattatattggtaaaagaggagcaactgttggtgttaccagagaaaagaggattaagtatgctaaagagatcctccaaaaagaaatgcttcctcacgtaggtgttggagatttttgcgagacaaagaaagcttattattttggatatattattcaccggctgcttctttgtgcacttggccggagggcggaagatgatagagatcattatggcaacaagaggttggaccttgctggtccattacttggaggcctctttagaatgctttttcggaagttaactagggatgtgagatcttatgtgcagaagtgtgttgataacgggaaggatgtgaacctgcaatttgctatcaaagcgaaaactattacaagtggtcttaaatactcacttgctactggaaattgggggcaagcaaatgcagctggtactagagctggagtgtcacaggtgttaaaccgtttgacatatgcctcaactttgtcacacttgcgaaggctcaattctcctataggacgtgaagggaaattggctaaaccacgtcagttgcataattcacagtggggaatgatgtgtccagcggaaacaccagaaggacaggcctgtggacttgtaaagaatcttgccttgatggtatacataactgtcggatcagctgcatatcctattcttgaatttttggaagagtggggtacggagaattttgaggaaatctcacctgcagttatccctcaagctacaaaaatttttgtcaatggttgctgggttggtgtacatcggaatcctgatatgcttgtgacaacattgagacggttgagaagacgggttgatgtcaacactgaagttggtgttgttagagatatccgtctaaaagaacttcgaatatatactgactatggtcgttgcagtcgaccattgttcatcgtggagaaacaaagacttctcataaagaagaaagatattcatgcactgcaacaaagagaaagcccagaagacggtggctggcatgatcttgtagcaaagggatttatagaatacattgacacggaagaagaggagacaacaatgatttccatgaccatcaatgatcttgtacaagcgagagtcaatccagaggaagcttattctgaaacttatacccattgtgagatccacccttcattgattttgggtgtttgtgcttcaattataccatttcctgatcataatcagtccccgcgtaatacctatcaatctgctatgggtaagcaagcaatgggaatatatgttaccaactaccaatttcgaatggatacattggcctatgttctctactatccccaaaagccacttgttactacacgagctatggaacatctccactttcggcagcttccagctggcattaatgctattgttgctatcgcctgctattctggatataaccaagaagattctgttattatgaatcaatcatcaatagaccgtggattcttccgatcacttttcttccgctcttaccgagatgaggagaaaaaaatggggacccttgttaaagaagattttggtcgaccagatagggctaatactatgggaatgaggcatggctcttatgataaattggatgatgatggtcttgcacctcctggaacaagagtttcaggtgaggatgtaatcatcggaaagaccacccccatttctcaggaagaagctcagggacaagcatcacgctattcaagacgtgatcatagcataagcttacgtcacagtgaaacaggcatagtggaccaagttctattgacaactaatgctgatgggttgagatttgtgaaagtaagggtaagatctgttcgcattccccagattggggacaagtttagcagtaggcatggtcaaaaggggacagtgggcatgacttacacgcaggaagacatgccttggactgtggaaggcatcacacctgatatcattgtgaacccacatgctattccttctcgaatgacaattggtcagcttattgaatgtatcatggggaaagttgcagctcacatgggcaaggaaggggatgccactccttttacagatgtcaccgtggacaatatcagcagagctcttcataaatgtggatatcaaatgcgtggttttgagaccatgtataatgggcacacaggcaggcgcctttctgctatgatatttttggggcccacatattaccaaagactaaagcacatggttgatgataagatccattctcgtggtcggggccctgtgcagatcctcacaaggcagcctgcagagggacgatcccgtgatggtggtctccgtttcggagagatggaaagagattgcatgattgcgcatggtgctgctcatttccttaaagagaggttgtttgaccaaagtgatgcatacagggtccatgtgtgcgagcgttgtgggttgattgctattgcaaatctaaagaagaactcatttgagtgcagaggatgcaagaataaaactgatattgttcaggcaatccttctcgtatacattccttacgcctgtaagctgctcttccaagagcttatggccatggcaattgctccaagaatgctcacaaaggaacctcccaaagaccaaaagaagaaaggagcctgagatacgtgagcaaatcaagtcctgttttcttcctcttcattttgaaccctgcagagtacaattggtataaaaagagcacaaagatggatattttaaaagccaaattcggctttattaggggctggctaactcttgcctgtgctgagatgcaaagtgaaagcgggagtgagagatggttgtaataaataatctttttccttttcacgtaaccgccagtgaattcatgtgtctatagtggggattgtgtatgaatatgatgttgtatcatctatcagttatgctaacttttgtagccctatccagaatgttaataatagttaggggcttattcattacgatgatttattgctaatcttgaatttttctgtggatatatttaccaaattttggaaaagaaaaggaagatataccactatactttttagtat

SEQ ID NO: 1669 - DNA, 3767 bp, Eutrema parvulum
cgaggccgtctcattcattctctgcgtctgttgttcttcagtgagaggtgataaaaaatggagtataatgagtatgaacaggatcctccttacattgaagaagatgacgacgaggagataacgcaggaggacgcgtgggcagtgatatctgcgtatttcgaagagaaaggtctcgttcgtcagcagctcgattcgttcgatgagtttattcagaatactatgcaagaaatcgttgatgagtcggctgatatcgaaatccgacctgagtcccagcacaatcccgggcaccaatctgatttcgccgagacaatctacaagattagttttggacagatttatctgagtaagcccatgatgacggaatctgatggagagactgccaccttgttcccgaaggctgcaaggttgagaaacctcacgtactcggctcctttgtatgtcgatgttactaagagagttattaagaaagggcatgatggtgaggaagttacggagacacaggattttaccaaagttttcattggaaaggttcccatcatgctccggtctagttactgtaccttgtttcagaactcggagaaagatttgacagagcttggagaatgtccttatgatcagggcggatacttcattatcaatggcagtgaaaaggttctgattgctcaggagaagatgagtacgaaccacgtttatgttttcaagaagcggcagccaaataaatatgcatatgttggtgaagtccgttccatggctgagaaccagaataggcctccaagcacaatgtttgtccgtatgcttgctcgtgctagtgcaaaagggggttcatctggacagtatattcgctgtactctaccatacatcagaacagaaattcctatcatcattgtatttcgtgcgttaggatttgttgccgataaggacatattggaacatatctgctatgattttgccgatactcagatgatggagttgctcaggccttccttggaagaagcttttgtcattcagaatcagcaggttgcacttgactatattggaaaacgtggtgcaactgttggtgtaaccaaggaaaagaggataaagtatgcaaaagatatccttcagaaagaaatgcttcctcatgtaggagttggggagttttgtgagactaagaaagcttactatttcgggtatatcatacaccggctgctgctttgtgcacttggccgaaggccagaagatgatagggatcattatggtaacaaaaggctggatcttgctggtcctttacttggagggctatttagaatgcttttcagaaagctaacaagggatgtgagatcttatgttcagaagtgtgttgacaatggcaaagaagtcaatcttcaatttgccattaaggctaaaacgattacctctggcctgaaatattctcttgctactgggaactggggccaggcaaacgctgctggcacaagagctggagtctctcaggttctaaatcggttaacatatgcttccactttgtcacatcttaggcgtctcaattctcctatagggcgtgaaggaaaattggcaaaaccaagacaactgcacaactcacagtggggaatgatgtgccctgctgaaacacctgaaggacaggcttgtggtctagtgaaaaacttggcgctcatggtctacataacagttgggtcagctgcttatcctatattggaatttttggaagaatggggaactgagaattttgaggaaatctctccatctgttataccccaagctacaaaaatctttgtcaatggaatgtgggttggagttcatcgagatcctgacatgttagtgaaaacgttaagacgtttgaggagaagggttgatgtaaacactgaagttggcgttgttagagatatccgtctaaaagagctccggatatacactgattatggtcgttgtagccgtcccttgttcattgtggataaccagaggctgttaataaagaagagagatatctatgctctgcaacaaagggaaagtgcagaagaagatggttggcatcatctagttgcaaaggggtttatagaatacatagacacagaggaagaggagacgactatgatatccatgactattaatgatctggttcaagctagactcagtcccagcgaggcatattctgaaacttacacacattgtgagattcacccttctttgatattgggcgtatgtgcttcaattataccatttcccgaccacaatcagtcaccccgtaatacatatcaatctgctatgggaaagcaagctatgggaatatatgtcaccaactaccaatttcgcatggatactctagcctatgttctctattaccctcaaaagcctctggttaccacaagagctatggagcatcttcactttaggcaacttccagctggaattaatgctattgttgccatttcttgctattctggatataatcaagaagattctgtcatcatgaatcagtcttcaatagaccgtggcttctttcgatccttgttctttcggtcttacagagatgaggagaaaaaaatggggacgcttgtcaaagaagactttgggcgcccagacagagcaagtacaatgggtatgcgacatggttcttatgagaaactggatgatgatggtcttgcacctcctggtactagagtttcaggtgaagatgttatcattgggaaaaccactccaatatctcaagatgaggctcaaggacaatcatcacgatacactagacgtgatcatagtataagcttgcgacatagtgaaactggaatggtggatcaggtgttattgacgacaaatgcagatggtttgaggtttgtgaaagtgagggttagatccgttcgtattcctcaaattggagacaaatttagtagtagacacggtcagaagggaactgttggtatgacgtacacccaggaggacatgccttggacgattgaaggcgttactcctgatattattgtgaatccgcatgctattccatctcggatgacaattggacagcttattgagtgcatcatgggaaaagtggcagctcacatgggaaaggaaggagatgcgactccttttacagatgtcacggtggataatataagcaaagctctccataaatgtgggtaccaaatgcgtggatttgagagaatgtacaatgggcacacgggcagaccactcacagctatgattttccttggaccaacgtactaccaaaggttgaagcatatggtcgatgacaagattcactcccgtggacgaggtcctgtgcaaatcttaacaagacaaccagctgaggggcgatcccgtgatggtggtctgcgttttggagaaatggaacgtgattgcatgattgcacatggtgctgctaactttttgaaagagaggctgtttgatcagagcgatgcgtatagggtacatgtgtgtgaaacctgtgggctcatcgccattgcaaatctgaagaagaattcttttgaatgcagaggttgcaagaacaaaacagatattgttcaggttcacattccatatgcttgcaaactgctcttccaagagcttatgtcaatggcaattgcgccacggatgcttactaaagacctgaaagggactaaaggcagaaagtgaggagcgttgctctcttgattttggaaacacttgagcttttcttgttctctttgtaacaaaactaaattacaaattcgtgtatcgtttatttgtatttcttctgaaagtagaaactagtgaggtatatgataagattttcaaaa

SEQ ID NO: 1670 - DNA, 3811 bp, Nicotiana benthamiana
ttgccccttttccctcttctcctctcttccccgttgccccttggactcgcccaagtaaaccactctgaaccaaatataactactaacaacactgaaaaaacaaagatcagggcgccaattatcttttgattttgaatcaatccatttgaactgtaaaaaagaaaagaaaaaagaaactcaaatttaattttgttgaatcaatatggatatggaagaagagtacgaacaacaatacagtaatgatgaagatgaagaggaaataacccaagaggatgcttgggctgtcatcagtgcttacttcgaagagaaggggcttgtccgtcaacaactggattcgtttgatgagtttattcagaacactatgcaagaaattgtggatgaatctgctgacattgagatccgacccgaatcccagcataaccctggtcaccaatctgactttgctgagacaatatacaaaatcaactttggtcagatttatttgagtaagccaatgatgacagagtcagatggcgaaactgctaccctgtttccaaaagctgcaaggttgaggaatctgacatactctgcaccactgtatgttgatgttacaaagagagtcatcaagaaagggcatgatggtgaagaagttactgaaactcaggacttcacaaaagtcttcattggaaaggttcctataatgcttcggtcaagttactgcacactatatcaaaattcagagaaagatctaacagagcttggagaatgtccattagatcaaggtgggtacttcattatcaatggaagtgaaaaggtcctaattgctcaggagaagatgagcaccaaccatgtgtatgtatttaagaagaggcaacccaacaagtatgcgttcgttgcggaagtcaggtcaatggcagaatctcaaaaccgcccgccgagtactatgtttgtgcggatgctctcaagaactagcgcaaaagggggttcctcgggccaatacattcgggcgacccttccatatatccggacggagatccctatcattattgtgtttcgagctctaggttttgtggctgataaggatatattggaacatatttgttatgattttaatgatactcaaatgatggagttgttgcgtccttctttggaagaagcttttgttatacaaaaccaacaggttgctcttgactacatcgggaagagaggggctaccgttggtgttacaagggaaaagaggataaagtatgccaaagagattcttcagaaagaaatgcttcctcatgttgggattggagagtattgtgaaacaaagaaagcttattattttgggtatatcatccaccggcttctgttatgtgcacttggccgaagggctgaggatgatagggatcactatggaaataagagactggatcttgctggtccattgcttggtggcctgtttcggatgctttttagaaagttgacaagggatgttagagcctatgttcagaagtgtgttgacaatggaaaagatgtgaaccttcaatttgcaatcaaagctaaaaccattaccagtgggctgaaatactctcttgctactggaaactgggggcaagctaatgcagccggtactagagctggtgtttcacaggtgttgaatcgtctgacttatgcttctactttgtctcacttgcgaaggttgaactccccaataggacgagaagggaaactggccaaaccaaggcaattgcataattcacaatggggaatgatgtgtcctgcagaaacaccagaaggtcaagcatgtgggctggtgaagaatctagccttaatggtttatattacagttggttcagcggcatatccaattctggagtttttggaagagtggggtactgagaactttgaggaaatttctcctgccgttattccacaggctacaaagatctttgtcaatggtacctgggtgggaattcatcgcgatcctgacatgttggtgagaacactgagacgacttaggagaagggttgatgtcaatactgaggttggggtagttcgtgatatccgtttgaaagaacttcgaatttatacagactatgggaggtgcagtcgtccattatttattgtggaaaagcaaaggctgctgatcaagaagaaggatattcaaacattgcaacaacgggaatcacctgaagagggtggctggcatgatctggtggctaagggatacatcgagtacattgacactgaagaagaagaaacaacgatgattagcatgactataaatgatcttgtgcaagcacgccttaatccggaggaagcttattccgatacctatacccactgtgagattcacccgtcacttatattgggtgtttgtgcatcaattattccgtttcctgatcataatcagtctccccgtaatacttatcagtcagctatgggtaagcaagccatggggatttatgttaccaactaccaatttcggatggacacattggcctatgtgctttattatcctcagaagcctcttgtcacaacacgggccatggaacacttgcatttcaggcaactgcctgcgggcatcaatgcaattgttgccatttcctgctattctggatacaatcaggaggattctgtcattatgaatcagtcatcgattgatcgtggatttttccgatcactatttttccgctcatacagggatgaggaaaagaagatggggacattggtcaaggaggactttggacgtcctgatagagcttctactatgggtatgcggcatggttcttatgataagttggatgatgatggtcttgcccctccgggaaccagagtttctggtgaggatgtaatcattgggaagacaactcccatttctcaagatgatgcacaagggcaagcctctcgctatacaaggaaagatcacagtaccagtctccgccatagtgaaactggaatggtagatcaggttctattaacaacaaacgctgacgggctcagatttgttaaagtaagggttagatcagtccgcattcctcaaattggggacaagtttagcagtaggcatggtcagaagggaacagttggcatgacttatacacaagaagatatgccatggactgtggaaggcattactcccgatatcattgtgaatcctcatgctattccttctcgaatgactattggtcagctgattgagtgtattatgggaaaggttgccgcacacatgggaagagaaggtgatgccactccctttacagatgttactgtggataacatcagcaaagctttgcataaatcgactgaagcactacataaatgtggataccagatgcgtggttttgagaccatgtacaatggtcacactgggcggcggcttagtgcaatgatattccttggtcccacgtactaccagcgactgaagcatatggttgatgacaagattcattctagaggcagaggccctgtgcaaatcctcacaaggcagcctgcggaaggtcggtcacgtgatggtggtctccgttttggggaaatggagcgagattgtatgattgctcacggtgccgctcattttctcaaagagcggttatttgaccaaagtgatgcatatagagttcatgtttgtgagcgttgtgggctgattgctattgcaaacctcaagaagatttcttttgaatgcagaggctgcaagaacaaaactgatatcgtccaggtccacattccatatgcatgcaagttgcttttccaggagctaatggctatggctatagctccaagaatgcttacaaaggatgtcaaacaagccaaagatcaaaagaaaaaaggagcttgattaatttggcca

SEQ ID NO: 1671 - DNA, 3799 bp, Zea mays
aaccaaatcaggcaatcgtgcccagttccgcttcccctcgccatttcgccccgcctcccgcccctactccctacaccttcaccgctgtcgggggaggcggctcgccgtgacatcgaccccaccccacccccagcgtagcatcccgccactccatcgcactgtccatggaggatgacgagtacgaggaggggatggagatgggctacggcgggcatcaccagcacggcggcggccacgcggggtacggcgcggaggaggacgacgaggtggggtacggcggcgggggcggggaagagatggatgaggatgcggacggggacgctgagcagcaggaggatatcactcaggacgacgcctgggccgtcatatccgcctacttcgaggagaagggcctcgtgcgccagcagctcgattccttcgacgagttcatccagaacaccatgcaggagattgttgatgagtccgccgacatcgagatccgccccgagtcgcagcacaaccctggccgccaggccgaatttgccgagactctgcacaggatcagctttggtcaaatctatctcagcaagccaatgatgactgaagccgatggagagacagctactttatttccaaaatcagcaaggctcaggaacttgacatactctgcaccactgtatgttgatgtgtcatacagagtaatgaagaaaggacatgactgtgaggaagttacagagactgcagagtatccaaaagtgtttattgggaaggttccaatcatgttgcgctctagttactgcacactgtatcaacaatctgagaaggatctcactgaacttggggagtgtccttatgaccaaggtggttatttcattatcaatggaagcgaaaaggttcttattgcccaggagaagatgagcactaaccatgtctatgtttttaagaagaggcagcctaataaatttgcatatgtggctgaagtccgttccatggctgagaaccagaacagaccagccagtggcatgtttgtacggatgctttcacgagcaggagcaaaagggggatcatctggtcaatatatccgtgctactctaccttatattcgtgcggacattcccattatcattgtatttcgagcattaggatttgttgctgacaaggatatactggagcatatatgttatgacttttctgatacacaaatgatggaattgctacgcccatccctggaggaagcttttgtcattcaaaatcaacaggttgctctagactacattggaaaacgtggcgcaacagttggtgtcactcgagaaaagagaattaaatatgcaaaagaaatacttcaaaaggaaatgttgcctcatgttggtgttggggaattctgtgaaactaagaaggcatactattttgggtatattattcaccgcctactgatgtgtgctcttagtcgaagagctgaggatgaccgagatcattatggaaacaaaagactagatcttgctggtccactgcttggagggctgtttagaatgtgtgtagataatggaaaggaagttaatttgcaatttgctatcaaagcaaaaactgttaccagtggcttgaagtactcacttgctactggaaactggggacaggctaaccaagctggaaccagagcaggggtttctcaggtgcttaatcgcctgacctatgcttctaccctttcacatctccggaggctgaactctcccattgggcgtgaaggaaaattggcaaaaccccgccagttgcataattcacattggggaatgatgtgtcctgctgaaacaccagaaggacaagcttgtggcttggtgaaaaatcttgccttgatggtatatatcacggttggttctgctgcaaatccaattttggagtttttggaggagtggggcacagaaaattttgaggagatatcaccagctgtcattccacaagctgctaaaatttttgtcaatggttgttgggttggaattcatagaaaccctgacctgttggttaagactcttaggcgtttaagaagacagattgatgtcaacactgaagttggtgtggttcgtgatatccgtcttaaagaacttcgactttacacggattatggacgctgcagtcgtccattatttattgttgagggccagaggctgctcatcaagaaggcgcacatccgagccttgcaacaaagggagactcctgatgaaggctggcatgaattggtctcaaaaggatatatagagtatatagatactgaagaagaggagactaccatgatctccatgaccataaatgaccttcaaaatgcaaggcacaacccagaagaggcttactctgaaacttacacacattgtgagattcatccttcattgatacttggtgtttgtgcgtcgattattccgtttcctgaccacaaccagagatgaggaaaagaagatgggtacacttgtcaaagaggaatttggtcgtccaaatagggaaaatactatgggaatgcgccatggttcatatgataaactagatgatgatggccttgcaccacctggaacaagggtctcgggtgaagatgtcattattgggaagacatctcctattccacaggatgacgctcaagggcaagcttctaggtactcgaagcgtgatcatagtacttctctgcgtcacagtgaaagtggcatggtggatcaggttctgttgacaacaaatgcggatggtctaagatttgtcaaggttaggatgcgatctgttcgaataccacaaattggagacaagtttagcagtaggcatggacaaaaaggaactgttgggatgacttacactcaagaggatatgccatggacaatcgaaggcatcacacctgatattattgtgaatccacatgctattccatcccgtatgactattgggcagctgattgagtgtatcatgggtaaagttgcggctcagatggggaaggaaggagatgccactccattcacggatgtgactgtggataacattagcaaagctcttcataaatgtaattatcaaatgcgtggatttgagaccatgtacaatggtcacaccggaagaaaactgacagcaatgattttcctgggacccacgtattaccaaagactcaagcacatggtggatgacaagatacattccagaggacgtggtcctgttcagatactcacccgacaaccagcagaggggcgatctcgtgatggtggtctccgctttggagaaatggaaagggattgtatgattgcacatggagcagctttcttcctgaaggaaaggctgtttgaccagagtgacgcatacagagtccatgtatgtgagaaatgtggtctcatcgcaattgctaatctaaagaaaaactcgtttgaatgtaggggctgcaagaacaagactgacattgtccaagtacacataccctatgcttgtaagcttctgttccaggagcttatggcaatggccattgctcccagaatgcttacccatgatatgaagacagggaaggatcagaagaagcgctgaacttgtatcacatgagatgtaactggaactttgctccattgctatatttctcgcgtgcacacggtagtacgctgttaaggaacattgtggtcacttgttttccgacttcgactctggtttgtcgtgaacgatggacaggccattatcgtatcttgatgggctatcagcccaatctgtgttagtgctgttagatgatctgtgctagcagatcgttgagttaattttgtacattataggaatgtgctgcaatgtattaatctacgaatacaaagactttggcgcgcta

SEQ ID NO: 1672 - DNA, 3995 bp, Arnica chamissonis
tgtttcaatctcgaccctccgacgagactagggaccctaaaccctctctgcctctctaatccagattgcctgtcttcaagaacttcaaatcggactactagatttgatttgtagcaaggtttttggaagattagattatggatttggaagaagagtatgatcaaggatacaacgatgaggaagaagatataacccaagaggatgcttgggcggttatcagttcttattttgaggagaagggtcttgttcgtcaacagcttgattcgtttgatgagtttattcagaatactatgcaagaaattgtcgacgagtctgcagatatcgagatccgacccgaatcccagcacaatccgggtcaccaacctgattttgcagagactatctataaaatcagttttggtcagatttatctgagtaaaccaatgatgacagagtccgatggtgaaaccgccacattgtttccaaaggcagcaaggctgagaaatctaacatattctgcaccattgtatgttgatgtatctaaaagggctataaagaaaggtcatgatggtgaagaagtcacagaaactcaggattttgctaaagtattcattggaaaggtccctattatgctacggtcaagttactgtacactatttcaaaattcagaaaaggacttgacagagcttggagagtgtccgtatgatcaaggtggatatttcattatcaatgggagtgaaaaggttctaattgctcaagagaaaatgagcaccaatcatgtctatgtgttcaaaaagagacaaccgaacaaatatgcttatgtggcagaagttcgttcaatggcagaatctcaaaataggccacctagtaccatgtttgttcgcatgcttgctaggaccagtgccaaagggggctcttcaggtcaatatattcgtgctacacttccctatattcgaactgagattcctatcattattgtgtttcgagcattgggatttgttgctgataaagatatattagaacacatatgttatgatttttctgatactctaatgatggagttgctgcggccttcattggaagaagcatttgttatacaaaatcagcaagtggccttagattacattggaaaaagaggtgccactgttggtgtcacaaaagaaaagagaataaagtacgcccgtgatattcttcaaaaagaaatgcttcctcatgtgggggttggagagtactgtgaaacaaaaaaggcatactactttggatacattatccaccgtcttttgttatgtgctcttggccggagggctgaggatgaccgggatcattatggaaacaagaggcttgatcttgcgggtccattgcttggtggcctatttagaatgctctttcgaaagttgacaagagatgtaagaggatatgtgcagaagtgtgtagacaatgggaaggatgttaatctgcaatttgcaattaaagccaaaacgattaccagtggccttaaatattcccttgctacagggaattggggacaagcaaatgcagctggaacaagggctggtgtttctcaggtgttgaatcgtttgacatatgcatctactttgtcacatttaagaagactaaactctcctatagggcgtgaaggaaaactggcaaaaccaagacagttgcacaactcacaatggggaatgatgtgtcctgcagaaacccctgaaggacaggcatgtgggctggtgaaaaaccttgcattgatggtttacataactgttggatcagccgcatacccaattctggagtttttagaagaatggggtacagagaattttgaggaaatctctcctgctgttatcccacaagctacaaaaatctttgtcaatggtctgtgggtgggaattcatcgtgatcccgacatgttggttagaacgctgaggagactaagaagaagagttgatgtgaacactgaagttggagttgttcgagatattcgtttgaaagaacttcgaatttataccgattatggccgttgtagtcgtccacttttcattgttgagaagcaaagacttctaataaaaaagaaagacatccaaaagctgcaacaaagggaaactccagaagatggtggctggcatgatcttgtggcaaacggattcattgagtatattgatacagaagaagaagagactactatgatttccatgaccattaatgatcttgtaagcgctaggctaaatccggaagaatcttattctggtacttatacccattgtgaaatccatccatcattgattttgggtgtctgtgcgtccatcattccatttcctgaccacaatcagtctccacgtaatacataccagtcagccatgggaaaacaagctatggggatttatgtcaccaacttccaattccgtatggatacattggcttacgttctctactatcctcaaaaaccacttgtgactactcgggcaatggagcacttgcacttcagacagcttccagctggcattaatgcaattgtggcgatttcttgttattctggatacaaccaagaagattcagttattatgaaccaatcgtcaatagatcgtggtttcttcagatcacttttcttccgttcatacagagacgaagagaagaagatggggacccttgtgaaagaagattttggtcgtcccgatagagctaataccatgggtatgaggcatggttcatatgataaattggatgatgacggtctagcccctcccggaactcgagttggaggtgaagatgtgatcattggaaaaacaacacctattgctcaagaagatgctcagggtcaagcctcacgttacactcgtcgtgatcacagcacaagcttacgacacagtgaaaacggaatggttgatcaggtgttgctaactacaaatgctgacgggctgcggtttgtgaaagtgagggtgagatccgtaagaataccccaaattggagacaagttcagtagtaggcacggtcaaaagggaaccgtgggtatgacttacacacaggaagacatgccgtggactgttgaaggcatcactcctgatattatagtcaacccgcatgctatcccgtcccgtatgaccatcggtcaacttattgagtgtatcatggggaaagttgctgcacatatgggcaaagaaggagatgctacccccttcacagacgttactgttgataatatcagtagggcgctacacaagtgtggttaccagatgcgtgggtttgagaccatgtacaacggtcatacgggtcggcgtctccccgctatgatattccttgggccaacttactaccagaggttaaagcatatggtggatgacaagattcattcacgtggacggggcccagttcagattttgactaggcagccggctgagggacggtcacgtgacggtgggctgcggtttggggagatggaacgagactgcatgattgctcacggtgctgctcattttcttaaagaacgactgtttgaccagagcgacgcgtatagggttcatgtgtgtgaacgttgtggcttgattgctattgctaatcttaaaaagaattctttcgaatgtagaagctgcaagaacaaaactgatatcgttcaggtgcatattccatacgcatgtaaacttcttttccaggagctcatgtcaatggcgattgcgcctagaatgcttacaaaagatgtgaaacaagcaaaagatagcaagaagaaaggcgcttgatacgtttatgtgtactctgtgcttctgaaagagtacaattacagtttgacaatgatttgtaatgtaaacaaacgttttctccccaatcccaagcttcaaaccgttatttaactgttttcacatggtgggagcactgtattctcagtatcatggtcattttcatggagttatgttggaaccatcagtctctccactagcactccttgttttcatttgttagggtagaaatgactcgtgtttcgacatcactcatgtgccatttgaaattttgggcaacttttgcgattg

SEQ ID NO: 1673 - DNA, 4303 bp, Medicago truncatula
acaagtcattattcattcattcatacatcaaacctctttcgaaaatctcttcacttttttctctctgctagggtttcatatcttcgtcttctttctctcacactaaaaacacactcaaaattacactaaaacaccgcataatttgaacttcgaatttgaacaaaatgatgatggatttggaagaagaaaatgaattcgatcagcaaatggaagaagaagacgatgaagaagagattacccaggaagatgcctgggctgtgatttctgcttattttgaagaaaaaggacttgtacgtcaacagcttgattcctttgatgaattcattcagaacacgatgcaggagatagttgatgaatccgctgatatcgaaattcgacccgaatctcagcacaatcctggacatcagtctgatttcgctgagacgatttacaaaataagctttgggcagatttatttgagtaagccgatgatgacggaatctgatggagaaactgctacattgtttcctaaggccgccaggcttaggaatcttacttactcagctcctttgtatgttgatgtttctaagagggtcattaagaaagggcatgatggtgaagaggtcactgagactcaagatttcaccaaagttttcattggcaaggttcctattatgcttcggtctagttattgcacactatatcagaattcagagaaggatttgactgagcttggagagtgtccgtatgatcaaggaggttatttcattattaatggcagtgagaaggttcttattgctcaggagaagatgagcaccaatcatgtctacgtcttcaagaagagacaacctaacaagtatgcttatgtgggtgaagttcgctccatggcagagtcacaaaacagaccacctagcactatgtttgtgcgcatgctctctcgggctagtgccaaagggggttcttcagggcaatatatacgtgctactcttccttacattcgaactgaaattcctatcattattgtgtttcgggcattggggtttgtcgccgacaaggatatccttgaacatatatgctatgactttgcggatactcaaatgatggagttgcttcgtccttccctggaagaagcatttgtgatacaaaatcaacaggttgcacttgattatattggaaaaagaggatcaactgtaggtgtaaccaaggaaaagagaattaagtatgctaaggacatccttcaaaaggagatgcttccccatgttggtgttggagagtattgcgagactaaaaaagcatactattttggatatatcattcaccggctacttttgtgcgcacttgggcggagggctgaagatgatagggatcattatggaaacaagaggctggacctggcaggtcctttacttggcggtctctttagaatgctattcagaaagttgaccagagatgtcaggggttatgtgcaaaagtgtgttgataatgggaaggatgttaacctgcaatttgctatcaaagcaaaaaccatcacaagtggacttaaatactcacttgctactggtaattgggggcaagcaaatgctgcgggtactagagctggagtgtcacaggtgctaaatcgtttaacctatgcttccactttatcacacttgcgaagattgaattctcctataggacgtgaaggaaagttggccaaaccaagacagctgcataattcacaatggggaatgatgtgtccggcagaaacaccagaaggacaagcctgtggactggtgaagaatctggccttgatggtatacattacagttggttcagcagcatatcctattctggagtttttagaagaatggggcacagaaaattttgaggaaatttctcctgcggtgattccccaagctacaaaaattttcgtaaatggttgctggatgggtattcatcgtgaccctgatatgttggttaggacattgagaaagctgagacgtcgggttgatgttaatactgaagttggggttgttagagatatccgtcttaaagaactgcgcatatatacagattatggtcgctgcagtcgtcctttattcattgtggataaacaaaggcttctcataaagaagaaagacattcattctttgcaacaaagggaatccccggaagatggtggatggcatgatcttgtgtccaagggctttatagaatatattgacacagaagaggaagagactactatgatttccatgacaattaatgatcttgtacaagcaaggctgaatccagaagaagcatattctgatacttacactcactgtgaaatccatccatcactgattttgggtgtatgtgcttccatcataccatttcctgaccacaatcagtcccctcgtaatacgtatcagtccgctatgggaaaacaagcgatgggtatttacgttaccaactaccagtttcgaatggataccttggcgtatgttttatattatcctcaaaagccactggtcactacgagagccatggagcatcttcattttcgtcaactccctgctggaattaatgccattgtggccatttcatgttattctggttataatcaagaagattctgtcatcatgaaccaatcatcaatagaccgtggcttctttcggtctctgtttttccgttcatatagagatgaagagaaaaaaatgggaactcttgtcaaagaagattttggtcggccggatagagccaacacaatgggcatgaggcatggttcttatgataaattggatgatgatggtcttgctccacctggcacaagagtgtctggtgaggatgttattattggaaaaaccactcctctatctcaggaagagcaacaaggacaagctgctcgttactcaaaacgtgatcacagcataagtttacgccatagtgaaactggaatagtagatcaagttctgttgaccacaaatgctgatgggttgagattcgtgaaagtaagggtgagatctgttcgaataccacagattggtgacaaattcagtagtagacacggtcagaaggggactgttggtatgacttatacacaagaagacatgccctggactgtagaaggcatcacccctgatattattgtcaatccacatgctataccttctcgaatgacaattggtcagcttattgagtgtatcatggggaaggtggctgcccacatgggaaaagaaggagatgctactccttttacagatgttactgtggataatatcagcaaagctctacacaaatgtgggtaccaaatgcgtggttttgagacaatgtacaatggtcatacaggaaggcgtctcagtgcaatgatcttccttggccctacctattaccaaaggttgaagcatatggttgatgacaagatccattctcgtggacgagggcctgtgcagattcttacaaggcaacctgctgaggggcggtcacgtgatggaggtcttcgatttggagagatggaacgtgattgcatgattgctcatggagccgctcatttcctaaaggaaagattgtttgatcaaagtgatgcatatagagtccacgtgtgcgaacgctgtggattgatagctattgcaaatctgaagaagaattcttttgagtgtaggggctgcaagaacaaaactgacattgttcaggtttatattccttatgcttgtaagctgctcttccaagagctaatggctatggccatagctccaagaatgcttactaaagaggtgaaagctataaaagaccaaaagaagaaaggagcctgatgagcaagtttgagaaaatcaatcagtcttattccatgctgacttcttcctctcgtgaacgtggatcacacacatggcatccgaagatgtatgaatttgattctgttttctgaagactgataaatgagatcagtagcctttcaagtgttgggaagtgacattccttttatatgtcaaggatttttcctttctagttcaagaaataaacctgaaacaaacctcttaacccggtagcctcttcaatacctcgcttcctatatcgcatttgacaatataattactagagaatatatcgatcgaaaaatttgctgggctgtcaactttaagctcatcattctatagacctgaatcgttttgtttgggtaaagtaccagatatacttttttactacaaccgtataaatacaatgaacagtacatacggtgtctgcgttttgtatgggtgaagtaaccatacaaaataatgagttaacaatagttttttttttgctcgaatgccaacactacttgttactccagttttcctcgttattttgccaagttaaatttgtg

SEQ ID NO: 1674 - DNA, 3816 bp, Ambrosia trifida
tgataacacgacgaccgtagacgagaccctaaaaaaccttcttaaataactatttgatcagcagttagggtttcaattaataatggatttggaagaagagtatgatcaaggatacgacgacgatgaagaagacataacccaagaggatgcttgggccgttatcagctcttatttcgaagaaaagggtctcgttcgtcaacaactcgattcctttgatgagtttatacaaaacactatgcaggaaattgttgacgagtctgcagatatcgagattcgtcctgaatctcagcataatcctggccaccagtctgattttgctgagactatctataaaatcagcttcggtcagatttatctgagtaaaccgatgatgactgaatcagatggtgaaaccgccacattgtttccaaaggcagcaaggctgagaaatctaacatattctgcaccattatacgtcgatgtatcaaaaagtgctataaagaaagggcatgatggtgaagaagttacagaaactcaggattttgctaaagttttcatcgggaaggttcctataatgctacggtcaagttactgtacattatttcagaactctgaaaaagatttgactgagctcggagagtgcccttatgatcagggtggatacttcattataaacggaagtgaaaaagttctaattgctcaagagaaaatgagcaccaatcatgtttatgtgtttaaaaagagacaacccaacaaatatgcttatgtggccgaagttcgttcaatggcagaatctcagaacaggccacccagtaccatgtttgttcggatgcttgctcggactagtgccaaagggggttcttcaggtcaatatattcgggctacacttccatacattcgaactgagattcctataattattgtttttcgagcactgggatttgttgctgataaagatatattagaacacatatgttatgattttgctgatactcaaatgatggagttgctacgaccttcattagaagaagcatttgttatacaaaatcaacaagtggccttagattacattggtaaaagaggtgctactgttggtgtcacaaaagagaagagaattaagtatgcccgtgatattcttcaaaaagaaatgcttcctcatgtgggggttgaagagcactgtgaaacaaaaaaagcttactactttggatatatcatccaccgtctattgttatgtgctcttggtcggagggctgaggatgacagggatcattatggcaacaaaaggcttgatcttgccggtcctttgctaggtggcttatttagaatgcttttccgaaagttaacaagagatgttagaggatatgtacagaagtgcgtagacaatgggaaggatgttaatctgcaatttgcaattaaagcaaaaacgattaccagtggccttaaatattctcttgctactgggaattgggggcaggcgaatgcagctggaacaagggctggtgtttcacaggtgctgaatcggttgacatatgcatctacgttgtcacatttaagaagactaaactctcctatcgggcgtgaaggaaaactggcaaaaccaagacagttgcataactcccaatggggaatgatgtgccctgcagaaactcctgaagggcaggcttgtgggctggtgaaaaaccttgctttgatggtttacattactgttgggtcagctgcatacccaattctggaatttttggaagaatggggcacagaaaattttgaggaaatatctcctgctgtcatcccgcaagctacaaaaatctttgtcaatggtctgtgggtgggaatccatcgtgatcctgacatgttggttaggactttgaggagattaagaagacgagttgatgtgaatactgaagtcggagttgttagagatattcgtttgaaagaacttcgaatctataccgattatggccgctgcagtcgtccacttttcattgttgagaagcaaagacttttaataaaaagaaagacatccagaagctgcaactaagggaaacccacgaagatggtggctggcatgatcttgtgtcaaacggattcattgagtatattgatacagaagaagaagagactactatgatttcctatgactatcaatgatcttgtaagtgcgaggctaaatccggatgagtcttattcggacacttatacacattgtgaaattcatccatcattgatcttgggtgtttgtgcctccattataccatttcctgaccacaatcagtccccacgtaatacgtatcagtcagccatgggtaaacaagctatggggatttatgtcaccaacttccaatttcgtatggatacactggcctatgttctttactatcctcaaaaaccacttgtgactactcgagcaatggagcacttgcagttcagacaacttccagctggcattaatgcaatagtggctatttcctgttattctggatataaccaagaagattcggttattatgaaccagtcatcaattgatcgtggtttcttcagatcactcttcttccgttcatacagggacgaagaaaagaagatggggacgcttgtgaaagaagattttggccgccccgatagagctaataccatgggcatgaggcatggttcatatgataaattggatgacgacggtctagctcctcctggaacacgagttggaggtgaagatgtgataattggaaaaacaacacctattgctcaggacgatgctcagggtcaagcctcacgttacactcgtcgcgatcacagcacaagcttacgtcacagtgaaaatggaatggttgatcaggtactgctgactaccaatgccgacgggttaaggtttgtgaaagtgcgggtcagatctgtaagaataccccaaatcggagataagtttagtagtagacacggtcaaaaaggaactgtgggtatgacttacacgcaagaagatatgccatggaccgttgaaggcatcacccctgatattatagtcaacccacacgctatcccctcccgtatgaccattggtcaacttatcgagtgtatcatggggaaagttgctgctcatatgggcaaagaaggagatgccactcccttcacagatgtaacggtggataatattagtagggcgctacacaagtgtggctaccagatgcgtgggtttgagaccatgtacaacggtcatactggccggcggcttccagctatgatattcctggggccaacatactaccaaagattaaaacatatggtggatgacaagatccattcacgtggaaggggtccggttcagatcttgactagacagccggctgagggacggtcacgtgatggtgggcttaggtttggtgagatggaacgggactgcatgattgctcatggcgctgctcattttcttaaagagagactgtttgaccagagcgatgcgtacagggttcatgtttgtgagcgttgtgggttgattgcgattgctaatcttaaaaagaattcattcgagtgcagggggtgcaagaacaagaccgatattgttcaggtgcatattccatacgcatgtaagctattgttccaggagcttatgtccatggcaattgctcctagaatgctgactaaagacatcaaacaagctaaagacagcaagaagaaaggcgcttagcttagatcactcaatttttctagtcatggaatttaattaagtttttgaacttgaatgttttgtgttggttggctatgtattactagtaataattatataaatattgaagctgaaatcattaattggatgtgatgtactttgttgttacattagctaaaaaagaa

SEQ ID NO: 1675 - DNA, 3607 bp, Prunus persica
aattccgatccgcaaccacattcatggacgaggagcccgagtacgacgaccagcagtacaacgacgacgacgaagatgaaatcacgcaggaggacgcctgggccgtcatctcagcctacttcgaagagaagggtttggtgcgccaacagctcgactcattcgacgagttcattcagaacacaatgcaggaaatcgtcgatgagtcggccgatatcgagattcgccccgagtcgcagcacaacccgggccaccagcctgatttcgccgagactacatataggattaagttcggtcagatttatttgagtaagcccatgatgaccgagtcggatggagaaactgcaaccttatttcccaaagctgccaggttgagaaatctaacgtactcagcacccttgtatgtggatgtctcaaagagcattgtaaagaaaggacatgatggtgaagaagtcaccgaaactcaggatttcaccaaagtattcattggaaaggttcctataatgcttcggtctagttattgcacgttgtaccagaattccgaaaaagatttaacagagctgggagagtgtccatatgatcaaggtggatattttattataaatgggagtgaaaaggttctgattgcccaagagaagatgagcaccaatcatgtctacgtgttcaaaaagaggcagcctaacaagtatgcctacgtggcggaagttcggtctatggcggagtcccaaaacagaccgcccagtacaatgtttgtgcggatgcttgctcggactagttctaaagggggttcttctggacaatacattcgtgctactcttccatacattcgagctgaaattcctattattattgtattccgagctctcgggtttgttgctgataaagacatattagagcatatatgttatgacttctctgatactcagatgatggagttgcttagaccttctctggaagaagcatttgtgattcaaaatcaacaggttgcactcgactatattggaaaaagaggtgcaactgttggtgttagtagagaaaagaggatcaagtatgcaaaagagatccttcaaaaggaaatgcttccacatgttggtgttggagaattttgtgagacaaagaaagcttactattttggatatatcattcacaggcttctactgtgtgcacttggtcggagggcagaagatgatagggatcattatggcaacaagaggctggatcttgctggtcccttactgggaggcttgtttcgaatgttattcaggaagttgactagggatgtgagaggttatgtgcaaaagtgtgtcgataatggaaaggaacttaacctgcaatttgccatcaaagctaaaacaatcactagtggcctcaaatattcacttgctactgggaactgggggcaagcaaatgcagctggtacaagggctggagtgtcacaggtgttaaatcgtttgacatatgcgtccaccttgtcacacttgagaaggctaaattctcccatagggcgtgaagggaaattggccaaaccacggcagttgcataactcgcagtgggggatgatgtgtccagctgaaacacctgaaggacaagcatgtggacttgtaaagaatcttgcgttgatggtatacatcacagtaggatcagctgcatatccaatattggaatttttggaagaatggggtacagagaattttgaggaaatttcccctgcagttattccccaagccacgaaaatttttgttaatggctgttgggttggcatacatcgtgatcctgaaatgttggtgaaaacattaagaaagctaaggcgacgggttgatgtcaatactgaagttggggttgtcagagatatccgtcttaaagaattgcggatatatactgattatggccgttgcagtcgtccattattcatcgtggacaaacaaaggcttctcataaagaagaaagatattcatgcattacagcagagggaaaaccctgaagatggtggctggcatgaccttgtagcaaagggatttatagaatatattgatacggaagaagaggagactacaatgatttccatgacaattaatgatcttgtacaagcaaggctcaatcctgaagaggcatattctgacacttacactcattgtgaaattcatccatcgcttattttgggtgtttgtgcttcaattataccatttcccgatcataatcagtctccacgtaatacgtatcaatctgctatgggcaagcaagctatgggaatttatgtcaccaattatcagttccgaatggatacactggcgtatgttctgtactaccctcagaagccccttgtcactacacgagccatggagcatcttcatttcaggcagcttccagctggcatcaatgctattgttgccatttcttgctattctggttataaccaggaagattctgtcattatgaatcaatcctctatagaccgtggattcttccggtcaatattcttccgctcttatagggacgaggagaaaaagatggggacccttgtcaaagaggatttcgggcgtccagacagagcaaacacgatgggcatgcggcatggttcttacgacaagttggatgatgatggtctcgcacctcctggaactagggtttcaggtgaagatgttatcataggaaagaccactcccatggctcaggatgaggcgcaagggcaagctgcttcacgatacacacggcgtgaccatagcataagcttacgccacagtgaaacagggattgtggatcaggttctactgacaactaatgctgatgggttgaggtttgtgaaagtaagggtgagatctgtccggataccacagattggtgataaatttagcagtagacatggacagaaggggacagtgggtatgacttatacacaagaagacatgccatggactgtggaaggggtcacccccgatattatcgtgaacccacatgctattccttctcgaatgaccattggtcagcttattgagtgtatcatggggaaggttgcagctcacatggggaaggaaggagatgcaactccctttacggatgtgactgtggacaatattagcagagctcttcacagctgtgggtatcaaatgcgtgggtttgagaccatgtataatggccacacaggcaggcggcttagtgctatgatattccttggccccacatattaccagaggctgaagcatatggttgatgacaagatccattcccgtgggcggggtccagtacagatcctcacaaggcagcctgctgagggacgatctcgtgatggtggtctgcgatttggagaaatggagcgagattgcatgattgcccatggcgctgctcattttctgaaagagagattgttcgaccagagtgatgcatatagggttcatgtctgtgagcgttgtgggttaatagctattgcaaatctcaagaagaattcatttgagtgcagaggttgcaagaataaaactgacattgttcaggtatacattccctatgcttgcaagctgctcttccaagagcttatgtccatggctatagcaccaagaatgctcacaaaggacatcaagcccgccaaagaccaaaagaagaaaggagcctgatatat

SEQ ID NO: 1676 - DNA, 4531 bp, Prunus mume
caattttgttgttattgttttggttgctcttctctttggcttgaacgttgaaccgcctctacgtcctgaagacaggaagcaacggcggcaaaagataaaacgatccatacccgcaagtgctaataaaacgacagttctctctcttttgtctattttcaaacctcgcaacctcaccactttcgaagctcatctgaacctgaacagtgaaaagctctgctagggttttgctcactcgcaaacgcaccgttcagtcgggcacaaagaaccgaaccagacctagggtttcgaattccgatccgcaaccacattcatggacgaggagcccgagtacgacgaccagcagtacaacgacgacgacgaagatgaaatcacgcaggaggacgcctgggccgtcatctcagcctacttcgaagagaagggtttggtgcgccaacagctcgactcattcgacgagttcattcagaacacaatgcaggaaattgtcgatgagtcggccgatatcgagattcgccctgagtcgcagcataacccgggccaccagcctgattttgccgagactacatataggattaagttcggtcagatttatttgagtaagcccatgatgaccgagtctgatggagaaactgcaaccttatttcccaaagctgcaaggttgagaaatctaacgtactcagcacccttgtatgtggatgtctcaaagagcattgtaaagaaaggacatgatggtgaagaagtcaccgaaactcaggatttcaccaaagtattcattggaaaggttcctataatgcttcggtctagttattgcacgttgtaccagaattccgaaaaagatttaacagagctgggagagtgtccatatgatcaaggtggatattttattataaacgggagtgaaaaggttctgattgcccaagagaagatgagcaccaatcatgtctacgtgttcaaaaagaggcagcctaacaagtatgcctacgtggcggaagttcggtctatggcggagtcccaaaacagaccgcccagtacaatgtttgtgcggatgcttgctcggactagttctaaagggggttcttctggacaatacatccgtgctactcttccatacattcgagctgaaattcctattattattgtgttccgagctctcgggtttgttgctgataaagacatattagagcatatctgttatgacttctctgatactcagatgatggagttgcttagaccttctctggaagaagcatttgtgattcaaaatcaacaggttgcactcgactatattggaaaaagaggtgcaactgttggtgttagtagagaaaagaggatcaagtatgcaaaagagatccttcaaaaggaaatgcttccacatgttggtgttggagaattttgtgagacaaagaaagcttactattttggatatatcattcacaggcttctactgtgtgcacttggtcggagggcagaagatgatagggatcattatggcaacaagaggctggatcttgctggtcccttactgggaggcttgtttcgaatgttattcaggaagttgactagggatgtgagaggttatgtgcaaaagtgtgtcgataatggaaaggaacttaacctgcaatttgccatcaaagctaaaacaattactagtggcctcaaatattcacttgctactgggaactgggggcaagcaaatgcagctggtacaagggctggagtgtcacaggtgttaaatcgtttgacatatgcgtccaccttgtcacacttgagaaggctaaattctcccatagggcgtgaagggaaattggccaaaccacggcagttgcataactcgcagtgggggatgatgtgcccagctgaaacacctgaaggacaagcatgtggacttgtaaagaatcttgcgttgatggtatacatcacagtaggatcagctgcatatccaatattggaatttttggaagaatggggtacagagaattttgaggaaatttcccctgccgttattccccaagccacgaaaatttttgttaatggctgttgggttggtatacatcgtgatcctgaaatgttggtgaaaacattaagaaagctaaggcgacgggttgatgtcaatactgaagttggggttgtcagagatatccgtcttaaagaattgcggatatatactgattatggccgttgcagtcgtccgttattcatcgtggataaacaaaggcttctcataaagaagaaagatattcatgcattacagcagagggaaaaccctgaagatggtggctggcatgatcttgtagcaaagggatttatagaatatattgatacggaagaagaggagactacaatgatttccatgacaattaatgatcttgtacaagcaaggctcaatcctgaagaggcatattctgacacttacactcattgtgaaattcatccatcacttattttgggtgtttgtgcttcaattataccatttcccgatcataatcagtctccacgtaatacgtatcaatctgctatgggcaagcaagctatgggaatttatgtcaccaattatcagttccgaatggatacactggcgtatgttctgtactaccctcagaagccccttgtcactacacgagccatggagcatcttcatttcaggcagcttccagctggcatcaatgctattgttgccatttcttgctattctggttataaccaggaagattctgtcattatgaatcaatcctctatagatcgtggattcttccggtcaatatttttccgctcttatagggacgaggagaaaaagatggggacccttgtcaaagaggatttcgggcgtccagacagagcaaatacgatgggcatgcggcatggttcttacgacaagttggatgatgatggtcttgcacctcctggaactagggtttcaggtgaagatgttatcataggaaagaccactcccatggctcaggatgaggcgcaagggcaagctgcttcacgatacacacggcgtgaccatagcataagcttacgccacagtgaaacagggattgtggatcaggttctgctgacgactaatgctgatgggttgaggtttgtgaaagtaagggtgagatctgtccggataccacagattggtgataaatttagcagtagacatggacagaaggggacagtgggtatgacttatacacaagaagacatgccatggactgtggaaggggtcacccccgatattattgtgaacccacatgctattccttctcgaatgaccattggtcagcttattgagtgtatcatggggaaggttgcagctcacatggggaaggaaggagatgcaactccctttacagatgtgactgtggacaatattagcagagctcttcacagctgtgggtatcaaatgcgtgggtttgagaccatgtataacggccacacaggcaggcggcttagtgctatgatattccttggccccacatattaccagaggctgaagcatatggttgatgacaagatccattcccgtgggcggggtccagtacagatcctcacaaggcagcctgctgagggacgatctcgtgatggtggtttgcgatttggagaaatggagcgagattgcatgattgcccatggcgctgctcactttctgaaagagagattgttcgaccagagtgatgcatatagggttcatgtctgtgagcgttgtgggttaatagctattgcaaatctcaagaagaattcatttgagtgcagaggttgcaagaataaaactgacattgttcaggtatacattccctatgcttgcaagctgctcttccaagagcttatgtccatggctatagcaccaagaatgctcacaaaggacatcaagcccgccaaagacaaaaagaagaaaggagcctgatatatatatatatatatatatatatatgcatatgattgatggcaaaaaaaaatccattttctgaagttttggtacgctgcagcaaagtcagaacaactccgtttaaaaaaagcatgaagttgaggattggagtctgtaaatcgtgccacaataaaaacatgctggaggctactccaagggtgggagaccgaatcagaagattggtcagttcctattaatttcgattgagtatatggctcaaagtcttgcatcggttcagctgtagtatttccgtgaggtagttttgttttcttctcatttcacgtgaagaggaggagagggatttgtaataacttaactgtaattgattgtattttattacactatcaaatatagataaatctatacgcaacattttagttgtaatgtgctttcctaagttgttgtcaaagcggaattctgttatctgtttcggtggttagtaaaacaaaagtgtaatgatcttatgaattgtcagattcagatctatattgtaaaagttcctccaataatattttcatgtggatggagatttaacaaataggttaaattttgtacaaacttaaaaaattttgaatgtatttgaaataactagttgtagtatatttgaaataatcatttgtt

SEQ ID NO: 1677 - DNA, 3795 bp, Brassica napus
ctcgccgtctctcgtccattctctgcgtcgagaatggattacaataacgaatacgaacaagaaccgacttacatcgaagaagatgacgacgaggagatcacccaggaggacgcctgggcggttatctctgcctatttcgaagagaaaggtctcgttcgccagcagctcgattccttcgatgagtttatccagaacactatgcaagaaatcgtcgacgagtccgctgatatcgagatccgacctgaatctcagcacaatcctggccaccaatctgatttcgccgagacaatctacaagattagttttggacagatttatctgagtaaacccatgatgacggaatctgatggagagactgccaccttgtttcccaaagctgcaaggttgaggaacctcacgtactcagctcctttgtatgtcgatgtttctaagagagttattaagaaagggcatgatggtgaggaagttacggagacacaggattttaccaaagttttcatcggaaaggttcccatcatgctccggtctagttattgtaccttgtttcagaactcggagaaagatctgacagagcttggagaatgtccttatgatcagggcggatacttcattatcaatggcagtgaaaaggttctgattgctcaggagaagatgagcacgaaccatgtttatgtttttaagaagagacagccaaataagtatgcatatgttggcgaagtccgttccatggctgagaaccaaaataggcctccaagcacaatgttcgttcgcatgcttgctcgtgctagtgcaaaagggggttcatctggacagtatattcggtgtactctcccttacatcaaagcagaaattcctattatcattgtatttcgtgcattgggatttgttgccgataaggacattttggaacacatttgctatgactttgccgataaccagatgatggagttgctcaggccttctttagaagaagcatttgttattcaaaatcagcaggttgctctcgactatattgggaaacgtggtgcacctatgggtgtaaccaaggaaaagaggataaagtatgcaaaagatatccttcagaaagaaatgcttcctcatgtaggagttggggagttttgtgagacgaagaaagcttactatttcgggtatatcatacaccggctgctgctttgtgcacttggccgaaggccagaagatgatcgggatcattatgggaacaaaaggctggatcttgctggtcctttacttggagggctatttagaatgcttttcagaaagctgacgagggatgtgagatcttatgtacagaagtgcgttgacaatggcaaagaagtcaatcttcaatttgccattaaggctaaaacaatcacctctggcctgaaatattctcttgctactgggaactggggccaggcaaacgctgctggcacaagggctggagtctctcaggttctaaatcggttaacatatgcttccactttgtcacatctgaggcgtctcaattctcctattgggcgtgaaggaaaattggcaaaaccaagacaactgcacaactcacagtggggtatgatgtgccctgctgaaacacctgaaggacaggcgtgtggtctagtgaaaaacttggcgctcatggtctatattacagttgggtcagctgcttatcccatcttggaatttctggaagaatggggaactgagaattttgaggaaatctctccatcagttataccccaagccacaaaaatctttgttaatggaatgtgggttggagttcatcgagatcctgacatgttggtgaaaacgttgagacgtttgagaagaagggttgatgttaacactgaagttggcgttgttagagatattcgtctgaaagagctccggatatacactgattatggtcgttgtagtcgtcccttgtttattgtggataaccagaggctgttaataaagaagagagatatctatgctctgcaacaaagggaaagtgcagaagaagatggttggcatcatctagttgcaaaagggtttatagaatacatagacacagaggaagaggagacgacaatgatatccatgacaatcagtgatctggttcaagccagactccgtcccgacgaggcatattctgaaacttacacacactgtgagattcacccttcgttgatattgggcgtatgtgcttcgattataccttttcccgaccataaccagtcacctcgtaatacatatcaatctgctatgggaaagcaagctatgggaatatatgtcaccaactaccaatttcgcatggatacattagcctatgttctctattaccctcaaaagcctctggttaccacacgagctatggagcatcttcattttaggcaacttccagcagggattaatgctattgttgccatttcttgctactctggatataatcaagaagattctgtcatcatgaatcagtcttcaatagaccgtggtttctttagatccttgttctttcggtcatacagggacgaggagaaaaaaatggggacccttgtcaaagaagactttggacgcccagacagggcaagtacgatgggtatgcgacatggttcttatgagaaactggatgatgatggtcttgcacctcctggtactagagtttcaggtgaagatgtaatcattgggaaaactactcccatatctcaagatgaggctcaaggacaatcatcacggtacaccagacgtgatcatagtataagcttgcgacatagtgaaactggaatggtcgatcaggtgttgttgaccacaaatgctgatggtttgaggtttgtgaaagtgagagttagatctgttcgtatccctcaaattggagacaaattcagcagtagacacggtcagaagggaactgttggcatgacctacacacaggaggacatgccttggacaattgaaggcgttacccctgacattatagtgaatccacatgctattccctctcggatgacaattggacagctgattgagtgcatcatgggaaaagtggcagctcatatgggaaaagaaggagacgcgactccttttacagatgtcacggtggataatataagcaaagctctccataaatgtggctaccaaatgcgtggatttgagcgaatgtacaacggtcacacgggcagaccactcacagctatgatattcctcggaccaacttattaccaaaggttgaagcatatggttgatgacaagattcactcgcgtggacgaggtcctgtgcagatcttaacaagacagccggctgaaggacgatcccgtgacggtggtctgcgttttggagaaatggaacgcgattgcatgattgcacacggtgctgcaaacttcctgaaagagaggctgtttgatcagagcgatgcgtatagggtacacgtgtgtgaaacctgtgggctcatcgccattgcaaacctgaaaaagaattctttcgaatgcagaggttgcaagaacaaaacagatattgttcaggttcacattccatatgcttgcaaattgctcttccaagagcttatgtcaatggcgattgcaccacggatgcttactaaaggcttgaaaaatgctaaaggcagaaagtgaggagctttgttggtcgctgagtttgcaaacatttgagctctcttgttctctttgctcgcatctttgtgacaattcaaatttgaacgtgtaacgtttatttagtatttcttctgaaactaaaactacggagctatatgataatatttctctacgtattttgattattattattgtggaaattgagcaacaagg

SEQ ID NO: 1678 - DNA, 3865 bp, Tabernaemontana elegans
tgacttcgtttggactcgccttttctctcttccctcagtccgcgcttcttgtgcctgaaattcgaccaaaacttgaaaattccaccgatttctgaacataaagcattcttttgctgttaatctgtatacattttgtaagaatggagatagacgaggaatacgaacctcagtacaatgacgaagatgaggagataacgcaagaggatgcgtgggctgtgatcagtgcttattttgaggagaagggtctggtgaggcaacagctggactcgttcgacgagttcattcagaacaccatgcaagaaatcgtcgacgagtcggctgacattgagatccggcccgaatcccagcacaacccgggtcaccagtccgacttcgctgagaccatctataagatcagttttggccagatatatcttagcaaaccaatgatgacggagtctgatggtgaaactgcaaccttatttccaaaagctgctaggctgaggaacctgacatattcagcccccttgtatgttgatgtcactaagagagttatcaagaaaggacatgatggtgaagaagtcacggaaactcaagattttggtaaagtcttcattgggaaggttcctataatgctccgatcaagttactgtacattgttccagaactcagagaaggatctcaccgaacttggagaatgtccatatgatcagggtgggtattttatcataaatggaagtgaaaaggtcctcattgctcaggagaagatgagcaccaatcatgtctatgtattcaagaagaggcaaccaaacaagtatgcctttgtggcagaagtccggtccatggctgagacccaaaacaggccccccagcaccatgttcgtccgtatgctctcgcgatcaagtgccaaagggggagcctcaggccagtatatccgtgctacccttccttacattcgaacagaaattcctattattatagtgttccgagctttaggattcgtggcagacaaagatatactagaacatatttgctatgatttcaaagatactcaaatgatggagttgttgcgcccctccttggaagaagcatttgttattcaaaaccagcaggttgccttggactacattggtaaaagaggggccaccgttggtgtcacaagggaaaagaggattaaatatgctaaagagattcttcagaaagaaatgcttcctcatgtaggggttggagaatactgtgaaacaaagaaagcttactattttggctatatcatccaccggctattgctgtgtgcacttggccgaagagccgaagatgatagagatcattatggcaataagagactagatcttgctggtcctctgcttggtggccttttcagaatgctatttagaaagttaaccagagatgtgagagcttatgtccagaagtgtgtggataatggaaaagatgtcaacttgcaatttgcaatcaaagccaagaccattaccagtggacttaagtactcactggcaacgggtaattgggggcaagcaaatgctgcaggtacaagagctggtgtttcacaggtgttaaatcggttgacgtatgcctctacattgtcgcacttaaggaggctaaattctccaataggacgtgaagggaaactggccaaaccaaggcagttacacaattcccaatggggaatgatgtgtccagcggaaacccctgaaggacaagcatgtggacttgtgaagaatctagcactcatggtgtacattacagttggttcagctgcttatccaattctggaattcttagaggaatggggtactgaaaattttgaggaaatttctcctgctgtgattccagaagcaacaaaaatctttgtcaatggctgttgggttggtatccatcgtgaccctgatatgttggtcaggaccttgaggcgtctgaggcgaagggtggatgttaacactgaggtgggcgtggttcgagatattcggttgaaggaactgcggatttacacggattatggccgctgcagtcgtccattgttcattgtagaaaaacaaagactgcttatcaagaagagggatattcaagccttgcaagcgagggagtcccctgaagacggtggctggcatgaacttattgccaagggattcatagaatatattgatactgaagaagaagaaactactatgatttccatgacaattaatgatcttctaactgcaaggcttaatccggaggaggcctatactgatacctatacccattgtgagattcacccatcattgatcttgggtgtgtgcgcttcaattatacctttccctgaccataaccagtcgcctcgtaatacttatcagtcagctatgggtaagcaagccatgggtatatatgtcaccaactatcaattccggatggacactttggcctatgtgctctattatcctcaaaaaccacttgttactactcgagccatggagcacttgcacttcaggcagctacctgctggcattaatgccattgttgcaattgcttgctattcggggtacaaccaggaagactccgtcattatgaatcagtcatccatcgatcgtggcttcttcaggtcactgttcttccgctcatacagagacgaggagaagaagatggggactctggtcaaggaggagttcggtcgtccggacaggtccaatacaatgggtatgcggcatggatcttatgataaactggatgatgatggtcttgctcccccaggaacaagagtttctggtgaggatgtaatcattgggaagactacccccattcaccaggatgatgcccatgttccagcttcgttgtcttcccgttacactaagcgtgaccatagcacgagcttgcgacatagtgaaaatggtatagttgatcaagtactgctgacaacgaatgctgatggattgaggtttgtcaaagtgagggtaagatctgttcgaattcctcaaattggagacaagtttagcagtaggcatggtcagaaaggaacagttggcatgacttatacacaagaagacatgccatttactggtgaaggcataactcctgatataattgtgaatcctcatgctattccttcccgaatgactattggccagctgattgagtgtatcatgggcaaggttgctgcacatatgggcaaggaaggagatgctactccttttactgatgttactgtggataacatcagcaaagcccttcacaaatgtggttaccagatgcgtggctttgagagaatgtataatggccacacagggagaccccttacagctacaatattccttggacccacttactaccagaggctgaagcacatggttgatgataagatccactcccgtggtagaggccctgttcaaatcctcacaaggcagcctgctgaggggcgatcacgagatggtggtcttcgatttggagagatggaaagggattgcatgattgctcatggggctgctcactttctcaaggaaaggttgtttgaccagagcgatgcatatagaatccatgtttgcgagcgttgtggtctgatagctattgcaaacctcaaaaagaattcctttgagtgcagaggctgcaaaaacaaaactgatatcgtccaggttcacattccttatgcttgtaagctgctcttccaagagctgatgtcgatggctatagcacccagaatgctcacaagagacatcagacaaatcaaagaccagcataagagaggcaattgactcacatgacctattgggctgtagcttttgttgtgttactagatgtgttgttctcttaactaaagaactcggtgagatgtgtatacattgttctttgtggcaatggtgaaactacaggggagcattcctcttgtgtgtaaaatctt

SEQ ID NO: 1679 - DNA, 3764 bp, Eutrema halophilum
ctctgcggtctcgcatcgtcgttcgcttgagtagtgtttttgctctgctctgttcttcagtgaagtgataaaaatggattacaacgaatacgaacaggagcctaattacgtcgaagacgatgacgatgaggagattactcaggaagacgcatgggccgtcatatctgcttatttcgaagagaaaggtctcgttcgtcagcagctcgattcgttcgacgagtttattcagaatactatgcaagaaatcgttgatgagtctgctgatatcgagatccgacctgaatcccagcacaatcctggccaccagtcagattttgccgagacaatctacaagattagttttggacagatctatctgagtaaacctatgatgaccgaatctgacggagagactgccaccttgttccctaaggctgcaaggttaagaaacctcacatattcggctcctttgtatgttgatgttactaagagagttataaagaaagggcatgatggtgaggaagttacagagacacaggattttactaaagttttcattggaaaggttcccatcatgctccggtctagttactgcacgttgtttcagaactcggagaaagatttgacagagcttggcgaatgtccttatgatcagggcggatactttatcattaatggcagtgaaaaggttcttattgctcaggagaagatgagtacgaaccatgtttatgttttcaagaagagacagccaaataagtatgcatatgtaggtgaagtccgttccatggcggagaaccaaaataggcctccaagcacaatgtttgtgcgcatgcttgctcgtgctagtgcgaaagggggttcatctggacagtatattcggtgtactctaccatacatcagaacagaaattcctattatcatagtgtttcgtgcgttgggatttgttgctgataaggacatattggaacacatttgctatgattttgccgatactcagatgatggagttgctcaggccttcgttggaagaagctttcgttattcaaaatcaacaggttgcacttgactatattgggaaacgtggtgcaactgttggtgtaaccaaggaaaagaggataaagtatgcaaaagacatccttcaaaaagaaatgcttcctcatgttggaattggggagtattgtgagacgaagaaagcttactattttgggtatatcatacaccgactgctgctttgtgcacttggccgaaggccagaagatgatagggatcattatggtaacaaaaggctggatcttgctggtcctctgcttggagggctgtttagaatgcttttcagaaagctaacaagggatgtgagatcttatgttcagaagtgcgttgacaatggcaaagaagtcaatcttcaatttgccattaaggctaaaacaattacctctggcctgaaatattctcttgctactgggaactggggccaggcaaacgctgctggcacaagagctggagtctctcaggttctaaatcggttaacatatgcttccactttgtcacatctgaggcgtctcaattctcctatagggcgtgaaggaaaattggcaaaaccaagacaactgcacaactcgcagtggggtatgatgtgccctgctgaaacacctgaaggacaggcttgtggtctagtgaaaaacttagcgctcatggtctacataacagttggatcagctgcttatcccatattagaatttttggaagaatggggtactgagaattttgaggaaatctctccatctgttataccccaagccacaaaaatcttcgtcaatggaatgtgggttggagttcatcgagatcctgacatgttagtgaaaacgttaagacgtttgagaagaagggttgatgttaacactgaagttggcgttgttagagatatccgtctaaaagagctccggatatacactgattatggtcgttgtagccgtccgttgtttattgtggataatcagaggctgttaataaagaagagagatatctatgccctgcaacaaagggaaagtgcagaagaagatggttggcatcatctagttgccaagggctttatagaatacattgacacagaggaagaggagacgactatgatatccatgactatcaatgatctggttcaagctagactccgtcccgacgaggcatattctgaaacttacacacattgtgaaattcacccctctttgatattgggtgtatgtgcttcaatcataccatttcccgaccataatcagtcaccacgtaatacatatcaatctgctatggggaagcaagcaatgggaatatatgtcaccaactaccaatttcgcatggataccctagcctatgttctctattaccctcaaaagcctctggttacgacaagagctatggagcatcttcactttaggcaacttccggcaggaattaatgctattgttgccatttcttgttattctggatataatcaagaagattctgtcatcatgaaccagtcttcaatagatcgtggtttctttcgatccttgttctttcggtcgtacagagatgaagagaaaaaaatggggacgcttgtcaaagaagactttgggcgcccagacagagcaagtacaatgggtatgcgacatggttcttatgaaaaactggacgatgatggtcttgcacctcctggtactagagttacaggtgaagatgtaatcattgggaaaaccactccaatatctcaagatgaggctcaaggacaatcatcgagatacactagacgtgatcatagtataagcttgcgacatagtgaaactggaatggtggatcaggtgttattgactacaaatgctgatggtttgaggtttgtgaaagtgagggtcagatccgttcgtattcctcaaattggagacaaatttagtagtagacacggtcagaagggaactgtaggcatgacctacacacaggaggacatgccttggacgattgaaggcgtcactcccgatattattgtgaatccacatgccattccgtctcggatgacaattggacagctcattgagtgcatcatgggaaaagtggcagctcacatgggaaaagaaggagacgcgactccttttacagatgtcacggtggataatataagcaaagctcttcataaatgtgggtaccaaatgcgtggatttgagagaatgtacaatggtcacacgggcagaccactcacagctatgatattccttgggccaacgtattaccaaagattgaagcatatggttgatgacaagattcactcgcgtggacgaggtcctgtgcaaatcttaacaagacaaccagctgaagggcgatcccgtgatggtggtctccgttttggagaaatggaacgcgattgcatgattgcacatggtgctgctaactttttgaaagagaggctgtttgatcaaagcgatgcgtataggatacacgtctgtgaaacctgtgggctcatcgccattgcaaatctgaagaagaattcttttgaatgcagaggttgcaagaacaaaacagacattgttcaggttcacattccatatgcttgcaaattgctctttcaagagcttatgtcaatggcaattgcgccacggatgcttaccaaagacctgaattcggttaaaggcagaaagtgaggagctttgacttctgattttgtaaaacacttatgagtttttctttcactcttttcctggcatctttgtaacaaaactaaattatgagtatttctttgaaactataaaaggtatatgacatttt

SEQ ID NO: 1680 - DNA, 4295 bp, Phaseolus vulgaris
atggagttggaagacgagtacgaggagcaaatgatggaggatgaagaggaggaggacgagatcacgcaggaagacgcgtgggccgttatctcggcgtacttcgaagagaaaggcctcgttcgtcaacagctcgattccttcgacgagttcatccagaacaccatgcaggaaatcgtcgacgagtctgctgacattgaaattcgacccgagtctcagcacaatcccggccaccaatccgattctgcagagactgtttataaaatcagttttggtcagatttacttgagtaagcctatgatgacggagtctgatggagaaacggcctcgttgtttcccaaggctgctaggttaaggaacctcacgtattcagctcctttgtatgttgatgtctctaagagggttataaagaaggggcacgatggtgaagaggtcactgagactcaggatttcacgaaagttttcattggcaaggttcctataatgcttcggtctagttactgcacattataccagaattcagagaaggatttgactgagcttggggaatgtccgtatgatcaaggagggtatttcattattaatgggagtgagaaagttctgattgctcaggagaagatgagcaccaaccatgtctatgtctttaagaagaggcagccaaacaagtatgcctatgtggctgaagttcggtccatggcggagtcacagaacagaccacccagtactatgtttgtgcgcatgctctctcggactagttccaaagggggttcttcaggacaatatatacgtgccactcttccttacattcgaactgaaattcccatcattattgtgtttcgagcattggggtttgttgctgataaagatatattagaacatatatgctatgacttttcggatactcaaatgatggatttgctacgtccttctctggaagaagcgttcgtaattcaaaatcaacaggttgcacttgactatattgggaaaagaggatccactgttggtgtaaccaaggaaaagagaattaagtatgctaaggagatccttcaaaaggagatgctccctcacgttggcattggagaatattgtgagaccaagaaagcttactattttggatatatcattcaccggttactactctgtgcgcttgggcggagagctgaggatgatagggatcattacggaaacaagaggctggatctggccggtcctttacttggtggtctttttagaatgctattcagaaagctaactagagatgtcagggcatatgtacagaagtgtgttgataatgggaaagatgttaatctgcaatttgctatcaaagcaaaaactgtcactagtggacttaaatactcacttgctactggtaattgggggcaagcaaatgctgcagggactagagctggagtttcacaggtgctgaatcgtttaacctacgcatccactttatctcacttgcgaagactgaattccccaatagggcgtgaagggaagttggccaaaccaagacagctgcataattcacaatggggaatgatgtgtccagcagaaacacccgaaggacaagcctgtggactggtgaagaatctggcattgatggtctacataacagttggttcagctgcatatcctattctagagtttttggaagaatggggcacagagaattttgaggaaatttctcctgcagtgattccccaagcaacaaaaatttttgtaaatggttgctggatgggtatccatcgtgatcctgatatgttggtgagaacattaagaaagctgagacgaagggttgatgttaacactgaagttggggttgtcagagacatccgtcttaaagaattgcgtatatatacagattatggtcgttgcagtcgtcctttattcattgtggataggcaaaggcttctcataaagaagaaggatattcatgctttacaacagagggaatcccctgaagagggtggatggcatgatctagtttccaagggctttatagaatatattgacacggaagaagaagagactacaatgatttccatgacaattaatgatcttgtacaagctaggatcaatccagaagaagcatattctgatacttatactcattgtgaaatccacccatcactgattttgggtgtatgtgcttccatcataccatttcctgatcacaatcagtccccacgtaatacttatcagtctgcaatgggaaagcaagcaatgggaatatatgttaccaactaccagtttcgaatggacaccttggcctatgttttatattatccgcaaaagccactagtcactacaagagccatggagcatcttcacttccgtcaactcccagctggaattaatgccatcgtggccatttcctgttattctggttacaatcaagaagattctgtgatcatgaaccagtcatcaatagatcgtggattctttcggtctctgtttttccgttcatatagagatgaagagaaaaagatgggaaccctagtcaaagaagattttggccgtccagatagagctaacaccatgggaatgagacacggttcttatgataagctggacgatgatggtcttgcaccaccaggcacaagagtatctggtgaggatgttattattggaaagaccaccccaatatctcaggaggaggctcagggacaagctttacgatacactaggcgtgatcacagcataagcttacgtcacagtgaaactggaattgttgatcaagttttgctaacaacaaatgctgatggattgagatttgtgaaagtaagagtgagatctgttcgtataccacagattggtgacaaattcagtagtagacatggtcagaagggaactgttggtatgacttatactcaagaagacatgccttggactgtagaaggcatcacccctgatattattgtcaatccacatgccattccttctcgaatgacaattggtcagcttattgagtgtatcatggggaaggtggcagctcacatgggaaaagaaggagatgctactccttttacagatgttactgtggacagtatcagcaaagctctacacaaatgtgggtatcaaatgcgtggttttgagactatgtacaatggtcatacagggagacgtctcagtgcaatgattttccttggtcctacgtattaccaaagattgaagcacatggttgatgacaagatccattctcgtggccggggtcctgtgcagatcctcacaaggcaacctgctgagggaaggtcacgagatggaggtcttcgatttggagagatggaacgagattgcatgatagctcatggagctgctcatttcctgaaggaaaggttgtttgatcaaagtgatgcatatagggtccatgtatgtgagaaatgtgggttgatagctattgcaaatctcaagaagaattcctttgagtgcagggggtgcaaaaacaaaactgacattgttcaggttttcattccttatgcttgtaaactcctcttccaagagttaatggctatggccatagctccaagaatgcttacaaaggacgtcaaatctaaaaaggaccaaagaagaagggagcctcataaacatgtttgaccaaagacacttttcttaaattcgcacttcaagctctccagaacttggactatacatggtatctaaactacacgaacctttcaaaagtgttgggaaaatcactaccgaatagttttcttacattcctgattgatgtttccctttgcctagaagtgaaaggaactgagtattactgtacaagtgtcttgtgtccaatcaaccatgaattccagctccaatttttgaaatccttttattggtttacgggatggtcaagatgtgaatacggttaaaagttgtataaaagaagtgcctgaatcagctaaggagttttctcttctgccagttcctccttacttcacagcctatgagcatgctgattgggatcattgcttagatacccgaaatcttttacatctggtcattctttcttgggtatcgtgcaaatggaaaaggtaagtcattaattgcatctttctatgtagtgaagctaagaatatatgtagccctatttgctagtgctgtcacttggattttcatcttatgcttgtttgcttgtattcgccaaaaatgtgcatgaagatgcaaaaagagtgagtccagtgggagtttgtttccagtcaaatgtggaaaagatggagaggtgcacctcttttttgtgccaaaatgaagagaagtattacataattgattgtgtaatgtattttccttttatctttttcatg

SEQ ID NO: 1681 - DNA, 3929 bp, Brassica rapa
ggagacctttctaaaagtaaaaacactcgaagctcgccgtctctcgttcattctctgcgttgagaatggattataataacgaatacgaacaagaaccgacttacatcgaagaagatgacgacgaggagatcacccaggaggacgcctgggcggttatctctgcctatttcgaagagaaaggtctcgttcgccagcagctcgattccttcgatgagtttatccagaacactatgcaagaaatcgtcgacgagtccgctgatatcgagatccgacctgaatctcagcacaatcctggccaccaatctgatttcgccgagacaatctacaagattagttttggacagatttatctgagtaaacccatgatgacggaatctgatggagagactgccaccttgtttcccaaagctgcaaggttgaggaacctcacgtactcagctcctttgtatgtcgatgtttctaagagagttattaagaaagggcatgatggtgaggaagttacggagacacaggattttaccaaagttttcatcggaaaggttcccatcatgctccggtctagttattgtaccttgtttcagaactcggagaaagatctgacagagcttggagaatgtccttatgatcagggcggatacttcattatcaatggcagtgaaaaggttctgattgctcaggagaagatgagcacgaaccatgtttatgtttttaagaagagacagccaaataagtatgcatatgttggcgaagtccgttccatggctgagaaccaaaataggcctccaagcacaatgttcgttcgcatgcttgctcgtgctagtgcaaaagggggttcatctggacagtatattcggtgtactctcccttacatcaaagcagaaattcctattatcattgtatttcgtgcattgggatttgttgccgataaggacattttggaacacatttgctatgactttgccgataaccagatgatggagttgctcaggccttctttagaagaagcatttgttattcaaaatcagcaggttgctctcgactatattgggaaacgtggtgcacctatgggtgtaaccaaggaaaagaggataaagtatgcaaaagatatccttcagaaagaaatgcttcctcatgtaggagttggggagttttgtgagacgaagaaagcttactatttcgggtatatcatacaccggctgctgctttgtgcacttggccgaaggccagaagatgatcgggatcattatgggaacaaaaggctggatcttgctggtcctttacttggagggctatttagaatgcttttcagaaagctgacgagggatgtgagatcttatgtacagaagtgcgttgacaatggcaaagaagtcaatcttcaatttgccattaaggctaaaacaatcacctctggcctgaaatattctcttgctactgggaactggggccaggcaaacgctgctggcacaagggctggagtctctcaggttctaaatcggttaacatatgcttccactttgtcacatctgaggcgtctcaattctcctattgggcgtgaaggaaaattggcaaaaccaagacaactgcacaactcacagtggggtatgatgtgccctgctgaaacacctgaaggacaggcttgtgggctagtgaaaaacttggcgctcatggtctatattacagttgggtcagctgcttatccgatcttggaatttctggaagaatggggaactgagaattttgaggaaatctctccatcagttataccccaagccacaaaaatctttgttaatggaatgtgggttggagttcatcgagatcctgacatgttggtgaaaacgttgagacgtttgagaagaagggttgatgttaacactgaagttggcgttgttagagatattcgtctgaaagagctccggatatacactgactatggtcgttgtagtcgtcccttgtttattgtggataaccagaggctattaataaagaagagagatatctatgctctgcaacaaagggaaagtgcagaagaagatggttggcatcatctagttgcaaaagggtttatagaatacatagacacagaggaagaggagacgactatgatatccatgactatcagtgatctggttcaagccagactccgtcccgacgaggcatattctgaaacttacacacactgtgagattcacccttcgttgatattgggcgtatgtgcttcgattataccttttcccgaccataaccagtcaccccgtaatacatatcaatctgctatgggaaagcaagctatgggaatatatgtcaccaactaccaatttcgcatggatacattagcctatgttctctattaccctcaaaagcctctggttaccacacgagctatggagcatcttcattttaggcaacttccagcagggattaatgctattgttgccatttcttgctactctggatataatcaagaagattctgtcatcatgaatcagtcttcaatagaccgtggtttctttagatccttgttctttcggtcatacagggacgaggagaaaaaaatggggacccttgtcaaagaagactttggacgcccagacagggcaactacgatgggtatgcgacatggttcttatgagaaactggatgatgatggtcttgcacctcctggtactagagtttcaggggaggatgtaatcattgggaaaaccactcccatatctcaagatgaggctcaaggacaatcatcacgatacaccagacgtgatcatagtataagcttgcgacatagtgaaactggaatggtcgatcaggtgttgttgaccacaaatgctgatggtttgaggtttgtgaaagtgagggttagatctgttcgtatccctcaaattggagacaaattcagcagtagacacggtcagaagggaactgttggcatgacctacacacaggaggacatgccttggacaattgaaggcgttacccctgacattatagtgaatccacatgctattccctctcggatgacaattggacagctgattgagtgcatcatgggaaaagtggcagctcatatgggaaaagaaggagacgcgactccttttacagatgtcacggtggataatataagcaaagctctccataaatgtggctaccaaatgcgtggatttgagcgaatgtacaacggtcacacgggcagaccactcacagctatgatattcctcggaccaacttattaccaaaggttgaagcatatggttgatgacaagattcactcgcgtggacgaggtcctgtgcagatcttaacaagccagccggctgaaggacgatcccgtgacggtggtctgcgttttggagaaatggaacgcgattgcatgattgcacacggtgctgcaaacttcctgaaagagaggctgtttgatcagagcgatgcgtatagggtacacgtgtgtgaaacctgtgggctcatcgccattgcaaacctgaaaaagaattctttcgaatgcagaggttgcaagaacaaaacagatattgttcaggttcacattccatatgcttgcaaattgctcttccaagagcttatgtcaatggcgattgcaccacggatgcttactaaaggcttgaaaaatgctaaaggcagaaagtgaggagctttgttggtcgctgagtttgcaaacatttgagctctcttgttctctttgctcgcatctttgtgacaattcaaatttgaacgtgtaacgtttatttagtatttcttctgaaactaaaactacggagctatatgataatatttctctacgtattttgattattattattgtggaaattgagcaacaaggtgagaaaatcctttggaccatcgacaataacttcttgtttgacattttaaaagttctcgttcttgagaatcacaagggccatgtgaaaacagttattatcct

SEQ ID NO: 1682 - DNA, 3912 bp, Malus domestica
aatcccaatccgccaccgtagatcatggaggaggagcacgagtacgacgatcagcagtacatggaggacgacgacgaagacgaaatcacgcaggaggacgcgtgggccgtcatctctgcctacttcgaggagaagggcttggtgcgccagcagctcgactcgttcgacgagttcattcagaacacaatgcaggagattgtcgacgagtcggccgatatcgagattcggcctgagtcgcagcacaacccggggcaccagcctgatttcgccgagactgtatgcaagattagctttggtcagatttatttgagtaagcccatgatgaccgaatctgatggagaaactgcaaccttatttcccaaagctgcaaggctgagaaatctgacgtactcagcacccttgtatgtggatgtctcaaagaggatgataaagaaaggacacgatggcgaagaactcaccgagacccaggatttcaccaaagtattcattgggaaggttcctataatgcttcggtctagttattgcacactgtaccagaattcagagaaagatttaactgagctgggagagtgtccatacgatcaaggtggatattttattataaatgggagtgaaaaggttcttattgctcaagagaagatgagcaccaatcatgtctatgtgttcaagaagaggcagccgaacaagtatgcctatgtggctgaagttcggtctatggcggagtctcaaaacaggccgcccagtaccatgtttgttcggatgcttgcccggactagttctaaagggggttcttcgggacagtatatcaaagctacacttccttatattaaaggggaaattcctattatcatcgttttccgggctcttgggtttgttgccgataaagacatcctcgagcacatatgttatgacttttctgatactcaaatgatggagttgctcagaccttctttggaagaagcatttgtgattcagaatcaacaggttgcattagattatattggaaagagaggtgcaaatgttggtgtaagtagagacaagagaatcaagtacgcgaaagagattctacaaaaggaaatgcttccacacgttggtgttggagaattttgtgagacaaagaaagcttactattttggatatatcgttcacaggcttctactctgtgcacttggtcggaggccagaggatgacagggatcattatggaaacaagcggcttgatcttgctggtcccttacttggaggcttgtttagaaatctattcaggaagttgactaaggatgtgagagcttatgcacagaagtgtgttgacaatggaaaggatcttaatctgcaatttgccatcaaagctaaaaccatcacgagtggcctcaaatattcacttgccactggaaactggggacaagcaaatgcagctggtacaagggctggagtgtcgcaggtgttaaatcgtttgacatacgcatccaccctctcacacttgagaagactgaattctccaatagggcgtgaagggaaattggctaaaccacgtcagctgcataattcgcaatggggaatgatgtgcccagctgaaacacccgaaggccaagcatgcgggcttgtcaagaatcttgcgttgatggtatacataacggtaggatcagctgcatatccaatcttggaatttttggaagaatggggtacagaaaactttgaggaaatttcacctgcggttataccccaagctacaaaaatttttgttaacggctgttgggttggaatccatcgtgatcctgaaatgttggtgagaacattaagaaagctaaggcgacgggttgatgtcaacactgaagttggggttgtgagggatatccgtctgaaagaattgcggatatatactgactatggccgttgcagtcgtccattattcattgtggacaaacagaggcttctcataaagaagcgagatattcatgcattgcagcagagggaaagccctgaagatgctggttggcatgaccttgtagcgaagggatatattgaatatattgacactgaagaagaggagactacaatgatttccatgacaattaatgatcttgtccaagcaagactcaatcctgaggaggcatattcggacacttatacacattgtgaaatccacccatcacttattttgggtgtttgtgcttctattataccatttcctgatcataatcagtctccacgtaatacgtatcaatctgctatggggaagcaagctatggggatttatgtcaccaattatcagttccggatggatacattggcgtatgttttatactatcctcagaaaccacttgtcaccacacgagccatggagcatctccacttccggcagcttcccgctggcatcaatgctattgttgccatttcctgttattccggttataaccaggaagattctgtcattatgaatcaatcctctgtggaccgtggattcttccggtcactattctttcgatcttatagggatgaggagaaaaagatgggaacccttgtcaaagaggattttgggcgtcctgacagagcaaatactatgggtatgcgacatggttcttatgacaaattggatgatgatggtcttgctcctcctggaactagggtttcaggtgaggatgtcatcataggaaagaccacacccatggctcaggacgaggctccagggcaagcgacatcgcgttacacgcggcgtgaccacagcataagcttgcgccacagtgaaaccggcatagttgatcaggttctactgacgaccaatgccgatgggttgcggtttgtcaaagtaagggtgaggtcagtcagaataccgcagattggtgacaaattcagtagcagacatggacagaaggggacagtgggcatgacttatacgcaggaagacatgccatggactgtggaaggggtcacacctgatataatcgtgaacccacacgctattccgtctcgtatgacaattggtcagctgattgagtgtatcatggggaaggttgcagctcacatgggaaaggaaggagatgctactccttttacagatgtgacggtggacaatatcagtaaagctcttcacagttgtggttatcaaatgcgtggattcgagaccatgtataatggtcacacgggcaggcggctcagcgctatgatattccttggccccacatattaccaaagactgaagcacatggtcgacgacaagatccattcacgtggacggggcccagtgcagatcctcacaaggcagccagctgagggacggtctcgtgatggtggtctacgatttggagaaatggaacgagattgcatgattgcccatggtgctgcccactttctgaaagaaagattgttcgaccagagtgatgcatatagggttcatgtctgcgagcgttgtgggttaatagctattgcaaatctcaagaagaattcgtttgagtgcaggggttgcaagaacaaaactgacattgttcaggtttacattccttatgcctgcaagctgctattccaagagctcatgtcaatggccatagcgccaagaatgctcacaaaggacataaagccggccaaaaaccaaaagaagaaaggaggctgatatagtcgaagttgattgcgaaagcagacacgtcctttgttttcgctgttttcgtcaaaacaagcatggagttaacgattagaggccttaccgtcataaaaatagacacgccggagtttaaggaggttgaaggcggctcagaaggttcatcggttcctgccttggggggattggaagacataatcagaatgagttgagatgtattttcatgggattcgaatggctttgtgtttggaatcggttcaaactgtattgttctggtctcgttttaagttgagagttggaacctcctaattgtaatttttc

SEQ ID NO: 1683 - DNA, 3737 bp, Arabidopsis lyrata
gtctctctctttgttctttagagagctcgagtagtgttttgctctgctccgatcttaagtgagtgagaaaaaatggagtacaacgaatacgaacctgaacctcaatatgtagaagacgatgatgatgaggaaattacccaggaggacgcgtgggctgttatatctgcttatttcgaagagaaaggtctcgttcgtcagcagctcgattcgtttgatgagtttattcagaatactatgcaagaaatcgttgatgagtctgctgatatagagatccgacctgaatctcagcacaatcctggccatcagtccgattttgcggagacaatctacaagattagctttggacagatttatctgagtaaacctatgatgacagagtctgatggagagactgccaccctgttccctaaggctgcgaggttgagaaacctcacatattctgctcctttgtatgtcgatgttactaagagagttataaaaaaagggcatgatggtgaagaagttacagagacccaggattttactaaagttttcattggaaaggttcccatcatgctccggtctagttactgtaccttgtttcagaactcggagaaagacctgacagagcttggagaatgtccttatgatcagggtggatacttcattattaatggcagtgaaaaggttcttattgctcaggagaagatgagtacgaatcatgtttatgtgttcaagaagagacagccaaataagtatgcttatgttggtgaagtccgttctatggctgaaaaccaaaataggcctccaagcacaatgtttgtgcgtatgcttgctcgtgctagtgcaaaagggggttcatctggacagtatattcgatgtactcttccatacatcagaacagaaattcctattatcatagtatttcgtgcactgggatttgttgccgataaggacatattggaacacatctgctatgattttgccgatacccagatgatggagttgctcaggccttccttggaagaagctttcgttattcaaaatcagctggttgcacttgactatattggaaaacgtggtgcaactgttggtgtaaccaaagagaaaaggataaagtatgcgaaagatatccttcagaaagaaatgcttcctcatgtaggaattggggaatattgcgagacgaagaaagcttattattttgggtatatcatacaccggctgctgctttgtgcactgggccgaaggccagaagatgatagggatcattatggtaacaaaaggctggatcttgctggtccattacttggagggctgtttagaatgcttttccgaaagttaacaagggatgtgagatcttatgttcaaaagtgcgttgacaatggcaaagaagtcaatcttcaatttgccatcaaggctaaaacaattacctctggcctgaaatattctcttgctactgggaactggggccaggcaaacgctgctggcacaagagctggagtttctcaggttcttaatcggttgacgtatgcttcgactttgtcacatctgaggcgtctcaattctccaataggacgtgaaggaaaattggcaaagccaagacaactgcacaactcacagtggggaatgatgtgccctgctgaaacacctgaaggacaggcttgtggtctagtgaaaaacttggctctcatggtctacataacagttgggtccgctgcttatcctatattggaatttttggaagaatggggtactgagaattttgaggaaatatctccatctgttataccccaagccacaaaaatctttgtcaatggaatgtgggttggagttcatagagatcctgacatgttggtgaaaacgttgagacgtttgagacgaagggttgatgtcaacactgaagttggcgtagttagagatatacgtcttaaagagctccgaatatacactgattatggccgttgtagccgtccgctgtttattgtagataatcagaggctcttaataaagaagagagatatttatgctctgcaacaaagggaaagtgcggaagaagatggttggcatcatctggttgctaagggctttatagaatacatagacacagaggaagaggaaacgaccatgatttccatgactatcagtgatctggttcaagctagactccgcccagaggaggcttatactgaaaactacacacattgtgagattcacccatctctgatattgggggtctgtgcttcaatcataccatttcctgaccataatcagtcacctcgtaatacatatcaatctgccatggggaagcaagcaatgggaatttatgtcaccaactaccaatttcgcatggataccttagcctatgttctctattacccgcaaaagcctctggttactacaagagctatggagcatcttcactttaggcaacttccagcaggaattaatgctattgttgccatttcttgctattctggatataatcaagaagattctgtcatcatgaatcagtcttcaatagatcgtggtttctttcgatccttgttctttcggtcttacagagatgaggagaaaaaaatggggactcttgtcaaagaagactttgggcgcccagacagaggaagcacaatgggtatgcgacatggttcttatgataaactggatgatgatggtcttgcacctcctggtactagagtttcaggtgaagatgttatcattgggaaaaccactccaatatctcaagatgaggctcaaggacagtcatcacgatacactagacgcgaccatagtataagcttgcgacatagtgaaactggaatggtggatcaggtgttattgactacaaatgcagatggtttgaggtttgtgaaagtgagggtcagatctgttcggattcctcaaattggagacaaatttagtagtagacatggtcagaagggaactgttgggatgacctacacgcaggaggacatgccatggacgattgaaggcgtcactccggacattattgtgaatccacatgctattccgtctcgaatgacaattggacagctaattgagtgcatcatgggaaaagtggcagctcacatgggaaaagaaggagatgcgactccttttacagatgtcacggtggataatataagcaaagctcttcataagtgtgggtaccaaatgcgtggatttgagagaatgtacaatggtcacacgggcagaccactcactgctatgatattccttgggccaacgtattaccagagattgaagcatatggttgatgacaagattcactcccgtggacgaggtcctgtgcaaatcttaacaagacaaccagctgaagggcgatcccgtgatggtggtctccgttttggagaaatggaacgcgattgcatgattgctcatggtgctgcacactttttgaaagagaggctgtttgatcagagtgatgcgtatagggtacatgtgtgtgaagtctgtgggctcatcgccattgcaaatctgaagaagaattcttttgaatgcagaggttgcaagaacaaaacagatattgttcaggtatacattccatatgcatgcaaattgctctttcaagagcttatgtcaatggctattgcgccaaggatgcttaccaaacacctgaaatcggctaaaggcagacagtgaggagctttgtgctctgattttgtagaaacttaaaccttcgttctcttttggtcagagctttgtaacaaaactaaatttacaaaattgtgtaatgtttc

SEQ ID NO: 1684 - DNA, 4011 bp, Amsonia hubrichtii
gacttggccctttctcctccctacataaaacccgcacttcccgtgtctgaaattcgaccaagaatttgaaaaaattcccactgattttactgaaaagaaagttttctttttgctggttatttgaataattttgtaagaatggagatagacgaggagtacgagcaacagtacaatgatgaggaggaggagataacgcaagaggatgcgtgggctgtgatcagtgcttactttgaggagaagggtctggtgagacaacaactggactcgttcgatgagtttattcagaacactatgcaagaaatcgtcgacgaatccgctgacattgagatccgacccgaatcacagcacaaccccggtcaccagtccgacttcgctgagacaatttataagatatgttttggtcaaatatatcttagcaaaccaatgatgacggagtctgatggagaaacagcaaccttgtttccaaaagctgctaggctgaggaacctgacatactcagctcctttgtatgtcgatgtcactaagagagttatcaagaaaggacatgatggtgaagaagtcactgaaactcaagattttggcaaagtcttcatcgggaaggttcctataatgctccggtcaagttactgtacattgtaccagaactcagagaaggatctcaccgagcttggagaatgcccatatgatcagggtgggtattttatcataaatggaagtgaaaaggtgctgattgctcaggagaagatgagcaccaatcatgtctatgtattcaagaagaggcaaccaaacaagtatgcgtttgtggcggaagtgcggtccatggctgagacccaaaacaggcctccgagcaccatgtttgtgcgtatgctctctcgatcgagtgccaaagggggagcctcaggccagtatatccgtgctactctaccatacattcgaacagaaatccctattattatagtgttccgagctttaggatttgtggcagataaagatatactggaacatatttgctatgattttaaagatactcaaatgatggagttgttgcgcccctccttggaagaagcatttgtaattcaaaatcagcaggttgccttggactacattggtaaaagaggggccacagttggtgtcactagggaaaagaggattaaatatgctaaagagatccttcagaaagaaatgcttcctcatgtaggggttggagaatattgtgaaaccaaaaaagcttactattttggctacatcatccaccgactattgctgtgtgcacttggtcgaagagcagaagatgatagagatcattatggcaataagagactagatcttgctggtcctctgcttggtggccttttcagaatgctattccggaagttaaccagggatgtgagagcttatgtccagaagtgtgttgataatggaaaagatgtcaacttgcaatttgcaatcaaagccaagacgattacaagtggactcaagtattcacttgcaacgggtaattgggggcaagcaaatgctgcgggtacaagagctggtgtttctcaggtgttaaatcggttgacttatgcctcgactttgtctcacttaaggaggctgaattctccaataggacgtgaagggaaacttgccaaaccaaggcagttgcacaattctcagtggggaatgatgtgtccagcagaaacccctgaaggacaagcatgtggactagtgaagaatctagctctcatggtgtatgttaccgttggttcagcagcatatccaattctggaattcttagaggaatggggtactgaaaattttgaggaaatttctcctgctgtgattccggaagcaacaaaaatctttgtcaatggctgttgggttggtatccatcgtgatcctgatatgttggtcaggaccttgaggcgtctgagacgacgggtggatgttaacactgaggtgggtgtggttcgggatattcggttgaaggaactgcggatttatactgattatggccgctgcagtcgtccattgttcattgtagaaaaacaaagactgcttatcaagaagagggatattcaagccttacaagcaagggaatccccagaagacggcggctggcatgaccttattgccaagggattcatagagtatatcgatactgaagaagaggaaactactatgatttccatgacaattagtgatctggtaactgcaaggcttaatccagaggaggcctatacagatacttatacgcattgtgaaattcacccatcgttgattttgggtgtgtgcgcttcgattataccattccctgatcacaaccagtcacctcgtaatacttaccaatcggctatgggtaagcaagccatgggtatatatgtcaccaactatcaattccggatggacactttggcctatgtgctctattatcctcaaaaaccccttgttactactcgagccatggagcacttgcacttcaggcagctacctgctggcattaatgccatcgtgtcaattgcctgctattctgggtacaaccaagaagactctgttatcatgaatcagtcatccattgaccgtggcttcttcagatcactgttcttccgctcatacagagacgaggagaagaagatgggtactctggtgaaggaggatttcggtcgtccagacaggtccaatacaatgggtatgcggcatggatcttatgataaactggacgatgatggtcttgctcccccaggaactagagtttctggtgaggatgtaatcattgggaagactacccccattcaccaggatgatgcccatgttccagggtcgttgtcttcccgttacactaagcgtgaccatagcacaagcttgcgccacagtgaaaatggtatagttgatcaggtattgcttacaacaaatgctgatgggttgaggtttgtgaaagtgagggtgagatctgttcgaattcctcaaattggagacaagtttagtagtaggcatggtcagaaaggaacagttggcatgacctacacacaagaagacatgccatttactggtgaaggaataactcctgatatcattgtgaatcctcatgctattccttcccgaatgactattggccagctaattgagtgtatcatgggcaaggttgctgcacatatgggcaaggaaggagatgctactccttttactgatgttactgtggataacatcagcaaagcccttcacaaatgtggttaccagatgcgtggctttgagagaatgtataacggccacacggggagaccccttacagctacaatattccttggacccacttactaccagaggctgaagcacatggttgatgataagatccactcccgtggtagaggccctgttcaaatcctcacaaggcagcctgctgaggggcgatcacgtgacggtggtcttcgatttggagagatggaaagggattgcatgattgcgcacggtgctgctcactttctcaaggaaaggttgtttgaccagagtgatgcttatagaatccatgtttgcgagcgttgtggcctgatagctattgccaacctcaaaaagaattccttcgaatgtagaggctgcaaaaacaaaactgatattgtccaggttcacattccatatgcatgtaagctgctgttccaagagctgatgtcgatggctatagcacccagaatgctcacaagagatatcaaacaaatcaaagaccaacagaagagaggcaattgactcacttgacctcttgggccttatattgtgtaactggatatgttgttctcttaagaactggaggagagatatgtgtacttcattgttgtggcaaatttggaactttaggaaagttgtcctcttggtgtaaaattttagctctcttttcggattttggataatcaatgctatacttataatttcctcctttttgaggattcattctatagttgtttgggtgcaaggagaggaatctctttgagcattatgtcatcaactgttctgtgggttgcttgtattaatatattgggattc

SEQ ID NO: 1685 - DNA, 3904 bp, Plantago ovata
cgattcgacatggatgaagatgatatgtactacgggcaggaggagtacggcggccaggaggaggagttgtacgataacaatgataatgagaatccagttgatgaagaagatgaaatcacgcaggaagacgcttggacagtcatcagtgcctactttgaagagaaagggcttgtgaggcagcagctggattcatttgatgagttcatccaaaatactatgcaggaaatagtcgacgagtcgtctgatatcgagatccgacccgagtcgcagcacaacccgggacaccagcccgattttgctgagaccatctataagatcagctttggtcagatttacctcagcaagccgatgatgacggagtctgatggagaaactgcaactttgtttcctaaggctgcaaggctaaggaacttgacatattcagcgccattgtatgtggatgtgagcaagaaagtgattaagaaaggtcatgatggtgaagaagttactgaaactcaggatttcactaaagtgttcattggcaaagttccgattatgcttcgttcgagttactgtacactataccaaaattcagagaaagacttgacggagcttggagagtgtccatatgaccagggtggttatttcattatcaatggaagtgagaaggtcttaattgcccaagaaaagatgagcacaaatcatgtctatgtcttcaaaaagaggcaaccaaataagtatgcttatgttgcggaagtccggtcaatggcagaggctcaaaacaggcctcccagcacgatgtttgtccggatgctttcaaggacaagtgccaaagggggatcatcagggcaatatatacgggccaccctgccatacatacgcactgagattcccatcattatagttttccgtgcattaggatttgtcgcggacaaagatatactggagcacatatgttacaattttcaggatactcaaatgatggagatgctaaggccctccctggaggaagcattcgtgatccaaaatcaacaggttgccctggactatatcgggaaaagaggagccactgttggggtcaccaaggagaaaagaatcaagtatgctaaagagattctccaaaaagaaatgctccctcatgttggcgttggcgaatattgtgaaacaaagaaagcttattattttggttatatcatccaccggcttctgctatgtgccattggacgaagaccagaagacgacagagaccactatggcaataagagactggatcttgctggtcctctgctcggtggcctgtttcgaatgttattcagaaagttgacaagagatgtgagatcttatgttcaaaagtgtgtagataatggaaaagatgtgaatttgcaatttgcgataaaagcaaaaactattaccagtggtcttaaatactcccttgctacgggcaattggggccaagcaaatgctgcagggacaagggctggggtttctcaggtgttgaataggttgacatatgcctctacattgtcacacttgaggagactaaattcacccattggacgtgaaggaaaacttgccaagccaaggcagttgcacaattcacagtggggaatgatgtgtcctgctgaaaccccagagggacaagcatgtggattggtgaagaatctcgcgttgatggtctatatcactgttggttccgcagcatacccaattttagaatttttggaggaatggggtacagaaaatttcgaggaaatttcacctgctgtgattcctaaagcaacaaagatcttcgtgaatggttgctgggttggtattcaccgcaacccgaaaatgttggtgtcgactcttaaacgactgaggaggcgtgttgatgttaatactgaggttggggtggtgcaagatattcgtctgagtgaattgcgtatatatacagattatggacgctgcagtcgcccattgttcatagtggaaaatcaaaaacttctcattaaaaagaaggatatcgttgagttacagaagagggaatctgatgatggtggctggcatgatttggtccaaaaaggatttatagaatacattgataccgaagaagaggaaataacaatgatttccatgacgataagtgatcttagcagtgcaaggaacaatccaggcgaggcatattcagagacttatactcactgtgagattcacccatccttgattcttggtgtctgtgcttcaatcattccatttcctgatcacaatcagtctcctcgtaatacttaccagtcagctatgggtaagcaagcaatgggtatatacgtcaccaattaccaattccgaatggacacattggcttatgttctgtactaccctcaaaagccactagtcaccactagagcaatggagcatttgcattttaggcaactacctgctggtatcaatgctattgtggccattgcctgctattccggatacaatcaggaagattctgtcattatgaaccagtcctcgatcgatcgtggcttcttcaggtctctattcttccgttcatatagagacgaggagaagaagatgggaacacttgtcaaagaggattttggacgcccagatcgagccaacaccatgggcatgcgtcatggttcctatgataaattagatgatgatggtcttgctcctcctgggactagatgttcgggagaagatgtgattataggaaaaacaaccccaatatcccccgaggaagcaacagggcctgctgctcgttacacaaagcgtgatcacagcacaagcttacgacacagtgaaactggaatggtggatcaggttctcttgaccacgaatgctgatgggttgcgttttgtaaaggtgagggtcagatctgtccgagtacctcaaattggtgacaagttcagtagtcgacatggtcagaagggaacagtgggtatgacttacacacaagaagacatgccatggagtgtggaaggtatcacccccgacattattgtcaatcctcatgctattccgtcccgtatgactatcggtcagcttattgagtgtatcatgggaaaagttgccgcacatatgggaaaggaaggagatgctactccatttaccgacgttactgtggataatataagcaaagctctccacaaatgtgggtatcagatgcgaggttttgagacaatgtataacggccacactgggagaaagctcacatctatgattttcctcgggcccacttattaccagaggctgaagcatatggttgatgataagattcattctcgtggtagagggcctgttcagatcctcacaaggcaacctgctgaaggacggtctcgtgatggtggtcttcggtttggtgagatggaaagagactgcatgattgcacatggcgctgctcatttcctcaaggaaagattgtttgaccagagcgatgcatacagaatccatgtctgtgagcaatgtggattgattgctatagccaacttgaaaaagaactcgttcgagtgcaggagttgcaaaaacaagacagatattgttcaggtccatattccatatgcttgtaagttgcttttccaagagctaatgtccatggctatagctccaaggatgctgacgaaggatattaaacaatcgaaagagcagaaaaagaaaggggtttgatgtgatcgactgagatgagttcaagagagtggtgacataatgttgggatcaattatgccacagaacgtacaaaagaaagaaagaaaaagcaactacaagtaggaatgtgaaattataatatactgttgagagaagaaaactactactaggcttccagttttcatcagatattttatttgaacttgctaaatatgatatgccccttgggaatattgttaaatctttggttctgatactctgtttgattgaatgatggaagtttatgcgatgccag

SEQ ID NO: 1686 - DNA, 3809 bp, Arabidopsis thaliana
ctctgcgtcctgtctctctctttgtctccgagagctcgagtagtgaagtttgctgtgctctaatcttcagagagtgagaataaatggagtacaacgaatacgaacctgaacctcaatatgtagaagacgatgacgatgaggagattacccaggaggacgcgtgggctgttatatctgcttatttcgaagagaaaggtctcgttcgtcaacagctggattcgtttgatgagtttattcaaaatactatgcaagaaatcgttgatgagtctgctgatatcgagatccgacctgaatctcagcataatcctggccatcagtccgattttgcggagacaatctacaagattagctttggacagatttatctgagtaaacctatgatgacagagtctgatggagagactgccaccctgttccctaaggctgcaaggttgagaaatctcacatactctgcgcctttgtatgtcgatgttactaagagagttattaagaaagggcatgatggtgaagaagttacggagacacaggattttactaaagttttcattggaaaggttcccatcatgctccggtctagttactgtaccttgtttcagaactcggagaaagacctgacagagcttggagaatgtccttatgatcagggtggatacttcattattaatggcagtgaaaaggttctgattgctcaggagaagatgagtacgaatcatgtttatgtgttcaagaaaaggcagccaaataagtatgcttatgttggtgaagtccgttctatggctgaaaaccaaaataggcctccaagcacaatgtttgtgcgtatgcttgctcgtgctagtgcaaaagggggttcatctggacagtatattcgatgtactcttccatacatcagaacagaaattcctattatcatagtatttcgtgcactgggatttgttgccgataaggacatattggaacacatctgctatgattttgccgatacccagatgatggagttgctcaggccttccttggaagaagctttcgttattcaaaatcagctggttgcacttgactatattggaaaacgtggtgcaactgttggtgtaaccaaggaaaaaaggataaagtatgctagagatatccttcagaaagaaatgcttcctcatgtaggaattggggagcattgcgagacaaagaaagcttactattttgggtatatcatacaccggctgctgctttgtgcacttggccgaaggccagaagatgatagggatcattatggtaacaaaaggctggatcttgctggtcctttacttggagggctatttagaatgcttttccgaaagttaacaagggatgtgagatcttatgttcaaaagtgcgttgacaatggcaaagaagtcaatcttcaatttgccattaaggctaaaacaattacctctggcctgaaatattctcttgctactgggaactggggccaggcaaacgctgctggcacaagagctggagtctctcaggttcttaaccggttgacatatgcttcgactttgtcacatctgaggcgtctcaattctccaataggacgtgaaggaaaattggcaaaaccaagacaactgcacaactcacagtggggaatgatgtgccctgctgaaacacctgaaggacaggcttgtggtctagtgaaaaacttggctctcatggtctacataacagttgggtcagctgcttatcctatattggaatttttggaagaatggggtactgagaattttgaggaaatatctccatctgttataccccaagccacaaaaatctttgtcaatggaatgtgggttggagttcatagagatcctgacatgttggtgaaaacgttgagacgtttgagacgaagggttgatgtcaacactgaagttggtgtagttagagatatccgtcttaaagagctccggatatacactgattatggacgttgtagccgtccgttgtttattgtagataatcagaagctcttaataaagaagagagatatctatgctctgcaacaaagggaaagtgcagaagaagatggttggcatcatctggttgctaagggctttatagaatacatagacacagaagaagaggaaacgaccatgatttccatgactatcagtgatctggttcaagctagactccgcccagaagaggcttatactgaaaactacacacattgtgagattcacccatctctgatattgggggtctgtgcttcaatcataccatttcctgaccataatcagtcacctcgtaatacatatcaatctgccatggggaagcaagcaatgggaatttatgtcaccaactaccaatttcgcatggatacgttagcttatgttctctattatccacaaaagcctttggttactacaagagctatggagcatcttcactttagacaacttccagcaggaattaatgctattgttgccatttcttgctattctggatataatcaagaagattctgtcatcatgaatcagtcttcaatagatcgtggtttctttcgatccttgttctttcggtcttacagagatgaggagaaaaaaatggggacgcttgtcaaagaagactttgggcgcccagacagaggaagtacaatgggtatgcgacatggttcttatgataaactggatgatgatggtcttgcgcctcctggtactagagtttcaggtgaagatgttatcattgggaaaaccactccaatatctcaagatgaggctcaaggacaatcatcccgatacactagacgtgatcatagtataagcttgcgacatagtgaaactggaatggtggatcaggtgttattgactacaaatgcagatggtttgaggtttgtgaaagtgagggtcagatccgtgcggattcctcaaattggagacaaatttagtagtagacacggtcagaagggaactgttggcatgacctacacgcaggaggatatgccatggacgattgaaggggtcactccggacattattgtgaatccacatgctattccgtctcgaatgacaattggacagctaattgagtgcatcatgggaaaagtggcagctcacatgggaaaagaaggagatgctactccctttacagatgtcacggtggataatataagcaaagcccttcataagtgtgggtaccaaatgcgtggatttgagagaatgtacaatggtcacacgggcagaccactcacagctatgatattccttggaccaacatattaccaaagattgaagcatatggttgatgacaagattcactcgcgtggacgaggtccggtgcaaatcttaacaagacaaccagctgaagggcgatcacgtgatggtggtctccgttttggagaaatggagcgcgattgcatgattgcacatggtgctgctcactttttgaaagagaggctgtttgatcagagtgatgcgtatagggtacatgtgtgtgaagtctgcgggctcattgccattgcaaatctgaagaagaattcttttgaatgcagaggttgcaagaacaaaacagatattgttcaggtatacattccatatgcttgcaaattactctttcaagagcttatgtcaatggctattgcaccaaggatgctcactaaacacctgaaatcggctaaaggcagacagtgaggagcttgcaatctgattttgtagaaacttgaactttccttctctcttggtcatagctttgtaacaatactaaatttacaaatttgtgtaatatttctgtactaattcttaaagctagaaaggtaccttataagatatatttatggattctttagtaaa

SEQ ID NO: 1687 - DNA, 3965 bp, Malus domestica
cctccgccgtaaatcatggaggaggagcacgagtacgacgatcagcagtacatggacgacgacgatgaagatgaaatcacgcaggaggacgcgtgggccgtcatctccgcctacttcgaggagaagggcttggtgcgccagcagctcgactcgttcgacgagttcattcagaacacaatgcaggagattgtcgacgaatcggccgatatcgagattcggcccgagtcgcagcacaacccggggcaccagcccgatttcgccgagacggtatgcaagattagctttggtcagatttatttgagtaagcccatgatgaccgaatccgatggagaaactgcaaccttatttcccaaagctgcaaggcttagaaatctgacgtactcagcacccttgtatgttgatgtctcaaagaggatgataaagaaagggcacgatggcgaagaactcactgagacccaggatttcaccaaagtattcattgggaaggttcctataatgcttcggtctagttattgcacgctgtaccagaattcggagaaagatttaactgagctgggagagtgtccatacgatcaaggtggatattttattataaatgggagtgaaaaggttcttattgctcaagagaagatgagcaccaaccatgtctatgtgttcaagaagaggcagcctaacaagtacgcctatgtggctgaagttcggtctatggcggagtctcaaaacaggccgcccagtaccatgtttgttcggatgcttgctcggactagttctaaagggggttcttcgggacagtacatcaaagctactcttccgtatattaaaggtgaaattcctattattattgtgttccgggctctcgggtttgtagcggataaagacatcctagagcacatatgttatgacttctctgatactcaaatgatggagctgcttagaccttctctggaagaagcatttgtcattcagaatcaacaggttgcactagattatattggaaagagaggtgcaaatgttggtgtaagtagagacaagagaatcaagtatgcgaaagagattctacaaaaggaaatgcttccacacgttggtgttggagaattttgtgagacaaagaaagcttattattttttggatatatcgtccacaggcttctactatgtgccctaggacggaggccagaagatgacagggatcattatggcaacaagaggcttgatcttgctggtcccttactcggaggcttgtttcgaaatgtatgctattcaggaagttgactaaggatgtgagagcttatgcacagaagtgtgttgacaatggaaaggatcttaatctgcaatttgccatcaaagctaaaaccattacgagtggcctcaaatattcacttgccactggaaactgggggcaagcaaatgcagctggtacaagggctggagtgtcgcaggtgttaaatcgtttgacatacgcatccaccctctcacacttgagaagactgaattctccaatagggcgtgaagggaaattggctaaaccgcgtcagctgcataattcgcaatggggaatgatgtgcccagctgaaacacctgaagggcaagcgtgcgggcttgtaaagaatcttgcattgatggtatacataacggtaggatcagctgcatatccaatcttggaatttttggaagaatggggtacagaaaactttgaggaaatttctcctgcggttataccccaagctacaaaaatttttgttaacggctgttgggttggaatccatcgtgatcctgaaatgttggtgaggacattgagaaagctaaggcgacgggttgatgtcaacactgaagttggggttgtgagagatatccgtctgaaagaattgcggatatatactgactatggacgttgcagtcgtccattattcattgtggataaacagaggcttctcataaagaagagggatattcatgcattgcagcagagggaaagccctgaagatgctggttggcatgaccttgtagcaaagggatatattgaatatattgacactgaagaagaggagactacaatgatttccatgacaattaatgatcttgtccaagcaagactcaatcctgaggaggcatattcggacacttatactcattgtgaaatccacccatcacttattttgggtgtttgtgcttctattataccgtttcccgatcataatcagtctccacgtaatacatatcaatctgctatggggaagcaagctatggggatttatgtcaccaattatcagttccggatggatacattggcgtatgttttatactaccctcagaaacctcttgtcaccacaagagccatggagcatctccacttcaggcagcttcccgccggcatcaatgctattgttgccatctcctgttattctggttataaccaggaagattctgtcattatgaatcaatcctctgtggaccgtggattcttccggtcactattcttccgatcttatagggacgaggagaaaaagatggggacccttgtcaaagaggattttgggcgtcctgacagagcaaatactatgggtatgcgacatggttcttatgacaaattggatgatgatggtcttgctcctcctggaactagggtttcaggtgaggatgttatcataggaaagactacacccatggctcaggatgaggctccagggcaagctacatcgcgttacacacggcgtgaccacagcataagcttgcgccacagtgaaaccggcatagttgatcaggttctactgacgaccaatgccgatgggttgcggtttgttaaagtacgggtgaggtctgtcagaatacctcaaattggtgataaatttagtagcaggcatggacagaaggggacagtgggtatgacttatacccaggaagacatgccgtggactgtggaaggggtgacccccgatataatcgtgaacccgcatgctattccttctcggatgacaattggtcagctcattgagtgtattatggggaaggttgcagctcacatgggaaaggaaggagatgctacaccttttacagatgtcacggtggacaatatcagtaaagctcttcacagttgtgggtatcaaatgcgtggatttgagaccatgtataatggtcacacgggcaggcggctcagcgctatgatattccttggccccacatactaccagagactgaagcatatggtcgacgataagatccattcacgtggacggggtccagtgcagatcctcacaaggcagccagctgagggacgatctcgtgatggtggtctacgcttcggggaaatggaacgagattgcatgattgcccatggtgctgctcactttctgaaagaaagattatttgaccagagtgatgcatatagggttcatgtctgtgagcgttgtgggttaatagctattgcaaatctcaagaagaattcgtttgagtgcaggggttgcaagaacaaaaccgacattgttcaggtttacattccttatgcctgcaagctgctgttccaagagctcatgtcgatggccatagcgccaagaatgctcacaaaggacatcaagcctgccaaaaaccaaaagaagaaaggagcctgatgtagttgattgctgaaacacaacatctttgctttctgagttctcgtctaaacaagcacgaagttaacaggctttaccgtgataataatagatacacgccggagtttcaagaggttgaaggcgaatcagaaggttcatcagggcgggtttcgagaaagttaatcagaattagtggatgcgttttcatcggagtcgaatggctcgtgtttggaattggttcaaaccgttttgtcttgaaagttttgttttcgtctcgttttaagctggagagctggaactaattgtatttccctgtagttaagctatcattaagtacatacatgtatgacatcatcgttaaatatatatctgagttcattga

SEQ ID NO: 1688 - DNA, 4091 bp, Fragaria vesca
ggtttccaattcgcggccatggaagaagagccggagtacgaagagcaatacaatgacgacgacgacgaagatgagataacgcaggaagacgcctgggctgtgatttcggcctatttcgaagagaagggcctggtgaggcagcagctcgactcgttcgatgagttcatccagaacacaatgcaggagatcgtcgacgaggctgccgatatcgaaatccgacccgaatcgcagcataatccgggtcaccagcccgatttcgctgagactatatacaaaatcagcttcggtcagatttatcttagtaagcctatgatgactgagtcggacggtgagacggcgacgctgtttccgaaggcggcgaggttgcgaaacttgacttactcggcgcctctgtatgtggatgtgtcaaagagggttataaagaaaggacatgatggtgaggaagtcaccgagactcaggattttaccaaagtgtttattggcaaggttcctattatgctccgttcgagttattgtacattgtatcaaaattccgagaaagacttgacagagctgggggagtgtccttatgaccaaggagggtatttcattatcaatgggagtgagaaggtgttgattgctcaggagaagatgagcacgaaccacgtctatgtctttaagaagaggcagcctaataagtacgcttatgttggggaggtgcggtctatggccgagtctcaaaaccgacctcccagcaccatgttcgttcgtatgctttccaggaccagctccaaagggggttcttccggacaatatattcgcgctactcttccatatattcgagctgaaattcccatcattattgtcttccgggctctcggctttgtggctgacaaagatattttggagcacatatgctatgattttgctgatacacaaatgatggagctgcttcgtccttccctggaagaagcatttgttattcagaatcaacaggtggctctagattatattggtaaaagaggtgcaacagctggtgtacccagagacaagaggataaggtatgcgagagatattcttcaaaaggaaatgcttccacatgttggtactggggagttttgtgagaccaagaaagcatactatttcggatacatcattcacaggcttctactgtgtgcacttggtcggagggcagaagatgatagggatcactatggcaacaagaggctggatcttgctggccccttgcttggaagcttgtttagatcgctattcaggaagttaaccaaggatgtcaaaggttatgtgcagaagtgtgttgataatggaaaggacgttaacctgcaatttgcaatcaaagcaaaaaccattaccagtggtctcaaatattcacttgctactgggaactgggggcaagcaaatgcagctgggacaagggctggagtgtcgcaggtgttaaatcgtttgacatatgcatccacattatcacatttgcggaggctaaattctcccatagggcgtgaaggtaaacttgccaaaccccggcagttgcacaattcacagtggggaatgatgtgtcctgctgagacacctgaagggcaggcatgtgggcttgtaaagaacctggcattgatggtatacataacagtgggatcagctgcgtatccaatcttagagtttttagaagaatggggtacagaaaattttgaggaaatttcccctgccgttattccccaagccacaaagatttttgttaatggctgctgggttggcatacatcgtgatcctgaaatgttggtgagaacattgaggaagcttaggcggcgggtggatgtcaatactgaagttggggttgtcagagatatccgtctgaaagagttgcggatatatacggactatggtcgttgcagtcgtccattattcattgtggacaagcaaaggttgctcataaagaagaaagatattcatgcattgcagcaaagggaaaaccctgaagacggtggttggcatgatcttgtagcaaaaggatttattgaatatattgacactgaagaagaggagaccactatgatttcaatgacaattaatgatcttgtacaagcaaggctcaatcctgaggaggcatattctgatacatatactcattgcgagattcacccctcacttatattgggtgtttgtgcttcaattatcccatttcctgatcataatcagtctccacgtaatacatatcagtctgccatgggaaagcaagctatgggaatttatgtcaccaattatcagttccgaatggacacactggcttatgttctgtactaccctcagaagccgcttgtcactacaagagccatggagcatcttcacttcaggcaacttccagccggaattaatgccattgtcgccatttcctgctattctggttataaccaggaggattctgtcattatgaatcaatcctctattgatcgtggatttttccggtcactgttcttccgctcctatagggatgaggagaaaaagatggggactcttgtcaaagaagattttggacgtccagacagagcaaatacgatgggtatgcggcatggatcttatgataaattggaagatgatggtcttgcacctcctggaaccagggtttcaggtgaggatgttatcatagggaagaccactcccattgctccggaggaggctcaggggcaagctgcttcacgttactcacgtcgtgatcatagcataagcttacggcacagtgaaacggggattgtggatcaggtcttattgactaccaatgccgatgggttgaggtttgtgaaagtaagggtgaggtctgttcgaattccacagattggggataaatttagtagtaggcatggacagaaagggacggtgggtatgacgtatacacaagaagacatgccatggactgtagaaggagtcacccctgatattattgtgaaccctcatgctattccttcccgaatgaccattggtcagcttattgagtgtatcatggggaaggttgcagcacacatgggaaaggaaggagatgctactccttttacggatgtgactgtggacaatattagcaaagctctccacaaatgtggatatcaaatgcggggatttgagaccatgtataatggtcacaccggtcggcgattgagtgcgatgattttccttggccctacatattaccagagattgaagcatatggtcgatgataagatccattcacgtggtcggggtcctgtacaaattcttactaggcaacctgctgagggacggtcccgtgatggtggtttacgatttggagagatggaacgagattgcatgattgcccatggtgctgctcactttcttaaagagagattgtttgatcagagtgatgcttatagggttcatgtctgtgagcgctgtggtttaatagctattgcaaatctcaagaagaattcattcgagtgcagaggttgcaagaacaaaactgatattgttcaggttcatattccttatgcctgcaagctgcttttccaagagcttatggccatggctatagcaccaagaatgctcacaaaggatgtcaagcctatcaaagataagaagaaaggagcctgatatgccaactaaggaagttctagctcattttctgaactttcaatggctgcagttaaaagttatgaaattcatactcagcattgtcgtagtggaaatattttcgagtctccgagagctgggttgtgattggttggagacttggagggagatgctgttgcaactccgtttagcttaagcatgtctgcgcaatttttctgcctcactttcatattgtgatctgtaatggactgtttagcaaccctataacaaatcaatatacgactccttgtttataatgtggtctacttagtaggatatatttcaataatggatatactggaaacatggatagaaccaataattctacggatgagttgtagggagaagtgtacaatatcttctactttcttctattattgagcaagaatgtgaaaagtaaatattctggcttatgtgacgaaaatgtattccatatctcacctcgccttagaatgtagaacaaggtgtgttatatgtat

SEQ ID NO: 1689 - DNA, 3763 bp, Cucumis sativus
gcgtaaggtcattcgagctcgcgcgaggttcatttcctagaaaccacacttcctccgttaccctcacgaaaatggaggattacgaagagtatgatcggaatatgaatgacgacgatgatatggaccaggctatccctgacgacgaagaagagatcacacaggaagatgcttgggcagtaatttcagcatattttgaagagaaagggttggtccggcagcagctggattccttcgatgagtttattcagaatactatgcaggaaatcgtggacgagtctgcagacattgagattcgccccgagtcacagcacaatcccggccaccagtcggatgttgctgagacaatatacaagatcagctttggtcagatatacttgagtaagccaatgatgaccgaatctgatggagagactgcaaccttatttcctaaggctgcacggttgaggaatttaacatactcagcgcctttgtacgtggatgtctcaaaaagagtcattaagaaaggtcatgatggtgaagaagttactgaaacccaagattttacaaaagtttttattgggaaggttcctatcatgctccgatcgagttattgcacactgtatcaaaattctgagaaggatctcactgagctcggggagtgtccatatgaccaaggaggatattttatcatcaatggcagtgagaaggttcttattgcacaagagaagatgagcacaaatcatgtatatgttttcaagaaaagacagcctaacaagtatgcctttgtagcagaagttcggtctatggctgagtcacaaaatagaccacccagtaccatgtttgtacggatgctttctcgaactagtgccaaggggggttcttcaggacagtacatacgtgccactctgccttacattagaaatgagattccaattataattgtgtttcgtgctctaggatttgttgctgacaaagatattctagagcatatatgttatgacttctctgatactcaaatgatggagttgcttcggccttccctggaagaggcttttgttatccaaaatcaacaggttgcactagactatattgggaagagaggatcaacagttggtgtgaccaaggaaaagaggattaagtatgccaaggagatccttcaaaaagaaatgcttcctcatgttggcgtaggtgaattttgtgagacgaagaaggcatattattttggttatataattcaccggctactcttatgtgcccttggccggagagcagaagatgacagggatcactatggaaacaaacgactggaccttgctggtcctttacttggaggcttgttcagaatgctatttagaaagttaacaagagacgtgagaggttatgtacaaaagtgtgttgataatggaaaggacgtcaatttgcaatttgccatcaaggcgaaaaccattactagtggcctgaaatattcacttgccactggaaactgggggcaagcaaatgcagctggtacaagagctggagtatcacaggtgttaaatcgtttgacatatgcatcaactttgtctcacttacggaggctgaattcccccattggacgagaaggtaaattggccaagcctcgacagttgcataattcacaatggggaatgatgtgtcctgctgaaacgccagaaggacaagcatgtggactggtaaaaaatcttgcattgatggtctatattacggttggatctgcagcataccctattttggaatttttggaagaatggggcacagagaatttcgaggaaatttctcctgctgtcattcctcaagctacaaaaatttttgtcaatggttgttgggttgggatccatcgagatcctgaaatgttggtgaagactttgagacggctgaggagacgagttgatgtaaatactgaagttggagttgttagagatatccgtttgaaagaactacggatatatactgattatggccgttgcagccgtccattattcattgttgagaaacaaaggcttctcataaagaagaaggatatccatgctcttcagcagagggaatctccagaagatggtggttggcacgatcttgtagcaaaaggattcattgaatacatagacactgaagaagaggaaactaccatgatttccatgacaattagtgtgagtaaacagtaaatctatttgataggctgacggtaatttacaaaaacttaaaattcttttgaaataaaccaggatcttatacaagcaaggatcaacccggttgaggcttattctgacacttacactcactgtgaaatccatccatcattgattttgggtgtttgtgcttcaattattccatttcccgaccataaccagtctccacgtaacacgtatcaatctgccatgggtaaacaagctatgggaatttatgtcaccaactaccaatttcgaatggatactttggcctatgttttgtattatccgcaaaaacctcttgtgactactcgagctatggagcaccttcatttcaggcaacttccagctggcattaatgccattgttgccattgcttgctactctggttataaccaggaagactctgtgatcatgaatcaatcttccattgaccgtggattttttaggtcacttttcttccggtcatacagagatgaggagaaaaaaatgggaactcttgtaaaagaagattttggacggccggacaggagtaatactatgggtatgaggcatggctcttatgataaattggatgacgatggtcttgcaccccctggtaccagagtatcaggtgaggacgtcattattggaaagactactcctatctctcaggaagaagcccagggacaagctgcacgttactcaagacgtgatcatagcattagtttacgtcacagtgaaaatgggattgtagatcaagttctactgaccacaaatgctgatggattgagattcgtgaaagtaagggtgagatctgttcgaatacctcagattggggataagttcagcagtcgacatggtcaaaaaggaacagtgggaatgacttacacacaagaagacatgccttggactgtggaaggaatcacccctgatattatcgtgaatccacatgctattccttctcggatgacaattggtcagcttattgagtgtatcatggggaaggtggcagcccacatgggaaaagaaggagatgctaccccatttactgatgtcactgtggataacatcagtaaggcactgcataagtgtggttatcagatgcgtggatttgaaaccatgtataatggccatacaggccgacggctctcagcaatgatattcctcggtccaacatactatcaaaggctgaagcatatggttgatgacaaaatacattcacgtggaaggggtcctgtgcagatccttacgagacaacctgctgagggtcggtcacgtgatggtggtctccgatttggggagatggagcgtgactgcatgattgcccatggtgccgctcattttctaaaggagaggttgttcgatcaaagtgatgcttataggatccatgtctgtgagtgttgtggattgatagccattgcaaatctcaagaagagttctttcgaatgtaggggctgcaaaaacaaaactgacatcgttcaggtatatatcccttatgcctgtaagcttctcttccaagagcttatggccatggcaatagcaccacgtatgttcacaaaggagatcaaaccattaaaagaccaaaagaagaaaggatcctgatttctttctatagcttc

SEQ ID NO: 1690 - DNA, 3673 bp, Brassica napus
gttgtgcgctctctcagatagcaatggagtataataacgaatacgagcaggaaccgacttacatcgaagacgacgacgatgaggagatcacccaggaagacgcgtgggcggttatctctgcctatttcgaggagaaaggtctcgttcgccagcagctcgattccttcgatgagtttattcagaatactatgcaggagatcgtcgatgagtctgcggatatcgagatccgtcctgagtctcagcacaatcctggccagcaatctgatttcgccgagacaatctacaagattagttttggacagatttatctgagtaaacccatgatgacggaatctgatggagagactgccaccttgttccccaaggctgcaaggttgagaaacctcacctactctgctcctttgtatgtcgatgttagtaagagagttataaagaaagggcatgatggtgaggaagttacagagacgcaggattttaccaaagttttcattgggaaggttcccatcatgctccggtctagttactgtaccttgtttcagaactctgagaaagatttgacagagcttggagaatgtccttatgatcagggcggatactttattattaatggcagtgaaaaggttctgattgcccaggagaagatgagtacgaaccatgtttatgttttcaagaagcgacagccgaataagtatgcatatgttgctgaagtccgttccatggctgagaaccaaaataggcctcccagcacaatgtttgtgcgtatgcttgctcgtgctagtgcgaaagggggttcatctggacagtatattcggtgtactctaccatacatcaaagcagaaattcccattatcatagtgtttcgtgccttaggatttgttgccgataaggacatattggaacatatttgctatgattttgccgataatcagatgatggagttgcttaggccttccttggaagaagctttcgttattcaaaaccagctggttgcactcgactatattgggaaacgtggtcaacccatgggcgtgggtgtaagcaaggaaaagaggataaagtatgcaagagatatccttcagaaagaaatgcttcctcatgtaggagttggggagttttgtgagacgaagaaagcttactattttgggtatattatacaccggctactgctttgtgcacttggccgaaggccagaagatgatagggatcattatggtaacaaaaggctggatcttgctggtcctttacttggagggctgtttagaatgcttttcagaaagctaacgagggatgtgagatcttatgttcagaagtgcgttgacaatggcaaagaagtcaatcttcaatttgccattaaggctaaaacaattacctctggcctgaaatattctcttgctactgggaactggggtcaggcaaacgctgctggcacaagagctggagtctctcaggttttaaatcggttaacatatgcttccactttgtcgcatttgaggcgtctcaattctcctattgggcgtgaaggaaaattggcgaaaccaagacaactgcacaactcacagtggggtatgatgtgccctgctgaaacacctgaaggacaggcttgtggtctagtgaaaaatttggcgctcatggtctacattacagttgggtcagctgcttatcccatcttggaatttttggaagaatgggggactgagaattttgaggaaatttctccatcagttataccccaagccacaaaaatctttgtcaatggaatgtgggttggagttcatcgagatcctgacatgttggtgaaaactttgagacgtttgagaagaagggtcgatgttaacactgaagttggcgttgttagagatattcgtctgaaagagctccggatatacactgattatggtcgttgtagtcgtcccttgtttattgtggataaccagaggctgttaattaaaaagaaagatatctatgctctgcaacaaagggaaagtgcagaagaagacggttggcatcatctagttgcaaaggggtttatagaatacattgacacagaggaagaggagactactatgatatccatgactattaatgatctggttcaagctagactccgtcccgatgaggcatattctgaaacttacacacattgtgagattcacccttctttgatattgggcgtttgtgcttcgattataccatttcccgaccataaccagtcaccccgtaatacatatcaatctgctatgggaaagcaagcgatgggaatatatgtcaccaattaccaatttcgcatggataccttagcatatgttctctattaccctcaaaagcctctggtcactacaagagctatggagcatcttcactttaggcaacttccagcaggaattaatgctattgttgccatttcttgctattctggatataatcaggaggattctgtcatcatgaatcagtcttcaatagatcgtggtttctttagatccttgttttttcggtcttacagagatgaggagaaaaaaatggggacgctcgtcaaagaagactttggtcgcccagacagagcaagtacaatgggtatgcgacatggttcatatgagaagctggacgatgatggtcttgcacctcctggtaccagagtttcaggtgaagatgtaatcattgggaaaaccactccaatatctcaagacgaggctcaaggtcaatcatcgcgatacactagacgtgatcacagtataagcttgcgacatagtgaaaccggaatggtggatcaggtgttattgaccacaaatgcagatggcttgaggttcgtgaaagtgagggtgagatccgttcgtattcctcagattggagacaaatttagtagtagacacggtcagaagggaaccgttggcatgacgtacacacaggaggacatgccttggacaattgaaggcgtcactcctgatatcatcgtgaacccgcatgctattccgtctcggatgacaattggtcagcttatcgagtgcatcatgggaaaagtggcagctcacatgggaaaagaaggagatgcgactccttttacagatgtgacggtggataacataagcaaagcgctccataagtgtggctaccaaatgcgtggattcgagagaatgtacaatgggcacacgggcagaccactcacagctatgatattccttggaccaacatactaccagaggctgaagcatatggtggatgacaagattcactcgcgtggacgaggtcctgtgcagatcttaacaagacaaccagctgaagggagatcacgtgacggtggtctgcgatttggagaaatggagcgtgactgcatgattgcacatggagctgcaaacttcttgaaagagaggctgtttgatcagagcgatgcgtatagggtgcatgtgtgtgaaacctgtgggctcatcgccattgcaaatctgaagaagaattcttttgaatgcagaggttgcaagaacaaaacagatattgttcaggttcacattccatatgcttgcaaactgctctttcaagagcttatgtcaatggcgattgcaccaaggatgcttaccaaaggccttaaatcagccaaaggcaggaagtgagaaagctttgctctcttttgctagtatatctttataacgaaaccaaactacgaattcttgtgtcgtttatttgc

SEQ ID NO: 1691 - DNA, 3836 bp, Brassica rapa
ctcgaggccgtctcattcatcctcttttgctgttcgcttgagcagtgtggtgttgtgcgctctctcagatagcaatggagtataataacgaatacgagcaggaaccgacttacatcgaagacgacgacgatgaggagatcacccaggaagacgcctgggcggttatctctgcctatttcgaggagaaaggtctcgttcgccagcagctcgattccttcgatgagtttattcagaacactatgcaagagatcgtcgatgagtctgcggatatcgagatccgtcctgagtctcagcacaatcctggccagcaatctgatttcgccgagacaatctacaagattagttttggacagatttatctgagtaaacccatgatgacggaatctgatggagagacggctaccttgttccccaaggctgcaagggtgagaaacctcacctactctgctcctttgtatgtcgatgttagtaagagagttataaagaaagggcatgatggtgaggaagttacagagacgcaggattttaccaaagttttcattgggaaggttcccatcatgctccggtctagttactgtaccttgtttcagaactctgagaaagatttgacagagcttggagaatgtccttatgatcagggcggatactttattattaatggcagtgaaaaggttctgattgcccaggagaagatgagtacgaaccatgtttatgttttcaagaagcgacagccaaataagtatgcatatgttgctgaagtccgttccatggctgagaaccaaaataggcctcccagcacaatgtttgtgcgtatgcttgctcgtgctagtgcgaaagggggttcatctggacagtatattcggtgtactctaccatacatcaaagcagaaattcccattatcatagtgtttcgtgccttaggatttgttgccgataaggacatattggaacatatttgctatgattttgccgacaatcagatgatggagttgcttaggccttccttggaagaagctttcgttattcaaaatcagctggttgcactcgactatattgggaaacgtggtcaacccatgggcgtgggtgtaagcaaggaaaagaggataaagtatgcaagagatatccttcagaaagaaatgcttcctcatgtaggagttggggagttttgtgagacgaagaaagcttactattttgggtatatcatacaccggctgctgctttgtgcacttggccgaaggccagaagatgatagggatcattatggtaacaaaaggctggatcttgctggtcctttacttggagggctgtttagaatgcttttcagaaagctaacgagggatgtgagatcttatgttcagaagtgcgttgacaatggaaaagaagtcaatcttcaatttgccattaaggcaaaaacaattacctctggcctgaaatattctcttgctactgggaactggggccaggcaaacgctgctggcacaagagctggagtttctcaggttttaaatcggttaacatatgcttccactttgtcgcatttgaggcgtctcaattctcctattgggcgtgaaggaaaattggcgaaaccaagacaactgcacaactcacagtggggtatgatgtgccctgctgaaacacctgaaggacaggcttgtggtctagtgaaaaatttggcgctcatggtctacattacagttgggtcagctgcttatcccatcttggaattcttggaagaatgggggactgagaattttgaggaaatctctccatcagtaataccccaagccacaaaaatctttgtcaatggaatgtgggttggagttcatcgagatcctgacatgttggtgaaaactttgagacgtttgagaagaagggttgatgttaacactgaagttggcgttgttagagatattcgtctgaaagagctccggatttacactgattatggtcgttgtagtcgtcccttgtttattgtggataaccagaggctgttaataaagaagaaagatatctatgctttgcaacaaagggaaagtgcagaagaagatggttggcatcatctagttgcaaaggggtttatagaatacattgacacagaggaagaggagactactatgatatccatgactattaatgatctggttcaagctagactccgtcccgatgaggcatattccgaaacttacacacattgtgagattcacccttctttgatattgggcgtttgtgcttcgattataccatttcctgaccataatcagtcgccccgtaacacgtatcaatctgctatgggaaagcaagcgatgggaatatatgtcaccaattaccaatttcgcatggataccttagcctatgttctctattaccctcaaaagcctctggtcaccacaagagctatggagcatcttcactttaggcaacttccagcaggaattaatgctattgttgccatttcttgctattctggatataatcaggaagattctgtcatcatgaatcagtcttcaatagatcgtggtttctttagatccttgttctttcggtcttacagagatgaggagaaaaaaatggggacgctagtcaaagaagactttgggcgcccagatagagcaagtacaatgggtatgcgacatggttcatatgagaagctggacgatgatggtcttgcacctcctggtaccagagtttcaggtgaagatgtaatcattgggaaaaccactccaatatctcaagacgaggctcaaggtcaatcatcgcgatacactagacgtgatcacagtataagcttgcgacatagtgaaaccggaatggttgatcaggtgttattgaccacaaatgcagatggcttgaggttcgtgaaagtgagggtgagatcagttcgtattcctcagattggagacaaatttagtagtagacacggtcagaagggaaccgttggcatgacgtacacacaggaggacatgccttggacaattgaaggcgtcactcctgatatcatcgtgaacccgcatgctattccgtctcggatgacaattggtcagcttatcgagtgcatcatgggaaaagtggcagctcacatgggaaaagaaggagatgcgactccttttacagatgtcacggtggataacataagcaaagcgctccataagtgtggctaccaaatgcgtggattcgagagaatgtacaatgggcacacgggtagaccactcacagctatgatattccttggaccaacatactaccagaggttgaagcatatggtggatgacaagattcactcgcgtggacgaggtcctgtgcagatcttaacaagacaaccagctgaagggcgatcacgtgacggtggtctgcgatttggagaaatggagcgtgactgcatgattgcacatggagctgcaaacttcttgaaagagaggctggttggtcagagcgatgcgtataggggacatgtgtgtggaacctgtgggctcatcgccattgcaaatctgaagaagaattcttttgaatgcagaggttgcaagaacaaaacagacattgttcaggttcacattccatatgcttgcaaactgctgtttcaagagcttatgtcaatggcgattgcaccaaggatgcttaccaaaggccttaaatcagccaaaggcaggaagtgagaaaactttgttctcttttgctagtatatctttataacgaaaccaaactacgaattcttgtgtcgtttatttgcacttctgaaactagaagctagagaggtatgctctcatgtttaagaaaataacgatacaacttttgtctttggacattaatttgttctgcgggagtacttaacaagctaaagt

SEQ ID NO: 1692 - DNA, 3912 bp, Papaver somniferum
ctagtgaggcagcagctggactccttcgacgagtttatccaaaacactatgcaggaaatagtcgatgagtctgctgacatagagattcgtcccgaatctcagcataatcctgggaggcagtccgatttcgttgagacagtgtacaagatcagttttggtcagatttatctgagtaaacctatgatgactgaatctgatggagagacagctactttgtttcctagagcagcacggttgaggaacttaacatactccgcaccattgtatgtggatgtctctaagagaatcataaagaaaggtcatgattgtgaagaagttactgaaacacaggattttactaaagtttttattggaaaggtaccaattatgctccggtcgagttattgtacattgtatcaaaattcggagaaagatttaacagagttaggagagtgtccttatgatcaaggtgggtatttcattatcaatggaagtgagaaggttttaattgctcaggagaagatgagcaccaatcatgtgtatgtattcaagaagagacagcctaacaagtacgcctacgtcgctgaagttcggtccatggcagagtctcaaaatagaccaccaagtggcatgtttgtgcgaatgctttctcgggccagtgcaaaagggggttcttcgggacagtacattcgagctacacttccatatattcgcacagaaataccaattattattgtgtttcgggctctaggtttcgtcgctgacaaggatatcttggagcacatttgctatgacttctctgataatcagatgatggagctgcttcggccctctttagaagaagcatttgtgattcaaaaccaacaggttgcactagattacattggtaaaagaggatccactgtgggtgtgacaagggaaaagaggatcaagtatgcaaaagagatactccagaaagaaatgcttcctcatgttggcgttggggaatattgtgaaaccaggaaagcttactattttggatatatcattcatcgactgttgctatgtgctctcggtcgaaggcctgaggatgacagggatcattacggaaacaagaggctggaccttgctggtcctttacttggaggcctgttccgaatgctcttcaggaagttgacaagggatgtcagaggctacgttcagaagtgtgttgataacggaaaagatgttaatttgcaatttgcgataagagctaaaacaattacgactggtcttaaatactcccttgctaccgggaactgggggcaagcaaatgcagctggtaccagagctggtgtttcgcaggtgctcaatcgcctaacttatgcatcaactctctcccatttgcggaggttgaactcgccaatagggcgtgaagggaaactggcaaaacccaggcagctgcataattcacaatggggaataatgtgtccagctgagacaccagaaggacaggcctgtggactggtaaagaatcttgcgctcatggtttacataacagtaggttctgcggcaaatccaattttggaatttttggaggagttcggtatggaaaattttgaggaaatttcccctgcagtcattcctcaatccactaagatttttgtgaatggttgctgggttggtatccatcgtaatccagagcctttggtgaagactctaagacggctgagaagacgggttgatgtcaatacggaagttggagttattcgagaagttcgtttgaaagaactgcgactttatacagattatggacgctgcagtcgtccactgtttattgtggagaagcagaggctgttgataaagaaaagagatattcgagcattacagcaaagggaatcacctgaggaggatggctggcatgatcttgtcgctaaaggatacatagagtatgttgacacagaggaagaagagaccactatgatttccatgacaatcaatgatcttgtatctgcaagacataatccagaagaggcgtattctgaaacttacacccattgtgaaattcacccatcgcttatattgggtgtttgtgcttctattatcccatttccagatcacaaccagtctccacgtaatacatatcaatctgccatgggcaagcaagcgatgggaatatatgtaaccaactatcagttgcggatggatacattggcatatgttctctactatccacaaaagcccctagttaccactcgtgcaatggaacacttgcacttcagacagctcccagctggcattaacgctatcgttgcaattgcctgttattctgggtataatcaagaagattctgttatcatgaatcaatcatcaatagatcggggtttcttccgttcgttgttcttccgttcatacagagacgaggagaaaaagatgggaacccttatcaaagaggattttgggcgcccaaacagggagaatactatgggaatgagacatggctcttatgacaaactggatgatgatggccttgcacctcctggtacaagggtctcaggtgaagatgtcattattggaaagaccactcccattgcacaggatgatgctcaacaaggacaagcttcccgttacacacgtcgtgaccacagtaccagcatgaggcacagtgaaagtgggatggtggatcaggtcgtattgacaactaatgctgatggtttgaggtttgtgaaagtaaggatgagatctgttcggatacctcagattggagacaagttcagtagtaggcatggtcagaaaggaactgtcggcatgacatacacacaagaagacatgccatggacagttgaaggcatcacacctgacatcattgtgaacccacatgctattccttctcgaatgacaattggtcagcttattgagtgtatcatgggaaaggtcgcagctcatgtggggaaggagggagatgctactccctttactgatgtaacggtggacaatataagcaaagcccttcataaatgtggatatcagatgcgagggttcgagactatgtacaatgggcatacagggaggaagctgactgccatgatctttttgggtcccacttactatcagagattaaagcatatggtggatgataagattcattcacgtggaaggggacctgttcagatccttacaaggcagccagctgaaggtcgatcccgtgacggaggtcttcgatttggggagatggagcgggattgtatgattgcacatggagctgcacacttcctgaaagaacgtttgtttgaccagagtgatgcctacagggttcatgtctgtgagcattgtggattgatagctattgccaatcttaaaaagaattcctttgagtgcagaggttgcaagaataagaccgacattgttcaggtgtacataccctatgcatgcaaactgctcttccaagaactcatgtccatggctattgctccaagaatgctcacaaaggaagtgaaacaagcaaaagatacaaagaagaaaggagcctaaatagatggttgcaatggcagagctacataaactttttccctcacattttttaatgaagccccctcctattttctgctcttcgcatctgattaaagttttgctaaagattggtgttatgtgatacagacatcatcgacctctgaccaaaaaatgtaaaaaaatatgagtcctttatccggtaaaagtagttcgaacagagtaatgcaccgaaatgaaatctgagtggaattcatattttcttttttcttataaatgtaatactagtaaattattgtcttcctaatgaaacatctgaattttgtgcttctggtccctcaactatggacattcacaggagggtggtctgttatatatgttcctgttgtagccttgcgtagaaacttgaaatctaagaaccaagtgatttcttaatgcattgttcgactcttgcatcaaaaaaaaaaa

SEQ ID NO: 1693 - DNA, 4161 bp, Abies balsamea
gagtacaagatgtatgcaggagaagaggaagaatatgtaaatgaagaagaggagataacgcaggaagatgcgtgggcggttatcagcgcttactttgaagagaaggggctggtccgccagcagctcgattccttcgatgagtttattcagaataccatgcaggaaatcgtggacgagtctgccgacatcgagattcgccccgaatcccagcataatcccggcagacaaaccgactttacagagaccgtcttcaagattagctttggtcaaatatatctcagtaaacctatgatgacagagtctgatggggaaactgctaccttgtttcccaaggcagcaagattgagaaatttgacctactcagctccgctatatgttgatgtcactaaacgagtgttcaagaaaggcctcgattgtgaagagctggcagaaaaacaagagctcactaaagtttttattggcaaggtgccaataatgctccgttctgcatattgtacattatctcccacgaatgaaaaggatctccaagagcttggagagtgtccatatgatcaaggtggatactttattatcaatggcagtgagaaggttttgattgcccaagaaaaaatgagtacaaaccatgtttatgtttttaagaaacggcaaccaaataaattctcttatgttgctgaggtgaggtctatggctgaagcgcaaaacaggccgccaagtagtatgtttgtccgtatgctttcaagggctagtgcaaaagggggttcatcagggcagtttattcgagcaacgctgccatatatccgtgctgacattccaattattattgtatttcgagcattggggtttgttgctgacaaagatattttagaacatatatgctacgacttcagtgatgctgcaatgatggaattgttgagaccgtcactagaggaagcatttgtcattcagaatcaacaggttgctttggattacattggaaaacgtggctccactgttggtgttactaaagaaaagcgtataaagtatgcaaaagacattttacagaaagaaatgttacctcatgttggtgtaggagagctttatgagacgaagaaagcttacttttttggatacatcatccatcgacttctactatgtgctcttggtcgacggccagaggatgatagggatcactatgggaataaaagattggatctggctggtcctcttcttggaggactattcagaatgctttttcggaaattgaccagggatgtgaggtcttacttgcaaaagtgtgttgatgctggaaaggatgttaatctacaatttgcaatcaaagcaaaaactatttctagtggcctgaaatactccttggctactggaaactggggccaagcaaatgcagctggcacaagagctggagtatcacaggttttaaatcgtctgacatttgcatcaactttatcacatttaagaaggttaaactctccaatcggtcgtgaaggaaagttggcaaaacccagacagttgcataattcacactggggtatgatgtgtcctgcagaaaccccagaaggacaggcttgtgggcttgtgaaaaatttggcccttatggtgtacatcaccgttggttcttctcctaatccaattctggaattcttggaagaatggagcactgagaattttgaggaaatatctccggcggttattccaagtgcaacaaaaatatttgtaaatggttgttgggttggtattcaccgagatcctgaacttttggtgaagacactgagacagttgagaagacaggttgatgtgaacccagaagttggagttgttagagatatccgtctgaaagaattgaggctgtatactgattatggtcgatgcagtcgaccattgtttgttgtggagaaacaacgcctgagcataaagaaatcagacatcaatagattacaggaacggactagtccagatgaaggttggcatgatcttgttacaaggggttttattgagtatgtggatacagaggaagaggaaacaacaatgatttcaatgaccatcaatgaccttgtgactgcaagaaataatcctgcagaagcatattctcatacgtacacccattgtgaaattcatccatcattgattttgggtgtttgtgcatcaattattccgtttcctgatcataaccagtcccctcgtaacacataccagtcggctatgggtaaacaagcgatggggatttatgtcacgaattaccagcttagaatggataccttagcctatgtactctattatccacaaaagccacttgttacaacccgtgctatggaacatttgcactttaggcagctgccggcaggaatcaatgcgattgtagctattgcctgctattctggatacaatcaggaagattctgtcatcatgaaccaatcttctatagaccgtggatttttccgttcactattttttaggtcctacagagatgaagaaaagaggatggggacacttgttaaagaggaatttggctgtccaaacagggagaatactctaggcatgcgacatggttcatatgataaattggacgatgatgggcttgctcctcctgggactagggtctcaggagaggatgtaatcattggtaaaacaacacctgtagcaccagatgagacagcaggtcagcaacaacgttacacaaagcgggatcagagtacatccctgcgtcatagtgaaagtgggatggttgatcaggttctgctgacgacaaatcaggatggcttgcggtttgtgaaagttagaatgagatctgtgcgtataccacagattggggataagttcagtagtaggcacggtcagaagggaactgtaggtatgacatacactcaggaggatatgccttggacagttgagggtatcacacctgatattatagtgaatccacatgctatcccctctcgaatgactattggccaactcattgaatgtatcatgggaaaagtggctgcacacatgggaaaagagggagatgcaactccattcactgatgtaactgtggatagcattagcaaggcacttcataaatgtggataccagatgagaggtttcgagaccatgtacaatggtcacacgggtagaaagctaactgccatgatatttttaggtcctacatattaccagcgattaaagcatatggtggatgacaagattcattctcgtggtcgtggccctgttcaaattctcacacgacaaccggcagaaggacgttctcgtgatggaggtctacgttttggagagatggaacgtgattgtatgatagcccatggagctgctcatttcctgaaagaaaggctttttgaccaaagtgatgcatatcgggtccatgtttgtgagcgctgtggtttaattgctattgcgaatttgaagaaaaattcttttgactgtagaggctgcaagaacaagactgatatcgtgcaggtgcacataccttatgcttgtaagttgttgtttcaagaactcatggccatggccattgccccaagaatgttcactaaagaagttaaggaaataaaagatcaaaagaagaagggaggagcttgaacattgtctgctgcatctgggttctttgcgcaactaattgaaatacaatcactttgcgcaactaattggaatacgatcaccctatagcagtggaagatgtggctgtttttgtaaactggacaggaaacagtgtgtcaactgccattctagggtgcgatctgaattaaaatgaaaaaagtttatgggtcaaagcaagataaatttcatcaggttgagtgagataaatttcataaggttgaccaggtcaaagttggtatacaagaatgttattgtgcccctggttaatgggctataccattctgactgcctgcgtgcttatataaactctccgctcatccaacgacctctcttgtactgtattactgatgtataatgtttagtaaagaattgcactacaaagcagagtacaggcctttctttgcacaaattattctaatatgctttagggccctaggctaccttatgtctttaaaggcgaggaacattagatagtaggaaaagattgaattgattggatgcctcatcaaccctatttcgtagaattggtgctgttgctaaaagttgtggcaatgaactgttatacaagtc

SEQ ID NO: 1694 - DNA, 3952 bp, Cephalotaxus harringtonia
agggggagaggaggtcgagcaggtggaggatggaagggaggaaataacgcaggaagatgcgtgggtggtcatcagcgcctacttcgatgagaaggggttggtgcgccagcaactcgactcattcgacgaattcatccaaaacacaatgcaggaaattgtcgacgagtccgccgatatcgagattaaacccgaatcgcaacataatcctggcagacaagccgacttcactgagactgttttcaagataagctttggtcagatatatcttagcaaacctatgatgacagaatctgatggggaaactgctactttgtttcccaaagcagcgcgattaaggaatttgacctactcagctccactatatgttgatgtcactaaacgggttttcagaaaaggacttgattgtgaagagctatcagagaaacaagatcttacaaaagtgtttattgggaaggtgccaataatgctgcgttctgcgtattgcacgttgtctccaacaaacgaaaaggatcttcatgagcttggagagtgtccatatgaccaaggtggatattttatcatcaatggcagcgagaaggttttaattgctcaagaaaaaatgagtacaaatcatgtttatgttttcaagaaacggcaaccaaataaatattcttatgttgctgaggtgaggtctatggctgaagcacaaaacaggccaccaagtagtatgtttgtgcgcatgctttcaagagcgagtgctaaagggggttcatctgggcagtttattcgagcaacattgccttatattcgttcagacattccaattattatcgtgtttcgagccctggggtttgttgccgacaaagacattttagagcatatatgctatgattttagtgatgctgcaatgatggagttgctgagaccatcactggaggaggcatttgtcattcagaaccagcaggttgcattggattacattggaaaacgtgggtcaactgttggtgttactagagaaaagcgtataaagtatgccaaagacattctgcagaaggaaatgttgccacatgttggtgtaggagagcatagtgaaactaagaaagcctatttctttggatacatcattcatcgacttctattatgtgctcttggtcgtcgaccagaggatgacagagatcattatgggaacaaaagattggacctagcaggtcctcttcttgggggactgttccgaatgcttttccgaaagctgaccagggatgtgaggtcttacttgcaaaagtgtgttgattctgggaaggatgtaaatctacaatttgcaattaaagccaaaacaatttccagtggtctgaaatactccttagccactggaaactggggacaagcaaatgcggcaggcacaagagctggagtgtcacaggttttgaatcgtctgacatttgcatcaactttatcccatttaagaaggttgaactctccaattggtcgtgaagggaaactggctaaacccagacaattgcataattcacattggggcatgatgtgtcccgcagaaactcctgaaggacaggcttgcgggctagtgaaaaatttggctcttatggtttacattaccgttggttcatctgctaatccaattctggagtttttggaagaatggagcacagagaattttgaggaaatatctccagcagccattccaacatcaacaaaaatatttgtaaatggttgttgggttggaattcaccgtgatcctgagcttttggtgaggactctgagacagctgagaaggcaggttgatgtcaacccagaagtaggagttgtcagagacattcgactaagggagttaaggctatatactgattatggccgctgcagtcgaccactatttgttgtggagaatcaacgtttgaagataaagaaagtagacatcaataatttacaggcgagtcgggaagacggatggcatgaacttgtcacacagggttttattgagtatgtggacacggaggaagaggagacaactatgatttccatgacaattaatgaccttgtgaatgcaagaacgaatcctgaggatgcttattctcatacatacacccactgtgaaattcatccatcattgattttgggtgtttgtgcgtcaatcattccattccctgatcataatcagtctcctcgtaatacataccagtctgctatgggtaaacaagcaatgggcatttatgtcaccaattatcagctacgaatggatactttagcatatgtactttattatccacagaagcccctagttactacacgggccatggagcacttgcacttcaggcagctgccagcaggaattaatgcaattgttgctattgcctgctattctggatacaatcaggaagattctgtcatcatgaatcaatcctcgatagatcgtggattctttcgctcattattttttcggtcctacagagatgaagaaaaaaggatgggaacactagtcaaggaggaatttggtcgtccgaacagggagaatacaatgggtatgcgacatggttcatatgataaattggatgatgatgggcttgctcctcctgggactagggtttcaggagaggatgtgataattggtaaaacaacgcccatagcccaagatgaatcaggaggccaggtatcaaaatacacaaagagagatcagagtactagtttgcgccatagtgaaagtggtatggttgaccaggttctgctgacaaccaatcaggatggcttgcggtttgtaaaagttagaatgagatctgtccgtataccacagattggggataagttcagtagtagacatggtcagaagggaactgtaggcatgacgtatactcaggaggatatgccttggacagttgagggcattacacccgatattatagtaaatccacacgctattccttcccgaatgactattggtcaactcattgagtgtatcatgggaaaggttgctgctcacatgggaaaggagggagatgcaacccctttcactgatgtcactgttgacagcatcagcaaggcacttcataaatgtggataccagatgagaggttttgagacaatgtataatggacacactggtagaaagctaagtgcaatgatatttctaggccctacatattaccaacgtttaaagcatatggtggatgacaagatccattctcgtggccgcggacctgttcaaattcttactcgacaaccagcagaaggacgctcccgtgatggaggtttacgctttggagagatggagcgtgattgtatgatagcacatggagctgcccattttctgaaagaaaggctttttgaccaaagtgatgcatataggattcatgtttgtgaacgctgtggtttaattgctattgcaaatttgaagaaaaactcttttgattgtagaggctgcaaaaacaaaacagacattgttcaggtgcacattccatatgcttgtaagctactttttcaagaacttatggctatggccattgccccaagaatgttcacgaaagaagtgatacaactgaaagatcaaaagaaaaagggaggagcttgaatgaaatgtggtcatgtcatctttattctctggacgttgatgatttcctcatcgtatgggttttctaatcagatggggcattggcattgcgaatgctgccaagttagatctatgaaatggaccaaaataaaattgaaggtgatattttactacttgaagtaagacaaaataatttactggtcaaagtgagttgaaccatgtaaggctggatttgagaaaatttgtagatgagaaagttctagtgcatcacatcatgtaagtctggatttgagaatgtttgtagagaattaaatcaagcaagaaggaattctttccatttctgctttttgtcaacttaaattcctctaaccaggactatattgccccttcagtatcctttcttgtactgtttcaagt

SEQ ID NO: 1695 - DNA, 3961 bp, Euphorbia peplus
tccttcgatgagtttattcagaataccatgcaggaaatcgtcgatgagtcgtccgatatcgagattcgacctgagagtcagcataatccgggacatcagtctgatttcgttgagactatctttaagataagcttcggccagatatacttgagcaagcctatgatgaccgagtctgatggagaaactgcaactttatttcctaaagctgcaaggttgaggaacctaacatactcagctcccttgtatgtggatgtttccaagaaggtcataaagaaaggacatgatggcgaagaagtcactgagactcaggacttcaccaaagttttcattgggaaggttcctataatgcttcggtcaagttattgtacgctgttccagaattcagagaaagatcttacagagcttggcgagtgtccattggatcagggtgggtattttatcataaatggaagtgaaaaagttctgattgctcaggagaagatgagcaccaatcatgtttatgtgttcaagaagaggcagccaaacaagtattcctatgtggcagaagttagatctatggcagagtctcagaaccggcctcccagtaccatgtttgtgcggatgctttcccggactagtgccaaggggggatcttcagggcagtacattcgtgctactcttccgtatattcggactgaaattcccattatcattgtgtttcgggctctggggtttgttgctgacaaagatatattagagcacatctgctatgatttctctcgtactaacatgatggagttgcttcgaccttctttggaagaagcatttgtgattcaaaatcaacaggttgcgctagattacatcggaaagcgtggagcaactgtaggtgtgaccaaggagaaaaggataaagtatgctaaagagatccttcaaaaggaaatgcttcctcatgttggagttggggaatattgcgagactaaaaaagcatactattttgggtatatcattcaccggcttctactttgtgcacttggcgagagaccggaagatgatagagatcattatggaaacaagaggctcgaccttgctggtcctttgcttggtggactctttagaatgttattcagaaagcttaccagagacgtcagatcttatgttcaaaagtgtgtagatgttggtaaggacgtaaatcttcaatttgccattaaagcaaaaaccattactagtggtcttaagtactcactggccactggaaactgggggcaagcaaatgctgccggtacacgagctggagtgtctcaggtgttaaatcgtttgacctatgcatctactttgtcccacttgcgaagattgaattctccaattgggcgtgaagggaaattggctaagcccaggcagttgcataattcacagtggggaatgatgtgtccagcagaaacacctgaaggccaagcttgtggactggtgaagaatctcgcattgatggtttatattactgttggatcagctgcatatcctatcttggaatttttggaagaatggggtaccgagaattttgaggaaatatctccagcagttattcctcaatctacaaaaattttcgttaatggttgttgggtgggtgtccatcgtaatcctgatatgttggttaagacgttgagacggctgaggagaagggttgatgtcaatactgaagttggggttgttcgggatattgctttgaaagagcttcgaatatatactgattatggccgttgcagtcgtcctttattcattgttgagaatcaaaggcttctcataaagaaaaaggacattcatgccctacagcagagggaaaccgcagaagaagctggctggcatgatcttgtcgcaaaaggtttcattgaatatatcgatactgaggaagaagagaccactatgatatcaatgacgattcatgatcttgtacaagcaagactcaatcatgaagatgcttattctggtacttacacccattgtgagattcacccatcattaattttaggggtttgtgcatcaatcattccttttccggatcacaaccagtccccacgtaacacatatcaatctgctatgggaaagcaagccatgggaatatatgttacaaactatcagtttcgaatggatacactggcttatgtgctttattaccctcaaaagccgcttgttactaccagagctatggagcaccttcactttaggcagcttccggctggaattaatgctattgttgctatttcctgctattctggatacaaccaagaagattctgtcattatgaaccaatcttccattgaccgtggatttttcagatcacttttcttccgttcatatagggacgaggagaaaaagatgggaacacttgtcaaagaggatttttgtcgtccagatagaaataatacaatgggcatgcggcatggctcttatgataagttagatgatgatggtctggcccctccaggtacaagagtttccggtgaggatgttatcattggaaagaccactcctattactcaggaagaatctcaggggcagtctgcacgttacaccaggcgagatcacagcataagcttacgccacagtgagactgggatggttgatcaggttcttctgacaaccaatgctgatggattgaggtttgttaaagtaagggtgagatcagttcgcatacctcagattggagacaagttcagcagtagacatggtcaaaaggggacagtaggcatgacttacactcaagaagacatgccttggactgtggaaggcattactccggatatcattgtgaacccacatgctattccttctcgtatgacaattggtcagcttattgaatgtatcatggggaaggttgcagctcacatgggaaaggaaggagatgctactcctttcaccgatgtcactgtggacaatattagcaaggcccttcataaatgtgggtaccagatgcgagggtttgagaccatgtacaacggccacactgggcgtcggcttactgcaatgatattccttggccccacttattatcaaaggttgaagcatatggtggacgacaagatccattcacgtggaaggggacctgtgcagatcctcaccaggcaaccagctgaagggcgatcacgtgatggtggcctccgatttggggagatggaaagagactgcatgatagcacatggtgctgcgcattttcttaaagagaggctatttgatcagagtgatgcctatagggtccatgtttgtgagcgttgtggattaattgcgattgcaaatcttaagaagaattcatttgaatgcagaggttgcaagaataagacggatatcgtccaggtgcatattccgtatgcctgtaagctactattccaagagcttatgtccatggctatagcaccaagaatgctcacaaaagaagagaagccatcaaaagaccagaagagaaaaggagcttagttcaacataaaacttttgggaacgaactcgaactcatctccctttttctgatgcgtagtgtacatattgttgttcagaccaaaatctggattaaggatcaatatataagtattcagttaaatgtttcgggaggaaatgaaatcgctgcagtgaagggatcctgcaaattttccaaaatactgttggtggtgtaagaatcttcattagcaaaatggtcagatataatgatctccaagaaacatacatgggtttcggatgggtcttttctgtaaggaagtctacttaaagctgctactgcctgctcgatggtgaataaatgccaggagaggagagctttcttttgttagtgtaggaggccgattttatcaaatatctgtattctaaaacagagacattttcttttacatattattctcttcagcaattttgtttttagagaacatggtaattgtgatatggtacttagggttggatagggggcttcgaattgattgctagttactataaatttacatat

SEQ ID NO: 1696 - DNA, 4292 bp, Ceratodon purpureus
gctatcctgagggaaacttcggagggaagcagtctcaagatggttcttaacccattcgccctaagtctggaataatcaaccaaaactcacgcagaatcgcagcgagcctccaacataggcattccaaatttgctctggtttggccatgctgaggcataagtttagttcaccctcgttcggcgaatgctcagaccctattcctgaaagccctcgccagcagtgcgactagggctgggtgctgcgacgacgttcgaatgcgaaaaagagcatacggtgcttaatcgagtgtgtacggtttcagtttgtgaggggaaagagacgagaagagtattttgaaaagcctggagggagggaattcagtggagtagcggagggggtttgacctctttgaggtagggtttgtagattagggtgtgctgagaggggagtttgctggaggggaggagagagtggaggcaagatgttcgggggtgacgaggagtacgatgaggaggaggaggagataacgcaggaggatgcgtgggcggttatcagtgcctacttcgaggagaaggggttggtgcggcagcagctggattccttcgatgagttcattcagaacaccatgcaagaaatcgtggacgagtcctcggacatcgagattcgccctgagtcgcagcacaaccccggccggaacgcggagattggtgatgttacgtacaagatcaactttggccaaatttatcttagtaaacctatgatgactgaggctgatggagaaacagccactctttggccaaaagctgccagactccggaatctgacatactctgcaccactgtacgttgatgtgaccaagttcgtcacaaggaagaccgaagatggagaggaggagactgaacaggaggatttgtccaaagtttacattggcaaagttcccattatgcttcggtctcgttattgtactttgttcgagaactcagacaaagatcttactgagctcggggagtgcccttatgatcaagggggttactttattatcaacggcagtgagaaggtacttattgcccaggaaaaaatgagtacgaatcatgtgtacgttttcaagaagaggcagccaaataagtattgctatgtggctgaagtgcgctctatggctgagagccagaacaggcccccgagtggtatgttcgttcgaatgctctctagagctggtgccaaggggggctcttcggggcaatatatccgtgcaactttaccctacattcgcacggaaattcctatcatcgtggtttttcgagcattgggtttcgtggcagataaagatattttggaacatatttgttatgacttcagcgacactgccatgatggagttgctgaggccttctttggaagaagcttttgttattcagaatcaacaggtagcgctcgattatattggcaaacgtggttctactgttggagtaacaagagaaaaacgtattaagtatgcgaaggagattctgcagaaggaaatgcttcctcatgtgggtgttggagagttttgcgaaacaaagaaggcttactttttcgggtacattatccaccggttgctactctgtgcgataggtggtgcagaagacgaccgtgatcattacggcaataagcgtctggatcttgcagggccccttctgggtggtctctttcgcatgctctttcggaagcttactaaggatgtccgtggctacttgcaaaagtgcgtggacaacgggaaggagatcaatcttgcctatgcagtgaaggctaagaccattactagtggcttgaagtactctctggcgacagggaactggggtcaagcaaatactgcaggtgtaagagccggcgtatcgcaagtgctgaatcgtttgacctatgcttctactctatcacatttgcgcaggctcaattctcccattggccgtgaaggcaagcttgcaaaacccaggcagcttcacaactctcattggggtatgatgtgcccagcagagactcctgaaggccaggcttgcgggcttgtaaagaatttggctctgatggcatatatcactgttggctcagctgccaatccaatcctggagtttttggaggaatggagtactgagaattttgaggagatctccccggctgtaattcccaactccacgaagatttttgtgaatgggctctgggtgggaattcatcgtaatcctgagctgcttgtgcgtacactacgtcagcttcgacgacaggtcgacgtgaacaccgaagttggagtggtacgagacatccggttgaaagagttaaggctatacacagattacggacgctgcagtcgtcctctcttcattgtggagaagcagcgcttgctcatcaagaagcaagatgttcgagcgttgcaaatgaaggaaacgtccgagaatggctggtatgatcttgtgtcgaaggggtttatcgagtacgttgatactgaagaggaggagacgaccatgatttccatgacaattgcggatcttgtcaatgcccgcaacaatccagacgaggcctactctgacacatacacgcattgtgagattcatccgtccatgatccttggggtctgtggctccatcattccctttcctgatcacaatcagtcaccacgtaacacctatcagtctgccatgggcaagcaggccatgggaatttatgtcacgaactaccaacttcgtatggacacgctggcttacgtgctgtactatcctcaaaagcctttagtgaccactcgagccatggaacacttgcattttcggcagcttcctgcgggcatcaatgctatagtagctattgcttgctactccggttacaaccaagaggattctgtcattatgaatcagtcttccattgatcggggtttcttccgctccatcttttacagatcttacagagatgaggagaagaagcaaggtactctaatcaaggaagaatttgagagaccgaacagagagaacaccactggcatgcggcatggttcgtatgacaagcttgatgatgatggccttgccccacctggcactcgagtgtcaggtgaagatgttatcattggcaaaactacgcctctgccacaggatgacaatgccagccaagcgcagcgctacacgaagcgggaccagagtacttgcttgcgtcacagtgaaagtggtatgattgatcaggtcttgttaacgaccaatgctgacggcttgcggtttgtcaagatcagagtccggtctatccggattcctcaaattggagacaagttcagtagtaggcatggacaaaaaggaactgtcggaatgacttacacgcaggaagacatgccatggacacaagagggaattacacccgatatcatcgtgaacccccatgctatcccatctcgtatgaccattggtcagctcattgagtgtatcatgggcaaagtggctgcccatatgggtaaggaaggagatgctacaccgttcactgatgtcactgtcgacaacatcagtaaagctctgcataagtgtggctatcaaatgaggggttttgaagtgatgtacaatgggcacactggccgaaggctcactgcgcacatctttttgggtcctacatattatcagcggcttaagcatatggttgatgataagattcattcaagaggtcggggtcctgtgcaaatcttgacacgtcagcctgccgaaggtcgatcaagagatggaggtttgcgattcggagaaatggaaagagactgtatgattgctcatggtgcagctcatttcttgaaggaacgcttgttcgatcagagcgatgcctatcgggttcacgtttgtgagcattgtggactgattgccatcgctaatttgaaaaagaatacttatgaatgccgaggctgtaaaaacaacaccgatattgtacaggtgcacatcccatatgcatgcaagcttctctttcaggagttgatgtccatggcaattgctccccgtatgtttacgaaggaattgaagatgagaagtgaacacgcgaaaaaggctgctgcctgatattttttagcagtgtgctcttgtactgtacagtagagataatcgtagattgttagatttaggaagtctttttgaagtgtcggagttcgttatcctgggcgagctagggattatcctgaattggtgcatcttctgcaggcttacaatttacattgtaaagtttagggccattttcttggtggagtattagttaaagtttggtaggtcagatgctgttggcaatgacaaagtaggaagttgactctcgtcttacctagtgttgctgctaattatt

SEQ ID NO: 1697 - DNA, 3857 bp, Physcomitrella patens
atgtatggcggtgacgaggaatacgatgatgaagaggaggagataacgcaggaggatgcgtgggcggtcatcagtgcgtactttgaagagaagggtttggtgcggcagcagctggactcgttcgatgagttcattcagaatacaatgcaggaaatcgtggacgagtcttcggatatcgagattcgtcccgagtcacagcacaaccccggtcgtcaggctgagattggcgatgttacatacaagatcaattttggtcaaatctatctcagtaagcctatgatgactgaagccgatggagaaacggccacactttggccgaaggctgctaggcttcgaaacttgacgtattcagctccactctacgtggatgtcaccaagtttgtcacgaggaagactgaagatggggaggaggagacggagcaagaagatctatctaaagtttatattggcaaggtgcccatcatgcttcgttcacgctattgcacactattcgaaaactccgacaaggaccttactgagctcggagagtgtccctatgatcaaggaggctatttcatcattaacggcagtgaaaaggtgctcatcgcacaggaaaaaatgagcacgaaccatgtgtatgtcttcaaaaagaggcaaccgaataaatattgttacgtggctgaagtgcgctctatggctgagaaccagaacagaccccccagtggtatgtttgttcgaatgctctcccgagctggtgctaagggaggttcttcgggacaatatattcgcgcgacgctaccctacatccgcacggaaattccaatcatcgtggtttttagggctctaggtttcgtggctgataaagatatcttggagcatatttgttacgacttcagtgatactgccatgatggagttgctgaggccttctctggaggaagctttcgtgattcagaatcaacaagtggctcttgattacattggaaagcgtggttctactgttggagttactagggaaaaacgtattaagtatgcaaaggagattctgcagaaggaaatgcttccccacgtgggagtaggagagttttgtgaaacaaagaaggcttacttttttggttatattatccaccggctgttgctctgtgcaataggtggagcagaagatgatcgtgatcattatggcaacaagcggttggatcttgcagggccccttcttggtgggctctttcggatgctttttcgaaagcttacaaaggatgtccgaggatacttgcaaaagtgcgtggataatgggaaagaaatcaaccttgcctatgcagtcaaggctaagaccattacaagtggtttgaagtactcgctggctacaggaaactgggggcaggcaaacacagctggtgtgagagcaggagtatcgcaggtgctgaatcgcttgacctacgcttcgactctctcgcatttacgtagactcaactcccccatcggtcgtgaaggcaagcttgcgaagcccaggcagcttcacaattcccactggggtatgatgtgcccagctgagacccccgagggtcaggcatgtggacttgtcaagaatttggcgctgatggcatatattactgtcggctcagctgccaatccaattctggagtttttggaggagtggagtactgagaacttcgaagaaatttctcctgctgtgatccccaactccacaaagattttcgtgaatggtctgtgggtgggaattcatcgcaatcctgagttgcttgtacgaacactgcgtcaacttcggcgacaggtcgatgttaacactgaagtgggggttgtgagagatatccggttaaaagagctacgactgtacacggattacggacgttgtagtcgtcctcttttcattgttgagaagcaacgtttgcttattaagaagcaagacgttcgagcgttacaaatgaaggaatcctccgagaacagttggtacgatcttgtttctaaggggttcattgagtacgtggatactgaagaggaggagacgactatgatctccatgaccattgctgatcttgtcaatgccaggaacaatccagaggaggcctattctgacacatacacgcattgtgagattcatccctccatgattctgggggtctgtggctctattatccccttccctgatcacaaccagtcgccacgtaatacctatcagtctgctatgggcaagcaagctatgggaatttatgtcacaaactatcagcttcgaatggacacgctagcttacgtcttatactatccccaaaagccgttggtgaccacgagagccatggagcacttacatttccgacaacttcctgctggaatcaatgcaattgtagctattgcttgctactcaggttataaccaggaggattctgtcatcatgaaccaatcttctattgatcgagggtttttccgctctatcttttacagatcctacagggatgaggagaagaaacaaggcactctgattaaggaagaatttgagagacccaatagagaaaataccactggtatgcggcatggttcgtatgacaagcttgatgacgatggacttgccccacctggtactcgagtatcaggcgaggatgttatcattggcaagactacaccgttgccacaagatgacaacgctagccaagcccagcgatacacaaagcgggatcagagcacttgcttgcggcatagtgaaagtggtatgatcgatcaagttttactgacaaccaacgccgatggtctgcgttttgtaaagatcagggttcggtctatccggattcctcaaattggagacaagtttagtagtagacatggacagaagggaacagttggaatgacttacacccaggaagatatgccttggactcaagagggaattacaccagatatcattgtcaacccccatgctattccgtctcgaatgactattggtcagctcattgaatgtattatgggcaaagtggctgctcacatgggaaaggaaggagatgccacaccattcactgatgtcactgtggataacattagtaaagccctgcacaagtgtggttaccaaatgaggggttttgaagtgatgtacaatgggcacacaggccgaaggcttactgcacacatctttttgggtcctacttattaccagcgactcaagcatatggttgatgataagattcattcaaggggacgaggtcctgtgcaaatcttgacacgacagcctgcagaaggtcgatccagggatggaggtttgcggtttggagagatggaaagagattgtatgatcgctcacggtgcagctcatttcctgaaggagcgcttatttgatcaaagtgatgcttaccgagttcacgtttgtgagcattgtggtatcattgccatcgccaacttaaagaagaatacttacgaatgccgaggctgcaaaaacaacactgatattgtacaggtgcatattccgtatgcttgtaagcttctctttcaggaattgatgtcaatggcaattgctcctcgaatgtttaccaaggagttgaagatgagaagcgaacatgcgaagaaagctgctgcctaattattctgggcctgatgtatagtagaagattttagattgatatttagagttccagcattgaaggaatagaaagttgttctagacaagctatgcccatctttgagaggtacaccttctgcaggcttatagtttacggtgtaaagttgagggtccattttttggtattggttagagcatcacagatcggggagtgtcggctgtcatgatgaaagcagaagttgacgttcgtttttcttatagtttttaaaattatctgatgaaaacaaaacaaaacaaaatataactttcagttcagtatc

SEQ ID NO: 1698 - DNA, 3915 bp, Petunia hybrida
ataccaaaaacaacaataacagacgaaaaaagaaccccattttgtggaaacctttacgtttaatataatacaagcttcaaaaaattaatctgaaaagatgtatggagaaagtgaatatgtggacgaaaatattgacgatagaactacaatggcagttgatgaacaagaagatgattatgatgatgaatcgcaagagataactcaggatgatgcatgggcagttattagtgcatattttgaagagaaaggtctcgtgaggcaacaattggactctttcgacgagttcatacaaaatacaatgcaagaaattgttgatgaaactgctgatattgagatacgtcctgaatctcaacataatcctgctcgtcaatctgatttcgtcgatacaatatacaagatcaagtttactcagatatacttgagtagacctatgatgacagagtctgatggagagactaataccttgtttccaaaggctgcaagattgaggaacctcacatactcctcccccctatatgttgatgtgagaaaggaagtgataaagaaaggtcatgactatgaagaagtctctgagtgtcaggaatttaccaaagttttcattggaaaggttcctataatgcttcgatcaagctactgcagcttgtataacctatcagagaaagacttaactgagctgggagagtgtccctatgatcaaggtggatacttcatagtcaatggaagtgaaaaagtcctgattgcacaggagaaaatgagcagtaaccatgtttacgtattcaagaaacgacagccaaacaagtatgcatatgtagcagaagttcggtctatagctgagggccaaaccaaggcgcctagcaccatgtttgttaggatgctttcaaggtctaatgcaaaggtaggatcctctgggcaatacattaaagccactcttccatacataaagaatgaaattccaattataattgtcttcagagcattaggatttgttgcagacaaggatatattagcacatatctgctatgactttgctgacacgcaaatgatggaattacttcgcccttccttggaagaggcttttgtgattcaaaatcagcaggttgcacttgactatattggcaaaagaggatctacagttggtttctcaagagaaaggagaattaagtatgccaaagagatcctccaaagggaaatgcttccacatgttggtactagagagtattgtgaaactaagaaagcctattattttggatacatcatccatcggcttttactctgtgtactaggacggaggcctgaagatgatagggatcattatggaaataaaagattggatcttgctggtcctttactcggtggcttattccgaatgctattcagaaagctaacaagggacgtgagatcctatgtccaaaagtgtgttgatagtggaaaggatgtcaatttgcaatttgcaattaaagcaaaaacaataaccagtgggcttaaatattctcttgctactgggaactggggacaagcaaatgcagccggtaccagggcaggagtttcacaggttttgaatcgtttgacatttgcatccactctttcccacttgcgtagattgaactcaccaatagggcgcgagggtaaactggcaaaacctagacaactgcacaattctcactggggaatgatgtgtccagcagaaacgcctgaaggacaagcatgtgggctggtaaagaaccttgcactaatggtgtacataacagtaggatcagcagcaaatccaattttggagtttttagaggagtggagtacagagaattttgaggaaatatctcctgctgtaattccccaatcgaccaaaattttcgtaaatggttgctgggtgggcattcaccgtaatccagatttattggtaaggacactgagacagctgaggagacaggttgatgtcaatactgaagttggagtcgtccgcaatatcaatttaaaggaactgaggctatatacagattatggacgctgtagtaggccattatttattgtcgataaaaagaagttgataataaagaagaaagatattctggcattgcagctaagggactcatctgaagattctggctggcatgatcttatcgcaaaaggtttcattgagtatgttgatacggaggaagaagagactacaatgattgcaatgaccataaatgaccttacaaattcaagactgaacccaagcgaggcttattctgaaacctacacacactgcgaaatccatccatctttgatattgggagtatgtgcttcaatcataccatttcctgatcataaccagtcccctcgtaacacataccaatctgctatgggaaagcaagctatggggatctatgtcaccaattaccaatttcggatggatacattggcctatgttctgtactatccacagaaacctcttgttactactcgtgctatggagcatttgcatttcagacagcttccagccggcattaatgctatcgttgcgatttcctgctattccggatataaccaagaagattctgtcatcatgaatcaatcttcaattgaccgtggcttcttccgctctctattttttcgttcatatagggatgaagagaaaaagatgggaacacttgttaaagaggattttgggcgtcctgatagagaaaataccatgggaatgcgacatggatcttatgataaattagatgatgatggatttgcaccacctggaacaagagtttctggtgatgacgtcataataggaaagaccacccctatttctcaagatgatgctcaaggacaatcagcaagatacacacggaaagaccatagtacaagtctacggcatagtgaaactggaattgtggatcaggttcttttgacaacaaatgcagatggattgaggtttgtcaaaatcaggatgagatctgtcagaattccccaaattggagacaaattcagcagcagacatggacaaaaaggaacaattggaatgacatacacacaagaggacatgccatggacaatggaggggatcaccccagacatcattgtgaatccacatgccattccttctcgtatgacaattggtcagctagttgagtgtgttatggggaaggttgctgctcacatgggaaaggaaggagacgctacccctttcactgatgttactgtggataatatcagcaaagctctgcacaagtgtggttatcagatgcgtggttttgagagaatgtataatggtcatacaggccgtatattaacggcaatgatattcttggggcctacatactaccagaggctgaagcatatggtagatgataagatccactctcgtggccgtggtcctgttcagattcttacgaggcagcctgctgaagggagatctcgggatggaggtctacgttttggagagatggaacgtgactgtatgatagctcatggagctgctcatttcctaaaagagaggctgtttgatcaaagtgatgcttacagaattcatgtatgccagcaatgtggcttaattgcaattgcaaatctgaaaaagatatcatttgagtgcagatcttgcaagaataaaactgatatcgttcaggtgtatattccttatgcctgcaagctactgattcaagagctcatgtccatggccatagccccaagaatgcttacgaaggaagtcaaaccatccaatggaaagaaagctacatgacaacgacataactcaacacctcatcacaagtctctccactggatattcaaaggactccctatgatacgataacaattttcaagaatgcagcacggatggcttgagtgtcaaattcaatatagttttggcgatatcccatgaaccatttttaggcactaaaaatcttttccatacaataactctacgtttttcatgaccacaaacag

SEQ ID NO: 1699 - DNA, 3673 bp, Mimulus guttatus
ttcgtcattctttaatttcaatgtacggcggtggatatcaatacccagacccgtacccggatccgagcaacagcggggcggcatttgtggagggggagggtgacgacgacgacggcggcggcgaagaaccggaggatatatcgcaggaggatgcttggactgtgataagctcgtatttcgaggagaagggtttggttcgtcagcaattggattcgtttgatgagttcatacagaacacgatgcaggagattgtggacgagtcctccaacatcgagatccgacccgaatcccagcacaatccgggtcggagctccgatttcgttgagacagtatacagaatcagcttcgggcagatataccttagtaaaccgatgatgactgaatcagatggagagaccaacacattgtatccaaaagctgcacggttaaggaacctaacctattcgtcaccattgtacgtcgatgtcacaaagagagtcgtaaagaaaggttacgaccacgaagaagtcatagagacacaagagttcaccaaagtcttcatcggaaaggttccaataatgcttcgttcgagctattgtagtttgtaccatctctcggagaaagacttgatggagatgggggagtgcccttatgatcagggcggatactttataataaacgggagcgagaaagttcttattgctcaggagaaaatgagcactaatcacgtctatgtgtttaagaagcgtcagcctaacaaatacgcttacgtggccgaagttaggtccatagccgagtcgcagaacaaggcacctagtggcatgtttgttaggatgctttctagacctggagcaaaaggggggacctcgggacagtacattcgagctacacttccgtacattaggaccgaaattcctataataatcgtgtttcgcgcattgggatttgtggcggataaatatatattagaacatatctgctatgattttaatgatacaaaaatgatggagttgttgaggccttcgttggaagaggcctttgtgatacaaaatcaacaggttgcacttgactacattggaaagagaggatctacggttggtgttacgagagaaaaaagaattaagtacgcgaaagaaatcctccaaagggagatgcttccgcatgtcggtactgatgagtattgtgaaaccaagaaagcctattatttcggatacgtaataaacaggctattactctgcgcacttgggcgaagaccagaggacgatcgagatcactacgcgaataagaggctcgatcttgctggtccattgttagcgggtttatttcgcatgttgttcagaaaattaaccagggatgtcagatcatatgttcaaaggggcgtcgatagtggcaaggaagtaaatttgcaatttgctattaaggcaaaaacaatcacaagtggactcaagtattctcttgccactggaaactggggacaagcaaatgcagctggaactagagctggagtttctcaggtgctcaatcgtttgacatatgcatcaacactctctcatttgaggagattaaactcgcctattggccgtgaaggtaaattggctaaaccgaggcagttgcacaattcacactggggtatgatgtgtcctgcagaaacacctgaaggacaagcatgtggattggtcaagaaccttgcccttatggtgtacataacagtcggatcagcagcaaatccgattttggagtttttagatgagtggagtacggagaattttgaggaaatatcaccagctgtgattcctcacgctacgaaaatattcgtcaatggtaactggattggcattcatcgggatccagagctgttggttagaacactcagacagctaagaagacaggttgatgtgaacactgaagttggaattattcgcgatatacatctgagagagcttcgactatatacagactacggtcgttgcagtcgccccttattcattgtcgagaaacaagagttgcttataaagaagagggatattcttgccctgcagcaaagagaatcggccgatgaatatggttggcatgatcttgtaagaaaaggatttatcgaatacgttgacacagaagaagaggagaccacaatgatttcaatgtcgataaacgatcttgtgaattcgaggcgaaaccctgatgatgcttattccgaaacatacacgcactgtgaaatccatccgtcgctgatattgggtgtttgcgcttcaatcataccatttcccgaccacaaccagtcccctcgtaacacttatcagtcggcgatgggaaagcaagcaatgggaatatacgtgactaattaccaactacgaatggacacgctagcctatgtactttactatcctcagaagcctctcgtcactactcgtgctatggagcatttgcatttcagacaacttccagctggcatcaatgccattgtatccattacttgctactcgggatataatcaagaagattctgtaatcatgaaccaatcttcaattgaccgtggattctttcggtctttgttcttccgttcatatcgggacgaggagaaaaagatgggaacactagttaaagaggattttgggtgtcctaatcgagacacaaccctgggaatgcggcatggatgttacgacaaactagacgatgatggctttgctcctcctgggacaagagtctccggtgatgacgtcatcatagggaagacaaaaccaatttctcaggaagatgctcaaggaaaatccgcaagattcacaaataaggaccatagtactagtttacgtcacagcgaaagtgggatcgtcgatcaggtacttttgacaacaaatgctgacggactgaggtttgtcaagattcgaatgcgatcggttcgaatacctcaaataggagacaaatttagcagcagacacgggcaaaagggaacgataggaatgacgtacacacaggaagatatgccgtggagtatcgaaggcattacacctgacataatagtcaacccgcatgctattccttctcgcatgacgattggtcagcttattgaatgcattatggggaaggtggctgctcacatgggcaaggaaggagatgctacaccttttactgatgttactgtggacagcattagcaaagctctgcacaaatgtggttaccaaatgcgaggattcgagacaatgtacaacggccacacgggccgtcagctgacagccatgatattccttggccccacttattaccaacggctaaagcacatggttgacgacaagatccactcgaggggccgaggcccggttcagatcctgacccgacaacccgccgaaggaagatccagagacggtggtttgagattcggagaaatggagcgcgattgcatgatagctcatggagccgcgcatttcttaaaagagaggttgttcgaccagagcgacgcttacaggattcacgcgtgcgagaattgcggtattatcgccattgccaatctaaagaagcttagcttcgaatgtaggagctgcaagaataaaacagacattgttcagatatacattccttacgcatgcaagcttctgatacaagaactcatgtcgatggcgatttcaccgaggctgctcacaaagggtttggacacatccaaggaacaaaaaaagaaaggtggataatttccagctgcctccat

SEQ ID NO: 1700 - DNA, 4112 bp, Elaeis guineensis
tccttcgatgaattcatccagaacaccatgcaggagatcgtcgatgagtcggccaacatcgagatcagacctgaatcccaacacaatcccggccgccagtctgacttcgtcgagacaatatacaagatcagctttggccaaatatatttgagcaggcctatgatgacagagtcagatggagaaactgcgacattattcccaaaagctgcaaggctgaggaatctgacatactcagcccccttatatgtagacgtcaccaagaaagttataaagaaagggcacgactgtgaggaagtgactgagacacaggaatttcccaaagtatttattgggaaggttcctattatgctacggtctagctattgcacgttatatcagaattctgaaaaagatctaacagaacttggagaatgcccttatgaccaaggtggatactttataattaatgggagcgaaaaagttctgattgcacaggagaagatgagcaccaatcacgtttatgtctttaaaaaaaggcagcccaataagtatgcttatgttgctgaagtccgatcaatgccagagtcccaaagcaggccagcaagcaccatgtttgtgcgcatgctttcccgtaccagtgccaaagggggttcttcaggacagtatattcgtgctactcttccatacatacgagccgatataccaataattattgtatttcgagcactaggttttgttgccgacaaagatattttagaacatatatgctatgacttcagtgatacacaaatgatggaattgctgagaccatctttggaagaagcatttgttattcaaaatcaacaggtggctctggactacatagggaagcgaggggcaactgttggtgtgacgagggagaagaggatcaagtatgcaaaagaaattcttcaaaaagaaatgctgcctcatgttggtgttggagaattttgtgaaactaagaaagcatactattttggttacattattcatcgtctgttgctgtgtgcacttggacgaagaccagaagatgatagggatcattatggcaacaaaaggctggaccttgctggtcctctacttggaggcttgttcagaatgctttttagaaaattgaccagggatgtgagatcttacgtccagaagtgtgtagataatggaaaagatgttaatctgcaatttgcaatcaaagctaaaaccatcacaagtggccttaaatattcccttgctactggaaattggggacaagcaaatcaagctggcaccagagcaggggtttcacaggttttgaatcgcctaacatatgcttctactctctctcacctgcggaggttgaactctcctataggacgtgaaggtaagttggctaaacctcgacagttgcacaattctcattggggaatgatgtgtcctgctgaaacacctgaaggacaggcttgtggattggtgaaaaatctcgctttgatggtgtacattactgtaggatcggctgcacatcctattttagaatttcttgaggagtggggtactgaaaactttgaggaaatatcacctgcagtaattcctcaagcatctaaaatttttgtcaatggttcctgggtgggtattcatcggaaccctgacctcttggtgaggaccttaagacggttgaggagacagattgatgtcaacactgaggttggagttgtacgagatattcgtctcaaagaactacggctttatactgactatggtcgctgtagtcgtccactatttattgtagagaaccaaaggctgctgataaagaaaaaagatattcaagcactgcaacaaagggaatctccagaggaaggttggcatgatcttgttgcgaagggatttatagagtacattgataccgaggaggaagagactacaatgatagccatgactatcaatgatctcgtaaatgcaagacagaacccagaggaggcatactcggaaacttacactcactgtgagatccatccatcattaattttgggtgtttgtgcatctatcatcccttttccagaccacaaccagtcacctcgtaatacataccagtcagcaatgggcaagcaagccatggggatttatgtaaccaattaccaattacgaatggatacattggcctatgttctctactatcctcaaaagcctcttgttacaactcgtgccatggaacatttgcactttagacaattacctgctgggattaatgcaattgttgcaattgcctgctattcgggatataaccaagaagattctgttattatgaaccaatcttcaattgatcgtggattctttcggtctttgtttttccgttcttacagagatgaggaaaagaagatgggaactcttgttaaagaagacttcgggcgcccaaatagggaaaatacgatgggtatgcggcatggctcttatgacaaattggatgatgatggtcttgcgcctccgggtacaagggtctctggtgaagacgtcataattggaaagacatctccaatccctcaagatgattctcaaggtcaagcttcaagatacacacgtcgtgatcatagtaccagtgtacgacatagtgaaagtgggatggtggatcaggtcctattgacgacaaatgctgatggtttgagatttgtgaaagtaagaatgaggtcagttcgtattcctcaaattggtgataaatttagtagcaggcatggccaaaagggaactgttggaatgacatacacacaagaagacatgccatggactgtggaaggcattacacctgacattattgtgaatccacatgccattccttctcgaatgacaataggtcaacttattgagtgcatcatgggaaaagttgctgcccatatgggaaaggagggagatgctactccttttactgatgtcacagtggacaatatcagcaaagctcttcataagtgtggatatcagatgcgtgggtttgaaactatgtataatggccacactgggcggaagctgactgccatgatattccttggacctacttattaccagagactgaagcacatggttgatgacaagatccactctcgagggcgtggacctgtgcaaattcttacaaggcagccagcagaaggacgctctcgtgatggaggtcttcgctttggtgagatggagcgagattgcatgattgcacatggggctgcacatttcctgaaggaaaggttatttgaccaaagtgatgcttatagggttcatgtttgtgagagatgtgggcttattgctattgccaactcaagaagaattcctttgagtgcagaggttgcaagaacaagactgacattgttcaggtgcatataccttacgcatgtaagctgctttttcaagagctcatggccatggcaattgctcccagaatgttcacaaaagaaatgaagccagccaaagatcaaaagaagaaaggagcctaaatcattgtacccatacttttatggcctactgatgcgtagtccttgtttgtacccaaaaaaaaaaaacgtgatccttgttgtaagatgtgggatattggtactgcttcgggaaatccagaaattttgaggtcaggcttcattattatgatggtgcatattctcatatttgaagtggttgtcagttgtgtatgctggtctgagcagtcgcggtagttctaaattgctgctttgagggcgatggagagaagttgattctgtttatgctgctcaggatcatcttgaagacaactatatgtggtggaaggaaagggtgttttgattagcttgagccttcattcatttggaagaaagcacgacatgtgtcatctacttgccatactgctatgggcgttaagggagcatgtacatgtctcacaagtgtttagctattcatgtaaaacttttgcgtagattatctagcatcacgtggagatactactgtggttgcatatttgaataattgcgccatgctaagtttaggctaatgaacttgtttttcggttcgtctttgagaagtaatcgtttgtgggaatcatacaatagttgtgtagtggtaccccttcttaaatgtgaaagcttcttgatagacaaaaaaaaaaaactaaaagtaagacgtacgtccgaacggacgga

SEQ ID NO: 1701 - DNA, 4234 bp, Solanum lycopersicum
aaaaattgaaaaacctaaattctgaaaactctcagtttcacttctgcattttctcggcgaatcgatcaacaatggagtattttacctgaaactcaaattctacgtaaatcggacaagttttcgtcaagtattagggtttaatttccccaaaacgttaaccggagaataattgatgaattataagaattaattgagcaattagaaacaaaatttagattctctgtttgttgaaattatactggaattatgatgtatggagataatgaatatgttgatgatagagatatggtgcaagtagaagacgaaggaggagaaggaagaggtgatgttgatgaagatgaagatgaagatgagtcacgggagataactcaggacgatgcatgggctgttattagttcatattttgaagaaaaaggacttgtgaggcaacaattggattcgtttgatgagtttatacagaatacaatgcaggaaattgttgatgaaactgctgatattgaaattcgacctgaatctcagcataatcctagtcgtcaacctgatttcgttgagacgatctacaagatcaagtttactcagatatacttgagtagacctatgatgacagagtctgatggagagactaatactttgtttccaaaggccgcaaggttaagaaacttgacatactcttccccgctatatgttgatgtgaagaaggaagtaataaagaaaggtcatgactatgaagaagtgacagaaaatcaggaatttaccaaagttttcattggaaaggttcctataatgcttcggtcaagctactgcagcttgtataacctgtcggagaaagatttaacagagttgggagagtgcccgtatgatcaaggtggatacttcatagtcaatgggagtgagaaagttctgattgcacaggaaaaaatgagcagtaatcatgtttatgtattcaagaaaagacaaccaaacaagtatgcttatgtggcagaagttcggtctatatccgagggccaaaacaaggcacctagtggcatgtttgttaggatgctttctaggtctaattctaaggttggggcgtatggccagtatattcgtgccactcttccatacatacggactgaaattccaattatagtagtcttcagggcattaggatttgtcgctgacaaggatatattggcgcatatttgttatgattttgctgacactcagatgatggaattacttcgcccttccttggaagaagctttcgtgattcaaaatcagcaggtggcacttgactatattggcaaaagaggatctactgttggtttcacaagagaaaagagaatcaagtatgccaaagagattctccaaagagaaatgcttccgcatgttggtactagagaatattgtgaaactaagaaagcctactattttggctacatcatccatcgtcttttactctgtgtattgggacggaggcctgaagatgatagggatcattatgctaacaaaagactggatcttgctggccctttacttggtggcttattccgaatgctattcaggaagctaacaagggatgtgagatcctatgttcaaaagtgtgttgacggtggaaaggatgtgaatttgcaatttgccattaaagcaaaaacaattacaagtggacttaagtattctcttgctacggggaactggggacaagcaaatgctgctggtaccagggcaggagtttcacaggttttgaatcgtttgacatttgcatctactctttctcacttgcgtagattgaactcaccgatagggcgggagggtaaattggcaaaacctagacagcttcataattctcactggggaatgatgtgtccagcagaaacgcccgaaggacaagcatgtggactggtaaagaaccttgctttaatggtgtatataacagtaggatcagcagcaaatccaattttggagtttctagaagagtggagtacagaaaattttgaggaaatatctcctgcggttattccccaatctaccaagatttttgtaaatggttgttgggttggcattcatcgtaatccagatctgttggttaggacactgagacagctgaggagacaggttgatgttaatactgaagttggagttgtccgaaatataaatctgaaggaactgcgcctgtatacagattatggacgttgtagtaggccgttattcatagtggataaaaagagattgagaataaagaagaatgatattatcgcactgcaaatgagggagtcatctgaagattctggctggcatgatcttgtggcgaaaggatttattgagtatgttgatactgaggaggaagagactacaatgatcgcaatgaccataaatgatcttacaaattcaagggtgaacccagatgaggcttatgctgagacctacacacactgtgaaatccatccatctttgatattgggagtgtgcgcttcaatcataccatttccagatcataatcagtcccctcgtaacacatatcaatcagctatgggaaagcaagcaatggggatttatgtcaccaattaccaatttcggatggatacattggcctatgtactgtattatccacaaaagcctcttgttactacgcgagctatggagcatttgcatttcagacagcttccagctggcattaatgccattgttgccattacctgttattctggctataaccaagaagattctgtcatcatgaatcaatcttcaattgaccgtggcttattccgctctctatttttccgttcatatagggatgaagagaaaaagatgggaacgcttgttaaagaggattttgggcgtcctgatagagaacataccatgggaatgcgacatggaaattacgataaattagaagatgatggatttgcacctcctggaacaagagtttctggtgatgatgtcataattggaaagaccacacctatttctcaagatgaggctcaaggacaatctgcaagatacacgcgcaaagaccatagtaccagtctacgacatagtgaaactggaattgtggatcaggttcttttgacaacaaatgcagatggattgagatttgtcaaaataaggatgagatctgtcagaattccacagattggagacaaattcagcagccggcatggacaaaaaggaaccattggaatgacttatacacaagaagacatgccatggtccgctgaaggcatcaccccagatatcattgtgaatcctcatgctatcccttctcgtatgacaataggtcagctagttgagtgcatcatggggaaggttgctgctcacattggaaaggaaggagatgctaccccttttactgatgttactgtggatagtatcagcagaactctacacaattgtggctatcagatgcgtggttttgagagaatgtataatggtcatacaggtcgtgtactgcctgcaatgatattcttggggccaacttactaccagagactgaagcacatggtggatgataagattcattctcgtggccgtggtcctgtgcagattctcactagacagcctgctgaagggagatctcgtgatggaggactacgatttggggagatggaacgtgactgtatgatagctcatggagctgcacacttccttaaagagagactgtttgatcaaagtgatgcttacagagttcatgtatgccagcaatgtggtttaatggctattgcaaatctgaaaaagatgtcattcgagtgcagatcttgtaggaataaaactgacaatgttcaggtgtatattccctatgcctgcaagcttctgattcaagagctcatgtcaatggcaattgccccaagaatgcttacaaaggaactgaaaccatcaaatcgaaagtaagcatcctgacagtacaacttgtttcagactccggttctgcacttggtcatcacatatctacttaactaaatattttcccaccatggcattagcgaactgttggaaagagtttggagtctgataagcagttgcacaagtctctttcgaatggtaaacaaacattagttaacctggataatctaactttattttatcagacattatccagagctaataaacttaggtgctgttttgacatgttttactatttttcaaaatattttttgattatacattgacctgattttaaacagcaccaagtgaactcatattaactttactttttagagactattcgtttggttatctccagattagcacgtttttt

SEQ ID NO: 1702 - DNA, 3810 bp, Antirrhinum majus
  misc_feature (3753)..(3759): n is a, c, g, or t
tctacaaaatcagcggaatcgaaattgtaaaaacagttttgatttaattgtatatattttctaccagttgaaaatgtacggcggtggggatccgtatccggatcaaaacgtagtggaagtacacgatcacgacgaggaggagaaggaggatgaggatatatcgcaggaggatgcatggacagtgataagctcttatttcgaggagaaaggtttggttaggcagcagttggattcgttcgacgagttcatacagaacaccatgcaggagattgtcgatgaatcctccaacattgagatccgacccgaatctcagcacaatcccggtggaaactccgactttgccgaggcgatgtacaggattagctttggtcaaatataccttagtaaacctatgatgacagaatctgatggtgagactaatactttgtttccaaaagccgcaaggttgagaaatttaacgtactcttcaccactgtatgttgatgtcactaagcgagtcgtgaaaaagggtttcgactgtgaagaagtcacagagactcaagaattcgccaaagtttttattggaaaggttccaattatgctcaggtcaagctattgtagtttgtatcatctgcctgagaaagatttgatggatctgggggagtgcccttatgatcaaggtggatacttcatagtaaatgggagtgagaaagtccttattgctcaggagaaaatgagcaccaatcatgtatatgtgttcaagaaacgacagcctaacaaatattcttacgtagctgaagtaaggtctatagccgagtcccaaaacaaggcgcccagcggcatgtttgtgaggatgctttcgagatctggtgctaaaaggggcacatcggggcagtacatttatgctacactcccttacattaggactgaagttcccataataattattttccgcgctttaggttttgtggcagacaaagatattcttgaacatatctgctatgattttaatgattcaaaaatgatggaattactgcgacctttcttggaagaggcatttgtgatccaaaatcaacaggtggctcttgactacatagggaaaaggggctctactataggagttacgagagacaaaaggattaagtatgctagagaaatcctgcaaagagagatgcttccacatgttggtactgaggagtactgtgaaactaagaaagcttattattttggatatatcatcaataggctcttactttgtgcgcttggacgaaggccagaagatgatcgggaccactatgcaaataagaggcttgaccttgctggtcctttactcgcgggtctatttcgaatgttgttcagaaagttaaccagggatgtgagatcctatgttcaaaagtgtgtcgacaatgggaaggatgtaaatctgcaatttgcaattaaagcaaaaacaatcacaagtggactcaagtattctattgcaactggaaattgggggcaagcaaatgctgctggtaccagagcaggagtttcacaggtgcttaatcgtttaacatatgcctcaacactttcccatctaagaagattaaactcacctattggccgtgaaggtaaattggctaaacccagacaactgcacaattcccactggggcatgatgtgtcctgcagaaactcctgaaggacaggcatgtggactagtaaagaaccttgcactgatggtctacataacagtaggatctgcagcaaaccccattttggagtttttggatgagtggagtacagaaaactttgaggaaatatcgccagcagtgattcctcaagctaccaaaatatttgtaaatggtaactggattggcattcaccgtaatccagagttattggttagaactctcagacagctgaggagacaggttgatgtcaacacagaagttggaattattcgtgatatacaccttaaagaacttcggctatacacagactatggccgttgtagtcgccccttattcattgttgataaacaaaggttggttataaagaagaaggatattcttgccctgcaacaaagagaatcagctgacgagtatggctggcatgatcttgtcaggaatggatctgttgagtatgttgatacagaggaggaggaaactacaatgatatcaatgacaataaatgatcttataaattcgaggcacaacccagatgctgcttattctgaaacatacacccattgtgaaatccatccatcactggtattgggtgtttgtgcttcaataataccgtttccggaccacaaccagtcacctcgaaacacttatcaatcggcaatgggaaagcaagcaatgggaatatatgttaccaattaccaattacgaatggatacactagcctatgtactctactatcctcagaagcctcttgtcactacccgtgcgatggagcatttgcactttaggcagcttccagccggcattaacgccattgttgctattgcctgctattctggatataaccaagaagattctgtaatcatgaaccaatcttcgattgatcgtggattctttcgctccctattctttcgctcttaccgggatgaagagaagaagatgggaacacttgtgaaagaggattttgggtgccctaacagagataacaccatgggaatgcgacatgggtcatatgacaaattagaggatgatggctttgcacctcctggaacaagagtttctggtgatgatgtaatcattgggaagacaacaccatttacgccggacgaaaatcagaatataagattcacgcgccaggaccatagtagtagtttacgccacagtgaaagtggagtcgtggatcaggttctattgacgacaaatgctgatggattaagatttgtcaaagttcggatccgatcagttcgaatacctcaaataggagacaaatttagtagcagacatgggcaaaagggaacaattggaatgacttacacgcaggatgatatgccttggtcaatcgagggcatcacccctgacataatagtgaacccccatgctattccttctcgcatgactattggtcagctcattgagtgcatcatggggaaagttgccgctcatatgggaaaagaaggagatgctacaccgtttactgatgttactgtggacaacatcagcaaagctcttcacaaatgtggttaccaaatgcgcggtttcgagacaatgtacaatggccacacaggccgtccactaacatcaatgatattcttggggccaacttactaccagaggctaaaacacatggtggatgataagatccactctcgaggtagagggccagtacagatcctgacgaggcagccggctgaaggaagatcacgagacggtggtctgagattcggagagatggagcgtgactgcatgatagcacatggagctgcccattttctcaaggagaggttgtttgatcagagtgatgcatatagggtgcatgtgtgtgagagatgcgggttgatggggattgctaatctaaagaagcatagctatgagtgcagaagttgcaagaacaaaacagacattgttcagatatatatcccttatgcttgcaagcttctgattcaagaactcatgtctatggccatcgccccgaggctacttacgaacgatgtaaaatcagtcaagggacaaagtaagacagggggatagcatgcgttcctgtttctgtttcaagggaattggtatttaccaactattcacgtttttttgctcttaaccatcgaattgttaannnnnnnaaccctatctaaactttgatataacttaatcacctaacaacttattttgtc

SEQ ID NO: 1703 - DNA, 3923 bp, Solanum phureja
aaatattgaaaacctaaattctgaaaactcccagtttcagttctgcatcttctcggagaagcaacaatggagtatttcacctaaaactcaaatttctacgtaaatcggacaatttctcgtcaagtattagggtttaatatcccccaaaacgttaaccgaagaataatcgaggaattataagaattaattgagtaattagaaacaaaattagatcgtctgtttgttgaaatcaatattgttatactggaattatgatgtatggagataatgaatatgttgatgatagagatatgatgcaagtagaagacgaaggaggagaaggaagaggtgatggtgatgaagatgaagatgagtcacaggagataactcaggacgatgcatgggctgttattagttcatattttgaagaaaaaggacttgtgaggcaacaattggattcgtttgatgagtttatacagaatacaatgcaggaaattgttgatgaaactgctgatatcgaaattcggcctgaatctcagcataatcctagtcgtcaagctgatttcgtggagacaatctataagatcaagtttactcagatatacttgagtagacctatgatgacagagtctgatggagagactaatactttgtttccaaaggctgcaaggttaagaaacttaacatactcttccccgctatacgttgatgtgaagaaggaagtaataaagaaaggtcatgactatgaagaagtgacagaaaatcaggaatttaccaaagttttcattggaaaggttcctataatgcttcgatcaagctactgcagcttgtataacctatcggagaaagatttgacagagttgggagagtgcccttatgatcaaggtggatacttcatagtcaatgggagtgagaaagttctgattgcacaggaaaaaatgagcaataatcatgtctatgtattcaagaaaagacaaccaaacaagtatgcttatgtggcagaagttcggtctatatccgagggccaaaacaaggcacctagtggcatgtttgttaggatgctttctaggtctaattctaagggggcgtatggccaatatattcgtgccactcttccatacatacgggctgaaattccaattatagttgtcttcagggcattaggatttgtagctgacaaggatatattggcgcatatttgttatgattttgctgacactcagatgatggaattacttcgcccttccttggaagaagctttcgtgattcaaaatcagcaggtggcacttgactatattggcaaaagaggatctactgttggtttcacaagagaaaagagaatcaagtatgccaaagagattctccaaagggaaatgcttccacatgttggtactagagaatattgtgaaactaagaaagccttctattttggctacatcatccatcgtcttttactctgtgtactgggacggaggcctgaagatgatagggatcattatggaaacaaaagactggatcttgctggccctttacttggtggtttattccgaatgctattcaggaagctaacaagggatgtgagatcctatgttcaaaagtgtgttgacggtggaaaggatgtgaatttgcaatttgccattaaagcaaaaacaattacaagtggacttaagtattctcttgctactgggaactggggacaagcaaatgctgctggtaccagggcaggagtttcacaggttttgaatcgtttgacatttgcatctactctttctcacttgcgtagattgaactcaccaatagggcgggagggtaaattggcaaaacctagacagcttcataattctcattggggaatgatgtgtccagcagaaacgcccgaaggacaagcatgtggactggtaaagaatcttgctttaatggtgtatataacagtaggatcagcagcaaatccaattttggagtttctagaagagtggagtacagaaaattttgaggaaatatctcccgcggttattccccaatctaccaagatttttgtaaatggttgttgggttggcattcatcgtaatccagatctgttggttaggacactgagacagctgaggagacaggttgatgttaatactgaagttggagttgtccgcaatataaatctgaaggaactgaggctgtatacagattatggacgttgtagtaggccgttattcatagttgataaaaagagattgaggataaagaagaaggatattgtcgcactgcaaatgagggagtcaactgaagattctggctggcatgatcttgtggcgaaaggatatattgagtatgttgatactgaggaggaagagactacaatgatcgcaatgaccataaatgatcttacaaattcaaggctgaacccagatgaggcttatgcggagacctacacacactgtgaaatccatccatctttgatattgggagtgtgcgcttcaatcataccatttccagatcataaccagtcccctcgtaacacatatcaatccgctatgggaaagcaagcaatggggatttatgtcaccaattaccaatttcggatggatacattggcctatgtactgtattatccacaaaagcctcttgttactacgcgagctatggagcatttgcatttcaggcagcttccagctggcattaatgccattgttgccattacctgctattctggctataaccaagaagattccatcatcatgaatcaatcttcaattgaccgtggcttcttccgctctctatttttccgttcatatagggatgaagagaaaaagatgggaacgcttgttaaagaggattttgggcgtcctgatagagaacataccatgggaatgcgacatggaaattacgataaattagaagatgacggatttgcacctcctggaacaagagtttctggtgatgatgtcattattggaaagaccacacctatttctcaagatgaggctcaaggacaatctgcaagatacacgcgcaaagaccatagtaccagtctacgacatagtgaaactggaattgtggatcaggttcttttgacaacaaatgcagatggattgagatttgtcaaaataaggatgagatctgtcagaattccacagattggagacaaattcagcagccggcatggacaaaaaggaaccattggaatgacttatacacaagaagacatgccatggtccgctgaaggcatcaccccagatattattgtgaatccacatgctatcccttctcgtatgacaataggtcagctagttgagtgcatcatggggaaggttgcttctcacattggaagggaaggagatgctacccctttcactgatgttactgtggatagtatcagcaaaactctactccagtgtggctatcagatgcgtggttttgagagaatgtataatggtcatacaggtcgtatactaagtgcaatgatattcttggggccaacttactaccagagattgaagcacatggtggatgacaagatccattctcgtggccgtggtcctgtgcagattctcactaggcagcctgctgaagggagatctcgcgatggaggactacgatttggggagatggaacgtgactgtatgatagctcatggagctgcacacttccttaaagagagactgtttgatcaaagtgatgcttacagaattcacgtatgccagcaatgtggtttaatggctattgctaatctgaaaaagatgtcattcgagtgcagatcttgtaggaataaaactgacaatgttcaggtgtatattccctatgcctgcaagcttctgattcaagagctcatgtcaatggctattgccccaagaatgcttacaaaggaattgaaaccatcaaatggaaagtaagcatcctgacagcaccacttctttcacactccagttctgcacttggtcatcacacatcta

SEQ ID NO: 1704 - DNA, 3668 bp, Tripterygium wilfordii
actatctataagatcagctttggtcagatatacttgagcaagcctatgatgacagagtccgatggagaaactgcaactttattcccaaggctgcgaggctgaggaacctaacctactcagcccctttatacgtggacgtcacaaagagggttattaagaaagggcatgatggtgaagaagtcacagagacacaagatttctcaaagaccttcattggaaaagtccccataatgctccgatcaagttattgcacattgtaccagaactcggagaaggatttaacggaacttggggagtgtccatatgatcaaggtgggtattttatcatcaatgggagtgaaaaggttctcatagcacaggagaagatgagtaccaatcatgtttatgtgttcaagaagagacagccacacaagtttgcatatgtagcggaagttcgatcgatggcagaatcccagaacaggccgcctagtaccatgtttgtgcggatgctttctcgaactagtgctaaagcgggatcttcagggcaatatattcgtgctacgcttccatacattcgaactgaaattccgattataattgtgtttcgtgctctgggttttgttgctgacaaagacatattggagcacatatgttacgacttttctgatacgcaaatgatggagttgcttcgaccatctctagaagaagcatttgttattcaaaatcaacaggttgcattagactacattggaaaacgaggatcaactgttggtgtgactaaggagaagagaattaagtatgcgaaagagatcctacaaaaggaaatgcttcctcatgttggtgttggagaattctgtgagacaaagaaagcttactattttggatatatcatccaccggcttctactttgtgcactaggccgaagggcagaagatgatagggatcattacggcaataaaaggctggatcttgctggccctttacttggtggcctgtttagaatgctcttcagaaaactgacaagggacgtgagagcttatgtgcagaggtgcgttgacaatggaaaagatgttaacctgcaatttgcaatcaaagcaaaaactatcacaagcggtctcaaatattcactagctactgggaactgggggcaggctaatgcagctggtacaagggctggagtgtcacaggtgttaaatcgtttaacatatgcctctaccttgtcacacttgcgaagattgaattcaccaataggccgtgaagggaagttggcaaaacctcgtcagttacataattcacaatggggaatgatgtgtccagctgagacacctgaaggccaagcatgtggacttgtaaagaatcttgcgctgatggtctacataacagttggatcagcagcgcttccgatcttggaatttttggaagagtggggtactgagaattttgaggaaatatctcctgcagtgattccccaagctacaaaaatatttgtcaatggttgttgggttggtatccatcgtgatcctgatatgttggtgaaaactttgagacgtctgaggagaagggttgatgtcaatactgaagttggggttgttagagatatccgtctgaaggaattgcggatatatactgactacgggcgctgcagccgtcctttgttcattgtggagaagcaaagacttttgataaagaagaaggatatccatgcattacaacaaagggaaagcggggaagatggggcatggcatgagcttattactaagggatttatagaatatattgacacagaagaagaggagacgacaatgatttccatgactattaatgaccttgtacaagctaggttcaatccagaggaggcttattcagaaacttatacccattgtgagatccacccatcattgattcttggtgtttgtgcttcaatcattccatttccggaccataatcagtccccacgtaatacatatcaatctgccatgggtaagcaagcgatgggaatttatgtcaccaattaccaattccgaatggacacactggcttatgtcctctactatcctcaaaagccccttgttactacacgagcgatggagcatctccacttcaggcagcttcccgctggcattaatgcaattgttgccattgcgtgctattctgggtacaaccaagaagattcagtcatcatgaaccagtcatcaatagatcgtggattctttcgatcactttttttccgatcatatagggatgaagagaaaagatgggtacacttgtgaaagaagattttgggcgtccagacagagctaataccatgggaatgaggcatggctcttatgataaacttgatgatgatggtcttgcacctcctggtacaagagtttctggtgaggatgtaatcattggaaagacaacccctatttctcaggaagatgctcagggccaaggatcacgatacacaaggcgtgatcatagcataagtttgcgtcacagtgaaacaggaatggtggatcaagttctattgacaacaaatgctgatgggttgaggtttgtgaaagtaagagtgagatctgttcgaataccacagattggggacaagtttagcagtaggcatggtcaaaaggggacagtgggcatgacttatacgcaagaagatatgccatggactgtggaaggcatcacacctgatatcattgtgaatccccatgctattccctctcgaatgacaattggtcagcttattgaatgtataatgggcaaggttgctgctcacatgggaaaagagggagatgccactccttttactgatgtcactgtggacaatatcagtaaagcacttcataaatgtggatatcaaatgcgtggctttgagaccatgtataatggtcatactggccgtcgtctcactgctatgatattccttggtcccacatattaccaaagattaaagcacatggtggatgacaagatccattcacgaggtcgtgggcccgtgcaaattcttacgaggcaacctgctgagggacggtctcgtgatggtggtcttcgttttggagaaatggaacgagattgcatgattgctcatggtgctgctcactttctcaaagagagattgtttgaccaaagtgatgcatatagagtccatgtatgcgagcgttgtgggttgatagccattgcaaatctgaagaagaattcctttgagtgtagaggttgcaagaacaaaaccgacattgtccaggtccacattccttacgcatgcaaactgcttttccaagagcttatggccatggcgatagcaccaagaatgttgacgaaggatgaaaaaccacccaaagccccaaagaagaaaggagcctgacaaaattgactcctgaactcttgaaactcgagggtttttgtaattgcgcgctgcggaatgtaaagagtcagtatgtgtaaacaccgaatatgagatggtatgtaggaacttccacagtagtagatactgtttcaccataaaaaacagttgtcttcgggaattccatgttgaggaccgagcttctgtgagctaaagataagtggatggactaccagtttagccgttggaaaattccattccgaatatgataggccatggagatgttactgcgcgtatgtttttgtttatgttgtttttttttttattatttttgtttgtagtcatgcatatatgttgtgta

SEQ ID NO: 1705 - DNA, 3801 bp, Brassica rapa
atggactacaaacagaaccaaacttacattgatgccgacgataaggagattacacaagaggacgacgatgaggagattacacaggaggacgcatggaccgtcatctcagcctacttcgaagaaaaaggtctcgttcgtcagcagctcgattctttcgatgagtttattcagaacactatgcaagaaatcgtcgacgagtcgtctgatgttgagatccgagccgagtcccagcacaatcctggccaccaacctgatttcgccgagagaaactacaatattagttttggacagatttatctgagtaagcccacgataacggagtctgatggagagactgccaccttgttccccaaggctgcaaggttgagaaacctcacctactcggctcctttgtatgtcgacgtttgcaagaccgttattatgaaagggcatgatggggaggaaattacggagacacaggattttaccaaagttttcatcggaaaggttcccatcatgcttcggtctacttactgtaccttgcatcagaattcggagaaggatttgacagagcttggagaatgtccgtttgatcagggcggatacttcattattaatggcagtgaaaaggttctgattgctcaagagaagatgagttcgaaccatgtttatgtgttcaagaagagacagccgaataagtatttgtatgtcgctgaagtccgttccatggcggaagaccaaaataaacctccgagcacaatgtttgtgcgtatgctctctggctcgaaagggggttcatctggacagtttattcgatgtactcttccatatatcaagaaagaaattcctattatcatagtatttcgtgcattgggatttgttgccgataaggacatattggaacgtatatgctatgagtttggagatactcagatgatggagttgctcaggccttccttggaagaagcttttgtgattcaaagtcagcaggttgcccttgactatattggaaaacgtggtgcgcctgttggtacatccaaggaaaagagaataaagtatgcgagagatatccttcagaaagaaatgtttcctcatataggagtcggggagtttgagacgccgaaagcttactacttcgggcttatcatacaccggctgctgcgttgtgcacttggccgaaatccagaagatgatagggatcattatggtaacagaaggctggatcttgctggtcctttacttggagggctgtttagaatgcttttcagaaagctaacgagggacgtgagatcttatgttcagaagtgcgttgacaatggcaaagaagtcaatcttcactttgccattaaggctaaaacaattacctctggcttgaaatatgctcttgctactgggaactggggccaggcaaacgctgctggcacaagagctggagtctctcaggttctaaaccggttaacatatgcctcccctttgtcacatctgaggcgtcccaattctcctattgggcgtgaaggaaaattggcaaaaccaagacaactgcacaactcacaatggggtatgatgtgccctgctgaaacacctgaaggacaggcttgtggtctagtgaaaaacttggcgctcatggtctacgttacagttgggtcagctgcttctcccatcttggcaattttgtcggatttttggaagaatggggacttgagactctcgaggtctgaaatatccccagcagatataccccaagctacaaaaatctttgtcaatggaaagtgggttggaattcatcgaattcctgacatgttggttagaacgttgagacttttgagaagaaggaatgatattaacactgaagtcagcgttgttagagatattcgtctgaaagagctcaggatatacactgactatggtcgctgtagtcgtcccttgtttattgtggataatcagaggctcttaataaagaagaaagatatatactctctgcaacaaagggaaagtgcagaagaagatggttggcatcatctacttgtaaaggggtttatagaatatgtagacacagaggaagaggagactactatgatatccatgactatcaatgatctggttcaagctaggctccgtcccgacgaggcatattctgacacttacacacattgtgagattcacccttctttgatattgggcgtgtgtgcttcaatcataccatttcccgaccataatcagtcaccccgtaatacataccaatctgctatgggaaagcaagcaatgggaatatatgtcaccaactaccaattccgcatggataccttagcctatgttctatattaccctcaaaagccgctggtcaccacaagagctatggagcatcttcactttaggcaacttccagcaggaattaatgctattgttgccatttcttgctattctggatataatcaggaagattctgtcatcatgaatcagtcttcaatagatcgtggtttctttagatccttgttcttccggtcttacagagacgaggagagaaaaatgggaacccttatcaaagaaaactttgggcgcccagacagaggaaacacactgggtatgcgacatggttcttatgagaaactggatgatgatggtctcgcacctcctggtactagagtttcaggtgaagatgtaatcattgggaaaaccactccaatatctcaagacgaggctcaaggacaaacatcacgatacaccagacgtgatcacagtttaagcttgcgtcatagtgaatctggcatggtggatcaggtgttattgaccacaaatgcagatggtttgaagttcgtgaaagtgagggttaggtccgttcgtattcctcaaattggagacaaattcagcagtagacatggtcagaagggaactgttggcatgacatacacacaagacgacatgccttggacgattgaaggcgttactcctgatataatcgtgaatccacacgctatcccgtctcggatgacaattggacagctcattgagtgcatcatgggaaaagtggcagctcagatgggtaaagaaggagacgccactccctttacagatgtcacggtggacaacataagcaaagctctccatgaatgtgggtaccaaatgcgtggatttgagagaatgtacaatggtcacacaggcagaccactcccagcgatgatattcattggaccaacctattaccaaaggttgaagcatatggttgatgacaagatccactctcgtggacgaggtcctgtgcaaatcttaacaagacaaccggctgaaggacgatcccgtgacggtggactgcgttttggagaaatggagcgagactgcatgattgctcatggtgctgctagctttttgaaagagaggctgtttgatcagagcgatgcgtatagggtacatgtgtgtgaaacctgtgggctcatcgccattgcaaacctgaagaataatacttttgaatgcaaaggttgcaagaacacaacagatattgttcaggttcacataccatatgcttgcaaattactgtttcaagagcttatgtcaatggcgattgcgccacggatgcttactaaagacctgaaatcagctaaaggcaggaagtgaggagatttcttgtactctttggctctcgtatctttgtgataaaactacaattcaaacttgtgtatcgtttatttggtattaattctgaactagaaactagaaactattgaggtatatttctagagaggtatatgtttaccaaaaaaaaaactagagacgtatatgataatactttagaagttattattatattaacttgtcagtgaatccgtg

SEQ ID NO: 1706 - DNA, 3861 bp, Liriodendron tulipifera
  misc_feature (2439)..(2439): n is a, c, g, or t
  misc_feature (3384)..(3384): n is a, c, g, or t
  misc_feature (3597)..(3597): n is a, c, g, or t
  misc_feature (3706)..(3706): n is a, c, g, or t
  misc_feature (3708)..(3708): n is a, c, g, or t
  misc_feature (3710)..(3710): n is a, c, g, or t
  misc_feature (3712)..(3712): n is a, c, g, or t
  misc_feature (3741)..(3741): n is a, c, g, or t
  misc_feature (3743)..(3743): n is a, c, g, or t
  misc_feature (3752)..(3752): n is a, c, g, or t
  misc_feature (3801)..(3801): n is a, c, g, or t
  misc_feature (3805)..(3805): n is a, c, g, or t
gcagcgaggttgaggaacctgacttactctgcaccattgtatgtggatgtcacaaaacgtgtcataaagaaagggcatgactgtgaagaagtcacagagacacaggatttcaccaaagttttcattgggaaggttcctataatgctgcggtctagttattgtacgttgtaccagaactcagaaaaagatctaacagaacttggggaatgtccatatgaccaagggggatactttattatcaatgggagtgagaaggttcttattgcccaagaaaagatgagcaccaatcatgtctacgtgtttaagaaaaggcagcctaacaagtatgcctatgtagctgaggtccggtccatggcagagtcccagaacaggccaccaagcagcatgttcgttcgcatgctttctcgggctagcgcgaaagggggctcttcagggcagtatattcgggctactcttccttatattcggacagaaatcccaataattattgtgtttcgagcattagggtttgttgctgacaaggatatattagagcatatatgctatgacttttctgacactcagatgatggaattactgcggccatccttggaagaagcatttgttattcaaaaccaacaggttgcactagactacattgggaagcgaggacaaactgttggtgtgacaaaggaaaagagaatcaagtatgccaaagaaattcttcaaaaggaaatgctgcctcatgtcggtgttggggaatattgtgaaacaaagaaggcttactattttggatatatcattcatcgactactgctttgtgcgcttggccgaaggccagaggatgacagagatcattatggcaataaaaggctggatcttgctggtcctttgcttggaggcttgttcagaatgcttttcagaaagttgaccagggatgtgagaggatatgtccagaagtgtgttgataacggaaaagacgttaacttgcaatttgcgatcaaagctaagacgataactagtggccttaagtactcccttgccactggaaattggggacaagcaaatgcagctggtacaagagctggagtttctcaggtgttgaatcgcttgacgttcgcatctactttgtctcacttgcgaaggttaaactctcccatagggcgtgaaggaaaattggcgaaaccccggcagttgcacaactcccactggggaatgatgtgtcctgcagaaacaccagaaggacaggcctgtggactggtgaagaatctagcattgatggtgtacataacagtgggatcagccgcaaatcctattttggaatttttagaagagtggagcactgagaacttcgaggaaatatctcctgccgttattcctcaagcaaccaaaatttttgttaatggttgctgggttggcattcatcgtaatcctgagcttttggtgaagactttgagacagcttaggcggcaggttgatgtcaatactgaagtgggggttattcgagatatccgcctgaaagaactacgactttatactgactatggtcgctgcagccgtccattatttattgtggaaaaacaaaggctgctgataaagaagaagcatattcgatctctgcagcaaagggaaacccaagacgaaggctggcacgatcttgttgcaaaaggattcatagagtatgtagataccgaagaagaagagactacaatgatttccatgaccatttctgatcttgtaagtgcaaggcttaatccagatgaagcatattccgagacctacacccattgtgaaatccatccatcattgatattgggggtttgcgcttctattattccctttcctgaccacaaccagtcacctcgtaatacataccagtctgcaatgggcaagcaagcaatgggaatttatgttaccaactaccagttacgaatggatacactagcctacgttctctactatccacagaagcctcttgttactactcgtgccatggaacacttgcattttaggcagctgccagctggcattaatgcgattgttgcaattgcttgctattctggatataaccaagaagattctgttattatgaaccaatcgtcaattgatcgtggtttcttccggtcattattcttccgttcatacagagatgaggagaagaagatgggaacacttatcaaagaagattttggtcgtccaaacagggaaaatacaatgggcatgcggcatggatcttatgataaattggatgatgatggtcttgcacctcctggcacaagagtctcaggcgaagatgtcattattggaaagacaactcccattgcccaggatgaatctcaaggacaagcttcacgatacacacgacgtgatcatagcacaagcttacgacacagtgaaagtgggatggtggatcaggttctattgacaactaatgctgatgggttgaggtttgtgaaagtnagaatgagatccgtccgaattcctcagattggtgataagtttagcagtaggcatggtcagaagggaactgttggcatgacttacacacaagaagacatgccgtggacagtggaaggcatcacaccagatattattgtgaatccacatgccattccttctcggatgacaattggtcagcttattgagtgtatcatggggaaggtggcagttcacatgggaaaggagggagatgcaactccttttactgatgtcactgtggacaacatcagcaaagctcttcataaatgtggatatcagatgcgtggcttcgaaaccatgtataatggtcacacagggcgtcggttgactgccatgatattcctcggtcccacctactaccagagactgaagcacatggtggatgacaagatccattcacgagggcggggcccggtgcaaatcctcactaggcaacctgccgaaggacgctcccgtgatggaggcctgcgctttggggagatggagcgagattgcatgattgcccatggggctgcacacttccttaaagaaaggctgtttgaccagagtgatgcctatagggttcacgtctgtgaacgttgtgggctgattgctattgccaaccttaagaagaattcctttgagtgcagaggttgcaagaacaagacagatattgttcaagtccacataccttatgcctgcaagctgctcttccaagagctcatggccatggccatcgctcctagaatgcttacaaaagaagtcaaaccattgaaagaccacaagaagaaaggagcctgaaaagagagattattggaaggtcatgctagtttatgtgttcacgactatctatttgaaacagcaacccaccattaactggagaccgaatgggacttgccaaccttgctttggatctgttggtcgtttggatgtgatttgcatcttgtnttcttttcgtgggaagtacgctgacaaagaaagtcataccaaaatctatgaataaatagatctgtcattctttaccttacaaactcggatgggccagcagctgttatattgtctcggaggatggaagttatatagcccaactgggattgaaatatgcagctgagcttgatgtagtgaaagtatgtgtgacaaagataacagtccagacttttnttttatgcaaatactgaagggaaactgtttggctctctatttacgtttgtagtcctttagtacagaactctcttgatgagatcaagtatttagatccttagtaccaaantntntnttgatgagttgtttaaaaaaaaaaaaaantnttgatgagntgaagtatttagagactttttccttatccaaaaaagcagattttcctgntgtntcatgtaatcagggattgatgaacctatgtaagaattttgattttttttcttgaac

SEQ ID NO: 1707 - DNA, 3467 bp, Vinca minor
aaaattagctttggtcagatatatcttagtaaaccaatgatgacggaatcggatggtgaaactgcaactttatttcctaaagctgctaggctgaggaacttgacatattcggctcccttgtatgttgatgtctctaagaaagttatcaagaaaggacatgatggtgaagaatataccgaagatcaaaattttggtaaagtcttcattgggaaggttcctataatgctccggtcaagttactgtacgttgttccaaaactcagaaaaagatctcaccgagcttggagaatgcccttatgatcaaggtgggtatttcatcataaatggaagtgaaaaggtactcattgctcaagagaagatgagcaccaatcatgtctatgtgttcaagaagaggcaaccaaacaagtatgcctttgtagcggaagtccggtctatggctgagacccaaaacaggccgcccagcaccatgtttgtgcgtatgctctcgcgatcaagtgccaaagggggagcctcaggccagtatatccgtgctactcttccttacatccgaacggaaattcctattattatagtctttcgagctttaggatttgtggcagacaaagatattctggaacatatttgctacgatttcaaagatactcaaatgatggagttgttgcgcccctccttggaagaagcatttgtaattcaaaatcagcaggttgccctagattacatcggtaaaagaggggccactgttggcgtcacaaaggaaaagaggatcaaatatgctaaagagattcttcagaaagaaatgcttcctcacgtaggtgttaaagaaagctgtgaaacaaagaaagcttactattttggctatataattcaccggctattgctgtgtgcacttggcatacgggccgaagatgatagagatcattatggcaataagagattagatcttgccggtcctctgcttggtggcctttttagaatgctattcagaaagttaaccagggatgtgagaggttatgtccagaagtgtgttgataatggaaaagatgtcaacttgcaatttgcaatcaaagccaagactattaccagtggacttaaatactctcttgcaacggggaattgggggcaagcaaatgctgcaggaacaagagctggtgtttcacaggtgttaaatcgactgacttacgcctcaacactgtcgcacttgaggaggctaaattctccaattggacgtgaagggaaactggccaagccaaggcagttgcataattcccagtggggatgatgtgtccagcagaaacacctgaaggacaagcatgtggactagtgaagaatttagctctcatggtgtacatcacagttggttcagctgcatatccaattctggaattcttggaggaatggggtactgagaattttgaggaaatttctcctgctgtgattccaggagcaacaaaaatctttgtcaatgggtgctgggtgggtattcaccgtgaccctgatatgttggtcacgactttgaggcgtctgagacgacgggtggatgttaacactgaggtgggggtggtccgggatattcgattgaaggaactgcggatttatactgattatggccgctgcagtcggccattgttcattgtagaaaaacaaagactgctcatcaagaaaagggatattcaagccttgcaagcaagggagtccccagaagatggtggctggcacgaccttatttccaagggatacatagaatatattgatactgaagaagaagaaaccactatgatttccatgacaattagtgatcttgtaacggcgaggcttaatccagaggaggcctatactgatacctatacccactgtgagattcacccgtcattgattttgggtgtctgtgcttcaattataccattccctgaccacaaccagtcgcctcgtaatacttaccagtcggctatgggtaaacaagccatgggtatatatgtcaccaactatcaatttcggatggatactttggcatacgtgctctattatcctcaaaaaccacttgttactactcgagccatggagcacttgcacttcaggcagctacctgctggcatcaatgccattgttgcaatatcttgctattccgggtacaaccaagaagattctgtcatcatgaatcagtcgtccatcgaccgtggcttcttcaggtcactgttcttccgctcatacagagacgaggagaagaagatggggactctggtcaaggaggacttcggacgtccagacaggtccaataccatgggtatgcgtcatggatcttatgataagctggatgacgatggtcttgctcctcctggaacaagatgttctggcgaggatgtaatcattgggaagactaccccgattagcccggatgacaccagtgttccagctgcctctgctgctcgttacactaagcgggaccacagcacaagcttgcgccacagtgaaaatggtatggttgatcaagtattgctcacaacaaatgctgatgggttgaggtttgtaaaagtgagaataagatctgttcgaattcctcaaattggagacaagttcagcagtcggcatggtcagaaaggaacagtcggcatgacctatacacaagaagacatgccgtttactcaggaaggcataagtcccgatatcattgtgaaccctcatgctattccttcccgaatgactatcgggcagctgatcgagtgtatcatgggcaaggttgctgcacatatggggaaggaaggagatgctactccttttactgatgttaccgtggataacatcagcaaagcccttcacaaatgtggttaccagatgcgaggctttgagagaatgtacaatggccacacagggagaccgcttacagccaccatattccttggacccacttactaccagaggctgaagcatatggttgatgataagatccactcccgtggtagaggccccgtgcaaatcctcacgaggcagcctgctgaggggcgatcacgtgatggaggtcttcgatttggagagatggaaagagattgtatgattgcacacggtgctgctcattttctcaaggaaagattgtttgatcagagcgatgcatataggatccatgtttgcgagcgttgtggcctgatagctattgcaaacctaaaaaagaactccttcgaatgcagaggctgcaaaaacaaaactgatatcgtccaggttcacattccttatgcctgtaaactgctgttccaagagctgatgtcaatggcgatagcgcctagaatgctcacaaaagatattaaacaagtcaaagaccagcagaagaaaggccgttgattcgcacgacctcttgggcatcccatcctgtagcttttgttatgtaactggatttgttcttctcttagcaactctgagaagatcaaactttaggagagctgttctctgtgtgtaaaatttttggctctttttttttta

SEQ ID NO: 1708 - DNA, 4194 bp, Secale cereale
agccgacacacccaccccatccccatccccgagcgccgctagggttgcggctcgctccggcgatggaggacgacgaatatgaggaggggatggagatggatatgggagggcaccagcacctccagcaccgggggtacgagctgaggaggaggttgaggggggatacgccggcggcggggacggggaggacgaggaggaggaggcgcgggacgaggaggagattacccaggaggacgcctgggccgtcatctccgcctacttcgaggagaagggcctcgtgcgccagcagctcgactccttcgacgagttcatccagaacaccatgcaggagatcgtcgatgagtcgccgacatcgagatccgccccgagtcgcagcacaaccccggccgccaagccgagttcgccgagacactccacaagatcagctttggtcaaatctatctgagcaaaccaatgatgactgaagctgatggagagactgctaccttattccccaaatcagcaaggcttaggaatctgacatactcagcaccactttatgtagatgtatcatacagagttgtaaagaaagggcatgactgtgaagaagttacagaaactgcggagtacccgaaagtcttcattggaaaggttccaatcatgctgcgttctagttactgtacattgtttcaacaatctgaaaaggatcttacagaacttggagagtgcccttatgaccaaggaggatattttgtaatcaacggtagtgaaaaggttctcattgcccaggagaagatgagcaccaaccatgtctatgtgtttaagaagaggcaaccaaataagtttgcatatgtgggtgaagtccgttcaatggcagagaaccagaacagacctgctagtagcatgtttgttcggatgctttcccgagctggcgcgaaagggggttcatctggtcaatatatccgtgctactctgccctacattcgtgcagatattcccatcatcattgtgtttagagcactaggatttgttgctgacaaagatatactggagcacatatgttacgatttctccgatacacaaatgatggaattgctgcgcccatctttggaggaagcctttgtcattcaaaatcagcaggttgctctggactacattggaaagcgtggtgctacagttggtgtaactcgagaaaaaagaataaagtatgcgaaagagatacttcagaaggaaatgttgccccatgttggtgtaggcgaattctgtgaaactaaaaaggcatactactttgggtatattattcaccgcctgttgatgtgtgcccttggtcgaagagctgaagatgacagagatcattacggcaacaaaaggctcgaccttgcaggtccattgcttggaggactgttcagaatgcttttcaggaaattgacgagggatgtgaggtcatatgttcagaagtgtgtcgataatgggaaggaagttaatttgcaatttgctattaaagctaaaaccattactagtggattgaagtattcccttgctactggaaactgggggcaggctaaccaggctggcacaagagccggtgtgtctcaggtgcttaatcgccttacatatgcttctacattatcacatcttcggaggttgaactctcccattgggcgtgaagggaaactggcaaaacctcgccaattgcataattctcattggggaatgatgtgccctgctgaaacacctgaaggacaggcctgtggcttggttaaaaatcttgccttgatggtttatatcactgttggttctgccgcaaatcctattttggaatttttggaagagtggggcacagaaaattttgaggagatatcaccggcagtcattcctcaagctgctaaaatatttgtcaatggttgttgggttggaattcataggaatcctgacctattggtgaagacccttcgtcgtttaagaagacagattgatgtcaacactgaagttggtgtcgttcgtgatattcgtcttaaagaacttcgactctatactgattatgggcgttgcagtcgcccgctgtttatcgttgaaaaccagaggcttctaattaagaagaaacatatccgagcactgcagcaaagggagactcctgatgaaggttggcatgacttggttgccaaaggatttatagagtacatagatactgaagaggaagaaactactatgatctccatgactatacgtgaccttgaaacttcgaggcataacccaggggaggcatattctgagacttacacacactgtgagattcacccttcattgatacttggtgtgtgtgcgtcaattattccttttcctgatcacaaccagtcacctcgtaatacatatcagtctgctatgggaaagcaagccatgggaatctatgttaccaactatcagttaagaatggacacattggcctacgttctgtactacccacaaaagcctcttgttactactcgtgctatggagcatttgcacttcaggcagttaccagctggcattaatgcaattgttgctattgcatgctactctggatataaccaagaagattcggttattatgaaccaatcttcaatagatcgtgggttcttcagatcactatttttccgctcttacagagatgaggaaaagaagatgggaactcttgtcaaagaggaatttggtcgtccaaatagggagaacactatgggaatgcgccatgggtcttatgataaattagatgatgatggccttgcaccaccgggaacaagggtctctggggaagatgtcattattgggaagacatctccaattccacaagatgatgctcaagggcaagctactagatactcaaagcgtgatcatagtacttctctgcgtcacagtgaaagtgggatggtggatcaggttctgctgacaacaaatgctgatggtttaagatttgtcaaggttagaatgcgatcagtgcgcataccacaaataggagataagttcagcagtaggcatggtcagaagggaactgttggaatgacttacacacaagaggacatgccatggacaatcgaaggcatcacaccggatatcattgtgaatccacatgctattccatcccgtatgactattggccagctgattgagtgtattatgggtaaagttgcggctcacatgggaaaggaaggagatgcaactcctttcactgatgttactgtggataatatcagtaaagcactgcacaagtgtggctatcagatgcgtggatttgagaccatgtacaatggtcatactggaagaaaattgactgcaatgattttcttaggtccaacttactatcagagacttaagcatatggtggatgacaaaattcactctagaggtcgtggtcctgtccagatactgaccagacagccagcagaggggcgctcacgtgatggtggtctccgttttggagaaatggagagggattgcatgattgctcatggagctgcatttttcttgaaggaaaggttgtttgaccagagcgatgcttacagagtgcatgtttgtgagaagtgtggactcattgccattgccaatctcaagaagaattccttcgaatgcagaggctgcaagaacaaaactgacattgtccaggttcatataccgtacgcatgtaagctcctcttccaggagctcatggcgatggcgattgctcccaggatgctcacccatgaggtcaagggtgcgagggataagcatcgttgagcttgaatgttgtattcaggtgcctgactggagctgttctccggggtaccttgttgtggaacttaagaatgagtatggctcttctgacacggactttggttctgatggctaggcatttttaagagctatccttctgattgtgttctggatacgccagacgccagacatgaagttacttaggttctttatacattagtattcatttactaacaggactaataatgtgtaccttttctctatgacggatcgatggcaacatcatcttttgacaggtcttggcttttaagagctcaacttgaacgatgcttgtatcattctatgaagatagttgcatgaatttctgggacgaggcgcgagtagccttgggtcatactctgtaccaatagttgggggaaactatttcaagttcccaagtattttgggacagaggtagtgtttagtaggaattgtcaacttaataaccactga

SEQ ID NO: 1709 - DNA, 3411 bp, Triticum aestivum
cccaatcatgctgcgttctagttactgcacactgtttcaacaatctgaaaaggatctcacagaacttggagagtgcccttatgaccaaggaggatattttgtaatcaacggtagtgaaaaggttctcattgcccaggagaagatgagcactaaccatgtctatgtgtttaagaagaggcaaccaaataagtttgcatatgtgggtgaagtccgttcaatggcagagaaccagaacagacctgctagtagcatgtttgttcggatgctttcccgagcaggcgcgaaagggggttcatctggtcaatatatccgtgctactctgccctacattcgtgcagatattcccatcatcattgtgtttagagcactaggatttgttgctgacaaagatatactggagcacatatgctacgatttctccgatacacaaatgatggaattgctgcgcccatctttggaggaagcttttgtcattcaaaatcagcaggttgctctggactacattggaaagcgtggtgctacagttggtgtaactcgagaaaaaagaataaagtatgcgaaagagatacttcaaaaggaaatgctgccccatgttggtgtaggcgaattctgtgaaactaaaaaggcatactactttgggtatattattcaccgcctgttgatgtgtgctcttggtcgaagagctgaagatgacagagatcattacggcaacaaaaggcttgaccttgcaggtccattgcttggaggactgttcagaatgcttttcaggaaattgacgagggatgtgaggtcatatgttcagaagtgtgtcgataatgggaaggaagttaatttgcaatttgctattaaagctaaaaccattactagtggattgaagtattcccttgctactggaaactggggacaggctaaccaagctggtacaagagccggtgtgtctcaggtgcttaatcgccttacgtatgcttctacattatcacatcttcggaggttgaactctcccattgggcgtgaagggaaactggcaaaacctcgccaattgcataattctcattggggaatgatgtgccctgctgaaacacctgaaggacaggcttgtggcttggttaaaaatcttgccttgatggtttatatcactgttggttctgccgcaaatcctattttggaatttttggaagagtggggcacagaaaattttgaggagatatcaccggcagtcattcctcaagctgctaaaatatttgtcaatggttgttgggttggaattcataggaatcctgacctattggtgaagacccttcgtcgtttaagaagacagattgatgtcaacactgaagttggtgtcgttcgtgatattcgtctgaaagaacttcgactctatactgattatgggcgttgcagtcgcccactgtttatcgttgaaaaccagaggcttctaattaagaagaaacatatccgagcattgcagcaaagggagactcctgatgaaggttggcatgacttggttgccaaaggatttatagagtacatagacactgaagaggaagaaactactatgatctctatgactatacgtgaccttgaaacttcgaggcataatccaggggaggcatattctgagacttatacgcactgtgagatccacccttcattgatacttggtgtgtgtgcgtcaattattccttttcctgatcacaaccagtcacctcgtaatacatatcagtctgctatgggaaagcaagccatgggaatctatgttaccaactatcagttaagaatggacacattggcctacgttctgtactacccacaaaagcctcttgttactactcgtgctatggagcatttgcacttcaggcagttaccagctggcattaatgcaattgttgctattgcatgctactctggatataaccaagaagattcggttattatgaaccaatcttcaatagatcgtgggttcttcagatcactatttttccgctcttacagagatgaggaaaagaagatgggaactcttgtcaaagaggaatttggtcgtccaaatagggagaacactatgggaatgcgccatgggtcttatgataaattagatgatgatggccttgcaccaccgggaacaagggtctctggggaagatgtcattattgggaagacatctccaattccacaagatgatgctcaagggcaagctactagatactcaaagcgtgatcatagtacttctctgcgtcacagtgaaagtgggatggtggatcaggttctgttgacaacgaatgctgatggtttaagatttgtcaaggttagaatgcgatcagtgcgcataccacaaataggagataagttcagcagtaggcatggtcagaagggaactgttggaatgacttacacacaagaggacatgccatggacaatcgaaggcatcacaccggatatcattgtgaatccacatgctattccatcccgtatgactattggccagctgattgagtgtattatgggtaaagtcgcggctcacatgggaaaggaaggagatgcaactcctttcactgatgttactgtggataatatcagtaaagcactgcacaagtgtggctatcagatgcgtggatttgagaccatgtacaatggtcatactgggagaaaattgactgcaatgattttcttaggtccaacttactaccagagacttaagcatatggtggatgacaaaattcactctagaggtcgtggtcctgtccagatactgaccagacagccagcagaggggcgctcacgtgatggtggtctccgttttggagaaatggagagggattgcatgattgctcatggagctgcatttttcttgaaggaaaggttatttgaccagagcgatgcttacagagtgcatgtttgtgagaagtgtggactcattgccattgccaatctcaagaagaattccttcgaatgcagaggctgcaagaacaaaactgacattgtccaggtccatataccgtacgcatgtaagctcctcttccaggagctcatggcgatggcgattgctcccaggatgctcacccatgaggtcaagggtgcgagggataagcaccgttgaatgaggtcaagggtgcgagggataagcaccgttgtgcttcgagtgttgtattcgggtgcctgactggaactgttttccggggtgccttgttgcggaacttaagaactatcatccttctgattgtgttctggatacgtcagataccaggcccagacatgaagttacttaggttctttattaccattagatttactaacaggactaataatgtgtggtaacatcatcttttgacagtcttggcttttaagagctcaactcgaacgatgcttgtatgaagacagttgcatgaatttctgggttgaggcatgagtagcctt

SEQ ID NO: 1710 - DNA, 3063 bp, Panicum virgatum
gtaggaggagacgggagcgatttgcggatcgaatccatggcgcggaccaactgggaggccgataagatgctcgacgtctacatctacgactacctggtgaagcgcaacctgcaggccaccgccaaggccttcatcgccgagggcaaggtcgccaccgaccccgtcgccatcgacgcccccggcggcttcctcttcgagtggtggtccatcttctgggacatcttccactcctccaccgccaaggcctcctcctccgccggggcgcctcctcccccccacctcgatatcaacaagtcgagggagcaccagatgaggctccagctactgcaccagcacaacgcccaactccacaccagaggagctgcccctcctcctcccgcctccatcaatgccctcaactctgacgtctccgccgtccttgcttctaaaatgatggaggaccggatcaggaaccccaaccctggcgattccgacgcgtcacagcatctcctggacgcaaacaggatcgcccttctcaagtcaccacctaaccacactgggccaccacctatgcagcagcagattcacccaagaaaccagcaacatgacatcaagcctgatgctgctatgccaccgagaacagtgccagcggacccttcttcattatatgcgtcagggttgatgcaccctaaacctccattacttgctgctggactaaatcaaggtggtgttgggagtgtgccactcaaaggctggcctctaactgtcccaggtatcgaccaactacggtccaatttaggtgtccagaagcagttggtgccatcttcgaaccagttccaacttttatcaccacaacaacaattgattgctcaggcacaaacaccgaatgaccttactagaatgggttctccagcaccatctgttcaaccgaatgtccggtcagatgatccggattatctgatgaagttgaagatggcccagatgcagcagtcctcaggtcaccggtctatggaattgcaacagccacatcaacagagcactagaaagcggaagccaacttcttcaggtgcagctaatagtactggcacaggaaatactgttgggccttctcctccatcaactccatccactcatactccaggtggtggagtaccagttgttagcaatgcaaatattttacagaagagttcgatgatttgcggcgcggatggaaccagtgggcttgcctcatcttcaaaccagatggatactttggatagttttgttgattttgatgagaatgttgattcattcttgtcaaatgatgatggagacggaagagacatgtttgcaggactgaaaaaaggttcctcggagcacaattcagagtccttaaagggtctctccttgagtgaggtaggtaacaaccgtacaagcaacaataaggttgtgtgctgtcacttctctacagatggaaagctactagctagtgccggccatgagaagaaggtcttcctctggaatatggataatttcaagatggataccaaaatagaagaccatacaaactttatcacagacataagattcaaaacgaattccactcagttggctacatcatcttccgatggaactgttcgactttggaatgctgctgatgaaagcggcgctttacaaacttttaatgggcatagctctcatgtaacatcactagattttcacccaagattgacagaggttctttgctcttgtgatgacaatggagaaattcgcttctggacagttggtcaaactacatcgtcccatgtttttagggtgaagcagggtggtaccggaagagtcaggtttcagcctcgaagtgggcagctcctagctgtggcaggtggaagcatggtgaatatttttgatgttgaaaagcaagccaacttaccctttccaccaaagggtcacaatagtgaggtaaactgtgtgtgctgggatgaaaatggtgaatatctggcttctgtaagtcaggacactctgaaagtgtggtcggtatcgtcgggcgcgtgcattcatgagttaagatcccatggaaaccagtatcagtcatgcatattccacccgagatacccaaaagtgttgattgttggtggttatcagacgctggagctgtggagcttatcagataaccagagaaatccaatccaggcgcatgaggggctgatagctgctctggcacactcccccttcacagggatgattgcctctgccagtcatgacagatatgtaaagctctggaagtaggtagaaaggtgatggactgtacactagccgtctagtccaaattttatacttatcattaccttatatagcttcggtttcattccttggttgacttacaataggtaggagatgtaagatggatacacttttgagggctgtacatgattgggctgatataggctttaatttgtggtgtttgtagcagagaagaagtgcactgatcatcatcatcatatatagaatttgattcacttgtcttgtcagactatatatatattgatagaacaaatgggccggcctggaactaatccatagtggaaagagtgatgtatagtatagtttgtactgcctctctttctgcctcagtgagcgagtgttgggaggaggctagctagattagatacatgtatatgatatgatggtggattagctagtttgtgggtgcatctccgtctccatgggccgctgatggcttgagccccctgagcacggacacgccgccacccccactctgttgcgcaggtgcaggtgcagatgctgggtcctttgctgtcgtgctcatggttgaaatcccggcttctcccatgcatgcgctggcgcaggagagctggcagacgacgggccagccggtacaggcggcgttgcagtcgttgcggcagttgcccaccgccgcccgaggggacgccgcgagcaccaccaccaagcacagcaccgccgccgcctgcgcgctcgtggccgccatcaccggtcgaccacacgcacttgcttgttgcagcagggagaggacaaggcggcggatcggaggacgagacgacgccgccgccgccgggccgggatgat

SEQ ID NO: 1711 - DNA, 3067 bp, Panicum virgatum
gtggggtgggggagacgggagcgatctgcggatcgaatccatggcgcggaccaactgggaggccgataagatgctcgacgtctacatctacgactacctggtgaagcgcaacctgcaggccaccgccaaggccttcatcgccgagggcaaggtcgccaccgaccccgtcgccatcgacgcccccggcggcttcctcttcgagtggtggtccatcttctgggacatcttccactcctccaccgccaaggcctcctcctccgccgccggggcgcctcctcccccccacctcgatatcaacaagtcgagggagcaccagatgaggctccagctactgcaccagcacaatgcccaactccacaccagaggagctgcccctcctcccgcctccatcaatgccctcaactctgacgtctccgccgtccttgcttctaaaatgatggaggaccggatcaggaaccccaaccctggcgattccgacgcgtcacagcatctcctggacgcaaacaggatcgcccttctcaagtcaccacctaaccacaatgggccaccacctatgcagcagcagattcacccaagaaaccagcaacatgacatcaagcctgatgttgctatgccaccgagaacagtgccagcggacccttcttcattatttgcatcagggctcatgcacccaaaacttccattgcttgctgctggactaaatcaaggtggtgttgggagtgtgccactcaaaggctggcctctaactgtcccaggtatcgaccaactacggtccaatctaggtgtccagaagcagttggtgccatcttcgaaccagttccaacttttatcaccacaacaacaattgatcgctcaggcacaaacaccaaatgaccttactagattgggttctctagcaccatctgttcaaccaaatgtccggtcagacgatccagattatctgatgaagttgaagatggtccagatgcagcagtcctcaggtcaccggtctatggaattgcaacagccacatcaacagaacactagaaagcggaagccaacttcttcaggcgcagctaatagtactggcacaggaaatactgttgggccttctcctccatcaactccatccactcatactccaggtggtggagtaccagttgttagcaattctaatattttacagaagagttcgatgatttgcggcgcggatggaaccagtgggcttgcctcatcttcaaaccagatggatactttggatagttttgttgattttgatgagaatgttgattcattcttgtcaaatgatgatggagacggaagagacatgtttgcaggactgaaaaaaggttcatcggagcacaattcagagtccttaaagggtctctccttgagtgaggtaggtaacaaccgtacaagcaacaataaggttgtatgctgtcacttctctacagatggaaagctactagctagtgccggccatgagaagaaggtcttcctctggaatatggataattttaagatggataccaaaatagaagaccatacaaactttatcacagacataagattcaaaacgaattccacgcagttggctacatcatcttccgacggaactgttcgactttggaatgctgctgatgaaagcggcgctttacaaacttttaatgggcatagctctcatgtaacatcactagattttcacccaagattgacagaggttctttgctcttgtgatgacaatggagaaattcgcttctggacagttggtcaaactacatcgtcccatgtttttagggtgaagcagggtggtaccggaagagtcaggtttcagcctcgaagtgggcagctcctagctgtggcaggtggaagcatggtgaatatttttgatgttgaaaagcaagccaacttaccctttccaccaaagggtcacaatagtgaggtaaactgtgtgtgctgggatgaaaatggtgaatatctggcttctgtaagtcaggacactgtgaaagtgtggtcggtatcatcgggcgcgtgcattcatgagttaagatcccatggaaaccagtatcagtcatgcatattccacccgagatacccaaaagtgttgattgttggtggttatcagacgctggagctgtggagcttatcagataaccagagaagtccaatccaggcgcatgaggggctgatagctgctctggcacactcccccttcacagggatgattgcctctgccagtcatgacagatatgtaaagctctggaagtaggtagaaaggtgatggactgtacactagccgtctagtccaaattttatacttatcattaccttatatagcttcggtttcattccttggttgacttacaataggtaggagatgtaagatggatacacttttgagggctgtacatgattgggctgatataggctttaatttgtggtgtttgtagcagagaagaagtgcactgatcatcatcatcatatacagaatttgattcacttgtcttgtcagactatatatatattgatagaacaaatgggccggcctggaactaatccatagtggaaagagtgatgtatagtatagtttgtactgcctctctttctgcctgagtgagcgagtgttgggaggaggctagctagattagatacatgtatatgatatgatggtggattagctagtttgtgggtgcatctccgtctccatgggccgctgatggcttgagccccctgagcgcggacacgccgccacccccactctgttgcgcaggtgcaggtgcagatgctgggtcctttgctgtcgtgctcatggttgaaatcccggcttctcccatgcatgcgctggcgcaggagagctggcagacgacgggccagccggtacaggcggcgttgcagtcgttgcggcagttgcccaccgccgcccgaggggacgccgcgagcaccaccaccaagcacagcaccgccgccgcctgcgcgctcgtggccgccatcaccggtcgaccacacgcacttgcttgttgcagcagggagaggacgaggcggcggatcggaggacgagacgacgccgccgccgccgggccgggatgat

SEQ ID NO: 1712 - DNA, 2734 bp, Zea mays
tgccgccatccatcctttttcccttcctcccctcaccccctcgtcggaatcggaacggctgtcgtctgccccttcgcccccctcttcgatccctcaccccacccagtgctagctagctagctagcttctagtggctagtagctcccctcccctgtgggctgcaacctggtttgggttcgcggatcgatcgcgagatcaatcaatccatggcgcggaccaactgggtggccgataagatgctcgacgtctacatctatgactacctggtgaagcgcaacctgcaggccaccgccaaggccttcatcgccgagggcaaggtcgccaccgaccccgtcgccatcgacgcccccggcggcttcctcttcgagtggtggtccatcttctgggacatcttccattcgtccaccgccaaagcctcatccacatccactgccgccgccttcatcgaccacaccgccaagcaacagcagccaatcggcgccgggaccggggcgcctcctcctcatccccttcacgattccagagagcaccagatgaggctccagcagctgctgcaccaacacaacccccacctccacactacaagagatgcttctcctcccgcctctatcaatgccctcaactccgatgtctccgctgtcctcgcgtccaaaatgatgcaagaccgagtcaggaaccccaaccctattgactccgacgcctcacagcatctcctagacgcaaacaggatcgcgcttctaaagtcaccaccacctagccacactgggcctatgcctatgcagcagcagcttcatccaaggaaccagcaacttgacatcaagcccgatgttggtatgccacagagaacgatgcctgcagacccttcttccatgtatgcatcagggatgatgcacccaaaacctgcattacttgccactggactaaatcaaggtggtgttgggagtgtgccacttaaaggttggcctttaacggtcccaggtattgaccaactccggtccaatttaggtgtgcagaagcaattggtgccatcttcaaaccagttccaacttttatcgccacaacaacagttgcttgctcaggcacaaacacagaatgaccttaccagaatgggttctccagcaccatctgcttcgccgaatgttcgaccagatgacccggattatttgatgaagttgaagatggcccagatgcagcagtcctcaggccacaggcctatggaattgcaacagccgcatcagcagaacactagaaagcggaagccaacttcttccggagcagctaatagttctggcacaggaaatactgtcgggccttctcctccgtcaactccatccactcatacccctggtggtggagtaccagtggctagcaatgttaatattttacagaagagttcaatgatttgtggtgtggatgcaactggtggacttgcctcatcctcaaaccagatggatgctttggatagttttgttgattttgatgaaaacgtcgactcttttttgtcgaatgatgatgtagacggaagaggcatgtttgcagcacttgaaaaagggtcttcagagcacaatacagagtccttaaagggtctctctttgagtgaagttggtaacaaccgtacaagtaacaacaaagttgtttgctgtcacttctcttcagatgggaagttactcgctagtgccggccatgagaagaaggtcttcctctggaatatggacaattttaagatggataccaaaatagaagaccatacaaactttatcacagacataagattcagaactaattcaactcagttggctacatcatcttctgacggaactgttcgactttggaatgctgctgatgaaagtggcgctttacaaacttttcatgggcataggtctcatgtaacatcagtagattttcacccaagattgacagaggttctttgctcttgcgacgacaatggagaaattctcttctggacagttggtcagactacatctactcatgttttgcgggtgaagcagggtggaactggaagagtcaggtttgaacctcgaagtgggcagctcctcgctgtggcagctggaagcatggtgaacatttttgatgttgaaaagcaatccagcttaccctgccctccaaagggtcacaatagtgaggtaaactttgtgtcctgggatgaaaatggtgaatatctggcatctgtaagtcaggacactgtgaaagtgtggtcggtatcgtctggtgtgtgcattcatgagttacgatccaatggaaaccaatatcagtcatgcacattccatcctagatacccgaaagtgttgattgttggtggttatcagactctggagctgtggagcttatcagataaccagagaatcccaatccaggcgcacgaagggttgatagctgcactggcgcactccccgttcactggaatgattgcctctgccagtcatgacagatgtgtaaagctctggaagtagctatatatagaggtgatggaatagtcctaatcctaattatatatgccattattaacttatatgtagcgtttgtttcattccttggttaataacttatataatataatatatacataggcggagacgtgagatggatatacttttcaagggtgattggaccctgtgaggtggatggatgtagggtcggttgtacatgatatattgttgagctgatgattgggctgtatctgcgcctataccattatataacccaccggtttaaa

SEQ ID NO: 1713 - DNA, 2155 bp, Pennisetum glaucum
ccagctccaagccagaggacctgacgtctccgccgtcctcgcttccaaaatgatggaggaccgcatcaggaaccccaaccctgctgactctgacgcatcacagcatctcctagacgcgaatagggcagcggctcttcgcaagtcaccgcctaaccaaactgggccgctccctatgcagcagcagatgcacccaaggaaccagcaacttgacatcaagcccgatgttgctatgccacagagaacagtgccagcggaccattcttcgttatatacatcagggatgatgcacccaaaacctccattactcgccgctggactaaatcaagctggaggaagcgtgccgctcaaaggctggcctctaacggtcacaggtactatcgaccaacttcggtccaatttaggtgcgcagaagcagttggtgccatcttcaaaccagttccaacttttgtcaccacaacaacagttgattgctcaggcacaaacaccgaatgaccttactagaatgagttctcctgcaccagctgcttcaccgaatgttcgatcagatgatccagattatttgattaagttgaagatggtccagatgcagcagccctcaggctaccggccaatggaattgcaacagccgcaacaacagaacactagaaagcggaagccaacttcttctggagcagctaatagtactggcacaggaaatactgttgggccttctcctccatcaactccatccactcatactccaggtggtggggtaccagtgactagcaattctaatattttacagaagagttcgatgatttgcggagcggatggaaccagtggacttgcctcgtcctcaaatcagatggataatttggatagttttgttgattttgatgaaaatgttgattcattcttgtcgaatgatgatggagatggaagagacatgtttgcagcattgagaaaagggtcttcagagcacaattcagagtccttaaagggtctctccttgagtgaggtaggtaacaaccgcacaagcaacaacaaggttgtttgctgtcacttctctacagatgggaagttactagctagtgctggccatgagaagaaggtcttcctctggaatatggataattttaagatggataccaaaatagaggaccacacaaactttatcacagacataaggttcaaaactaattccactcagttggctacatcatcttctgatggaactgttcgactttggaatgctgctgatgaaagcagcactttacagacttttcatgggcatacctctcatgtaacatctttagattttcacccaagattgacagaggttctttgctcttgtgatgacaatggagaaattcgcttctggacagttggtcaaactacatcgacccatgtttttagggcgaagcagggtggtaccggaagagtcaggtttcaaccgcgaagtgggcagctcctagctgtggcaggtggaagcatggtgaacatttttgatgttgaaaagcaggccaacttaccctctccagcaaagggtcacaacagcgaggtaaactgtgtgtgctgggatgaaagtggtgagtatctggcctctgtaagtcaagacacggtgaaagtgtggtcagtatcgtcgggagcgtgcatccacgagctaagatctcatgggaaccaataccagtcgtgcgtgttccacccgagacacccgaaagtgttgattgttggtggttatcagacgctggagctgtggagcttatcggacagccagaggaacccgatccaggcgcacgaggggctggtagctgctctggcgcactccccgttcacggggatgatcgcctctgccagtcacgacagatacgtgaagctgtggaagtgatgggtgcattatggttatacactcacaatcacaagtggtctatctacatctagtctagtcctcctaattaaaaaaactgtactacttgtgttgggcagggcttaaagtggcttagtgctgacttgtacttaatagcttggcgacttgattactattaatcatgcgctcgagagtttggagggctagctgtacatgaatgattgattggattatattgggctgataggcggctttactctagcttgttggtaacctgctcatgtatctgtaccatgtggcagaggggga

SEQ ID NO: 1714 - DNA, 2715 bp, Panicum virgatum
tcttcaccataatctaatattacaggttttctaattacaggtatttaccaagcttcagtaaggtaacaattcacgtgctgcgaaaacttagcaaggctatttaaaaaaacttagcaaggctcctccgttctgccctgtttccgcgggtccgcccatgacagtatgacaccctcgtgcgctcatctcatctgtggcgtgcgcgtgtggccggagcacaagcctccgaactccgaagggcagccgagccgcacgccatccgttaccgccggagcaacgtcagcagcacagcccccaactcaaatccatctacacccaggaggccaggacccagcgccagcggttcctccaccaccagccgccccctccccgcgtccgccccgcccgcgcccgctgccgctgctgcttccaacgcactcgagctccgcggcatccgcatccgaatccgcacacgatccccgcgccacttgccccgcccgcccgcccgccggccggccaatgcccggcgcgatgagatgagacgccgccgccgcgcggcggtgctcgcagcccccctcacgcgcgcccgcatcggggatccctcctcctcccacccttcccccaccagcgccgcatttattccctcccccagcacgacaacggtcacgcttccgtcgtcccgtccgtctcgtcgcatccggcgctgcccccctatttaaggcgcgcgggctgagagccagcgataatgctcttgtccaggaggccccttgccgccgcgctccacctcgcgcccctctcgcctcccttgctcctcttcttcgcgtccgcgtcgtcgtcgtgctcgcccgccgcagcgtcggcctccggcgggtccagaggttgtagtgctgtaaggatggacagcggtgcagtggaaacagcatccacttgggcagtatggtcaacaccttcggcagaaccgagaagcatttctatcgggaaggagatattctgcaacaggtcactcaacatgaggaacatcacagcagtgggatttgatatggactacactcttgcacagtacaagcctgagaccttcgagtcccttgcttactatggtacaattgagaagcttgtgaaggatctgaactaccctgaagagctgttgacttgggagtttgattggaaatacatggtcagaggattagttcttgataagaagagaggaaatattttgaagatggaccgacacaagtatgtaaaagttgcataccatggttttagggaattgtcgaaagaagaaaaagttgctgcttatgggagtacattgataagagactcatttgatgaacctgattatgcccttatagatacacttttctcattgggtgaagcttatctatttgctcagcttgttgatttcatggacagtaatcctggaaaagtacctgcaggcacagactatccgcttatgtataaagatgtgaggtctgcggttgacttgtgtcatcgtgatggaacattaaagcggatggttgcgaaggaccctggcaggtacatcaatgaggacttggcaattgtaccaatgcttgaaatgataaaaaaatctggacgctcaacattcttggtgacaaatagtttgtgggactataccaatgttgtcatgaactacctttgtggaccatacacttcagatgcaggatctggtctcaaccacaagtggcttcaatatttcgatattgtaataactggcagttcaaagccaagtttcttccacgatgataaccgtgcgggactctttgaagttgagcctgattccggaaaacttctaaatgctgatattcaggctagtaaatttattggaagcccaagatcaagtcgtcagcatgcaatgccagttcacaaagtttaccagggaggcaatgttggtcatcttcacagattactttctattgcttctagttcacagatcctctatgttggcgatcacatatacggagatattttgcgcagcaagaaagttctgggctggcggactatgctggtgattccagaactggagcatgaggtgaagcttctttcagaatcaaagtcgactcggaaggagcttaggcatcttagaatggagcgtgattcaattgaagacagaatccatcatcttgaatggtctcttaaatttgatgatctcacagaaaatcagaaggaaaagttgttctctgaacatgtcaatctgctgcaacagcgagagcatgctcgtcgccttcatcaagaggctcaaaggcaacaccatcagaagtttcataaggtgtggggacagctcatgaagactgggtaccaaaattcccgatttgctcatcaggtcgagaggtttgcgtgcctgtatagcagccaggttacaaacttcggtttgtattcccccaacaagtactatcgcccgagcgaagattacatgccccatgagttcgatgtgcttgagctgtaggagcagtccctagttcaaagctccccgttgtaattgaaccacagcaggttaggtgggtgattttagctttgggcattgattaaaatgtgtagttgctgtatttatcaagcgaaagattcactcattggacatgttttatccgagtattgtgggttatgtatagtaaatatagtttcacatagagcaatacatttacctgtatattttttgtacataacaagttttaagcagaagcaaaggaaagcaatgccgatcgtgtcttaattacacgttgtgaa

SEQ ID NO: 1715 - DNA, 2507 bp, Panicum virgatum
ttgccctcgtgcgctcattgtggcgtgcgcgtgtggccggagcaaaagcctccgaagggcagccgagccgcacgccatccgttaccgccggagcaacgtcagcagcacagcccccaactcaaacccatctacacccagcagttcctccaccaccaggcaccagcccacctcctccccgcgtccgctcgcccgcccgcgctcgcccgctgccgctgctgcttccaacgcacgcgagctctgcggcatccgcatccgaatccgcacacgatccccgtgccacttgccccgcccgcccgcggccaatgcccggcgcgatgagatgagacgccgccgccgcgcgccagcagcgccccgcccgtatcggggatccctcctccgcccaccctccccccaccagcgccgcattgattccctcccccagcacgacaacggtcacgcttccgtcgtcccgtccgtctcgtcgcatccggcgctgccccgcggcctatttaaggcgcgcgggctgagagccagagataatgctcttctccaggaggcccctcgccgccgcgctccacctctcgcgcctctcgccgcccttgctcctcctcttcgcgtccgcgtcgtcgtcgtgctcgcccgccgccgccgcgtcggcctccgggcccagaggttgtagtgctgtcaggatggacagcggtgcagtggaatccactggggcagtatggtcaacaccttcggcagaaccgagaaacatttctatcgggaaggagatattctgcaataggtcactcaacatgaggaacatcacagcagtaggatttgatatggactacactcttgcacagtacaagcccgagaccttcgaggcccttgcttactatggtacaatcgagaagcttgtgaaggatctgcactaccctgaagagctgctgacttgggagtttgattggaaatacatggtcagaggattagttcttgataagaagagaggaaatattttgaagatggaccgacacaagtatgtaaaagttgcataccatggttttagggaattgtcgaaagaagaaaaagttgctgcttatgggagtacattgataagagactcatttgatgaacctgattatgcccttatagatacgcttttctcattgggtgaagcttatctatttgctcagcttgttgatttcatggacagtaatcctggaaaagtacctgcaggcacagactatccgcttatgtataaagatgtgaggtctgcagttgacttgtgtcatcgtgatggaacattaaagcggatggttgcgaaggaccctggcaggtacatcaatgaggacttggcaattgtaccaatgcttgaaatgataaagaaatctggacgctcaacattcttggtgacaaatagtttgtgggactacaccgatgttgtcatgaactacctttgtggaccatacacttcagatgcaggatctggtctcaaccacaagtggcttcaatattttgacattgtaataactggcagttcaaagccaagtttcttccacgatgataaccgtgcgggcctctttgaagttgagcctgattccggaaaacttctaaatgctgatattcagattggaagcccaagatcaagtcatcagcatgcaacgccagttcacaaggtttaccagggaggcaatgttggccatcttcacagattactttctattgcttctagttcacagatcctctatgttggtgatcacatatatggagatattttgcgcagcaagaaagttctgggctggcggactatgctggtgattccagaactggagcatgaggtgaagcttctttcagaaacaaagtcgactcggaaggagcttagacatctcagaatggagcgtgattcaattgaagacagaatccatcatcttgaatggtctcttaaatttgatgatctcacagaaaatcagaaggaaaagttgttctctgaacatgtcaatctgctgcaacagcgagagcatgctcgctgccttcatcaagaggctcaaaggcaacaccatcagaagtttcataaagtgtggggacagctcatgaagactgggtaccaaaattcccgatttgctcatcaggtcgagaggttcgcatgcctgtacagcagccaggttacaaacttaggtttgtattcccccaacaagtactatcgcccgagcgaagattacatgccccatgagttcgatgtgcttgagctgtaggagcactccctagttcaaagctccccgttgtaattgaaccacagcagtgtaggagggtgattttagctgtggcattgattaacatgtgtagttgccgtatttatcgagcgaaagattcactcattggacatgttataaccgagtattatgggtcaggtatagtaactatagtttcagatagagcaatacatttacctgtatattttttgtacataacaagttttaagcagaaggaaaaaaaaaagcaatgccgatcatgtcttaagtacacgttgtgaattctgtgttttg

SEQ ID NO: 1716 - DNA, 2481 bp, Zea mays
catccatcccatcccaagccagcaccagcagttcctccaccaccagcccagccctcgccccgtccgttcgtccgcccgcgcccgctgctgcttgcctgcttcccacgcacgcgagctctgttccgtgctgcagcaaccgcaaccgcatccgcatccgaatccgcacacgatccccgcgccacttgccccgtcaccccccacgcggcccgcgcctccgcccgctcgtcggccaatgcccggcgcaggccagctcggcgagatgagatgacgccgccgcgcggcggtgcccggcctcccgtcgctcacgcgcgccagcaccagcaccacccggccccatcgggattcttcatcccgtcctccacctagcgcggtagcgccgcatttattccctcccccgcacaacggtcacgtttccatcgcccccccgtcttctctccctcgtcgcatccggcactcctcctcgtctcctatttaaagcgcgccgggctgggagccagcgatcatgctattctctaggaggcctctcgccgccgctttccacctcgcgcccctttcgcctccgctgctcctcttcttcgcatccgcgtcctcgtcctgctcgcccgccgcctccgccgccgccgcgtcggtctccggctccaggggttgcactgctgcaaggatggacagcggtgcggtggagacagcgtccactggggcagtatggtcatcaccttcggcagaaccgagaagcatttctgtcgggaaggaggtattctgcaacaggtcactcaacatgaggaacatcacagcagtgggatttgatatggactacactctggcacagtacaagcctgaaaccttcgagtcccttgcttactatggtacaatagagaagcttgtgaaggatctccgctaccctgaagagctgttgacttgggaatttgattggaaatatatggtcagaggactagttctcgataagaagagaggaaatatcttgaagatggatcgacacaagtatgtaaaagttgcataccatggttttaaggaactatcgaaagaagaaaaagttgctgcttatgggagtacattgataagagattcatttgatgaacctgattatgcccttatagatacacttttctcactgggtgaagcttatctatttgctcagcttgttgatttcatagacaagaatcctggaaaagtacctgcaggcacagactatccacttatgtacagagatgtgaggtctgcggttgacttgtgtcatcgtgatggaactctaaagcggatggttgcgaaggatcctgccaggtacatcaatgaggacttggcaattgtaccaatgcttgaaatgatcaggaaatctggacgctcaacattcttagtgacaaatagtttgtgggactacaccgatgttgtcatgaactacctttgtgggccatacacttcaggtgtaggctctggtctcaatcacaagtggcttcaatattttgatattgtaataacaggcagttcgaagccaagtttcttccatgatgataaccgtgcaggattgtttgaagttgagcctgattctggaaaacttctgaatgctgatattcagatcggaagcccaagatcaagtcatcaacactcaacaccagttcagaaagtttatcaggggggcaatgttggtcatctccacagattactttctgttgcttctagttcacagattctctatgttggtgatcacatatacggagatattctgcggagcaagaaagttctaggctggcggactatgctggtgattccagaactagaacaagagctgaagcttctctcagaatcaaagtctactcgtaaggagcttagacatcttagaatggagcgtgattcgattgaagacaaaatccatcatcttgaatggtctcttaagcttgatgatatctcagaaaaccagaaggagaaattgttctctgaacatgacaatctgctgaaacagagagggcatgttcgtggtcttcatcaagaagctcagaggcaacatcatcagaagtttcataaggtgtggggacagctcatgaagactgggtaccaaaattccagatttgctcatcaggttgagagatttgcatgcttgtacagcagccaggttacaaacttcggtttgtattctcctgacaaatactatcgtccgagcgaagattacatgccccacgagtttgatgtgcttgggctgtaggagcagcccctactgctggtcggagttcctcgttgtaattgatccatagcataggagggtgacatcgtagttgccgtattatataacaggaagcttcacccattgtgaaggagagaaggtttataactatagtagctacatttctacttatcagtaagtttacctgtatataaatatgtacataactgatatatgatgcgtgttatttgtgagcacgcgttaagtagtactgactaagtcctgctggtgtagtcattggttttttt

SEQ ID NO: 1717 - DNA, 1824 bp, Pennisetum glaucum
gccgccgcgtcggcctccggcggcaccagaggaggttgcagtgctgtaaggatggacagcggtgcagtggagtccactggggcagtatggtcaacaccttcggcagaaccgaaaagcgtttcaatcgggaaggcgatattctgcaataggtcactcaacatgaggaacatcacagcagtgggatttgatatggactacactcttgcacagtacaagcctgagaccttcgaggcccttgcttactatggtacaattgagaagcttgtgaaggatctccgctaccctgaagagctgttgacttgggagtttgattggaaatacatggtcagaggactagttcttgacaagaagagagggaatatcttgaagatggatcgacacaagtatgtaaaagttgcataccatggttttagggaattgtcaaaagaagaaaaagttgctgcttatgggagtacattgataagagattcatttgatgaacctgattacgcccttatagatacactcttctcattgggtgaagcttatctatttgctcagcttgttgatttcatggacaataatcctggaaaagtacctgccggcacagactatccgcttatgtataaagatgtgaggtctgcggttgacttgtgtcatcgtgatggaactttaaagcggatggttgcgaaggatcctggcaggtacatcaatgaggacttggcaattgtaccaatgcttgaaatgctaaaaaaatctggacgctcaacattcttagttacaaatagtttgtgggactacactgatgttgtcatgaactacctttgtggaccatacacttcagatgcaggatctggtctcaaccgcaagtggcttcaatattttgatattgtaataactggcagttcgaagccaagtttcttccatgatgataaccgtgcaggcctctttgaagttgaacctgattctgggaaacttctaaatgctgatattcagattggaagcccaagatcaagtcttcagcatgcagcaccagttcacaaagtataccagggaggcaatgtcggtcatctccacagattactttctgttgcttctagttcacagatcctctatgttggtgatcacatatatggtgatattctgcgcagcaagaaagttctgggctggcggactatgctggtgattcctgaactggagcacgaggtgaagcttctttcagaatcaaagttgacacggaaggagcttagacaccttagaatggaacgtgattcaattgaagacagaatccatcatctcgaatggtctctcaaatttgatgatatcacagaaaatcagaaggaaaagttctcagaacatgctgatctgctgcaacagcgagagcatgttcgccgccttcatcaagaggcgcagaggcaacatcatcagaagtttcataaggtgtggggacaactcatgaagactggttaccaaaattcccgatttgctcatcaggtcgagagatttgcatgcctctacagcagccaggttacaaacttcggtttgtattctcccaacaagtactatcgtccaagcgaagattacatgccccatgagttcgatgtgcttgggctgtaggagccaagtccctgcagatgcccaaagctccccattgtaattggacggcagcaggataaatgggttgattctaattgcagcattgattaacatgtgtagttgccatatttatctagcgaaagcttcacccgttaggcatgttatgagaaggaaagagagatactagtatttaaagaaactatagttttgcatatatcagtaactttacctgtatatttttgtacataa

SEQ ID NO: 1718 - DNA, 2432 bp, Oryza sativa
gtttcccccctcgaggccctgaaccgcaaggcccccctcgtgtgtgcttctcctgcttggcgcgcccccggccaaacgcatccccacctcctccccttcccgtcgctcgctggcttccaacgcacgcgagcctcgcatcgcatcggaatcctcacgcgatccctccgccccccgccgcggcgccggccaccaccgccaatgcccggcggcgcgcggcgccggtgaagggtgagggcgagcagcgccgtcgcgcgcgcgccccgcccgtttggattccattccttcctctccccactcacacccactgctcaatttattcccacgcgccccacgctgacgcctcgtcgcactcgtgtctcgcgtcccgtcccgtctcggcgtcgcctcgccttcgccttcgcctatttaagggggggcgatatgctcttcgccaggaggccgctcgccaccgccgccagccacctcgcgcccttctcccctcccctcctcctcttcttcgcctccgcctcctcgtcgtgctcatccgccgcgtcgccttcttcggcctcgggccctagagggtgcagtgctgtaaggatggagaccggtgcggtggagccagcatcaacaggagcaatatggtcaacgccatcagtggaacctagaaccatttctgttgggaaagagatattctgcaaccggtcactcaacatgaggaacatcactgcagtaggatttgatatggactacactcttgcgcagtacaagcccgagacatttgaggctcttgcttaccatggcacaatagagaagcttgtcaaggaccttggctaccctgaggagctgttaacatggcagtttgactggaaatatatggtcagaggattagttcttgataagaagagagggaatatcttgaagatggatcggcacaagtatgtgaaagttgcttatcatggatttagggaaatgtcaaaagaagaaaaagtgtctgcttatggaagtacattgatacgagattcctttgatgagcctgactatgccctcatagatacacttttctcattgggtgaagcctatctgtttgctcaacttgttgatttcatggataacaatcctggaaaagtaccttcaggcactgactatccgcttatgtacagagatgtgaggtctgctgttgacttgtgccatcgtgatggaacattaaagagaatggtcgcaaaggatcctagcaggtacatcaacgaggacttggccattgtaccgatgcttgaaatgattagaaaatctgggcgctcaacattcttggtgacaaatagtctgtgggactacacagatgttgtcatgaactacctctgtaggccatatacctcagatgtaagctccagtcacaaccacaagtggcttggatatttcgatgttgtgataacaggaagtgcaaagccagggttcttccatgatggtaaccgtgctggactgtttgaagttgagcctgattctggaaagcttttaaatgctgatcttcatattggaagccccagatcaggtcagcagccttcaaggccaatccacaaaatttaccagggaggaaatgttggtcatcttcacagattactttctgttgcttctagttctcagatcttatatgttggagatcacatttatggagacatactgcgcagcaagaaagtccttggttggcgcacaatgctagtaataccagagctagagcaagaggtgaaacttctttcggaatcaaaatctactcgaaaggagcttaggcatcttaggatggagcgtgattcaattgaagataaaatccatcgtcttgaatggtcactcaagtttgaaaatcttacagaagatgagaaggaaaagttattctcggagcatgacattctgctgcaaaagaaggaacatgttcgtcggcttcatcaagaggctcaaaggcaacatcatcataagttccataaagtgtgggggcaactcatgaagacgggttatcaaaactcccgatttgctcatcaggtcgagagatttgcgtgcctttacagtagtcaagtcacaaactttgctttgtattctcccaacaagtactaccgtccaagcgaagattacatgccccatgagttcgatgtgcttgggctgtaggagttctcccggtctccttgaatagattttcagcttgcatctggataggagcatgatcttttgtcctgtggctcttaccgtctaataacattgtagtttctgttaattttgtaagcaagtgtgggattaatctggtgaatgttcacctgttcttttcaagttaccgctgaaaaaagaaagcgaaaggtttgtgtaattatagtcggccatagcagatcagcaatttaactatatctttttgtacataataacaagcttatagtgaaattaaaggaaaagttcttgatggaaagttttagctc

SEQ ID NO: 1719 - DNA, 2164 bp, Hordeum vulgare
ccccctcggattccccccgccccatttattcccctcccggcccgccaacaacagcgtcccgtcatcctcctcgtccgcgccacccccgccccctctcgcctatttaaggccgccccagcgatatgctctccaggaggccgctcgccgccgcgctacgcctcgcgcccctctcgcctcccctcctcctcttcttcgcatcctcctcctcctcctcccccgccgcgtcggcttcggggcccagaggctgcagtgctctaaggatggatagcggtgctgcggaacctgcttcaacaggggcaatctggtcaacaccgtcggtggagccgagaagcatttctattgggaagcagatattctgcaataggtcactcaacatgaggaacatcaccgcagtaggatttgatatggactacactctcgcgcagtacaagcccgagacattcgaggcccttgcttaccatggcactattgagaagcttgtgaaggatctgaactaccctgtggagctgttgacatggcaatttgactggaaatacatggtcagaggactagttcttgataagaaaagaggaaatatcttgaagatggaccggcacaagtatgtaaaagttgcataccatggatttagggagatgtcgaaggaagaaaaagttgctgcttatggaagtacattgataagggattcctttgatgaacctgattatgcccttatagatacacttttctcactgggtgaagcctatctgtttgctcagcttgttgatttcatggacagcaatcctgcaaaagtaccttcaggcactgactatgcgcttatgtataaagatgtgaggtctgccgttgatctgtgtcatcgtgatggaactttaaaacgaatggttgcaaaggaacctagcaggtatatcaatgaagacttggcaattgtaccaatgcttgaaatgcttagaaaatctggacgctcaacattcttggtgacaaacagtttatgggactacactgatgttgtcatgaactacctatgtgggccatatatgtcagatgtaagctcaagtcacaaccgcaagtggcttgagtattttgatgttgttataacaggcagttcgaagccaagcttttttcatgatgataatcgagcaggattgtttgaagttgagcctgattctgggaaacttctaaatgctgatcttcagattggaagcccaagatcaagtcaacatcagccaaaaccaattcacaaagtttaccagggaggcaatgttggtcatcttcacagactactttctgttgcatctagttcacagatcctttatgttggcgatcacatatatggagacatactccgcagcaagaaagttctaggttggcggactatgcttgtaatacctgagctggagcaagaggtgaagcttctttcagaatcaaaatctactcgaaaggaacttagacaccttagaatggagcgtgattcagttgaagacacaatccatcgccttgaatggtctcttcaatttgaagatcttacagagaatgagaaggggaagttgttatctgagcatgacaatctactgcaaaagctgaagggtatccgctgccttctccgagatgctcagatgcaacatcatcagaagtttcacaaggtgtggggacagcttatgaagactgggtaccaaaattctcggtttgctcatcaggtcgagagatttgcgtgcctatactgcagccaagttacagactttgggttgtattctcccaacaagtactaccgtccgagcgaagattacatgccccatgagttcgatgtgcttggcctgtagtactagtttgtgctcatgcagaatcggagttctccattgaggtgtaggcaagcaagataggggcacaattttagcatggtactgaataacttgtttacatcctcacacaatggatgaggtttatacttggtgaaactgcacccatttccacatgtttatatactagagttgctcataggaaattacacaggtttcccattttgtacataacatgttctaacatggggcgaatgaaaccaatgttcaatgttgatcattccaactttcaaagtaaataatctaatttggttattctgcttggatatgctcatctgaattagaggtctatttggttctctgttcgaaaggct

SEQ ID NO: 1720 - DNA, 2402 bp, Secale cereale
gactcggaactccctcgcccaccccgctccgtcgctcgcggtcgctgctggcttccgacgcacgcggcatccgaatccgcaccgcaccgcacacgatccccgcgccacttgtccctcgccgcccaatgcccgccctccggtgagatggcgccgccgctcggcggtgctcgcgccaccccaccctctcggattcccccacttcatttattccccgggccagcaacaacaccccgtcatcctcatccgcacttctgctcgcctatttaaggccggcccagcgacatgctctccaggaggccgctcgccgccgcgctacgcctcgcccccctctcgcctcccctcctcctcttcttcggcctcctcctcgtcgtcgcccgcctcctgctctcccccgccgcatcggccttgggccccagaggctgcagtgctctaaggatggatagcggtgccgtggaaccagcttcaacgggggcaatctggtcaacaccgtcggtgggagccgagaagcatttcaattgggaagcagatattctgcaacaggtcactcaacatgaggaacatcaccgctgtaggatttgatatggactacactcttgcgcagtacaaacccgagacatttgaggcccttgcttaccatggcaccattgagaagctcgtgaaggatctcaactaccctgaggagctgttgacatggcaatttgactggaaatatatggtcagaggactagttcttgacaagaaaagaggaaatatcttgaagatggaccggcacaagtatgtaaaagttgcataccatggatttagggagatgtcgaaggaagaaaaagttgctgcttatgggagtacattgataagggattcctttgatgaacctgattatgcccttatagatacacttttctcactgggtgaagcctatctgtttgctcagcttgttgatttcatggacagcaatcctgcaaaagtaccttcaggcactgactatgcgcttatgtatagagatgtgaggtctgcggttgatctgtgccatcgtgatggaactttaaaacgaatggttgcaaaggaacctagcaggtatatcaatgaagacttggcaattgtgccgatgcttcaaatgcttagaaaatctggacgctccacattcttggtgacaaacagtttatgggactacactgatgttgtcatgaactacctatgtgggccatatatgtcagatgtaagctcaagtcacaaccacaagtggcttgagtattttgatgttgttataacaggcagttcaaagccaagcttttttcatgatgataatcgaacaggattgtttgaagttgagcctgattctgggaaacttctaaatgctgatcttcagattggaagcccaagatcaagtcaacatcagccaaaaccaattcacaaagtttaccagggaggcaatgttggtcatcttcacagactactttctgttgcttctagttcgcagatcctctatgttggtgatcacatatatggagacatactccgcagcaagaaagttctaggttggcggactatgctggtaatacctgagctggagcatgaggtgaagcttcaatcagaatcaaagtcaactcgaaaggagcttagacaccttagaatggagcgtgattcagttgaagacacgatccatcgccttgaatggtctcttcaatttgaagatcttacagagaatgagaaaggaaagttgttatctgagcatgataatctactgcaaaagctgaagggtatccggtgccttctccgagatgctcagatgcaacatcatcagaagtttcacaaggtgtggggacagcttatgaagactgggtaccaaaattctcggtttgctcaccaggttgagagatttgcgtgcctatactgcagccaagttacagactttgggttgtattctcccaacaagtattaccgtccgagcgaagattacatgccccatgagtttgatgtgcttggcctgtagaactagtttgtgctcatgcgggatcgaagttctcctttgaggtgtaggctgcagcaagataagggcacaattttagcatgatactgaataacaaatgtttaccaccccacacaacgatgaggtctacctggtgaaacttcacccattttacatgtttatatactatagttgctgataggaaattttacaggtttcctgctttgtacataacatgttctaacagggggcgaatgaaaacaatgttgaatgttgatcattccaactttcaaagtaaataatttaatttggttactctgcttggctatgactaataaaaaaaaaaaaaaaaaaacaaaaaaaaaagtaatacggtcgtaggtaacacttggctttctgtgactagccgaagaccagacgaagggggttaggcggg

SEQ ID NO: 1721 - DNA, 2361 bp, Brachypodium distachyon
cttgcttagcgcgccccacccaaccaacccagccaaagcccaaacacaaacagccccaccaccccccggccaccgcgcccccgtccgtcgctcgctggcttccaacgcacgcagcatccgaatccgcacacgatccccgcgccacttgtccgcgggggcatccccgtcccgtcccgccggccaatgcccgcctcccggtgagatggcgccgccgcacggcggtgctcctcccaccctctcggattccccccacttcatttattattctccccccacaacgccaacgctccgtcgtcgtcatccgcaaccgcgcccctcgcctatttaaggcgcccccagccagccgatatgctctgcaggaggccgctcgccgctgccgccgcgctccacctcgcgcccctctcgcctcccctcctcctcttcttcgcgtcgtcgtcatcgtccgcctcctgctcccccgccgccgccgcagcagcagcaactcccgcttcgggtcatagaggctgcagtgctgtaaggatggataccggtgcggtggaaccagcatcaacggggacgatatggtcaacaccgtcagtggagccgagaagcatttccattgggaagcagatattctgcaatagatcactaaacatgaggaacatcaccgcagtgggatttgatatggactacactcttgcacagtataagcccgagacgttcgagtcccttgcttaccatggcacgattgagaagcttgtcaaggatctcaactaccctcaagagctgttaacatggcagtttgactggaaatatatggtcagaggactagttcttgataagaagagaggaaatatcttgaagatggatcggcacaagtatgtaaaagttgcataccatggattcagggagatgtcaaaggaagaaaaagttgctgcttacgggaatacattgattagggattcctttgatgaacctgattatgcccttatagatacgcttttctcactaggtgaagcctatctatttgctcaacttgtggatttcatggacaacaatcctggaaaagttccttcaggcatcgattatgcgctgatgtataaagacgtgaggtctgcggttgacctgtgtcatcgtgatggaactttaaaacgaatggttgcaatggaacctggaaggtatatcaatgaggacttggcaattgtaccaatgcttgaaatgcttagaaaatctggacgctcaacattcttggtgacaaatagtctgtgggactacactgatgttgtcatgaactacctatgtgggccatatatatcggatgtaagctcaaatcacaaccgcaagtggctcgagtattttgatgttgttataacaggcagttcaaagccaagtttttttcatgatgataatcgaacaggactgtttgaagttgagcctgattctggaaaacttctaaatgctgatcttcagattggaagcccaagatcaagtcaacatcagtcaaaaccaattcacaaagtttaccagggaggcaatgtgggccatctccatagactactttctgttgcttctagttcgcagatcctctatgttggcgatcacatatacggagacatactgcgtagcaagaaagtcctcggttggcggactatgctggtaatacctgagctggagcaagaggtgaagcttctttcagaatcaaaatctactcgaaaggagcttagacaccttaggatggagcgtgattcaattgaagacacaatccatcgccttgaatggtctcttcaatttgaagatcttacagagaatagaaaggagaagttgttctctgagcatgacattctactgcaaaagctgaagggtatccgatgcgttctccgagatgctcagctgcagcatcatcagaagtttcacaaggtgtggggccagcttatgaagactgggtaccaaaattctcggtttgcccatcaggttgagagatttgcgtgcctatactgcagccaagttacaaacttcggtttgtattctcccaacaagtattaccgcccgagcgaagattatatgccccatgagtttgatgtgctaggcctgtagctacaagtttattctcatgttgaattgaagttccccttgggagactcggctgcagcaagatttgagcatgaaattatgattcactgaataacaatctagtttcatatattaccaccttaaacaagggattaggtttttctggtgaagctccgttcacccactgtacatgtttatctgaagtaattatagctgtttatagaaaattcacatgtttatccttttgtacatgccatatcattaacagagagcgattgaaagaaaagttgagggctgatcatgtcctagcct

SEQ ID NO: 1722 - DNA, 2364 bp, Triticum aestivum
cccccgcctccctccgtcgcccgcggtcgctgctggcttccaacgcacgcggcatccgaatccgcaccgcaccgcacccgatcccccgcgccacttgtcccgccgcccaatgcccgccctccggtgagatggcgccgccgcgcggcggtgctcccaccccctcggattccccccacgccatttattctcccccaacagcgtcccgtcatccccctcacccgcaccacccccgctcgcctatttaaggcccagcgacatgctctccaggaggccgctcgccgccgcgctacgcctcgcgcccctctcgcctccgctgctcctcttcttcgcctcctcctcctcctcgtcgtcgtcacccgcctcgtgctcctcccccgccgcttcggcctcgggccccagaggctgcagtgctctaaggatggataccggcgctgtggagccagcttcaacgggggcaatctggtcaacaccgtcggtggagccgagaagcatttccatcgggaagcagatattctgcaacaggtctctcaacatgaggaacatcaccgcagtaggatttgatatggactacactcttgcgcagtacaagcctgagacatttgaggcccttgcttaccatggcaccattgagaagctcgtgaaggatctcaactaccctgaggagctgttgacatggcaatttgactggaagtatatggtcagaggactagttcttgataagaaaagaggaaatatcttgaagatggaccggcacaagtatgtaaaagttgcataccatggatttagggagatgtcaaaggaagagaaagttgctgcttatgggagtacattgataagggattccttcgatgaacctgattatgcccttatagatacacttttctcactgggtgaagcctatctgtttgctcagcttgttgatttcatggacaacaatcctgcaaaagtaccttcaggcactgactatgcgcatatgtatagagatgtgaggtctgcggttgatctgtgtcatcgtgatggaactttaaaacgaatggttgcaaaggaacctagcaggtatattaatgaagacttggcaattgtgccgatgcttcaaatgcttagaaaatctggacgctccacattcttggtgacaaacagtttatgggactacactgatgttgtcatgaactacctatgtgggccatatatgtcagatgtaagctcaagtcacaaccacaagtggcttgagtattttgatgttgttataacaggcagttcaaagccaagcttttttcatgatgataatcgaacaggattgtttgaagttgagcctgattctgggaaacttctaaatgctgatcttcagattggaagcccaagatcaagtcaacatcagccaaaaccaattcacaaagtgtaccagggaggcaatgttggtcatcttcacagactactttctgttgcttctagttcgcagatcctctatgttggtgatcacatatatggggacatactccgcagcaagaaagttctaggttggcggactatgctggtaatacctgagctggagcaagaggtgaagcttcaatcagaatcaaagtctactcgaaaggagcttagacaccttagaatggagcgcgattcagttgaagacacgatccatcgccttgaatggtctcttcaatttgaagatcttacagagaatgagaaggggaagttgttatctgagcatgataatctactgcaaaagctgaagggtatccgctgccttctccgagatgctcagatgcaacatcatcagaagtttcacaaggtgtggggacagcttatgaagactgggtaccaaaattctcggtttgctcaccaggtcgagagatttgcgtgcctatactgcagccaagttacagactttgggttgtattctcccaacaagtattaccgtccgagcgaagattacatgccccatgagttcgatgtgcttggcctgtagaactagtttgtgttgatgcggaatcgaagttctcctttgaggtgtaggttgcaacaagatatgggcacaattttagcatgataccgaataacaaatgtttaccacctcacacaatggatgaggtctacctggtgaaacttcacccattttacatgtttatatactatagttgctgataggaaattttacaggtttcccgctttgtacataacatgttctaacagggggcgaatgaaaccaatgttgaatgttgatcattccaactttcaaagtgaataatttaatttggttactcccgcttgcctatgatcatctgtaattttataactccctaagtgtccggttactagttttaggttcaaagtttggttttaggaaaaacggggtcccgt

SEQ ID NO: 1723 - DNA, 2322 bp, Triticum aestivum
gcaccgcaccgcacccgatccccgcgccacttgtcccgccgcccaatgcccgccctccggtgagatggcgccgccgcgcggcggtgctcccaccccctcggattccccccacgccatttattctcccccaacagcgtcccgtcatccccctcacccgcaccacccccgctcgcctatttaaggcccagcgacatgctctccaggaggccgctcgccgccgccctacgcctcgcgcccctctcgcctcccctgctcctcttcttcgcctcctcctcctcgtcgtcccccgcctcctgctcctcccccgccgcttcggcttcaggccccagaggctgcagtgctctaaggatggatagcggcgctgtggaaccagcttcaacgggagcaatctggtcaacaccgtcagtggagccgagaagcatttccatcgggaagcagatattctgcaacaggtctctcaacatgaggaacatcaccgcagtaggatttgatatggactacactcttgcgcagtacaagcccgagacatttgaggcccttgcttaccatggcaccattgagaagctcgtgaaggatctcaactaccctgaggagctgttgacatggcaatttgactggaagtatatggtcagaggactagtgcttgataagaaaagaggaaatatcttgaagatggatcggcacaagtatgtaaaagttgcataccatggatttagggagatgtcgaaggaagaaaaagttgctgcttatgggagtacattgataagggattcctttgatgaacctgattatgcccttatagatacacttttctcactgggtgaagcctatctgtttgctcagcttgttgatttcatggacagcaatcctgcaaaagtaccttcaggcactgactatgcgcttatgtatagagatgtgaggtctgcggttgatctgtgtcatcgtgatggaactttaaaacgaatggttgcaaaggaacctagcaggtatatcaatgaagacttggcaattgtgccgatgcttcaaatgcttagaaaatctggacgctccacgttcttggtgacaaacagtttatgggactacactgatgttgtcatgaactacctatgtgggccacatatgtcagatgtaagctcaagccacaaccaaaagtggcttgagtattttgatgttgttataacaggcagttcaaagccaagcttttttcatgatgataatcgaacaggattgtttgaagttgagcctgattctgggaaacttctaaatgctgatcttcagattggaagcccaagttcaagtcaacatcagccaaaaccaattcacaaagtttaccagggaggcaatgttggtcatcttcacagactactttctgttgcttctagttcgcagatcctctatgttggtgatcacatatatggagacatactccgcagcaagaaagttctaggttggcggactatgctggtaatacctgagctggagcaagaggtgaagcttcaatcagaatcaaagtcaactcgaaaggagcttagacaccttagaatggagcgtgattcagttgaagacacgatccatcgccttgaatggtctcttcaatttgaagatcttacagagaatgagaagggaaagttgttatctgagcatgataatctactgcaaaagctgaagggtatccgttgccttctccgagatgctcagatgcaacatcatcagaagtttcacaaggtttggggacagcttatgaagaccgggtaccaaaattctcggtttgctcaccaggtcgagagatttgcgtgcttgtactgcagccaagttacagactttgggttgtattctcccaacaagtattaccgcccgagcgaagattacatgccccatgagttcgatgtgcttggcctgtagagctagtttgtgtacatgcagaattgaagttctcctttgaggtgtaggctgcaacaagatatgggcacaattttagcatgatacagaataacaaatgtttaccacctcacaaaacggatgaggtctacctggtgaaacttcacccattttacatgtttatatactatagttgctgataggaaattttacaggtttcccgttttgtacataacatgttctaacagggggcgaatgaaaccaatgctgaatgttgatcattccaactaagtaaataatttaatttggttactccgcttggctatgctcatctgaatttgaagtggtgtataacaattcataatatcccgatgaggtctgtaactcctaattaattttgagggtcatttggttctctgttttaaaggccgagccatttgtttc

SEQ ID NO: 1724 - DNA, 2279 bp, Triticum aestivum
cctcccccctccgccctccctccgtcgcccgcggtcgctgctggcttccgacgcacgcggcatccgaatccgcaccgcaccgcacccgatccccgcgccacttgtcccgccgcccaatgcccgccctccggtgagatggcgccgccgcgcggcggtgctcccaccccctcggattccccccactccatttattctccccctggcccgccaacaacagcgtcccgtcatcctcctcacccgcaccacccccgctcgcctatttaaggcgacatgctctccaggaggccgctcgccgccgccctacgcctcgcgcccctctcgcctccgctcctcctcttcttcgcctcctcctcctcctcgtcgtcgtcacccgcctcgtgctcctcccccaccgcttcggcctcggcccccagaggctgcagtgctctaaggatggatagcggcgctgtggaaccagcttcaaccggggcaatctggtcaacgccgtcggtggagccgagaagcatttccatcgggaagcagatattctgcaacaggtctctcaacatgaggaacatcaccgcagtaggatttgatatggactacactcttgcgcagtacaaacctgagacattcgaggcccttgcttaccatggcaccattgagaagctcgtgaaggatctcaactaccctgaggagctgttgacatggcaatttgactggaagtatatggtcagaggactagttcttgataagaaaagaggaaatatcttgaagatggaccggcacaagtatgtaaaagttgcataccatggatttagggagatgtcgaaggaagaaaaagttgctgcttatgggagtacattgataagggattccttcgatgaacctgattatgcccttatagatacacttttctcactgggtgaagcctatctgtttgctcagcttgttgatttcatggacagcaatcctgcaaaagtaccttcaggcactgactatgcgcatatgtatagagatgtgaggtctgcggttgatctgtgtcatcgtgatggaactttaaaacgaatggttgcaaaggaacctagcaggtatatcaatgaagacttggcaattgtaccgatgcttcaaatgcttagaaaatctggacgctccacattcttggtgacaaacagtttatgggactacactgatgttgtcatgaactacctatgtgggccatatatgtcagatgtaagctcaagtcacaaccacaagtggcttgagtattttgatgttgttataacaggcagttcaaagccaagcttttttcatgatgataaccgaacaggattgtttgaagttgagcctgattctgggaaacttctaaatgctgatcttcagattggaagcccaagatcaagtcaacatcagccaaaaccaattcacaaagtttaccagggaggcaatgttggtcatcttcacagactactttctgttgcttctagttcgcagatcctctatgttggtgatcacatatatggagacatactccgcagcaagaaagttctaggttggcggactatgctggtaatacctgagctggagcaagaggtgaagcttcaatcagaatcaaagtctactcgaaaggagcttagacaccttagaatggagcgtgattcagttgaagacacgatccatcgccttgaatggtctcttcaatttgaagatcttacagagaatgagaagggaaagttgttatctgagcatgataatctactgcaaaagctgaagggtatccgctgccttctccgagatgctcagatgcaacatcaccagaagtttcacaaggtgtggggacagcttatgaagactgggtaccaaaactctcggtttgctcaccaggtcgagagatttgcatgcctatactgcagccaagttacagactttgggttgtattctcccaacaagtattaccgtccaagcgaagattacatgccccatgagttcgatgtgcttggcctgtagaactagtttgtgctcatgtggaatcgaagttctcctttgaggtgtaggctgaagcaagatatggacgcaattttagcatgatactgaataacaaatatttaccacctcacacaacagaatgaggtctacctggtgaaacttcacccattttacatgtttatatactatagttgctgataggaaattttacaggtttcctgctttgtacataacatgttctaacagggggcaaatgaaaccaatgttgaatgttgatcatttcaactttcaaagtaaataatttaatttggtta

SEQ ID NO: 1725 - DNA, 2042 bp, Triticum aestivum
gccgcttcggcttcaggccccagaggctgcagtgctctaaggatggataccggcgctgtggagccagcttcaacgggggcaatctggtcaacaccgtcggtggagccgagaagcatttccatcgggaagcagatattctgcaacaggtctctcaacatgaggaacatcaccgcagtaggatttgatatggactacactcttgcgcagtacaagcctgagacatttgaggcccttgcttaccatggcaccattgagaagctcgtgaaggatctcaactaccctgaggagctgttgacatggcaatttgactggaagtatatggtcagaggactagttcttgataagaaaagaggaaatatcttgaagatggaccggcacaagtatgtaaaagttgcataccatggatttagggagatgtcaaaggaagagaaagttgctgcttatgggagtacattgataagggattccttcgatgaacctgattatgcccttatagatacacttttctcactgggtgaagcctatctgtttgctcagcttgttgatttcatggacaacaatcctgcaaaagtaccttcaggcactgactatgcgcatatgtatagagatgtgaggtctgcggttgatctgtgtcatcgtgatggaactttaaaacgaatggttgcaaaggaacctagcaggtatattaatgaagacttggcaattgtgccgatgcttcaaatgcttagaaaatctggacgctccacattcttggtgacaaacagtttatgggactacactgatgttgtcatgaactacctatgtgggccatatatgtcagatgtaagctcaagtcacaaccacaagtggcttgagtattttgatgttgttataacaggcagttcaaagccaagcttttttcatgatgataatcgaacaggattgtttgaagttgagcctgattctgggaaacttctaaatgctgatcttcagattggaagcccaagatcaagtcaacatcagccaaaaccaattcacaaagtgtaccagggaggcaatgttggtcatcttcacagactactttctgttgcttctagttcgcagatcctctatgttggtgatcacatatatggggacatactccgcagcaagaaagttctaggttggcggactatgctggtaatacctgagctggagcaagaggtgaagcttcaatcagaatcaaagtctactcgaaaggagcttagacaccttagaatggagcgcgattcagttgaagacacgatccatcgccttgaatggtctcttcaatttgaagatcttacagagaatgagaagggaaagttgttatctgagcatgataatctactgcaaaagctgaagggtatccgctgccttctccgagatgctcagatgcaacatcatcagaagtttcacaaggtgtggggacagcttatgaagactgggtaccaaaattctcggtttgctcaccaggtcgagagatttgcgtgcctatactgcagccaagttacagactttgggttgtattctcccaacaagtattaccgtccgagcgaagattacatgccccatgagttcgatgtgcttggcctgtagaactagtttgtgttgatgcggaatcgaagttctcctttgaggtgtaggttgcaacaagatatgggcacaattttagcatgataccgaataacaaatgtttaccacctcacacaatggatgaggtctacctggtgaaacttcacccattttacatgtttatatactatagttgctgataggaaattttacaggtttcccgctttgttacataacatgttctaacagggggcgaatgaaaccaatgttgaatgttgatcatttcaactttcaaagtaaataatttaatttggttattactccgcttggctatgctcatctgaatttaaagtgctgtataacaattgataatatcccaatgaggtctgtaacccctaatgaattttgagggtgaaatttgagggccatttggttcaatgtttgaaaggctgagccatttgtttctaaac

SEQ ID NO: 1726 - DNA, 1553 bp, Sorghum bicolor
gcgtcgtggtcaaccgcaccgcacctggggtatttctagtggcgtcccatctccccggcctgaggcgatgacgacgacgatgatgaggctgaggcagcacctgggcctggcctcctcctcctcctcctcctcccctgctattatttatttatacctccgccatcgccaggctcggcaacaacacccaccgccgccgaacaagtactactagcaccaccctaaagcagctcctcctcgccttcctcctcatcctcgtcttcttgatccccagctccgtcttgttgcccccagctcggcctcggatcatgtcgtcctctgcttccgactctgcctcgtccgcggcgccgttcgagaagcccagggccgtggtcaagaagctcctcgcggagtcgcagcccgaggggcagggcgcaaccgtccgcaggagcatcggcaggcatgaactccggaacctggatcccttcctcatgctcgacgagttctcagtctccaagcccgccggattccccgaccacccacacagaggattcgagaccgtcacctacatgctcgagggcgccttcacccaccaggacttcgccggccacaagggcaccatcaaaacaggcgacgtccaatggatgacggcggggcgcggcatcgtgcactcggagatgccggcgggggacggcgtgcagaaggggctacagctctggatcaacctctccgccaaggacaagatgatcgagccgcggtaccaggagctggagagcaaggacatcagccgcggggagagagacggcgtggaggcgcgcgtcatcgccggggaggccctgggcgcggcgtcgcccgtgtacacgcggacgcccaccatgtacgtcgacttcaccatgcgccccgggtcacgcctccaccagccggtgcccgaagggtggaacgccttcgtctacgtcgtcgacggcgagggcgtgttcgggcgggacaaggccgcgcccaccgccgcgcaccactgcctcgtgcttggacccggcgacgggctcagcgtgtggaatcggtctgacaggccgctcaggttcgtgctcgtcgccgggaagccgcttggtgagcccgtggtgcagcatgggcccttcgtcatgaactcgcgcgccgagatccagcaggccatggaggactactactatggcaagaatggattcgagagggccagccagtggagctcctcctccgcctgatcgtgatcggcgaggcaatcgcaccaaatctaatctcacgtgcaaaataaacatttttaattaaatttcttggcttgtacgactggccatttgtttgttggggaaggctagaacgttccacactctgattttgattattcttttttctagcaaccattgtactagtagcatgtcatttattagtgtggtgaattggtgattgaaataaacagtgtggaaaattgatagtatcaataaagtattattgtattattagtactatggaaaatcgtatccagaccatgaatcggagtattgtattagctcgttcatttatgcgtggcgacatttattcatttaccc

SEQ ID NO: 1727 - DNA, 1494 bp, Panicum virgatum
  misc_feature (905)..(905): n is a, c, g, or t
ctaagatgtcccacccctcccaccccaaaccccacgccagcccaacaccgcccgaccatgtcgcgcaaaaacttccgcaagcggaccatcgagccggacgctgacgaccgctccgacgacgaggacacccgccgcgtcgccctggaggagatcaagtacatccagaagctgcgggagaggaagctgggcatccccgccgaccccgccgccgcctccaccaacgggtcctccgcccgtggacgggtgggtggcgggggagcggccgtcggcgaggccgagaaggaggacctcgtcctccaggacaccttcgcgcaggagaccgccgtcaccatcgaggatcccaatatgttgaagtatgtggagaccgagctggggaagaagaggggtaagatggttgatgtgggacaaaaggaggagatggaccatgtggacgagctctacaccgtgccagaccacctcaaggtgaaaaagaagaactcggaggagagctcgacacagtggaccactggcattgctgaagttcagctgcctattgagtacaaattaagaaacattgaagaaactgaggcagctaaaaagatgctgcaagagaaaaggcttgctggtaaaccaaaatcagattcaaatattccatcaagttacagtgctgattatttccatcgcggcaaagaatatgatgagaaattgcgaagagagaatcctggctgtacaaagataaagattctcgggctaatgaaagtgcagggggcaaagtagcagatagtaaaacccagatggtgccgctgcaggacggagagaagctgctagtgatcagttcatgctcgagcgtttccgcaagagagaaaaatccgtgtcatgcgaaggtagccagagctgactggctgctagactgctgccattgaccngttgcctttgaagctcgaacatgttgttgtgatcacatggaggcctcaatatatcctgtccattttagtgagaattttgctatagagttgcatccttggttgttgactctgcttttgcagctgctaagggcaaggagcagagtaaacccttattacagaggtgatttggggcaatagatttgaggggagggctatcaaaaattcgtgcaagctcggaggctcggatgtctgaggggggccttgcagtggttgatgacataggagctgtaactggccaggatcttgccaaaaactccatgttcatcggcacaggaagagacaggtgtgctctctttggccaatataaatgagctgctgcgttatctattggaaaggccaaagatgccattttttctttcgagttcatggcaaagccagcgatttcatctttcgcctggaatataccgtttctctgagttcctcaaagtctgctgcagtggtatgtataccctagattttaaggacgagcaatttgtgagttacttttgttgccttatggctggttgctttgctcttcctagttcaatttgaaaaccgtagtagtaattct

SEQ ID NO: 1728 - DNA, 1631 bp, Sorghum bicolor
atccggttcgtgcaaccaagccgggctcacctggcccggccaccgcccaccggagccctggacctgaaaaactcgtttcggattcaaaccctccaatcccaaatctgccctcctcatcggcacacctcgccgccggccacacccccggcgatcgtcgccctacccggtagacccttctccctacctcaaaccccgcccaagcccaacacggcaacacctccccaccatgccgcggaacttccgcaagcggggcatcgagccggacactgacgaccgctccgacgacgaggacactcgccgcgtcgccctcgaggagatcaagtacatgcagaagctccgtgagaggaagctgggtatccccgccggcaccgccgccgcatccactaacgggtcctccgcccgtggtggtcgagtgggcagcggggcagcggccgctggcgaggctgagaaggaggacctcgtcctccaggacaccttcgctcaggagaccgccgtcaccatcgaggaccccaacatgttgaggtatgtggagactgagcttgcgaagaagaggggtaagatggttgatgtgggacacaaggaagagatggaccatgtggacgagctctacactgtgccagaccacctcaaggtgaagaagaagaactcagaggagagctcgacacaatggaccactggcattgctgaagttcagctgcccattgagtacaaattaagaaatattgaagaaactgaggcagctaaaaaggtgctgcaagagaaaaggcttgctagtaaaccaaaatcagatgcaaacattccatcaagttacagtgctgattatttccaccgtgggaaagaatatgatgagaaactgcgaagagagaatcctggattgtacaaagataatgattctcggcctagaggaagttcaggaggcaaagcaacagatactaaaaatccaggtggcgttggtgcaggacggagagaagccgcgagtgatgagttcatgcttgagcgtttccgcaaacgagaaaaattccgtgcccttcgaagatagccagagctgacatgctgctagattgtgccagttacctttgaagctcaaaaatgtcattgtgatcacatcaaggcccaacatgtcatgtcctttttagtgagaaatttactgtaaaatgcatctttggttgttgaatctgcttctgcagttgctaagggcaaggagcagattaaatccttattacagaggtgatttggggcaatatatttgagctgagggatatctgaaatttgtgtcagctcggaggctcagatgtcagaggggccttattggttcaggacaaaggtgtgctctccatgaccatgaccaatataaatgaacatcttgagcaaacaccaaagggtagcgtgatctcattttctttgggtgcatggcaaagcctgcaaaatttatctttctagccttgaatatattgtttctctgaattgttcgtagtctgctgaagtagcatcagctatctataagaatccttgatttctagggacgaagtaatttgtgagttgtttttgctgccttattgctgcttgctttgcctttctagttcaaggatcaaatcctcggcctttaaatcgaggattttcatatcaatttt

SEQ ID NO: 1729 - DNA, 1818 bp, Zea mays
atagtatagaagcatagatttgtgaactttgagattatctattggatttggtttttcttttttgataaactgaaataaactgcgcttggaactcagcgtaaaacggggaaggacggacgggcccacatgactgttactgtaacttaatccggttcatggtctgtggtttgtccaacaaagcctgggcctggccgcctggacctgaaaaagtcgttcgggattcaaacccttcgatcccaaatctgccctgcacgcctcgccgccggccacacccccggcggtcgtcgccctacccgcccttctccttacctctaaccccgccggagcccaacacctccccaccatgccgcgaaacttccgcaagcggggcatcgagcaggacactgacgaccgctccgacgacgaggacactcgccgcatcgccctcgaggagatcaagtacatgcagaagctccgggagaggaagctgggtatccccgccgacctcgccgccgcatccactaacgggtcctccgcccgtggtctattgggcaccggggcagcggtcgccggtgaggccgagaaggaggacctcgtcctccaggacaccttcgctcaggagaccgccgtcactatcgaggaccccaacatgttgaggtacgtggagaccgagctggcgaagaagaggggtaagatggttgatgtgggacacaaggaagagatggaccatgtggacgagctctataccgtgccagaccacctcaaggtaaagaagaagaactcagaggagagctcgacacaatggacaactggcattgctgaagttcagctgcctattgagtacaaattaagaaacatcgaagaaaccgaggcggctaaaaagttgctgcaagagaaaaggcttgcaagaaaaccaaaaccagatgcaaacattccatcaagttatagtgctgattatttccaccgtggcaaagaatatgatgaaaaactgcgaagagagaatcctgggttgtacaaagataatgattctcggccaagtggaaatccaggaggcaaagcaacagatactaaaaatccagatggtgttggtgcaggacggagagaagctgcgagtgatgaactcatgcttcagcgtttccgcaaacgagaaaaattccgcgcccttcgaagataagccagagctgacaggttgctagattgtgccagttgcctttgaagctcaaaaatatagttgtggctgcataaagtcccaacatatcatgtccttttagtgagaaacttactgtaaaatgcatccttggttattgagtctgcttctgcagctgctaagggcaaggagcagattaaccttattacagaggcgatttggggcaatatatttgagctgagggatatctgaattttgtgtcagctctgaggctcatatattaagaggggccgcagtggttcaggacataggagctcataactttccagatgctcagatcgtgccatgttcatctgcaatggaagaaaggaaggtgtgttctccgtacaaatataaatgaactgcttcgacatcttgagcaaactccaaggggtagtgcgaatgtctgatctcattttctttggagtgaatggcaaagcctgcaaattcatctttctagtctagaatgtattgtttctctgaattatttgcagtttgctgcagtagcatcagttatctagatttctagggacgagcaatctgtgagttgtttttgttgcactattgctgcttgctttgcctttactagttcaagtatcaattctttataagagttttgagtttcatatcaattttgaggttttggccttttg

SEQ ID NO: 1730 - DNA, 1630 bp, Panicum virgatum
tcccttcccccgcctcgcagcgtcgccctggaggagatcaagtacatgcagaagctgcgggagaggaagctgggcatccccgccgaccccgcggccgcctccaccaacgggtcctccgcccgcggacgggtgggtgtcgggggagcggccgtcggcgaggccgagaaggaggacctcgtcctccaggacaccttcgcgcaggagaccgccgtcaccatcgaggatcccaatatgttgaagtatgtggagaccgagctggcgaagaagaggggtaagatggttgatgtgggacaaaaggaggagatggaccatgtggacgagctctacaccgtgccagaccacctcaaggtgaaaaagaagaactcggaggagagctcgacacagtggaccactggcattgctgaagttcagctgcctattgagtacaaattaagaaacattgaagaaactgaggcagctaaaaagatgctgcaagagaaaaggcttgctggtaaaccaaaatcagattcaaatattccatcaagttacagtgctgattatttccatcgcggcaaagaatatgatgagaaattgcgaagagagaatcctgggctgtacaaagataaagattctcgggctaatgaaagtgcagggggcaaagtagcagatagtaaaaacccagatggtgccgctgcaggacggagagaagctgctagtgatcagttcatgctcgagcgtttccgcaagagagaaaaattccgtgtcatgcgaaggtagccagagctgactggctgctagactgctgccattgacccgttgcctttgaagctcgaacatgttgttgtgatcacatggaggcctcaatatatcctgtccattttagtgagaattttgctatagagttgcatccttggttgttgactctgcttttgcagctgctaagggcacggagcagagtaaacccttattacagaggtgatttggggcaatagatttgaggggagggctatcaaaaattcgtgcaagctcggaggctcggatgtctgaggggggccttgcagtggttgatgacataggagctgtaactggccaggatcttgccaaaaactccatgttcatcggcacaggaagagacaaaggtgtgctctctttggccaatataaatgagctgctgcgttatctatgggaaaggccaaagatgccattttttctttcgagttcatggcaaagccagcgatttcatctttcgcctggaatataccgtttctctgagttcctcaaagtctgctgcagtggtatgtaccctagattttaaggacgagcaatttgtgagttacttttgttgcctttatggctggttgctttgctcttcctagttcaatttgaaaaccgtagtagtaattctaaagccacattctctttggagtttaaataagggtacggtacccccatatgcctgtttgcaaatccgtggtgttatctggacctggtttctgaagtcagtttttgaacagcgctctttttggaacgagaacttttccggtgaatttgaccagaaaattcctatgcacccgtcattgacttttgtgtttgaaattataatttacttgtgcagctcgtaagcgctcacgggagattatgctttgggaaa

SEQ ID NO: 1731 - DNA, 1127 bp, Panicum virgatum
cggctttatctaggcgtccaaaacgaatcgaatggctggctacacccgaaccctgtccgactccgtgggcgcctgcctctgtgttttgtaccccgtttttcccaaactcctttgccgccgccgccgccgccgccagtctcgcgctccggcgaagggtgtttagtgtttacccaggggaccatggaggagtacggagggggagacctcctgagcgaggcgatgggctctgcggcgcgggtggtggtggtagaggactgcgtggaggcccccggggccttcgtcctccacctcctcctcaagcgcgcgctcgccggaggcggggcagctgccttcctcgccctcgcgcagcccttcacccattacgaccgcatcctgcgcaagatgggatgtaacctttccctgcatagaaggaatgagaggcttcatttcttcgaattgcaagcattcccaggtggagcaagggagggtgccattgctgattgttttgttcgactgtacagtgaaattcaaagagtggtggaggcaaccaggaccggagaaaatgcaggccaatttaccatcatgttagacgatgtttcacttttggaagttgcagcccatggttccgtagacaatgtgctggacttcttgtattattgtgtgacacttacatctgagatgaattgctccctggtgatcctcatccacgaggatatatatgcggttgaggagaacatgggtctccttttacatctgcgccacattgcagatcttgtggttaaagcagcacctttgagcacaggtttggctgctgatgttcatggacagctttctgtgatcaacaagggtacgttcagcgagcaaagggcaaaagcgcagaaagtatggagcttccatttcaaagtgaaggagaatggtaccgacttcttctatccagggagcagacactagggagtactactttgtaattgtaatactggctactttgtaactgtaataccggctgagatgacttctgtgtgaaatctggcgttgttatgctttgtatgctgctaattcaggtagcactacgagtaaagattcgttgaatcctttcttcacaaacttgcttgtgctcaagcattcgccacaggcccacagccaagtgc

SEQ ID NO: 1732 - DNA, 1113 bp, Panicum virgatum
gactccgtgggcgcctgcctctctgttttgtgagtaacccccgtttttctgagactcctttgccgccgccgccgccagtctcgcgctccggcgaagggtgtttacccaggggaccatggaggagtacggagggggagatcttctgagcgagatgatgggatctgcggcgcgggtggtggtggtagaggactgcgtggaggccccgggggccttcgtcctccacctcctcctcaagcgcgcgctcgccggcggcggggcagctgccttcctcgccctcgcgcagcccttcacccattacgaccgcatcctgcgcaagatgggatgtaacctttccctgcatagaaggaatgagaggcttcatttcttcgaattgcaagcattcccaggtggagctagggatggtgccattgctgattgctttgttcgactgtacagtgaaattcaaagagtggtggaggcaacgaggactggaaaaaatgcaggcccattcaccatcatgatagacgatgtttcacttttggaagttgcagcccatggttccgtagacaatgtgctggacttcttgtattattgtgtgacacttacatctgagatgaattgctccctggtgatcctcatccacgaggatatatatgcagttgaggaaaacatgggtctccttttacatctgcgccacattgcagatcgtgtggttaaagcagcacctttgagcacaggtttggctgctgatgttcatggacagctttctgtggtcaacaagggtacgttcaacgagcaaagggcaaaagcgcagaaagtatggagcttccatttcaaagtgaaggagaatggtaccgacttcttctatccagggagcagacactgacactagggagtactactttgtaattgtaatactggctactttgtaactgtaatgccgtctgagatgagatgacttctgtgtgatatctggcgatgttatgctttgtatgctgctaattcaggtggcactatgctttgtatgctgctaattcaggtggcactatgctttgtatgctgctaattcaggtggcactatgagtaaagattcgttgaatgctttcttcacaaacaagcattcgccacagccaa

SEQ ID NO: 1733 - DNA, 1043 bp, Cenchrus ciliaris
  misc_feature (380)..(382): n is a, c, g, or t
  misc_feature (392)..(392): n is a, c, g, or t
  misc_feature (425)..(425): n is a, c, g, or t
  misc_feature (427)..(429): n is a, c, g, or t
gagagagagaactagtctctgtttttttcctcaaattcctttgccgccgccggcgccccccgtctcgctctccggcgaagggtgtttactcaggggaccatgcctgaggacggagggggagacctcctgagcgaggcgatgggctccgcggcgcgggtggtggtggtagaggactgcgtggaggcgcccggggcctttgtcctccacctcatcctcaagcgcgcactcgccggcggcggggcggctgccttcctcgccctcgcgcagcccttcacccactacgaccgaatcctgcgcaagatgggatgtaacctttccctgcataggaggaacgagaggctttatttcttcgaattgcaagaattcccagctggagctannnatgttgctantgccgataactttgttcgactgtacagtgaaantnnnagagtggcggaggcatccaggggtggagaaattgcaggcccattcaccatcgtgatggacgatgtttcactgttggaagttgcagcccatggttccataggcaatgtgctggacttcttgcattattgtgtgactcttacatctgagatgaattgctcgctggtgatccttgtccacgaggatatatatgcaggcgaggagaacaatggtcttcttatacatttgcgccacattgcagatcttgtggttaaagcagcacctttgagtacaggcttggctgctgatgttcatggacagctttcggtggtcaacaagggtacattcaccgagcaaagggctaaagcacagaaggtttggaatttccattttaaagtgaaggagaatggtgcggacttcttttatccagggagcagacactagggagcactttgtaatgtgggatggcttttgttgtgataactggagttgctatgccttgtatgacatctgctagcctacgtagtatttgagtaaagtttcatcgaatccttttcttcacaagcttgcattcaagcattcgctacagccaagttcatcaaggttgacctaccataaaagggtctatttcatattta

SEQ ID NO: 1734 - DNA, 1162 bp, Zea mays
acggctctatacctctcgccctctgagtctcgcgcggtcagtcggtctctctctctcactctctcttgtctccaagtttgtaaccctagccgccaagcttgaagctccagccgtgctcgtgtagggctgcaggccatccgagctccggcttccggcatccaccagacgtccttagaatacggtgcagcgagcagcaagtcgccgagcagccgagccaccgccgagcagccgagccgccgccgagcgccgagtcttctatgtttgcttctccggtgaaaggtgtttgctaggggaccatggaggagcacggagcggaagacctcctgtgcgaggcgatgggatctgcggcgcaggtcgtggtggtagaggattgcgtggaagcaccgggggccttcgtcctccacctcctcctcaagcgcgcgctcgccggctgcggctccgctgccttcctcgccctcgcgcagcccttctcccattacgatcgcgtcctgcgcaagatgggctgtaacctttccctgcataggaggaatgagaggcttcatttctttgaattgctaggattcccaggtggagcaagggaaggcaccattgctgatagctttgctctattgtacaatgaaattcaaagactggtggaggcaaacagggctggagaaaatgaaggccagttcaccatcgttatagacgacgcttccctgttggaagtcgtggcccttggttctgtaagcgatgtgctggatttcttgcactattgtttcacactcacgtctgagatgaattgcaagctagtgatcctcattcacgaggatatatacgcaaatgaggagaacatgggtctccttttacatctgcgctacattgcggatcttgtgattaaagcagcacctttaagcactggtttggctgctgatgttcatggacagctggcggttgtgaacaagggtacattcagcgagcaaagggcaaaagcacagaaagtttggaacttccatttcaaagtgaaagaaaacggtgctgacttcttctatccagggagtagacattagggaatacttgtatacagtagaaacaactctggttgtgataactgataaccagtgctgctattcttcgtgtaccttgtgctaagcacagtaaagttttgtccaatccttcatttcac

SEQ ID NO: 1735 - DNA, 1192 bp, Sorghum bicolor
ctcggattacgtgggctcgctggacgggctacatgggctagtcgtgcgggtcgatccagcgggttagcggcaaagcccatcccacaccgctctggttctgacgaacccctttgccgccgccgccgccgccgccgcagtctttgcttttccggtgaaaggttttttgcttaggggaccatggaggagtacggagggggagacctcctgagcgaggctatgggatctgcggcgcgggtggtggtggtagaggactgcgtggaggcaccaggggccttcgtcctccacctcctcctcaagcgcgcgctcgccagcggcggcgcggctgccttcctcgccctcgcgcagcccttctcccattacgaccgcgtcctgcgcaagatgggttgtaacctttccctgcataggaggaacgagaggcttcatttctttgaattgctaggattcccaggtggagcaagggaaggcacaattgctgataggtttgttcaattgtacaatgaaattcaaagactggtggaggcaaacaggactggagaaaatgcaggccagttcaccgtcattatagatgacgcttccctgttggaaattgtggcccttggttctgtaaatgatgtactggatttcttgcactattgttttgcactcacgtctgagatgaattgcacactagtggttctcatccacgaggatatatatgcagacgaagagaacattggtctccttttacatctgcgctacattgctgatcttgtgattaaagcagcacctttgagcactggtttggctgctgatgttcatggacagctgtcggtggtgaacaagggtacattcggcgagcaaagggcaaaagcacagaaagtttggaacttccatttcaaagtgaaggaaaacggtgctgatttcttctatccagggactagacattagggagtacttaggccgtgtttacttcctcaaccaaaacatttcgttacactgtagctttttcgtttgtttgtggtaattattgtccaaccatggactaattaggctcaaaagattcgtcttgtcaatttcgaccaaactatgtaattagtctttatttttatctatatttaatactccatgcatacgtctaaagattcgatgtgacggggaatcttgaaaaattttagttttttgggaggaagtaaacaaggccttatattgcagt

SEQ ID NO: 1736 - DNA, 847 bp, Panicum virgatum
  misc_feature (303)..(303): n is a, c, g, or t
  misc_feature (364)..(364): n is a, c, g, or t
  misc_feature (777)..(777): n is a, c, g, or t
gtagaggactgcgtggaggccccgggggccttcgtcctccacctcctcctcaagcgcgcgctcgccggcggcggggcagctgccttcctcgccctcgcgcagcccttcacccattacgaccgcatcctgcgcaagatgggatgtaacctttccctgcatagaaggaatgagaggcttcatttcttcgaattgcaagcattcccaggtggagctagggatggtgccattgctgattgctttgttcgactgtacagtgaaattcaaagagtggtggaggcaacgaggactggaaaaaatgcaggnccattcaccatcatgatagacgatgtttcacttttggaagttgcagcccatggttccgtanacaatgtgctggacttcttgtattattgtgtgacacttacatctgagatgaattgctccctggtgatcctcatccacgaggatatatatgcagttgaggaaaacatgggtctccttttacatctgcgccacattgcagatcgtgtggttaaagcagcacctttgagcacaggtttggctgctgatgttcatggacagctttctgtggtcaacaagggtacgttcaacgagcaaagggcaaaagcgcagaaagtatggagcttccatttcaaagtgaaggagaatggtaccgacttcttctatccagggagcagacactgacactagggagtactactttgtaattgtaatactggctactttgtaactgtaatgccgtctgagatgagatgacttctgtgtgatatctggcgntgttatgctttgtatgctgctaattcaggtagcactacgagtaaagattcgttgaatcctttcttcacgt

SEQ ID NO: 1737 - DNA, 1086 bp, Hordeum vulgare
caagtacgcgttcctttgtacactactcctttggtctctgaattcgctcggacacctccttccttccttggccgcggccgccgccgcagcagcagcagcccgttggtcgcggtctccggggggttgggtgagggggagatgcaggggtacggcggggaagacctgctgggcgaggccatgtgcgccggcgcgcgggtggtggtcgtggaggactgcgtggaggcgccagccgccttcgtcctccacctcctcctcaagcgcgcgctcgccgcgggcgggggcgcggcgctcctcgccctcgcgcaccccttctcgcactacgaccgcgtcctccgcaagatgggctgtaacttatccgtgcataggaagagcgagaggcttcatttcttcgacttgcaggcgttcccaggtggaacacggggaggtgtcattgctgatagcttggctcagctgtacagtggccttcagagagtggtggaggcatacaggactggagaaaatgcaggtcggttcacggttatgatagatgatgtttcgctcttggaagttgctgccaatggttctgcagatgatgtcttggacttcctgcattattgtgtgacacttacttccgagatgaattgctcgcttgtggttcttaatcacgaggatatttattcaagcgaggatggtgtgggacttctcttgcatctgcgctatattgctgatcttgtgattaaggcagcgcctctgagcaccggtttagccgctgatgttcatggacagctgtcagtggtaaacaagggaatgctcatcgagcaaagaccagcgaaagggcagaaagtttggaacttccatttcaaggtgaaggaaaacggcgcagacttcttctacccagggagcagacattagaaccacaagcgaactttggccacagtaaagcagacttgagtgaagttgccctgttttaaggaacatcatggaaaggaaagcagtcttgcctggttgcatctctttacgcctttttttagatagcttgtgttgcccttatttcattggaaaaggatatgcactcaacattgtaagagcatctctagtagaaccctc

SEQ ID NO: 1738 - DNA, 1205 bp, Sorghum bicolor
ataaaacttcctaacatcgtgtcttcagaaacagctgagatgtacatgtcaccgagcaaatccaatcctccccgaccccagcaatggagtagtagtcaccagcgaccaagaaatcgggaaccctcgtttcccatctcgtggcccgttggcgcgagcggcgagcgtgcagcgtcagacattttccggacggacgcttttctatcccaagcctatccatctatttatcgactcgcccgccgcactacgcttccacttctcccttccaccgctgcgcttcgtggtagctgctgctcctgctcctgcttacctcacggcacggccgccgccgcctccaagtcccactagctgcagctaactcccgccgccgcccccgatccgaccgagagcgagcatggcgcactccctcgccgcttccttctcgccggccgccgccgccgcccggcgccaggtgacaaatgtgatttcaagccggagctcggtttccttccagagccacaggatgacttctgtatccatccgttcaagaccaagttctcttcggtttaagatttgctgttcggctaagaaagagacagtcgacaaggtttgtagtatagtgaagcagcagctggctcttcccgatggtactgctctcaccggcgaatcaaaattcgctgaacttggtgctgattcactggatacggttgagattgtgatgggcctcgaggaggcattcaacataactgtcgacgaaactagtgcacaggacatcgcaacggtgcaggatgcggcggaccttattgagaagcttatgcaggaggcacctccaaaggtcgtctagatccatcaaccttgcgatctatgactttgcattcaatctctgttgtatgttaaattgttcatgttaccatttgttctttcttgatgattcaagatgagatttttgtattgatgttgctgaggtaaattagatgctccatccaaaggctacatgaagcagatgaagacaaatgtattccactttccattcgtatgttgtactactatagagaaacccatgaactattatgaagagtcactacaactatcgttattgatttttgagaagtctcgcacatgaaagactgaattttctctttcatctcaaaaaattctgggtttgatcatttcacataatggaactaaacattatgtaaaatttttggcaaaatggttgtcattcttca

SEQ ID NO: 1739 - DNA, 821 bp, Panicum virgatum
ctttctttatcctgagagaagacctgagccctgtctatctctatttatcgcctcgcccgccgcactactgccaccgctgcggctgcgtggtagcttctgcctcacctgactgacctccctccccgggcgagcatcaccagccagcctctctctgtcccgccgccgcccgccgatccgagagcgagcatggcgcactccctcgccaccgccgccgccgcgtccttctcgccggccgccgcacggcgccaggtgacgaatgttttttcaagccgaagttcagtttccttccagagccacaggatgacttctgtgtccattcgttcaagaccaagttctcttcggcttaagatttgctgttcggctaaacaagagacagtcgataaggtttgtagtatagtgaaggagcagctagctctccccgatgggactgctctcagcggcgaatcaaaattcgctgaacttggtgccgattcactggatacggttgagattgttatgggccttgaggaggcattcaacatcactgtcgatgaaacgagcgcacaagacattgcaaccgtgcaggatgcggcggacctcattgagaagcttgtgctcgagaaggctgcataagcaccttaagtggacgatccaaaaccaagggtagtctggacccttcgaccctgtgatcaatgactttgcattcgatctctgtttttgttcaagttacccatttgttgttccttgatcattcaagatgagattttgtattgaattattgatgttgttgaggtaaattagatgctccaaagactacatgaagcaaatgaaaacgatgtatt

SEQ ID NO: 1740 - DNA, 563 bp, Saccharum officinarum
ccctcgccgactgcttctccccggccgccgcccggcgccaggtgacaaatgtgatttccagccggagctcggtctgcttccagagcctcaggatgacttgtgtatgcatccgttcaagaccaaattatgttcggtttaagatttgctgttcggctaagaaagagacagttgacaaggtttgtagtatagtgaagcagcagctggctcttcccgatgggacggctctcactggcgaatcaaaattcgctgaacttggtgctgattcactggatacggttgagattgtgatgggcctggaggaggcattcaacataactgctgatgaaacaagtgcacaggacattgcaacggtgcaggatgccgcggaccttattgagaagcttatgctggaggcacctccgaaggtcgtctagctccatcaaccttgcgatcgacgactttgcattcgatctctgttgtatgttaaattgttcatgttacccatttgttctttcttgataattcaagatgagattttgtattgatgttgctgaggtaaattagatgctccaatgctacatgct

SEQ ID NO: 1741 - DNA, 1009 bp, Pennisetum glaucum
acgctgccaccaccaccgctatacgctctcgctgcgtggtagctgctgcctcaccctcacctcccctcctcccctcctgagtgagagagcacacccaccagccaccacctctctgccccgatccgagagcgagcatggcgcactccctcgcaaccgccgccgccgcttcctccttctcgtcggccgccgcccggcgccaggtcacaaatgtgatttcaagccgaagttcggtttccttccagagctacaggatggcttctgtgtccatccgttcaagaccaagttctcttcggtttaagatttgctgttcggctaagaaagagacagtcgacaaggtttgtaatatagtgaaggaacagctggctctccccgatgggactgcaatcacgggcgaatcaaaattcgctgaacttggtgctgattcactggatacagttgagattgtgatgggcctcgaggaggcattcaacattactgtcgatgaaacgagcgcacaggacattgctaccgtgcaggatgcggcggaccttattgagaagcttgtgctggagaagtctgggtaagcaccttaagtggaggatctgaaactaagggtggacctgtcagaccttgcgatggactgactttgtattcgatctctgttgtatgttcagtcattcgtgttacccacatttgttctttcttgatcattcaagatgagattttgtattgatgttgctgaggtaaattagatactccagaggttacatgaagcaaatgaaaacaatgtattccactttccatttgtatgttgttctactaatatggagaaacaaataaagtggcaaagattcgccgcaatgtgtttttccttctgcagatgtatcatgctggtgtgtttggtctgtagccttcgcaattatttgcatatttgatggataacaataatgacagcatttcctgcctttgataattgaatagcagtcttcatgcaattaaatattgatggcaattcatcatctcgaaatcc

SEQ ID NO: 1742 - DNA, 1311 bp, Panicum virgatum
aaatcatcttttcatggtgtgtctccttcataacctccggtaacggtgatacgtgcagtaaacccaaatcacaaacccaaagctatctttttcagtgcgagataccactttattctccactaatctatccatcttccaattgtcctcatctcaagaaaaaagaatcctaaatggcacggcctcagaaacagttgagacgttcatgtcatcgcgcattcgtgcaaatcctcgcctccccgagcatcaccatcgatgggatcctcgttttcccattttgtggctgacgagagcgtgcaccgtcgtcagacattttcggacggatgctttctttatcctgagagaagacctgagccctgtctatctatttatcgcctcgcccgccgcactactgccaccgctgcggctgcgtggtagcttctgcctcacctgactgacctccctccccggcgagcatcaccagccagcctctctctgtcccgccgccgcccgccgatccgagagcatggcgcactccctcgccaccgccgccgccgcgtccttctcgccggccgccgcacggcgccaggtgacgaatgttttttcaagccggagttcagtttccttccagagccacaggatgacttctgtgtccattcgttcaagaccaagttctcttcggcttaagatttgctgttcggctaaacaagagacaatcgataaggtttgtagtatagtgaaggagcagctagctctccccgatgggactgctctcagcggcgaatcaaaattcgctgaacttggtgccgattcactggatacggttgagattgttatgggccttgaggaggcattcaacatcactgtcgatgaaacgagcgcacaagacattgcaaccgtgcaggatgcggcggacctcattgagaagcttgtgctcgagaaggctgcataagcaccttaagtggacgatccaaaaccaagggtagtctggacccttcgaccctgtgatcaatgactttgcattcgatcgctgtttttgttcaagttacccatttgttgttccttgatcattcaagatgagattttgtattgaattattgatgttgttgaggtaaattagatgctccaaagactacatgaagcaaatgaaaacgatgtatttcactttccatttgtatgttgttctattagtatagagaaaccaataaactggcgaagagtcactgcaactgtcttctagatttctgagaagttatacagtttttttttaataaaaagtctgaatacgacgatgtaccgttgatcttgggatgcagatttacagataacagtgtc

SEQ ID NO: 1743 - DNA, 742 bp, Zea mays
atcaacgcttgtggtgaaacaccacaatgcgttagcacctgacagacagccttgtatttgcaaatctaacaacaattactgtatgtgacttcacaaagatcaaaagccacagttgcagtgactcttcataacagttcattgatctctctatggaagtacaacatgcaaatgggaagtggaatacatcgtcttcatctgctccatgcagcctttggagcatctaatttatacctcagcaacatccatacaaaaatcttatcttgaaccatcaataaagaacaaattgggtaacatgaacaatttaacataaaacgccaagtcgccaatcgcaagactgatggatcgatctagacaacctttggaggcgcttccagcatgagtttctcgatgaggtctgcagcgtcctgcaccgtcgcgatgtcctgtgcgcttgtttcgtcgacggttatgttgaacgcctcctcgaggcccatcacaatttcaacctgcaggagaaaatgaatcagcaccaagttcggcgaattttgattcgccagtgatagcagtcccatcgggaagagccagctgctccttcactatactacagaccttgtcgactaataaaatgatgcataccgaacagcaaatcttgaaacgaagagaacttggtcttgaacggatggatacagaagtcatcctgtggctctggaaggaaaccgagctccggcttgaaatcacatttgtcacctgaaatggaccaaga

SEQ ID NO: 1744 - DNA, 1006 bp, Eragrostis curvula
  misc_feature (37)..(37): n is a, c, g, or t
  misc_feature (815)..(815): n is a, c, g, or t
  misc_feature (845)..(846): n is a, c, g, or t
  misc_feature (851)..(851): n is a, c, g, or t
  misc_feature (870)..(871): n is a, c, g, or t
  misc_feature (873)..(873): n is a, c, g, or t
  misc_feature (889)..(889): n is a, c, g, or t
  misc_feature (892)..(892): n is a, c, g, or t
  misc_feature (912)..(912): n is a, c, g, or t
  misc_feature (917)..(917): n is a, c, g, or t
  misc_feature (923)..(924): n is a, c, g, or t
  misc_feature (928)..(928): n is a, c, g, or t
  misc_feature (940)..(940): n is a, c, g, or t
  misc_feature (943)..(943): n is a, c, g, or t
  misc_feature (945)..(945): n is a, c, g, or t
  misc_feature (949)..(949): n is a, c, g, or t
  misc_feature (965)..(966): n is a, c, g, or t
  misc_feature (971)..(972): n is a, c, g, or t
gggcttggaacttcctccgcctccaggagcagagtanagagcacccacctaccagtcttccccggccgcctctgatccgagacagcagtagtagtagctcatggcgcactccctcgccgccgcttccgcctccttctcgccggtcgctacccggcggcaaccgtccggtcaggtgacaaatgttatttcaagtcggagctcggtttccttccaaagccagaggatgaactttgtgtccatccgttcgaggcccagttctctttggtttaggatttgctgctcggctaagcaagagacagtcgacaaagtttgttcgattgtaaaaaatcagctggctctccctgacggcactgttgtcactggagaatcaaaattctctgaacttggtgccgattcattggacacggttgagatcgtaatgggccttgaggaggaattcaacatcactgttgatgaaacaagcgcacaggacatcgcaaccgtgcaggatgcagcgaacctcatcgagaagcttgtgacggagaagactccataagcaaagagtgatttgctggtccttctggaactggagagccatctggctctatggaccttgtgacggacacaaaactgcattcaacctactgtatgttcaattgtttatgttgcccatttgttgtaatttcttgatcattcaagatgagattttgtattgatgttgctgaggttaaattaccttcagctgagcaaattggagactatgtaaaccgtttttaattcgtatgttgtactgagggccactggccgtgtcttttggctttctgaaagacaggtanttataaatgataatctgagccaaatgatgnnattgnaagctttattgcctttttnnantaccagaggctccacngtnttactgtaaacctccactgngtaantgtaannaagnatgcactctttnggncnggantatttgcttaataacnnacttnnctttttaaacaaaaaaaaaaaaaaaaaaaaaaaa

SEQ ID NO: 1745 - DNA, 703 bp, Setaria italica
gttattttcattggaacaatccacttatggggacagtctcatggtccatttcaggttacaaatgtgatttcaagccggaattcggtttccttccggagctacaggatgacttctgtgtccatccgttcaagaccaagttctcttcggtttaagatttgctgttcggcaaagaaagagacagtcgacaaggtttgtagtatagtgaaggagcagctggctctccctgatgggactgccatcacgggcgaatcaaaattcgctgaacttggtgctgattcactggatacagttgaaattgtgatgggcctcgaagaggcattcaacatcaccgttgacgaaacgagcgcacaagacatcgctaccgtgcaggatgcggcggaccttattgagaagcttgtgctggagaaggcgtcataagcaccttaagtggaggatccaaaaccaacagtggacccatcgaccttgccaccgacgactttgtattcgatctctgttgtatgttcaattattcatggtacccatttgttctttcttgatcattcaagatgagattttgtattgatgttgctgaggtaaattagatgctccagaggttacatgaagcaaatgaaaacaatgtattccactttccatttgtatgttgttctactaatatggagaaacaaataaagtggcaaagagtcaccgcaatgtgttttcttac

SEQ ID NO: 1746 - DNA, 790 bp, Cynodon dactylon
ttagcttacctcaccaccttcaggaagcagagcactcaccaaccacaaggagccttccccgccgccttcgatcccagatagtagtagctcatggctcactccctagccgccgcttcggcatccttctcgccgctcgcctcccggcggcgggcatccggccaggtgacaaatgttctttcaagtcggagctcagtttcctttcaaagccagcgaatgaactttgtttccatccggtcaaggccaagtactctccggtttaagatctattgttcggctaagcaagaaacagtcgacaaggtttgttcgattgtaaaaaagcagctggctctccctgacgagactgctgtcacaggagaatcgaaattctctgaacttggtgctgattcgttggatacggttgagattgtgatgggccttgaggaggaattcaacatcacggtcgatgaaacaagcgcacaggacatcgcaaccgtgcaggatgcagcgaacctcatcgaaaagcttgtgacggagaagactccataagcaaacctcaatttcctggtccttacggaaatgaagagccatctggctcaatgaaccttatgatggacacacattcattcaatctctgttgtatgttcacttattcatgttactcctttgttgttgtttcttgatcattcaagatgagattttgtattgatattgctgaggttaagttgcattctccagaggcatgtaagcccttcatagtttgtatcttgtattgagggcccctgccggcgtcttttggctatttggctttctg

SEQ ID NO: 1747 - DNA, 993 bp, Oryza sativa
cttttgccattttcgttgatggaggcaacgcaacgcaagctgcatctaccgctttcttggactgtgttctctcctctatcctattatctattcaatctatttatctccttacctgagctataatgccactactgcgtctgcgtggtagctagctcgcgagccaagaaagcccctacctcagctaagctgccagcccagcctcccatggcgcactccctcgccgccgccgcctcgtccttctcgccgcccgccgcacgccggcgactgcccggacaggtgactaatgtaatttcgagacggagctcagtttccttcaacagccagagaataagttttatgtccattcgttcaaggccaagtcagcttcgttttaagatttgctgctcggctaagaaagagacagtcgacaaggtttgcaacatagttaagacacagctggcactccctgagggaactgctgtcactggtgaatcaaaattctctgaactcggtgctgattcactggatacggttgagattgtgatgggcctcgaggaggaattcaacatcactgtcgacgaaacaagtgcgcaggacatcgcaactgttcaagatgcagcaaacctgatcgagaagctcgtgctggagaaggctgcataaaaaccatgcacctcaattcatcagccctttcggaaacgccaaagggctgctgctatgttttgatctcgcaattgcgtttcgggagagaatacgttcttctaaaatttatggccaactttgcattctatctgtattgtatgttcagtcattcctgctaccccatttattctttccttgatcattgaaggtagggttttgtactccaaaggctacatgagggaaattaattgagaccacttgttctgtgccacttccatttcatgtactgtatactgctgaagaaaaattaatactaataacttgtcaagagtcactggttcatccctcttgggtctctgaggaggcttacaggct

SEQ ID NO: 1748 - DNA, 812 bp, Sorghum bicolor
aacgggagccacccaaactcggcaaaagcatccatccccaccacgcgtccacgcccaaatgctggcgaccacctgcggcgcgccgccgtgcccgtgcgcacggtcgcggcggccccccacggcggcctttggcggaggctatggcattgggcgcacccgccgcagcactaggccaagggcgctgaggagagccggggtggtgcggtgcgggctgctgcccgtggacccgtgggcgccgacgatggactcccagagcgtggcgtcgcagctcttcgccgtctcgctcttcccctacctgggattcctctacttcatgaccaggtccaaaaccgcgcccgggctcacgctcttcggtttctacttcctcctcgtcttcgtcggcgccaccacaaaagttcattacggaacctcgctgtctaatgttgactggctgcacgggagcgcggaatcgctgcttactcttaccaatctatttatcgttttgggcctgaggggagccttgaggaagctggaggaagaagaggacacgaacgggagggtttctgaagcttctcaagacagtaaagaaaaaagttctgtctagataggtgtatcagtacccctgatggtgcattcagtaactaagagtgcgtgcatttcttcttttgctcaattagttagtaatgatgttttgggtgtaaagaaatctggcaaatcaactttgtgcatatgctgagaaaaaaacaatgtatctgctgcaattctgtgtagttgcagtctccagttacgctgttgtgagtagttgcagtgtccagtgtgtaataggcaatggt

SEQ ID NO: 1749 - DNA, 3368 bp, Setaria italica
agggagggagggagggaggtagggagcgatgacgtggttccgcgccgcctcgggcgctgcccgcctcgccctccgccgcagcctcgccacccgcgcgccgacagccgccgccgccacccgatgcgcccgcggcttccactccaccgccctgcggcctcgctccgccgcccccgcgccccgggccgtcccgctctcccgcctctccgatagcttcctcgacggcaccagcagcgtctacctcgaggagctccagcgcgcctgggaggtcgacccctcctccgtcgacgagtcctgggacaacttcttccgcaacttcgtcgcccaggcctccccctccgccggcgtctccggccagaccatccaggagagcatgcagctcctcctcctcgtcagggcctaccaggtcaacggccacatgatggccaagctcgaccccctcggcctcgacgaccgtgccgtccccgaggacctccacctcggcctctacggcttcaccgacgccgacctcgacagggagttcttcctcggcgtctggaggatgtccggcttcctctccgagaaccgccctgtcctcaccctccgcgagatcctcagcaagctccagcaggcctactgcggccccatcggctacgagtacatgcacatccccgacagggacaagtgcaactggctcagggaaaaaatcgagaccgccaagcccagggactatgacaaggaacgtcgcctcgtcatgctcgacaggctcatctggagcacgcagttcgagaacttccttgccaccaagtgggccaccgccaagaggtttggccttgagggtggtgagacgctcatccctggcatgaaggagatgttcgatagggctgctgacctcggcgtcgagaacatcgtcatcgggatgccgcacagggggaggctcaatgtccttggtaacgtcgtccgcaagccattgtctcagatattcagtgagttcactggcggcacaaggcctgttgaaggcgaggatgggctctacactggaactggtgatgtcaagtaccacctgggtacctcttatgaccgcccaactcgtggtggcaagaggattcacttgtctttggtcgccaatcccagtcatctggaagctgttgatcctgttgtcattggcaagacgcgtgccaagcaattctactccaatgatgccgacaggacaaagaacatgggtattctgatacacggagatggtagctttgctggccagggtgtggtctatgagacgctccatctaagtgctctcccgaactacactactggtggaaccatacatattgttgttaacaaccaagtcgcctttacgactgatccaagagctggcaggtcctcccagtactgcacagatgttgccaaagccctgaatgctcctatattccatgtaaatggtgatgatttagaggctgttgtccgtgtatgtgagcttgcagctgagtggcgccagacttttcactcagatgtcgtcgtcgatctaatctgctaccgccgttttgggcataacgaaatcgatgaaccctccttcacacagccaaagatgtatcaggtcattaagaaccatcccagttcattgaagctttatgagcagaaactgctaggaacaggtgaagtctcgaaagaagatgtccagaggatccatgacaaggtgaaccgaatcttgaatgaagagtttacaaagagcaaagactatgttcccaacaagagggattggctctctgcttattggactggctttaagtcgccagagcaaatatcgcgtgttcggaacactggggtcaagccggagatactgaaacgtgtaggacaagcaattactacactgcctgaaaacttcaggccacacagagcagtgaagaagatttttgagctgcgtgcagctatgattgagagtggtgaaggaattgattgggctgttgcagaagccctagcctttgcaacacttatagtggaaggcaatcatgttaggctaagtggacaggatgtggaaagaggaactttcagccaccggcatgcagttctgcatgaccaggatactggagcgaagtactgcccactcgaccatgttgcaatgaatcaaagtgaggagctgtttactgtaagtaacagttcgctttcagaatttgctgtccttgggtttgaattgggttactccatggagaaccctaattcattggttctttgggaagcacaatttggtgactttgccaatggcgcgcaagtgatgtttgaccagtttctgagcagtggagaggcaaaatggttgcgccaaactggccttgttgttctgcttcctcatggttatgatggccaaggccccgaacattccagttctcgtttggagcgcttccttcagatgagtgatgataatccttttgtcatacctgagatggaaccgacacttcgcaagcagatccaagagtgtaactggcaagttgtgaatgtgacaactcctgcaaattatttccacgtgttgcgtcgtcagatacatagggagttccggaagccactgattgtaacagctcccaagaacctgcttcggcacaaggattgcaagtccaatctttctgagtttgatgatgttgaaggccatctaggatttgataagcagggaacacgtttcaagcggctgataaaggaccgcaacgatcacaagcaagtcgaggagggtatcaaccgtcttatattatgttctgggaaagtttactatgaacttgacgaagagcgtaaaaagtcagagcgcagtgacattgcaatttgcagggttgagcaactttgcccattcccgtacgaccttatccaaagagagctcaagagatatccaaatgcggagattgtgtggtgccaggaggagcccatgaacatgggtgcatacagctacatctctcctcggctgtatactgccatgaaggctctcgggcggggttcatttgaagatatcaagtacgtcggcagagcaccttcagctgctacagccactggcttcctgtcggttcatgtgcaggagcaatcagagctagtaaagaaggcacttcagccggagccgatcaagttcccctgatgagatgcagatcttcacttcttagtacaaactatatcgaaataacaggaccctaacatgcctgtttgcaggaggctcaacataccgaacctgcattttgaaagttttgccatgtacgagcgttttctttttctgttccagttttgtggcttttgtgctctttggaaataatgacacattatcaagacatgaagccgtgtgaaactggtcattcaactttgctttcattcatagtggctttgttcgtgcaggtgtttccatgtcattgaacttttatgcattatga

SEQ ID NO: 1750 - DNA, 3711 bp, Oryza sativa
cctagacatgatggagatggacagaggcgaggcgacgatgaggatgcggcttcgaagttgaactaggcggcggtgggcccaccgcttccattcttctcgcctttttcttccaccgttgcgagttctctctgcctgcgctgcggctgcacccttccccaagtcggatttccattgcattctcgattccattccttccccctccccctctttcttcgacttggacttggccttccttcttcctcctcaacctcgacctcgatctaggtctacgctccgccctccgccccccgccccccgccgccgccagggagggagccggagccggagccgatcgatggcgtggctccgcgccgcctcgggcctcgcccgccacgccctccgccgccgcgtgcccgtcgcttcccgtttcttccactcggcgcggccggcctggaggtcctccgccccggtgccccgcgccgtcccgctgtccaggcttaccgacagcttcctcgacggcaccagcagcgtctacctcgaggagctccagcgcgcatgggaggccgacccctcctccgtcgacgaatcctgggacaacttcttccgcaacttcctcggccaggccgcgccctcctccgccggcctctccggccagaccatccaggagagcatgcagctcctcctcctcgtccgtgcctaccaggttaacggccacatgaaggccaagctcgacccgctccgactcgacgaccgcgccgtcccggacgacctcgacctttccctctacggcttcaccgaagctgacctcgaccgcgagttcttcctcggcgtttggaggatggccggtttcctctccgacaaccgccccgtcctcaccctccgcgagatcctcagcaagctcgagcaggcctactgcggccccatcggctacgagtacatgcacatccctgacagggacaagtgcaactggctaagggacaagatcgagaccgccaagctcaaggagtacaacaaggaccgccgcctcgtcatgctggacaggctcatctggagcacccagtttgagaacttcctcgccaccaagtgggccactgccaagcgctttggcctcgagggcggcgagaccctcatccctggcatgaaagagatgtttgacagggctgccgaccttggcgtcgagaacattgtaatcggcatgccacacaggggaaggcttaatgtgcttggcaatgttgtccgcaagcccttgtcgcagattttcagtgagttcaccggtgggactaggcccgtcgaaggcgaggatggcctctacactggaaccggtgatgtcaagtaccatctgggcacctcctatgacaggccaactcgaggtggaaagaggatccacctatcgttggttgcgaatcccagtcacctcgaggctgtcgatcctgttgtcataggcaagacgcgggcaaagcaattttactccaatgatcttgacaggacaaagaacatgggcattctcatccatggagatggcagctttgctgggcagggtgttgtctatgagacacttcatctgagtgcccttccaagctatacaactggaggaaccatccacatcgttgtcaataaccaagttgccttcacaacagatccaagagccggcagatcttcgcagtattgtacggatgttgccaaagccttgaacgctcctatattccatgtaaacggtgatgatctggaggcagttgtacgagtttgtgagcttgcagctgagtggcgccagactttccattctgatgtggtagtcgatctgatctgttaccgacgatttggacataatgaaatcgatgagccctccttcacacagccaaagatgtatcaggttattaagaaccatcctagttcattaaagctttatgaacagaaactgctaggaacaggcgaagtctcaaaagaagacgttcagaagatccacgagaaagtcaacagaatcctgaatgaagagtttgcaaaaagcaaagattatgttcccaataagagggactggctttcggcttactggactggcttcaagtctcctgagcagatttcacgcgtccgcaacactggggttaatccaggggtgctgaaacgtgttggacaggcaattactactttacctgaagacttcaagccccacagggcagtgaagaagatttttgagcagcgtgcagcaatgatcgagagcggtgaaggaattgattgggccgttgctgaagcccttgcctttgcaacactcattgtggaaggcaaccatgttaggctgagtggacaggacgtggaaagaggaacttttagccaccgtcatgcagttctgcatgaccaggaaaacgggaggaaacattgcccacttgaccatgttgtgatgaatcaaaacgaggagctgtttaccgttagcaacagttcactttcagaatttgctgttcttggttttgaaatggggtactccatggagaaccctaattcactagtgctctgggaagctcagtttggtgacttttccaatggtgcacaagtgatgtttgaccagtttttgagtagtggagaggcaaaatggctgcgtcaaactggccttgtcgttctactgcctcatggttatgatggccaaggcccagagcattccagtgcccgtttggagcgctttcttcagatgagtgatgataatccttttgtcatacctgagatggaaccaacactccgcaagcagatccaggagtgtaattggcaagttgtgaacgtgacaacgcctgcaaactatttccatgtgctgcgtcgtcagatacatagggagttccggaagcccctgattgtaatggcccccaagaacctacttcggcacaaggattgcaagtcaaatctctctgagtttgatgatgttgaaggccatccaggtttcgataagcaaggaacacgcttcaagcggttgataaaggaccggaatgaccacaagcaagtcgaggagggtatcaaacgccttgtattgtgttctgggaaggtgtactatgagcttgatgaagaacggaagaagactgaacgcagtgatgttgcaatttgcagagttgaacaactttgtccattcccatatgatcttatccagagagagctaaaaagatatccaaatgcggagattgtctggtgccaagaggaacccatgaatatgggcgcatatagttacatctcccctcgcctgtacgcctctatgaagactcttgggcgtggttcattcgatgacatcaagtatgtgggcagggcgccttcagctgcgacagctactggcttcctgtcggttcatgcgcaggagcagacagagctggtaaagaaagcactgcaggcagagcctatcaagttcccctgatatgatgcatctgtggtttccacttggtgcttatacttgtgcaagacaagtgtgtgcgagctcagctcgtccagcctttgcacacataccataccatcttaaaagttttgctatgtatttacaagctactgtttctctagcttgtttgaggcgattcgatttgaatgtcgtgaataatgcactatttgagccttcttatcgttgaggaggaacctgtttcgacgtgagcaacaaattttgcaatatagtagaagctttagcttcctttcttttttctcttgatatgcaatatgatgtagcacatctgcacattgttgtttgatctccttgccacacttgaacaaaaagat

SEQ ID NO: 1751 - DNA, 3274 bp, Panicum virgatum
ccgtcccgctctcccgcctctccgacagcttcctcgacggcaccagcagcgtctacctcgaggagctccagcgcgcctgggaggccgacccctcctccgtcgacgagtcgtgggacaacttcttccgcaacttcgtcgcccaggcctccccctccgccggcgtctccggccagaccatccaggagagtatgcagctcctcctcctcgtcagggcctaccaggtcaacggccacatgatggccaagctcgaccccctcggcctcgacgacagagccgtccccgaggacctccgcctcggcctctacggcttcactgacgccgacctggacagggagttcttcctcggcgtctggaggatgtccggtttcctctccgagaaccgccccgtcctcaccctccgcgagatcctcagcaagctccagcaggcctactgcggccccatcggctacgagtacatgcacatccccgacagggacaagtgcaactggctcagagaaaagatcgagaccgccaagcccagggactacgacaaggaccgccgcctcgtcatgctcgacaggctcatctggagcacgcagttcgagaacttcctcgccaccaagtgggccaccgccaagaggtttggccttgagggtggtgagacgctcatccctggcatgaaggagatgttcgatagagctgctgacctcggcgtcgagaacattgtcatcggtatgccgcacagggggaggctcaacgtccttggtaatgttgtccgcaaaccattgtctcagatattcagcgagttcactggtggtacaaggcctgttaaaggtgaggatgggctctacactggaactggtgatgtcaagtaccacctcggtacctcctatgaccgccctactcgtggtggcaagaggattcacttgtccttggtcgccaatcccagtcatctggaagctgttgatcctgttgttattggcaagacacgtgccaagcaattctactctaacgacgccgacaggacaaagaacatgggtattctgatacacggagatggtagctttgctggtcagggtgtggtctacgagacactccatctaagtgccctcccgaactacactaatggtggaaccatacatattgttgttaacaaccaagttgccttcacgaccgatccaagagctggcaggtcctcccagtactgcacagatgttgccaaagccctgaacgctcctatattccatgtaaatggggacgatttagaggctgtcgtctgtgtatgtgagcttgcagcagagtggcgccagacttttcactcagatgtggttgtcgatctaatctgctaccgccgttttgggcataatgaaatcgatgaaccctccttcacacagccaaagatgtatcaggtcattaagaaccatcccagctcattgaagctttatgagcagaaactgctaggatcaggagaagtctcgaaagaagatgtccagaagatccatgacaaggtgaaccgtatcttgaatgaagaatttacaaagagcaaagactatgttcccaacaagagggattggctctctgcttactggactggctttaagtcgcccgagcaaatatcacgtgttcgcaacactggggtcaagccggagatactgaaacgtgttggacaagcaattactacactgcctgaaaacttcaagccacacagagcagtgaagaagatttttgagcttcgtgcagctatgattcagagtggcgaaggaattgattgggctgttgcagaagccctagcctttgcaacacttattgtagaaggcaatcatgttaggctaagtggacaggatgtggaaagaggaactttcagccaccggcatgcagttctgcatgaccaggaaactggagcgaagtactgcccacttgaccatgttgcgatgaatcaaagtgcggaactgtttactgtgagtaatagttcactttcagaatttgctgtccttgggtttgaattgggttactccatggagaaccctaattcattggttctttgggaagcacaatttggtgacttttccaatggtgcgcaagtgatgtttgaccagtttttgagcagtggagaggcaaaatggttgcgccaaactggccttgttgttctgcttcctcatggttatgatggccaaggtcccgaacattccagtgcccgtttggagcgcttccttcagatgagcgatgataatccttttgtcatacctgagatggaaccgacacttcgcaaacagatccaagagtgtaactggcaagttgtgaatgtgacaactcctgcaaattatttccatgtgctgcgtcgtcagatacatagggagttccggaagccactgattgtaacagctcctaagaacctgcttcggcacaaggattgcaagtccaatctttctgagtttgatgatgttgaaggccatccgggatttgataagcagggaacacgtttcaagcgactgataaaggaccgtaacgatcacaagcaagtcgaggagggtatcaaccgtcttatattatgttctgggaaagtttactatgaacttgacgaagagcgtaaaaagtcagagcgcagtgatgttgcaatttgcagagttgagcaactttgcccattcccgtacgaccttatccaaagagagcttaagagatatccaaatgcggagattgtgtggtgccaggaggagcccatgaacatgggtgcatacagctacatctctcctcggctctatactgccatgaaggctcttgggcggggttcgtttgaagacatcaagtacataggcagagcaccttcagctgctacagccacaggcttcctgtcggttcatgtacaggagcagtcagagctggtaaagaaggcactgcagccggagccgaacaagttcccctgatgggatgcagatcctaacggtgtggtgaaataacatgaccctgacatgcctgtttgcaggaggctcaacataccgaacgtgcaatttaaaagttttgcacgttttctcttctttttcaattttgaggcttttatgtttttttttgggaaataatgacgcattatgaagagacctgaagctgtctgaaaccgatgtcattcattcgactttgctttcacagtggctttgtgttgtgctggtgtttgctctccagggtcaggttcagattaacccagggatattttgaggattttatcgcattgcaattgcatccgtgtttcaggaagcaatttgcatcaactgacacaggaagacgcgcgactctactttttaca

SEQ ID NO: 1752 - DNA, 3318 bp, Hordeum vulgare
gggcggtcctcgcccgcgccgccagcgccaccccgggcgcccgatccgcgtggttccacacctccgccatccgccgcagggccgcggcccctgtcccgcgggccgtgccgctctccaggctcacggacagcttcctcgacggcaccagcagcgtgtacctggaggagctgcagcgcgcgtgggaggcggacccggcctcggtcgacgagtcgtgggacaacttcttccgcaacttcctcggccaggccgccggctcccccggcgcgggcctctccggccagaccatccaggagagcatgcagctgctcctcctcgtgcgcgcctaccaggtcaacggccacatgaaggccgccctcgacccgctccggctcgacgaccgcgccgtgcccgaggacctcgacctcgccctctacggcttcacggaggccgatctcgaccgcgagttcttcctcggcgtctggatgatggccggcttcctctccgagaaccgccccgtgctcaccctccgcgagatcctcagcaagctcgagcgcgcatactgcggccccatcggcttcgagtacatgcacatccccgacagggacaagtgcaactggctcagggagaagatcgagaccgtcgcgcccaaggagtacgacagggaccgccgcctcgtcatgctcgacaggctcatctggagcacccagttcgagaacttcctcgccaccaagtgggccaccgccaagcggttcggcctcgagggcggcgagacgctcatccccggcatgaaggagatgttcgacaggtccgccgatctcggtgtcgagaacattgtcattggcatgccccacagggggaggctcaatgtgctggggaacgtcgtccgcaagcccctgtctcagatattcagtgagtttgctggagggacgaggcctgtcgaaggtgaggacgggctctacactggaaccggtgatgtcaagtaccatctaggtacctcctacgaccggccaacccgtggtggcaagaggatccacttgtcgttggtcgccaatcccagtcatctggaggctgtcgaccctgttgtcattggcaagacgcgtgcaaagcagttctactccaatgatgatgacaggacaaagaacatgggcattcttatccacggggatggtagctttgctgggcagggagtggtttatgagacgctccatctgagtgcccttccaaactacaccactggaggaaccattcacattgttgtcaataatcaggttgccttcacaactgatccaagagccggcaggtcttcccagtactgtacggatgtggccaaggctgtgaatgtccctatattccacgttaatggtgatgatctggaggctgttgtacgtgtctgcgaacttgcagctgagtggcgccagactttccattctgatgtggtggtcgacctgatctgctaccgtcgttttggacacaatgaaattgatgagccatccttcacacagccaaagatgtatcaggtcatcaagaaccatcccagttcattgaagctttacgaacagaaactgcttgaaacaggtgaagtcgccaaagaagatgttgataggatccatgataaagtgaaccggatcctgaatgaagagttcgctaaaagcaaggattatgttcccaacaagagggattggctctcggcttactggactggcttcaagtcacctgagcagatttcacgtgtccgcaacaccggggttaagccggaggtactgaaacgtgttgggcaagcaattacttctctgcctgaaagcttcaagccccacagagcagtgaagaagatttttgagcagcgcgctgcaatgatcgagagtggcgaaggtattgactgggctgttgccgaagcccttgcatttgcagcactcatagttgaaggcaaccatgttaggctgagtggacaggatgtcgaaaggggaacttttagccaccgtcattcggttgtgcatgaccaggaaactggggcgaagtactgcccacttgatcatgttgtgatgaatcaaaatgaggagctgtttactgttagcaacagttcactttctgaattcgctgttcttgggtttgaattgggctactccatggagaacccaaattcgctagtactctgggaagctcagtttggtgacttctccaatggtgcacaagtgatgttcgaccagtttctgagtagtggagaggcaaaatggctgcgccaaactggccttgttgttctactgcctcatggttatgatggccaaggtcctgaacactccagctcccgtttggagcgcttccttcagatgagtgatgacaatccttttgtcatacctgagatggacccaacacttcgcaagcagatacaggagtgtaactggcaggttgtgaatgtgacaacccctgcaaactatttccatgtgctgcgtcgtcagatacatagggatttccggaagccgctgattgtgacggcccccaagaatctacttcggcataaggagtgcaaatccaacctctctgagtttgatgatgttgaagggcacccaggatttgataagcaaggaacacgtttcaagcgcctgataaaggaccgtaacgatcacaaggaagtcgaggagggtatcaaccgccttgtattatgttctggaaaagtgtattatgaacttgatgatgagcggaaaaagtccgagcgcagcgatgttgctatttgcagggttgagcaactttgcccattcccatacgaccttatccagagagagctaaagagatatccaaatgcggagattgtgtggtgccaagaggagcctatgaacatgggcgcatacagctacatctcaccccgcctgtactcagccatgaagaccctggggcggggcacttttgaggacatcaagtacgtgggcagggcgccttcggccgccacagccaccggcttcttgacggtccatgtgcaggagcagtcggagctggtgaagaaggcattgcaaccggagccgatcaagttcccctgatgcgggaaacccgtgcaaaaataacctgtcgcaggctcgggttgtccagcctgtgcacacaccgtcttaaaagttttggcctgtacaagttcttttttgctctctcttcgttcttctgtgaggcgtttcgctctgaaggtcgtgaataatcaactattgtgaaccttcttgctgttgaggaggcgtgaggcccgtctcagcacgagcaacatccttgaatcatgatgctagttttactgacagcgttgcttccgtgattgttctctgcatgaatcaatcaatcttgatgcattggttccatatatgtgcg

SEQ ID NO: 1753 - DNA, 3168 bp, Panicum virgatum
ggcttccactccaccgccctgcggcctcgctccgccgcccccgcgccccgcgccgtcccgctctcccgcctctccgacagcttcctcgacggcaccagcagcgtctacctcgaggagctccagcgcgcctgggaggccgacccctcactccgtcgacgagtcgtgggacaacttcttccgcaacttcgtcgcccaggcctccccctccgccggcgtctccggccagaccatccaggagagtatgcagctcctcctcctcgtcagggcctaccaggtcaacggccacatgatggccaagctcgaccccctcggcctcgacgacagagccgtccccgaggacctccgcctcggcctctacggcttcactgacgccgacctcgacagggagttcttcctcggcgtctggaggatgtccggtttcctctccgagaaccgccccgtcctcaccctccgcgagatcctcagcaagctccagcaggcctactgcggccccatcggctacgagtacatgaacatccccgacagggacaagtgcaactggctcagagaaaagatcgagaccgccaagcccagggactacgacaaggaccgccgcctcgtcatgctcgacaggctcatctggagcacgcagttcgagaacttcctcgccaccaagtgggccaccgccaagaggtttggccttgagggtggtgagacgctcatccctggcatgaaggagatgttcgatagagctgctgacctcggcgtcgagaacattgtcatcggtatgccgcacagggggaggctcaatgtccttggtaatgttgtccgcaaaccattgtctcagatattcagcgagttcactggtggcacaaggcctgttaaaggtgaggatgggctctacactggaactggtgatgtcaagtaccacctcggtacctcctatgaccgccctactcgtggtggcaagaggattcacttgtccttggtcgccaatcccagtcatctggaagctgttgatcctgttgttattggcaagacacgtgccaagcaattctactctaacgacgccgacaggacaaagaacatgggtattctgatacacggagatggtagctttgctggtcagggtgtggtctacgagacactccatctaagtgccctcccgaactacactactggtggaaccatacatattgttgttaacaaccaagttgccttcacgaccgatccaagagctggcaggtcctcccagtactgcacagatgttgccaaagccctgaatgctcctatattccatgtaaatggtgatgatttagaggctgtcgtccgtgtctgtgagcttgcagcagagtggcgccagacttttcactcagatgtggttgtcgatctaatctgctaccgccgttttgggcataatgaaatcgatgaaccctccttcacacagccaaagatgtatcaggtcattaagaaccatcccagctcattgaagctttatgagcagaaactgctaggatcaggagacgtctcgaaagaagatgtccagaggatccatgacaaggtgaaccatatcttgaatgaagaatttacaaagagcaagcactatgttcccaacaagagggattggctctctgcttactggactggctttaagtcgcccgagcaaatatcacgtgttcgcaacactggggtcaagccggagatactgaaacgtgttggacaagcaattactacactgcctgaaaacttcaacccacacagagcagtgaagaagatttttgagcttcgagcagctatgattgagagtggcgaaggaattgattgggctgttgcagaagccctagcctttgcaacacttattgtagaaggtaatcatgttaggctaagtggacaggatgtggaaagaggaactttcagccaccggcatgcagttctgcatgaccaggaaactggagcgaagtactgcccacttgaccatgttgcgatgaatcaaagtgcggaactgtttactgtgagtaatagttcactttcagaatttgctgtccttgggtttgaattgggttactccatggagaaccctaattcattggttctttgggaagcacaatttggtgacttttccaatggtgcgcaagtgatgtttgaccagtttttgagcagtggagaggcaaaatggttgcgccaaactggccttgttgttctgcttcctcatggttatgatggccaaggtcccgaacattccagtgcccgtttggagcgcttccttcagatgagcgatgataatccttttgtcatacctgagatggaaccgacacttcgcaaacagatccaagagtgtaactggcaagttgtgaatgtgacaactcctgcaaattatttccatgtgctgcgtcgtcagatacatagggagttccggaagccactgattgtaacagctcctaagaacctgcttcggcacaaggattgcaagtccaatctttctgagtttgatgatgttgaaggccatccgggatttgataagcagggaacacgtttcaagcgactgataaaggaccgtaacgatcacaagcaagtcgaggagggtatcaaccgtcttatattatgttctgggaaagtttactatgaacttgacgaagagcgtaaaaagtcagagcgcagtgatgttgcaatttgcagagttgagcaactttgcccattcccgtacgaccttatccaaagagagcttaagagatatccaaatgcggagattgtgtggtgccaggaggagcccatgaacatgggtgcatacagctacatctctcctcggctctatactgccatgaaggctcttgggcggggttcgtttgaagacatcaagtacataggcagagcaccttcagctgctacagccacaggcttcctgtcggttcatgtacaggagcagtcagagctggtaaagaaggcactgcagccggagccgaacaagttcccctgatgggatgcagatcctaacggtgtggtgaaataacatgaccctgacatgcctgtttgcaggaggctcaacataccgaacgtgcaatttaaaagttttgcacgttttctcttctttttcaattttgaggcttttatgtttttttgggaaataatgacgcattatgaagagacctgaagctgtctgaaaccgatgtcattcattcgactttgctttca

SEQ ID NO: 1754 - DNA, 5207 bp, Panicum virgatum
cctccccctccgccggcgtctccggccagaccatccaggagagcatgcaactcctcctcctcgtcagggcctaccaggtcaacggccacatgatggccaagctcgaccccctcggcctcgacgacagtgccgtccccgaggacctccgcctcggcctctacggcttcacggacgccgacctcgacagggagttcttcctcggcgtctggaggatgtccggtttcctctccgagaaccgccccgtcctcaccctccgcgagatcctcagcaagctccagcaggcctactgcggccccatcggctacgagtacatgcacatccccgacagggacaagtgcaactggctcagagaaaagatcgagaccgccaagcccagggactacgacaaggaccgccgcctcgtcatgctcgacaggctcatctggagcacgcagttcgagaacttcctcgccaccaagtgggctaccgccaagaggtttggccttgagggtggtgagacgctcatccctggcatgaaggagatgttcgatagggctgctgacctcggcgtcgagaacattgtcatcgggatgccgcacagggggaggctcaatgtccttggtaatgttgtccgcaaaccgttgtctcagatattcagcgagttcactggtggcacgaggcctgttgaaggtgaggatgggctctacactggaactggtgatgtcaagtaccacctgggtacctcctatgaccgcccaactcgtggtggcaagaggattcacttgtccttggtcgccaatcccagtcatctggaagctgttgatcctgttgtcattggcaagacgcgtgccaagcaattctactccaacgatgccgacaggacaaagaacatgggtattctgatacatggagatggtagctttgctggccagggtgtggtctacgagacgctccatctaagtgccctcccgaactacactactggtggaaccatacatattgttgttaacaaccaagttgccttcacgacggatccaagagctggcaggtcctcccagtactgcacagatgttgccaaagccctgaatgctcctatattccatgtaaatggtgatgatttagaggctgtcgtccgtgtctgtgagcttgcagcagagtggcgccagacttttcactcagatgtggttgtcgatctaatctgctaccgccgttttgggcataatgaaatcgatgaaccctccttcacacagccaaagatgtatcaggtcattaagaaccatcccagctcattgaagctttatgagcagaaactgctaggatcaggagacgtctcgaaagaagatgtccagaggatccatgacaaggtgaaccatatcttgaatgaagaatttacaaagagcaagcactatgttcccaacaagagggattggctctctgcttactggactggctttaagtcgcccgagcaaatatcacgtgttcgcaacactggggtcaagccggagatactgaaacgtgttggacaagcaattactacactgcctgaaaacttcaacccacacagagcagtgaagaagatttttgagcttcgagcagctatgattgagagtggcgaaggaattgattgggctgttgcagaagccctagcctttgcaacacttattgtagaaggtaatcatgttaggctaagtggacaggatgtggaaagaggaactttcagccaccggcatgcagttctgcatgaccaggaaactggagcgaagtactgcccacttgaccatgttgcaatgaatcaaagtgcggaactgtttactgtgagtaacagttcactttcagaatttgctgtccttgggtttgaattgggttactccatggagaaccctaattcattggttctttgggaagcacaattcggtgacttttccaatggtgcgcaagtgatgtttgaccagtttttgagcagtggagaggcaaaatggttacgccaaactggccttgttgttctgcttcctcatggttatgatggtcaaggtcccgaacattccagtgcccgtttggagcgcttccttcagatgagcgatgacaatccttttgtcatacctgagatggaaccgacacttcgcaaacagatccaagagtgtaattggcaagttgtgaatgtgacaactcctgcaaattatttccatgtgttgcgtcgtcagatacatagggagttccggaagcctctgattgtaacagctcctaagaacctgcttcggcacaaggattgcaagtccaatctttctgagtttgatgatgttgaaggccatccgggatttgataagcagggaacacgtttcaagcgactgataaaggaccgtaacgatcacaagcaagttgaggagggtatcaaccgtcttatattatgttctgggaaagtttactatgaacttgacgaagagcgtaaaaagtcagagcgcagtgatgttgcaatttgcagagttgagcaactttgcccattcccgtacgaccttatccaaagagagcttaagagatatccaaatgcggagattgtgtggtgccaggaggagcccatgaacatgggtgcatacagctacatctctcctcggctgtatactgccacgaaggctcttgggcggggttcgtttgaagacatcaagtacataggcagagcaccttcagctgctacagccacaggcttcctgtcggttcatgtacaggagcagtcagagctggtaaagaaggcactgcagccggagccgatcaagttcccctgatggggatgcagatcttcacgctgctgttgcttagtacaaactatcgtgaaataacatgaccctgacatgcctgtttgcaggaggctcgacatacccgaacgtgcattttaaaagttttgcacattttcttttctttttcaattttgaggcttttgtgtttttttttgggaaataattatgaagacctgaagctctgtgaaaccgatgtcattcattcgactttgctttcatagtggctttctgttatgctggtgtttcctctccagggtgaggtccaaataatcaacggatattttgaggattttaccgcattgcaattgcatccatgtttcaggaagcaattcgcatcaactgacaaagacgccaggcaacgactcttttacacaggcgcttcgtcactcgttagcttttctttatttttagcatcaccaccagactttattgatcatggacacgataagagttacgcacggcatcagtcccaagcaaaagaagatgcggagcttgggccggtacaactgtggtaagtatgatgaaattggcccgtgaaaaccagactggcccaatgccgctgtttgtcaatcatcatcaccgccatgcccagcccagcctacacctattactcgtttcgcatctcgtcggcatcgccatcgccgccatgccgcatctggccgccgccgatgctttcctcattctcgagttcatcgccggcaaccgccgcactccccacggcatactagccgccctcctcgccctcctaccctcctccttttcgccccgcacctccccgcgcctccgcaaagctctagtgctccgcgccctccacgccgccctccacgccgaagatgcctcctgttccttcaccctcctcggcaaagcgcggagggtcctcgccgaccccaacgcctccgcctgcttcccaaaccagctttcttttgcagacaaccaggaggacgacggggctagggccgcagccgcggtggccgatctcaagcgcttcctcgaccacgagtgggccaacctcccaccctccatgcttgagcttgccgccgatcgcctcgccggacacaggtccctccaaacgtgggccgccgccgaccatgccaatcgtacaaagcttcgcctgctcggggagtccacagagcgtgagattttagccaagcttatgcaagatgcatcagcttctcatccacctatcctgccggaagtttctgataacgcaaacgatgctaatgaagctgatggtgctcaacaaaaccatgcggcttatcattctaagcaaagcaatgaagctgaccgtgctcaagaaggcatggctgcgcatcaaaatgtgtcaatgaaaggagcacagggggtccaacttccagagaagtctgtccctgcgtctaataagcccagtcttatggagagacatcccaatgcaagtatttttgagtggaatggcttgggtgactatgatgaagacaggctagtagggaagcgtaagctacccccttttgtgaggaaaccacatccttcccctgcatttgcacataagatgagaaagaagtggagtgagatagaggaaaaaaccttgttggaaggggtggagaagtatggcaaaggctattggaaagatatcaaaatggcttaccctaacgtctttgaagagagatcaacggtagatctgaaggataagttcagaaatatggaaaggcaccatgaataaacttgaggcctggtggtgttgtgcttctctgctctgtagatactagtataatatgatggcggcagtatgcaaatgaaaacccatgtaaggtggcgtgcagacatttttttctgtgtttatttggagtgtctgaagggagagtctccagcactgggcatcttctctcatctccattccacatgatttctcctctctggattcctgtagggttgactttgacccatgcaaaaggttttatctttggagggaaatttacatactcctagggtttagggtacatcccattaccagtgtaggtgagtaattttgtgaaaaaattaccctccacagccctttttttgttgggggggggggggggtgcatctgctaaaaaaaacagaggaggagctgcggtggaaaatgaaacagctagtgggaaaattgaaaaggctagtttttttaagaaaacctagtgggaaaattagcctttcgacagctttttgacttttccgaaagtaaatgcaggtttggaagtccaaccaaatacacccagaaccatgaggcaaaaggtgctaatcagtcaggtaatgttaaatcattaagtttaccttcaaaacaccagttcaaagatcggcagaaagaagagttccatactatagctttcttttttttggtcatccaatgtcaatccatatagttttgcttcttatttatcatgggggtattatcattcatgcattcttgcttcattgtattttagacca

SEQ ID NO: 1755 - DNA, 3639 bp, Musa acuminata
aagaccaccaaactgggaggctcgggaaaggcggctctgtggcgtactggccttctgacgatataaggaagcctttggctcctcgcccagggttagggttccgccttctcctacctgcatttcaggattgtcgtcgcgttctcagcttgtgatgtgtatggtttaaggtttgatctctttgttctccgatattaacggtttctctgtaaagaaagttgatctttttagtggtgatccaccggatcttggtcgagatccatcgccatggcgtggtttagggccgtgtccggcgtggccagattggccattaggagaaacctatctcaggcgccgcatcacatcggcaggccccgcgccctcccctctccgccctcccggggcttccactctgccgcccttcggcgcaaagccgagtccgccgcgccgatcccccgggctgtgcccctctctaggctgaccgacagcttcctggatggcaccagcagtgtctacttggaggagcttcagcgggcctgggaggctgaccccaacagcgtcgatgagtcgtgggacaacttctttaggaacttcgttggacaggccgccacgtcgccaggaatctccggccagaccatccaggagagcatgcgattgctactgctcgtcagggcctaccaggtcaatggccacatgaaggccaagttagatcctttgggtttggaggagcgtgaaatccctgaggatttggatttgggtctctatggattcacggaggcagatttggatagggagttcttccttggtgtgtggagaatggctggcttcttgtcggataaccgccctgtgcaaaccctccgcgagattttgaacaggctcgagcaagcgtattgcgggaacgtgggatatgagtacatgcacatccctgatagggataagtgtaattggataagggacaagattgagacggtcaaacctagggagtacagtcgggaacggcgagaggtcattcttgacaggcttatttggagcactgagtttgagaatttcttggctaccaagtggactgctgcaaagcggttcggtcttgaaggaggggagaccctgattcctgggatgaaggagatgtttgatagagcggctgaccagggggtggagagtattgttattggaatgtctcacagaggcaggctgaatgtcttgggcaatgttgtcaggaagcctttgcgtcagattttcagtgaattcagcagtggcacaaagcctgtggatggtgaagttgggttgtatacaggaacaggtgatgtgaaataccatttgggtacttcatatgacaggccaaccagaggtggcaaaaggattcatttatccttggtcgccaatccaagtcatttggaggctgttgatccacttgtggttgggaagacacgggcaaaacaatactactccaacgatattgataggataaaaaatatgggtgtattgatccacggtgatggaagttttgcaggacaaggtgtggtctatgagactctacatctcagtgccctccccaactacactaccgggggaacaatccacatagtgattaacaatcaggttgcattcaccactgatcctgggtccggaaggtcttctcaatattgcacagacgttgccaaagccctgaatgctccaatctttcatgtaaatggagatgatatggaagcagttgtccatgtttgtgagcttgcagcggagtggaggcagacattccattcagatgtggtggttgatatagtatgttacagacgatttggccataatgagattgatgaaccctctttcacacaacctaaaatgtatcaggtcatacggaatcatccaagtgcacttgaaatttaccaaagcaaactcttggagtcgggagaaatcactaaagaagatatcgaaagaattcacaacaaagtcacttccattttgaatgaagagtttattaacagcaaagactatgttccaaaaaggagggactggctttcagcatattggttaggatttaagtctccagaacagatttcgcgtattcgaaacactggagttaaacctgagattttgaaacgcgttggacaagccattacaactcttcctgaaactttcaagcctcatagagcagtaaaaaagatctttgagcaacgtgctcagatgattgaaagtggggaaggcattgactgggcaatgggagaggcacttgcttttgctactctaattatagaaggaaatcatgttagattgagtggccaagatgttgaaagaggtacatttagtcatcgtcattcagttattcacgaccaacagacgggagagaaatactgccctttggatcatattgtgatgaaccaagatgaagagttgttcactgtcagcaacagttcactttcagagtttgctgtccttggattcgaattgggctattcgatggaaaaccctaactcattgatactttgggaagctcagtttggtgatttttcaaatggtgcacaggtaatgtttgatcagtttttgagcagtggagaatccaaatggctacgccaaactgggcttgttgttttacttccccatggttatgatggtcaaggcccagaacattcaagtgcacgattggagcgtttcctccagatgagtgatgataacccgtatgtaattcctgagatggacccaactctccggaaacagatccaggaatgcaattggcaagtcgtgaatgtgacgactcctgcaaattatttccatgttttgcgacggcagattcatcgggagttccggaaacctctgattgtgatgtcccctaagaacctacttcggcacaaggactgcaaatcaaatctatccgagtttgatgatcttgaaggccatccaggatttgataagcaaggaacacgtttcaaacgccttataaaggaccagaataatcacaaagagatagaggagggtattaaccgtctcattttgtgctctggaaaggtctattatgaacttgacgaaggacgcaagaagttggatcgccaggatgtagccatttgtagagtggaacagctttgcccattcccctatgacctcattcaaagagagcttaagcgatatccaaatgcggaaattgtctggtgtcaggaagagccaatgaacatgggtgcatacagctatatcaatcctcgcctatacaccgccatgagggcactaggtcggggggagtttgaagacatcaagtacgtcgggagggcaccttctgctgcaacggccacaggtttctactctgttcatgttcaagagcaaaccgagcttgtacaaaaggcattacagcctgaggcgatcagttttccttattgaaaagtttttcgatatcggacccagaacaaataatatgaaatgagctgttgcttgagttttatgatgtttcaggcaaaggtactatgctcatgaaccattgtcaaattttgaacagttcatcttttttggtgtttctgttgtcatttacactcagaaatggcagctgatgctgattctcctttatatctgattcgagcaattaccatctgcctcatttctttggtgattgtcaaaccatgttgtttgatttttatactcagcaagttaatgatcatatcttctgtttggattagccattga

SEQ ID NO: 1756 - DNA, 3475 bp, Elaeis guineensis
tttcccagtcttttttttgcgtaaatttgttctcgaagggtttgatttctttaaattcagataataggcttatttggatgccgttctgagaaatatttggtcgctttagtggaaattgatcgctatggcgtggtttagagctgcgtccggggtagctagattggccctcagaagaaacctatctcaggcgcctcatcacatcgccagaactcgtgctcttccttcctctactcgttgctttcattccacgaattttagacccaaggccgccccggttccccgccccgtgcccctctccaagctcacagatagcttcctcgatggcacgagcagtgtttacttggaggagctgcagagagcctgggagaacgaccccagcagtgtggatgagtcatgggacaacttctttagaaactttgttggccaagctgccacttctccgggaatctccggccagaccatccatgagagcatgcgattgctgctcctggttagggcctaccaagtcaatggccacatgaaggcccagctcgatcctttaggtttagagaagcgggaaattcccgaggatttggacccggctttgtatggattcaccgaggccgatttggatagagaattcttcctgggcgtgtggaggatgtcgggcttcttgtcagagaatcgcccagtccagacccttcgggagattttaaacaggctcgagcaggcttactgcgggactatcgggtatgagtatatgcacattcctgatcgtgaaaagtgtaactggttgagagaaaagattgagaccgtgaaaccgagggagtacagtccggaccgccgtgaggtcttgcttgataggcttatttggagcactcagtttgagaatttcttggccacgaagtggactgccgcgaagagatttggtcttgaaggtggggagactttgattccgggcatgaaggagatgttcgacagagcggctgatatgggggtggaaagcattgtgattggaatgtctcacaggggaaggttgaatgttttgggtaatgtcgtccggaagcctttgcgtcagattttcagtgaatttagtggtggtacgaagcctgttgaagagggagaagggttgtacaccggaacaggagatgtgaaatatcatctgggtacttcctatgacaggcccaccagaggtgggaaaagaatacatctatctttagttgcaaatccaagtcatttagaagcagttgatccccttgtcgttgggaagactcgggcaaagcagtactactcaaatgatgccgagaggacaaagaatgtgggagttttgattcatggtgatggaagctttgcggggcagggtgtggtttatgagaccttgcatctgagtgctctccccaactacacaaccggtggaacaattcacattgttgtgaacaatcaagttgcatttacaaccgatccaaagtctgggaggtcttctcagtattgtacagatgtagctaaagcattaaatgctccaattttccatgtgaatggtgatgatttcgaagcagtggtccatgcttgtgaacttgcagcagggtggcgtcagacattccattcggatgtggtggttgacattgtttgttaccgtagatttgggcacaatgaaattgatgaaccctctttcacacagcctaaaatgtatcaggtgattcggaaccatccgagtgcactagagatataccaaaacaagcttctacaatcagggcagatctctaaagaagatattgagagaatacacaacaaagtcaattccattctgaacgaagaatttattaaaagcaaagactacgttccaaggaggagggattggctttcagcttattgggctggatttaaatcacctgaacaaatttcccgtattaggaatactggtgtcaaacctgaaatactgaaacgtgttgggcaagccattaccacccttcctgaaaattttaagcctcacagagctctaaagaagatttttgagcaacgtgctaagatgattgaaactggggaaggcattgactgggcacttgcagaagcactagcttttgccacccttataattgaaggtaatcatgtcaggttaagtgggcaggatgtcgaaagaggcactttcagtcatcgtcatgcatttgttcatgatcaagaaactggagagaagtactgcccactaggccatattttaatgaaccaaaatgaggagatgtttactgttagcaacagctctctttcagagtttgctgtccttggatttgaattgggttactcaatggaaaatcccaactcattagtactttgggaagctcagtttggtgactttgcgaatggggcccaagtcatttttgatcagtttttaagtagtggagagtcaaagtggcttcgccaaacaggtcttgctgttttgctcccccatggttatgatggtcaaggccccgaacattcaagcgcacgattggagcgttttctccagatgagcgatgataacccttatgttatacctgagatggatccaacactcagaaaacagattcaagagtgcaattggcaagtagtgaatgtcacaacacctgcaaactattttcatgttctgcggcggcagatacacagagatttcaggaaacctctaattgtgatgtctccaaagaacctgcttcggcacaaggactgcaagtcacatctttctgaatttgacgatctcgtagggcaccctggatttgataagcaagggacacgcttcaagcgcctcataaaagatcagaatgaccataaagatcttgaggagggtattaatcgactgattttgtgctctggaaagatttattatgaactggatgaagcacgaaagaaaaaggatcgcaaggatgttgcaatctgtagagttgaacagctctgcccattcccatatgacctgatccagagagaactgaagcgatatccaaatgcagagattgtttggtgccaggaggagccaatgaacatgggtgcataccattatgttacccctcgtttgcatactgccatgagggcacttggcagagggactatagaagacattaattatgttggaagggagccatctgctgccacagcaactggtttctattctgttcatgtgcaagagcagacccagattattcagaaggcaatgcagcaagagccagtcagatacccatactgaactctcttctagtttcaagaagaagaaaaaatgtgcatgttctccgaaattttatattcctttgcaggagttgatgtgcatcaactcgagtacttgtcttttacggtctgaatgaatttactggtgcatttctgctgctgtattttggaaaccaactttacaaaatgttctcgtatttatttgatccttagagtatacgtggttatggcagcatgaggactctggtgatctggcaaaatcattgtggtaagaaatcgttacatattgttaccaaaaataagacatagt

SEQ ID NO: 1757 - DNA, 3003 bp, Secale cereale
tctccggccagaccatccaggagagcatgcagctgctgctcctcgtgcgcgcctaccaggtcaacggccacatgaaggcggcgctcgacccgctggggctcgacgaccgcgccgtgcccgaggacctcgacctcgccctctacggcttcaccgaggccgatctcgaccgcgagttcttcctcggggtctggatgatggccgggttcctctccgagaaccgcccggtcctcaccctccgcgagatcctcggcaagctcgagcgcgcctactgcgggcccatcggcttcgagtacatgcacatccccgaccgggacaagtgcaactggctccgggagaagatcgagaccgtcgcgcccagggagtaccccaaggaccgccgcctcgtcatgctcgaccggctcatctggagcacccagttcgagaacttcctcgccaccaagtgggccaccgccaagaggttcggcctcgagggcggcgagaccctcatccccggcatgaaggagatgttcgacaggtccgccgatctcggcgtagagaacatcgtcattggcatgccccacagggggaggctcaatgtgctggggaacgtcgtccgcaagcccttgtctcagatattcagtgagtttgctggcgggacgaggcctgtcgaaggcgaggatgggctctacactggaaccggtgatgtcaagtaccatctgggtacctcctacgaccggccgacccgcggtggcaagaggatccacttgtcgttggtcgccaatcccagtcatctggaggccgtcgaccctgttgtgattggcaagacgcgggcaaagcagttctactccaatgatgatgacaggacaaagaacatgggcattcttattcatggagatggtagctttgctgggcagggcgtggtgtatgagacgctccatctaagcgcccttccaaactacacaactggaggaaccattcacattgttgtcaacaatcaagttgccttcacaactgatccaagagccggcaggtcttcccagtactgtactgatgcggccaaggctgtgaatgtccctatactccatgttaatggtgatgatctggaggctgttgtacgtgtctgcgaacttgcagctgagtggcgccagaccttccattctgatgtggtggtcgacctgatctgctaccgtcgttttggacacaatgaaattgatgagccatccttcacacagccaaagatgtatcaggtcattaagaaccatcccagttcattgaagctttatgaacagaaactgcttgaaactggtgaagtcactaaagatgatgttcagaggatccacgacaaagtgaaccgaatcctaaatgaagagtttgctaaaagcaaagattatgttcccaacaagagggattggctctcggcttactggactggctttaagtcacctgagcaaatttcacgtgttcgcaacaccggggttaagccggaggtactgaaacgggttgggcaagcaattactactctgcctgaaagcttcaagccccacagagcagtgaagaagatttttgagcagcgtgctgcaatgatcgagagtggtgaaggtattgattgggctgttgctgaagcccttgcctttgcagcactcatagttgaaggcaaccatgtcaggctgagtggacaggatgtggaaaggggaacttttagccaccggcattcagttgtgcatgaccaggaaactggggcgaaatactgcccgctcgatcatgttgtgatgaaccaaaatgaggagctgtttactgttagcaacagttcactttctgaattcgctgttcttgggtttgaattgggctactccatggagaacccgaattcgctagtactctgggaagctcagtttggtgacttctccaatggtgcacaagtgatgttcgaccagtttctgagtagtggagaggcaaaatggctgcgccaaactggccttgttgttctactgcctcatggttatgatggccaaggtccggaacactccagctcccgtttggagcgcttccttcagatgagtgatgacaatccttttgtcatacctgagatggacccaacacttcgcaagcagatacaggagtgtaactggcaggttgtgaatgtgacaacccccgcaaactatttccatgtgctgcgtcgtcagatacatagggacttccggaaaccgctgattgtgacggcccccaagaacctacttcggcataaggagtgtaaatccaacctctctgagtttgatgatgttgaagggcacccaggatttgataagcaaggaacacgtttcaagcggctgataaaggaccgtaatgatcacaaggaagttgaggagggtatcaaccgccttgtattatgttctggaaaggtgtattatgaacttgacgatgagcggaaaaagtccgagcgcagtgatgttgctatttgcagggttgagcaactttgcccattcccatatgaccttatccagagagagctaaaaagatatccaaatgcggagatcgtgtggtgccaagaggagccaatgaacatgggcgcatacagctacatctcaccccgcctctactcagccatgaagaccctggggcggggcacttttgaggacatcaagtacgtgggcagggcgccttcggccgccacagccaccggcttcttgacggtccacgtgcaggagcagtcggagctggtgaagaaagcattgcaaccagagccgatcaagttcccctgatgcggaaaccctcgcgaaaataacccttcgcaggctcgggttgtccagcctgtgcacacaccgtcttaaaagttttggcctgtacaagttcttttgctctctcttcgttcttctgtgaggctttggctccgaaggtcgtgaataatcaactcttatatgaaccttcttgctgttgaggaggcgtgaggccctctcagcacgagcaacattcctgaatcatcatgctagttttgctgacagtatggcactaccgtttttcgttatt

SEQ ID NO: 1758 - DNA, 3458 bp, Triticum aestivum
ttttccgcggctagatttggcgtcgggagaggaaattcgatctgaaaatggggttgttccgggccgcgtcgggcttagcccgggtggcgctgcggaggagcctgtcgcgcgctccggcgagcccgttcgccggccccgcgccgcggtacttccactcgacgctcccccggcggtacgcggcgcctgagccccgcgccgtgccgctctcgcgcctcaccgacagcttcctcgatggcaccagcagcgtgtacctcgaggagctgcagcgggcgtgggaggcggacccgacctccgtcgacgagtcctgggacaacttcttccggaactttgtcgggcaggccgccacgtcccccggcatatccggccagacgatccaggagagcatgaggctgctgctgctcgtgcgcgcctaccaggtgagcggccacatgaaggccaagctcgatcctcttgggctggagcagcgcccggttccggatgtcctggacccggcgttctacggcttctctgagtctgatttggatcgggagttcttcctcggggtgtggaggatggctgggttcttgtcggagaatcggcctgtgcagacacttcgttctgtgttgggacgcctggagcaggcctactgtggcaccattggttacgagtacatgcacatacctgaccgcgaaaagtgcaactggctgagggagaggatcgagacagttaacccaagggagtacacctatgatcgtcgccaggtcatgctcgataggctcatctggagtacccagtttgagaatttcttggcacagaagtggaccactgcaaagcgatttggcctagaaggtgccgagacactgattcctggtatgaaggagatgtttgacagggcagctgatcttggtgtagagagtattgtcattgggatgccacacagaggcaggctcaatgtcttgggaaacgtcgtacgtaagcccttgcgacagatcttcagcgagtttagtggtggtaccaagcctgtcaatgagggggagggtttgtatacagggacaggcgatgtcaagtaccatctaggaacttcatatgataggcctaccagaggtgggaaacatatccatctatcgttggttgcaaatccaagtcatttggaagcagtcgatcctgttgttgctgggaagaccagagcaaagcagtactattctaatgatcttgacaggaccaagaatctaggggtgctattgcatggtgatggaagcttctcagggcagggtgttgtgtatgagaccctgcatctgagtgcacttccaaactacaccaccggtggaacaattcatcttgtggtcaataatcaggttgcattcactactgatccgatgtcagggagatcttcacagtattgtacagatgtagccaaagcattggatgctccaattttccatgtgaacggtgacgacttggaggctgtggttcatacttgtgaacttgctgcggagtggaggcaaacatttcattctgatgtagtggtggatattgtatgctaccgtcgatttgggcataatgagattgacgagccctccttcacccagcctaaaatgtacaaggtgattaggaaccacccaagtgcgcttgagatatatcaaaaccagctgttagaatcggggaagatctccaaggaagatattgacaagatacacaagaaggtcagcaccatactgaatgaggaattcaaaaagagcaaagacgatatccccaacaagagggactggctttcagcttactggactgggtttaagtccccagaacagatttcacgtatccgaaacaccggtgtcaagccagagattctaaaacgtgttggtgaagccatgacaacactgccagaaactttcaaacctcacagggctgtcaagaagatttttgatctgcgtcgccaaatgattgagactggggaaggcattgactgggcagtgggtgaagcacttgcttttgcaactcttataattgaggggaaccatgtcaggttaagtggccaggatgttgagagaggtacattcagccaccgccattctgtcatccatgaccaagaaactggagagcagtactgcccacttgataatcttgtcatgaaccagaatgaggaactatttactgtaagcaacagttccctgtcagaatttgctgttctgggctttgagttgggttattcaatggagaacccaaactcactggttttatgggaagcacagtttggtgatttttcaaatggggctcaagtgatatttgatcagttcattagtagcggagaggcaaaatggctccgccagactgggcttgttgtctgccttcctcatggatatgacggtcaagggcctgaacattctagtgcgagaatggagcgcttccttcagatgagtgatgataacccctatgttatacctgagatggatccaacactgaggaagcaaatccaggagtgcaactggcaggtcgtgaatgtcacaactcctgcaaactatttccatgtgctgcgtcgccagatacaccgggatttcagaaagcctttaattgtgatgtctccaaagaatctccttcgtcacaaggactgcaaatccagtctatctgaattcgatgatcttgctggtcaccctggatttgataagcaagggacacgcttcaagcgtctaataaaagaccggaatgaccataaggaccttgaggaaggaatcagacgtctagttctttgttctggaaaggtgtactatgaattggatgaagaaagaaagaagtcggattccaatgatgtcgcgatatgtagagttgagcagctctgtccattcccctacgacctcattcagcgtgagctgaagagatatccaaatgccgagattgtttggtgccaagaagaaccgatgaacatgggggcgtatacctacatcaatcctcgcctgctgaccgcgatgagggcgctcggtcgtggcagcatagatgatatcaagtatgtcggaagggccccatctgcagccacagctacaggtttctatactgtccatgtgcaggagcaaaccgagctcgtgaagaaggcgctgcagcgagaccccatcaagtctccgctctgaacatgtagattctttgcatagccatcagaacttctgatctcctaccatgcagaaaaacaacaggtctaaattacacctcttcagccatttggtgaataatcgttacgcatgtgtggtaccgcacattagaaacggtctgaggtccattttgagtgcataattttttcccgtcaaagcttttttgtctacatccttctgtttttctgggtgctaaggttaaacaagctgtatccagttctccctttgccaataaagaagtgtacccagtactgatgtatgtatgtcctacgagacggtccgtccctactgctgtgcctagcatatgattccagtctgtctctctgaaatacttggaaagaa

SEQ ID NO: 1759 - DNA, 3847 bp, Eucalyptus grandis
aaattgggggacgcagagaacctgcgagaagagaaaaagcgaaagccgatattcggaagcagcggaggggaaggaaaggaaggaagcgaagagggaggggcgcggcagcacaagagcggcgtctagggttcgcgtgtcgatccgggccatttcgcttcgctctcggattctcgatgattgtagtttgagctcgggtgttgccatctctggtttcctagtcagttggtcagatcaaaatggtgtggtttagggcaagttccagtgcagcaaagcttgttgtcaggagagctctctctcaaagtagatcctatgtgactagatcacgaattcttccatcacaagagcgatgttttcatgctacagcttttagaccaaaggcacaggctgctcctgtccctcgccctgttccactctcaaggcttaccgatagcttcttggatgggacaagtagtgtttacttggaagagcttcaaagggcatgggaggctgacccaaatagcgttgatgaatcatgggacaatttttttagaaactttgtgggtcaagcagcgacatctcccggcatttcagggcagacaatccaagagagcatgcgtctgttgttatttgtgagggcttaccaagtgaatggtcatatgaaagccaaattggatcctctgggtttggaggaaagagaaattccatctgatttggaccctgctctttacgggttcactgaagctgatctagacagagaatttttcataggggtatggaggatggctggtttcttgtctgagaaccgaccagtccaaacactaagatccattttaaccaggcttgagcaggcttactgtgggagcattggatatgagtatatgcacattgctgaccgtgaaaaatgcaactggttgagagataagattgaaacaccaacacctatgcagtacaatcgccaacgtcgggaagttattcttgataggcttatatggagcacacaatttgaaaacttcttggccaccaagtggacaacagccaaaaggttcggtcttgaaggtggtgaaactctgattcctgggatgaaggaaatgtttgataggtcagcagatcttggggttgagagcatcgtcattggaatgcctcacagaggtagattaaatgttctagggaatgttgttcgaaaaccactccgacaaatatttagcgagttcagtggcggtacaaaaccagtggatgaagttgggctttacacaggtactggtgatgtgaagtaccacctgggtacttcctatgatagaccaactcggggtgggaaaagaatacatttgtcattggtggcaaatccaagtcacttggaagctgtggacccagtggtggttggtaaaactagggccaagcagtattactcaaatgatgtcgagagaacaaagaatatgggtattctgattcatggtgatggtagctttgctggacagggtgtggtgtatgagactctacatcttagcgcccttccaaattataccactggtgggacaatacatatagtcgtaaacaaccaggttgcctttaccactgacccgagggctggtcgatcatctcagtactgtactgatgttgctaaggcattgaatgcccccatatttcacgtgaatggtgatgatgtggaagctgttgttcatgtctgtgagcttgcagctgagtggcgacagacttttcattcagatgtggtggttgatttagtgtgttatcgtcggtttggacacaatgagattgatgaaccgtctttcactcagccaaaaatgtataaggttattcgaaatcatccttctgctcttgaaatctatcgaaagagactcttagagtctgggcaggttaccaaagaggacattgagaagatacaaagcaaggttaatacaatactcaatgaagaattccttgctagcaaagattatgttccccaaaggagggactggctttcatctcactggtctgggtttaaatcacctgaacagctttctcgcatccggaatactggtgtgaagccagagattctgaaaaatgttggcaaagcaattacaactctgcctgaaacctttaagccccacagagcagtgaagaaggtctatgatcaacgagcccagatgattgaaactggggaaggtattgattgggcagtggcagaagcacttgcttttgccacactactcgtagaaggtaaccatgttaggttgagcggtcaggatgtcgaaagaggtacctttagtcatcggcattcagtacttcatgatcaggaaactggggagcagtactgccctcttgaccatgtgatgatgaatcaaaatgaggaaatgtttacagttagtaacagctcactctctgagtttgctgttcttgggtttgaattgggctactctatggaaaatccaaattccctagtactatgggaagctcaatttggtgactttgccaatggagctcaagtaatttttgaccagtttttgagtagtggggagtctaagtggctacgacaaactgggcttgtcgtgctgcttcctcacggttatgatggccagggccctgaacattcaagtgcacgtttggagcgtttccttcagatgagtgatgacaacccatatgcgataccagagatggagccaactctccgaaagcagattcaggaatgcaattggcaggttgtgaacaccacaactcccgctaattacttccatgtcttgcggagacagattaacagagaattccgtaaacctctcatcgtaatggctcctaagaacttgcttcggcataaggattgcaaatcaaatctatccgagtttgatgatgtacaaggacatccaggttttgacaaacagggcactagattcaagcgcctcattaaggaccagaatgatcactcagatcttgaggagggcatcagaagactggttctttgctctggaaaggtttactatgagcttgatgaggagcgtaagaaggttggcggaaaggacgttgcaatttgtagggtggaacagctgtgccccttcccatatgatctcgtccaacgagagttgaagcgatatccaaatgcggaaatagtctggtgccaggaagagcctatgaacatgggtgcttacagctacgttgcaccccgtctctcgactgcaatgaaagcactgggccgaggaactttcgaggatatcaaatacgttggccgtgctccatctgctgccacagccactggattctatcaggtgcatgttaaggaacacaccgagctcgtgcagaaagccctgcaacctgaaccgataaactatccattttaaagcttgttctacaggagagcgggggactagcaaagaagagtttgtgatgaaaggtatagaaactctcttttaatttcttatacttgaaaatttgttctatttgctattttcttcctgatatgcctgttgtgggcgccttgatatttccggacaagcttgtctccattggagttttttatgcttgttctatgtactgcgaaaaaagcggtgttgaaataaaactgagataaagctgccatcactccattgagctgcattatgttgcaattgtctttgttcaacgctccattgagatgcattatgttgctaatttttctattatttaagtcaagataaagtgcaaaatctctctcaagcaagagatcagggctgtgttttgtaatactgtatctcagtttgttgctttttcttaaaaatatatttggcaagatcctaatcaccataaattattactctgttcaacaaatttagttaccttttccttactagataaagtggtgtgtggacttgattatatcattttaagcaatccaatataaggtcat

SEQ ID NO: 1760 - DNA, 3487 bp, Secale cereale
tggaacccgctccaggcattcttccaccgaagaatcgggacgatttcttttttttccgcggctagatttggcgtcgggagtggaaattcgatctgaaaatggggctgttccgggccgcgtcgggtttagcccgggtggcgctgcggaggagcctgtcgcgcgctccggcgagcccgttcgccggccccgcgccgcggtacttccactcgtcgctcccccggcggtacgcggcgcctgagccccgcgccgtgccgctctcgcgcctcaccgacagcttcctcgatggcaccagcagcgtgtacctcgaggagctgcagcgggcgtgggaggcggacccgacctccgtcgacgagtcctgggacaacttcttccggaactttgtcgggcaggccgccacgtcccccggcatatccggccagacgatccaggagagcatgaggctgctgctgctcgtgcgcgcctaccaggtgagcggccacatgaaggccaagctcgatcctcttgggctggagcagcgcccggttccggatgtcctggacccggcgttctacggcttctctgagtctgatttggatcgggagttcttcctcggggtgtggaggatggctgggttcttgtcggagaatcggcctgtgcagacacttcgttctgtgttgggacgcttggagcaggcctactgtggcaccattggttacgagtacatgcacatacctgaccgcgaaaagtgcaactggctgagggagaggatcgagacagttaacccaagggagtacacctatgatcgtcgccaggtcatgctcgataggctcatctggagtacccagtttgagaatttcttggcacagaagtggaccactgcaaagcgattcggcctcgaaggcgccgagacactgattcctggtatgaaggagatgtttgacagggcagctgatcttggtgtagagagtattgtcattgggatgccacacagaggcaggctcaatgtcttgggaaatgtcgtacgtaagcccttgcgacagatcttcagcgagtttagtggtggtaccaagcctgtcaatgagggggagggtttgtatacagggacaggcgatgtcaagtaccatctaggaacttcatatgataggcctaccagaggtgggaaacatatccatctatcgttggttgcaaatccaagtcatttggaagcagtcgatcctgttgttgctgggaagaccagagcaaagcagtactattctaatgatcttgacaggaccaagaatctaggggtgctattgcatggtgatggaagcttctcagggcagggtgttgtgtatgagaccctccatctgagtgcacttccaaactacaccaccggtgggacaattcatcttgtggtcaataatcaggttgcattcactactgatccgatgtcagggaggtcttcacagtattgtacagatgtagccaaagcattggatgctccaattttccatgtgaacggtgacgacttggaggctgtggttcatacttgtgaacttgctgcggagtggaggcaaacatttcattctgatgttgtggtggatattgtatgctaccgtcgatttgggcataatgagattgacgagccctccttcacccagcctaaaatgtacaaggtgattaggaaccacccaagtgcgcttgagatatatcaaaaccagctgttagaatcagggaagatctccaaggaagatattgacaagatacacaagaaggttagcaccatactgaatgaggaattcaaaaagagcaaagatgatatccccaacaagagggactggctttcagcttactggactgggtttaagtccccagaacagatttcacgtatccgaaacaccggtgtcaagccagagattctaaaacgtgttggtgaagccatgacaacactcccagaaactttcaaacctcacagggctgtcaagaagatttttgatctgcgtcgccaaatgattgagactggggaaggcattgactgggcagtgggtgaagcacttgcttttgcaactcttataattgaggggaaccatgtcaggttaagtggccaggatgttgagagaggtacattcagccaccgccattctgtcatccatgaccaagaaactggagagcagtactgcccacttgataatcttgtcatgaaccagaatgaggaactatttactgtaagcaacagttccctgtcagaatttgctgttctggggtttgagcttggttattcaatggagaacccaaactcacttgttttatgggaagcacagtttggtgatttttcaaatggggctcaagtgatatttgatcagttcattagtagcggagaggcaaaatggctccgccagaccgggcttgttgtctgccttcctcatggatatgacggtcaagggcctgaacattctagtgcgagaatggagcgcttccttcagatgagtgatgataacccctatgttatacctgagatggatccaacactgaggaagcaaatccaggagtgcaactggcaggtcgtgaatgtcacaactcctgcaaactatttccatgtgctgcgtcgccagatacaccgggatttcagaaagcctttaattgtgatgtctccaaagaatctccttcgtcacaaggactgcaaatccagtctatctgaattcgatgaccttgctggtcaccctggatttgataagcaagggacacgcttcaagcgtctaataaaagaccggaatgaccataaggaccttgaggaaggaatcagacgtctagttctttgttctggaaaggtgtactatgaattggatgaagaaagaaagaagtcggattccaatgatgtcgcgatatgtagagttgagcagctctgtccattcccctacgacctcatccagcgtgagctgaagagatatccaaatgccgagattgtttggtgccaagaagaaccgatgaacatgggggcgtattcctacatcaatcctcgcctgctgaccgcgatgagggcgctcggtcgtggcagcatagatgatatcaagtacgccggaagggccccatctgcagccacagctacaggtttctatactgtccatgtgcaggagcaaaccgagctcgtgaagaaggcgctgcagcgagaccccatcaagtctccgttctgaacatgtagattctttgcatagccatcagaacttctgatctcctaccatgcagaaaaacaacaggtctaaattacacctcttcagccatttggcgaataatcgttacgcatgtgtggtaccgcacattagaaacggtctgaggtctattttgagtgcataattttttcccgtcagagctttttttgcctacatccttttgtttttctgggtgctaaggttaagcaagctgtatccagttctccctttgccaataaagaactgtacccagtactgatgtatgtatgtcctactagacggtacatccctactgctcctactgctgtacctagcatatgatt

SEQ ID NO: 1761 - DNA, 3588 bp, Brachypodium distachyon
tctctcttcctgcgacggaattctccaatccgtcctctttttcttttgcggctaggtttggcgttgagaggggaaattcgatccggaaatggggtggttccgggccgcgtcgggtttagcccgggtggcgctgcgaaggaacctgtctcgtgtcccggcgagcccgttcgccggccccgcgccgcggtacttccactcgacgcgtccccggcgattcgctgcgccagagccccgcgccgtgccgctgtcgcgcctcaccgacagcttcctcgatgggacgagcagcgtgtacctcgaggagctgcagcgggcgtgggaggctgaccccagctccgttgatgagtcgtgggacaacttcttccgcaactttgtcgggcaggccgccacctctcctggtatatccgggcagacgatccaggagagcatgaggctgctgctgctcgtgagggcgtaccaagtgagtgggcacatgaaggcgaagctcgatcctcttgggctggaggagcgaccggttccagatgttctggacccggcattctacgggttctctgaggatgatttggatcgggagttcttccttggggtttggaagatggctggtttcttgtcggagaatcgccctgtgcaaacacttcgttctgttgttgaacgtctggagcaggcgtactgtggcaccatcggttacgagtacatgcacatacctgatcgcgaaaagtgcaactggctgagggagaggatcgagacagttaaccccagggagtacacctatgatcgtcgccaggtcatgctagataggcttatctggagcacacagtttgagaatttcttggcacagaagtggacaactgcaaaacggttcggcctcgaaggtgccgagacactgattcctggcatgaaggagatgtttgacagggcagctgatcttggtgtcgagagtattgtcatagggatgcctcacaggggcaggctgaatgtcttgggaaacgtcgtgcggaagcccttgcgacagatcttcagcgagtttagcggcggcaccaagcctgtcaatgaaggggagggcttgtatacagggactggcgatgttaagtaccatctaggtacttcatacgataggcctaccaggggcgggaaacatatccatctatcattggttgcaaatccaagtcacttggaagctgtcgatccggttgttgccggaaagaccagagcaaaacagtactattctaatgatcttgacaggaccaagaatcttggggtgctgttgcatggtgacggaagcttctcagggcagggtgttgtattcgagacccttcatctcagtgcccttccgaactacaccactggtgggacaattcatattgtggtcaataatcaggttgccttcaccactgatccaatgtcagggagatcttcacagtattgcacggatgttgccaaagcattggatgctccaattttccatgtgaatggtgatgacttggaggcagtggttcacacgtgtgagcttgctgccgagtggaggcaaacatttcattctgatgtagtcgtggatattgtgtgctaccgtcgtttcgggcataatgagattgatgagccctccttcacccagcctaaaatgtataagattattaggaaccatccaagtgcgcttgagatatatcaaaaacaactattagaatccgggaagctctccaaggaagacattgacaagctacacaagaaggtcagcaccatactgaatgaggaattccaaaaaagcaaagacgatatccccaacaagagggattggctttcagcttactggactggatttaagtccccagaacagatttcacgtatacgaaataccggtgtcaagccagagattctaaaacgtgttggagaagccatgaccactctgccagaaactttcaagcctcacagggctgtcaagaagatttttgatctgcgtcgccagatgattgagactggtgaaggcattgactgggcagtgggtgaagcacttgcttttgcaactcttatagttgaggggaaccatgtcaggttaagtggccaggatgttgagaggggtacattcagccaccgccattctgtcattcatgaccaggaaactggagagcagtactgcccgcttgataatctggtcatgaaccaaaatgaggaactatttactgtaagcaacagctccctgtcagaattcgctgttcttggctttgagttgggttattcaatggagaacccaaattcacttgtcttatgggaagcccagtttggtgatttttcaaatggagctcaagtgatatttgatcagttcattagtagtggggaggcgaaatggctccgtcagaccggactagtcgtttgccttcctcatggatatgatggtcaggggcctgaacactctagtgcaagaatggagcgcttccttcagatgagtgatgataacccttatgtgattcctgagatggatccaacactgaggaagcaaatccagcagtgcaattggcaggttgtgaatgtcacgactcctgcaaactatttccatgttctgcgtcgccagatacaccgtgacttccgaaagcctttaattgtgatgtctccaaagaatctccttcgtcacaaggaatgcaaatccagtctgtctgaattcgatgatcttgctggccaccctggatttgataagcaagggacacgtttcaagcgtctgataaaagaccggaacgaccataaggaccttgaggagggaatcaaccgtttagttctttgttctggaaaggtgtactatgaattggatgaagaaagaaagaaattggatcgcaatgatgttgctatatgtagagttgaacagctctgtccattcccgtacgacctcattcagcgcgagttgaagagatatccaaatgcagagattgtttggtgccaggaagaaccgatgaacatgggggcatacacctacatcaaccctcgattgcttaccgcgatgaaagcgctcagccgaggcagtatagaggatatcaagtacgtgggaagggccccatctgcagccactgctacaggtttctattccgtccatgtgcaggaacaaaccgagctcgtgcagaaggcactgcagaaagaccctatcaagggtccgttttgaacctgtgtagatacttcgagtaaatatcagaattctcttcagtttggtgaataatcctttcggatatatggtaccgtacgttagaaacggtctgaggtccatcttggatgggttttttttttgcatcaaagctttttctatacaaccgtttgtgtttgtcaatgcagctaagcaagctgtatccagtttgtcataaaagggtggtcatgatcaaaatgccatactgatgtatattgctgtgacacatttctattgctgtgcaaagcacatgatttctgtctgtctctgcaaacactggagcccgttattatgatgttctctggaagtgaaccggcgacattgcctgacagtactgttatctcccgggccaattatgtgacacattcatctgtcacttgacaagcattttacaggcatcttttgttacaactgtttctgaactcaatcct

SEQ ID NO: 1762 - DNA, 3724 bp, Sorghum bicolor
tcaccctatcccatcccatctctccgaatctttcggcatcggcaccggcaccggcgagagaagagaaggggcgacccaggcgggccaacgcgcaccctagcactttatcatcatcaaggggtagacggccctcgaagcgcacccgtccggaccgaccccatcctcctttcccgaacaaccggagcgcggcggcgcggcgcgagacccttccccgccccagtccgccgactactcgcccaggagggacttgcgatcgatcgcgtgcccgccgactgatgggaggctagattccggcaatcaacctttgcggctgatttttggtgaagcgacctcgatctgaaaaatggggctgttccgggcggcgtccggcctggcccgtgtggcgctgcggcggaacctctcgcgcgccgcggcgagccccttcgccggcggcggtggcgccgtccctcgtgccgcgccggcgcgctacttccactccacccgcccgcgctggttcgctgcgcctgagccccgtgcggtgccgctctcgcgtctcaccgacagcttcctcgatgggaccagcagcgtctaccttgaggagctgcagcgggcctgggaggccgaccccaactccgtcgacgagtcctgggacaacttcttccgcaacttcgtcggccaggctgcggccacctcaccgggcctctccggccagaccatccaggagagcatgaggctgctgctgcttgtcagggcgtatcaggtgagtggccacctgaaagccaagctcgacccgctcgggctggaggagcgcccggtcccagacgtgctggacccagcgttctatgggttctctgaggctgacttggaccgcgagttcttccttggggtgtggaggatggctgggttccttgaggagaaccggccagtgcagacgctgcgttccgtgctggagcggctcgagcaggcctactgcggcaccattgggtatgagtacatgcacatacctgacagggagaagtgcaactggctcagggataggatcgagacagttaacccaagggagtactcttatgatcgtcgtcaggtcatgctggataggcttatctggagcacacagtttgagaatttcttggctaccaagtggacgactgcaaaacggttcggtcttgaaggcgctgagactctgatccctggcatgaaggagatgtttgacagggcagctgatcttggtgtagagagtattgtcattgggatgccacatagaggcaggttaaatgtcttgggaaacgttgtgaggaagcccttgcgacagatattcagcgagtttagtggtggtaccaagcctgtcaatgaaggggaggggttgtatacagggactggtgatgtcaagtaccatcttggaacttcatatgataggcctaccagaggtgggaaacaaatccatctgtcactggttgcaaacccgagtcatttggaagcagttgatccagttgttgctgggaagacaagagcgaagcagtactattctaatgaccgcgacaggaccaagaatttgggagtgttgctgcatggtgatggtagtttctcagggcagggagttgtgtatgagacactgcatctcagtgcccttgaaaattacaccactggtgggacaatacatattgtggtcaataatcaggttgctttcactactgatccaaagtcagggagatcctcgcagtattgcacagacgtagcaaaagcattggatgctcctattttccatgttaacggtgatgatttggaggccgttgttcatgtctgtgagctcgctgcagaatggcgacagacatttcattcagatgtagtggtggacattgtatgctaccggcgatttggccataatgaaattgatgagccgtccttcacccaacctaagatgtacaaggtgattaggaaccatccaagtgcgcttgagatttatcaaagaaagttgttggagtctgggaagatctcaaaggaagatattgataagttaaacaagaaggtcagcactatacttaacgaggaattccagaatagcaaagactatgttcccaacaagagggactggctttcagcttactggactgggttcaagtcaccagagcagatttcgcgtatccgaaacaccggtgtcaagccagagattctaaaacgtgttggagaagccatgactactctgccagaaaattttaagcctcacagggctgtgaagaagatttttgatctgcggcgtcagatgattgagactggagaaggcattgattgggcagttggtgaagcactcgcttttgctactcttataattgaggggaaccatgtcaggttaagtggacaggatgttgagaggggtacattcagccaccgtcattctgtcatccatgaccaagaaactggagagcagtactaccctctggatcatcttgttatgaatcaagatgaggagctttttactgtgagcaacagttccctgtcagaatttgctgttttgggctttgaattgggttactccatggagaacccgaactcattggtcatatgggaagctcagtttggtgattttgcaaatggagctcaagtgatatttgatcagttcctgagtagtggggagtcaaaatggctccgccagactggccttgtcgtttgccttcctcatggatatgatggtcaggggcctgaacattctagtgcaagattggagcgctttcttcagatgagtgatgacaacccttatgttatacctgagatggatccaacactgcggaagcaaatccaggagtgcaattggcaggtcgttaatgtaacgactcctgcgaattatttccatgttctgcgtcgccagatacaccgggacttcaggaagcctttgattgtgatgtccccaaagaacctccttcgccacaaggactgcaagtcaaacctatctgaatttgatgatcttgcgggccaccctggattcgacaagcaagggacacgcttcaagcggctcattaaggaccagaataatcacaaggaccttgaggagggaatcaaccgtctagttctttgctctgggaaggtgtattatgaactggatgaagaaagaaggaaggcagagcgcactgatgttgctatatgtagagttgagcagctctgcccgttcccctatgacctcattcagcgcgagttgaagagatatccaaatgctgagatcgtgtggtgccaggaggagccgatgaacatgggagcgtacagctacatcaacccgcggctgctgacggcgatgaaggctcttggccgtggtggcatcgaggacatcaagtacgtcggcagggccccttcggctgctaccgcgacgggcttctactctgtgcacgtgcaggagcagacggagctggtgaagaaggcgctgcagcgcgaccccatcaactacccgttctgaaagaaacgagaccccctgtagattctaatcggggaccttttgattttgatatacctctatagagagagcaggccttaagttatacagtacctgtgcagccatttggtgaaataatcatttcggactctacagtgccgcatttgaaaggaacggttgtaagtttggaaaaactccatctcgcagcgtcatttttgtgttcgtgtatgctgaaaagcttgcatggctgaaagcctgaaacaccgactgccggaattttcttgtgatgaattgcaaagtgtataaaggcaatgaacaggtatgcca

SEQ ID NO: 1763 - DNA, 3428 bp, Avena sativa
cgcgcggcgtcatctctccaccgagtggagatccgtctggaattggatcgatttcttccatttggcgtcgggagagggaattcgatctgaaaaatggggtggttccgtgccgcgtcgggcatagcccgggtggcgctgcggaggaacctgacgcgtgctccggcggctccattcgccgcccccgcgcgccggtacctccactcgacgatcccccggcggtacgccgcgccagagccccgcgccgtgccgctctcgcgcctcaccgacagcttcctcgatgggaccagcagcgtctacctcgaggagctgcagcgggcctgggaggcggacccgacctccgtcgacgagtcctgggacaacttcttccgcaacttcgttggccaggccgccacctcccccggcatatccggccagacgatccaggagagcatgaggctgctgctcctcgtgcgggcgtaccaggtgagcggccacatgaaggccaagctcgatcctcttggcctggaggagcgcccggttccggatgttctcgaccccgccttctacggcttctctgaggccgatttggatcgggagttcttcctcggtgtctggaggatggctggcttcctgtcggagaatcggcctgtgcagacgcttcgttctgtggtgggacgtcttgagcaggcatactgtggcaccatcggttacgagtacatgcacatacctgaccgcgaaaagtgtaactggctcagggagaggatcgagacggttaacccaaaggagtacacctatgatcgtcgccaggtcatgcttgataggctcatctggagcacgcagtttgagaatttcttggcacagaaatggaccaccgccaagcgattcggtctcgaaggtgcagagacattgattcctggtatgaaggagatgtttgacagggcagctgatatgggtgtagagagtattgtcattgggatgccacacagaggcaggctgaatgtcttgggaaatgtcgtacggaagcccttacgtcagatcttcagtgagttcagcggtggtaccaagccggtcaatggagggggagggtttgtatacagggaccggagatgtcaagtaccatctaggaacttcatatgataggcctactaggggtgggaaacatatccatctgtcgttggttgcaaatccaagccacttggaagcagtggatcctgttgttgccgggaagaccagagcaaaacagtattactctaatgatcttgacaggaccaagaatctcggggtgctgttgcatggtgatggaagcttctcagggcagggtgttgtgtacgagaccttgcatctcagtgcccttccaaactacaccaccggtgggacaattcatcttgtcgtaaataatcaggttgcattcactactgacccaatgtcggggaggtcttcacagtattgcacagatgtagccaaagcattggatgttccaattttccatgtgaacggtgatgatttggaggcagtggttcgtacatgtgagcttgctgcggagtggaggcaaacatttcattctgatgtggtggtggatattgtatgctaccgtcggttcgggcataatgagattgatgagccctccttcactcagcctaaaatgtacaaggtaattaggaaccatccaagtgcgcttgagttatatcaaaaccagctgttagaatcggggaagatctccagggaagacatcgacaagttacacaagaaggtcagcacaatactgaatgaggaattcaaaaagagcaaagatgatatccccaacaagagggattggctttcagcttactggactgggtttaagtccccagaacagatttcacgtatccgaaacaccggtgtcaagccagagattctaaaacgtgttggagaagccatgacaactctgccagaaactttcaagccccacagggctgtgaagaagatttttgatctgcgccgccaaatgattgagactggggaaggcattgattgggcagtgggtgaagcacttgcttttgcaactcttataattgaggggaaccatgttaggttaagtggccaggatgttgagaggggtactttcagccaccgccattctgtcatccatgaccaggaaactggagatcagtactgtccacttgatcatcttgtcatgaaccaaaacgaggaactatttactgtaagcaacagttccctgtcagaatttgccgttctgggctttgagttgggctattcaatggagaacccgaactcactggttctatgggaagcacagtttggtgatttttcaaatggagctcaagtgatatttgatcagttcattagtagcggggaggcaaaatggctccgccagactggacttgttgtttgccttcctcatggatatgacggtcaggggcctgaacattctagtgcaagaatggagcgcttccttcagatgagtgatgataacccttatgttatacctgaaatggatccaacaatgaggaatcaaatccagcagtgcaactggcaggttgtgaatgtcacaactcctgcaaactatttccatgttctgcgtcggcagatacaccgcgatttcagaaagcctttaattgtgatgtctccgaagaacctccttcgtcacaaggactgcaaatccagtctatctgaatttgatgaccttgccggccaccctggatttgataagcaagggacgcgcttcaagcgtctaataaaggaccggaatgaccataaggatctcgaggaaggaatcagacgtctagttctttgttctggaaaggtgtactatgaattggatgaagaaagaaagaaatcggatcacaatgatgttgctatatgtagagtcgaacagctctgcccattcccatatgacctcattcagcgcgagttgaagagatatccaaatgctgagattgtttggtgccaagaagaaccgatgaacatgggggcgtacacctacatcaatcctcgcctgctgactgcgatgagggcgcttggtcgtggctccatagaggacatcaagtacgtcggaagggccccgtctgcagccacagctacaggtttctataccgtccatgtccaggagcaaactgagctggtgaagaaggcgctgcagcaagaccccatcaactccctgttctgaacgtgtagattctttgaatagacatctaaacctctgatactaccgtacacaaaagcaggtctagatttcacctgtgcagccatttggtgaataatctgtctcggatttttgttgagacaatcgtctcggatgtgtgtcaccgcccgttagaaacggtccaaggtcttgtgagtgcatttttttctctgtcgaagcttttggtctacaccctttttgtgtttttgagtggtataaggtaaacatgctccatccgaggtccttccttatcaataaagaactgtat

SEQ ID NO: 1764 - DNA, 3652 bp, Ricinus communis
ggaaaaaagaaggaaagaataagataaaagagctcacaacggttagatttaagacagtcgccaccgcatcgcttatcagcgattaggtttttttttttctttctttctttctttctaccattctctctttctctcactctctccgttctgaccggtcttaaatttctttagaagaaaatacatgcatctatgtttgaggattgatcaggggaggtataatttttgacaaattggcgaattttagttagtgtgctctgatagctatggcatggtttagagctggtgctagtgtggcaaggcttgccattagaaggactttatctcagagtggatcatacacagttagaacaagagttgttccttctcagaatagatatttccataccactgtctttaagtcgaaggcgcaggcagcacctgtccctcgtcccgtgcccctctctaggttaaccgatagcttcttagatggaaccagtagtgtttacttggaggagctacagcgtgcttgggaagccgaccccagtagtgtggacgagtcatgggacaatttcttcaggaattttgtcggccaggcagccacatcgcctggaatttcaggtcagacaattcaggagagtatgcgtttgctgttgcttgtgagggcttaccaggttaatggtcatatgaaggctaagttggacccattggggttggaagaaagagaaattccagaggatttggatccagctctttatgggttcgcagaagctgaccttgatagagaattcttcttgggagtgtggagaatgtctgggtttttgtctgaaaaccgtccagtgcagactcttaggtccatattgacgcgcttggagcaggcatattgtgggagcattggctacgagtatatgcacattgcagatcgtgataaatgtaactggttgagagacaagatcgaaaccccgactcctatgcaatacaatcgtcagcgtcgtgaagttattcttgataggctaatatggagtacgcaatttgagaacttcttggccaccaagtggactacagctaagaggtttgggcttgaaggtggggagactctgattcctggcatgaaggagatgtttgataggtcagcagatctcggggttgagagcatagttattggaatgcctcatagaggaagattaaatgttcttggtaatgttgttcggaagccactacgtcaaatatttagtgagttcagtggcggcacaaagcctgtagatgaagttggtctctacacaggaactggtgatgtcaagtatcacttgggaacttcttatgatcgtccaaccagaggtgggaagagaattcatttgtctttggtggcaaatcctagtcacttggaagctgtagatcctgttgttgttggaaagactagagctaaacaatattactccaatgatgaggataggataaaaaatatgggaattttgattcatggtgatggtagttttgctggacaaggtgtagtctacgaaactctacatcttagtgcactgccgaactactcgactggtgggactatacacattgtggtgaataaccaagttgcttttaccactgatccaacggcaggcagatcttcacagtattgcactgatgttgccaaggctttaaatgcccctattttccatgtaaatggagatgatgtagaggcagttgttcatgcctgtgaacttgcagctgagtggcgccagactttccattcggatgttgtggttgatttagtctgttaccgtcgatttggacataatgagattgatgaaccatctttcacacagcccaaaatgtatcaggtcatccgaaatcatccctcatcccttcagatttacaaaaacaagctcttagaatctggacaggtgggtgaagaggatattagcagaatacaagagaaggtcattacaatcctcaatgaagaattcttggccagcaaagattatgttcctaaaagaagagattggctttcatctcactgggctgggtttaagtcacctgaacagctttcacgtatcagaaataccggggtgcagcctgagatcttgaagaatgttggaaaagcaatcactactattccagataattttaagccacacagagctgtaaagaaggtttatgaacaacgtgcacaaatgattgaaactggggaaggaattgactgggcagttgcagaagctcttgctttcgccactttgcttgtggaaggtaatcatgtccgattgagtggtcaggatgttgaaagaggtacattcagtcaccggcattcagtaattcatgatcaagaaactggggagaagtattgccctctggatcatgttatcatgaaccaaaatgaggagatgtttaccgtcagtaacagttctctctcagagtttggtgttcttggatttgaattgggttactcaatggaaagtcccaattctctggtaatctgggaagctcagtttggtgacttttctaatggggctcaagtgatatttgatcagttcctgagtagtggagaatcaaagtggttgcgtcaaactgggcttgtggtgcttctaccacatggatatgatggtcagggtcctgaacattcaagtgcacgattggaacgcttccttcagatgagtgatgacaacccttgtgtgattcctgaaatggaaccaactctccggaagcagattcaggaatgtaactggcaggttgtaaatgttacaacccctgctaattacttccatgtcttgcgccgtcagctacacagggacttccggaagcccctcattgtgatggctcccaaaaacctacttcgtcacaaggactgcaaatcaaatttgtccgagtttgatgatgtccaaggccaccctggatttgacaaacagggaaccagatttaagcgtttgataaaggatcagaatgaccattctgatcttgaagagggtatcagacgtctggttctttgctctggaaaggtttattatgagctcgatgaagaacgcaaaaagattggtgccaaggacgttgccatatgtagggtggagcagctgtgtccattcccctacgatctcatccagcgtgaactaaaacgatatccaaatgccgaaattgtttggtgccaggaagagccaatgaacatgggtgcatacaactatattgcaccccgcctttgcactgccatgaaagcactggaaagaggatctgtagaggatatcaagtatgttgggcgtgctccatctgctgcaacagccactggtttctaccaggtgcatgtgaaggagcagagcgagcttgtgcaaaaagccatgcaaccggagccaatacattatcccttttgaagcccttgcacattgttaaatacaaattttaatgaacaataatgccacatcactagatacatctctttttgaggaggctggatattgtttacaaatgttcttctttcatacatttcatttagccaaggaatcatcttggtacacttctatacaagcggtttcgcacttttgaggtataatgtgatgcactagtcaagtgtttgtctttgtatcggatttgagaggtaatagatggacaattggcttccgccttttgtttttacttttttgaaattatgaactttatttatttcatttcaatatcatgtcctttttcagtaagc

SEQ ID NO: 1765 - DNA, 3702 bp, Setaria italica
ccaccccccgcctccgcccttatcatcacgggagaggcgggctctcgaaccgacccgtccccatccaccccttcccgaaccaccggagcgcgccggcgcggcgcggcgcgagaaaccttccccggcttccgcttcccgtcctcagcccggccccgcccgcccactggggagagcgtgcctccgatcgcgtgcgcggcggctgatgggaggctagattccgggaaggagaaagcagtccacacccaggtacacgtcctcacgaggtagattttgttaagcgaagctcgatctgagaatggggctgttccgggcggcgtccggcctggcccgggtggcgctgcggcggaacctcgcgcgcgccgcggggaaccccttcgccggcggcgcggtccccggcgccgcgcccgcgcgctacttccactccacgcgcccgcgccggttcgccgcgccggcgccccgcgcggtgccgctctcgcgcctcaccgacagcttcctcgacgggaccagcagcgtctacctcgaggagctgcagcgggcgtgggaggccgaccccaactccgtcgacgagtcctgggacaacttcttccgcaacttcgtcggccaggcggccgccacctcgcccggcctctccgggcagaccatccaggagagcatgaggctgctgctgctcgtcagggcgtaccaggtgagcggccacttaaaggccaagctcgacccgctcgggctggaggagcgcccggtcccggacgtgctggacccggcgttctatgggttctccgaggcggatttggaccgcgagttcttcctaggggtgtggatgatggcggggttcttgtcggagaatcggcctgtgcagacgctgcgttccgtgctgaagcggctcgagcaggcctactgtggcacaattgggtatgagtacatgcacattccagaccatgacaagtgtaattggctcagggataagatcgagacggttaacccaagggagtacacctatgaccgtcgccaggtcatgctcgataggcttatctggagcacacagtttgagaatttcttggcgaccaagtggaccaccgcaaagcggttcggtcttgaaggtgcagagactctgatccctggcatgaaggagatgtttgacagggcagctgatcttggtgtagagagtattgtcattggtatgccacacagaggcaggctgaatgttttgggaaatgtcgtccggaagcccttgcgacagatcttcagtgagttcagtggtggtaccaagcctgttaatgaaggggaagggttgtatacagggactggtgatgtcaagtaccatctaggaacttcatatgataggcctaccaggggtgggaaacatattcatctgtcactggttgcaaacccgagtcatttggaagcagttgatcctgttgttgctgggaagacaagagcgaaacagtactattctaatgatcgtgacaggaccaagaatttgggggtattgctgcatggtgacggtagtttctcagggcagggcgttgtgtatgagaccctccatcttagtgcccttgaaaactacaccactggtgggacaatacatatcgtggtcaacaatcaggttgcgttcactactgatccaaggtcagggagatcctcacagtattgcacggatgttgccaaagcattggatgctccaattttccacgttaacggtgatgatttggaggccgtggttcatgtctgtgagcttgctgcagaatggcgacaaaaattccattccgatgtggtggtggacattgtatgctaccggcgatttggccataatgaaattgacgagccctccttcacccaacctaaaatgtacaaggtgatccggagccatccaagtgcgcttgagatttatcaaaataagctgttagaatctgggaagatctccaaggaagatattgacaggttaaacaagaaggtcagcacgatactgaatgaggaattcaagaacagcaaagactacgtccctaacaagagggactggctttcagcttactggactgggttcaagtcaccagagcagatttcacgtatcagaaacaccggtgtcaagccagagatcctaaaacgtgttggagaagccatgactactctgccagaaaacttcaagcctcacagggctgtgaagaagatttttgatcagcggcgtaagatgatcgagactggagaaggcattgattgggcagtgggtgaagcacttgcttttgctactcttatagttgaggggaaccatgtcaggttaagtggtcaggatgttgagaggggtacattcagccaccgtcattcggtcattcatgaccaggaaactggagagcagtactgcccgcttgataatcttgttatgaaccaagacgaggagctttttactgtgagcaacagttccctgtcagaatttgctgttttgggctttgagttgggttactccatggagaacccaaactcactggtcctatgggaagctcagtttggtgatttttcaaatggggcccaagtgatatttgatcagttcctgagtagtggggagtcaaaatggctccgccagactggccttgtcgtctgccttcctcatggatatgatggtcagggacctgaacattctagtgcaagactggagcgctttcttcagatgagtgatgacaacccttatgttatacccgagatggatccaacactgcggaagcaaatccagcagtgcaattggcaggttgtgaatgttacgactcctgcaaattacttccatgttctgcgtcgccagatacaccgggacttcaggaagcctttgattgtgatgtccccaaagaacctccttcgccacaaggactgcaaatcgaatctatctgagtttgatgatcttgcgggccaccctggttttgacaagcaagggacacgcttcaagcggctcataaaggaccagaacaatcacaaggaccttgaggagggaatcaaccgtctggttctttgctcaggaaaggtgtactatgaactggatgaagaaagaaggaagacggagcgcactgatgttgctatatgtagagttgaacagctctgcccattcccctacgacctcatccagcgcgagttgaagagatatccaaatgccgagattgtgtggtgccaggaggagccgatgaacatgggtgcatacagctacatcaacccgcggctgctgacggcgatgaaggcgctgggccggggcggcatcgaggacatcaagtacgtcggcagggccccgtcggcggccaccgcgacaggcttctactcggtgcacgtgcaggagcagacggagctggtgcagaaggcgctgcagcgcgaccccatcagctatccgttctgattctgatgaaagaaagaaaccccctgtagattcttggagtagccctggaattggagacctttctaattttgattccactagtaccatagagagagcaggtccgagttatacctgtgcagcagccatttggtgaagggaaataatttcgtttcggatgtacggtaccgcatgaaagaaaccgtttgaactcccgttttagcccgtgttttgatttgcatcccgtgtatttctgaatgctaaactggtatgtcttgttattagaggtaccgaaatttacttatgggtgaacattcatgtttttcttttgaatggcatgcatataggacaatacatcc

SEQ ID NO: 1766 - DNA, 3524 bp, Sorghum bicolor
catttttcggtgaagcgacctcgatctgaaaaatggggctgttccgggcggcgtccggcctggcccgtgtggcgctgcggcggaacctctcgcgcgccgcggcgagccccttcgccggcggcggtggcgccgtccctcgcgccgcgccggcgcgctacttccactccacccgcccgcgccggttcgctgcgcctgagccccgtgcggtgccgctctcgcgcctcaccgacagcttcctcgatgggaccagcagcatctacctcgaggagctgcagcgggcctgggaggccgaccccaactccgtcgacgagtcctgggacaacttcttccgcaacttcgttggccaggctgcggccacctcaccgggcctctccggccagaccatccaggagagcatgaggctgctgctgctcgtcagggcgtatcaggtgagcggccacctgaaggccaagcttgacccgctcgggctggaggagcgcccggtcccggacgtgctggacccagcgttttatgggttctctgaggcggacttggaccgcgagttcttccttggggtgtggaggatggctgggttccttgaggagaaccggccagtgcagacgctgcgttccgtgctggagcggctcgagcaggcctactgcggcaccattgggtacgagtacatgcacatacctgacagggagaagtgcaactggctcagggataggatcgagacagttaacccaagggagtactcttatgatcgtcgtcaggtcatgctggataggcttatctggagcacacagtttgagaatttcttggcgaccaagtggacgactgcaaaacggttcggtcttgaaggcgctgagactctgatccctggcatgaaggagatgtttgacagggcagctgatcttggtgtagagagtattgtcattgggatgccacatagaggcaggttaaatgtcttgggaaacgttgtgaggaagcccttgcgacagatattcagcgagtttagtggtggtaccaagcctgtcaatgaaggggaggggttgtatacagggactggtgatgtcaagtaccatcttggaacttcatatgataggcctaccagaggtgggaaacaaatccatctgtcactggttgcaaacccgagtcatttggaagcagttgatccagttgttgctgggaagacaagagcgaagcagtactattctaatgaccgcgacaggaccaagaatttgggagtgttgctgcatggtgatggtagtttctcagggcagggagttgtgtatgagacactgcatctcagtgcccttgaaaattacaccactggtgggacaatacatattgtggtcaataatcaggttgctttcactactgatccagagtcagggagatcctcgcagtattgcacagatgtagcaaaagcattggatgctcctattttccatgttaacggtgatgatttggaggccgttgttcatgtctgtgagctcgctgcagaatggcgacagacatttcattcagatgtagtggtggacattgtatgctaccggcgatttggccataatgaaattgatgagccgtccttcacccaacctaagatgtacaaggtgattaggaaccatccaagtgcgcttgagatttatcaaagaaagttgttggagtctgggaagatctcaaaggaagatattgataagttaaacaagaaggtcagcactatacttaacgaggaattccagaatagcaaagactacgttcccaacaagagggactggctttcagcttactggactgggttcaagtcaccagagcagatttcgcgtatccgaaacaccggtgtcaagccagagattctaaaacgtgttggagaagccatgactactctgccagaaaattttaagcctcacagggctgtgaagaagatttttgatctgcggcgtcagatgattgagactggagaaggcattgattgggcagttggtgaagcactcgcttttgctactcttataattgaggggaaccatgtcaggttaagtggacaggatgttgagaggggtacattcagccaccgtcattctgtcatccatgaccaagaaactggagagcagtactgccctctggatcatcttgttatgaatcaagatgaggagctttttactgtgagcaacagttccctgtcagaatttgctgttttgggctttgaattgggttactccatggagaacccgaactcattggtcatatgggaagctcagtttggtgattttgcaaatggagctcaagtgatatttgatcagttcctgagtagtggggagtcaaaatggctccgccagactggccttgtcgtttgccttcctcatggatatgatggtcaggggcctgaacattctagtgcaagattggagcgctttcttcagatgagtgatgacaacccttatgttatacctgagatggatccaacactgcggaagcaaatccaggagtgcaattggcaggtcgttaatgtaacgactcctgcgaattatttccatgttcttcgtcgccagatacaccgggacttcaggaagcctttgattgtgatgtccccaaagaacctccttcgccacaaggactgcaagtcaaacctatctgaatttgatgatcttgcgggccaccctggattcgacaagcaagggacacgcttcaagcggctcattaaggaccagaataatcacaaggaccttgaggagggaatcaaccgtctagttctttgctctgggaaggtgtattatgaactggatgaagaaagaaggaaggcagagcgcactgatgttgctatatgtagagttgagcagctctgcccgttcccctatgacctcattcagcgcgagttgaagagatatccaaatgctgagatcgtgtggtgccaggaggagccgatgaacatgggagcgtacagctacatcaacccgcggctgctgacggcgatgaaggctcttggccgtggtggcatcgaggacatcaagtacgtcggcagggccccttcggctgctaccgcgacgggcttctactctgtgcacgtgcaggagcagacggagctggtgcagaaggcgctgcagcgcgaccccatcaactacccgttctgaaagaaacgagaccccctgtagattcttggaattggggaccttttgattttgatatacctctatagagagagcaggccttaagttatacagtacctgtgcagccatttggtgaaataatcatttcggactctacagtgctgcatttgaaaggaacggttgtaagtttggaaaaactccatctcgcagcttcatttttgtgttcgtgtatgctgaaaagcttgcatggctgaaagcctgaaacaccgactgccggaaatttcttgtgatgaatgtataaaggcaatgaacaggtatgccattcatcttgcttttgaatgtcgtaactatttggctggctgaaaaaaagctgctgctaatgctgatttgttataagagaaaaacattgtttcatggctgctgttgattcagtctctt

SEQ ID NO: 1767 - DNA, 3765 bp, Amborella trichopoda
tttttgtgcgtttttgttgaatatctgtttaacatttgcaactaccaaggaatcagataaagatttaactgaaaataaggaaaaataattttttacaatgaaatatcagtggtttctgttgagaagagctgttattctgaattagaaatggattgagcggaaaaagaaggaaaaaattgtttttcctgttaacgttaatagttgatgtggttaataattgatgtcatctatgcttgcagaaaatgggggtgaaacaaatggtgcagtaatccattctattaggctctacccaattcagggatttgggctttggaaataaaaacatggcatggtttagattagcatcaggagtggccaaggccactctcaggagaaatcttattcaggcttcttacacaactcggccttcatggactgtcccatatgctcgaccttttcattctactgtaaggaggtcccaagcccaagcagcacctgttccccgcccagttcctctctctaaacttactgatagctttcttgatggaactagtagtgtctacttagaggaattgcagagggcttgggaggctgatccagagagtgtcgatgaatcatgggacaatttttttagaaattttgttgggcaagctgctacttctcccgggatatccgggcaaaccattcaagaaagcatgaggctcctgttgctagttagagcctatcaagtgaatgggcatatgaaggccaagcttgacccacttggtttagaggagagggaaatacctgctgatttggaccctgggctttatgggtttactgaagctgatctagatagggaattttttcttggagtttggagaatggctggtttcttgtctgagaatcggcctgttcaaacccttagatcaatattaaaccggctagagcaggcttattgtgggtacattggtttcgagtatatgcatatagccgacagggataaatgcaattggttgagagataagatcgagacagttgagcctatgaagtacagccaagagcgtcgtgaggttattcttgataggcttatttggagcacgcagtttgagaacttcttggctacaaagtggacagctgcaaagaggtttggtcttgaaggtgcggagactcttatccctggcatgaaagaaatgtttgataggtcagcagatttgggggttgagagtatagttattggcatgtcacatagaggaaggttaaatgtgttaggaaatgtggtcaggaagccattacgccagattttcagtgaattcagtggtggaacaaagcctgttgatggagaagttggcttgtacacaggaactggtgatgtgaagtaccatttgggtacctcatatgatcggcccaccagaggtggaaaaaggattcatctctctcttgttgcaaaccctagccatttggaagccgttgatcctgttgtggtcgggaagactagggcaaagcaatattattccaatgacactgaaaggaagaagaatatgggtgtcttgattcatggtgatgggagctttgctggtcaaggtgttgtttacgagacattgcatcttagtgctcttccaaattacacaactggtgggaccatccatattgtggtgaacaaccaggtggctttcaccactgacccaaggtctggaaggtcctcgcaatactgcactgatgtggccaaagccttgaatgcacctattttccatgttaatggtgatgatgtggaagctgtggttcatgtgtgtgagcttgctgctgagtggcgccagctttttcagtctgatgtagttgttgacatcatatgctatcgccgatttggacataacgagattgatgagccatccttcactcagcctaagatgtatcaggtcattagaaatcatccacgggccctagacatttatcaagaccaattgataaaatcggggcagatatcaaaagaaaatattgatagaataaataataaggtcagcacaattctaaacgaagaatttgtaaacagcaaagacgatgtaccgaggaagagagattggcttgctgcctattggtctggatttaaatcacctgaacaaatttcacggatccgtaatacaggggtgaagccagaaatattgaaaactgttggcaaagcaattactacacttccagagaattttaagcctcatagagcagtcaagaaaatttttgaactacgcggtcagatgatcgagactggagaaggaattgactgggcagttggagaagcacttgcttttgcaactcttatagtggaagggaatcatgtcaggttgagtggtcaggatgttgaaagaggcacttttagccatcggcattcagttattcatgatcaggagactggggaaaagtactgtcctttggaccatctcatcctcaaccaaaatgaggagatgtttactgtcagcaacagctctctttcggagtttggcgtgcttggatttgagttgggttattcaatggaaaatccaaattcattggttctttgggaagctcaatttggagatttttcaaatggtgcccaagttatttttgatcagtttttgagtagtggagaatccaaatggctgcgacaaactggccttgttgtattgcttcctcatggttatgatggtcagggtcctgaacattcaagtgcaaggttggagcgtttccttcagatgagtgatgacaatccttttgtgatacccgagatggattccacacttaggaaacagatccaagagtgcaattggcaggttgtgaatgtcacaaccccagctaattatttccatgtgcttcggcgtcagattaacagagagtttcgtaaacccctgattgttatgtctccaaagaatttgcttcgtcacaaggattgcaaatcgaacctatcagaatttgatgatgttcaaggtcacccagggtttgacaagcaaggaacccgattcaagcgtcttattaaggatcagaatgaccattctgatcttgaggaaggtattaggcgtctaattctctgttcaggaaaggtctactacgaacttgatgaagagcggaagaaagttgatggcaaagatcttgcaatctgcagggttgagcagctttgcccattcccctatgaccttatccagagagagttgaagcgatacccaaatgctgaaattgtgtggtgccaggaggagccgatgaacatgggtgcctatccttatatcactcctcgccttctcactgccatgaaggcattaggcaggggttcatacgaggatatcaaatacgtggggcgtgcgccttcagctgccacagccactggtttctatcaggtgcatgtgcaggaacacactgagctcattcaaaaggccctacagccggatcccataaagttcccttgatgtctctttcgaaacttatcctcaaagggtaccaaattcaaggtgtattgtctaagttgcttggcctatgctctctctctctctctctctccatgcattacagctgttctaaagtttggcatttttattctgatatagataacgttgagtgtataaaagcctgcccatggccgtgttggaattttgtcaattcagtgctgcagttgggattgttttttaaactgtctttgtaattcactggtgtttgtgattatgagagaactcttgcatttcatgcttgggcttttgtagcaataaatgtcaaacaatattgacttttaatcatgggtgataatggttggaattgcgcaccaaatgtgaattaagtttcatgggtccc

SEQ ID NO: 1768 - DNA, 3492 bp, Brachypodium distachyon
catttcatttttgcggctagatttggcattgagggaggaaatccgatccgaaaatggggtggttccgggccgcgtccgggttagcccgggtggcgctgcgaaggaacctgtcgcgtgtcccggcgagcccattcgccggacccgcgccgcggtacttccactcgacgcgtccccggcggttcgcggcgccggagccccgcgccgtgccgctgtcgcgcctcaccgacagcttcctcgatgggacgagcagcgtgtacctcgaggagctgcagagggcatgggaggcggatccgaactccgttgacgagtcgtgggacaatttcttccgcaactttgtcgggcaggcctccacctctcccggcatatccgggcagacgatccaggagagcatgaggctgctgctgctcgtgcgggcgtaccaggtgagtgggcacttgaaggcgaagctcgatcctcttggcctggaggagcgaccggttccagatgttctggacccggcgttctacgggttctctgaggctgatttggatcgggagttcttcctcggggtgtggaaaatggctggtttcttgtcagataatcgtcctgtgcaaacacttcgttccgttgtggaacgtctggagcaggcatactgtggtacgattggatacgaatacatgcacatacctgatcgcgaaaagtgcaactggctaagggagaggatagagacagttaaccccagagagtacacctatgatcgccgtcaagtcatgctggataggctcatctggagcacacagtttgagaatttcttggcacagaaatggacaactgcaaaacggttcggcctcgaaggtgccgagacactgattcctggcatgaaggagatgtttgacagggcagctgatcttggtgtagagagtattgtcatagggatgccacacagaggcaggttgaatgtcttgggaaacgtcgtacggaagcccttgcgacagatcttcagcgagtttagtggcggcaccaagcctgtcaatgaaggggagggcttgtatacagggactggcgatgttaagtaccatctaggtacttcatacgataggcctaccaggggcgggaaacatatccatctatcattggtcgcaaatccaagtcatttggaagcagtcgatcctgttgttgccgggaagaccagagcaaagcagtactattctaatgatcttgacaggaccaagaatcttggggtgctgttgcatggtgatggaagcttctcaggccagggtgttgtatacgagaccctgcatctcagtgcccttccaaattacagtaccggtgggacaattcatattgtggtcaacaatcaggttgcattcaccactgatccattgtcagggaggtcttcacagtattgcacagacgtagccaaagcattggatgctccaattttccacgtgaacggtgatgacttggaggcagtggttcatacctgtgagcttgctgctgagtggaggcaaacatttcattctgatgtggtggtggatattgtgtgctaccgtcgtttcgggcataatgagattgatgagccctccttcacccagcctaaaatgtacaaggtcattaggaaccatccaagtgcgcttgagatatatcaaaagcagatgttagaatcagggaagctctccaaggaagacattgacaagttacacacgaaagtcaacaccatactgaatgaggaattcaaaaaaagcaaagatgatatccccaacaagagggactggctttcagcttactggactgggtttaagtcaccagaacagatttcgcgtgtccgaaacaccggtgtcaaaccagagattctaaagcgtgttggtgaagccatgaccactctgccagaaaatttcaagcctcacagggctgtcaagaagatttttgatctgcgtcgccagatgattgagactggggagggtattgactgggcagtgggtgaagcacttgcttttgcaactcttataattgaggggaaccatgtcaggttaagtggccaggatgttgagaggggaacattcagccatcgccattctgtcgtccatgaccaagaaactggacagcactactgtccgcttgataatcttgtcatgaaccaaaatgaggaactatttactgtaagcaacagttccctgtcagaatttgctgttcttggttttgagttgggttattcaatggagaacccaaactcgctggtattatgggaagcacagtttggtgatttttcaaatggagctcaagtgatatttgatcagttcattagtagcggggaggcaaaatggctccgccagtccgggcttgtcgtttgccttcctcatggatatgatggtcagggacctgaacattctagtgcaagaatggaacgcttccttcagatgagtgatgataacccttatgttatccctgagatggattcaacaacgaggaagcaaatccagcagtgcaatttgcaggttgtgaatgtcacaactcctgcaaactatttccatgttctgcgtcgccagatacaccgggacttccgaaagcctttaattgtgatgtctccaaagaatctccttcgtcacaaggaatgcaaatccagtctgtctgaattcgatgatgttgccggacaccctggatttgataagcaagggacacgcttcaagcgtctgataaaagaccggaacgatcataaggaccttgaggagggaatcaaccgtttagttctttgttctggaaaggtgtactatgaattggatgaagaaagaaagaaatcggatcgcaatgatgttgctatatgtagagttgagcagctgtgtccattcccctatgaccttattcagcgcgagttgaagagatacccaaatgccgagattgtttggtgccaagaagaaccgatgaacatgggggcatatacctacatcaaccctcgcctgctgactgcgatgagagcgcttggccgtggcaccatagaggatatcaagtatgccggaagggccccttctgcagccaccgctacaggtttctattctgtccatgggcaggagcaaaccgagctcgtgcagaaggcactgcagcgagaccctatcaagtgtccgttttgaatccgtagatgctccgaatagccatcagaatctcttgagtttggtgaataatcgttttggatgtatggtacggcacgttataaacggtctgaggtccatcttggacagcaattttgttttctgcatcgaagttttcatttctgagcttggttccgctgcacccatgaacaggtagcgaaataagcttcatcaccacattctaatattttcttagacacgccacattgtgagatttaccttgacattgtaataacaaagggtgcatcttctactaataacaaaggagtatattagtagaaggtgcatcctttgttattttactacactcggacaacaaaattttgggttcttcaaagtgcttctcataaaattttggtgttccataggt

SEQ ID NO: 1769 - DNA, 3647 bp, Zea mays
cgttcccatcctcctttcccgaacaaccggagcgcggcgcgagacaggcctctactccccgtctcccccgctccagctgacctcgcccactggttgtggggagagatcgcgttcatcagtgccctgtacggagtgaccgatctcggatgaggaccgatatgccagttttgctgtgattattgatctgtgcggtgcgtaatcgatcgagatttagtttgatttgggaagcccagaagcaagggggacgtgcgatcgatcacgtgcgcggcgactgatggcaggctagattccggcaatccacagtcagacacatacattttgcgatcgatttttggtgaagcgaccttgatctgaaaatggggctgttccgggcggcgtccggtctggctcgtttggcgctgcggcggaacctctcgcgcgccgcagcgagccccttcgccggcagcggtggcgccgtcccgggtgcaatgccggcgcggtacttccactccacacgcccgcgcaggttcgccgcgcccgcgccccgtgcggtgccgctctcgcgcctcaccgacagcttcctcgacgggaccagtagcgtctacctcgaggagctgcagcgagcatgggaggccgaccccaactccgtcgacgagtcctgggacaactttttccgcaacttcgtcggccaggctgccgccacctcgcctggcctctccgggcagaccatccaggagagcatgaggctgctgctgctcgtaagggcgtaccaggtgagcggccacctgaaggccaagctcgacccactggggcttgaggagcgcccagtcccggatgtgctggacccggggttctatggattctctgaggcagacttggaccgtgaattcttccttggggtgtggatgatggctgggttcttgtccgagaaccggccagtgcagacactgcgttccgtgctggagcggctcgagcaggcttactgcggcaccattgggtatgagtacatgcacatacctgacagggagaagtgcaactggctcagggataggatcgaaacagttaacccaagggagtacacttatgatcgtcgtcaggtcatgctggataggcttatctggagtacacagtttgagaatttcttggcgaccaagtggacgactgcaaaacggtttggtcttgaaggcgctgagactctgatccctggcatgaaggagatgtttgacagagcagctgatcttggtgtagagagtattgtcattgggatgccgcacagaggcaggttaaatgtcttgggaaatgttgtgaggaagcccttgcgacagatatttagtgagtttagtggtggtaccaagcctgtcaatgaaggggaggggttgtatacaggtactggtgatgtcaaataccatcttggaacttcatatgacaggcctaccaggggcgggaaacatatccatctgtcactggttgcgaacccaagtcatttggaagcagtcgatcctgttgttgctgggaagacaagagcgaaacagtactattccaatgaccgtgacaggaccaagaatttgggtgtgttgctgcatggtgatggtagtttctcagggcagggcgttgtgtatgagacactgcatctcagtgcccttgaaaactacaccactggtgggacaatacatatcgtggtcaacaatcaggttgctttcactactgatccaaggtcagggagatcctctcagtattgcacagatgtagcgaaagcattggatgcgccgatttttcatgttaatggtgatgatttggaggccgtggttcatgtctgtgagctcgctgcagaatggcgacagacatttcattcagatgtagtggtggacattgtatgctaccggcgatttggccataatgaaattgatgagccgtccttcacccaacctaagatgtacaaggtgattaggaaccatccaagtgcgcttgagatttatcaaagaaagttgttagagtctggaaagatctcaaaggaagatattgataagttaaacaagaaggtcagcactatacttaatgaggaattccagaacagcaaggactatgttcccaacaagagggactggctttcagcttactggactgggttcaagtcaccagagcagatttcgcgtatccaaaacactggagtcaagccagagattctaaaacgagttggagaagccatgactactctaccagaaaatttcaatcctcacagggctgtgaagaagattttttatcagaggcgtcagatgatcgagactggagaaggcattgattgggcagttggtgaagcacttgcttttgctactcttatcattgaggggaaccatgtcaggttaagtggtcaggatgttgagaggggtacatttagccaccgtcattctgtcctccatgaccaagaaactggagagcagtactgcccactggatcatcttgttatgaaccaagatgaggagctttttactgtgagcaacagttccctgtcagaatttgctgttttgggctttgaattgggttactctatggagaacccaaactcattggtcatatgggaagctcagtttggtgatttttccaatggagctcaagtgatatttgatcagttcctgagtagcggggagtcaaaatggctccgccagactggccttgtggtttgtcttcctcatggatatgatggccaggggcctgaacattctagtgcaagattggagcgctttcttcagatgagtgatgacaacccttatgttatacctgagatggatccaacactgcggaagcaaatccagcagtgcaattggcaagtcgttaatgtaacaactcctgcaaattatttccatgttctgcgtcgccagatacaccgggactttaggaaacctttgattgtgatgtccccaaagaacctccttcgccacaaggactgcaagtcgaacttatctgaatttgatgatcttgcgggccaccctggattcgacaagcaagggacacgcttcaagcggctcattaaagaccagaataatcacaaggacctcgaggagggaattaaccgtctagttctttgctctggaaaggtgtactacgaactggatgaagaaagaaggaagacggagcgcactgatgttgctatatgtagagttgagcagctctgcccattcccctatgacctcatccagcgcgagttgaagagatatccaaatgctgagatcgtgtggtgccaggaggagccgatgaacatgggagcgtacagctacatcaacccccggctgctgacggcaatgaaggctctgggccgtggtggcatcgaggacatcaagtacgtcggcagggccccgtcggctgctactgctacgggcttctactcggtgcacgtgcaggagcagacggagctggtgcaaaaggccctgcagcgcgaccccatcaactacccgttctgaaagaaacgagacccctgtaaattcttggaaaattgggcaccttttgattttgatatacctctatagagagagcaggccttaaggtatgcctgtgctgctgtgcagccatttgttgaaataatcgtttcggactctacagtaccgcattatatagtttataattccatgataaatattgtataagtaattattgattaattaatattatttact

SEQ ID NO: 1770 - DNA, 3511 bp, Manihot esculenta
aggcttttcttttttaccaatctctctctctgaccggccttgttccgttagagaaattacatatgttcatgcttgaggtttgatccacggaggtacatctttgacaaatttgtggtattctgtactgtgcattgttatcaatggggtggtttagggctggcactagtgtggcaaggcttgccattaggaggactttatctcaaagtggatcatatacaactagaacacggctcattccttctcagagtcgttatttccataccactgtctttaagtccaaggcacaatctgcacctgtccctcgtccagtgcccctctccaggttaactgatagcttcttagatggaaccagtagtgtgtacttggaggagctacaacgagcttgggaagctgacccgaatagtgtggatgagtcttgggacaatttctttaggaattttgtgggtcaggctgccacatccccaggaatttcaggccagaccattcaggagagtatgcgtttactgttgcttgtgagggcttatcaagttaatggccatatgaaagccaagttggatccgttggggttggaagaaagagaaattccagatgatttagacccagcactttatgggttcacagaagctgaccttgatagagaattctttttaggagtgtggagaatgtctgggtttttgtctgaaaaccgtccggttcagactcttaggtctatattaacccgtctcgagcaggcttattgtgggagcattggctttgagtatatgcacattgcagatcgtgataaatgtaactggttaagagacaagattgaaactccaactcctatgcagtacaatcgccaacgtcgtgaagttattctcgatagacttatatggagtacacaatttgaaaacttcttggccaccaagtgggcaacagctaagaggtttgggcttgaaggcggggaaactcttattcctggtatgaaggagatgtttgataggtcagcagatctgggcgttgagagcatagttattggaatgcctcatagaggaagattgaatgttcttggtaatgttgttcgaaagccgcttcgtcaaatatttagcgagtttagtggtggtacaaagcctgtagatgaggttggcctttacactggaactggtgatgtgaagtatcacttaggaacttcatatgatcgtccaaccagaggtgggaagagaatccatttgtcattggttgcaaatcctagccacctggaagctgtagaccctgttgttgttggaaagactagagctaagcaattttactccaatgatgagcagaggaccaaaaacatgggagttttgattcatggtgatggtagctttgctggacaaggtgtggtctatgaaactttacatcttagtgccctgccaaactacactactggcggaactatacacattgtggtgaataaccaagttgctttcactactgatccgagggccgggagatcttcacagtattgcactgatgttgccaaggctttggatgcccctattttccatgtaaatggagacgatgtggaggcagttgttcatgcctgtgagcttgcagctgagtggcgccagactttccattcggatgttgtggttgatttggtgtgttaccgtcgatttggacataatgagattgatgagccatcattcacgcagccaaaaatgtatcaggttattcgaaatcatccctcatctcttgagatttacagaaagagacttttagaatctggccaggtgggtgaagaagatattcaaaagatacaagagaaggtcaattcgattctcaacgaagaattcttggctagcaaagattatgttcctaaaagaagagattggctttcatctcactgggctgggtttaagtcacctgaacagctttcacgtatccgaaacactggggtgaaacctgagatcttgaagaatgttggcaaggcaatcacaacttttcctgataattttaagcctcacagaggtgtaaagaaggtttatgaacaacgtgcacaaatgattgaaactggggaaggaattgattgggcagttgcagaagctcttgcctttgccactttggttgtagaaggtaatcatgttagattgagtggccaggatgttgaaagaggtacatttagtcaccggcattcagtcgttcatgatcaagaaactggggaaaagtattgtcctctggaccatcttgtcattaaccaagatgaggaattgtttactgtcagcaacagttctctttcagagtttgctgttcttggatttgaattgggttactcaatggaaaatccaaattcattggttatctgggaagctcaatttggtgactttgctaatggggctcaagtgatatttgatcagttcctgagtagtggggaatcgaagtggttgcgtcaaactggccttgttgtgcttcttcctcatggatatgatggtcagggtcctgaacattcaagtgcacggttggaacgcttccttcagatgagtgatgacaatccttatgtcattccagacatggacccaacacttcggaagcaaatccaggaatgtaactggcaggttgtaaatgttacaactcctgctaattatttccatgtcttgcggcgccagctacacagggagttccgtaagcccctcattgtgatggctccaaaaaacctacttcgtcacaaggactgcaaatcaaatctttccgagtttgatgatgtccaaggccaccctggctttgataaacagggaaccagatttaagcgtctcataaaggatcagaatgaccactctgaccttgaagagggtatcagacgcctggttctttgctctggaaaggtttactatgagcttgatgaagagcgcaaaaagaatggtgctaaggatattgcaatttgtagggtggagcagctgtgtccattcccatatgatctcatccagcgtgagctcaagcgctatccaaatgccgagattgtttggtgccaggaagagccaatgaacatgggtgcatacaattacattttgctccgcctttgcactgctatgaaagcactgggaagaggatctctggaggacatcaagtatgttggacgtgccccctctgctgcaacagccaccggattctaccaggtgcatgtgaaggagcagaccgaactcatccaaaaagccatgcaacctgagccaataaagtatccctcctgaaccttttcaatctgttaaatacttatcttaaagaacaatgtggcacatccattgataaatctccctttgtggaggctggatattgttcatgtcctgttcacgaagcttctttttttgggccaaggcataatatcggtactcttttacaagtttatgacacttcaaggtataatgccgtgcaataatcaagtgttgtcattgttgtcaaaatagggattatgtgtagaagagatggtgagctatttgcattatggatgtatacattccatcatatttctgattcattttgctggtagcatttcttt

SEQ ID NO: 1771 - DNA, 3753 bp, Zea mays
catctccggatctatcgccctcgccatcggcaatcggcatcgccaccggtagtgggagggagcaagggggggacccaggccaacgccgcgcacctttgccctcttatcatcatcaacatcaccacgggcgggggagacggccctcgaagcgtacccgtccccatcctccttttccgaaccaccggagcgcggcggcgcggcgcgagacccttcccggcttctactcctccgatcctccgcaccggctgacgagtagcccactcactgggggacgtgggatcgatcggcggctgatgggaggctagattccgcaatcccacagactagacacatccccttcgcggttgactttggcgaatcgaccttgatctgaaaatggggctgttccgggcggcgtccggcctggcccgtttggctctgcgaaggaacctcttgcgcgccgcggcaagcccctttgccgccggcggtggcgccgtcccaggtgccgcgccggcgcgctacttccactccacctgcccgcgccggttcgctgcgcccacgccccgtgctgtgccgctctcgcgcctcaccgacagcttccttgatgggaccagcagcgtctacctcgaggagctgcagcgggcctgggaggccgaccccagctctgtcgatgagtcctgggacaactttttccgcaacttcgtcggccaggctgccaccacctcacccggcctctctgggcagaccatccaggagagcatgaggctgctgctgctcgtcagggcataccaggtgagcggccacctgaaagccaagctcgacccgctcgggcttgaggagcgtccggtcccggatgtgttggacccggcgttctatgggttctctgaggcggacttagaccgcgagttctttcttggggtgtggatgatggctgggttcttgtctgaaaaccggccagtgcagacgctgcgctcggtgctggagcggctcgagcaggcctattgcggtaccattgggtatgagtacatgcacatacctgacagggagaagtgcaactggctcagggataggattgagacagttaacccaatggattacacttatgaccgtcgtcaggtcatgcttgataggcttatctggagcacacagtttgagagtttcttggcgaccaagtggacaactgcaaaacggttcggtcttgaaggtgctgagactctgatccctggcatgaaggagatgtttgacagggcagctcatcttggtgtagagagtattgtcattgggatgccacacagaggcaggttaaatgtcttgggaaatgttgtgaggaagcccttgcgacagatatttagcgagttcagtggtggcaccaagcctgtcaatgaaggcgaggggttgtatacagggactggtgatgtcaagtaccatcttggaacttcatatgataggcctaccaggggtgggaaacatatccatctgtcactggttgcaaacccgagtcatttggaagcagttgatcctgttgttgctgggaaaacaagagcgaagcagtactattctaatgaccgtgacaggaccaagaatttgggagtgttgctgcatggtgatggtagtttctcagggcagggcgttgtgtatgagacgctgcatctcagtgcccttgaaaactacaccactggtgggacaatacatatcgtggtcaataatcaggttgctttcactactgatccaaggtcagggagatcctcacaatattgcacagatgtagcaaaagcattggatgctcctattttccatgttaacggtgatgatttggaggctgttgttcatgtctgtgagctcgccgcagaatggcgtcagacatttcattcagatgtagtggtggacattgtatgctaccggcgatttggccataatgaaattgatgagccgtccttcacccaacctaagatgtacaaggtgattaggaaccatccaagtgcgctagagatttatcaaaggaagttgttagagtctgggaagatctcaaaggaagatattgataggttaaacaaaaaggtcagcactatacttaatgaggaatttcagaacagcaaagactatgttcccaacaagagggactggctttcagcttactggactgggttcaagtcaccagagcagatttcgcgtatccgaaacaccggtgtcaagccagagattctaaaacgtgttggagaagccatgactactctgccagaaaatttcaagcctcacagggctgtgaagaagatttttgatctacggcgtcagatgatcgagactggagaaggcattgattgggcagttggtgaagcacttgcttttgctactcttataattgaggggaaccatgtcaggttaagtggtcaggatgttgagaggggtacatttagccatcgacactctgtcatccatgaccaagaaactggagagcagtactgcccgctggatcatcttgttatgaaccaagatgcggagctttttactgtgagcaacagttccctgtcagaatttgctgttttgggctttgaattgggttactccatggagaacccaaactcattggtcttatgggaagctcagtttggtgatttttcaaatggagctcaagtgatatttgatcagttcctgagtagtggggagtcaaaatggctccgccagactggccttgtcgtttgccttcctcatggatatgatggtcaggggcctgaacattctagtgcaagattggaacgctttcttcagatgagtgatgacaacccttatgttatacccgagatggatccaacactgcggaagcaaatccagcagtgcaattggcaggtcgttaatgtaacaactcctgcaaattatttccatgttctgcgtcgccagatacaccgggacttcaggaagcctttgattgtgatgtccccaaagaacctccttcgccacaaggactgcaagtcgaacctatctgaatttgatgatcttgcgggccaccctggattcgacaaacaggggacacgcttcaagcgtctcattaaggaccagaataatcacaaggacctcgaggagggaatcaaccgcctagttctttgctctggaaaggtgtactatgaactggatgaagaaagaaggaagtcggagcgcactgatgttgctatatgtagagttgagcagctctgcccgttcccctatgacctcatccagcgcgagttgaagagatatccaaatgccgagatcgtgtggtgccaagaggagccgatgaacatgggagcatacagctacatcaacccgcggttgctgacggcgatgaaggttctgggccggggtggcatcgaggacatcaagtacgtcggcagggccccgtcggctgctaccgcgacgggcttctactcggtgcacgtgcaggagcagacggagctggtgcagaaggcgctgcagcgcgaccccctcaactaccctttctgaaagaaacgaggcccctgtagattcttggaattggggaccttttgaatttgatataataccaatatagagagaacatgccttaaattttatctgtgcagccatttggtgaaataattgtttcgactctgcagtaccgcatgaaacaaaccgttgtaagtttggaaaaactccatctcgcagcgttgattttgtgttcctaaatgctggaaagtttgtatggctgaaagcctgaaacaccgcctgccgcaattttcttgcgttgaattgcaaagtctataaaagcaatgaactgatatgtca

SEQ ID NO: 1772 - DNA, 6014 bp, Oryza sativa
gcacgacaaccaggcattaatcctttgcaaaacccaaccaagcaagcatcaggcaagaatctagaagcagccattatcaagaagaacggcagaacagtgaggattggaagcaactcttccagtgtttgatttaatttccactgaatatctatttcaacttgattagataatcccccgtatcatacttcccattctccaaattgagcactaccaacaggccatctcaatttccaccgaaacccaaatgatgtaacagtcaaaccatagccataaacactcaaatcacaaccgagaaagaataggcaatgcggagctgaattctcattgtcaaggcggaagatggtcaggcgcttccagcggacgacagtgaggaggccccggcggtcatcccaggcgaagaggttggcgccattggtcttcccgatgacgacgacggtctcgagcccggggaggcaatggaggttgacatggaggcacggagtagatgggtgatgcgggcggcggcgccggtcggggtagatcggcgatgcaggccacgatagggcgcgatggagaatcggcgatgctggtttcggcgtcggtcggcggcggttggcgtgaggggcgaggcggcgtcgcgggtggcgaggaggcgtcgcgatggcggggcgtcggcggcgtgagggtgcagcgtcggtggcgtgagggtgcagcgttggcagagctgggtgagtgcgagagagaggagggcagagacggggttctcggcgtgattgggttacgcgcgtgagggaaggggagaggaggaatgcaggcaggtgtgggtgccaagcgcgtgcggaagggagagggtccacgacgatctcgaaccattggattcgatcattcttgaccatcggatttgatgaatgaggtttgtaggagtgtagttggtgaattataggttagatatgacagcaatctatacaagatctgcttcaaatgagttgatttactttaaactatccacattgcagccatcagttagcatagtcagccatcagttagcgttagccatcatagttgcctatctttcctactcttatgtttcttatttcagttagggaagacgatgattagtgttagctgttttttctccatcttttgttctttctgtacgttcaaggaaaacggaactcccttgtccgggaaagcgttttgacgcactcatcaggttgttttcaccgacagagctcgttgtcgttgtttatctttctatcgggaccacaccgttgccatccacatttatgttgttttggaattttttcgttgccaacctccaccatatatatggatgagtcatatcgtgggacacatcctaccaccttcctcaccgctgttttggtcatcatagcactagtgcccattttttctctccctatgtttctcaccttcagctagggaggatgatgctaactgttaggcactattctttcctggcccatctcaaccatgctcctgaaccgctcaaaataccgagaccgtagaaatatgaatagaacatgaaagaactaatttatgtcaatgaaacgggtacccgttcagaattaatggatcatattttcaactatgggctaaaataagtttttttattttctagctaatttcagtttttttcatttacaataatagttttagcactatttggtcagctaaaaaattttaacttatatttttttctctgtgttgaattatttatatctaaataaaaaatgaggatttagttatataatttccatgatattaaaatatcgttcgaacaagcctatttgtagttttatgttgttttttatgtgattatattttcttcagttttatgttgttatttctataattatattttcttcatcatttatacctaaatgtgaaatataatttaagatttattttatgtgaatgaatgctacttcatctatttcaggttataaaattttttaatattactcacatttatataaatccatttatataaatgctaataagaatctgttacaaaagcattatgctagtctattctcaaactaggaggccaaagttcgatcgatggtagctcgtccatggtcgaacccatccattccagaaggtcggacctgtcagagcaccgtggcaccccgtgcgacgacgcgactgtggtctgtgggcccccaccctctcaaaaccctcacgccactgacatctgggccccaccccctacttttctctcccccctcgctctcccatccacgcgcgcggagtgggacccaccacccaggcgttcgcccttatcgttgcgcgagcccttcttcttcctcctctctctctctctctctctctctctctcgccaaccaatctcctcccccctcctttcctcctcctcccgaaccaccggaatccgacgcggcgccgccgcgccaccccgttccgccggctctcttcctcacctctcctccccaggagatcgtcaatctcctcggtcaggtgtttgatcgattgcctgtgggaagcatatgggcggttagattcgtgaagttgagaggaatcagaagacgggaattgtttgaggggactgaatttgatctggaaaatggggtggtttcgggctgcgtccggattggctcgggtggcgctgaggaggaacctggcgcgtgctccggcgaacccttttgccggtcctgcgccacggtacttccactccacccgcccccggcggttcgccgctcctgtgccccgcgccgtgccgctctcgcgcctcaccgacagcttccttgatggcaccagcagcgtgtaccttgaggagctccagagggcgtgggaggctgatcccacctctgtcgacgagtcctgggacaatttctttcggaactttgtcgggcaggctgcaacttcgcctggcatatctgggcagacaattcaggaaagcatgaggttgctgcttcttgtgcgagcgtaccaggtgagtggtcacctgaaggctaagcttgatcctctcgcgctagaggagcggcctatccctgatgttctggaccctgcgttctatgggttctctgaggctgatctggaccgggagttttttcttggtgtgtggaggatggctgggttcttgtcggagaatcgccctgtgcagacactccgttctgtgttggagcggcttgagcaagcttactgtggtaccattgggtatgagtacatgcacatacctgacagggagaaatgtaattggctgagggataggattgagacggtcaatgcaagggagtactcctacgaccgtcgccaggtcatgcttgataggctcatgtggagcactcagtttgagagcttcttggcacagaaatggacgaccgccaagcggtttggtcttgaaggtgcggagacactgatccctggcatgaaggagatgtttgacagggcagctgatcttggtgtagagagcattgtgattggtatgccacacagaggtaggctgaatgtcttgggaaatgtcgtgaggaagcccttgcgacagatcttcagtgagtttagtggtggtaccaagcctgccgaagaaggggagggcttgtatacagggactggagatgtcaaataccatctaggaacttcatacgataggcctaccagaggtggaaagcatatccatctgtctctggttgcaaacccaagtcatttggaagcagtcgatcctgttgttgctgggaagaccagagcaaaacagtactattctaatgatcttgacaggaccaagaatttaggagtcttgttgcatggtgatggaagcttctcagggcagggtgtagtgtatgaaaccctgcatctcagtgctcttccaaactacactactggtgggacaattcacattgtggtcaataatcaggttgctttcactactgatccaagggcagggaggtcttcgcagtattgcacagatgttgctaaagcattggatgctccaattttccatgtgaatggtgatgacttggaggcagtggttcatgtctgtgagcttgctgcggagtggcggcaaacatttcattctgatgttgtggtggatattgtatgctaccgccggtttgggcataacgagattgatgagccttccttcacccagcctaaaatgtacaagataattaggaaccaccagagtgctcttgagatataccaaaacagacttttagaatctgggaagatatccaaggaagatattgataagatgcagaagaaggtcagcactatcttgaatgatgaattccaaaacagcaaagaatatattcccaataagagagactggctctcagcttactggactggattcaagtcaccagaacagatttcacgaatccgaaatactggtgtcaagccagagattctaaaacgtgttggagaagccatgactactctgcctgaaaatttcaagccccacagggctgtcaaaaagatttttgagctgcgtcgtcagatgattgagacgggcgaaggcattgattgggctgttggtgaagcacttgcttttgcaactcttataattgagggaaaccatgttaggttaagtggtcaggatgttgagaggggtacattcagccaccgccatgctgttatccatgaccaggaaactggagagcaatactgtccgcttgataatcttgttatgaatcaagatgaggaactatttactgtaagcaacagttccctgtcagagtttgctgttttgggctttgaattgggctattccatggagaatccaaactcactggttttatgggaagcccagtttggtgatttttccaatggagctcaagtgatatttgatcagtttctgagtagtggagaggcaaaatggctccgccagaccggtcttgtcgtttgccttcctcacggatatgatggtcaggggcctgaacattccagtgcaaggttggagcgtttccttcagatgagtgatgacaacccttatgttattcctgagatggatccaactctgaggaagcaaatccagcagtgcaactggcaagttgtgaatgtcacaactcctgcaaactatttccatgtcctgcgtcgccagattcaccgggacttcagaaagcctttgattgttatgtctccaaagaatctccttcgacacaaggactgcaaatcgaatctttctgaatttgatgaccttgctggtcaccctggatttgacaagcaaggaacccggtttaagcgtctaattaaagatcagaacaaccataaggaccttgaggagggaatcaagcgtttagttctctgttctggaaaggtatattatgagttggacgaagaaagaagaaaaaaggagcgtgatgatgttgctatatgtagagttgaacagctctgtccattcccatatgacctcatccagcgcgagttgaagcgatatccaaatgccgagattgtttggtgccaagaggaacccatgaacatgggggcgtacagctacatcaatcctcgcctcctgaccgcgatgagggcgcttggtcggggcacgatagacgacatcaaatacgttggaagggccccatctgcagccaccgcaacaggtttctactccgtccatgtgcaggagcaaaccgagcttgtgcagaaggcactgcagcgagaccctatcaactctccattttgaacctgtagattttatttggatagccgtgggtaatcaaacctttgatccaacagcaaaattattgcctgtgcagccatttggtgaataatccgcttcggatgtttggtaccgcatgagagaaaccatttgaaacccatgttgggatgcatcattttgtgtttcttaacatcaaattaaaccaagttgcatccaatgcttacttgaggagtagaaataagtcgatgctgaatactgatcttccatgtttttgtgatactacattcttattactgcgcctttcaccatccaagaagtatgaattcttctttcaggccgtgtttttctggtatttttcagtcccttgctgcaagtagtaccctgcaactgcaagcactgaagcac

SEQ ID NO: 1773 - DNA, 3946 bp, Musa acuminata
cttatccgttaggttggagccttccgaagaccgctcgagtgttcgtcttcgctctgtgttccgaggaaggaggaggaggaggaggaagaggggatgagcagaacctgcgagagcagaagcttctcgtcttccccacccatctccggatgatttcggcggttctcttcgttatcgtcctccccgacttcttttaggagagcggaagaagatttttgatcgatccccaatggcgtggtttcgcgccgcgtcgggggtcgcacgactggccctcaggcgaaaccttgctcgaaccccttaccacgtcgcgagagctggcgccctgcctcggttccagcccgcccgatgcttccactcgacgcagctgcggcgggccgcaccggtcccccgccctgtgccgctctcgcggctcaccgacagcttccttgacggcaccagcagcgtctacttggaggagctgcagagggcatgggaagccgaccccagcagcgtggacgagtcctgggacaactttttccggaactttgtcggccaggccgccacctcacctggtatctccggccagaccatccaagagagtatgcggctactcctcctcgtccgagcctaccaggtaaatggccacatgaaggccaagctcgatcctctagatctcgaggagagggagatgtcggatgacttggatctcgccctctatgggttcacagaggctgatctggatagggagttctttcttggagtgtggaggatgtcggggttcttatcggagaaccgccctgttcagacccttcggtcgatcttggaacggctcgagcaggcctactgtgggaccgtagggtacgagtacatgcacattcccaaccgtgatcagtgcaattggttgagggagaggattgagaccgtgaagcctagggagtacagccaggaacgacgtcaggtcattcttgatcgacttacatggagcacactgtttgagaatttcttggccacaaagtggaaggctgcaaagcggtttggtctggaaggtggcgagactctgattccaggaatgaaggagatgtttgatagagctgctgacctgggggtagagtccattgtgattggaatgcctcacagaggaaggctaaatgttctgggcaatgtcgttcgaaaacctctgcggcagatcttcagtgaattcagtggtggtactaaacctgtagaagagggagaagggttgtacacagggaccggagatgtgaaatatcatctaggtacttcgtatgataggcccaccagaggtgggaaaatgatccatctatcattagtcgcaaatccaagccatcttgaagcggtggatccagttgtggttgggaaggcgagggctaaacaatactattctaatgatattgagaggaccaggaatatgggggtgttaatccacggtgatggaagctttgcagggcaaggcgttgtctatgagacattgcatttgagcgcccttcccaattacacaaccggggggacaattcacattgttgtgaacaatcaagttgcattcacaacggatccaaaatgtgggaggtcttctcagtactgtaccgatgttgccaaagcgttaagcgttccgattttccatgtgaatggtgatgacgtcgaagcagttgtccatgtgtgtgagcttgcagctgaatggcgccagacattccattctgatgtggtggttgatgttgtctgctaccgtaggtttggacataatgaaattgatgagccgtctttcacgcagcccaaaatgtatcgggtaattcaggatcatccaagtgcacttgaattgtatgaaaaggaacttttagaatcaggacggatctctaaagatgatgttgataggatgcgtaataaagttagtacaattctggaagaagagtttattaacagtaaagattatgtcccaagaaaaagggactggctctctgcttactgggctggcttcaaatcaccggaacagatttcacgtattcgtaatactggtgtcaagccggagatactcaaacgtgttggacaagccattacaactcttcctgagaacttcaagcctcacagggcaatcaagaggatttttcagcagcgggctgagatgattgaaactgaggaaggtattgactgggcacttgctgaggctcttgctttcgccacccttatagtggaaggtaatcatgtcagattgagtgggcaagatgtggagagaggaacatttagtcataggcatgctgtggttcatgatcaagaaactggagagatgtactgccctctggatcatattattataaaccaagatgaggaaatgttcactgtcagcaacagttcactgtcagagtttggggtccttggttttgaattgggctactcgatggagaaccctaactcgttggtactttgggaagcacaatttggtgattttgcaaatggtgctcaagttatgtttgatcagtttttgagtagtggagaagcaaagtggctgcggcaaactggacttgctgtgttgcttccacatggttatgatggtcaaggtccagaacattcaagtgggcgagtcgagcgctttctccagatgagtgacgataacccatacattataccagagatggatccaacacttagaaaacagatccaggagtgcaattggcaagtcgtgaatgtgacaactcctgcaaactattttcatgttctgagacggcagctacacagagatttccggaaacctctgatagtgatgtctcctaaaaatcttctccgtcacaaggactgcaagtcacacctctctgaatttgatgatgtcctgggccaccctggatttgataagcagggaactcgcttcaagcgcctaataaaagaccggaatgatcacaaagaaatagaggagggtattgatcgtttaattctgtgctctgggaaggtgtattatgagctggatgaagctcggaaaaatacaaaacggaacgacgtggcaatttgtagagttgaacagctttgcccttttccttatgacctcattcagcgagagttgaaaagatacccaaatgcggagatcgtctggtgccaggaagagccaatgaacatgggtgcgtattcctatgtgaaccctcgtatatatactgccatgagggcgataagcagaggaaatatagaggacataaagtacgtcgggagggcgccttctgcagccactgcaaccggtttcttatctgttcatgtgcaagagcagaaggagattttacacaaggcgatgcagccggaaccaatcggattcccgttttgaagtaatgtttcacacgaacgattaaagaaccagttgttacgtgtttgtcgatgatactcaatatttggtatcagacagcagacttgtcgcttgttatatcaataatgattgggcgtggacgaaggtctgtttttttttttcccagaataattggtagctcttgcatttatgtttcaagtcgactattgacttacctgtttgtttgttatcttatgctgctgctttttttttccttttggcctttttggaagaccgaccccctggcctttgagatcactgacaggatgggtgggtggaagacatctgcaggtggggggggagcacacgattacgggaggaatgacatcatgtaatttagttggcttggaaggtttacccaccaataccccaaatcatcattgctcgcctcagcatcaaccgtaaagccccaatcgaaaaagcaggcctggcgctgatgattaggcgaatcatcttggcatccacgtgtcaccacacgggaagaaggtatgatggatggatggatggatggagttgtgaagcgaccacattatcgacgaaggaactgatgccgctcatgctacagccgacgacatcggttgtcgcttcgcctccgtcgacacagcgagtgtagctcgtaacacaccaaaccatggc

SEQ ID NO: 1774 - DNA, 3098 bp, Manihot esculenta
tgtgcattgttctctatggcgtggtttagagctggcactagcgtggcaaggcttgccattagaaggactttatcacagagtggatcatacacaactagaacacggatcattccttctcaaagtcgatatttccataccactgtttttaagtccaaggcacaaactgcacctgtccctcgtccggtgcccctctccaggctaactgatagcttcttagatggaaccagtagtgtttacttggaggagttacaacgagcttgggaagctgatccgaatagtgtggacgagtcgtgggacaatttctttagaaattttgtcggtcaggcagccacgtcccctggaatttcaggccagacaattcaggagagtatgcgtttgctgttacttgtgagggcttaccaagtcaatggtcacatgaaagctaagttggaccctttgggcttggaagaaagagaaattccagaggatttagacccagcactttatgggttcacagaagctgaccttgatagagaattctttttaggagtgtggagaatgtctgggtttttgtctgaaaatcgtccagtgcggacccttaggtccatattgacccggcttgagcaggcttattgtgggagcattggttttgagtacatgcacattgcagatcatgataaatgtaactggttaagagacaagattgaaactccaacgcctatgcagtacaatcgccagcgccgtgaagttattcttgataggctaatatggagtacacaatttgagaacttcttggccaccaagtggacaacggccaagcggtttggacttgaaggtggggagacccttattccaggtatgaaggagatgtttgatagagcagcagatcttggtgttgaaagcatagttattgggatgccccatagaggaagattaaatgttcttggtaatgttgttcggaagccactccgacaaatatttagtgagttcagtggtggtacaaagcctgtagatgaagttggtctctacacaggaactggtgatgtgaaatatcacttgggaacctcttatgatcgtccaaccagaggtgggaagagaatccatctgtcattggttgcaaatcctagtcacttggaagctgtcgatcctgttgttattgggaaaaccagagctaagcagtattactccaatgatgaacacaggacaaaaaacatgggagttttgattcatggtgatggtagctttgctggacaaggtgtagtttatgaaactctacatcttagtgcactgccaagctacactactggtggaactatacacattgtggtgaataaccaagttgctttcactactgatccaagggctggcagatcttcacagtattgtacagatgttgccaaggctttgaatgctcccattttccatgttaacggcgatgatgtggaggcagttgttcatgcctgtgagcttgcggctgagtggcgccagactttccattcagatgttgtggttgatttggtgtgttaccgtcgatttgggcataatgagattgatgagccatctttcactcaacccaaaatgtatcaggtaattcgaaatcatccctcatctcttgagatttatcaaaagaaacttttagaatccagccaggtgggtgaggaagatattctgaagatacaagagaaggtcaataagatactcaatgaagaattcttggcaagcaaagattatgttcctaaaagaagagattggctttcatctcattgggctgggtttaagtcacctgagcagatttcacgtatccgaaacactggggtgaaacctgagatcttgaagaatgttggtaaggcaatcacaacttttccagataattttaagcctcacagagctgtaaagaaggtttatgaacaacgtgcacaaatgattgaaactggggaaggaattgactgggcacttgcagaagctcttgcttttgccactttggttgtagaaggtaatcatgttagattgagtggccaggacgttgaaagaggtacatttagtcaccgacattcagtagttcatgatcaagaaactggggagaagtattgccctctggaccatgttatcatgaaccaaaacgaggagatgtttactgtcagtaacagttctctttcagagtttggcgttcttggatttgaattgggttactcgatggaaaatcccaattcattggtaatctgggaagctcaatttggtgattttgccaatggggctcaagtgatatttgatcagtttcttagtagcggtgaatcaaagtggttacgacaaactgggcttgttgtgcttcttcctcatggatatgatggtcagggtcctgaacattcaagtgcacgattggaacgcttccttcagatgagtgatgacaatccttatgtcattcctgaaatggacccaactcttcggaagcaaatccaggaatgtaattggcaagttgtaaatgttacaacccctgctaattacttccatgtcttgcggcgccagctacacaggggattccgtaagccccttgttgtgatggctcccaaaaacctcctccgtcacaaggattgcaaatcaaacctatctgagtttgatgatgtccaagggcacccgggctttgacaaacagggtactagatttaagcgtctcataaaggatcagaatgaccactctgatcttgaaaagggtatcagacgcctggttctttgctctggaaaggtttattacgaacttgatgaagagcgcaaaaagaatagtgctcaggacgttgcaatatgtagggtggagcaattgtgtccattcccatatgatctcatccagcgtgagctcaagagatatccaaatgccgagattgtttggtgccaggaagagccaatgaacatgggtgcatacagttacattgcaccccgtctttgcactgcaatgaaggaattggaacgaggatctatagaggacatcaagtatgttggacgtgctccatctgcttcaacagctactggtttctaccaagtccatgtaaaggagcagactgaactactgcaaaaagctatgcagcctgaacccataaagtatcctttttgaagcctttgcaatctttt

SEQ ID NO: 1775 - DNA, 3574 bp, Chelidonium majus
gacgtagcaagcaagaccaaagcacggacgtacgagtggttctgaaaactgaataactcaccctggttacccccggcgaccgtttctcctgccaaatctcatgtgctccggtttagagaagaaagaaagatcgggtagaattagggtttgaagtatttttggatgcagttttgtggaagaggttaatttggaattttgttgagcgatggcttggtttagggctgcttctagtttagcaaaattggctgctaagaaaaatctagctcaaactagatcttacgttacgagaacacgagcgatccgatctcagtctcagttttttcatactactgcttatagatcgaatgctgctcccgttcctcgtcctgtgccgctttctaggttaactgatagtttccttgatgggacaagcagtgtttacttagaggaattgcagagggcttgggaaactgatcctagtagtgtggatgaatcatgggacaatttcttcaggaactttgttggtcaggcttcgacgtcgcctggtatctctgggcaaactattcaagagagtatgcgtttgttgttgcttgtgagagcttaccaggttaatggccacatgaaagccaagttggatccgttgggtcttgaggaacgtgtgatccctgatgatttggatcctgccatttatgggtttagtgaagctgatctggatagggagtttttccttggtgtgtggagggtgtctgggttcatgtcggagaatcgtcccgtgcaaacccttcgagctatattgactcggcttgagcaggcttactgtgggagtattgggtatgagtacatgcatatttctgaccgcgacaagtgtaattggttgagagacaagattgagacgccgacgccgaggcaatataattcacagcgacgtgaagttatgctcgataggcttatgtggagtacgcagtttgagaatttcctggcgaccaagtggacggctgcaaagaggtttggtcttgaaggtggggagactttgattcctgggatgaaagagatgtttgatagggcagctgacatgggggttgagagtattgttatcgggatgtcgcatagaggaagattgaatgttttgggtaatgtcgttaggaagcctctccgtcaaattttcagtgagttcagtggaggtacaaagccaatagatgaagttggactatacacagggactggagatgttaagtatcacttgggaacttcttatgatcgacccaccaggggtggaaagagactccatctgtctttggttgcgaacccaagtcatttggaagctgtggaccctcttgtggtcggaaaaactcgagcgaaacagtactattctaatgatgtggacagaaccaagaatttgggtgtgttgattcatggtgatggaagttttgctggacagggtgttgtctatgagactctgcatcttagtgcccttcctaactatacaactggtgggacgatccacatcgtggtgaataaccaagtggccttcacaactgatccgagggctggaagatcttcacaatattgtaccgatgtggctaaagccttggagtgtcctatttttcatgtaaacggtgatgacttggaggctgttgttcatgcatgtgagcttgcagcagagtggcgacaaacattccattctgatgtggtggttgatataatatgctaccgtcgatttggtcacaatgagatcgatgaaccatctttcacacagccaaaaatgtatcagatcattcgaaatcatccatcagctcttgagatataccaaaagacactcttagaatcagagcagatttcacaagaagacattgacaggatgcagactaaggtcaactccattctcaacgaagagttcataaacagcaaagattatgttcctaaaagaagggactggcttgctgcttattggactggatttaaatcacctgaacagatttcacgtgtccgaaacactggggttaaaccagagatactgaagaatgtcggcaaagccataacgagccttccagatactttcaagcctcacagagctgttaagaagatatttgaacagcgtgcccagatgattgaatcaggggagggtattgactgggcagttggagaagcacttgcttttgctacattgctagtggagggtaatcacgtacgattgagtggtcaggatgttgaaagaggtacgtttagtcatcggcattcggtaattcatgaccaggaaaccggggaaaagtactgtcctctggaccatgtgaccatgaaccaaaatgaggagatgtttactgtcagtaacagctctctttctgagtttggtgtccttggatttgagttgggttattcaatggaaaatccaaattcattggtaatctgggaagcccagtttggtgatttttcaaatggagctcaggtgatgtttgatcagtttttgagcagtggggaatcaaaatggttacgtcaaacaggccttgttgtgctgcttcctcatggttatgatggtcagggccccgaacattcaagtgcaagattggagcgtttccttcagatgagtgatgataacccctatgttatccctgaaatggaaccaactcttcggaagcagatccaggagtgcaattggcaggttgccaatgtgacaacccctgctaattatttccatcttctacggcgacagatacacagggaattccgtaagccactaattgtgatggcacctaaaaacttgctacgtcataaggattgcaagtcaaatctgtccgagtttgatgatgtcaaaggtcaccccggttttgacaagcaagggacccgtttcaagcgccttataaaagatcagagagaccgttctgaccttgaggagggtgtcaggcgtttggttttgtgctctgggaaggtttattacgagcttgatgaagagcgaaagaaagtcaatggcgatgatgttgcaatctgcagggtggaacagctttccccgtttccatatgacctcatccagcgagagctgaagcgatatccaaatgcggaggttgtgtggtgccaggaagagccgatgaacatgggtgcatacagttacattgctcctcgtctttgtaatgcaatgaaggctcttggtagaggaacttatgaggacatcaaatacatcggccgtgccccatcagcagccaccgccactggtttctacacagttcacacaaaggagcagactgagcttgtacaaaaagcactgcagcctgaaccaatcaattatccttactgaattagcttcctcaaggtcaatcccaatgaataattttcctaatggggactcatcatcaatccagattaattatctgagcttttgtatatgtaggtttagggtggttaatcctttcccttgaatccatgactatgaggatcatttactttttgcagatctgtcatggctgcattttttttcttcttcttatttgtaaattcaagttttgtgcactgcatttcttttaactatctcggaaaactatgtgccctaagtttgatgcaatgactctgtaccgggggccatcaataattgcacaactgaatggta

SEQ ID NO: 1776 - DNA, 3646 bp, Malus domestica
gattggacagggttttgtatgattgaggggtttgagcagtgaaagaaaaatttgtgtagaattgggataaagtttgtgtgattgatagattgggttggtagctatgtcgtggtttcgagctgggtctagtgtggcaaagcttgccattaggagaagtttgtcgaatagtggatcctatgcggctagaaggcgggtccttccgtcccaaagccgagattttcacaccacaatatctaaatcgagggctgccccggttccacgccctgtacccctctccaggctaactgatagtttcttggatggaaccagtagtgtttatctggaggggcttcagagggcttgggaagctgatcccaatagcgtcgatgagtcgtgggacaatttctttaggaattttgtggggcaggcctctacctctcccggaatttcggggcagaccattcaagagagtatgcgcttgttgttgcttgtgagggcataccaggttaatggccacatgaaggctaaattggaccctttgggtttggaggagagagatatcccagatgatttggaccctgctctatatgggttcactgagtctgatctcgacagggagttctttttgggggtctggaggatggctgggtttttgtctgagaaccgtcctgtgcagacccttaggtccattttgacccggcttgagcaggcttactgtgggaccattgggtatgagtatatgcacattgcagatcgtgagagatgtaactggttgagagacaagattgagactcctacgcccatgcaatacaataggcagcgccgtgaggttattcttgataggcttatttggagtacacagtttgagaacttcttggctactaagtggacaacagcaaagaggttcggacttgaaggtggagaaactcttattccgggcatgaaggagatgtttgatagggctgctgatctcggggttgagagcatagtaattggaatgcctcacagaggcagactgaatgtattgggtaatgtggtgcggaagcctttgcgtcagatatttagtgaatttagtggtggtacaaagcctgtggatgaagttgggctttacactgggactggtgatgtcaagtatcacttgggaacctcttatgatcgacccacaagaggtgggaagagaattcatttatctttggttgcaaatccaagtcacttggaagctgtggaccctgtcgttgtcggaaaaactagagcaaagcagtattattcaaatgatgcggacaggaccaagaatatgggcattttgattcatggagacggtagctttgctggacaaggtgtggtctatgagactctgcatttgagtgctcttcctaactacaccactggtgggactatacacattgtggtgaacaaccaagttgccttcacaactgacccaatgtcgggaagatcttctcagtattgtactgatgttgccaaagcattgaatgcccctattttccatgtaaatggtgatgacatggaggcagtcgttcatgtctgtgagcttgccgctgaatggcgccagactttccattctgatgttgtggtggatttagtgtgctatcgtcgatttgggcataatgagattgacgagccatctttcacacagcccaatatgtacaaggttattcggaatcatccctcagctctaacaatctaccagaacaaacttctagagtctggacaagtgaccaaagaagacattgaaaggatacaaaacaaggttaattcaattctcaatgaagagttcttgtctagcaaggattatgttcctcaaagaagggactggctttcatctcattggtctggatttaagtcacctgagcagatttctcgtatccggaatactggggtaaaaccagagattttgaagagtgttggcaaagctgtcactgcccttccagaaacttttaaacctcacagagcagtaaagaaggtgtatgaacaacgtggacaaatgattgagactggtgaagggattgattgggcagttgctgaagcacttgcctttgccacactactagtagaaggtaaccatgttcgactgagtggtcaggatgttgaaagaggtacctttagtcatcggcattctgttcttcacgaccaggaaactggggaaaagtattgtcctcttgaccatattacggctggccaagatgaggaaatgtttacagttagcaacagctcactctcagagtttggtgttcttggatttgaattgggttactcgatggagagtccaaatgcattagtgatttgggaagctcaatttggtgattttgccaatggagctcatgttatctttgatcagtttttgagtagtggggagtccaagtggcttcgtcaaactgggcttgttgtgctgcttcctcatggttacgatggccagggccctgaacattctagtgcccgcctagagcgatttcttcagatgagtgatgacaatccttttgtcatacctgagatggatcccacacttcgaaagcaaattcaggaatgcaattggcaggttgtgaacgtgacaactcctgccaactacttccatgtactgcgtcgtcagatacacagggaattccgcaagcctcttattgttatggctcctaaaaaccttctacggcacaaggactgcaaatcaaatttatctgagtttgatgatgtgcaaggccacccaggttttgacaagcaggggactagatttaagcgactcatcaaggaccagaatcaccactctgatcttgaggagggtattagacggctggttctgtgctctggcaaggtttattatgagcttgatgaacagcgaagaaaggttgaagcaaaggatgttgcaatttgtagagtggaacagctttgccccttcccgtatgaccttatccagcgagagctgaagcgatatccaaatgctgagatagtttgggtccaggaagagccaatgaacatgggtgcctacagctatattgcaccccgccttagcactgccatgaagtccctgggtagaggaactatcgacgacatcaaatatattggccgtgctccatcagctgcatcagccactggtttctattcagttcatttgaaggaacaaagtgagattgtacagaaagcggtacagaaggagccaattgaatctcacagctgaagcagcgcctctcagacattaagattttttgcttctttgtttaatgctcgtgtttttgagaacaaggtcaatctgctttatcatcaacgacacaaggttggttagactttggccattccggatgattatctttcggatattcattgttatttcccgttatgtatttggttaagcatgattatactacttggaaggtttttgtctcgtcctttccactccttgaatttcgttaaactgatatctccggcggcatgtatctcaacaccacaacaagaatttgattgcaaatgactcttgagtatattgctcaaaattaagcatggttaaggaaaaaaaataactaaggggaaggttaacgagagaatttatagggcatatttgtattcaattcgttaaacttttagtcttcattgtttgtcgcacattttgtatagcctactttgtaattttttcaactatctgaactgtataaattttaattca

SEQ ID NO: 1777 - DNA, 3618 bp, Cucumis sativus
aatggggttgtttagagctggttctgctctggcaaaggttgccattaggagaactttagcacaagggggaggatcttatgctgccagatcacgtatcatttcatctcagaatcgatattttcacaccacgctttttaagcccaaagcacaatctgcgccggtgcctcgccctgttcctctttcgaagctaactgatagcttcctcgatgggaccagcagtgtgtatttggaggagcttcaaagggcttgggaggatgaccccaatagtgtcgatgagtcttgggacaatttctttaggaattttgtgggtcaggccgcaacctctcctggtatttcagggcagacaattcaagagagtatgcgtttgttgttgcttgttagggcttaccaggttaatggtcacatgaaagccaagttggatccattgaatttggaagaaagagaaatcccggatgatttggatcctgccctttatggatttacggatgctgatcttgacagggaattcttccttggtgtgtggaggatggctggatttttatcagaaaatcgtccagtgcagactctcagatcaattttgacccgtcttgagcaagcttactgtgggagtgttggatatgaatatatgcatattgcagatcgtaacaaatgtaactggttgagagacaagattgagaccccaacaccaatgcagtacaatcggcagcgccgagaggtgattcttgatcgccttatatggagcacacagtttgagaacttcttagccactaagtggaccacagcaaaaagatttggacttgaaggtggtgagactttgattccagggatgaaggagatgtttgatagggctgctgaccttggagttgagagcattgttattggaatgcctcaccgaggaagactaaatgttttgggtaacgttgttcggaagcctcttaggcagatctttagtgagtttagtggtggtacgaagcctgtggatgaagttggactttacacaggaactggtgatgtcaaatatcacttgggtacttcctatgatcgaccgactagaggtggaaaacatattcatctttctttggttgcaaatccaagtcacttggaagctgttgatccagttgttgttgggaaaactagagcaaagcaatattactccaatgacattgaaaggatcaagaatatgggcattttgattcatggggatggtagctttgcaggacaaggtgtggtgtatgaaactcttcatcttagtgctcttcctaactacaccactggaggaacaatccacattgtcgtgaataatcaagtcgcttttactaccgatcctagggctggaagatcatcacaatattgcactgatgttgccaaagctctggatgctcctattttccatgtaaatggtgatgacatggaagctgttgtccatgtttgtgagcttgctgcagagtggcgccaaacctttcattcagatgtagttgttgatctggtttgttatcgtcggtttggacacaatgagattgatgagccatcgttcacacaacctaagatgtatcaggtcatcaggaatcatccttcatctcttgaaatctaccagaaaaaactcttagaatctgggcaggtgagtcaggaggatatcaataaaatacgtgataaggttaataaaatccttaacgaagaatttttggcgagcaaagattatgttccaaagagaagagactggctttcggcatattggtctggtttcaagtctcctgaacagatctcaagagttcggaacactggagttaaaccagagatactaaagaatgttggaaaagctattactgtatttccagaaaatttcaagcctcacagagcagtaaaaaaagtttacgaacaaagagcacaaatgattgaaacaggagagggcattgactgggcacttggtgaagcccttgcttttgccactttgcttgtggaaggaaaccacgtcagattgagcggccaagatgttgagagaggtacctttagtcatcgacattctgttgtgcatgatcaagaaacaggagcgatctactgtcctctggaccatgttatcatgaatcagaatgaggagttgttcactgtaagcaacagttctctttcagagtttggagttcttggatttgagttgggttattcaatggaaaatcctaattcattggtaatctgggaagcccagtttggtgatttttcaaatggtgctcaagttatatttgatcaattcttgagcagtggtgaagcgaagtggctgcggcagacagggcttgttgtgctgcttcctcatggctatgatggccagggccctgaacattcgagtgcaaggttggaacgtttccttcagatgagtgatgataacccttttgttattccggagatggattctacccttagaaagcaaattcaggaatgcaactggcaagttgtgaatgttaccactcccgccaactatttccatgttcttcggagacagattcacagggagttccgtaagcccctagttgtgatggcccctaagaatcttcttcgacacaaagattgcaagtctaatttgtccgagtttgatgatgttcaaggtcatccaggctttgacaagcaaggaaccagatttaagcgcctcataaaggaccaaaacaatcactctgatcatgaagagggtattagacgtctagttctttgctctggaaagatttactatgagcttgatgacgagcgaactaaatcggatggaaaagacgtcgcaatatgtagggttgaacaactttgcccctttccttatgacctcatccagcgggagctgaagcgatatccaaatgccgaggtcgtctggtgtcaggaggaaccaatgaacatgggcgcatttacctacatttctccccgtcttgccactgccatgagggctcttggaagaggcacattcgaagacattaaatacgtcggtcgtgctccgtcagcctccactgccactggattctatactgttcacgtaaaggaacaaactgagctggtgaagaaagcattgcagcctgaacctatcaatagcagcttctgaacacattctaagttctttaacttggaatttctcctgaataatcctgaacattccagcaatggtaagctcctcttctcccttccccacacacacacacaaaaaaaaaaaaaaaaaaaaatcacgaggattaacaaaccttaaagctgaagttttagtggtctgattaccctatcccttgatttttgcatgcagtgtgatgcgagcatcatccactaagaccatttttaattgagattttcctttttttgacgttgatatgtcaatgataatagctttttttgtggttggattaatagaagattggatatatacttcgttcaataattgcagaaagactaatctgcacagttttccactcactcaccaatggaagtagtctttgttttttgttttcttcccaagtggtcagattatgtataatttgatcccaaatcttgattctacactttcaattatactttaatgccatttctctatggaaggaaactcttcttattctcatttattagttgaaagttgaagggttttgaaattgtttgaatgtggat

SEQ ID NO: 1778 - DNA, 3494 bp, Tripterygium wilfordii
gcaccacagcaccatgctttacgacgcctttaccaaccatcgtcgctccgtagccgattagggttttctctcatctcaaaccctatattactgccctggattttgcacaacatatatatgtgatttgagatatagtcttctcggtgaattttagttggattgatagccatggcgtggtttagagctggctctggtttagttagacttgctattaggaggactctgtcacagagtggatcatcatacacgggtaggacgcggatccttcccgctcagaatcgatattttcattctacggtgtttaaatctaaagcgcaagctgcgcctgtgcctcaccctgtgcctctctctaggctaactgatagtttcttagatgggactagtagtgtctacctagaggagcttcaacgcgcttgggaagctgacccaaatagtgtcgatgagtcctgggacaatttctttaggaattttgtggggcaggctgctacatctcctggaatttcaggccaaacaattcaggagagcatgcgtctgctgttgtttgtgagggcttaccaggtcaatggacacatgaaggctaagttggatccgttgggtctagaagaaagagaaatcccagaagatttggaccctgcactttatggattctcggaagctgacctggatagggaattctttttgggagtgtggaggatgtctgggtttttgtctgaaaatcgtcctgttcagactctccgatccatattgaccaggcttgagcaggcctattgtgggagcatcggttatgagtacatgcacatccctgaccgtgatcaatgcaattggttaagagagaagatagagaccccaacacccacacaatataatcggcagcgtcgtgaggttattcttgacagacttatatggagtacccagtttgaaaattttttggctactaagtggacaacagcaaagaggtttggtcttgaagggggcgagtcactgattcctggtatgaaggaaatgtttgatcgttcagctgatcttggtgttgagaacatagttattggaatgcctcacagaggtagactaaatgttcttggtaatgtggttcgaaagccgcttcgccaaatatttagcgagtttagtggtggcacaaagcctgtggatgaagtggggctctacacaggtactggtgatgtcaaatatcacttgggaacttcttatgaccgtccaaccagaggtgggaagagaattcatttgtctttggttgccaacccaagtcacttagaagctgtggatccagttgttgttggtaaaactagagccaaacagtattactcgaatgatctggataggactaagaatatgggcattttgattcatggggatggtagctttgctggacaaggtgttgtctatgagactcttcatcttagtgctcttccaaactataccactggtgggactatacacattgtagtgaacaaccaagtggctttcacaactgatccaaaggcaggcaggtcttcacagtattgcacagatgttgccaaggcactgaatgctcccattttccatgtgaatggagatgatattgaggctgttgttcatgtgtgtgagcttgctgcagagtggcgacagacgttccattcagatgctgttgttgatctagtgtgctacaggcgatttgggcacaatgagattgacgagccttccttcacgcagcccaaaatgtatcaggtcataaggaatcatccctcaagtcttgagatctaccaaaagaagctccttgaatctgggcaggtgacaaaggaagacattgataggatacaagagaaagtaaattcaatccttaatgaggaatttttggccagcaaagattatgttccaaaaagaagggactggcttgcatctcattggtctggtttcaagtctcctgaacagctttcacgaatcagaaacactggggtaaaacctgagattttgaagaatgttggcaaagcgatcacagcccttccagatacttttaagccccacaggggagtaaagaaagtttatgaacaacgtgcacaaatgattgaaacaggggaaggaattgactgggctctggcagaggcgcttgcttttgccacactgctagtagaaggtaatcatgtccgtctgagtggtcaggatgttgaaagaggtacatttagtcatcgacattctgtacttcatgaccaagaaacaggggatatgtattgccctctagaccatgttatcatgaatcaaaatgaagagatgttcactgtcagtaacagttcgctttcggagtttggtgttcttggatttgagttgggttattcaatggaaaatcctaattcgttggttctctgggaggctcaatttggtgattttgctaatggggctcaagtgatatttgatcagttccttagcagtggggagtcaaagtggttgcgtcaaactgggcttgttcttctgcttcctcatggttatgatggccagggtcctgaacattcaagtgcacgactagagcgttttcttcagatgagtgacgacaacccttttgttatccctgagatggatccaactatgaggaaacaaattcaggaatgcaactggcaggttgtgaatgttactactcctgccaattactttcatgttttgaggcgtcagttacacagggatttccgtaagcctctcgttgtaatgtctcccaaaaaccttctacgtcacaaggaatgcagatcaaatctctctgagtttgatgatgtcaagggccacccaggttttgacaaacaagggaccagatttaagcgcctaataaaggatcagaatcttcactctgaccttgaagagggtattaggcgtctagtactttgttctggaaagatttactatgagcttgatgaagagcgaagaaaggtcaatgcaaatgatgttgcaatctgtagagttgaacagctttgccccttcccatatgacctcatccaacgtgagcttaagcgatatccaaatgctgagatcgtttggtgccaggaggagccaatgaacatgggggcgtatagttacatttctccccgccttttcactgccatgaaagcgctgggcagaggaggtatggatgatataaaatatgccggtcgtgctccatctgctgcgacagccactggtttctatcaggcacatgtgaaggaacaatctgagcttgtgcacaaagccttgcagcctgaaccagtaaattacccatgctgaagcctttgcgaaatcctttcaagaccaattatagaagaataatggtcacattcattactggtttgatggatggttattttcctttaatttttctctcgtttctggttcattttaccttaaatatacccgaggcactacggtattatcatacgatcatagtttgcgtatctgactatgctttgatgcacccaaaaatgggtgaatttgaatgtaataagattcaatctgcatgaattgttgttgctacagcttgtgga

SEQ ID NO: 1779 - DNA, 3663 bp, Papaver somniferum
taaaaacataaaaatagtacatttacttccagaagaaggaatagggatttagggatttaataaaaagttgttaaaattctgacaaagaggtagtctagaagaaaaacaccactcagaaaatgcctcttggcggctactttgtggatttctagggtttctgtttcagataattttacgcgttcgaagattagggaaatacaagaaaagcaacagtcatgacgtggttcagagctgcatctagtgtagcaaagttagctgctaagagaaatctaactcaagtaagatcttacacgacaagaacacggttaatcccttcacaagcacgaggtttccattcgacgattttcaactcaaaagcagcttcatcagcgccagtcccacgtgcagtgcctctttcaaggctaactgatagttttcttgatggaacaagtagtgtttacttagaggagttgcaaagagcttgggaagctgacccgagtagcgtggatgaatcatgggataatttcttcaggaattttgttggtcaagctgcaacatctccagggatatcggggcagacaatacaagaaagtatgcgtttgttgttgcttgtaagagcgtatcaggttaatggacatatgaaggctaatttggatccgttagctttggaggaacgtgaaattcctgatgaattggaccctgctctttatgggtttactgaggctgatcttgacagggagttctttcttggggtgtggaagatggctgggtttttgtctgagaatcgtcctgtccaaacacttagaggtatcctgactcgtctggagcaggcatattgtggaagtgttgggtatgagtatatgcatattgcagatcgtgaaaagtgtaactggttgagagacaaaatcgaaacaccaacccaaggcaatataaccagcagcgtcgtgaagttatgcttgatagacttatgtggagcacgcagtttgagaatttcctggcaacaaagtggacggctgcaaaaaggtttggcctcgaaggcggtgaaactctgattcctggtatgaaagagatgtttgacagggcagcagatcttggggttgagagcattgttattgggatgtcacatagagggagattgaacgttctgggcaatgtcgtcagaaagccacttgctcagattttcagtgaatttagtggaggtataaagcccattgacgaagttgggctttacacaggaactggtgacgtcaagtaccacttgggaacttcttatgatcggccaacaaggggtggaaagagaatccatctatctttggttgcaaatccaagtcatttggaggctgtcgatcctgttgtggttggaaaaacacgagcaaaacaatattactctaatgatgtggagaggacaaaaaatttgggtatattgattcatggagatggaagttttgcaggtcagggtgtggtctatgagacactgcatcttagtgcccttcctaactatacaactggtggaactatccatattgtagtgaacaaccaagtggccttcacaactgatccaagcgctgggagatcttcacaatattgcactgatgttgcaaaggcgttgaatgcaccaattctccatgttaatggtgatgacttggaagcagttgttcatgtttgtgagcttgcagcagagtggcgccagatgtttcattctgatgtggtggttgatatagtttgttatcgtcgattcgggcacaatgagatcgatgagccatcatttacgcaacctaaaatgtatcaggtcatccgaaaccatccatcagctcttgagatttaccagaagaaacttgtagagcaaggacaaattggacaggatgacatagacagaatacatagcaaagttagtggcattctgaatgaagagttccttaagagcaaagattatgttccgaaaaaaagggactggctttcagcttattggactggatttaaatcacctgaacagatttcacgtgtccataacactggggtcaagccagagatattgaagactgttggcaaagcaataacaacccttccagagacttttaagcctcacagagcagtcaaaaagatatttgagcagcgtgctcagatgattgaaacagaagagggcatcgactgggcagtgggagaagcacttgcttttgctacactgctagtggaaggtaatcatgtcaggttgagtggtcaggatgtggaaagaggtacgtttagccaccgacatgcagtacttcatgatcagctaagcggggataaatattgtcctctcgaccacattgtgatgaaccagaatgaggaactgtttactgtcagcaacagttcgctctctgaatttggtgtccttgggtttgaattgggttattcaatggaaaatccaaattcgctagttatatgggaggcccagtttggtgatttttccaatggggctcaggtgatatttgatcagtttttgagcagtggggagtcgaagtggctgcgtcaaactggactagttgtcctactacctcatggttatgatggtcagggtcctgaacattcaagtgcccgactggagcgtttccttcagatgagtgatgacaatccttatgttatacctgagatggatccaacacttcggaagcagattcaagaatgcaattggcaggttgtgaacatcacaacccctgctaactatttccatgtccttcggcgccagattcacagagaattccggaagccacttgttgtgatggctcctaaaaaccttcttcgccacaaagactgcaagtcaaacctatccgagtttgatgatgtccaaggtcacccaggattcgacaagcagggcacccgattcaaacgtctcattaaggatcagaacgaccactccgatcttgaggagggcatcaggcgcctggttctgtgctctggaaaggtttattatgagcttgatgaagagcgtaagaaagctcagggaaaagatgttgcaatctgcagggtggagcagctatgccctttcccatatgacctaatccagcgagaattgaagagatatcctaatgcagagattgtgtggtgccaagaagagccaatgaacatgggtgcctacaactacattgcacctagactatggaccgcaatgagggcacttggccgaggaggtttggatgatattaaatacgtgggtcgtgctccttctgctgcaactgccactggtttctatacagtgcacacgaaagagcagaccgaacttgtgaagaaagcgattcagcctgaaccaatccaacaatatgcttgctgaacaaaattgaccattactgctaagccaatataggtgaggaataatcaaacatgcatactgaagaacagcctgcaaatatgattaaacaataatcaaatcattgttacgggaagaaccttaaaatatcttccctccatattttctttgtcttcttttgcattatataccaatcttcagtactttgtactaatcaggtaacatgaaattttttgatctgtgggatatatattagttgtgcaggtgaactgcattttactccaatttcttcagaacaaaacggtaaataccgaattatcacattgctcttattttggatacgtggatatcactgctgcaacctagcaaaatggacttttttcatcacaaaaaaaaaaaaa

SEQ ID NO: 1780 - DNA, 3470 bp, Papaver somniferum
ctgaagagaacaccactcagaaaaagcctcttggcggccactttgtggatttctagggtttctgtttcagataattttacgcgttcgaagactagggaaatacaagaaaagtaacagtcatgacgtggttcagagctgcatctagtgtagcaaagttagctgctaaaagaaatctaactcaagtaagatcttacacgacaagaacacggttaatcccttcacaagcacgaggtttccattcgacgattttcaactcaaaagcagcttcatcagcgccagtcccacgtgcagtgcctctttcaaggctaactgatagttttcttgatggaacaagtagtgtttacttagaggagttgcaaagggcttgggaagctgacccgagtagcgtggatgaatcatgggataatttcttcaggaattttgttggtcaagctgcaacatctccaggaatatcggggcagacaatacaagaaagtatgcgtttgttgttgcttgtgagagcgtatcaggttaatggacatatgaaggctaatttggatccgttagctttggaggaacgtgaaattcctgatgaattggaccctgctctttatgggtttactgaggctgatcttgacagggagttcttccttggggtgtggaagatggctgggtttttgtctgagaatcgtcctgtccaaacacttagaggtatcctgactcgtctggagcaggcatattgtggaagtgttgggtatgagtatatgcatattgcagatcgtgaaaagtgtaactggttgagagacaaaatcgaaacaccaaccccaaggcaatataaccagcagcgacgtgaagttatgcttgatagacttatgtggagcacgcagtttgagaatttcctggcaacaaagtggacggctgcaaaaaggtttggcctcgaaggcggtgaaactctgattcctggtatgaaagagatgtttgacagggcagcagatcttggggttgagagcattgttattgggatgtcacatagagggagattgaacgttctgggcaatgttgtcagaaagccacttgctcagattttcagtgaatttagtggaggtataaagcccattgacgaagttgggctttacacaggaactggtgacgtcaagtaccacttgggaacttcttatgatcggccaacaaggggtggaaagagaatccatctatctttggttgcaaatccaagtcatttggaggctgtcgatcctgttgtggttggaaaaacacgagcaaaacaatattactctaatgatgtggagaggacaaaaaaatttgggtatattgattcatggagatggaagttttgcaggtcagggtgtggtctatgagacactgcatcttagtgcccttcctaactatacaactggtggaactatccatattgtagtgaacaaccaagtggccttcacaactgatccaagcgctgggagatcttcacaatattgcactgatgttgcaaaggcgttgaatgcaccaattctccatgttaatggtgatgacttggaagcagttgttcatgtttgtgagcttgcagcagagtggcgccagatgtttcattctgacgtggtggttgatatagtttgttatcgtcgattcgggcacaatgagatcgatgagccatcatttacgcaacctaaaatgtatcaggtcatccgaaaccatccatcagcccttgagatttaccagaagaaacttgtagagcaaggacagattggagaggatgacatagacagaatacatagcaaagttagtggcattctgaatgaagagttccttaagagcaaagattatgttccgaaaaaaagggactggctttcagcttattggactggatttaaatcacctgaacagatttcacgtgtccataacactggggtcaagccagagatattgaagactgttggcaaagcaataacaacccttccagagacttttaagcctcacagagcagtcaaaaagatatttgagcagcgtgctcagatgattgaaacagaagagggcatcgactgggcagtgggagaagcacttgcttttgctacactgctagtggaaggtaatcatgtcaggttgagtggtcaggatgtggaaagaggtacgtttagccaccgacatgcagtacttcatgatcagctaagcggggataaatattgtcctctcgaccacattgtgatgaaccagaatgaggaactgtttactgtcagcaatagttcgctctctgaatttggtgtccttgggtttgaattgggttattcaatggaaaatccaaattcgctagttatatgggaggcccagtttggtgattttccaatggggctcaggtgatatttgatcagtttttgagcagtggggagtcgaagtggctgcgtcaaactggactagttgtcctactacctcatggttatgatggtcagggtcctgaacattcaagtgcccgactggagcgtttccttcagatgagtgatgataatccttatgttatacctgagatggatccaacacttcggaagcagattcaagaatgcaactggcaggttgtgaacatcacaacccctgctaactatttccatgtccttcggcgccagattcacagagaattccggaagccacttgttgtgatggctcctaaaaaccttcttcgccacaaagactgcaagtcaaacctatccgagtttgatgatgtccaaggtcacccaggattcgacaagcaggggacccgattcaaacgtctcattaaggatcagaacgaccactccgatcttgaggagggcatcaggcgcctggttctgtgctctggaaaggtttattatgagcttgatgaagagcgtaagaaaactcagggaaaagatgttgcaatctgcagggtggagcagctatgccctttcccatatgacctaatccagcgagaattgaagagatatcctaatgcagagattgtgtggtgccaagaagagccaatgaacatgggtgcctacaactacattgcacctagactatggaccgcaatgagggcacttggccgaggaggcttggatgatattaaatacgtgggtcgtgctccttctgctgcaactgccactggtttctatacagtgcacacgaaagagcagaccgaacttgtgaagaaagcgattcagcctgaaccaatccaacaatatgcttgctgaacaaaattgaccgttactgctaagccaatataggcgaggaataatcaaacatgcatactgaagaacagcctgcaaataatgattaaacaataatcaaatcattgttacggtatcttccctccatattttcttttcttcttttgcattatataccaatcttcagtactttgtactaatcaggtaacataaaaatttgatctgtggaatatatattagttgtgcaggtgaactgcattttacaaccaaaaaactaaaaactaggaacgtactcgaaccgaa

SEQ ID NO: 1781 - DNA, 3318 bp, Panicum virgatum
gcgcggcccccggcgccgcgcctgcgcgctacttccactccacgcgcccgcgcaggttcgccgcgcccgcgccccgcgcggtgccgctctcgcgcctcaccgacagcttcctcgatgggaccagcagcgtctacctggaggagctgcagcgggcctgggaagcggaccccaactcggtcgacgagtcgtgggacaacttcttccgcaacttcgtcggccaggcagccaccacctcgccaggcctctccgggcagaccatccaggagagcatgaggctgctgctgctcgtcagggcgtaccaggtgagcggacacttgaaggccaagctggacccgctggggctggaggagcgcccggtcccggacgtgctggacccggcgttctatgggttctctgaagcggatttggaccgtgagttcttcctaggagtgtggaggatggcggggttcctgtccgacaaccggcctgtgcagacgctgcgttccgtgttggagcggcttgagcaggcctactgtggcaccattgggtatgaatacatgcacattgctgaccgtgaaaagtgtaactggctcagggagaagatcgagactgttaacccaagggagtacacctatgatcgtcgccaggtcatgctcgataggcttatctggagcacacagtttgagaatttcttggcgaccaagtggaccaccgcaaagcggttcggtcttgaaggtgcagagactctgatccctggcatgaaggagatgtttgacagggcagctgatcttggtgtagagagtattgtcattggtatgccacacagaggcaggctgaatgttttgggaaatgtcgtgcggaagcccttgcgacagatcttcagtgagttcagcggtggtaccaagcctgttaatgaaggggaagggttgtatacagggactggtgatgtcaagtaccatctaggaacttcgtatgataggcctaccaggggtgggaaacatattcatctgtcactggttgcaaacccgagtcatttggaagcagttgatcctgttgttgctgggaagacaagagcgaagcagtactactctaatgatcgtgacaggaccaaaaatttgggggtattgctgcatggtgatggtagtttctcagggcagggagttgtgtatgagaccctgcatctcagtgcccttgagaactacaccactggtgggacaatacatattgtggtcaacaatcaggttgcattcactactgatccaaagtcagggagatcctcacagtattgcactgatgtagcgaaagcattggatgctccgattttccacgttaacggtgatgatttggaggccgtggttcatgtctgtgagcttgctgcagaatggcgacaaacatttcactctgatgtggtggtggacattgtatgctaccggcgatttggccataatgaaatcgacgagccctccttcacccaacctaaaatgtacaaggtgatccggaaccatccaagtgcgcttgagatttatcaaaataagctgttagaatctgggaagatctcgaaggaagatattgacaggttaaacaagaaggtcagcactatactgaatgaggaattcaagaacagcaaagactatgtccccaacaagagggactggctttcagcttactggactgggttcaagtcaccagagcagatttcacgtatcagaaacactggtgtcaagccggagattctaaaacgtgttggagaagccatgactactctgccagaaaatttcaagcctcacagggctgtgaagaagatttttgatcagcggcgtcagatgattgagactggagaaggcattgattgggcagtgggtgaagcacttgcttttgctactcttatagttgaggggaaccatgtcaggttaagtggtcaggatgttgagaggggtacattcagccaccgtcattctgtcatccatgaccaggaaactggagagcggtactgcccgctcgacaatcttgttatgaaccaagatgaagagctttttactgtgagcaacagttccctgtcagaatttgctgttctgggctttgagttgggttactccatggagaacccaaactcactggtcctatgggaagctcagtttggtgattttgcaaatggagctcaagttatatttgatcagttcctgagtagtggggagtcaaaatggctccgccagactggccttgtcgtgtgccttcctcatggatatgatggtcaggggcctgaacattctagtgcaagactggagcgctttcttcagatgagtgatgacaacccttatgttatacccgagatggatccaacactgcggaagcaaatccagcagtgcaattggcaggttgtgaatgtaacgactcctgcaaattacttccatgttctccgtcgccagatacaccgggacttccggaagcctttgattgtgatgtccccaaagaacctccttcgccacaaggattgcaagtcgaatctatctgagtttgatgatcttgcgggccaccctggatttgacaagcaagggacacgcttcaagcggctcataaaggaccagaacaatcacaaggaccttgaggagggaatcaaccgtctagttctttgctctggaaaggtgtattatgaacttgatgaagaaagaaggaagacggagcgcactgatgttgccatatgtagagttgaacagctctgcccgttcccatacgacctcatccagcgggagttgaagagatatccaaatgccgagatcgtgtggtgccaggaggagccgatgaacatgggtgcgtacagctacattaacccccgcctgctgacggcgatgaaggcgctgggccggggtagcatcgaggacatcaagtacgtgggcagggccccatcggcggccaccgcgacgggcttctactcggtgcacgtgcaggagcagacggagctggtgcagaaggcgctgcagcgcgaccccatcaactactcgttctgattctgatgaaagaaatcccctgtagattcttggagtagccctggaattggagacctttttgattttgataccactagtaccgtagagagagcaggtccgagtcatacctgtgcagcagccatttggtgaagggaagggaaataattcgtttcggatgtacggtaccggatgaacgaaaaactcccgttttagcgcatgttttgttctgcatcgcgtaaattttataagctggtaaatgttgttattacaagtgccggaaacattacttgcggttgaaaattcatgtttttttatcagaggtgatgcgtagatcctgttattacaagtatcaaaa

SEQ ID NO: 1782 - DNA, 3580 bp, Amsonia hubrichtii
gctggcttactgtagccgttgatagattttctctttgtggcttcatctctccagcttgactgcgatttcgctacggctgagctagggtttctccgaacctcaacttctctatatacgattggtttgggaatataatgactgttattagggcctaaatttggctgaggaagtataaaagcattacagaatcaaaacattagctgagtgcaatggcgtggtttagagctgggtctaatgtggcaaagcttgctgtcagaagaactctggcacagggaggaggttcatatgctgcaagaacccgtgtcatccctccgcaaagccgatattttcatacaactgttttcagacgtaaagcacaatctgcgcccatccctcgtcctgttccactgtctaaattaactgatagtttcttagatggtactagcagtgtttaccttgaagagctccaacgtgcatgggagcaggacccagatagcgttgatgaatcatgggataacttcttcaggaactttgttggccaggctgccacatcacctggaatttctggccaaacaattcaagagagtatgcggctgttgttgcttgttagagcatatcaagtttatggccacatgaaagccaagttggatcccttgggtttagagcagagggaaattccagatgatttagatccggctttgtatgggtttactgaaggtgatcttgaccgtgagttcttcattggtgtgtggaggatgtccgggttcttgtctgagaatcgtcctgtgcaaacattaagagccatattgacgcggcttgaacaggcttactgtggtactattggttatgagtacatgcacattgctgaccgcgagaagtgtaattggttgagggacaggattgagactcccacaccgactgaatacaatcgtgagagacgcgaggttattcttgatcgtttgatctggagttcgcagtttgaaaatttcttagctactaagtggacagctgccaagagatttggtcttgaaggtgctgagaccttgattcctggcatgaaagagatgtttgataggtcagcagatcttggggttgagaacatagttattggaatgtcccatagagggagactgaatgttctgggtaatgttgtgcggaagcccctccgccaaatatttagcgagttcagtggtggtacgaaaccttcagatgaggttggcttatacactggaactggtgatgtcaagtatcacctgggaacttcttatgaccggccaactagagggggaaagagaattcatttgtcactggtagcaaatcccagtcacttggaagctgtggacccagttgtggttggaaaaacaagagcaaaacaatattattctaatgatgtggatagaacaaggaatatgggtattttgattcatggagatggcagctttgcaggacaaggggttgtatatgagactcttcatcttagtgctcttcctaattatactactggagggactatacacatcgtggtgaataatcaagtggcgtttacaactgatcccagggcaggaagatcttcacagtattgtactgatgttgccaaagccttgaatgctccaattttccatgtcaatggtgatgatgtggaggcagtggttcatgcctgtgaacttgctgctgaatggcggcagacattccattcagacgttgtggttgacatagtttgttatcgtcgatttggtcacaatgagattgatgagccatcctttacccaacccaagatgtacaaggtcatccgcagtcatccttcggctcttgagatttaccaacagaaacttctagaatctgggcaagtgtctaaagaagacattgataggataagtaagaaggttaattcaattcttaatgaagaatttgtggccagcaaagattatgtcccgcaacgaagggactggctttcagcttactgggctgggttcaaatcccctgaacagctttcacgtatccgaaacactggtgttaagccagagattttgaagaatgttggcaaggcaatcacaagccttccagagaattttaagcctcacagagcagtaaagagggtgtatgatgaacgtgcaaagatgatcgagacaggggagggtattgactgggcattaggggaagcacttgcttttgcaactttgcttgtagaaggaaatcatgtcaggttgagtggtcaggatgttgaaagaggtacttttagtcatcgacattcagtccttcatgaccaggtaacaggagagcaatattgtcctcttgatcatgtaatgatgaaccagaatgaagaaatgtttactgtgagcaacagttcgctttcggagtttggtgttctgggctttgaattggggtactcaatggaaaatccaaattccttggtactgtgggaagcccaatttggagatttctcaaatggagctcaagtcatatttgatcagttcgtgagcagtggagaggccaaatggctgcgtcagacgggtttggttgtcctccttcctcatggctacgatggccagggccctgaacattctagtgcacgtttggaacggttcctccagatgagtgatgataacccctatgttataccagaaatggacccaacactcagaaagcagattcaagaatgcaattggcaggtggttaatgtaactacacctgcaaattatttccatgtccttcggcgtcaactacatagggaatttcgtaaaccacttattgtgatgtctccaaagaacttgctccgtcataaagaatgcaagtcaaatctttctgagtttgatgatgtccaaggtcatccaggttttgataagcaagggaccagattcaagcgcctcataaaagaccagaatgaccactcagatcttgaggagggcattagtcgtctgattctttgctctggaaaggtttattacgagcttgatgaacagaggagaaaggtggagaggaaggatgttgctatttgtcgggtagaacagctttgtcccttcccatatgacctcatccagcgtgaattaaagcgatacccaaatgcagagattgtttggtgccaggaagagccaatgaacatgggggcatacagttacatatcccccagactttgcactgccatgaaagcattgggaaggggtgatatggatgacattaaatatgttggtcgtgctccatctgctgccactgctactggtttccttcaggtccacttcaaggagcaaacagaacttgttcaaaaagctttgcagcctgagccaattaattacccgtgctaaactcaccaaatgaaacatgacgcgaactgacatactaccagttttgaataatcattcaagaacttgtggatgcccacatagtttgttgcttgtgctttttggtggtctaaaacctctcttttacccttataatctgtgtacacgaagtgaataaggattgacacattctttttttgtctggtatcagcttgagcagattctgttgtagcccttacagagcttgcagaaacggcgctgatatttcaggctaatatgtgaaaatgctttaggtatttatccaagttactaaaaagggctgattt

SEQ ID NO: 1783 - DNA, 3587 bp, Papaver somniferum
aacaccactacagaaaatgcctcttggcggccactttgtggatttctagggtttctgcttcagataattttacgcgttcgaagggaaatacaagaaaagtaacagtcatgacgtggtttagagctgcatctagtgtagcaaagttagctgctaagagaaatctaactcaagtaagatcttacacgacgagaacacgattaatcccttcacaagcacgaggtttccattcgacgattttcaactcaaaagcagcttcatcagcgccagtcccacgtgcagtgcctctctcaaggctaactgatagttttcttgatggaacaagtagtgtttacttagaggagttgcaaagagcttgggaagctgacccgagcagcgtcgatgaatcatgggataatttcttcaggaattttgttggtcaggctgcaacatctccagggatatcggggcagacaatacaagaaagtatgcgtttgttgttgcttgtgagagcgtatcaggttaatggacatatgaaggctaatttggatccgttagctttggaggaacgtgaaattcctgatgaattggaccctgctctttatgggtttactgaggctgatcttgacagggagttctttcttggggtgtggaagatggctggatttttgtctgagaatcgtcctgtccaaacacttagaggtatcctgactcgtctggagcaggcatattgtggaagtgttgggtatgagtatatgcatattgcagatcgtgaaaagtgtaactggttgagagacaaaatcgagacaccaaccccaaggcaatataaccagcaacgtcgtgaagttatgcttgatagacttatgtggagtacgcagtttgagaatttcctggcaacaaagtggacggctgcaaaaaggtttggccttgaaggcggtgaaactctgattcctggtatgaaggagatgtttgacagggcagcagatcttggggttgagagcattgttattgggatgtcacatagagggagattgaacgttctgggcaatgtcgtcagaaagccacttgctcagattttcagtgaatttagtggaggtataaagcccattgacgaagttgggctttacacaggaactggtgacgtcaagtaccacttgggaacttcttatgatcggccaacaaggggtggaaagagaatccatctatctttggttgcaaatccaagtcatttggaggctgtcgatcctgttgtggttggaaaaacacgagcaaaacaatattactctaatgatgtggagaggacaaaaaatttgggtatattgattcatggagatggaagttttgcagggcagggtgtggtctatgagacactgcatcttagtgcccttcctaactatacaactggtggaactatccatattgtagtgaacaaccaagtggccttcacaactgatccaagtgctgggagatcttcacaatattgcactgatgttgcaaaggcgttgaatgcaccaattctccatgttaatggtgatgacttggaagcagtcgttcatgtttgtgagcttgcagcagagtggcgccagatgtttcattctgacgtggtggttgatatagtttgttatcgtcgattcgggcacaatgagatcgatgagccatcatttacgcaacctaaaatgtatcaggtcatccgaaaccatccatcagcccttgagatttaccagaagaaacttgtagagcaaggacagattggacaggatgacatagacagaatacatagcaaagttagtgacattctaaatgaagagttccttaagagcaaagattatgttccgaaaaaaagggactggctttcagcttattggactggatttaaatcacctgaacagatttcacgtgtccacaacactggggtcaagccagagatattgaagactgttggcaaagcaataacaacccttccagagacttttaagcctcacagagcagtcaaaaagatatttgagcagcgtgctcagatgatcgaaacagaagagggcatcgactgggcagtgggagaagcacttgcttttgctacactgttagtggaaggtaatcatgtcaggttgagtggtcaggatgtggaaagaggtacgtttagccatcgacatgcagtacttcatgatcagctaagtggggataaatactgtcctctcgaccacattgtgatgaaccagaatgaggaactgtttactgtcagcaacagttcgctctctgaatttggtgtccttgggtttgaattgggttattcaatggaaaatccaaattcgctagttatatgggaggcccaatttggtgatttttccaatggggctcaggtgatatttgatcagtttttgagcagtggggagtcgaagtggctgcgtcaaactggactagttgtcctactacctcatggttatgatggtcagggtcctgaacattcaagtgcccgactggagcgtttccttcagatgagtgatgataatccttatgttatacctgagatggatccaacacttcggaagcagattcaagaatgcaattggcaggttgtgaacatcacaacccctgctaactatttccatgtccttcggcgccagattcacagagaattccggaagccacttgttgtgatggctcctaaaaaccttcttcgccacaaagactgcaagtcaaacctatccgagtttgatgatgtccaaggtcacccaggattcgacaagcaaggcacccgattcaaacgtctcattaaggatcagaatgaccactccgatcttgaggagggcatcaggcgcctggttctgtgctctggaaaggtttattatgagcttgatgaagagcgtaagaaagctcagggaaaagatgttgcaatctgcagggtggagcagctatgccctttcccatatgacctaatccagcgagaattgaagagatatccaaatgcagagattgtgtggtgccaagaagagccaatgaacatgggtgcctacaattacattgcacctagactatggaccgcaatgagggcacttggccgaggaggcttggatgatattaaatacgtgggtcgtgctccttctgctgcaactgccactggtttctatacagtgcacacgaaagagcagaccgaacttgtgaagaaagcgattcagcctgaaccaatccaacaatatgcttgctgaacaaaattgaccgttactgctaagccaatataggcgaggaataatcaaacatgcatactgaagaacagcctgcaaataatgattaaacaataatcaaatcattgttacggtatcttccctccatattttcttttcttcttttgcattatataccaatcttcagtactttgtactaatcaggtaacataaaaaattttgatctgtggaatatatattagttgtgcaggtgaactgcattttactccaatttcttcagaacaaaacggtaaataccgaattatcacattgctcttatttcaagagattcttattttggttttcgttctggataggtggatatgtcctgaggttttgcttcactttgaattctagtgtgttttcatcacacctgcaacctagcaagatgga

SEQ ID NO: 1784 - DNA, 3556 bp, Nicotiana benthamiana
agtggaaatgcatttttgagcttaacacgcgtttatagcagcagccgcttgaacgttgaatcgtccgttttctcttcaaaaaattccatcattctcagctattggccatgtcgctctagggtttgtaaccctaaccttcttcctctacttctctctcctcgcaattttaggtcgaggaattattaaaactttccaagagttcatttagatttcagaacttaagttgcagtaatggcgtggtttagagctggttctagtgtggcaaggcttgccattagaagggctctgtcgcagggtggttcttacgtcccaagaactcgcgttcttccatcacaaggtcgatgttttcacaccacaattgccaggccgaaggcacaagctgctcctgtccctagaccagtaccactctctaagttgactgacagtttcttagatggaacgagcagcgtctaccttgaggagcttcagcgagcctgggagcaagacccaaatagtgttgacgagtcatgggataacttctttaggaattttgttggacaagctgccacttcgcctgggatttctggtcagacgatccaagagagtatgcgtcttctgttgcttgtgagagcttatcaggtcaatggtcacatgaaagctaaactggatccattaggtttggaagagagggaaattcctgatgatttggatccagcattatatgggttcactgaagctgatcttgatagagagttcttccttggtgtttggaggatgtctggattcttgtctgagaatcgtcccgtgcaaactttgagggcaatattaacacggcttgagcaggcttattgcggaagcattggttacgagtacatgcatatttctgatcgtgataaatgtaattggttgagggaacggattgaaaccccaacatctatggagtataatcgtgagcggcgtgaagttattcttgaccgactgatgtggagtacacagtttgagaacttcttggccacaaagtggatggcagccaagagatttgggcttgaaggttgtgagaccttgattcctggcatgaaggagatgtttgatagggcagcagatcttggagttgagagcatagttattgggatgccacatagaggaagattaaatgttttaggtaatgttgttcgaaagccactaaagcagattttcagtgagtttagcggcggcacaaaacctggggatgaagctggttatgtgggaactggtgatgttaagtatcacttgggaacttcttatgatcggcctactaggggtgggaagagaattcatctatctttggttgcaaatccaagccacttggaagctgtggatccggttgttattggaaaaactagagcaaagcaatattacagtaatgacgtggatagaacaaagaacatgggtattttgctccatggtgatggtagttttgcaggacaaggtgttgtctatgagacactgcatctgagtgctcttccaaattactcgactggtgggaccattcacattgtggtaaataatcaagtggcgttcactactgatccaagggctggaagatcatctcagtactgtactgacgtcgcaaaggctttgaatgctccgattttccatgtcaatggtgatgacgttgaggcagcggttgctcatgtgtgtgaacttgctgcagaatggcgccagaaattccactcagatgttgtggttgatattgtctgttatcgtcgttttggacacaatgaaattgacgaaccttccttcacccagcctaaaatgtataagatcatcagaaatcatccttcatcattggagatctatcaaaacaaactcctaaaatccggtcaggtgaccaaagatgacgtggaaaagatacataacaagattaatagaatccttaatgaagagttcgttgctagtaaagattatgtccctcaaaaaagagattggctttctgccttttgggctgggtttaagtctccttcacagctttcacgtgttcggaacactggtgtcaaacccgagatcttgaagaatgttgggaaagcaatcacaatgcttccagacgattttaagcctcacagggcagtgaaaaggatttttgatgatcgccaaaaaatgattgagacaggggagggtgttgactgggcagttggagaagcacttgcttttgcaacattgcttgtggaaggcaatcatgttaggttgagtggtcaggatgttgagagaggaactttcagtcacagacattctgttcttcatgatcaggagacaggggcacagtactgccctcttgatcatgttatgatgaaccaaaatgaagagatgttcaccgtgagcaacagctccctttcagagtttggtgttctgggatttgaattgggttattcaatggaaaacccaaattcgttggtactttgggaagctcaatttggtgatttcgccaatggagctcaagtaatatttgaccagtttgtgagcagtggagaggcgaagtggttgcgccagtctgggttggttgtgcttttgccacatggttatgatggccagggccctgagcattcaagtggacgtttggaacgtttcctccagatgagtgatgacaacccatttgttatcccagagatggaacctacactacgaaagcagattcaggaatgtaattggcaggtggtcaatgtaacaactcctgcaaattatttccatgttttgcggcgtcaaattcacagagatttccgtaagcctctcattgtgatggccccaaagaacttgcttcgtcacaaagactgcaagtcaaatctatctgagttcgatgatgtccaaggccacccaggtttcgacaaacaaggtaccaggtttaagcgcctgataaaagataagaatgaccactcagatcttgaagagggtatcagaaggctggtcctttgctcaggaaagatttattatgagcttgatgaggaaagaaagaaagccgatgggaaagatgttgctatctgtcgtgtggaacagctttgtcctttcccatatgaccttatccagcgtgaattgaagcgatatccaaatgcagagatagtttggtgccaagaagagccaatgaacatgggtgcattccattacattgcaccacgcctttgtactgccatgaaatcactaggcagaggtaacatggatgacatcaagtatgtcggtcgcgctccttctgctgccacagccactgggttcttccaagttcatgtgaaagagcagtctgagcttgtgcagaaagccgtgcagcgtgatcctgttaactatccgttctgaagctgaagcgttcacttatccatagcactagcctccaaaactgatgcgacaatagaatgtttacttttctctgttcctggtatagtccaatgagagtttcagttgtttggaaataaaataaggcctttttgtttgtgctctttttcagttggttaaacgatttaactgatgctttcacatgtatacgtcaatcagttggtaacagttttgatgagcaagacaactcgctcacggtctatcctagttctttctttccttt

SEQ ID NO: 1785 - DNA, 3815 bp, Citrullus lanatus
ttcggtctgaggccaaggcaaggcagtatcgcttttcggcgatttgagggtttcgaatttcttcgccatttcgaattgtctagtggaagctgcagatgtatgtgattgggtagaaagaaagtctgagaaatattgatttggaacagctatttttttcttcttcttcttttttttttgtccttatttgttttggggagttttgatttgtaagaatggggttgtttagagctggttctgctttggcaaaggttgccattaggagaactttggcacaggggggaggatcgtatgctgcgagatcacgtatcatttcgtctcagaatcgatattttcatacgacggtttttaagtccaaagcacaatctgcgccagtgcctcgcccggtgccactttcgaagctaactgatagctttctggatgggacgagcagtgtgtatttggaggagcttcaaagggcttgggaggctgaccccaacagtgttgatgaatcatgggataatttctttaggaattttgtgggtcaggctgcaacgtctcctggtatttcaggccagacaattcaagagagcatgcgtttgttgttgcttgttagggcttaccaggttaatggtcacatgaaagccaagttggatccattgagtttggaagaaagagaaattcctgatgatctggaccctgcactttatggatttacagatgctgatcttgatagggaattcttccttggcgtgtggaggatggctggctttttatcagaaaatcgtccagtgcagactctcagatcaatattgacccgccttgagcaagcttactgtgggagtgttggatacgaatatatgcatatcgcagatcgtaataaatgtaactggttgagagacaagattgagaccccaacaccaatgcagtacaatccgcagcgccgagtggtgattcttgatcgtcttatatggagcacacagtttgagaacttcttagccactaagtggactacagcaaaaagatttggacttgaaggtggtgagactttgattccagggatgaaggagatgtttgatagggctgcagatcttggagttgagagcattgttattggaatgcctcaccgtggaagactaaatgttttaggtaatgtcgtccggaagcctcttaggcagatctttagtgaatttagtgggggtacaaagcctgtggatgaagttggactttacacaggaactggtgatgtcaaatatcacttgggtacttcgtatgatcgaccaactagaggtggaaagcatattcatctttctttggtcgcaaatccaagtcacttggaagctgttgatccagttgttgttgggaaaactagagcaaagcaatattactccaatgacactgaaaggatcaagaatatgggcgttttgattcatggtgatggtagctttgctggacaaggtgtggtgtatgaaactctgcatcttagtgctcttcctaactacaccactgggggaacaatccacattgtcgtgaataatcaagtggcttttactaccgatcctagggctggaagatcatcacaatattgcactgatgttgccaaagctttggatgctcctatattccatgtaaatggtgatgacatggaagctgttgtccatgtttgtgagcttgctgcagagtggcgtcaaacctttcattcagatgttgttgttgatttggtttgttatcgtcggtttggacacaatgagattgatgaaccatccttcacacaacctaagatgtatcaggtcataaggaatcatccttcatctcttgagatctaccagaaaaaactcttagaatctgggcaggtgagtcaggaggatatcaacaacatacgtgataaggttaataaaatcctcaatgaagaatttttggcgagcaaagattatgttccaaagagaagggactggctttcagcatattggtctggtttcaagtcacctgaacagctctcaagagttaggaacactggagttaaaccagagatactaaagaatgttggaaaagctattactgtatttccagataatttcaagcctcacagagcagtcaaaaaagtttacgaacaaagagcacagatgattgaaactggagagggcattgactgggcacttggtgaagcccttgcttttgccactttgcttgttgaaggcaaccatgtcagattgagtggccaagatgttgagagaggtacctttagtcatcggcattgtgcatgatcaagaaacaggggcaatctactgtcctttggaccatgttatcatgaatcagaatgaggagatgttcactgtaagcaacagttctctttcagagtttggagttcttggatttgagttgggttattcaatggaaaatcctaattcattggtaatctgggaagctcaatttggtgatttttcaaatggtgctcaagttatatttgatcaattcttgagcagtggagaagcgaagtggctgcggcagactgggcttgttgtgctgcttcctcatggctatgatggccagggccctgaacattcaagtgcaaggttggaacgtttccttcagatgagtgatgacaacccttttgttattccggagatggattctacccttagaaagcaaattcaggaatgcaactggcaagttgtgaatgttaccactccggccaactatttccatgttctgcggagacagattcacagggagttccgtaagcccctagttgtgatggcccctaagaatctgcttcgacacaaggattgtaaatctaatctgtccgagtttgatgatgttcaaggtcatccaggctttgacaagcagggaaccagatttaagcgccttataaaggaccagaacaatcactctgatcatgaagagggtattagacggctagttctttgctctggaaagatttactatgagcttgatgacgagcgaactaaggcagatggaaaggacgttgcaatatgtagagttgaacaactttgcccctttccttatgaccttatccagcgggagctgaagcgatatccgaatgccgagatcgtctggtgccaggaggagccaatgaacatgggtgcatttacctacatttctccccgtcttgccactgccatgagggctcttggaagaggctcgtcagaagacattaaatatgtgggtcgtgctccatcagcttctacagccaccggattctattcggttcacgtaaaggaacaaaccgagctggtgaagaaagcattgcagcctgaacctatcaagaacgcattctgaacacattcttagttggatgactttgcaatttctcctgaataatcttgaaatggtaatgcttctctttccacccccccccccaaaaaaaaaaaaaaaaaaaatgaaaatcatacgaggatgaacagacctgaaagctgaagttttagtggtctgaataccctgccccttgatttttgcatggagtgtgatgcgagcatcatccactaagaccattttttaattgagattttctttttgatgttgatatgtcaatgataatatctttttgtggttggattaatagagatttgatacataacttgttcaataattgcagaaagactaatctgcacagttttccactcaccaatgaaactactttgtttttgtttccgtaccaagtggtttatcatggacaattgatctcaaatcttgatgatagtctttcaattatacttcaatgccttgtttctatggaaggaaactcttgttctcgtttattagttgaaaattgaagtggtttgaaattgtttgaatgagaatttaacgaaatgtatcat

SEQ ID NO: 1786 - DNA, 3757 bp, Populus trichocarpa
gaattaacaacgacaacaataataataatcagcttcgagaatactgggaaagaaagaaaacgagagcacactgttgttgaattcaagacagcataatcgctttttcacggcgctagggtttccatccctttctctccggtgttcttcaacaaggcagaagtacatgttttttatgattgatttttgagcctgggaggtatatagtatatagtctttgaagaattggtggtattgggtttgtgtggactgacagctatggcatggtttagagcgggttctggtgtagcaaggcttgctatcaggaggactttatctcagggtggatcatatgcaacgagatcacgggttataccccctcagaatagatactttcattcaacagtctttaagtcaaaggcgcaagctgcccctgtcccccgtcctgtgcccctctctaagctaactgataacttcttagatgggaccagtagtgtttatttagaggagcttcagcgagcctgggaaactgatccaaacagcgtggatgaatcgtgggacaatttctttaagaactttgtgggtcaggctgctacttctcctggaatttcaggccaaactattcaggagagtatgcgtttgttgttgcttgtcagggcttaccaggttaatggtcacatgaaagccaagctggatccattggggctggaagaaagagaaatcccagatgatttagaccctgctctatatggtttcacagatgctgatcttgatagagaattctttttgggagtgtggaggatggctggatttttgtccgaaaaccgtccagtgcagactcttagagccatattgaccaggcttgagcaggcttattgtgggagcattgggtatgagtacatgcacattgcagatcgtgaaaaatgcaactggttgagagacaagattgaaaccccaacatctatgcagtacaaccgtcagcggcgtgaagttattcttgataggttaatatggagtacgcagtttgaaaacttcttggccactaagtggacgacagctaagaggtttggactcgaaggtggggagactttgattcctggaatgaaggagatgtttgataggtcagctgatcttggggtggagagcatagttattggaatgcctcacagaggaagattgaatgtactgggtaatgtggttcggaaaccactccgtcaaatatttagcgagtttagtggtggcacaaaacctgtagatgaagttgggctctacactggaactggtgatgtcaagtatcacttgggaacttcttatgaccgtccaacaagaggtggaaagagaatccatctatctttggttgcaaatcctagtcatctagaagctgtggatcctgttgttgttggaaaaactagagccaagcaatattactccaatgattctgacaggactaagaacatgggaatattgattcacggcgatggtagcttcgctggacaaggtgtagtgtatgaaactctacatcttagtgcactgccaaactatacaactggtgggaccatacatattgtggtgaacaaccaagtcgctttcacaactgatcctagggcaggaagatcttcacagtattgcactgatgttgccaaggcattgaatgcacctattttccatgtaaatggagatgatatggaggcagttgttcatgtgtgcgaacttgcagctgagtggcgccagactttccattcagatgttgtggttgatttagtgtgctatcgtcgttttgggcacaatgagatcgatgaaccatcttttacccaacccaaaatgtatcaggttattcggaatcatccatcagcactggagatctataaaaagaaactcttagaatctgggcaggtgaccgaagaagatattagcaggatacaggagaaggtcctttcaatcctcaatgaagaattcttggcaagcaaagattatgttcctaaaagaagagattggctttcatctcattggaccgggtttaagtcacctgaacagctttcacgtgtcagaaacactggagtgaaacctgagatcttgaagaatgtaggcaaagcaattaccacctttccagaaaattttaagcctcacagagctgtaaagaaggtctatgagcaacgtctacaaatgattgaaacaggggagggaattgattgggctgttggagaggctcttgcttttgccacacttctagtagaaggcaaccatgttcgattgagtggtcaggatgttgaaagaggtacattcagtcaccgtcattcagtggttcatgatcaggaaactggggagaagtactgccccctggatcatgttgtcatgaaccaagatgaagagatgtttactgtcagcaacagctctctttcagagttcggtgttcttggatttgaattgggttactcaatggaaagtccaaattctttggtaatctgggaagctcaatttggtgactttgctaatggggctcaagtgatattcgaccagttcctgagcagtggtgaatcaaaatggctgcgacaaactggtcttgttttgcttcttcctcatggatatgatggccagggccctgaacattctagtgcacggttggaacgattccttcagatgagcgatgacaatccttatgttatacctgagatggaaccaactcttcgtaagcaaatccaagaatgcaattggcaggttgtaaatgttacaacccctgccaattacttccatgttttgcgccgtcagatacacagagatttccgtaagcccctcgttgtgatagctcccaaaaacctacttcgtcacaaggagtgcaaatcaaatctctcagagtttgatgatgtacaaggccatcctggttttgacaaacaggggaccagatttaaacgtctcataaaggatcggaatgaccactcggaccttgaggagggtatcaggcgtctggttctttgctctggaaagatttattacgagcttgatgaagtgcgtggaaaggttgaggcaaaggacattgcaatttgtagggtggaacagctatgcccgttcccatatgatctcattcagcgtgagcttaagcgatatccaaatgcggagattgtttggtgccaggaagagccaatgaacatgggcgcttacaattacattgctccacgactttccactgccatgaaagcactggaaagaggaacggtggacgacatcaagtatgttggacgtgggccatctgctgcatcagccactggtttctaccaggtgcatgtgaaggaacagactgaacttgtgcaaatggccatgcagcctgaaccaataaagtttcctaactgaagctcttgcgaactgttgagcataaagtctaagaacaacaatcaaacatttatacattaaaaatatgttgtgaagttttgataccatttatatcttgccttgttttatgatgcctgttcatctttttttttcccctttccttcaaaacttctagtcaagggaccttgggtttctttacacccaagctgagctgcatttcgagatactgtcgtcaataacgcggaaggaaatgttcgtctttattgccgcacgattcacagtaacatgggtgttctgcaatttttttgttttgggtattcacgtgttattaccatgaaatgcattggagagacacgttagtagtcgaatatcgattccttaatcggtacatgtgtttgttccagtgcagaggcgtcctaactcgttttaacctctctttgcatcatcaattatgatc

SEQ ID NO: 1787 - DNA, 3782 bp, Populus trichocarpa
gaattaacaacgacaacaataataataatcagcttcgagaatactgggaaagaaagaaaacgagagcacactgttgttgaattcaagacagcataatcgctttttcacggcgctagggttttgtcaggtttccatccctttctctccggtgttcttcaacaaggcagaagtacatgttttttatgattgatttttgagcctgggaggtatatagtatatagtctttgaagaattggtggtattgggtttgtgtggactgacagctatggcatggtttagagcgggttctggtgtagcaaggcttgctatcaggaggactttatctcagggtggatcatatgcaacgagatcacgggttataccccctcagaatagatactttcattcaacagtctttaagtcaaaggcgcaagctgcccctgtcccccgtcctgtgcccctctctaagctaactgataacttcttagatgggaccagtagtgtttatttagaggagcttcagcgagcctgggaaactgatccaaacagcgtggatgaatcgtgggacaatttctttaagaactttgtgggtcaggctgctacttctcctggaatttcaggccaaactattcaggagagtatgcgtttgttgttgcttgtcagggcttaccaggttaatggtcacatgaaagccaagctggatccattggggctggaagaaagagaaatcccagatgatttagaccctgctctatatggtttcacagatgctgatcttgatagagaattctttttgggagtgtggaggatggctggatttttgtccgaaaaccgtccagtgcagactcttagagccatattgaccaggcttgagcaggcttattgtgggagcattgggtatgagtacatgcacattgcagatcgtgaaaaatgcaactggttgagagacaagattgaaaccccaacatctatgcagtacaaccgtcagcggcgtgaagttattcttgataggttaatatggagtacgcagtttgaaaacttcttggccactaagtggacgacagctaagaggtttggactcgaaggtggggagactttgattcctggaatgaaggagatgtttgataggtcagctgatcttggggtggagagcatagttattggaatgcctcacagaggaagattgaatgtactgggtaatgtggttcggaaaccactccgtcaaatatttagcgagtttagtggtggcacaaaacctgtagatgaagttgggctctacactggaactggtgatgtcaagtatcacttgggaacttcttatgaccgtccaacaagaggtggaaagagaatccatctatctttggttgcaaatcctagtcatctagaagctgtggatcctgttgttgttggaaaaactagagccaagcaatattactccaatgattctgacaggactaagaacatgggaatattgattcacggcgatggtagcttcgctggacaaggtgtagtgtatgaaactctacatcttagtgcactgccaaactatacaactggtgggaccatacatattgtggtgaacaaccaagtcgctttcacaactgatcctagggcaggaagatcttcacagtattgcactgatgttgccaaggcattgaatgcacctattttccatgtaaatggagatgatatggaggcagttgttcatgtgtgcgaacttgcagctgagtggcgccagactttccattcagatgttgtggttgatttagtgtgctatcgtcgttttgggcacaatgagatcgatgaaccatcttttacccaacccaaaatgtatcaggttattcggaatcatccatcagcactggagatctataaaaagaaactcttagaatctgggcaggtgaccgaagaagatattagcaggatacaggagaaggtcctttcaatcctcaatgaagaattcttggcaagcaaagattatgttcctaaaagaagagattggctttcatctcattggaccgggtttaagtcacctgaacagctttcacgtgtcagaaacactggagtgaaacctgagatcttgaagaatgtaggcaaagcaattaccacctttccagaaaattttaagcctcacagagctgtaaagaaggtctatgagcaacgtctacaaatgattgaaacaggggagggaattgattgggctgttggagaggctcttgcttttgccacacttctagtagaaggcaaccatgttcgattgagtggtcaggatgttgaaagaggtacattcagtcaccgtcattcagtggttcatgatcaggaaactggggagaagtactgccccctggatcatgttgtcatgaaccaagatgaagagatgtttactgtcagcaacagctctctttcagagttcggtgttcttggatttgaattgggttactcaatggaaagtccaaattctttggtaatctgggaagctcaatttggtgactttgctaatggggctcaagtgatattcgaccagttcctgagcagtggtgaatcaaaatggctgcgacaaactggtcttgttttgcttcttcctcatggatatgatggccagggccctgaacattctagtgcacggttggaacgattccttcagatgagcgatgacaatccttatgttatacctgagatggaaccaactcttcgtaagcaaatccaagaatgcaattggcaggttgtaaatgttacaacccctgccaattacttccatgttttgcgccgtcagatacacagagatttccgtaagcccctcgttgtgatagctcccaaaaacctacttcgtcacaaggagtgcaaatcaaatctctcagagtttgatgatgtacaaggccatcctggttttgacaaacaggggaccagatttaaacgtctcataaaggatcggaatgaccactcagaccttgaggagggtatcaggcgtctggttctttgctctggaaagatttattacgagcttgatgaagtgcgtggaaaggttgaggcaaaggacattgcaatttgtagggtggaacagctatgcccgttcccatatgatctcattcagcgtgagcttaagcgatatccaaatgcggagattgtttggtgccaggaagagccaatgaacatgggcgcttacaattacattgctccacgactttccactgccatgaaagcactggaaagaggaacggtggacgacatcaagtatgtcggacgtgggccatctgctgcatcagccactggtttctaccaggtgcatgtgaaggaacagactgaacttgtgcaaatggccatgcagcctgaaccaataaagtttcctaactgaagctcttgcgaactgttgagcataaagtctaagaacaacaatcaaacatttatacattaaaaatatgttgtgaagttttgataccatttatatcttgccttgttttatgatgcttgttcatctttttttttcccctttccttcaaaacttctagtcaagggaccttgggtttctttacacccaagctgagctgcatttcgagatactgtcgtcaataacgcggaaggaaatgttcgtctttattgccgcacgattcacagtaacatgggtgttctgcaatttttttgttttgggtattcacgtgttattaccatgaaatgcattggagagacacgttagtagtcgaatatcgattccttaatcggtacatgtgtttgttccagtgcagaggcgtcctaactcgttttaacctctctttgcatcatcaattatgatcattttaccatttgtt

SEQ ID NO: 1788 - DNA, 3278 bp, Citrus sinensis
aggttaacgattgaaagctatggggtggtttcgagctggttcaagtgtggcaaagctagccattaagaggactttatctcagggttgttcatataccacaaggacacgcatcgttccgtcgcaaacccggcattttcatagcactgtcttcaaatcaaaggcgcaatctgctcctgtgcctcggcctgtacccttatcaaagttgactgatagcttcttagatgggactagtagtgtctatttagaggagcttcagagagcttgggaagctgatccaaatagcgttgatgagtcatgggataatttctttagaaattttgtcggacaggctgctacttctcctggaatttcggggcaaactattcaggagagtatgcgcttgttgttgcttgtgagagcttaccaagttaatggtcatatgaaagcaaagttggacccattgggattggaagaaagagaaatccctgaagatttggaccctgctctttatgggttcacggaagctgatctcgatagagaattctttataggtgtgtggaggatggctgggtttttgtctgaaaatcgtcctgtgcagacccttagatccatattgacccggcttgagcaggcttattgtgggagtattgggtatgagtacatgcatattgcagatcgtgatcaatgtaattggttgagagataagattgaaaccccaacaccaatgcaatacaatagacaacgccgtgaggttattcttgataggctcatatggagtacacaatttgagaacttcttggcaactaagtggacaacagcaaagaggtttgggcttgaaggtggggaaactttaatccctggcatgaaagagatgtttgacagggcagctgatcttggggtcgagagcatagttattggaatgccccacagaggacgacttaatgtgctaggtaatgttgttcggaaaccacttcgtcaaatatttagtgagtttagtggtggtacgaagcctgtagatgaagatgggctctacactggtactggtgatgttaagtatcacctgggaacttcatatgatcgaccaactagaggtggtaagagaattcatttatctttggttgccaacccaagtcacttggaagctgtagacccagttgttgttggaaaaactagagcgaagcagtattactcccatgatgtggacaggaccaagaatatgggtgttttgattcatggtgatggtagctttgctggtcaaggtgtagtctatgaaactctacatctgagtgcacttccaaactacacaactggcggcactatacacattgttgtgaacaaccaagtggccttcaccactgatccaagggcaggcagatcctctcagtactgtactgacgttgccaaagccttgaatgcccccattttccatgtaaacggggatgacatcggaggcggttgttcatgtatgtgagcttgcagcagaatggcggcagaaattccattctgatgtggtggttgatttagtttgttacaggagatttgggcacaatgagattgatgagccatctttcacccagcccaaaatgtaccaggtcatccggagtcatccatcagcttttgagatctaccaaaagaaactattagaatctgctcaggtgactcaagaagacattaataggatacaggagaaggtcaatacaatcctcaatgaggaattcatggccagcaaagattatgttccaaaacgaagggattggctgtcagcttattgggctgggttcaagtcacctgaacaggtttcacgtattagaaacactggagtaaaaccagagatcttgaagaatgttggcaaagccataaccaaccttccagaaaattttaagcctcaccggggggttaagaaggtgtacgagcagcgtgcacaaatgattgaaactggggaaggcattgattgggcagttggggaggccctcgcattcgctactttgctggtagagggtaaccatgtgcgattgagtggccaggatgttgagagaggaacattcagtcaccggcattctgtgctacatgatcaagaaactggggagaagtattgcccactagaccatgttatgatgaaccaagatgaggagatgttcactgtgagcaatagctctctctcagagtttggtgttcttggatttgaactgggttactctatggaaaatccaaactcattagtattgtgggaagctcaatttggggacttcgctaatggagcacaagtaatttttgaccagtttctcagcagtggtgagtccaagtggttgcgtcaaaccggacttgttgtgctgctcccacatggttatgatggtcagggccctgaacattcaagtgcacgattggagcgtttccttcagatgagtgatgacaatccatttgttatacctgagatggatccaactcttcggaaacaaattcaagaatgtaactggcagattgtgaatgttacaactcctgctaattatttccatgttttgcggcgtcagatacacaggggattccgtaagcctctcatcgtgatttcacccaaaaacctgttgcgtcacaaggactgcaaatcaaatctttccgagtttgatgatgtccaaggtcaccctggttttgacaaacaagggaccagatttaagcggcttattaaggatcagaatggccactctgatcttgaggagggtatcagacgtctggttctttgttctggaaaggtttattacgagcttgatgaagggcggaagaagcgcagtgcaagtgatgttgcaatttgcagggtggaacagctttgtcctttcccatatgacctggttcagcgtgagcttaaacgatatccaaatgccgagatcgtttggtgccaggaagagccaatgaacatgggtgcgtacacctacatttcaccccgacttgccactgccatgaaagcagtgggcagaggaaccatagaggacatcaaatacattggccgcgctccgtctgctgccacagctactggcttctatcaggctcatgttaaagaacaaactgagctcgtgcagaaatccattcatccggaaccaatcaaggcccctgctgaaatctgttaaaaccctattattgtttgttttgatgtttcgataattcttttcctttctgcggcaccatggtgatcagttcacaaatcaagctgaatttccatatcaattttctactctgctgttgtaataatgttaggctgttaccagctatattttgttgcgaggtgaataaactggcaatacatttttgtc

SEQ ID NO: 1789 - DNA, 3621 bp, Citrus clementina
cttggttcgtatggaagcttcagcgtaaaagaggacgctagaacacaaaaggaaacactttgacgtgaaccaaaatagccatcacttcaatcaaatccactataaatgaaaatcaattttctcttttaataaatcctagatctacgctttttaatttcataatttttttctcaaaccgccccagtcaacgcacgccgcgacaggtaaccagtttgccgagttaccggccactcgcagccgttggcggtaacttcttcaccggccgccgccagctgactgaagcacaggctgacatctccaaccgttggaactcgccggtcactggaaaaatcgaatagcacagaaggttaacgattgaaagctatggggtggtttcgagctggttcaagtgtggcaaagctagccattaagaggactttatctcagggttgttcatataccacaaggacacacattgttccgtcgcaaacccggcattttcatagcactgtcttcaaatcaaaggcgcaatctgctcctgtgcctcggcctgtacccttatcaaagttgactgatagcttcttagatgggactagtagtgtctatttagaggagcttcagagagcttgggaagctgatccaaatagcgttgatgagtcatgggataatttctttagaaattttgtcggacaggctgctacttctcctggaatttcggggcaaactattcaggagagtatgcgcttgttgttgcttgtgagagcttaccaagttaatggtcatatgaaagcaaggttggacccattgggattggaagaaagagaaatccctgaagatttggaccctgctctttatgggttcacggaagctgatctcgatagagaattctttataggtgtgtggaggatggctgggtttttgtctgaaaatcgtcctgtgcagacccttagatccatattgacccggcttgagcaggcttattgtgggagtattgggtatgagtacatgcatattgcagatcgtgatcaatgtaattggttgagagataagattgaaaccccaacaccaatgcaatacaatagacaacgccgtgaggttattcttgataggctcatatggagtacacaatttgagaacttcttggcaactaagtggacaacagcaaagaggtttgggcttgaaggtggggaaactttaatccctggcatgaaagagatgtttgacagggcagctgatcttggggtcgagagcatagttattggaatgccccacagaggacgacttaatgtgctaggtaatgttgttcggaaaccacttcgtcaaatatttagtgagtttagtggtggtacgaagcctgtagatgaagatgggctctacactggtactggtgatgttaagtatcacctgggaacttcatatgatcgaccaactagaggtggtaagagaattcatttatctttggttgccaacccaagtcacttggaagctgtagacccagttgttgttggaaaaactagagcgaagcagtattactcccatgatgtggacaggaccaagaatatgggtgttttgattcatggtgatggtagctttgctggtcaaggtgtagtctatgaaactctacatctgagtgcacttccaaactacacaactggcggcactatacacattgttgtgaacaaccaagtggccttcaccactgatccaagggcaggcagatcctctcagtactgtactgacgttgccaaagccttgaatgcccccattttccatgtaaacggggatgacatcgaggcggttgttcatgtatgtgagcttgcagcagaatggcggcagaaattccattctgatgtggtggttgatttagtttgttaccggagatttgggcacaatgagattgatgagccatctttcacccagcccaaaatgtaccaggtcatccggagtcatccatcagcttttgagatctaccaaaagaaactattagaatctgctcaggtgactcaagaagacattaataggatacaggagaaggtcaatacaatcctcaatgaggaattcatggccagcaaagattatgttccaaaacgaagggattggctgtcagcttattgggctgggttcaagtcacctgaacaggtttcacgtattagaaacactggagtaaaaccagagatcttgaagaatgttggcaaagccataaccaaccttccagaaaattttaagcctcaccggggggttaagaaggtgtacgagcagcgtgcacaaatgattgaaactggggaaggcattgattgggcagttggggaggccctcgcattcgctacattgctggtagagggtaaccatgtgcgattgagtggccaggatgttgagagaggaacattcagtcaccggcattctgtgctacatgatcaagaaactggggagaagtattgcccactagaccatgttatgatgaaccaagatgaggagatgttcactgtgagcaatagctctctctcagagtttggtgttcttggatttgaactgggttactctatggaaaatccaaactcattagtattgtgggaagctcaatttggggacttcgctaatggagcacaagtaatttttgaccagtttctcagcagtggtgagtccaagtggttgcgtcaaactggacttgttgtgctgctcccacatggttatgatggtcagggccctgaacattcaagtgcacgattggagcgtttccttcagatgagtgatgacaatccatttgttatacctgagatggatccaactcttcggaaacaaattcaagaatgtaactggcagattgtgaatgttacaactcctgctaattatttccatgttttgcggcgtcagatacacaggggattccgtaagcctctcatcgtgatgtcacccaaaaacctgttgcgtcacaaggactgcaaatcaaatctttccgagtttgatgatgtccaaggtcaccctggttttgacaaacaagggaccagatttaagcggcttattaaggatcagaatgggcactctgatcttgaggagggtatcagacgtctggttctttgttctggaaaggtttattacgagcttgatgaagagcggaagaagcgcagtgcaagtgatgttgcaatttgcagggtggaacagctttgtcctttcccatatgacctggttcagcgtgagcttaaacgatatccaaatgccgagatcgtttggtgccaggaagagccaatgaacatgggtgcgtacacctacatttcaccccgacttgccactgccatgaaagcagtgggcagaggaaccatagaggacatcaaatacgttggccgcgctccgtctgctgccacagctactggcttctatcaggctcatgttaaagaacaaactgagctcgtgcagaaatccattcatccggaaccaatcaaggcccctgctgaaatctgttaaaaccctattattgtttgttttgatgtttcgataattcttttcctttctgcggcaccatggtgatcagttcacaaatcaagctgaatttccatatcaattttctactctgctgttgtaataatgttaggctgttaccagctatattttgttgcgaggtgaataaactggcaatacatttttgtc

SEQ ID NO: 1790 - DNA, 3281 bp, Flaveria ramosissima
cgatctccatatctagattcaagcaactgtttcaattttctgcaaatctaggtgtttgagatcatttaagaaacagagaacttgaaatttgagaaaatgacgtggtttagggctggatctagtgtggcaaagcttgctattagaagaaccgtggcacaaagtgggtcatatgcagcaagaaagcgcatttttccttcagaaagccgatatttccatacaacagttttcaaatcaaaagcgcaatctgcacctgtccctagacccgttccactttctaggttaacagacagctttctagatggaactagcagtgtgtacttggaagaacttcaaagagcttgggaagatgatccaaacagtgttgacgagtcatgggacaatttcttcaggaactttgtgggccaggctgccacgtcacctggaatatctggccaaacaatacaagaaagcatgcgtttgctgttgcttgttagagcataccaagtttatggccacatgaaagccaaaatagatccattgggtcttgaaaaagagagactcctgatgatttggatcctgtcttttacggttttagtgaagctgatttagaccgtgagttttttctcggtgtatggagaatgtctggatttttgtctgaaaatcgacctgtgcaaactcttagatcaatattgaccagacttgaacaagcttattgtggaaatattggttatgaatacatgcacattgctgatcgtgaaagatgtaactggttaagagataaaatcgagaccccaactccaactcaatataatagagaacgccgtgaggttattcttgacaggctcatttggagtactcaatttgaaaactttttagctactaaatggacagctgctaaaagatttggacttgaaggtggcgagacattaatcccaggaatgaaagagatgtttgacaggtcagcagaccttggtgttgaaagcattgtgattggaatgtctcacagaggacgattaaacgttttaggtaatgttgttagaaaaccattgcgccaaattttcagtgaatttagtggtggtacgaagccagttgatgaagttgggctttacacggggaccggtgatgtgaaatatcatcttgggacttcttatgatcgcccaacacgtggcggaaagagaattcatttgtctttagttgcaaaccccagtcatctggaagctgtagatcctgttgtgattggtaaaacaagagcaaaacagtattactcaaatgatgttgatagaacaaagaacatgggtattttgattcatggggatggaagcttcgctgggcaaggtgtggtttacgagactttgcatttaagtggtcttccaaattacacaactggtgggaccattcatatagtagtcaacaatcaagttgcttttacaactgatccacaatcaggaaggtcttcacaatattgtactgatgttgctaaagctttgaatgctccaatttttcatgttaatggtgatgacgtggaagccgtcgttcatgcttgtgagctggcagctgagtggcgtcaaacattccactccgatgttgttgttgatatagtatgttatcgtcgatttgggcataatgaaattgatgaaccatctttcacccaaccgaaaatgtacaagatcatcaggaaccatccatcatcactagaaatctaccagaagaagcttctagaaaatgggcaagcgactaaagaagatattgatagaatacaaagcaaggttaccacaattcttaatgaagagtttcttgccagcaaggattatgtccctcaaagaagagactggctttcggcttactggactggatttaagtcccctgaacagctttcgcgtatccgtaacaccggagttaaacctgagattttgaaaaatgttgggaaagcgattactacacttccagaaacctttaagccacacagagcagttaagaaaatatttgcagatcgttataagatgattgaaactggtgaaggtgttgattgggcagttgcagaagctctagcttttgcaacattactagtggaaggaaatcatgttagattgagtggtcaagatgttgaaagaggtactttcagtcacaggcattctgttgttcatgatcaagaaacaggggagcgttattgtcctttggatcatgtaatgatgaatcaaaatgaggaaatgtttaccgtaagcaacagttctctatcggagtttggtgtgcttggatttgaattgggctattcaatggaaaaccctaattcactggtattatgggaagctcaatttggtgatttttcgaatggtgcccaggtcatatttgatcaattcttgagcagtggtgaggctaagtggctgcgccagactggattggttgtcttgctgcctcatggttatgatggtcaaggtcccgaacactcaagtgcaagacttgagcgtttccttcagatgagcgatgataatccgtttgtcatacctgagatggaaccaacactacgcaatcaaattcaaacatgcaatatgcagattgttaatgttacgacaccagcaaattatttccatgtgttacgtcgacagctgcatagggagttccgtaagccacttattgtaatgtctccaaaaaatttgcttcgtcacaaagactgcaagtccaatttatctgagtttgatgacgttcaaggtcatcctggttttgacaaacaaggaaccagatttaaacggctcattaaggaccaaaatgaccactcagatcttgaagaagggattaggcgtttagttctttgctccggaaaggtttattatgaacttgatgaacaaaggaagtcagttgatggtaaagatgttgcaatttgtcgtgttgaacaactttgcccattcccgtatgatctcatccagcgtgaattaaagcgttatccaaacgcagagatagtttggtgtcaagaggagcctatgaatatgggggcctacagttacattgccccacgtcttgcaacggccatgaaggccctcaatagaggtactattgatgatatcaaatatgtgggccgggctccatctgctgcaactgcaactggtttctacaccgtccatggcagagaacagtctgaacttgtgcagaaggctttgcagcctgaacccgtcaccagtcccgcacttagttagagcctgcagcccggctatgcatctttgtccgagtttcggcttggcttctttttgcttctatttttctgtaagtttttttttgtcgttatgagaagtttacgcatgtaataatac

SEQ ID NO: 1791 - DNA, 3650 bp, Lactuca sativa
tggaagaagggaatcgcggtcgccagtgtccgtatactttgagtcggttcaaatggaaccatcttttttcaacgcaatgaaacaatccatcgatctccatttctagattcaaggagaaaacatcgcctcctcgtcttccacaaaattaggcatttgagataaaccaagagataggcaaactcaaaagttgaaaaagatgacgtggtttagggctggatctggtgtagctaagcttgcaatcaaaagaagcttatcacaaactggaacatatgcagcaaggaagcattttcttccttcacaaactcgacattttcacacaacacttttcaaatcaaaagcacaatctgcacctgtcccaagacctgtccccctttctcgcctaacagacagtttcttagatggaactagcagtgtctaccttgaagagcttcaaagaacttgggaaaacgacccacaaagtgtcgatgaatcatgggacaatttcttcagaaactttgtaggccaagcttccacatcccctggaatatctggccaaacaatccaagaaagcatgcgtttgttgcttcttgttagagcttaccaagtatatggccacatgaaagccaaaatcgatccattgggtcttgaaaaacgtgaaatcccagacgatttagaccctgctttctatggtttcactgaagccgatttagatcgtgagtttttcctcggtgtatggagaatgtctggtttcttatccgaaaatcgccctgttcaaacccttagatcaatcttaacaagactcgaacaagcttattctggaagcattggttatgaatacatgcatattgctgatcgtgaaagatgcaactggttaagagacagaattgaaaccccaactcccactcaatacaacagtgaaagacgtgaagtcattcttgatagactcatttggagcacacaattcgaaaacttcttagccacaaaatggacagctgctaaaagattcggtcttgaaggaggtgagactttaatcccaggcatgaaagaaatgtttgacaggtcagcagatcttggtgttgaaagcattgtaatcggaatgtcccacagaggaagattaaatgtgttaggaaacgttgtgagaaagccattaagacaaatcttcagtgaatttagtggaggaacaaaacctgttgatgaagttgggctctacactggaacaggtgatgtgaaataccacttgggtacttcatatgatcgcccaacaagaggtggaaagaggatacatttgtctttagttgcaaaccctagtcatttagaagctgttgaccctgttgtggttggaaaaacaagagcaaaacagtattactcaaatgatgctgatagaacaaagaacatgggaatcttgattcatggagatggaagttttgcagggcaaggtgtggtgtatgagactttacatttaagtggtcttccaaattacactacaggtggaacaattcatattgtagtcaacaatcaggttgctttcactactgatccacaagctggaaggtcatcacagtattgtacagatgttgctaaagctttgaatgctcctatttttcatgtcaatggtgatgatgtggaagcggttgttcatgcttgtgagcttgcagcggaatggcgtcagacattccattccgatgttgttgttgacattgtttgttatcggaggtttgggcataatgagattgatgaaccttcttttacacaacctaagatgtataaaatcattaggaatcatccttcttcacttgaaatttatcagaagaagcttctagaaactgggcaagctacaaaagaagatattgatagaattcaaagcaaggttacctccattcttaatgaagagtttcttgctagtaaggattatgtccctcaaagaagagattggctttctgcttattggcttggatttaaatcccctgaacaactttcacgtattcgtaacactggggtgaaacctgagattttgaagaatgttggaaaggcgattacaactcttccggaaacttttaagcctcatagagctgttaagaagatatttgcagaccgatttaagatgattgaaagtggagagggtgttgattgggcagttgcagaagctcttgcttttgcaacattacttgtggaaggaaatcatgtgagattgagtggacaagatgttgaaagaggaacttttagtcacaggcattctgttatccatgatcaggaaacaggggacagatactgtccgttggatcatgtaatgatgaatcaaaatgaggaaatgtttactgttagcaacagttctctttcggagtttgctgttttgggatttgagttgggatattcaatggaaaaccctaattcgttggtgttatgggaagctcaatttggggatttttcgaatggagctcaggtgatatttgatcagtttttgagcagtggggaggctaagtggctgagacagactggcttagtcgtgttgctacctcatggttatgatggtcaaggccctgaacactctagtgcaagacttgagcgctttcttcagatgagcgatgataatccttttgttgtacctgaaatggaaccaacactccgcaatcaaatccaaacatgcaactggcaagttgtcaacgtcacaactcccgcaaattacttccatgtgttacgtcgacagctgcatagggagttccgcaagccacttattgtaatgtccccgaaaaatctacttcgtcacaaagaatgcaaatcaaatctatcagagtttgacgatgtccaaggtcacccaggttttgacaaacaaggaacaagattcaaacgtctgataaaagaccaaaatgaccactcagatcttgaagagggaattagacgtttggttctttgctctggaaaggtttattatgaacttgatgaaaagaggaagtcaattgatggcaaagacgttgcaatttgcagagtcgaacagctttgccccttcccatatgacctcatccagcgtgaactcaagcgatatccaaatgcagaaattgtgtggtgccaggaggagccaatgaacatgggagcctacagttacattgccccccgccttgctaccgccatgaaaacactcaacagaggcaccattgacgatgtcaaatacgtcggccgtgctccctctgccgccaccgccaccggtttctacaccgttcatggaagagaacagtcggaacttgtccaaaacgccctccaatctgaacccatcaccaccaaccccaccctatgctaaaaccctaattcccgggtttttgtctttttgtggagtgatgtgcggggatgtttatttttgattttatttgctaatcggggaaaaatgttatgtaataattacaaccaaggtgagatttgtatacgtctcctgccatgtgttcatggcgtaatcagttttttttttttatatgtgttggtgaatcttgatgatgatatctgaaaatgatttatttttgaaagtgttatggttttggaagttgctaagttttaattatattatagatcgaaaggacaccaacctttgtgtttctcaaaagtcatgtgttctagaagtcgtacctgtcgtgtgacatacgtgatgactaagtagttctctcttgcaaacctacctactcaac

SEQ ID NO: 1792 - DNA, 3375 bp, Silene vulgaris
ttttcacaatgtcctttcgactttctctcgcctgccactgattcttctcttcttcatcttcttcgtctactcaattattctctcaattgtcaggttgttctacaagggtgaatttgtgatccgtagttatggtttggtttagagctggatcgaggttggcaaatcttgccgttaggagaactctatcgcaaggacgaacttatgtgaccagaacgcaggtcattgatacacaacgacgagcttttcatagcacaccttttagaagagctgctcctgttcctcgagctgttcccctgtctaagcttactgatagtttcctggatgggaccagcagtgtttacttagaggctctacagagagattgggaagctgacccaagcagtgttgacgagtcatgggacaatttcttcaggaactttgttggtcaagcagctacttcgcctgggatctctgggcagactattcaagagagtatgcgtttgctactgcttgtgagggcttaccaagttaatggtcacttcaaggccaaactagatccgttgggtcttgaggaaaggccggttcctgatgatttgaacctagagctatacggtttcactgaagctgacttggatcgagaatttttccttggagtttggaagatgtctgggtttttgtcggagaaccgtcctgtccaaacccttagaagtatccttaatcgtctcgaacaggcttattgtggaaggattgggtttgagtacatgcatattgctaaccgtgagaggtgtaattggctgcgagacagaattgagactcctagtgctatggaatataataaagaaagacgtcaagtgatgctggacaggcttatatggagcacacagtttgaaagtttcttggccactaagtggactacagctaaaagatttggtcttgaaggttgtgagaccctaattcccggtatgaaggagatgtttgataggtcagctgatcttggggtggaaaatatagttattggaatgtctcacaggggtaggttgaatgtgttgggtaatgttgtacgtaaaccactccgacagatatttagtgaatttagtggtggcacgaaacctacagacgaagttggactttacacgggaactggtgatgtcaaatatcatttaggaacgtcatatgatagacctactaggggtggaaagcggattcatctttcacttgttgccaatccgagtcacttggaagctgtggatcctgtagtggttgggaaaactagagctaaacagtactattctaatgacgttgacaggacaaagaatatggctattttgattcacggtgatggtagctttgctggacaaggtgtagtttatgagacactccatctcagtgctcttccaaattacaccactggcggcaccattcacattgtggtgaacaatcaagtggcttttacaactgatccaagttcagggagatcttcacagtactgtactgatgttgcaaaagctttggatgccccaatattccatgttaatggagatgatttggaggccgtggttcatgtttgtgagcttgctgcagagtggcgtcagacattccattcagatgttgtgattgacatagtctgctatcgtcgatttggtcacaatgagattgatgagccatcattcacacagccaaaaatgtacaaggtcatccgcaaccacccgtcgtctcttgaaatatacaaaaagaaagtccttgagaatggagaattgtcaaaagaagaaatcgatgagatccagaaaaaggttatgacaatccttaatgaggagtttgaagctagcaagaatcatgtgacgaataaaagggactggctttcagcttactggctaggattcaaatctcctgagcagctttctagaattcgtaacactggtgttaaaccagagatcttgaaaaatgttggcaaggcaatcaccaccatccctgagactttcaagccacataaggcagttaaaaggatttatgaccaacgtgcccagatgattgaaacaggggaaggcattgattgggctgttggagaagcactggcatttgctacattgctagtggaaggaaatcacgttcggttaagtggtcaagatgttgaaagaggtactttcagtcataggcattcggtaatccatgatcaggaatccggagaaaaatattgcccattggaccatgtcatgataaaccaaaatgaggaattgtttactgtcagtaatagctccctttcagagtttggtgttcttggatttgaattgggttattctatggagaaccctaattctctggtaatctgggaggctcagtttggagacttctctaacggagcacaggttatctttgatcagttcttaagcagtggagaggcaaaatggttgcgccaaactggtctggtggtgctacttcctcatggatatgatggtcaaggacctgaacattctagtgcaagattggaacgattcctgcagatgagtgatgacaatccctacgtaatacctgatatggaaccaacacttagaaagcaaatccaagaatgcaactggcaagttgtcaacgtgaccacaccagctaattatttccatgtcttgcgtcgtcagatacacagggagttccgtaagcctttaattgtgatggctcccaagaatttgcttcgacacaaagaatgcaagtcgaatttatctgaatttgatgatgttcaaggccacccagggtttgataagcaaggaactagattcaagcgtctcattaaggaccagaatatgcactcagatctcgaggagggcattagacgtctggttctctgctctggaaaagtttactacgagcttgatgagcaaaggaaaaaggcgaatggcagtgatgtagccatttgtagagttgagcagctttgtccgttcccatacgatctcgtccagcgggagttgaggcgatatccaaatgcggaggtggtatggtgccaagaggagccgatgaacatgggtggctacagttacattgcgcctcgtttgtttacagcaatgaaatcagtgggcagaggaaatatcgacgacattaaatacgtaggtcgccctccatctgctgccacggccactggttttctcatggtccatgctaaagaacagaccgagcttgtgcacaaggcattgcagcctgaacccatccaattcccttgatctagtggctgtaaatttgaccaattttctgctcttcccattgtgagggtgttttttacatataataatttagaccgaaaaatggcgattttggtcattgtaaactaaacttcttttctctagaattacaataatgatcggcaaaacattgtaaacctctttttgtatgacatcagatatcatttcttcgtac

SEQ ID NO: 1793 - DNA, 3366 bp, Flaveria ramosissima
gaaacaatacatcgatctccatctctagattcaagcaacggtttctatcttctgcaaaatctaggtgtctgagatcatttaagaaacagagaacttgaaatttgaaaaaatgacgtggtttagggctggatctagtgtggcaaagcttgccatcagaagatccttaacacaaagtggatcatatgcagcaagaaagcgtatttttccttcagaaagccgatatttccatacaacagtcttcaaatcaaaagcacaatctgcacctgtccctagtaccttgtttcctactttctaggttaacagacagctttttagatggaacaagcagtgtctacctggaagaactgcaaagagcttgggaggatgatccaaacagtgttgatgagtcatgggacaatttcttcaggaactttgtggaccaggctgccacgtcacccggaatatccggccagaccatacaagaaagcatgcgtttgctgttgcttgttagagcataccaagtttatggccacatgaaagccaaaatagatccattgggtcttgaaaaaagaagagactcctgatgatttggatcctgctttttacggtttcagtgaagctgatttagaccgtgaatttttccttggtgtgtggagaatgtctggatttttgtcggaaaatcgaccggtgcaaactcttagatcaatattgaccagacttgaacaagcttattgtggaaacattggttatgaatacatgcacattgctgatcgtgaaagatgtaattggttaagagataaaatcgagaccccaactccaactcaatataatagagaacgccgcgaggttattcttgataggctcatttggagtactcaattcgaaaactttttagctactaaatggacagctgctaaaagatttggacttgaaggaggtgagacattaatcccaggaatgaaagagatgtttgacaggtcagcagatcttggtgttgaaagcattgtgattggaatgtctcacagaggaagattaaacgttttaggtaatgttgttagaaaaccattgcgccaaattttcagtgaatttagcggtggtacaaagccggttgatgaagttgggctttacacggggaccggtgatgtaaaatatcatcttgggacttcttatgatcgcccaacacgtggtggaaagagaattcatttgtctttagttgcaaaccctagtcatttggaagctgtagatcctgttgtgattggtaaaacaagagcaaaacagtattactcaaatgatgttgatagaacaaaaaacatgggtattttgattcatggggatggaagctttgcagggcaaggtgtggtttatgagactttgcatttaagtggtcttccaaattacacaactggcgggaccattcatattgtagtcaacaatcaagttgcttttacaactgatccacaagcaggaagatcttcacagtattgtactgatgttgctaaagctttaaatgctccaatttttcatgttaatggtgatgacgtggaagctgttgttcatgcttgtgagctggcagctgagtggcgacaaacgttccactcggatgttgttgttgatatagtctgttatcgtcgatttggtcataatgaaattgatgaaccatctttcacccaaccgaaaatgtacaagatcattaggaatcatccatcatcactagaaatctaccagaagaagcttctagaaagtgggcaagcaactaaagaagatattgatagaatacaaagcaaggttaccacaattctcaatgaagagtttcttgccagcaaggattatgtccctcaaagaagagactggctttcggcttattggactggatttaaatcccctgaacagctttcgcgtatccgtaataccggagttaaacctgagattttgaaaaatgttgggaaggcgattacaacacttccagaaacctttaagccacacagagcagttaagaaaatatttgcagatcgttataagatgattgaaactggtgaaggtgttgattgggcagttgcagaagcactagcttttgcgacattactggtggaaggaaatcatgtgagattgagtggtcaagatgttgaaagaggtactttcagtcacaggcattctgttcttcatgatcaagaaacaggggagcgttattgtccattggatcatgtaatgatgaatcaaaatgaggaaatgtttaccgtaagcaacagttctctatcagagtttggtgtgctgggatttgaattgggctattcaatggaaaaccctaattcactggtattatgggaagctcagtttggtgacttttccaatggtgcccaggtgatatttgatcaattcttgagcagtggtgaggctaagtggctgcgccagactgggttggttgtgttgttgcctcatggttatgatggtcaagggcccgaacactcaagtgcaagacttgagcgtttccttcagatgagtgatgataatccgtttgtcatacctgagatggaaccaacactacgcaatcaaattcaaacatgcaatatgcagattgttaatgttacgacaccagcaaactatttccatgtgttacgtcgacagctgcatagggagttccgtaagccacttattgttatgtctccaaaaaatctgcttcgtcacaaagactgcaagtcgaatttatctgagtttgatgacgttcaaggtcaccctggttttgacaaacaaggaaccagatttaaacgactcattaaggaccaaaatgaccactcagatcttgaagaagggattaggcgtttagttctttgctctggaaaggtttattatgaacttgatgaacaaaggaagtcggttgatggtaaagatgttgcgatttgtcgtgttgaacaactgtgcccattcccatatgatctcatccagcgtgaactaaagcgttatccaaacgcagagatagtttggtgtcaagaggagcccatgaatatgggggcctatagttacattgccccacgccttgcaacggccatgaaggtcctcaatagaggtactattgatgatatcaaatatgtgggccgggctccatctgctgcaactgcaactggtttctacaccgtccatggcagagaacagtctgaactagtgcagaaggctttgcagccggaacccgtcaccagtcccgcacttagttaaagcctgcagcccgggtatgtatctttgtctgagtttcggcttggcctattttttcttcatttttcagaagttttccgcgtactgaaaagttttacgcgtgtaataatacatacaaacgttcatgtgaaatctgtacaatggattcatggtgttgttttttaactcgttctatttcttggc

SEQ ID NO: 1794 - DNA, 3460 bp, Centaurea maculosa
acgattgccatctctagattcaaggacagaaaaacaccgcttcttcctcttccaacaacctaggtgtttgagattattttaagaaacagtgaacttgaagtttgaaaaagatgacgtggtttagggctggatctagtgtggcaaagcttgcgataagaagaaccttatcgcaaagtggatcatatgcagcaaggaagcgtttactcccttcagaaagtcgacattttcacacaacagttttcaagtcaaaagcacagtctgcacctgtccctcgagctgttccactttctaggttaactgatagtttcttagatggaactagtagcgtttacctagaagagcttcagagagcttgggaggatgatccaaacagtgttgatgaatcatgggacaatttcttcaggaactttgttggccaggctgctacctcccctggaatatctggccaaaccattcaagagagcatgcggttgttgctgcttgttagagcttaccaagtttatggccacatgaaagccaagatagatccattgggtctggaaaagagggagattccggatgatttagatcctgctttttacggtttcagcgaagctgatctagaccgtgaattttttcttggtgtatggaggatgtctgggtttttgtctgaaaatcggccggtgcaaactcttaggtcaatattgaccagacttgaacaagcttatagtggaagcattggttatgagtacatgcacattgctgatcgcgaacgatgcaattggttgagggatagaattgagactccaactccaacacaatataatagtgagcgacgtgaggttatccttgacaggctcatttggagtactcagtttgagaacttcttggctactaagtggacggctgctaaaaggtttggacttgaaggtggagagacattaatcccagggatgaaggagatgtttgatcgctcagcagatcttggtgttgagagcattgtgattggaatgtcacacagaggaagattgaatgtcttaggtaatgttgtgcggaagccactgcgtcaaattttcagtgaattcagcggtggcacgaagccagtggatgaggttgggctttacaccggaactggtgatgtcaagtatcacttgggtacttcgtatgatcgccctacaaggggtggaaaaagaattcatttgtctttggttgcaaaccccagtcacttggaagctgtagatcccgttgtgatagggaaaaccagagcaaaacagtattactccaatgatgtggatagaacaaagaacatgggtatcctgattcatggagatggaagctttgcaggccaaggtgtagtctatgagactttgcatctgagtggccttccaaattacacaactggtggaaccatccatattgtagtgaacaatcaagttgcatttaccaccgatccgcaggcaggaagatcttcacagtattgtacggatgttgctaaagctttgaatgctcccatttttcatgtcaatggtgatgacgtagaagcagtggttcatgcttgtgagcttgcagcagagtggcgccagacattccactcagatgttgttgttgatattgtctgttatcgcagatttgggcataatgaaattgatgaaccctcttttacccaaccgaaaatgtacaagatcatcaggaatcacccctcatcactcgaaatttaccagaagaagcttctagaaaccggccaagcaacaaaagaagatattgatagaatacaaagtaaggttacttcgatccttaatgaagaattccttgccagcaaggattatgtccctctgaaaagggactggctttcagcatactggactggatttaagtctcctgaacagctttcacgtattcgtaacactggggtcaaaccagaaatcttgaaaaatgttgggaaggcgatcacaacccttccagaaacttttaagcctcacagagcagttaagaaaatatttgctgatcgttacaagatgatcgaaactggggagggtgtggactgggcagttgcagaagcccttgctttcgcaacattgctagtcgaaggaaatcatgtgagattgagtggtcaggacgttgaaagaggtactttcagtcacaggcattctgttattcatgatcaggaaactggggagcgatactgtcctttagaccatgtaatgatgaatcaaaacgaggaaatgtttactgtgagcaacagttctctttcggagtttggtgtccttggatttgaattgggctattcaatggaaaatcccaattcacttgttttatgggaagctcaatttggtgatttttcgaatggagctcaggtgatatttgatcaattcttgagcagcggggaggccaagtggttgcgtcagactggattagttgtgttgctacctcatggttatgatggtcagggtcccgaacattcgagtgcaagattggagcgcttccttcagatgagtgatgataatccatttgttataccggagatggaacctacactacgcaatcaaattcaaacatgcaattggcaggttgtcaacgttacaaccccagcaaattatttccatgtgttgcgtcgacagctgcatagggagttccgtaagccacttattgcaatggctcctaagaatttgcttcgtcacaaagagtgcaagtcaaatctatccgagtttgatgatgtccaaggtcacccaggtttcgacaaacaagggaccaggttcaagagactcatcaaggaccagaatgaccattcgaatcttgaagagggcattagacgtttagttctctgctctggaaaggtttattatgaacttgatgaaaaaaggacgtcacttgaagggaaagatattgcaatttgtcgtgttgagcaactgtgcccgtttccatatgacctcatccagcgtgaactaaagcgctatccaaatgccgaagttgtttggtgccaggaggagccaatgaatatgggggcatacagttacattgccccacgccttgccactgccatgaaggcactggatcgaggtacaatagacgatatcaagtacgtaggccgtgctccatctgccgcaactgcaaccggtttctactccgttcacggaagagagcagtcagaactcgttcagaatgccctgcagcccgaacctgtcaccaatcccgcattttgttagatcccagaatcctgggtttccattttcagcgttggtgcggtgtttttttgcttttcaaaatttccagaagttattcgcgtacgaacaacattacgcgtgtaataataacatacaaatgttcaggtgagattcgtatacgtgatgccatcttgccatgggttcatggtgtttcttttctttgcagataaattacacttgattcatgttgttgatcccgttttcattttggaatcatagatgtccgagttttgaaatgcaatcagtgttcatttgattac

SEQ ID NO: 1795 - DNA, 3440 bp, Aquilegia formosa
ctatggcatggtttagagctgcttcttctgcagcaaagttagctgttaggagaagtctagcacgtccaggatcgtatgcaacaaaagctcggattcttccatctcataatcgggattttcactcaacggtttttacatcgagggcacaagctgcaacagctcctattcctcgtcctgtgcccttatcgaggttgactgacagcttccttgatggttctagtagtgtttacttagaggagctgcagagggcttgggaagaagatccagatagtgttgatgaatcatgggataatttcttcagaaattttgttggtcaggctaccacatctcctggcatctcaggccaaacaatccaagaaagtatgcgattgttgttacttgtgagagcttaccaagttaatggacacatgaaagccaacttggaccccttagctcttgaggaacgtcatattcctgaagatctagatccggccttatatggtttttctgaagctgatcttgatagagagttcttccttggagtgtggaaaatggctgggttcttgtcagaaaaccgtcctgtgcaaacgcttcgatctatactgactcggcttcagcaggcttactgtggaagcgttggctatgaatatatgcacatttcagatcgtgaaaagtgtaactggttgagagataaaattgagacaccaacacctacacagtacaactcagaacggcgtgtggttatgctcgatagacttacgtggagcacacagtttgagaattttttggctacaaagtggaccgctgcaaagagatttggtctggaaggtggagaaactctaattcctggtatgaaggagatgtttgacaggtcggcggatcttggggttgagagcattgtgattgggatgtcgcatagagggcgattaaatgttcttggtaacgttgttcgaaagccacttcgccagattttcagcgagttcagtggaggcacaaggcctgtagatgaagttgggctctacacaggaactggtgatgtgaaataccacttgggaacatcttatgatcggcccacaaggggtgggaagagaatccatctgtccttggttgcaaatccaagtcatctggaagctgtagatcctcttgttattgggaaaactcgagcaaagcaatactactcaaatgatgtggataggacaagaaatttgggcattttgattcatggcgacggaagttttgcaggacagggtgtagtctacgagactctgcatttaagtggccttcctaactacacaactggtgggactatacacattgtggtgaacaaccaagttgcatttacaactgatccacaagctgggagatcttctcagtattgcactgatgtagctaaagcgctggatgctcctatatttcatgtaaatggtgatgacttggaggccgttgttcatgtttgtgaacttgcagctgagtggcgccagacattccactctgatgtggttgttgatatagtttgctaccgtcgatttgggcacaatgaaattgatgaaccatccttcacgcagcctaaaatgtacaaggtcattcgaagtcatccatcagctcttgaaatataccaacaaaaacttttgaaaaatggccagattgcgcaagaagacattgacaagatacagaagaaggtgaactctattctcaatgaagagtttatgaacagcaaagattatgttcccaaaaaaagggactggcttgcggcttactggtctggttttaaatcccctgaacagatttcacgtgttaggaatactggtgtaaaaccagagatattaaagaatgttggcaaagcaatcacaacgcttccagatacttttaaggctcacagagcagtaaagaaaatttttgaacaacgttctcagatgatcgagtcaggggagggcattgattgggcagtcggagaagcactcgcttttgctacactgcttgtggaaggtaatcatgttagattgagtggtcaggatgtcgaaagaggtacattcagccatcgacattctgtggttcatgatcaagaaacaggagagcagtattgtcctctcgatcacgttattatgaaccaagatgaggaaatgtttactgtcagtaacagctctctttcggagtttggcgttcttggttttgaattgggttattcaatggaaaatccaaattcattagtcatctgggaagcacaatttggcgacttttccaatggggcacaggtgatatttgatcagttcttgagcagtggagagtctaagtggttgcgtcaaactgggcttgttgtgttgcttcctcatggatatgatggtcaaggccctgaacattcaagtgcacgattggagcgcttccttcagatgagcgatgacaatccctatgttatacctgagatggatgcaacacttaggaagcagattcaagagtgcaattggcaggttgttaatgtcacaacccctgctaattatttccatgttctgcggcgccagatacacagggacttccgtaagccacttgttgtgatggctccaaagaatttgcttcgtcacaaagactgcaagtcaaatttatctgagttcgatgatgttcaaggccacccaggttttgacaaacaagggactcgttttaaacgccttataaaggaccagaatgaccattctgacctagaagagggcatcaggcgtctggttctgtgctctggaaaggtttattatgagcttgatgaacaacggaagaaagtaagtggcaaggacgttgccatctgccgggtagaacagctgtgccccttcccatatgatctcattcagcgagagttgaagcggtatccaaatgcagaggtagtctggtgccaagaagaaccaatgaacatgggtgcatatagttacattgcgcctcgactttgtactgcaatgagggcacttggccgaggaaccatggaagatatcagatatgtaggacgtgcaccatctgctgccactgctactggtttctatcaagctcatgtaaaggaacaggctgagcttgtgcagaaagcattgcagagtgagccaattaaatatccatactaaagtgcaaccacagcttgtagcagtttaatcttgagtgaaaaatatgtataaggtgagaaagttcaccacatcttccttgaattttcgaaaaggggttgggccaaatggcaaccatacatctctgtacaagttatgtcagactaattactgtgcccattgtcctctactcctttggatcaatcttactatatatgggggagtttttatctgcagttaaactgcattcgaatcttcaaatcatctattccttttttgtgcctatagaatgagtaaataataaccgagatttggagatttggagaatgtaatacatataggaaagtgcttttggagccctcattttcttcaaaatatgttgtcgatttc

SEQ ID NO: 1796 - DNA, 3718 bp, Podocarpus macrophillus
ggaatacgtaaagatgctttcaggtcaatgaaatactgctccctccattcatcaaatcgaggtgtcagatttgctttgggaaatggagagataacacacggttttaatcaaattctgaagcccaaatttcttcaaaggctcggtaaatttgatttgatctgataatttcatgttgaagattgattttttgatatgaagatgctgtaaaatttttatagatttttatcaaaattttgaagttttcattctagggtttgttatttagtaccgtggatataatcccggcagaattttggtttcgtaatcgagtgacggttgcaattctgtttcgaaaccccagaatacatgtattgaatctatttcgaaatcctagaaatcccttatctgaactataaccctaaaaagcctagtccaggtcttgtctgaaacttagacacccagagcactggttagattttaactaaaacctcagaaatccttcgtttttaccctctctgaaaccctagaaactctagacatagtcatgacttggcagaggctttcttccgggttagtcagggcagccctgcggatccgtttggctcaggcgtcagcccatacgaaacgatcactatggaccctctcgcaggcccgatcttttcactcgagtccccacaaattccaacaagccgctccggttcctcgacctgtgccgctgtcaaggctcactgacaatttccttgatggtactagcagtgtttatttggaagaattgcagagggcttgggaagcagatcctcatagtgtggatgaatcatgggacaatttttttcgaaattttgttggtcaggctgtgacatcgcctggaatttctggccaaacgatacaggagagcatgagacttctattgcttcttagggcttatcaggtgaatggccacatgaaggcaaaacttgatcctttgggtttggaggagagggaaattccggccgatttggaccctgctctttatggattcaccgaggctgatttggaccgtgagtttttccttggtgtgtggaggatgtccggttttctgtctgagaataggccggtgcaaacactgaggtcaattctcaataggttggagcaggcctattgtggtactattggttatgagtatatgcatatagctgaccgagataagtgtaattggttgagggaaaaaattgagacagtagttcccagtaagtatggccctgagaggaggcacgtaatccttgacaggcttatttggagtacccaatttgagaattttctggcgacaaagtggactgctgccaagcggtttggtctagagggtgctgagaccttgattccaggaatgaaagagatgtttgataggtctgctgatttgggtgtagagaatatcgttataggtatgtctcatagaggaagattgaatgtcctgggtaatgtggtaaggaagccgttgagacagatatttagcgaatttagtggtggcacaaagccggtagatgaggttggatcttacactggaaccggggatgtgaaatatcatttgggtacatcgtatgataggcctaccaggggtggaaaaaggattcatctttccctggttgctaatccgagtcacttggaagctgttgatcctgtcgttgttggaaaaacacgtgcaaagcagtattattctaatgacaaggataggacgaaaaacatggctatattgattcatggagatggaagttttgctggacaaggtgtggtttacgagacattgcatttaagtgctcttcctaattacactacaggagggactattcatattgtagtcaataaccaggttgcatttacaactgatcccaaggctgggagatcttcacagtattgtacagatgttgcaaaagctttaaatgctcccatcttccatgtgaatggtgacgatgtggaagctgttgtgcatgtatgtgaacttgctgctgagtggcggcagactttccattctgatgttgttgtggacattgtttgctaccgtaggtttggacataatgagatcgacgagccatccttcacacaacctaaaatgtatcaggtgattagaaatcatcctcgagcacttgatgtatatcaaaaacagctaattgaattggggcagctatctaaggaagaaattgatgctttgcacgagaaagtcaactcaattttgaatgaagagtttgtgaacagcaaagaatatgttccaaagcgacgtgattggcttgcagcatattggtctggcttcaagtcaccagagcaattgtctcgtatacgtaacacaggggtaaaaccagagatcttgaaaaatgtcgggaaagcaataaccactttaccagaaacattcaagccacatagggctgtaaagaggatttttgagcaacgtgcacaaatgatcgagaaaggggaaggtgttgattgggctgttggtgaagcacttgcatttgcaacactcctggtggagggtaatcatgttagactgagtggccaggatgtagaaagaggtacttttagccaccgacatgcagttcttcatgaccaagaaacgggagaaagatattgtccactggaccatcttgtaatgaaccagaatgaagaaatgtttactgtgagtaacagctctctctcagaatttggtgttctaggatttgaattgggttattctatggaaaatcccaattccttggtttgttgggaagctcagtttggtgattttgcaaatggtgcacaagtcatttttgatcaatttataagcagtggagagtcaaaatggcttcgtcaaagtgggcttgttgtattgcttcctcatggctatgatggtcagggccctgagcattctagtgcaagattagagcgccttcttcagatgagcgatgacaatccttttgtgattcctgaaatggattccacactgcgcactcaaattcaacagtgcaattggcaagttgtaaatgtgacaactcctgctaattacttccatgttcttcgccgccagatacacagggacttccgcaaaccattgattgttatgtctccaaagaaccttcttcgtcacaaggactgcaagtcgaatctgtcagaatttgacgatgtacaaggccatccaggatttgataagcagggtacccgtttcaagaggctcattaaggatcagaatgaccactctgatctagaggaaggcattcaacgtctgatactttgttctggaaaggtctattatgaacttgacgaggagagacaaagagtagaaaggaaagatgttgctatttgtcgagttgagcaactatgcccatttccgtatgatctggtccagcgagaattaaagagatatccaaatgcggagattgtgtggtgccaggaagagcctatgaacatgggagcatatcattatataactcctcgccttctatctgccatgaaaacactaggtcgtggtacatatgaagatattaagtatgttggtcgagctccatcggctgccacagcaaccgggttttatcaggtgcatgttaaggagcagagagaacttgttgagatagcgctgcagtcttctccaatcaagtttccttgatgcctctttctctttaggtttcaaataaaggggatggaagatgtacagcatcctatcccatattattaaatattatacctctcaattttcctttttaagttgtgctgaaattagttggacatgagcatcatatct

SEQ ID NO: 1797 - DNA, 3371 bp, Gossypium hirsutum
aaagagtcttaagcgaacacagccaacgtcaactttctactttattagggttttttaatttttctctcatatttttccagatatggggtggcttagagctgggtcaagtgtggcaaagcttgccattaggaggactttgtctcagggtggatcatatgctacaagatcacgcattgttccttcacagagtcgatatttcacaccactgtctttaaatcaaaggcacagactgctcccgttcctcgccctgttccactttctaagctaactgatagtttcttagatggaaccagtagtgtatacttagaggagcttcaaagggcctgggaagctgacccagatagtgttgatgagtcgtgggacaatttcttcaggaattttgttggtcaggctgccacatctccaggaatttcgggccagaccattcaggagagtatgcgattgttattacttgtgagggcttaccaggttaatggtcacatgaaagcgaagctggatccgctgggtttagaggaaagggaaatccctgatgatttggatccagctttttatggttttactgaagctgatcttgatagagaattctttctaggtgtgtggaggatggctggatttttatcagaaaaccgacccgtgcagacacttaggtcgattttgactcggcttgagcaggcttactgtggaagcattgggtttgaatacatgcacattgctgagcgtgacaagtgcaactggttgagagacaagattgaaactccaacaccaatgcagtacaatcgccagcggcgcgaagtcattcttgataggcttatatggagtacacagtttgaaaatttcttggctaccaagtggacaacagccaagagatttgggctagaagggggtgaaactttaattcctggaatgaaagagatgtttgatagggctgcagatctaggggttgaaagcatcgtaattggaatgcctcatagaggaagattgaatgtgctaggtaatgttgtccgaaaaccacttcgtcaaatatttagtgagttcagtggtggtacaaggcctgtggatgaagttgggctttacacaggaactggtgatgttaaatatcacttgggaacttcctatgatcgaccaacaagaggtggaaagagaattcatttgtctttagttgctaaccccagtcacttggaggctgtggacccagttgttgtcggaaaaactagagcaaagcagtattactccaatgatgaggataggaccaagaacatggctgttttgattcatggagatggcagctttgctggacagggtgtagtctatgaaactcttcatcttagtgcacttccaaactacactactggtggaactatacatattgtagtcaacaaccaagtggcatttacaactgatccaagggcaggcagatcttcacagtattgtactgatgttgccaaagctttgaatgctcccattttccacgtaaatggagataatgttgaggcagttgtccatgcatgtgaacttgcggctgaatggcgccaagccttccattcagatgtggtggttgatttggtctgctaccgtagatttgggcataatgagattgacgaaccatcatttacacagccaaagatgtataagattattcggaatcacccctcagcacttcagatctaccgaaacaagttgttggagtctggtcaggtgacagatgaagacattggtaatataagtcagaaggtcagtacaattcttaatgaagaattcttaggcagcaaagattatgttcccaaaagacgggactggctttctgcttactggacgggattcaagtcacctgaacaaatttcacgtgttcggaacactggggttaaacccgagatattgaagaatgttggcaaagcaatcacaacccttccagataattttaagcctcatagagcggtgaagaaggtttatgagcaacgtgcacagatgattgagacaggggagggccttgactgggctatgggtgaagcacttgcatttgctacattactggtagaaggtaaccacgttaggttgagtggtcaggatgttgaaaggggtacattcagtcatcggcattctgtgattcatgatcaggaaaccggggaacagtattgccctctggaccatgttatcatcaaccaaaatgaggagatgtttactgtcagcaatagttctctttctgagtttggtgtgcttggattcgaattgggttactcgatggagaatccaaattcattggttatgtgggaagctcagtttggtgactttgctaatggtgctcaagtgatatttgatcagtttataagtagcggggaggcaaagtggctgcgtcaaacaggtctcgttgtgctgcttccccatggttatgatggacaaggtccagaacattcaagtgcacgactagagcgttatcttcagatgagtgatgacaatccttttgtgatacctgagatggatccaactcttcgtaaacaaattcaggagtgcaactcgcaggtggttaacgttacaacacctgctaattacttccatgttttgcggcgtcagatacacagggaattccgtaagcctcttattgtgatgtcccccaaaaacttacttcgtcacaaggactgcaaatcaaatctttctgaatttgatgatgtccaaggccaccctggttttgataaacaaggaaccagatttaagcgccttataaaagatcagaatatgcactccgacctcgaggagggtatcagacgcttggtactttgttccggaaaggtctactatgagcttgatgatgagcgaaagaagaacaatgctagcgacgttgctatctgtcgtgtggaacagctttgcccatttccttatgacctaatccagcgggagcttaagcgatatccaaatgcggagattgtttggtgccaggaagaaccgatgaacatgggtgcatacaattacatcgcacctcgtcttgccactgcaatgactgctttgggtagaggaacctttgacgatatcagatacattggccgtgctccatctgcttccactgctactggcttctattctgtgcatgtgaaggaacaaactgagcttgtgcaaaaggccattcaacctgaaccgatcaagaccaatattactatctgaagcttttcgcaagatcattcttgaaaaactacagtattaaagcaatgctctaaaataacatctggtgcagagcttgagaactgttagggtttgttatttcgatgatcgtcatgtttctgctattccttctctgccaaggcaccgatacatgaaggtgaaccggttatcaaatagaaccctaacattataaacaatgcatcagttccttttataattcg

SEQ ID NO: 1798 - DNA, 3429 bp, Gossypium hirsutum
cattatttctagagatgaaattaggagaaaaagccaaagaataaaaaggaagagagttgaagaccaagatttttggtcctaactttgaaaagtcttaagccaacacagctaaagttaattctcttatagggtttttaaattttctctcctattttccagatatggggtggcttagagctgggtcaagtgtggcaaagcttgctattaggaggactttgtctcagggtggatcatatgctgcacgatcacgcattgttccttcacagagtcgattttttcacaccaccgtctttaaatcaaaggcacagactgctcccgttcctcgccctgttccactttctaagctaactgatagtttcttagatggaaccagtagtgtatacttagaggagcttcaaagggcctgggaagctgacccagatagtgttgatgagtcatgggacaatttcttcaggaattttgttggtcaggctgccacatctccaggaatttcaggccagaccattcaggagagtatgcgattgttattgcttgtgcgggcttaccaggttaatggtcacatgaaagcgaagttggatccgctgggtttagaggaaagggaaattcctgatgatttggatccagctctttatggttttactgaagctgatcttgatagagaattctttttaggtgtgtggaggatggctggatttttatcagaaaaccgaccagtgcagacacttaggtcgattttgactcggcttgaacaggcttactgtggaagcattgggttcgagtacatgcacattgctgaccgcgacaagtgcaactggttgagagacaagattgaaactccaacgccaatgcagtacaatcgccagcggcgtgaagtcattcttgataggcttatatggagtacacagtttgaaaatttcttggctaccaagtggacaacagccaagaggtttgggctagaagggggtgaaactttaattcctggaatgaaagagatgtttgatagggctgctgatctaggggtcgaaagcatagttattggaatgcctcatagaggaagattgaatgtgctaggtaatgttgttcgaaagccacttcgtcaaatatttagtgagttcagtggtggtacaaagcctgtggatgaagttgggctttacacaggaactggtgatgtcaaatatcacttgggaacttcctatgatcgaccaacaagaggtggaaagagaattcatttgtctttagttgccaaccccagtcacttggaggctgtggacccagttgttgtcggaaaaactagagcaaagcagtattactccaatgatgaggataggaccaagaacatggctgttttgattcatggagatggaagctttgctggacagggtgtagtctatgaaactcttcatcttagtgcacttccaaactacactactggtggaaccatacatgttgtagtcaacaaccaagtggcatttacaactgatccaagggcaggcagatcttcacagtattgtactgatgttgccaaagctttggatgctcccattttccacgtaaatggagatgatgttgaggcagttgtccatgcatgtgaacttgcagctgagtggcgccaaaccttccattcagatgtggtggttgatttggtctgctaccgtagatttgggcataatgagattgacgaaccatcttttacacagccaaagatgtataagatcattcggaatcacccctcagcacttcagatataccgaaacaagttgttggagtctgggcaggtgacagatgacgacattggtaatataagtcagaaggtcagtacaattcttaatgaagaattcttggccagcaaagattatgttcccaaaagacgtgactggctttctgcttactggacgggattcaagtcacctgaacaaatttcacgtgttcggaacactggggttaaacccgagatattgaagaatgttggcaaagcaatcacaaccctcccagataattttaagcctcatagagcagtgaagaaggtttatgaacaacgtgcgcagatgattgagacaggggagggccttgactgggctatgggtgaagcacttgcatttgctaccttgctggtggaaggtaaccatgttaggttgagtggtcaggatgttgaaaggggtacattcagtcatcggcattctgtgattcacgatcaggaaacaggggaacagtattgccctctggaccatgttatcatcaaccaaaatgaggagatgtttactgtcagcaatagttctctttctgagtttggtgtgcttggattcgaattgggttactcgatggagaatccaaattcattggttatgtgggaagctcagtttggtgactttgctaatggtgctcaagtgatatttgatcagtttataagtagcggggaggcaaagtggctgcgtcaaacaggtctcgttgtgctgcttccccatggttatgatggacaaggtccagaacattcaagtgcacgactagagcgttatcttcagatgagtgatgacaatcctttgtgatacctgagatggatccaactcttcgtaaacaaattcaggagtgcaactcgcaggtggttaacgttacaacacctgctaattacttccatgttttgcggcgtcagatacacagggaattccgtaagcctcttattgtgatgtcccccaaaaacttacttcgtcacaaggactgcaaatcaaatctttctgaatttgatgatgtccaaggccaccctggttttgataaacaaggaaccagatttaagcgccttataaaagatcagaatatgcactccgacctcgaggagggtatcagacgcttggtactttgttccggaaaggtctactatgagcttgatgatgagcgaaagaagaacaatgctagcgacgttgctatctgtcgtgtggaacagctttgcccatttccttatgacctaatccagcgggagcttaagcgatatccaaatgcggagattgtttggtgccaggaagaaccgatgaacatgggtgcatacaattacatcgcacctcgtcttgccactgcaatgattgctttgggtagaggaacctttgacgatatcagatacattggccgtgctccatctgcttccactgctactggcttctattctgtgcatgtgaaggaacaaactgagcttgtgcaaaaggccattcaacctgaaccgatcaagaccaatattactatctgaagcttttcgcaagatcattcttgaaaaactacagtattaaagcaatgctctaaaataacatctggtgcagagcttgagaactgttagggtttgttatttcgatgatcgtcatgtttctgctattccttctctgccaaggcaccgatacatgaaggtgaaccggttatcaaatagttgatttgatgcataattttttt

SEQ ID NO: 1799 - DNA, 3420 bp, Aquilegia formosa
aaagaaatctgttttgaatactatggcgtggtttaaagctgcatcaagtataagaaagttagtaacgaaacgaaatcttgcacaaataagatcttataatagcataacaacaacaagaacaagagcaattcaatctcaaaatcgatgttttcattcaacaatttttacaccaaaagcacaatcagcaacagctccgattcctcgtgctgttccgctttccaagttaactgatagttttcttgatggttcaagtagtgtttacttagaagagttgcagagagcttgggaagctgatcctaatagtgttgatgaatcttgggataatttttttagaaattttgttggtcaagcttctacttctcctggaatttcaggacaaacgattcaggaaagtatgagattgttgttacttgtaagagcttatcaagtgaatgggcatatgaaagcaaagttggatcctttaggattggaagaaagacagattccggatgatttggatccttctttttatggattttctgaagctgatctcgatagagaatttttccttggagtatggaagatggcaggatttttgtcagagaatcgtcctgtccaaacacttcgatcgatattgactcgtcttgagcaagcttattgtggaagtgttggatatgagtatatgcacattgcggatagaaataagtgtaattggttgagagataaaattgaaacaccaactcccaggcaatataacacgcagcgtcgtgaggttatgcttgatagacttacttggagtacacagtttgagaactttttggctacaaagtggacagctgcaaaaagattcggtctggaaggtggggaaactttaattcctggtatgaaagagatgtttgataggtcagctgatcttggggttgaaagtattgttattgggatgtcacatagaggaagattgaatgtgcttggcaatgttgttcggaaacctcttcggcaaattttcagtgaattcagtggaggcataaagccaattgatgaagttgggctctatacaggaactggtgatgttaaataccatttaggaacatcgtacgatcgaccgactaggggtgggaagagaattcatttgtctctggttgcgaatccaagtcatttagaagctgtggatccagttgtagttggaaagactcgagcaaaacaatattattctaatgatgaagacagaacaaagaatttgggaatattgattcatggagatggtagctttgcagggcaaggagtagtgtatgagactcttcatttaagtgctcttccaaactacacaaccggtggaaccattcacattgtggtgaacaaccaagtggcctttacgaccgatcctaggtctgggagatcatctcagtattgtactgatgttgctaaagcattggatgctcctattctccatgtgaatggtgatgacttagaggcagttgttcatgtttgtgagcttgcagcggagtggcgtcaaactttccattctgacgttgtagttgatatagtttgttaccgccgatttggacacaatgaaattgatgagccatcctttacacaacctaaaatgtacaaggtaatccgcaatcatccatcagctcttgagatataccaaaagaaactcttagagtctgggctgattgggcaggaagacattgataggattaacaagaaggttaacaacattctcaatgaagagttcatgaacagcaaagattatgttccacgaaaacgagactggctttcggcttattgggctggattcaagtcgcccgagcaggtttcacgtgttaggaacactggagttaagccagagattttaaagaatgttgggaaagcaatcacgacttttccagagaatttcaaacctcatagagcagtcaagaaaatatttgagcaacgtgctcaaatgattgaaacaggggaaggtattgattgggcagttggggaagctcttgcttttgctaccttactagtagaaggtaatcacgttagattgagcggtcaggatgttgaaagagggacatttagccaccgacattcagtagttcatgatcaagaatcaggagaaaaatactgtcctctggaccatgttattatgaaccaaaatgaggaaatgtttactgtcagcaacagctctttgtcagagtttggtgttcttggatttgaactgggatattcgatggaaaatccaaattctttagtgatctgggaagcccaatttggggactttgcaaatggagcacaggtgatatttgatcagtttttgagcagtggggaatcgaagtggttgcgtcaaactgggcttgttgtactgctccctcatggttatgatggtcaaggtcctgaacattcaagtgcacgattggaacgcttcctacagatgagtgacgacaatccgtatgttattcctgagatggattcaacacttcgtaagcagatccaagagtgcaattggcaggttgttaacgtcacaacccctgctaattatttccatgttctgcgacgccagatacacagagacttccgaaagccacttattgtgatggctcctaagaacttgcttcgacacaaagactgcaagtccaacttatctgaattcgatgatgtccaaggccatccaggttttgacaaacagggaactcggttcaagcgccttattaaggaccaaaatgaacattcggatcttgaggaaggcatcaggcgtctggttctgtgctcaggaaaggtttattatgagcttgatgaggaaagaaagaaagtcaatggcaaagatgttgctatctgccgtgtggagcaactgtgcccgtttccatatgatcttattcaaagagagttgaagcgatatccaaatgcggagattgtctggtgccaggaagagccaatgaacatgggtgcatataattacattgcacctcgcctttccaccgcaatgagagctttgggaagaggaaccacggaagacatcaactatgttggccgtgccccatctgctgccactgctactggtttctattcagttcatggaaaagagcagactgagcttgtgcagaaagcattgcagcaagatctgattaactatccttggtgatgcctatgagcttattgaaatagaaagatgcattaagcggatagggtcatgacatcgtttgcataaatggtcaggagggtccttataatatatacaactgtgtcccagctattttgagtcaatatttacgtgacatagtcttatttttagtctttactctctttttttccagttataatgagagttttcatttgtgcaattgaactgcttatgggatttcccagttgtatcctctgtgactgtgataataaatcaaataacaaacatgtaagagctgcattcacatctattttttacaagatggaagatagtgt

SEQ ID NO: 1800 - DNA, 3474 bp, Brassica rapa
tttccattacaataaaaaagtctcgtcctccttacacattagccttcttcttactttctccacgttacggtcttctcctccttctccgcctccaggcgttgaaagctgaaagatggtgtggtttcgagctggttccagcgcgacgaagctcgccgtacgaaggattctgaatcaaggcacgagaacaccacgctacctcccttctcaaaaccgttcctttcactcgaccctctacagaccaaaccctcagagctctgccgctcctgttcctcgcgctgttcccctctctaagctaaccgacagcttcctggatgggaccagcagtgtttacctcgaggagcttcaacgagcgtgggaagctgatcccaccagcgttgacgagtcttgggataatttctttaggaactttgtgggccaagctgcgacttctccaggcatctctggtcagacgattcaggagagtatgcgtctcttgttgctcgtgagggcttatcaggtgaacggtcacatgaaagctaagttggatccgttgggtttggagcagagggagatccctgaggatcttgacttggctctttacggattcactgaggctgatcttgacagagagttcttcttgggagtgtggcagatgtctggtttcatgtctgagaaccgccccgtgcagaccttgcgttctatattgacgaggctccagcaggcttactgtgggagtatcgggtttgagtatatgcacattgcggatcgggataagtgtaactggctgagggagaagattgagactcctactccttggaggtacaacagggagcgccgcgaggtgattctcgacaggcttgcttggagtactcagtttgagaatttcttagctaccaagtggacaacggctaagaggtttgggcttgaaggtggagagtctttgattcctggcatgaaggagatgtttgacagggcggcggatcttggagtagagagcattgttattggaatgtctcacagagggagattgaatgttttgggtaatgttgttaggaagccactccgtcagattttcagcgagttcagcggtggtattaggcctgtggatgaggttggctacactggcactggtgatgttaagtaccacttgggtacatcttatgatcgacctacgagaggtgggaagaagattcatctctcgttggttgcaaacccaagtcacttggaagctgctgattcagttgttgttggcaaaaccagagcgaagcagtactactccaaggatttggacaggaccaagaacttggggattttgattcatggagatgggagctttgctggacaaggagtggtttacgaaacgcttcatcttagtgctcttccgaattacaccactggtggtaccattcatattgtggtgaacaaccaagtggctttcaccacggatccaagggctgggaggtcttctcagtactgtactgatgttgccaaggctttgagtgctcccatcttccatgttaacggagatgatgttgaagctgttgttcatgcctgcgagcttgctgctgagtggcgtcagacgtttcattccgatgttgtcgttgatttggtttgctataggaggtttgggcataatgagatagatgaaccatctttcactcagccgaagatgtacaaggttatcaagaatcatccctcgacgcttcaaatctatcataagaagctcttggagtgcggtgaaatatcgcagcaggatattgacaggatacaggagaaggttaacaccattctcaatgaagagtttgttgctagcaaagattatctatctaagaagcgtgattggctttcaaccaattgggctggattcaagtctcctgagcagatctcacgtgttagaaacactggagtcaaaccagagatacttaagactgttggcaaggcgatttcatcactgccggagaacttcaaacctcacagagcggtgaagaaagtttatgaacagcgtgctcaaatgattgaaacaggagaaggaattgactgggcacttgcggaagctcttgcctttgctaccttagttgtggaaggcaaccatgtccgcttgagtggtcaggatgtcgaaagaggaacctttagtcatcgtcattctgtccttcatgaccaggaaactggagaagagtattgtcctctagatcatctcgtcatgaatcaggatcctgagatgttcactgtcagcaacagttctctttcagagtttggagtccttgggtttgagttgggttactcaatggaaagcccaaactcgttggtgctatgggaagctcagtttggagactttgccaatggagctcaggtgatatttgatcagttcatcagcagtggtgaagccaagtggctgcgtcagactgggcttgttgtgctacttccccatggatatgatggtcaaggccctgaacattcaagtgccaggctggaacgttaccttcagatgagtgatgacaacccctatgtcataccagacatggaacctacattgagaaagcaaatccaagaatgcaattggcagattgtcaatgccaccactcctgccaactatttccatgttctgcgtcgtcagctacacagagatttccgtaagcctttgattgtaatggcaccaaagaacttgctccgtcacaaagactgcaaatcaaacctctctgagtttgatgatgtccaaggccacccaggttttgacaaacaaggaactagattcaagcgattgatcaaggatcagaatgatcactctgatcttgaagaaggcatcagaagattggtgctttgctccggaaaggtgtattacgagcttgatgacgagaggaagaaggttggcgcaagcgatgttgctatttgtagagtggaacagctttgtcctttcccatatgatctcattcagcgtgagctcaagagatatccaaatgcggagatagtttggtgccaagaagaggcgatgaacatgggagcatacagctacataactccaaggctatggacagcaatgagaagcttaggcagcggagatatggaagacattaagtacgttggtcgtggaccttctgctgctaccgccactggtttctacactttccatgtcaaagagcaagcggagctcgtccagaaagccattggaaaggaatccatcagttgaaagaaacttcatttattaaatgaattctttaaataagaaaactttcggtgaaacaaagtgattaaacaacactgacaaaatcatgtccttgctttttattggtcccattgatttttgaacctgactcgtgttggcaggttaatacggatcatactcattttcataaaccttttgtttttcctctacagttttattctttgatacacctaaatgttttgcatttgtcgtacaacctttttttttggaagacattaaatgttcaactttagccatggccctcttctttttatttggttccctaatgaattttg

SEQ ID NO: 1801 - DNA, 3764 bp, Theobroma cacao
ggaaaaaaaaaggagaaagagaaagtaaaattaggtttgtctagagaagaaaatacgagaaaaaaaaggaaagaataaaaagaggaagagcagaccaagattttggtcttaacaagtcttgaagcctacagtcaccgtgacgttcaccttagggtttcaaaattttctctcccattttccaggtttatgatagataaaataagggcagatggttttttgattgaggtctgagcttggaggtataggatactctttgggaatcagtggcacatagatattgttgattgatagatatggggtggtttagagctggttctagtgtggcaaagcttgctagcaggaggactttgtctcagggtggattatatactgcaagatcacgtattgttccttcacagaatcattattttcataccactgtctttaaatctaaggcacagtctgcaccagttcctcgccctgtgccactttctaagctaactgacagtttcttagatggaaccagtagtgtgtacttagaggagcttcaaagggcctgggaagctgacccagatagtgttgatgagtcatgggacaattttttcaggaattttgtgggtcaggctgccacatcccctggaatttcaggccagacaattcaggagagtatgcgactgttattgcttgtgagggcttaccaggttaatggtcacatgaaagcaaagttggatcccttgggtttagaggaacgagaaatccctgatgatttggatccagctctttatggttttactgaagctgatcttgatagagaattctttttaggtgtgtggaggatgtctggatttttatcagaaaaccggccagtgcaaacacttaggtcaattttgactaggcttgaacaggcttactgtggaagcattgggtttgagtacatgaacattgcggaccgtgagaagtgtaactggttaagagacaagattgaaaccccaactccgatgcagtacaatcgtcagcgtcgtgaagtcattcttgacaggcttatatggagtacgcagtttgagaatttcttggccactaagtggacaacagctaagaggtttgggctggaaggaggtgagactttgattccgggaatgaaagagatgtttgacagggctgcagaccttggggttgagagcatagtgattggaatgcctcatagaggaagattgaatgtgctaggtaatgttgttcgaaagccacttcgtcaaatatttagtgagttcagtggtggtacaaagcctgtggatgaagtagggctttacacaggaactggtgatgtcaaatatcacttgggaacttcttatgatcgacctacaagaggtggaaagagaatccatttgtctttagttgcaaaccccagtcacttggaagcagtggacccagttgttgttggaaaaactagagcaaagcagtattattccaatgatgtggataggaccaagaacatggctgttttgattcatggagatggtagctttgctggacagggtgtagtttatgaaactcttcatcttagtgcccttgccaactacacaactggtgggactatacatattgtagtcaacaaccaagtggcctttacaactgatccaagggcgggcagatcttcacagtattgtactgatgttgccaaggccttgaatgctcccatttttcatgtaaatggagatgatgtggaggcagttgtccatgcttgtgagcttgcagcagaatggcgccaaaccttccattcagatgtggtcgttgatttggtctgttatcgtagatttggtcataatgagatcgatgagccatcattcacacagccaaaaatgtataagatcattcggaatcacccctcagctcttcagatctaccaaaacaaattgttagaatctgggcaggtgatgaaggaagatattggttggataagtgagaaggtcagtaaaattcttaatgaagaatttttggccagcaaagattatgttccgaaaagaagggactggctctctgcttattggacgggattcaagtcaccagaacaactttcacgtgtcagaaatactggggtaaagcctgagatattgaagaatgttggcaaagcaatcacaacccttccagataattttaagcctcatagagcagtaaagaaggtttatgaccaacgtgcacagatgattgagacaggggagggtcttgactgggctataggggaagcacttgcatttgctaccttgttagtggaaggtaaccatgttaggttgagtggtcaggatgttgaaaggggtacattcagtcatcggcattctgtgctacatgatcaggaaactggggagcagtattgccctctggaccatgttattatcaaccaaaatgaggagatgtttactgtcagcaatagttctctttcagagtttggtgtgctcggatttgaattgggttactcaatggaaaatccaaattccttggtcatgtgggaagcacaatttggtgactttgctaatggggctcaagtgatctttgatcagtttctgagtagtggggagtcaaagtggctgcgtcaaactggtctggttgtgctgcttcctcatggttatgatggccaaggtcctgaacattcgagtgcacgactagagcgttatcttctgatgagcggtgacaatccttttgttatacctgaaatggatccaactcttcgtacgcaaattcaggagtgcaattggcaggtggttaatgttacaacacctgctaattatttccatgttttgcggcgtcagatacacagggaattccgtaagcctcttattgtgatgtcccctaaaaacttgcttcgtcacaaggactgcaaatcaaatctttctgaatttgatgatgtccaaggccaccctggttttgataaacaaggaaccagatttaagcgcctcataaaggatcagaatatgcactctgaccttgaggagggtatcagacgcttggtactttgttctggaaaggtttactatgagcttgatgatgagagaaagaagaacaaggctactgatgttgctatatgtcgtgtggagcagctttgcccgttcccttatgacctcatccagcgagagcttaagcgatatccaaatgcagagattgtttggtgccaagaagaaccaatgaacatgggtgcattcagttacattgcacctcgtctcgccacttcaatgcaagcactgggtaggggaacctttgaggatatcaagtacgttggtcgcgctccatctgcttccactgccactggtttctatgtagttcatgtgaaggaacaaactgagcttgtgcaaaaggccattcaacctgaaccaatcaagttccatgcccctgtctgaagcttgccaaaaatcaaacttgaaacagtatagcattatacaattttctcaataacatctggtacagagcttggaaccctttgttagggtttgttatgttgatgctcgccatttttccctattccttgtctgccaaggcacaattgtttctatacgcgaggtgaactgaccgtaaaaatatctgagataatcgatgcataactttcattgtactgttttttttttttgttttttttttatatgcttcagcttctcttatcatgcataaatgaactgtcttgctcgtcactagacttttttgcatccttaggacaaaaagatgcaacttcggggggcaactatcagagaaattgaggattaagtttcatatttcctggaaaatagaaaaaaaaaatctat

SEQ ID NO: 1802 - DNA, 3384 bp, Gossypium hirsutum
gatatggggtggcttagagctgggtcaagtgtggcaaagcttgctatcaggaggactttgtctctgggtggatcatatgctgcaagatcacgcattgttccttcacagagtcgatattttcacaccaccgtctttaaatcaaaggcacagactgctcccgttcctcgccctgttccactttctaagctaactgatagtttcttagatggaaccagtagtgtatacttagaggagcttcaaagggcctgggaagctgacccagatagtgttgatgagtcgtgggacaatttcttcaggaactttgttggtcaggctgccacatctccagggatatcaggccagaccattcaggagagtatgcgattgttattgcttgtgcgggcttaccaggttaatggtcacatgaaagcgaagttggatccgttgggtttagaggaaagggaaattcctgatgatttggatccagctctttatggttttactgaagctgatcttgatagagaattctttttaggtgtgtggaggatggctggatttttatcagaaaaccgacccgtgcagacacttaggtcgattttgactcggcttgaacaggcttactgtggaagcattgggttcgagtacatgcacattgctgaccgcgacaagtgcaactggttgagagacaagattgaaactccaacaccaatgcagtacaatcgccagcggcgcgaagtcattcttgataggcttatatggagtacacagtttgaaaatttcttggctaccaagtggacaacagccaagaggtttgggctagaagggggtgaaactttaattcctggaatgaaagagatgtttgatagggctgctgatctaggggtcgaaagcatagttattggaatgcctcatagaggaagattgaatgtgctaggtaatgttgtccgaaagccacttcgtcaaatatttagtgagttcagtggtggtacaaggcctgtggatgaagttgggctttacacaggaactggtgatgtcaaatatcacttgggaacttcctatgatcgaccaacaagaggtggaaagagaattcatttatctttagttgccaaccccagtcacttggaggctgtggacccagttgttgtcggaaaaactagagcaaagcagtattactccaatgatgaggataggaccaagaacatggctattttgattcatggagatggaagctttgctggacagggtgttgtctatgaaactcttcatcttagtgcacttccaaactacactactggtggaactatacatattgtagtcaacaaccaagtggcatttacaactgatccaagggcaggaagatcttcccagtattgtactgatgttgccaaagctttggatgctcccattttccacgtaaatggagatgatgttgaggcagttgtccatgcatgtgaacttgcagctgagtggcgccaaaccttccattcagatgtggtggttgatttggtctgctaccgtagatttgggcataatgagattgacgaaccatcatttacacagccaaagatgtataagatcattcggaatcacccctcagcacttcagatataccgaaacaagttgttggagtctgggcaggtgacagatgacgacattggtaatataagtcagaaggtcagtacaattcttaatgaagaattcttggccagcaaagattatgttcccaaaagacgggactggctttctgcttactggacgggattcaagtcacctgaacaaatttcacgtgttcggaacactggggttaaacccgagatattgaagaatgttggcaaagcaatcacaacccttccagataattttaagcctcatagagcggtgaagaaggtttatgaacaacgtgcacagatgattgagacaggggagggccttgactgggctatgggtgaagcacttgcatttgcgaccttgctggtggaaggtaaccatgttaggttgagtggtcaggatgttgaaaggggtacattcagtcatcggcattctgtgattcacgaccaggaaacaggggaacagtattgccctctggaccatgttatcatcaaccaaaatgaggagatgtttactgtcagcaatagttctctttctgagtttggtgtgcttggattcgaattgggttactcgatggagaatccaaattcattggttatgtgggaagctcagtttggtgactttgctaatggtgctcaagtgatatttgatcagtttataagtagtggggaggcaaagtggctgcgtcaaactggtctcgtagtgctgcttccccatggttatgatggacaaggtccagaacattcaagtgcacgactagagcgttatcttcagatgagtgatgacaatccttttgtgatacctgagatggatacaactcttcgtaaacaaattcaggagtgcaactggcaggtggttaacgttacaacacctgctaattacttccatgttttgcggcgtcagatacacagggaattccgtaagcctcttatcgtgatgtcccccaaaaacttacttcgtcacaaggactgcaaatcaaatctctctgaatttgatgatgtccaaggccaccctggttttgataaacaaggaaccagatttaagcgacttataaaagatcagaatatgcactccgaccttgaggagggtatcagacggttggtactttgttccggaaaggtgtactatgagcttgatgatgagcgaaagaagaacaatgctaccgacattgctatctgtcgtgtggaacagctttgcccattcccttatgacctaatccaacgagagcttaagcgatatccaaacgcagagattgtttggtgccaggaagaaccgatgaacatgggtgcatacaactacatcgcccctcgtcttgccactgcaatgactgctttgggtagaggaacctttgatgatgtcagatatgttggccgtgctccatctgcttccactgctaccggcttctattccatgcatgtgaaggaacaagcggagctcgtgcaaaaggccattcaacctgaaccgatcaagaccaataccactatctgaagctttgcgcaaaatcattgttgaaaaactatagtattaaagcaatgctcaaaaataacatccggtgcagagctggaaaactgttagggtgtgttatttcgatgagtcatgtttcagctatcccttctctgctaaggcaccgatacatgaaggtgaactgattatcataattttcatttgtaatattttttggtttttttaaaccctaactgtataaacaatgcaccggttccttttataatgcagaaattaaacgacccctcaggtttcatatattctggaaataagattttactctttttttcctct

SEQ ID NO: 1803 - DNA, 3643 bp, Gossypium raimondii
gtgatagaatttttagttagtaataaattggttatatgttagtaataaatctatttccgaatattttttatattcaaaatttttaaaaatttaggtattccattatttctagggatgaaattaggagaaaaagcgaagaataaaatggaagagagttgaagaccaagattttggtcctaactttgaaaagtcttaagccaacacagctaacgttaatttctcttatagggtttttaattttctctcctattttccagatatggggtggcttagagctgggtcaagtgtggcaaagcttgctattaggaggactttgtctcagggtggatcatatgctgcacgatcacgcattgttccttcacagagtcgatattttcacaccaccgtctttaaatcaaaggcacagactgctcccgttcctcgccctgttccactttctaagctaactgatagtttcttagatggaaccagtagtgtatacttagaggagcttcaaagggcctgggaagctgacccagatagtgttgatgagtcgtgggacaatttcttcaggaattttgttggtcaggctgccacatctccaggaatttcaggccagaccattcaggagagtatgcgattgttattgcttgtgcgggcttaccaggttaatggtcacatgaaagcgaagttggatccgctgggtttagaggaaagggaaattcctgatgatttggatccagctctttatggttttactgaagctgatcttgatagagaattctttttaggtgtgtggaggatggctggatttttatcagaaaaccgaccagtgcagacacttaggtcgattttgactcggcttgaacaggcttactgtggaagcattgggttcgagtacatgcacattgctgaccgcgacaagtgcaactggttgagagacaagattgaaactccaacgccaatgcagtacaatcgccagcggcgtgaagtcattcttgataggcttatatggagtacacagtttgaaaatttcttggctaccaagtggacaacagccaagaggtttgggctagaagggggtgaaactttaattcctggaatgaaagagatgtttgatagggctgctgatctaggggtcgaaagcatagttattggaatgcctcatagaggaagattgaatgtgctaggtaatgttgtccgaaagccacttcgtcaaatatttagtgagttcagtggtggtacaaggcctgtggatgaagttgggctttacacaggaactggtgatgtcaaatatcacttgggaacttcctatgatcgaccaacaagaggtggaaagagaattcatttatctttagttgccaaccccagtcacttggaggctgtggacccagttgttgtcggaaaaactagagcaaagcagtattactccaatgatgaggataggaccaagaacatggctattttgattcatggagatggaagctttgctggacagggtgttgtctatgaaactcttcatcttagtgcacttccaaactacactactggtggaactatacatattgtagtcaacaaccaagtggcatttacaactgatccaagggcaggaagatcttcacagtattgtactgatgttgccaaagctttggatgctcccattttccacgtaaatggagatgatgttgaggcagttgtccatgcatgtgaacttgcagctgagtggcgccaaaccttccattcagatgtggtggttgatttggtctgctaccgtagatttgggcataatgagattgacgaaccatcttttacacagccaaagatgtataagatcattcggaatcacccctcagcacttcagatataccgaaacaagttgttggagtctgggcaggtgacagatgacgacattggtaatataagtcagaaggtcagtacaattcttaatgaagaattcttggccagcaaagattatgttcccaaaagacgggactggctttctgcttactggacgggattcaagtcacctgaacaaatttcacgtgttcggaacactggggttaaacccgagatattgaagaatgttggcaaagcaatcacaacccttccagataattttaagcctcatagagcggtgaagaaggtttatgaacaacgtgcacagatgattgagacaggggagggccttgactgggctatgggtgaagcacttgcatttgcgaccttgctggtggaaggtaaccatgttaggttgagtggtcaggatgttgaaaggggtacattcagtcatcggcattctgtgattcacgaccaggaaacaggggaacagtattgccctctggaccatgttatcatcaaccaaaatgaggagatgtttactgtcagcaatagttctctttctgagtttggtgtgcttggattcgaattgggttactcgatggagaatccaaattcattggttatgtgggaagctcagtttggtgactttgctaatggtgctcaagtgatatttgatcagtttataagtagcggggaggcaaagtggctgcgtcaaactggtctcgtagtgctgcttccccatggttatgatggacaaggtccagaacattcaagtgcacgactagagcgttatcttcagatgagtgatgacaatccttttgtgatacctgagatggatacaactcttcgtaaacaaattcaggagtgcaactggcaggtggttaacgttacaacacctgctaattacttccatgttttgcggcgtcagatacacagggaattccgtaagcctcttatcgtgatgtcccccaaaaacttacttcgtcacaaggactgcaaatcaaatctctctgaatttgatgatgtccaaggccaccctggttttgataaacaaggaaccagatttaagcgacttataaaagatcagaatatgcactccgaccttgaggagggtatcagacggttggtactttgttccggaaaggtctactatgagcttgatgatgagcgaaagaagaacaatgctaccgacattgctatctgtcgtgtggaacagctttgcccattcccttatgacctaatccaacgagagcttaagcgatatccaaacgcagagattgtttggtgccaggaagaaccgatgaacatgggtgcatacaactacatcgcccctcgtcttgccactgcaatgactgctttgggtagaggaacctttgatgatgtcagatatgttggccgtgctccatctgcttccactgctaccggcttctattccatgcatgtgaaggaacaagcggagctcgtgcaaaaggccattcaacctgaaccgatcaagaccaataccactatctgaagctttgcgcaaaatcattgttgaaaaactatagtattaaagcaatgctcaaaaataacatccggtgcagagctggaaaactgttagggtgtgttatttcgatgagtcatgtttccgctattccttctctgctaaggcaccgatacatgaaggtgaactgattatcataattttcatttgtaatattttttggtttttttaaaccctaacagtataaacaatgcaccggttccttttataatgcagaaattaaacgacctctcaggtttcatatattctggaaataagattttactctttttttcctctaaa

SEQ ID NO: 1804 - DNA, 3328 bp, Prunus persica
ctatgacttggtttagagcagggtctagcgtggcaaaacttgccattaggagaactctatcacacagtggatcatatgcaggtaggaggcgggtccttccgtcgcaaaatcgagactttcacaccactttatgtaaatcaaaggcgcaatctgccccagttccacgccctgtacctctctctaggctaactgatagtttcctggatggaaccagcagtgtttatttggaggggcttcagagggcttgggaagccgaccccaatagcgttgatgagtcatgggacaatttctttaggaattttgttggtcaggcctctacctcgccaggaatttcaggccaaaccattcaagagagtatgcgcttgttgttgcttgtgagggcataccaggttaatggtcacatgaaagctaaattggaccccttgggtctggaagagagagaaatccctgatgatttggaccctgctctatatgggtttactgaggctgatctcgatagggagttctttttaggggtctggaggatggctgggtttttgtctgagaaccgtcctgtccagacccttaggtccatactgacccggcttgagcaggcttactgtggaactattgggtatgagtatatgcacattgccgatcgtaatagatgtaactggttgagagacaagattgagactccgacaccaatgcaatacaataggcagcgtcgtgaggttattcttgataggcttatttggagtacacaatttgagaacttcttggccactaagtggacagcagcaaagaggtttgggcttgaaggtggagaaactctgattccaggcatgaaagagatgtttgatagggcagcagatcttggggttgagagcatagttattggaatgtctcacagaggaagactgaatgtattgggtaatgtggttcggaagcctttgcgtcagatatttagtgaattcagtggtggtacaaagcctgtggatgaagttggactatacacagggactggtgatgtcaagtatcacttgggaacctcttatgatcgacccactagaggtgggaacagaattcatttatctttgcttgctaatccaagtcacttggaagctgtagaccctgttgttgttgggaagactagagcaaagcaatattattcaagtgatccggacaggaccaagaatgtgggtatcttgattcatggagatggtagctttgctgggcaaggtgtggtctacgagactctgcatctaagtgctcttcctaactacaccactggtgggactatacacattgtggtgaacaaccaagttgccttcacaactgatccaatgtctggaagatcttcacagtattgtactgatgttgccaaagcattgaatgcccctattttccatgtaaatgctgatgacatggaggcagtcgttcatgtctgtgagcttgcagctgaatggcgccagactttccattctgatgttgttgttgatttggtgtgctatcgtcgatttgggcataatgagattgatgagccatctttcacgcagcccaaaatgtacaaggttatccggaatcatccctcagctctaacaatctaccagaacaaacttctagaatctggacaagtgaccaaagaagacattgaaaggatacagaacaaggttaattcaattctcaatgaagaattcttggctagcaaggattatgttcctcaaagaagggactggctttcatctcattggtctggatttaagtcacctgaacagatttcccgtatccggaatactggggtaaaaccagagattttgaagagtgttggcaaagcagtcacatccctcccagaaacttttaagcctcacagagcagtaaagaagaattatgaacaacgcgcacaaatgattgagaccggtgaaggaattgattgggcagttgctgaagcacttgcatttgctacactactagtagaaggtaaccatgttcgattgagcggtcaggatgttgaaagaggtacatttagtcatcggcactctgtagttcacgaccaggaaactggggagaggtattgccctcttgaccacattatggctaaccaagatgaggaaatgtttacagttagcaacagctcactgtctgagtttggtgttctgggatttgaattgggttactcgatggagagtccgaatgcattggtaatctgggaagctcaatttggtgattttgccaatggagctcaagttatatttgatcagtttttgagtagtggggagtccaaatggcttcgtcaaactgggcttgttgtgctgcttcctcatggttatgatggccagggccctgaacattctagtgcacgactggagcgatttcttcagatgagtgatgacaatccttttgtcatacctgagatggatcctacacttcggaagcaaattcaggaatgcaattggcaggttgttaatgtgacaactcctgccaactacttccatgttctgcgtcgtcagttgcacagggaattccgtaagccccttattgtgatggctcctaaaaacctgctaaggcacaaggagtgcaaatcaaatttatctgaatttgatgatgtgcaaggccacccaggttttgacaagcaggggaccagatttaagcgcctcatcaaggaccagaatgaccactctaatctggaggagggtattagacggctagttctttgctctggcaagctttattatgagctagacgaagagcgaagaaaggttgaagcaaaggatgtcgcaatttgtagagtggaacagctttgccccttcccatatgaccttatccagagagagctgaagcgatatccaaatgctgagatagtttggtgccaggaagagccaatgaacatgggtgcatacagctatattgcaccccgcctttgctctgccatgaagtccctgggcagaggaacgatcgaagacatcaagtatgttggccgtgctccatcagctgccacagccactggtttctatcaggttcatgtgaaggaacaaaacgagattgtgcacaaagcagtgcagccggagccaattgagtatcacatctgaagcccatgcatatttatcccaaaccaatgaatgacgtgtttatagatacttacataatactactatctgaaatttcctatcctgattttttgttgatacaaatggtggtttttcaccatgcaagccgagcggcgtctcaaagattaagatttttttctctcatgtgatgatgcacaagtgtttttgagaataatgtcaagatgctttatcattaaataacagaaggttggtttggccattccggatgatttttttggttc

SEQ ID NO: 1805 - DNA, 3774 bp, Prunus mume
agccagatgaagaaggaaaagatcttgggattgatttgggcaaacaatttccataaatcaacatgatgtttgggcttgggcttttgggcctactttacccgacccatccatattaaaatattaaaataataaggaagtaagatttttcggttcagacaattacccaaaaaggaataaaatgttgcactcagaaagctcagaaaagtcaccgtcgctacccagcgattagggttcccctattcttttcttccttctatatctctcgttttctcttcttcggtcactctcagggttttgattgatgttctgaagatttgtgacgtagaattttctgttgaattggataaaattgtgtgatagattgggttggtagctatgacttggtttagagcagggtctagcgtggcaaaacttgccattaggagaactctatcaaacagtggatcatatgcaggtaggaggcgggtccttccgtcgcaaaatcgagactttcacaccactttatgtaaatcaaaggcgcaatctgccccagttccacgccctgtacctctctctaggctaactgatagtttcctggatggaaccagcagtgtttatttggaggggcttcagagggcttgggaagccgaccccaatagcgttgatgagtcatgggacaatttctttaggaattttgttggtcaggcctctacctcgccaggaatttcaggccaaaccattcaagagagtatgcgcttgttgttgcttgtgagggcataccaggttaatggtcacatgaaagctaaattggaccccttgggtctggaagagagagaaatccctgatgatttggaccctgctctatatgggtttactgaggctgatcttgatagggagttctttttaggggtctggaggatggctgggtttttgtctgagaaccgtcctgtccagacccttaggtccatactgacccggcttgagcaggcttactgtggaactattgggtatgagtatatgcacattgccgatcgtaatagatgtaactggttgagagacaagattgagactccgacaccaatgcaatacaataggcagcgtcgtgaggttattcttgataggcttatttggagtacacaatttgagaacttcttggccactaagtggacagcagcaaagaggtttgggcttgaaggtggagaaactctgattccaggcatgaaagagatgtttgatagggcagcagatctcggggttgagagcatagttattggaatgtcccacagaggaagactgaatgtattgggtaatgtggttcggaagcctttgcgtcagatatttagtgaattcagtggtggtacaaagcctgtggatgaagttggactatacacagggactggtgatgtcaagtatcacttgggaacctcttatgatcgacccactagaggcgggaacagaattcatttatctttgcttgctaatccaagtcacttggaagctgtagaccctgttgttgttgggaaaactagagcaaagcaatattattcaagtgatctggacaggaccaagaatgtgggtatcttgattcatggagatggtagctttgctgggcaaggtgtggtctacgagactctgcatctaagtgctcttcctaactacacaactggtgggactatacacattgtggtgaacaaccaagttgccttcacaactgatccaatgtctggaagatcttcacagtattgtactgatgttgccaaagcattgaatgcccctattttccatgtaaatgctgatgacatggaggcagtcgttcatgtctgtgagcttgcagctgaatggcgccagactttccattctgatgttgttgttgatttggtgtgctatcgtcgatttgggcataatgagattgatgagccatctttcacgcagcccaaaatgtacaaggttatccggaatcatccctcagctctaacaatctaccagaacaaacttctagaatctggacaagtgaccaaagaagacattgaaaggatacagaacaaggttaattcaattctcaatgaagaattcttggctagcaaggattatgttcctcaaagaagggactggctttcatctcattggtctggatttaagtcacctgaacagatttcccggatccggaatactggggtaaaaccagagattttgaagagtgttggcaaagcagtcacatccctcccagaaacttttaagcctcacagagcagtaaagaagaattatgaacaacgcgcacaaatgattgagaccggtgaaggaattgattgggcagttgctgaagcacttgcatttgctacactactagtagaaggtaaccatgttcgattgagcggtcaggatgttgaaagaggtacatttagtcatcggcactctgtagttcatgaccaggaaactggggagaggtattgccctcttgaccacattatggctaaccaagatgaggaaatgtttacagttagcaacagctcactgtctgagtttggtgttcttggatttgaattgggttactcgatggagagtccgaatgcattggtaatctgggaagctcaatttggtgatttttccaatggagctcaagttatatttgatcagtttttgagtagtggggagtccaaatggcttcgtcaaactgggcttgttgtgctgcttcctcatggttatgatggccagggccctgaacattctagtgcacgactggagcgatttcttcagatgagtgatgacaatccttttgtcatacctgagatggatcctacacttcggaagcaaattcaggaatgcaattggcaggttgttaatgtgacaactcctgccaactacttccatgttctgcgtcgtcagttgcacagggaattccgtaagccccttattgtgatggctcctaaaaacctgctacggcacaaggagtgcaaatcaaatttatctgaatttgatgatgtgcaaggccacccaggttttgacaagcaggggaccagatttaagcgcctcatcaaggaccagaatgaccactctgatctggaggagggtattagacggctagttctttgctctggcaagctttattatgagcttgacgaagagcgaagaaaggttgaagcaaaggatgtcgcaatttgtagagtggaacagctttgcccctttccatatgaccttatccagagagagctgaagcgatatccaaatgctgagatagtttggtgccaggaagagccaatgaacatgggtgcatacagctatattgcaccccgcctttgctcggccatgaagtccctgggcagaggaacgatcgaagacatcaagtatgttggccgtgctccatcagctgccacagccactggtttctatcaggttcatgtgaaggaacaaaacgagattgtgcacaaggcagtgcagccggagccaattgagtatcacatctgaagcccgtgcatatttatcccaaaccaatgaatgacgtgtttatagatacttacataatactactatctgaaatttcctatcctgattttttgttgatacaaatggtggtttttcaccatgcaagctgagcggcgtctcaaggattaagatttttttttttctctcatgtgatgatgcacaagtgtttttgagaataatgtcaagatgctttatcattaaataacagaaggttggtttggccattccggattatttttttggttcaattgtactgcaattccctgttattatggttgaagtatttgatgaagcatatgatcatatcaattcggc

SEQ ID NO: 1806 - DNA, 3669 bp, Gossypium raimondii
acgagaaaaagcgaagaacaaaacggaagagaggcttttctttcggccgaaaaaaacagagttcaagaccaatattttggtcctaacttaaaaataaagagtcttaagcgaacacagccaacgtcagcttcacttatagggtttttaattttctctcatattttccagatatggggtggcttagagctgggtcaagtgtggcaaagcttgccattaggaggactttgtctcagggtggatcatatgctacaagatcacgcattgttccttcacagggtcgatattttcacaccactgtctttaaatcaaaggcacagactgctcccgttcctcgccctgttccactttctaagctaactgatagtttcttagatggaaccagtagtgtatacttagaggagcttcaaagggcctgggaagctgacccagatagtgttgatgagtcgtgggacaatttcttcaggaattttgttggtcaggctgccacatctccaggaatttcgggccagaccattcaggagagtatgcgattgttattacttgtgagggcttaccaggttaatggtcacatgaaagcgaagttggatccgctgggtttagaggaaagggaaatccctgatgatttggatccagctttttatggttttactgaagctgatcttgatagagaattctttctaggtgtgtggaggatggctggatttttatcagaaaaccgacccgtgcagacacttaggtcgattttgactcggcttgagcaggcttactgtggaagcattgggtttgaatacatgcacattgctgagcgtgacaagtgcaactggttgagagacaagattgaaactccaacaccaatgcagtacaatcgccagcggcgcgaagtcattcttgataggcttatatggagtacacagtttgaaaatttcttggctaccaagtggacaacagccaagagatttgggctagaagggggtgaaactttaattcctggaatgaaagagatgtttgatagggctgcagatctaggggttgaaagcatagttattggaatgcctcacagaggaagattgaatgtgctaggtaatgttgtcagaaagccacttcgtcaaatatttagtgagttcagtggtggtacaaggcctgtggatgaagttgggctttacacaggaactggtgatgtcaaatatcacttgggaacttcctatgatcgaccaacaagaggtggaaagagaattcatttgtctttagttgccaaccccagtcacttggaggctgtggacccagttgttgtcggaaaaactagagcaaagcagtattactccaatgatgaggataggaccaagaacatggctgttttgattcatggagatggaagctttgctggacagggtgtagtctatgaaactcttcatcttagtgcacttccaaactacactactggtggaactatacatattgtagtcaacaaccaagtggcatttacaactgatccaagggcaggcagatcttcacagtattgtactgatgttgccaaagctttgaatgctcccattttccacgtaaatggagatgatgttgaggcagttgtccatgcatgtgaacttgcagctgaatggcgccaaaccttccattcagatgtggtggttgatttggtctgctaccgtagatttgggcataatgagattgacgaaccatcatttacacagccaaagatgtataagatcattcggaatcacccctcagcacttcagatctaccgaaacaagttgttggagtctgggcaggtgacagatgacgacattggtaatataagtcagaaggtcagtacaattcttaatgacgaattcttggccagcaaagattatgttcccaaaagacgggactggctctctgcttactggacgggattcaagtcacctgaacaaatttcacgtgttcggaacactggggttaaacccgagatattgaagaatgttggcaaagcaatcacaacccttccagataattttaagcctcatagagcggtgaagaaggtttatgaacaacgtgcgcagatgattgagacaggggagggccttgactgggctatgggtgaagcacttgcatttgctaccttgctggtggaaggtaaccatgttaggttgagtggtcaggatgttgaaaggggtacattcagtcatcggcattctgtgattcacgatcaggaaacaggggaacagtattgccctctggaccatgttatcatcaaccaaaatgaggagatgtttactgtcagcaatagttctctttctgagtttggtgtgcttggattcgaattgggttactcgatggagaatccaaattcattggttatgtgggaagctcagtttggtgactttgctaatggtgctcaagtgatatttgatcagtttataagtagcggggaggcaaagtggctgcgtcaaactggtcttgtagtgctgcttccccatggttatgatggacaaggtccagaacattcaagtgcacgactagagcgttatcttcagatgagtgatgacaatccttttgtgatacctgagatggatacaactcttcgtaaacaaattcaggagtgcaactggcaggtggttaacgttacaacacctgctaattacttccatgttttgcggcgtcagatacacagggaattccgtaagcctcttatcgtgatgtcccccaaaaacttacttcgtcacaaggactgcaaatcaaatctctctgaatttgatgatgtccaaggccaccctggttttgataaacaaggaaccagatttaagcgccttataaaagatcagaatatgcactccgaccttgaggagggtatcagacgcttggtactttgttccggaaaggtctactatgagcttgatgatgagcgaaagaagaacaatgctaccgacgttgctatctgtcgtgtggaacagctttgcccatttccttatgacctaatccagcgggagcttaagcgatatccaaacgcagagattgtttggtgccaggaagaaccgatgaacatgggtgcatacaactacattgcacctcgtcttgccactgcaatgactgctttgggcagaggaacctttgatgatatcagatacattggccgtgctccatctgcttccactgctactggcttctattctgtgcatgtgaaggaacaaactgagcttgtgcaaaaggccattcaacctgaaccgatcaagaccaatattactatctgaagcttttcgcaagatcattcttgaaaaactacagtattaaagcaatgctctaaaataacatctggtgcagagcttgagaactgttagggtttgttatttcgatgatcgtcatgtttctgctattccttctctgccaaggcaccgatacatgaaggtgaaccggttatcaaatagttgatttgatgcatttttttttttgtaatattttttggtttttttaaccctaacattataaacaatgcatcagttccttttataatgcagaaattgaactaccttgctcttcattaggctcgacttctcagggcaactatggggaattaagggtccagtttcatatattccggaaataagaaagaaaaagaagaaaaaataaaaatttcaaataattttcatgagttttcaagtattaataattacaaaagcc

SEQ ID NO: 1807 - DNA, 3391 bp, Sequoia sempervirens
acatttgatgcctcattgtgaaacagcctatcggctgcggggcggctgcaaattatgactggaattgataaagctcgtgaattcaacgctcgggatttaataaccaaaagaaaaattcaatcttgcgtttgatcctttaccgaaaccccagaaacctcaagattagtagccatgactattccaaggctttactcgggtttatacagggccgccctgagaattcgtttggctcagcagtcctcttatacgaaaaaatcatcggtgtggagccttccatatgcgcgattttttcattcgacaccacataattttcagcaatcgacagctcctgtaccacgggcagtgccgctgtcgaggctgaccgacagttttttggatggtacgagcagtgtttatttggaggaattgcagcgggcctgggaagctgatcctcagagcgtggacgaatcatgggacaattttttcaggaattttgttgggcaggcagcgacatcgcctggtatttcggggcaaacaatccaggagagcatgaggcttttgttgctattgagggcttatcaggtgaacggtcatatgaaggcgaagctggatcccttgggtttggagcagagggaaattcccgtggaattggaccctgctctatatggatttacggaagcggatttggaccgggagtttttcctcggtgtatggaggatgtccgggtttttgtccgagaatcggccagtccaaaccctgaggtcaattctcactagattggagcaggcctactgtggcacagttgggtatgaatacatgcacattgctgaccgtgataagtgcaattggttgagagaaaagatcgagacagtggttcctagcaagtacggtccggagcgaaggtatgttatgcttgatagactgatttggagtacacaatttgagaattttttggcaacgaaatggactgctgccaaacgattcggtcttgaaggtgctgaaaccttgattccaggaatgaaagagatgtttgatagatctgctgacatgggtgtggaaagcattgttataggtatgtctcatagggggagattaaatgtcctggccaacgtggtcaggaagccattaagacacattttcagtgagtttagcagtggcacaaagcctgttgaagaagttggatcatatactggaacaggggatgtgaaataccatctgggtacatcatatgacaggcctaccagaggtgggaaaaggatacatctttctctagttgctaatcccagtcatttggaggcagtcgatcctgttgttgttgggaaaacccgagcaaaacagtattattcaaatgataaggacaggacaaagaacatggctgtattgattcatggagatggaagttttgctggacagggtgtagtttacgagacattgcatctgagtgctcttccaaattacacaactggagggactattcacattgtagtcaataatcaggttgcatttacaactgatcccaaagcagggagatcttcacaatactgtacagatgttgcaaaagctctgaatgctcccatcttccacgtaaatggtgatgatatggaagctgtggtgcacgtatgtgaacttgctgctgagtggcgtcagacattccactctgatgttgtggtggatattgtttgctatcgcaggtttgggcataatgagattgatgaaccatccttcacacaacctaaaatgtatcaggtgattagaaatcatccacgagcactggatctgtatgaaaagcagctaattgaatcagggcagttgtcaaaggaagaaattgatgatttgcacaacaaagtcaactcaattctgaatgaagagtttgtaaacagcaaagaatatgtgtcaaaccgacgagattggctagcagcatattgggctggctttaagtcaccggagcaattgtctcgtatacgtaatacaggggtcaaaccggagatattgaaaaatgttggaaaagcaataacttctttaccagaaactttcaagccacatagggctgtaaaaaggatttttgaccaacgtgcgcaaatgattgaaaaaggggaaggtgttgattgggctgttggtgaagctcttgcatttgcaactctccttgtagagggtaatcatgtgaggctgagtggccaggatgttgaaagaggtactttcagtcaccgacacgcagttcttcatgatcaggaaacaggagaaagatattgccctcttgatcatgttacaatgaaccaaaatgaagagatgtttactgtgagcaacagctctctctcagaatttggtgtgctgggcttcgaactgggctattcaatggaaaatcccaactcattggttttgtgggaagctcagtttggtgattttgcaaatggtgcccaagtcatttttgatcaatttataagcagtggggagtcaaaatggcttcgtcaaactggccttgttgttttgcttcctcatggctatgatggccagggcccagaacattcaagcgcaagattggagcgctttctccagggtagtgatgacaatccttttgtgattcctgaaatggatcctacgttacgcacccaaattcaacaatgcaactggcaagttgtgaatgtgacaacacctgctaattactttcacgttcttcgtcgtcagatacaccgggatttccgtaaaccattgattgttatgtctccaaagaatcttcttcgacacaaggactgcaaatcaaatctgtctgaatttgatgatgttcaaggccatccaggatttgacaagcaggggacccgatttaagcgtctcattaaggatcagaatgaccattctgatcaggaggaaggcatcaatcgtctaatactttgttcaggaaaggtctactatgaacttgatgaggaaaggaaaagagtccagaggaaagatgttgccatttgtcgaattgaacaattatgcccattcccatatgatctggtgcagcgtgaattgaagcgatatccaaatgcagagattgtctggtgccaggaagagcctatgaacatgggaggctatcattatatttctctgcgtcttttaactgccatgaaagcactgggtcgaggtacatttgaagatatcaagtatgttggtcgagctccatcagctgccacagcaacaggatttaatcaagtgcacgtacgggaacagaaagaacttgttgagacagcactgcagcctgctccaatcaagtttccttgatgttaatttgtaagaaaagaggaaggcttttaataatggggatagaaaatgtgcagcatcctcttatttctattacttcacctcgtgaattttctttgaagtaaaatattctctagttttaaagcaacagctatttcttttgtagggtcatgac

SEQ ID NO: 1808 - DNA, 3210 bp, Ambrosia trifida
agtcgccacttatagcggttgttaatattattcaaccagacttttcaacgcaatgttacaacataccgatctttctttctagatttcaagcatcggttccaatcatctgcacaattaggtgtttgaaatcatttaagatatagagaacttgaaattcggagacaatgacgtggtttagggctggatctagtgttgcaaagcttgcaatcagaagaactttaacacaaagtggatcgtatgcagcaagaaagcgtgttttccctgcagaaagccgatattttcatacgactgtctttaagtcaaaagcgcaatctgcgcccgtccctagagctgttccactttctaggttaacggatagttttctagatggaactagtagtgtctacctggaggaacttcaaagagcttgggaagatgatccaaacagtgttgatgaatcatgggacaatttctttaggaattttgtgggccaggctgccacgtcacctggaatatctggccaaacgatacaagagagcatgcggttgttgctgcttgttagagcgtaccaagtttatggccacatgaaagccaagatagatccattgggtcttgaaaaaagagagactcctgatgatttggatcctgctttctacggtttcagtgaagctgatttagaccgtgagttttttctcggtgtatggagaatgtctggttttttgtctgaaaaccgacctgtgcaaactcttagaaatatattaaccagacttgaacaagcttattgtggaaacattggttatgaatacatgcacattgctgaccgtgaacgatgtaattggttaagagataaaatcgagaccccaactccaactcagtataatagagaacgccgtgaggttattcttgacaggctcatttggagtactcagtttgaaaactttttagctactaaatggacggctgctaaaagatttggacttgaaggtggtgagacattaatcccaggaatgaaagagatgtttgacaggtcggcagatcttggtgttgaaagcatcgtgattggaatgtctcacagaggacgattaaatgttttaggtaatgtggttagaaaaccgttgcgccaaattttcagtgaattcagtggtggtacgaagcccgttgatgaggttgggctttacacgggaaccggtgatgtaaaatatcatcttgggacttcttatgatcggccaacacgcggtgggaagaggattcatttgtctttagttgcaaaccctagtcatttggaagctgtagatcctgttgtgattgggaaaacaagagcaaaacagtattactcaaatgatgttgatagaacaaagaatatgggtattttgattcatggggatggaagctttgcagggcaaggtgtggtttacgagacactgcatttaagtggtcttccaaattacacaactggtgggaccattcatattgtagtcaacaatcaagttgcttttactactgatccacaagcaggaagatcttcacagtattgtactgatgttgctaaagctttaaatgctccaattttccatgttaatggtgatgacgtggaagcagttgtgcatgcttgtgagctggcagctgagtggagacaaacgttccactcggatgttgttgttgatatagtctgttatcgccgatttgggcataatgagattgatgaaccatcttttactcaaccaaaaatgtacaagatcattaggaatcacccgtcatcattagaaatctaccagaagaagcttctagaaagtgggcaagcgacaaaggaagatattgatagaatacaaagcaaggttactacaattctaaatgaagagtttcttgccagcaaggattatgtccctcaaagaagagactggctttctgcttactgggctggatttaaatcccctgagcagctttcacgtattcgtaacaccggggttaaaccagagattttgaaaaatgttgggaaggcgattacaacacttccagaaacttttaagcctcacagagcagttaagaaaatatttgcagaccgttataagatgattgaaactggtgaaggtgttgattgggcagttgcagaagccctagcttttgcaacattactggtggaaggaaatcatgtgagattaagtggtcaagatgtagaaagaggtactttcagtcacaggcattctgttcttcatgatcaagaaacaggagagcgttactgtccattggatcatgtaatgatgaatcaacatgaggaaatgtttaccgttaagcaacagttctctttcggagtttggtgtgctgggatttgaattgggctattcaatggaaaaccccaattcactggtattatgggaagctcaatttggtgatttttccaatggggcccaggttatatttgatcaattcttgagcagtggtgaggctaagtggctgcgccagactgggttagttgtgttgctacctcatggttatgatggtcaagggcctgaacactcaagttccagacttgagcgttttcttcagatgagtgatgacaatccgtttgttatacctgagatggaaccaacactacgcaatcaaattcaaacatgcaatatgcagattgttaatgttacgacaccagcaaattatttccatgtgttacgtcgacagctgcatagggagttccgtaagccacttattgtaatgtctcccaaaaatttgcttcgtcacaaagactgcaagtccaatttatctgagttcgatgatgttcaaggtcaccctggttttgataaacaagggaccagatttaaacgtctcattaaggatcaaaatgatcactcagatctcgaagaagggattaggcgtctagttctttgctctggaaaggtttattatgaacttgatgaacaaaggaagtcggttgatggtaaagatgttgcaatttgtcgtgttgaacaactttgcccattcccatatgatctcatccagcgtgaattaaagcgttacccaaatgcagaagtagtttggtgtcaagaagagccaatgaacatggggccctacagttacattgccccacgccttgcaaccgccatgaaggacctcaatagaggtaacattgatgatatcaaatacgtgggccgggctccatctgctgcaactgcaactggtttttacaccgttcatggcagagagcagtctgaactcgtgcagaaagccctgcagcctgaa

SEQ ID NO: 1809 - DNA, 3381 bp, Gossypium hirsutum
caagacctaatatttttaggtacctaacttaaaaataaaaagtcttaagccaacacagccaacgtcaacttcacttatagggtttttaatttactctcatattttccagatatggggtggcttagagctgggtcaagtgtggcaaagcttgccattaggaggactttgtctcagggtggatcatatgctgcaagatcacgcattgttccttcacagagtcgatattttcacaccactgtctttaaatcaaaggcacagactgctcccgttcctcgccctgttccactttctaagctaactgatagtttcttagatggaaccagtagtgtatacttagaggagcttcaaagggcctgggaagctgacccagatagtgttgatgagtcgtgggacaatttcttcaggaattttgttggtcaggctgccacatctccaggaatttcaggccagaccattcaggagagtatgcgattgttattgcttgtgagggcttaccaggttaatggtcacatgaaagcgaagttggatccgctgggtttagaggaaagggaaatccctgatgatttggatccagctttttatggttttactgaagctgatcttgatagagaattctttctaggtgtgtggaggatggctggatttttatcagaaaaccgacccgtgcagacacttaggtctattttgactcggcttgagcaggcttactgtggaagcattgggttcgaatacatgcacattgctgagcgtgacaagtgcaactggttgagagacaagattgaaactccaacaccaatgcagtacaatcgccagcggcgcgaagtcattcttgataggcttatatggagtacacagtttgaaaatttcttggctaccaagtggacaacagccaagagatttgggctagaagggggtgaaactttaattcctggaatgaaagagatgtttgatagggctgcagatctaggggttgaaagcatagttattggaatgcctcacagaggaagattgaacgtgctaggtaatgttgtcagaaagccacttcgtcaaatatttagtgagttcagtggtggtacaaggcctgtggatgaagttgggctttacacaggaactggtgatgtcaaatatcacttgggaacttcctatgatcgaccaacaagaggtggaaagagaattcatttgtctttagttgccaaccccagtcacttggaggctgtggacccagttgttgttggaaaaactagagcaaagcagtattactccaatgacgaggataggaccaagaacatggctattttgattcatggagatggaagctttgctggacagggtgtagtctatgaaactcttcatcttagtgcacttccaaactacactactggtggaactatacatattgtagtcaacaaccaagtggcatttacaactgatccaagggcagggagatcttcacagtattgtactgatgttgccaaagctttgaatgctcccattttccatgtaaatggagatgatgttgaggcagttgtccatgcatgtgaacttgcagctgaatggcgccaaaccttccattcagatgtggtggttgatttggtctgctaccgtagatttgggcataatgagattgacgaaccatcatttacacagccaaagatgtataagatcattcggaatcacccctcagctcttcagatctaccgaaacaagttgttggagtctgggcaggtgacagatgacgacattggtaatataagtcagaaggtcagtacaattcttaatgacgaattcttggccagcaaagattatgttcccaaaagacgggactggctctctgcttactggacgggattcaagtcacctgaacaaatttcacgtgttcggaacactggggttaaacccgagatattgaagaatgttggcaaagcaatcacaacccttccagataattttaagcctcatagagcggtgaagaaggtttatgaacaacgtgcgcagatgattgagacaggggagggccttgactgggctatgggtgaagcacttgcatttgctaccttgctggtggaaggtaaccatgttaggttgagtggtcaggatgttgaaaggggtacattcagtcatcggcattctgtgattcacgaccaggaaacaggggaacagtattgccctctggaccatgttatcatcaaccaaaatgaggagatgtttactgtcagcaatagttctctttctgagtttggtgtgcttggattcgaattgggttactcgatggagaatccaaattcattggttatgtgggaagctcagtttggtgactttgctaatggtgctcaagtgatatttgatcagtttataagtagcggggaggcaaagtggctgcgtcaaactggtctcgtagtgctgcttccccatggttatgatggacaaggtccagaacattcaagtgcacgactagagcgttatcttcagatgagtgatgacaatccttttgtgatacctgagatggatacaactcttcgtaaacaaattcaggagtgcaactggcaggtggttaacgttacaacacctgctaattacttccatgttttgcggcgtcagatacacagggaattccgtaagcctcttatcgtgatgtcccccaaaaacttacttcgtcacaaggactgcaaatcaaatctctctgaatttgatgatgtccaaggccaccctggttttgataaacaaggaaccagatttaagcgacttataaaagatcagaatatgcactccgaccttgaggagggtatcagacgcttggtactttgttccggaaaggtgtactatgagcttgatgatgagcgaaagaagaacaatgctaccgacattgctatctgtcgtgtggaacagctttgcccattcccttatgacctaatccaacgagagcttaagcgatatccaaacgcagagattgtttggtgccaggaagaaccgatgaacatgggtgcatacaactacatcgcccctcgtcttgccactgcaatgactgctttgggtagaggaacctttgatgatgtcagatatgttggccgtgctccatctgcttccactgctaccggcttctattccatgcatgtgaaggaacaagcggagctcgtgcaaaaggccattcaacctgaaccgatcaagaccaataccactatctgaagctttgcgcaaaatcattgttgaaaaactatagtattaaagcaatgctcaaaaataacatccggtgcagagctggaaaactgttagggtgtgttatttcgatgagtcatgtttcagctatcccttctctgctaaggcaccgatacatgaaggtgaactgattatcataattttcatttgtaatattttttgtttttt

SEQ ID NO: 1810 - DNA, 3433 bp, Ambrosia trifida
gacttttcagcgcaatgttacaacataccgatctttctttctagatttcaagcatcggttccaatcatctgcataattaggtgtttgaaatcatttaagatatagggaacttgaaattcggagacaatgacgtggtttagggctggatctagtgttgcaaagcttgcaatcagaagaactttaacacagagtggatcgtatgcggcaagaaagcgtgttttccctgcagaaagccgattatttcatacgactgtctttaagtcaaaagcgcaatctgcgcccgtccctagagctgttccactttctaggttaacggatagttttctagatggaactagtagtgtctacctagaggaacttcaaagagcttgggaagatgatccaaacagtgttgatgaatcatgggacaatttctttaggaattttgtgggccaggccgccacgtcacctggaatatctggccaaacgatacaagaaagtatgcggttgttgctgcttgttcgagcgtaccaagtttatggccacatgaaagccaaaatagatccattgggtcttgaaaaaagagaaactcctgatgatttggatcctgcttttacggtttcagtgaagctgatttagaccgtgagttttttcttggtgtatggaggatgtctggttttttgtctgaaaaccgacctgtgcaaactcttagaaatatattaaccagacttgaacaagcttattgtggaaacattggttatgaatacatgcacattgctgaccgtgaacgatgtaattggttaagagataaaatcgagaccccaactccaactcagtataatagagaacgccgtgaggttattcttgacaggctcatttggagtactcagtttgaaaactttttagctactaaatggacggctgctaaaagatttggacttgaaggtggtgagacattaatcccaggaatgaaagagatgtttgacaggtcagcagatcttggtgttgaaagcattgtgattggaatgtctcacagaggacgattaaatgttttaggtaatgtggttagaaaaccgttgcgccaaattttcagtgaattcagtggtggtacgaagcccgttgatgaggttgggctttacacgggaaccggtgatgtaaaatatcatcttgggacttcttatgatcggccaacacgcggtgggaagaggattcatttgtctttagttgcaaaccctagtcatttggaagctgtagatcctgttgtgattgggaaaacaagagcaaaacagtattactcaaatgatgttgatagaacaaagaatatgggtattttgattcatggggatggaagctttgcagggcaaggtgtggtttacgagacactgcatttaagtggtcttccaaattacacaactggtgggaccattcatattgtagtcaacaatcaagttgcttttactactgatccacaagcaggaagatcttcacagtattgtactgatgttgctaaagctttaaatgccccaatttttcatgttaatggtgatgacgtggaagcagttgtgcatgcttgtgagctggcagctgagtggagacaaacgttccactcggatgttgttgttgatatagtctgttatcgccgatttgggcataatgagattgatgaaccatcttttactcaaccaaaaatgtacaagatcattaggaatcacccgtcatcattagaaatctaccagaagaagcttctagaaagtgggcaagcgacaaaggaagatattgatagaatacaaagcaaggttactacaattctaaatgaagagtttcttgccagcaaggattatgtccctcaaagaagagactggctttctgcttactgggctggatttaaatcccctgaacagctttcacgtattcgtaacaccggggttaaaccagagattttgaaaaatgttgggaaggcgattacaacacttccagaaacttttaagcctcacagagcagttaagaaaatatttgcagaccgatataagatgattgaaactggtgaaggtgttgattgggcagttgcagaagccctggcttttgcaacattactggtggaaggaaatcatgttagattaagtggtcaagatgttgaaagaggtaccttcagtcacaggcattctgttgttcatgatcaagaaacaggggagcgttactgtccgttggatcatgtaatgatgaatcaacatgaggaaatgtttactgtaagcaacagttctctttcggagtttggtgtgctgggttttgaattgggctattcaatggaaaaccccaattcactggtattatgggaagctcaatttggtgatttttccaacggggcccaggttatatttgatcaattcttgagcagtggtgaggctaagtggctgcgccagactgggttagttgtgttgctacctcatggttatgatggtcaagggcccgaacactcaagttcaagacttgagcgtttccttcagatgagtgatgacaatccgttcgttatacctgagatggaaccaacactacgcaatcaaattcaaacatgcaatatgcagattgttaatgttacaacaccagcaaattatttccatgtgttacgtcgacagctgcatagggagttccgtaagccacttgttgtaatgtcccccaaaaatttgcttcgtcacaaagactgcaagtccaatttatctgagttcgatgatgttcaaggtcaccctggttttgataaacaagggaccagatttaaacgactcattaaggatcaaaatgatcacgcagatcttgaagaagggattaggcgtcttgttctttgctctggaaaggtttattatgaacttgatgaacaaaggaagtcggtttctggtaaagatgttgcgatttgtcgtgttgaacaactttgcccattcccatatgatctcatccagcgtgaattaaagcgttatccaaatgcagaagtggtttggtgtcaagaagagccaatgaacatggggccctacagttacattgccccacgccttgcgaccgccatgaaggacctcaatagaggtaccattgatgatatcaaatatgtgggccgggctccatctgctgcaactgcaactggtttttacaccgttcatggcagagagcagtctgaactcgtgcagaaagccctgcagcctgaatccatcaccaatcctgcactttgctagatctgcagccagggtggtatcgagcgttggcttggcatctttttgcattcatttttcaaaggtttttccgcgtatgataagttctacgcatgtaataagataatacaatcgttcagctgaaatctgtacaatggatacgtggcttgtctttgacatgttatctttctttgtggtaaattatacaacttaccctatgtggatcttgtttttgatttaagggtggtggtaattgtaca

SEQ ID NO: 1811 - DNA, 3340 bp, Flaveria ramosissima
caaccccacgaacttagtaaattagaaaatagacgtggttagggcgtggatctagtgtggacaagcctgccattagaagatacctaacacaaagtggatcatatgcagacaagaagcgtatttttccttcagaaagccgatatttccatacaacagtcttcaaatcgaaagcacaatctgcacctgtccctagacctgttccactttctaggttaacagacagctttttagatggaactagcagtgtctacctggaagaactgcaaagagcttgggaggatgatccaaacagtgttgatgagtcatgggacaatttcttcaggaactttgtgggccaggctgccacgtcacccggaatatctggccagaccatacaagaaagcatgcgtttgctgttgcttgttagagcataccaagtttatggccacatgaaagccaaaatagatccattgggtcttgaaaaaagagagactcctgatgatttggatcctgctttttacggtttcagtgaagctgatttagaccgtgaatttttccttggtgtgtggagaatgtctggatttttgtcggaaaatcgaccggtgcaaactcttagatcaatattgaccagacttgaacaagcttattgtggaaacattggttatgaatacatgcacattgctgatcgtgaaagatgtaattggttaagagataaaatcgagaccccaactccaactcaatataatagagaacgccgtgaggttattcttgataggctcatttggagtactcaattcgaaaactttttagctactaaatggacagctgctaaaagatttggacttgaaggtggtgagacattaatcccaggaatgaaagagatgtttgacaggtcagcagatcttggtgttgaaagcattgtgattggaatgtctcacagaggaagattaaacgttttaggtaatgttgttagaaaaccattgcgtcaaattttcagtgaatttagcggtggtacaaagccggttgatgaagttgggctttacacggggaccggtgatgtaaaatatcatcttgggacttcttatgatcgcccaacacgtggtggaaagagaattcatttgtctttagttgcaaaccctagtcatttggaagctgtagatcctgttgtgattggtaaaacaagagcaaaacagtattactcaaatgatgttgatagaacaaaaaacatgggtattttgattcatggggatggaagctttgcagggcaaggtgtggtttatgagactttgcatttaagtggtcttccaaattacacaactggcgggaccattcatattgtagtcaacaatcaagttgcttttacaactgatccacaagcaggaagatcttcacagtattgtactgatgttgctaaagctttaaatgctccaatttttcatgttaatggtgatgacgtggaagctgttgttcatgcttgtgagctggcagctgagtggcgacaaacgttccactcggatgttgttgttgatatagtctgttatcgtcgatttggtcataatgaaattgatgaaccatctttcacccaaccgaaaatgtacaagatcattaggaatcatccatcatcactagaaatctaccagaagaagcttctagaaagtgggcaagcaactaaagaagatattgatagaatacaaagcaaggttaccacaattctcaatgaagagtttcttgccagcaaggattatgtccctcaaagaagagactggctttcggcttattggactggatttaaatcccctgaacagctttcgcgtatccgtaacaccggagttaaacctgagattttgaaaaatgttgggaaggcgattacaacacttccagaaacctttaagccacacagagcagttaagaaaatatttgcagatcgttataagatgattgaaactggtgaaggtgttgattgggcagttgcagaagcactagcttttgcgacattactggtggaaggaaatcatgtgagattgagtggtcaagatgttgaaagaggtactttcagtcacaggcattctgttcttcatgatcaagaaacaggggagcgttattgtccattggatcatgtaatgatgaatcaaaatgaggaaatgtttaccgtaagcaacagttctctatcagagtttggtgtgctgggatttgaattgggctattcaatggaaaatcctaattcactggtattatgggaagctcagtttggtgatttttccaatggtgcccaggtgatatttgatcaattcttgagcagtggtgaggctaagtggctgcgccagactgggttggttgtgttgttgcctcatggttatgatggtcaagggcctgaacactcaagtgcaagacttgagcgtttccttcagatgagtgatgataatccgtttgtcatacctgagatggagccaacactacgcaatcaaattcaaacatgcaatatgcagattgttaatgttacgacaccagcaaactatttccatgtgttacgtcgacagctgcatagggagttccgtaagccactgattgttatgtctccaaaaaatctgcttcgtcacaaagactgcaagtcgaatttatctgagtttgatgacgttcaaggtcaccctgggtttgacaaacaaggaaccagatttaaacggctcattaaggaccaaaatgaccactcagatcttgaagaagggattaggcgtttagttctttgctctggaaaggtttattatgaacttgatgaacaaaggaagtcggttgatggtaaagatgttgcgatttgtcgtgttgaacaactgtgcccattcccatatgatctcatccagcgtgaactaaagcgttatccaaacgcagagatagtttggtgtcaagaggagcccatgaatatgggggcctatagttacattgccccacgccttgcaacagccatgaaggccctcaatagaggtactattgatgatatcaaatatgtgggtcgggctccttctgctgcaactgcaactggtttctacaccgtccatggcagagaacagtctgaactagtgcagaaggctttgcagcctgaacccgtcaccagtcccgcacttagttaaaccctgcagccggggtatgtatctttgtccgaattcggcttggctttctttttgcttcatttttcagaagttttccgcgtattgaaaagttttacgcgtgtaataatacatacaaacgttcatgtgaactctgtacaatagattcatggcatgtttttaactttgcagttaattacacactgtttacctttttgaggatcgtattttgttcctttaatgacatgacatgtcttgtatta

SEQ ID NO: 1812 - DNA, 3570 bp, Vinca minor
tccagaacattattcgctactgtagccgttgaaacttgtataaataaggaaacaaaatctccagcttcactccgattttcgctatgctgcagctagggtttctttgaaccctctcaatttctccatattcgggttgtttggagtagaatgattgttattaggacctaaatttggctggggaaacatagaagttttataaaatagaaactttagcagagtgcaatggcgtggttcagagctggttctaatgtggcaaaacttgctgttagaagatctttggcacgaggtggaggaggttcatatgttgcaagagcccatgtgatccctttgcaaaaccgatattttcatacaactgtttttaagccgaaagcacaatctgcacccgttcctcgtcccgttccactgtctaagttaaccgatagtttcttagatggtactagcagtgtttaccttgaggagcttcaacgtgcttgggagcaggacccaaatagtgttgatgagtcatgggacaacttctttaggaactttgttggccaggctgccacatcacctggaatttctggccaaacaattcaagagagtatgcgactgttgttggttgtcagagcataccaggtttatggtcacatgaaagcaaatttggatcccttgggtttggagcagagggaaattcctgatgatttggatccagctttgtatgggtttagtgaagctgatcttgaccgagaattcttcattggtgtatggaggatgtctgggttcttgtctgagaatcgtcctgtgcaaacattaagagctatattgacaaggcttgaacaggcttactgcggtaatattggttatgagtacatgcacattgctgaccgtgagaagtgtaattggttgagggacagaattgagacacccacaccgatagaatacaatcgtgagagacgtgaagttattcttgatcgtcttgtctggagttctcagtttgaaaatttcttggctaccaagtggacagctgccaagagatttggtcttgaaggtgctgagaccttgattccgggcatgaaggagatgtttgataggtcagcagatcttggggttgagagcattgttattggaatgtcgcatagagggagactgaatgttcttggtaatgttgtccggaagcccctccgccaaatatttagcgagttcagcggcggtacaaaaccttcagatgaggttggcttatacactggaaccggtgatgtcaagtatcacctgggaacttcttatgaccggccaactaggggaggaaagaggattcatttgtcactcgtagcgaatcccagtcacttggaagctgtggacccagttgtggttggtaaaacaagagcaaagcaatattattctaatgatgtggatagaacaaagaatatgggtattttgattcatggagatggaagctttgcaggacaaggtgttgtatatgagactcttcatcttagtgctcttcctaattacactacaggagggactatacacattgtggtgaataatcaagttgcatttacgaccgatccccagtcaggaagatcttcacagtattgtactgatgttgccaaagccttgaatgctccaattttccatgtcaatggtgatgatgtagaggcagtggttcgtgtctgtgaacttgcagccgaatggcggcagacattccattcagatgttgtcgtagacatagtttgttaccgccgatttggtcacaatgagattgatgagccatcttttacccagcccaaaatgtataaggtcatccgcaatcatccttcggctcttgagatttaccagaagaaacttctaggatctgggcaagtgtctaaggaagacgttgataggataagcaagaaggttaatgcaattctcaatgaagaatttttggccagcaaagagtatatcccccaacgaagggactggctttcagcttactgggctgggttcaaatctcctgaacaactttcacgtatccgaaacactggtgtgaagccagaaattctgaagaatgttggcaaggcaatcaccagtcttccggagaactttaaggctcatagagcagtaaagagggtatatgatgaacgtgcaaagatgattgagacaggggaaggtattgattgggcagtaggggaagctcttgcttttgcaaccttgcttgtagaaggaaaccatgtcaggttgagcggtcaagatgttgaaagaggtacttttagtcatcgacactcagtccttcatgaccaggaaacaggagaaaaatattgtcctctggatcatgtcatgatgaatcagaacgaagaaatgtttactgtgagcaacagctctctttcggagtttggtgttctgggctttgaattaggttactcgatggaaaacccgaattccttggtactgtgggaagcccagtttggtgattttgcaaatggagctcaagtcatatttgatcagttcgtgagcagtggagaagccaaatggctgcgtcagtcaggattagttgtgcttctacctcatggctatgatggccagggtcctgaacattctagtgcacgtttggaacgtttcctccagatgagcgatgaccacccctatcttatcccagagatggactctactctcagaaaacagattcaagaatgcaattggcaggtggttaatgtaactacacctgctaattatttccatgtccttcgacgtcaaatacatagggaatttcgtaaaccacttattgtaatgtctccaaagaacttgctccgtcataaagaatgcaagtcgaatctttccgagtttgatgatgtccaaggtcacccaggtttcgataagcaagggaccagattcaagcgcctgataaaagaccagaatgaccactcagatcttgaggagggcattagtcgtctggttctttgctctggaaaggtttattacgagcttgatgaagagaggagaaaggtgggtagaaaagacgttgctatttgtcgagtagaacagctttgtcccttcccatacaacctcatccagcgtgaattaaagcgatatccaaatgccgagatcgtctggtgccaggaagagccaatgaacatgggtgcatacagttacatatcacccagactttgcagtgctatgaaagcattaggaaggggtaatcttgatgatattaaatacgtcggtcgcggtccatctgctgctactgccactggttcctttcggttcacgtcaaggagcagaccgaacttgttcaaaaagctttgcagaaagagcccatcaattaatttcccaagccgaaattaccaaatgagacctaacaacatattaggatacttaccttttttcgaataatcattcaagaacttgtgaatgccacagtctgctgcttgtgcttttgggtggtctggaccattcttttactcttatacccctctatattgaaagtgaataaggattttgtattaattttctggtcttggtatcagcaaggagagattctattgtagcccttatacaaaacttgtagacactgctgatatttcaggcaagtatgtgaaaatgctactaata

SEQ ID NO: 1813 - DNA, 3349 bp, Euphorbia peplus
ccgcgatttaggtttttcatccctccatctcctccgttttctcaccgccggtgctttcttccataattctttctagctgtatatgtgcttaggtcacattagggtgcatctgtagttatgacgtggtttagagctggcactactgtggcaaggcatgccatacgaaggaccttatctcagagcggaacatacacaactagagcacgcattattccttctcagagtcgatattttcatagcactgtcttcaagtcacaggcacaatctgctcctgtcccacgccctgtgcccctctctaagctgactgatagtttcttagatggaactagtagtgtttacttggaggaactgcaacgtgcttgggaagctgacccaaatagtgtggatgagtcatgggacaatttctttaggaactttgtgggtcaggcagccacatcccctggaatttcaggccaaacaattcaagagagtatgcggttacttttgctcgtgagggcttaccaggttaatggtcacatgaaagcaaagttggacccgttgggcttggaagaaagagaaattccagatgatttaaacccagctctctatgggttcactgatgctgaccttgacagagagttctttttgggagtatggagaatggcagggtttctgtctgaaaatcgtcctgtgcagacacttaggtcaatattgaccaggcttgagcaagcttattgtggcagtattggctatgagtatatgcacatagctgatcgcgagaaatgcaattggttgagagacaagattgaaacaccaactcctacccagtacaaccgtcagcgacgagaggttattcttgataggctaatatggagtacacaatttgaaaacttcttggccaccaagtggacaacagctaagaggtttgggcttgaaggtggtgagacactgattcctggcatgaaggagatgtttgataggtcagcagatcttggtgttgagagtatagttattggaatgcctcatagaggaagattaaatgttcttggtaatgtcgttcggaagccacttcgtcaaatatttagcgaatttagtggtggcacaaagcctgtagatgaagttggtctctacactggaactggtgatgtcaagtatcacttgggaacttcatatgatcgtccaactagaggaggaaaaaggatccatttgtctttggttgcaaaccctagtcatttggaagctgtggaccctgttgttgttggcaagactagagctaagcagtattactccaatgatgagaacaggacaaaacatatgggaatcttgattcacggtgatggtagctttgctgggcaaggtgtcgtatatgaaactctgcatcttagtgcactgccaaactatactactggtgggactatacacatagtggtgaataaccaagttgctttcaccactgacccaagggcaggcagatcttcacaatattgtactgatgtcgccaaggctttggatgcccctatattccatgttaatggagatgatgtagaggccgttgtccatgcctgtgaacttgcagctgagtggcgccaaactttccattcagatgttgttgttgatttagtctgttaccgtcgatttggccataatgagattgacgaaccatcttttacacaacccaaaatgtacaagatcattcgaagtcatccatcggctcttgagatctatagacagaaacttctagagtctgagcaggtgggtgaagaagatattagcaagatacaagcgaaggtcactgcaatactgaatgaagaattcctggccagcaaagattatgttcctaaaagaagagattggctttcatctcactgggctggatttaagtcacctgagcagctttcacgtgtccgcaacactggagtgaaacctgagatcttgaagaatgttggcaaagcaatcacaagtcttccagatacttttaagccccacagagctgtaaagaaagtatatgagcaacgtgctcaaatgattgaaacaggggaaggaattgactgggcagtagcagaagctcttgcttttgctactttgcttgtagaaggtaaccatgttcggttgagtggtcaggatgttgaaagaggtacttttagtcaccgacattcagtaattcatgatcaagaaactggggaacagtattgccctctcgaccatgttattatgaaccaaaatgcggagatgtttactgtcagtaacagttctctttcagaatttggtgtccttggatttgaattgggatactcgatggaaagtcccaattcattggttatttgggaagctcagtttggtgactttgctaatggagctcaggtgatatttgatcagttcattagcagcggtgaatcaaaatggttgcgtcaaactgggctggttgttctccttcctcatggatatgatgggcaaggtcccgaacattcaagtgcacgattggaacgcttccttcagatgagtgatgacaatccttttgttattcctgaaatggatgcgacccttcggaagcaaattcaggaatgtaactggcaggttgtaaatgtcacaacccctgctaattacttccatgtattgcgtcgtcagttgcacagagatttccgaaagcccctcgttgtgatggctcccaaaaacttacttcgtcacaaggactgcaaatcgaatctctctgagtttgatgatgtccagggccaccctggttttgacaagcagggtaccagatttaagcgtctcataaaggatcaaaatgaccactctgatcttgaagagggtgtcaggcgcctggttctttgctctggaaaggtttattatgagcttgatgaagaacgcaaaaagaataatgccaaggatgttgcaatttgtagggtggagcaactgtgtccgttcccatatgatcttgttcagcgtgagctcaagcggtatccgaatgcggagatcgtttggtgccaggaagaagcaatgaacatgggtgcttatagttacgtcttacctcgcctttgcactacggtgaaacaaatgggacgaggatcaatagaggacatcaagtatgtcgggcgtgctccgtctgctgcaacagccaccggtttctaccaggtgcatgtgaaggaacagacagagcttgttcagaaagccatacaacaagagccgattaagtatccattttgaagcctttgaaggctgttaaatacaaattttcacaagacaataattacacatccatagatgaaacttctttcatggatgctgggtactgtttacttgccttgttctttttgacttttaactcgtgtacaatttcatctgccaaggtgtcttggtatctttttatagc

SEQ ID NO: 1814 - DNA, 3260 bp, Papaver somniferum
gcagcaaaatcagcgaaatctgatcgtctcaggtgatatcaattaagaaattttgaggttttgattgagttttaaaatttcaatatggcgtggtttagagcagtatctaatatatcaaagctagcaattaagcgaaatctagcacaagctagatcttcatcatatataagtcgaacacaattaatccggtcacaacagcaacaaactcagtatttccattcatcagttattagatcgaaggcagctccatcgagtgcgccggttcctcgtcctgtaccattatctagattaactgatagttttctagatgggactagtagtgtgtacttagaggaattgcaaagggcatgggaagctgatcctaacagtgtagatgaatcatgggataatttctttaggaattttgttggtcaagcgtcgacatcacctggtttgtctggacaaactattcaggagagtatgcgtttgttgttgcttgtgcgagcgtatcaagttaatggtcatatgaaagcgaaattagatccgttggcgttagaggaacgtgaagttccggatgatttgaatcctgcgttgtatgggtttactgaagctgatttagatagagtagttttttctcggggtttggagtgtttcaggttttttgtctgagaatcgtcccgttcagactcttagagcgatattgaataggcttgagcaagcgtattgtgggagtattgggtttgagtatatgcatattgctgatcgggataagtgtaattggttgagagataagattgagacacctacacctaggcagtataatttgcagcgtcgtgaagttatgcttgatagacttatgtggagtacacagtttgagaatttcttggctacaaaatggactgctgcaaagaggtttgggcttgaaggtggagagactttgattcctggtatgaaggagatgtttgataggtcagctgatcttggggttgagagcattgttatcggtatgtcgcatagaggaagattgaatgttttgggtaatgttgtgaggaaaccacttgcacagattttcagcgagtttagtggaggtataaagcctatcgatgaagttggactgtatacagggactggagatgttaagtatcacttgggtacttcttatgatcgaccgactaggggtggaaaaagacttcatctgtctttggttgcaaaccctagtcatttggaagctgtcgatccacttgtgattggaaagactcgagcaaaacaatactattcgaatgatttagacaggacaaagaatttgggtgtgttgattcatggtgatggtagtttcgctggacaaggtgtagtttatgagactctgcatcttagtgcccttccgaattatacaacgggcgggactatccacattgtggtgaataaccaagtggctttcacgactgatccaatgtctgggagatcttcagaatattgtactgatgttgctaaagcgttggatgcccctatttttcatgtaaatggtgatgacttagaggctgttgtttatgtatgtgagctcgcagccgagtggcgacagactttccattctgatgttgttgttgatgtagtttgttatcgtcgatttgggcacaatgagattgatgaaccgtctttcacacagcctaaaatgtatcaagtcattcgtaatcatccatcagcgctcgagctttaccaaaagaagctcttagaaacagagcagattacagaagaagacatcaaaagaatgcagaataaagtcaacaaaatccttaatgaagagtttgttaacagcaaagattatgttcctaaaaaaagggactggcttgctgcttattggactggtttcaaatcccctgaacaggtttcacgtgttcgaaacactggggtgaagcctgagattctgaagagcgttggaaaagcaatcacaagtcttccagaaactttcaagcctcaccgagcagtaaagaagatatttgaacaacgtgcccagatgattgaaactggggaggggattgactgggcagtcggagaagcacttgcatttgctacattgctagtggagggaaatcacgtaaggttgagtggtcaggatgttgaaagaggtacctttagtcatcggcattcagttattcacgatcaggaaacaggggagaagtactgccctctcgatcatgttaccatgaaccaagatgaggagatgtttacagtcagtaacagctcgctttctgagtttggcgttcttgggtttgaattgggatactcaatggaaaacccaaattcattggttatatgggaagcacagtttggtgatttttcaaatggggcgcaggtgatgtttgatcagtttttgagtagtggagagtcaaaatggttacgtcaaactgggcttgtagtgctgcttcctcacggttatgatggtcagggacctgaacattctagtgcaagaatggagcgattccttcagatgagtgatgataatccctatgtcatacctgaaatggaccaaactcttcgaaagcaaatccaggagtgcaactggcaggttgcaaatgtaacaacccctgctaattatttccatctcctgcggcgtcagatacacagggaattccgaaagccactagttgtcatggcacctaaaaacctgcttcgtcacaaagattgtaagtcaaatctatctgagtttgatgatgtcaaagggcatccaggttttgacaagcaagggacccgtttcaagcgtcttataaaagaccagaaggaccgttctgaccttgaggagggtgtcaggcgtttggttttgtgctctgggaaggtctattacgagcttgatgaagaacggaagaaagtcagtggcgatgacgttgcaatctgcagagtggaacagctttgcccattcccttatgacctcatccagcgagagctgaagcgttatccaaatgctgaagttgtttggtgccaagaagagccaatgaacatgggtggatacagctacattgctccacgtctgtgtactgccatgaaggctttaggtagaggaaccatggaggacattaaatatgtcggtcgtggcccatcagctgccaccgccactggtttctactcggtccatacaaaggagcagactgacctagtccacaaggcactccagcctgagccaatcaactatcctttttgaagtattctaaatcctagagagaaggtatgcagaggaaggcacatttaataaactaaatgttattttgtatattttggtttaggttagg

SEQ ID NO: 1815 - DNA, 3551 bp, Solanum lycopersicum
tggtgaggttcgagaagagatggaaaaagtattgttaaaatattaaatgctgattgctcaactttgaacgtggcttcgtccactctctagaaagtcattatattcgcttcgctcaacccataaaacttgttaactcttcaaggtcatttctcaaggtataatgattgtgtgttgaagttttgttcgttgagggtttatcggtacttttgaagacttttaaattcgatttgagggcttgatttacagaaatggcatggtttagagctgggtctagtgtggcaaagcttgccattagaagggctgtgtctcagggtggctcttatgtgccaagaactcgcattattccatcacaaagcagatattttcataccacagttgtcaggccaaaagctcaagctgcaccagtcccgaggcctgtaccactttctaagttgactgatagcttcttagatggcactagcagtgtctaccttgaagagcttcagcgtgcttgggagcaagatccaagtagtgtagatgaatcttgggacaactttttcaggaattttactggcctagctgccacatctcctgggatttctggccaaacaattcaagaaagcatgaatcttctgttgcttgttagagcttatcaggttaatggtcatttaaaagccaaattagacccattggatctggaggagagggatatccccgatgttttggatccagtatcatatgggttcactgaagctgatcttgaccgagagttcttccttggtgtttggaggatggctggtttcttgtctgagaatcgccccgtgcaaaccttgagggcgattttgacaaggcttgagcaggcttattgtggcagcattggttttgagtacatgcacatttctgatcgtgataaatgtaattggttgagagaacgaattgaaactcctacacccagggagtacaaccgcgaacgacgtgaagttattcttgaccggttgatgtggagtactcagtttgagaacttcttagccaccaagtgggtggcagccaagagatttgggcttgaaggttgtgagactttgattcctggcatgaaggagatgttcgacagatcagcagatctgggagttgagagcatagtaattgggatgccacatagaggtagattaaatgttttaggtaatgttgttcgaaagccactaaggcaaatttttagtgagttcaccggtggtacaaaacctgcggatggagctggttatgtgggaactggtgatgtcaagtatcacttgggaacttcttatgatcgccctactaggggtggtaagagaattcatctatctttagttgcaaatccaagtcacttggaagctgtggacccagttgttattggaaaaactagagcaaagcaatattattcgaatgatgtggatagaacaaagaatatgggtattttgctccacggtgatggtagctttgctggacaaggtgttgtttatgagacattgcatttaagtgctcttccaaattacacaactggtggaaccattcatattgtagtgaataatcaagtggcctttacgactgatccaaaggctggaagatcttcccaatactgcactgatgttgcaaaggctttgagtgctccaattttccatgtcaatggcgatgatgtcgagggcgttgtttatgcctgtgaacttgctgcagaatggcgacagacattccactcagatgttgtggttgatattgtctgttatcgtcgatttggtcacaatgagattgatgaaccatccttcacccagcccaagatgtatcaggtcatcagaaatcatccttcttcattggagatctatcaaaacaaactcctacaacatggtcaagtgacaaaagatgatgtggaaaaaatacataacaagatcaatacaatccttaatgaggagtttgttgctagtaaagactatgtccctcaaaaaagagattggctttcagccttctggtctggatttaagtcacctgcacagctttcacgtgttcgaaacactggtgtcaaacctgagatcttgaaggatgtcgggaaagcaattacctcccttccagacgattttaagcctcacagagcagtaaaaaggatttttgatgaccgtaagaaaatgattgagacaggggagggcgttgactgggcagtgggagaagctcttgcttttgcaacattgcttgtggaaggaaatcatgttaggttgagtggtcaggatgttgagagaggtactttcagtcacagacattctgttgttcatgatcaggagacaggggcaaagtactgtcctcttgatcatgttatgatgaaccaaaatgaagagatgttcaccgtgagtaacagttctctttcagagtttggtgttcttggatttgaactgggttattccatggaaaatccaaattctttggttctttgggaagcccagtttggtgatttcgccaacggggctcaagtaatatttgaccagttcttaagcagtggagaggccaaatggttgcgccagagtgggttggttgtgcttctaccgcatggttatgatggccagggccctgagcattccagtgcacgtttggaacgtttcctccagatgagtgatgataacccctatgtcattccggacatggaacctacattaaggaaacagattcaggaatgtaacttgcaggtggtgaatgtgacaactcctgcaaattatttccatgttctccggcgtcagattcatagagacttccgtaaacctctcattgtaatgtccccaaagaacttgcttcgtcacaaggactgcaagtcaaacctatctgagtttgatgatgtccaaggccaccctggttttgacaaacaaggtaccaggtttaagcgcttaataaaagatcagaatgaccactcggatcttgaagaggatatccgacgcctggtcctttgctccggaaaggtctactatgagcttgatgaggagagaaagaaagttgaagggaaagacgttgcaatctgtcgggtggaacaactttgtcctttcccatatgaccttgttcaacgtgaattgaagcgctacccaaatgcagagattgtttggtgccaagaagagccaatgaacatgggtgcataccattacattgcaccacgtctttctactgcgatgaaagccctaaacagaggtaacgtagacgacataaaatatgtaggccgtgctccttctgcagccacagctactggtttctaccaagttcacgtgaaagaacagaccgagcttgtccagaaagccttgcaacaggatccaattagttctccagtctgaagctgagcctctggtgtatttctttgcacaaagtacctagattgatgctgaaataaatctttcaactccacaaacagtattttaagggtggaagttttcattctttggggaacagggaaaaatattatttgtcctcctttttttttaacttagaattgtacaaataaaatgtcagaaacaagtctctgttcctccctttttttattcttccaagagaatgaagttcatgattggtggttt

SEQ ID NO: 1816 - DNA, 4068 bp, Populus trichocarpa
gttggattgaggacagcatcatcgcttctgttttccacggcgactagggttttcttatacttcttttttctctccggtggctttgtttaaaaagatacatgttttttatgattgattcttgagcctgggaggtgtataatctttgaaaaagaattggtggtattgggttagtgtggattgatagtcatggcttggtttagagcgggtgctagtgtagcaaggctcgccattagaaggactttatctcagggtggatcgtatgcaacgagatcacgggttataccttctcagagtagatatttccattcaacagtgactaagtctaaggagcaaactgcgcctgtccctcgtcctgtccctctctctaagctaactgataacttcttagatgggaccagtagtgtttatttagaggagcttcagcgagcatgggaagctgatccaaatagcgtggatgagtcgtgggataatttctttaggaactttgtgggccaggctgctacgtctcctggaatttcaggccaaactattcaggagagtatgcggttgctgctgcttctcagggcttaccaggttaatggtcacatgaaagccaagttggatccactggggttggaagaaagagaaatcccagatgaattggatcctgctctatatggtttcacggaagctgatcttgatagagaattctttttgggagtgtggaagatggctggatttttgtctgaaaaccgtccagtgcagactcttaggtccatattgaccaggcttgagcaggcttattgcgggagcattgggtatgagtacatgcacattgcagatcgtgaaaaatgtaactggttgagagacaagattgaaaccccaacacctatgcagtacaatcgtcagcggcacgaagttattcttgataggttaatatggagtacacaatttgagaacttcttggccactaagtggacggcagctaagaggtttggactcgaaggtggagagactttgattcctggaatgaaggagatgtttgataggtcagctgatcttggggttgagagcatagttattggaatgcctcacagaggaagattgaatgtactgggtaatgtggttcggaagccgctccgtcaaatatttagcgagtttagtggtggcacaaaacctgtagatgaagttgggctctacactggaactggtgatgtcaagtatcacttgggaacttcttatgatcgtccaactagaggtgggaagagaatccatttatctttggttgcaaatcctagtcacctagaagctgtggatcctgttgttgttggaaaaactagagccaagcaatattactcgaatgattctgacaggactaagaacatggggattttgattcatggtgatggtagctttgctgggcaaggggtagtgtatgaaactctacatcttagtgcactgccaaactatactactggtggaaccatacatattgtggtgaacaaccaagttgctttcacaactgatcctagggcaggaagatcttcacaatattgcactgatgttgccaaggccttgaatgcacctatattccatgtaaatggagatgatatggaggcagttgttcgtgtgtgtgagcttgcagctgagtggcgccagactttccattcagatgttgtggttgatttagtgtgctatcgtcgttttgggcacaatgagattgatgagccttctttcacgcaacccaaaatgtatcaggttattcggaatcatccatcagctctggagatctataaaaagaaactcttagaatcaggacaggtgactgaagaagatattcataggatacaggagaaggtcctttcaatcctcaatgaagagttcttggcaagcaaagattatgttcctaaaagaagagactggcttgcatctcattggtctggttttaagtctcccgaacagctttcacgtgtcagaaacactggagtgaaacctgagatcttgaagaatgtaggcaaagcaattacgacccttccagataattttaagcctcacagagctgtaaagaaggtttacgatcaacgtgcacaaatgattgaaacaggggaaggaattgattgggctgttggggaggctcttgcttttgccacactgctagtagaaggcaaccatgttcgattgagcggtcaggatgttgaaagaggtactttcagtcatcgtcattcagtaattcatgatcaggaaactggggagaagtattgccccctggatcatgtcaccatcaaccaaaatgaagagatgtttactgtcagcaacagctccctttcagagttcggtgttcttggatttgaattgggttactcgatggaaagtccaaattcgttggtaatctgggaagctcaatttggtgactttgcaaatggagctcaagtgatatttgatcagttcctgagcagtggtgaatcaaaatggctgcgacaaactgggcttgttgtgctgcttcctcatggatatgatggtcagggccctgaacattcaagtggacggttggaacgattccttcagatgagtgatgacaatccttttgttatacccgagatggaaccaacttttcgtaagcaaatccaagaatgcaattggcaggttgtaaatgttacaacccctgctaattacttccatgttttgcggcgtcagatacacagagacttccgtaagccccttgttgtgatggctcccaaaaacctacttcgtcacaaggactgcaaatcaaatctctcagagtttgatgatgtgcaaggccatcctggtttcgacaaacaggggaccagatttaaacgtctcataaaggatcagaatgaccactcggaccttgaggagggtatcaggcgtctggttctttgctctggaaaggtttattatgagcttgatgaagagcgtagaaaggtcgaggcaaaggacattgcaatttgtagggttgaacaactatgcccgttcccatatgatctcatccagcgcgagcttaagcgatatccaagtgcggaggttgtttggtgccaggaagaaccaatgaacatgggcgcatacagttacattgcaccacgcctatccactgccatgaaagcattgggcagaggaactatggacgacatcaagtatgctggacgcgggccatcagctgcaacagccactggtttctaccagatgcatgtgaaggaacaggctgaacttctgcaaaaagccatgcaacctgaaccaatacaaattcctaattgaagcctttgcatactgtcgagtacaaagtctaagaacaataattaaaaatttatacaccaaagttatgttggcgtcttgataccatttatatctcgccttgtttaggcggctgcttctttttaatccctttcacccaaaaacttctagccaagggaccttggttttttacacaagcgaagttgctcttcgagatgtactgtcttgcattacaagaaggaaatgtttgtcttttattggaacacgatttgcaggaacatgacgttctgttttttttgtttttttttttttttagagctaagatttctattctcgtcttagagctgacgtgttttttttttcctggaatcttattttttgtgatggtttcaggtgctgagattgtttggtgtcaggaagagccaacatttacatggcaccccccgtctttgcacagctatgaaagcaatgtgcataggatcctgggaggatatcaaatacggtggcagggatccatctgcttcccacagccactggctttcttcaggttctcaaagatgagtaggctcagatcgtccagttagccatgcagcctgcaccaatcaagttcccctactgaaccacccgttcaaaaccccactcggataataattatatgacccattgagaagcataacaatattacacacagcccgcaccaatacatcatccctccaaattgccattattagttgtagaactacgatgatacaatcttaatattgatgccacctcagcatatgacattaaagcattaagcatttaattagcagacttccgagataataataatgtaattat

SEQ ID NO: 1817 - DNA, 3395 bp, Nicotiana benthamiana
gaacgtggcctttgtccactctctctctcttaaaaagtcgtttccctgaacccacaaacccctcattcattttcattcgctcactcctcaaggttatttctcaaggtataatgattgtgtgttgaagtttagttggttgagggtttattgaaactagtaaagtacttctaaattcaatttgagggcgtgatttacaacaatggcatggtttagagctggatctagtgtggcaaagcttgccattagaagagctgtgtctcaggggggttcttacgtgccaagaagtcgcattcttccatcacaaagtagatattttcataccacagttatcaggccaaaggcgcaatctgcacctgtcccaaggcctgtaccactttcaaaattgactgatagcttcttagatggtaccagcagtgtctaccttgaggagcttcagcggacttgggaacaagatccgaatagtgtggatgaatcatgggacaactttttcaggaattttgttggcttagctgccacatcgcctgggatttctggccagacgattcaggaaagtatgaatcttctattgcttgttagagcttatcaggttaatggtcatatgaaagccaaattggacccgttggctttggaggagagggaaattccagatgttctggatccagtatcatatgggttcactgaagctgatctggaccgagagttcttccttggtgtttggaggatgtctggtttcttgtctgagaatcgccctgtgcagaccttgagggcgatattgacaaggcttgagcaggcttattgtggcagcattggtttcgagtacatgcacattcctgatcgtgataaatgtaattggttgagagaacgtattgagactcctacaccgagggaatacaaccccgaacgacgtgaagttattcttgaccggttgatgtggagtactcagttcgaaaacttcttggcgaccaagtggatggcagccaagagatttgggcttgaaggttgtgagactttgattcctggcatgaaggagatgtttgatagatcggcagatctgggagttgagagcatagtaattgggatgccgcatagaggtagattaaatgttttaggtaatgttgttcgaaagccactaaggcaaattttcagtgagtttagcggtggtacaaaacctgcggatggtgctggctatgtgggaactggtgatgtcaagtatcatttgggaacctcgtatgatcgacctactagaggtggtaatagaattcatctatcattggttgcaaatcccagtcacttagaagctgtggaccccgttgttgttggaaaaactagagcaaagcaatactattctaatgacgtggatagaacaaagaacatgggtgttttgctccatggagatggtagctttgctgggcaaggtgttgtttacgagacattgcatttgagtgctcttccaaattacacaacaggagggaccattcacattgtagtgaataatcaagtggcctttactactgatccaaggtctggaagatcttctcagtactgcactgatgtcgctaaggctttgagtgctccaattttccatgtcaatggcgatgatgttgagggtgttgttcatgcctgtgaacttgctgcagaatggcgccagacgttccactcagatgttgtggttgatattgtatgttatcgtcgatttggacacaatgaaattgatgaaccatccttcacccagcccaagatgtataaggtcatcagaagtcatccttctgcactggagatctatcaagacaaactcctacaatctggtcaggtgacaaaagatgatgtggagaagatacataacaagatcaatacgatccttaatgaggagtttgttgctagtaaagactatatccctcaaaaaagagattggctttcagctttttggtctggatttaagtcacctgcacagctttcacgtgtcagaaacactggtgtcaaacctgagatcttgaaggatgttggaaaagcaataacaactcttccagaggacttcaagcctcacagagcaataaaaaaggtttatgatgagcgtaagaaaatgattgagacaggggagcgtgttgactgggcattgggagaagcacttgcttttgcaacattgctggtggaaggaaatcatgttaggttgagtggtcaggatgttgagagaggtactttcagtcacagacattctgttcttcatgatcaggagaccggggcaaagtactgtcctcttgatcatgttatgatgaaccaaaatgaagagatgttcactgtgagcaacagctccctttcagagtttggtgttctgggatttgaacttggttattcaatggaaaatccaaactctttggttctctgggaagcccaatttggtgatttttccaatggagctcaagtaatatttgaccagtttttgagcagtggagaggccaagtggttgcgccagactgggttggttgtgcttcttccacatggttatgatggccagggccctgagcattccagtgcacgtttggaacggttcctccagatgagtgatgataacccctttgtcattccggagatggaaccaacattgaggaaacagatccaggaatgtaactggcaggtggtgaatgtgacaactcctgcaaattatttccatgtgctcaggcgtcagattcacagagatttccgtaaacctcttattgtgatgtccccgaagaacttgcttcgtcacaaggagtgcaagtcaaacctgtctgagtttgatgatgtccaaggtcacccaggttttgacaaacaaggtacccggtttaagcggttgataaaggatcagaacgaccactcagatcttgaagagggtatcagacgcttggtcctttgctctggaaaggtgtattatgagcttgacgaggagaggaagaaagttgatgggaaagacgttgcaatctgtcgggtggaacagctttgtcctttcccgtacgaccttgttcaacgtgaattgaagcgatatccaaacgctgagattgtttggtgccaagaggagccaatgaacatgggtgcatacagttacattgccccacgtctttgcactgcaatgaaagcacttggcagaggtgatatggatgacataaaatatgttggtcgtgctccttctgctgccacagctactggtttccaacaggttcatgtgaaagaacagaccgagcttgtccagaaagccttgcaacgggatccaattaattctccattctgaagctgaggccttgttgtattctttgcacaaagttccaagactgatggtgaaataagagatctaactctatatttctggtgaaagttttgattctttgggaaacaggggcatattgtttgtgctcttttttctt

SEQ ID NO: 1818 - DNA, 3410 bp, Arabidopsis lyrata
agtggagaaagacgattgttgaatgcgttattgtaactgctaacttttgaagataaagcgttgtttttgaatctggtgaaatggtgtggtttcgagctggttcgagtgttacaaagttagctgttagaaggattctgaatcagggtggttcgtatgcgacgaggacacggtctcttccttctcaaacacgttcctttcactcgactatttacagaccaaaggctcagagtgctcctgttcctagagctgtacctctttctaagctaactgatagtttcttagatgggacgagcagtgtctaccttgaggagttacaaagggcttgggaagctgatcctaatagtgtagatgagtcttgggataatttctttaggaactttgtcggtcaggctgccacgtctcctggcatttctgggcagacaattcaggagagtatgaggctgttgttacttgtcagggcttatcaggtgaatggtcacatgaaagcgaagttggatccgttaggtttggaacagcgagagatccctgaggatcttgacttggctctttatggattcactgaggctgatcttgacagagagttcttcttgggagtctggcagatgtcaggattcatgtctgagaaccgaccagtgcagacccttcgttccatattgacaaggctcgaacaggcatactgtgggaatattgggtttgagtatatgcacattgcagatcgagataaatgtaattggttgagagaaaagattgaaacaccaactccttggcggtacaacagggagcgtcgtgaggtgattctcgatcggcttgcatggagtactcagtttgagaatttcttagctaccaagtggacgacagctaaaagatttggacttgagggaggagaatcattaattcctggcatgaaggagatgtttgacagggcagcagacctcggagtagagagtattgttattggaatgtctcacagaggaagattgaatgttctgggtaatgttgttcggaagccactacgtcagatatttagtgagttcagtggtggtatcaggcctgtagatgaagttggttacactggaactggtgatgtcaaatatcacttgggaacctcttatgatcgacctacaagaggtgggaagaaaatccatctttctttggtagctaatccaagtcacttggaagctgcagattctgttgttgttggcaaaaccagagcaaaacagtactactccaatgatttagacaggaccaaaaatttaggtattttgattcatggagatggtagttttgctggacaaggagtagtttacgaaactcttcatcttagtgctcttccaaactacaccaccgggggaaccatacatattgtggtgaacaaccaagtggctttcacgacagatccaaaggctgggagatcttcccagtattgtactgatgttgctaaggctttgagtgctcccatctttcatgttaatggggatgatgttgaggcggttgttcatgcctgcgagcttgctgctgagtggcgtcagacttttcattctgatgttgtcgttgatttggtttgctaccgtaggttcgggcataatgagatagatgaaccatccttcactcagccaaaaatgtacaaggttatcaaaaatcatccttcaacccttcagatctaccacaaaaagctcttggaatgtggtgaagtatcacaacaggatatcgaccggatacaggaaaaggttaacaccatcctcaatgaagaatttgtctctagtaaagactatctcccgaagaaacgagattggctttcaaccaattgggctggatttaagtctcctgagcagatctcacgagttagaaacactggcgtcaaaccagagatacttaagtctgttggcaaggcaatttcatcgcttccagaaaacttcaagccacacagggcagtgaagaaagtttatgaacaacgtgcccaaatgattgaatcaggagaaggagttgactgggctcttgcagaagctcttgcttttgctaccttagttgtggaaggcaatcatgtccggttgagtggtcaagatgtcgaacgaggaacatttagtcatcgtcattctgtacttcatgaccaggaaactggagaagagtattgtcctctagatcatctcatcatgaatcaggatcctgagatgtttactgttagcaacagttctctttcagaatttggtgtccttgggttcgaattgggttactccatggaaagcccaaactcgttggtactatgggaagctcagtttggagactttgccaatggagctcaggtgatatttgatcagttcatcagcagtggagaagccaaatggctgcgtcaaaccggtcttgttatgctacttccccatggttatgatggtcagggccctgaacattcaagtgcgaggttggaacgttacctccagatgagtgatgataatccctatgtcataccagacatggaaccaacaatgcgaaagcaaattcaagagtgtaattggcagattgtcaatgccacaactcctgccaactatttccatgttctgcggcgacagatacacagagacttccgtaagcctctgattgtaatggcaccaaagaacttgctccgtcacaaggactgcaaatcaaatctctcagagtttgatgatgtccaaggccatccaggttttgacaagcaaggcactagatttaagcgattaatcaaggatcagaatgatcactctgatcttgaagaaggcatcagaagattggtactttgctccggaaaggtctattatgagcttgatgatgagcggaagaaggttggcgcaaccgatgttgctatctgtagagtggaacagctttgtcctttcccatatgatctcattcagcgtgagctcaagagatatccaaatgcggagatcgtttggtgccaagaagaggcgatgaacatgggagcattcagctacatatctccacggctatggacagcaatgagaagcttaaacagaggagatatggaagacattaagtacgttggccgtggtccttctgctgctactgccaccgggttctacactttccatgtcaaggagcaagccgagcttgtccagaaagccatcggaaaggaacccatcaattaaaactcttcctttttaaatgaattctctgagtgaaaaggaaaaaaaggagaaaactttgaaataagaactttgggtgatgcaaaagtgctaaacaacactgacataatcctctgtttctttgttatatttttttggtcccattgattttgagcctgcctagtgttgcaggtcaaaacataaaaaaaaatctcatattgatacacagttttgttattgctcttcttttttcttctttgattcatcttttgcgttgtcattgtctttttcctttatctt

SEQ ID NO: 1819 - DNA, 3531 bp, Arabidopsis thaliana
aaaactttaaaaaccaaccctttcttcctcctcctccgagttcttctttctcttcttcgcctcctcctcctccaagtgtagaacgacgattgttgaatgcgttattgtaattgttaagaattgaagttaaagtgttgtttttgaatctggtgaaatggtgtggtttcgtgctggttccagtgttacaaagctagctgttagaaggattttgaatcagggtgcttcgtatgcgacgaggacacggtctattccgtctcaaactcgttcctttcactcgactatatgcagaccaaaggctcagagtgctccagttcctagagctgttcctctttctaagctaactgatagtttcttagatgggacgagcagtgtctaccttgaggagttacaaagggcttgggaagctgatcctaacagtgtagatgagtcttgggataatttctttaggaactttgttggtcaggctgccacgtctcctggcatctctgggcagacaattcaggagagtatgaggctgttgttacttgttagggcttatcaggtgaatggtcacatgaaagcgaagttggatccgttaggtttggaacagcgagagatccctgaggatcttgacttggctctttatggattcactgaggctgaccttgacagagagttcttcttgggggtgtggcagatgtcaggattcatgtctgagaaccgaccagtgcagacccttcgttccatattgacaaggctcgaacaggcatactgtgggaatatcggatttgagtatatgcacattgcagatcgagataaatgtaactggttgagagaaaagattgagacaccaactccttggcggtacaacagggagcgccgtgaggtgattctcgatcggcttgcatggagtactcagttcgagaatttcttagctaccaagtggacaacagccaaaagatttggacttgagggaggagaatcattaattcctggaatgaaggagatgtttgacagagcagcagatcttggagtagagagtattgttattggaatgtctcacagaggaagattgaatgttctgggtaatgttgttcggaagccactccgtcagatatttagtgagttcagtggtggtattaggcctgtagatgaagttggctacactggaactggtgatgtcaaatatcacttgggaacctcttatgatcgacctacaagaggtgggaagaaaatccatctctctttggttgctaatccaagtcacttggaagctgcagattctgttgttgttggcaaaaccagagcaaaacagtactactccaatgatttagacaggaccaaaaatttaggtattttgattcacggagatggtagttttgctggacaaggggtagtctatgaaactctccatcttagtgctcttccaaactacaccaccggaggaaccatacatattgtggtgaacaaccaagtggctttcacgacagatccaagggcggggagatcttcccagtattgtactgatgttgcaaaggctttgagtgctcccatctttcatgttaatggggatgatgttgaggctgttgttcatgcctgcgagcttgctgctgagtggcgtcagacttttcattctgatgttgtcgttgatttggtttgctaccgtaggttcgggcataatgagatagatgaaccatctttcactcagccaaaaatgtacaaggttatcaaaaatcatccttcaacccttcagatctaccacaaaaagctcttggaatgcggtgaagtatcacaacaggatattgaccggatacaggaaaaggttaacaccatcctcaatgaagaatttgtcgctagtaaggactatctccctaagaaacgagattggctttcaaccaattgggctggatttaagtctcctgagcagatctcacgtgttagaaacactggcgtcaaaccagagatactgaagactgttggcaaggcaatttcatctcttccagaaaacttcaagccacacagggcagtgaagaaagtttatgaacaacgtgcccaaatgattgaatcaggagagggagttgactgggcccttgcagaagctcttgcttttgctaccttagttgtggaaggcaatcatgtccgattgagtggtcaggatgtcgaacgaggaacatttagtcatcgtcattctgtccttcatgaccaggaaactggagaagagtattgtcctctagatcatctcatcatgaatcaggatcctgagatgtttactgttagcaacagttctctttcagaatttggtgtccttgggttcgaattgggttactccatggaaagcccgaactcgttggtactatgggaagctcagtttggagacttcgccaatggagctcaggtgatatttgatcagttcatcagcagtggagaagccaaatggctgcgtcaaaccgggcttgttatgctacttccccatggttatgatggtcagggacctgaacattcaagtgcgaggttggaacgttaccttcagatgagtgatgataatccctatgtcataccagacatggaaccaacaatgcgaaagcaaattcaagaatgtaattggcagattgtcaatgccacaactcccgccaactatttccatgttctgcggcgacagatacacagagacttccgtaagcctctgattgtaatggcaccaaagaacttgctccgtcacaaggactgcaaatcaaatctctcagagtttgatgatgtccaaggccacccaggttttgacaagcaaggaactagatttaagcgattaatcaaggatcagaatgatcactctgatcttgaagaaggcatcagaagattggtactttgctccggaaaggtctattatgagcttgatgatgaacggaagaaggttggcgcaacagatgttgctatctgtagagttgaacagctttgtcctttcccatatgatctcattcagcgtgagctcaagagatatccaaatgcggagatcgtttggtgccaagaagaggcgatgaacatgggagcattcagctacatatctccacggctatggacagcaatgagaagcgtaaacagaggagatatggaagacattaagtatgttggtcgtggtccttctgctgcaactgccacgggtttctatactttccatgtcaaagagcaagccgggcttgtccagaaagccatcggaaaggaacccatcaattaaaaactcttcctttttaaatgacttctcagactgataagagaaaaaggagaaaactttgaaataagaactttgggtgatgcaaaagtgctaaacaacactgtcaaaatccgctgtttctttgatatttttttggtcccattgattttgagcctggctcgtgttgccagtcaaaacattaaaaaaaaatcttatattgatatacagttttgttattgctcttctttttttcttctttgaatcatcttttgcgttgtcattgtcttttcccttatcttcttgttctctataatatgaaccattgatttcaattgagttatacaact

SEQ ID NO: 1820 - DNA, 3831 bp, Populus trichocarpa
aaaagatacatgttttttatgattgattcttgagcctgggaggtgtataatctttgaaaaagaattggtggtattgggttagtgtggattgatagccatggcttggtttagagcgggtgctagtgtagcaaggctcgccattagaaggactttatctcagggtggatcgtatgcaacgagatcacgggttataccttctcagagtagatatttccattcaacagtgacaaagtctaaggagcaaactgcgcctgtccctcgtcctgtccctctctctaagctaactgataacttcttagatgggaccagtagtgtttatttagaggagcttcagcgagcatgggaagctgatccaaatagcgtggatgagtcgtgggataatttctttaggaactttgtgggccaggctgctacgtctcctggaatttcaggccaaactattcaggagagtatgcggttgctgctgcttctcagggcttaccaggttaatggtcacatgaaagccaagttggatccactggggttggaagaaagagaaatcccagatgaattggatcctgctctatatggtttcacggaagctgatcttgatagagaattctttttgggagtgtggaagatggctggatttttgtctgaaaaccgtccagtgcagactcttaggtccatattgaccaggcttgagcaggcttattgcgggagcattgggtatgagtacatgcacattgcagatcgtgaaaaatgtaactggttgagagacaagattgaaaccccaacacctatgcagtacaatcgtcagcggcacgaagttattcttgataggttaatatggagtacacaatttgagaacttcttggccactaagtggacggcagctaagaggtttggactcgaaggtggagagactttgattcctggaatgaaggagatgtttgataggtcagctgatcttggggttgagagcatagttattggaatgcctcacagaggaagattgaatgtactgggtaatgtggttcggaagccgctccgtcaaatatttagcgagtttagtggtggcacaaaacctgtagatgaagttgggctctacactggaactggtgatgtcaagtatcacttgggaacttcttatgatcgtccaactagaggtgggaagagaatccatttatctttggttgcaaatcctagtcacctagaagctgtggatcctgttgttgttggaaaaactagagccaagcaatattactcgaatgattctgacaggactaagaacatggggattttgattcatggtgatggtagctttgctgggcaaggggtagtgtatgaaactctacatcttagtgcactgccaaactatactactggtggaaccatacatattgtggtgaacaaccaagttgctttcacaactgatcctagggcaggaagatcttcacaatattgcactgatgttgccaaggccttgaatgcacctatattccatgtaaatggagatgatatggaggcagttgttcgtgtgtgtgagcttgcagctgagtggcgccagactttccattcagatgttgtggttgatttagtgtgctatcgtcgttttgggcacaatgagattgatgagccttctttcacgcaacccaaaatgtatcaggttattcggaatcatccatcagctctggagatctataaaaagaaactcttagaatcaggacaggtgactgaagaagatattcataggatacaggagaaggtcctttcaatcctcaatgaagagttcttggcaagcaaagattatgttcctaaaagaagagactggcttgcatctcattggtctggttttaagtctcccgaacagctttcacgtgtcagaaacactggagtgaaacctgagatcttgaagaatgtaggcaaagcaattacgacccttccagataattttaagcctcacagagctgtaaagaaggtttacgatcaacgtgcacaaatgattgaaacaggggaaggaattgattgggctgttggggaggctcttgcttttgccacactgctagtagaaggcaaccatgttcgattgagcggtcaggatgttgaaagaggtactttcagtcatcgtcattcagtaattcatgatcaggaaactggggagaagtattgccccctggatcatgtcaccatcaaccaaaatgaagagatgtttactgtcagcaacagctccctttcagagttcggtgttcttggatttgaattgggttactcgatggaaagtccaaattcgttggtaatctgggaagctcaatttggtgactttgcaaatggagctcaagtgatatttgatcagttcctgagcagtggtgaatcaaaatggctgcgacaaactgggcttgttgtgctgcttcctcatggatatgatggtcagggccctgaacattcaagtggacggttggaacgattccttcagatgagtgatgacaatccttttgttatacccgagatggaaccaacttttcgtaagcaaatccaagaatgcaattggcaggttgtaaatgttacaacccctgctaattacttccatgttttgcggcgtcagatacacagagacttccgtaagccccttgtcgtgatggctcccaaaaacctacttcgtcacaaggaatgcaaatcaaatctctcagagtttgatgatgtgcaaggccatcctggtttcgacaaacaggggaccagatttaaacgtctcataaaggatcagaatgaccactcggaccttgaggagggtatcaggcgtctggttctttgctctggaaaggtttattatgagcttgatgaagagcgtagaaaggtcgaggcaaaggacattgcaatttgtagggttgaacaactatgcccgttcccatatgatctcatccagcgcgagcttaagcgatatccaagtgctgaggttgtttggtgccaggaagaaccaatgaacatgggcgcatacagttacattgcaccacgcctatccactgccatgaaagcattgggcagaggaactatggacgacatcaagtatgctggacgcgggccatctgctgcaacagccactggtttctaccagatgcatgtgaaggaacaggctgaacttctgcaaaaagccatgcaacctgaacctatacaaattcctaattgaagcctttgcatactgtcgaatacaaagtctaagaacaataattaaaaatttatacaccaaagttatgttggcgtcttgataccatttatatctcgccttgtttaggcggctgcttctttttaatccctttcacccaaaaacctctagccaagggaccttggttttttacacgagcgaagttgctcttcgagatgtactgtcttgcattacaagaaggaaatgtttgtcttttattggaacacgatttgcaggaacatgacgttctgttttttttgtttttttttttttttagagctaagatttctattctcgtcttagagctgacgtgttttttttttcctggaatcttattttttgtgatggtttcaggtgctgagattgtttggtgtcaggaagagccaacatttacatggcaccccccgtctttgcacagctatgaaagcaatgtgcataggatcctgggaggatatcaaatacggtggcagggatccatctgcttcccacagccactggctttcttcaggttctcaaagatgagtaggctcagatcgtccagttagccatgcagcctgcaccaatcaagttcccctactgaaccacccgttcaaaaccgcactcggataataatatatgacccattgagaagcataacaatattacacacagcc

SEQ ID NO: 1821 - DNA, 3524 bp, Vinca minor
tcttcttcttattgtataaataaggaaaaaaattctacagcttcactccgattttcgctattatgatccatctagagtttctttgaactctctcaatttctctattattcgggttgtttggagtagaatgattgttattagggcctaaattttgcttgggaaacataaaagcattacaaaatagaaactttagctgagtgcaatggcatggtttagagctgggtctaatgtggcaaagcttgctgttagaagatctctggcacgaggtggaggaggttcatatgtttcaagaacccatgtaatccctttgcaaaaccgatattttcatacaactgtttttaagccgaaagcacaatctgcacccgttcctcgttccgttccactgtctaagttaactgatagtttcttagatggtactagcagtgtttacattgaggagcttcaacgtgcttgggagcaggacccaaatagtgttgatgagtcatgggacaacttcttcaggaactttgttggccaggctgccacatcacctggaatttctggccaaacaattcaagagagcatgcggctgctgttggttgtcagagcataccaggtttatggtcacatgaaagccaagttggatcccttgggtttggagcagagggaaattcctgatgatttggatccggctttttatgggtttagtgaagctgatcttgaccgagaattcttcattggtgtgtggaggatgtctggtttcttgtctgagaatcgtcctgtgcaaacattaagagctatattgacgaggcttgaacaggcttactgcggtaatattggttatgagtacatgcatattgctgaccgtgagaagtgtaattggttgagggacagaattgagacaccaacaccgacagaatacaaccgtgagagacgtgaagttattcttgatcgtcttgtttggagttctcagtttgaaaatttcttggctaccaagtggactgctgccaagagatttggtcttgaaggagctgagaccttgattccgggtatgaaggagatgtttgataggtcggcagatcttggggttgagagcattgttattggaatgtcgcatagagggagactgaatgttctgggtaatgttgtccggaagcccctccgccaaatatttagcgagttcagtggcggtacaaaaccttcagatgaggttggcttatacactggaactggtgatgtcaagtatcacctgggaacttcttatgaccggccaactaggggaggaaagaggatccatttgtcactcgtagcgaatcccagtcacttggaagctgtggacccagttgtcgttggaaaaacaagagcaaagcaatattattctaatgatttggatagaacaaagaatatgggtattttgattcatggagatggaagctttgcaggacaaggtgttgtatacgaaactcttcatcttagtgctcttcctaattacactacaggagggactatacacattgtggtaaataatcaagttgcatttacgaccgatccccagtcaggaagatcttcacagtattgtactgatgttgccaaagccttgaatgttccaattttccatgtcaatggtgatgatgtagaggcagtggttcgtgtctgtgaacttgcagccgaatggcggcagacattccattcagatgttgtggtagacatagtttgttaccgccgatttggtcacaatgagattgatgagccatcttttacccagcccaaaatgtataaggttatccgcaatcatccttcggctcttgagatttaccaaaagaaacttctaggatctgggcaagtgtctaaggaagacgttgataggataagcaagaaggttaatacaattcttaatgaagaatttttggccagcaaagagtatatcccccaacgaagggactggctttcagcttactgggctggattcaaatctcctgaacaactgtcacgtatccgaaatactggtgtgaaaccagaaattctgaagaatgtcggcaaggcaatcaccagtcttccggagaactttaaggctcatagagcagtaaagagggtatatgatgaacgtgcaaagatgattgagacaggggaaggtattgactgggcagtaggggaagctcttgcttttgcaaccttgcttgtagaaggaaaccatgtcaggttgagcggtcaagatgttgaaagaggtacttttagtcatcgacactcagtccttcatgaccaggaaacaggagaaaaatattgtcctctggatcatgtcatgatgaatcagaacgaagaaatgtttactgtgagcaacagctctctttcggagtttggtgttctgggctttgaactaggttactcgatggagaacccgaattccttggtactgtgggaagcccagtttggtgattttgcaaatggagctcaagtcatatttgatcagttcattagcagtggagaggccaaatggctgcgtcagacaggattggttgtgcttctacctcatggctatgatggccagggccctgaacattctagtgcacgtttggaacgtttcctccagatgagcgatgaccacccctatgttatcccagagatggactctactttcagaaaacagattcaagaatgcaattggcaggtggttaatgtaactacacctgctaattatttccatgtccttcgacgtcaaatacatagggaatttcgtaaaccacttattgtaatgtctccaaagaacttactccgtcataaagaatgcaagtcaaatctttctgagtttgatgatgtcgaaggtcaccccggtttcgataagcaagggaccagattcaagcgcctgataaaagaccagaataaccactcagatcttgaggagggcattagtcgtctggttctttgctctggaaaggtttattacgagcttgatgaagagaggagaaaggtggggagaaaagacgttgctatttgtcgagtagaacagctttgtcccttcccatacaacctcatccagcgtgaattaaaccgatatccaaatgccgagatcgtctggtgccaggaagagccaatgaacatgggtgcatacacttacatatcacccagactttcaactgctatgaaagcattaggaaggggtaatattgatgatattaaatacgtcgggcgcggtccatctgctgctactgccactggtttcctttcggttcacgtcaaggagcaaaccgaactcgttcaaaaagctttgcagaaagagcccatcaattaaatttcccacactgaaattaccaaatgagacataacaacatattaagatacttcccaatttttgaataatcattcaagaacttatgaatgccacaattttacccttatacccctctatattgtaagttaataaggattttatgttccttttctggtcttggtatcagcaagggcagattctattgtagcccttatacaaaatttgtagacactgctgatatttcaggctaatatgtgaaaaatgctactaatatttatct

SEQ ID NO: 1822 - DNA, 3460 bp, Sciadopitys verticillata
gatcttttactgaaacccttggtagcgaaataaccctcggactagccgccatgacttggcatagactttcctctagcgtttgcagggcggccctgagagttcgtctctctcagcagagttcttatacaaaaaggtctttatggaacgtcccgcaggccagatcttttcacacaacgagggtttattttcaacaatcagcccccgtgccgcgttctgtgccactgtcgaggctcacagacaattttctggacggcactagcagcgtctatttagaggagctgcagagggcctagggaggccgatcctcagagcgtggacgaatcatgggacaattttttccggaactttgtcggccaggcgtccacctcgtccctggaatttccggccaaacaatccaggagagcatagaggcttttactgctcgttagggcttatcaagtgaacggccacatgaaggcgaagctggatcctttgggtttagaggagagggaaattccgttggatttggacccggcgctttatggtttcagtgaagccgatttggatcgggagttttttctcggtgtgtggaggatgtccgggtttttgtccgagaataggcctgtacaaaccctgaggtcaattctcaataggttggagcaggcttactgtggcacaattgggtatgagtatatgcatattcctgatcgtgataagtgcaactggttgagagagaagattgagactgtggttcccagcaagtatggaccggaaaggaggcatgttatacttgacaggctcatttggagttctcaatttgagaatttcttggcgacaaagtggactgctgcaaaacgtttcggtctggagggggctgagaccttgattccaggtatgaaagagatgtttgatagatctgctgatatgggcgtggagagtattgtgataggtatgtctcatagaggtagattgaatgtactggggaatgtggtgaggaagccattgagacagattttcagtgagtttagtggtggcactaagcctgtggacgaagttggatcttatactggaactggggatgtgaaataccatttgggtacatcgtatgataggcctaccaggggtggaaagaggattcatctttcactggttgctaatcccagtcacttggaagctgtagatcctgttgttgttgggaaaacacgagccaaacagtattattcaaatgatgaggacaggacgaagaacatggccatattgattcatggagatggaagttttgctgggcagggtgtagtgtatgagacattgcatttgagcgctcttccaaattacacaactggagggacaattcacattgtagtcaataatcaggttgcatttacaactgatcccaaggcgggcagatcttcacaatattgtacagatgttgcaaaagctttgaatgctcctatattccatgtaaatggtgatgatgtggaagcggtggtgcatgtatgcgaacttgctgctgagtggcgccagactttccactcggatgttgtggttgatattgtttgctaccggaggtttggacacaatgaaattgatgaaccatccttcacccaacctaaaatgtatcaggtcattagaaatcatccacgagcagttgatgtgtatgagaagcagttaattgagtcagggcagctgtcaaaggaagaaattggtgctttgcacaccaaagtcaattcaattttgaatgaagagtttataaacagcaaagaatatgtgccaaagcgacgagattggcttgcagcatattgggctggctttaagtcaccagagcaattgtcgcgtgtacgcaatacaggggtcaaaccagagatattaaaaaatgttgggaaagcaataactactttaccagaaacattcaagcctcatagggctgtaaagaggatttttgagcaacgagcacaaatgattgaaaaaggggagggtgttgattgggctgttggtgaagcacttgcatttgcaacactcttagtagagggtaatcacgtgaggctgagtggccaggatgtcgaaagaggtactttcagtcaccgacatgcagttcttcatgaccaggaaacaggagaaatatattgccctctggaccatgttatcatgaatcaaaatgaagagatgtttactgtcagcaacagctctctctcagaatttggtgtgctaggatttgaattgggttattcaatggaaaatcccaattcattggtcctgtgggaagctcaatttggtgatttttcaaatggtgcccaagtaatttttgatcaatttttaagctgcggggagtcaaaatggcttcgtcaaactggccttgttgttctgcttcctcatggctatgatggccagggtccagagcattctagtgcaagattagagcgctttctccagatgagtgatgacaatccttttgtgatacctgaaatggatcctacattacgcactcaaattcaacagtgcaattggcaagttgtaaatgtaactactcctgcgaattactttcacgttcttcgtcgccagatacaccgggacttccgtaaaccattgattgttatgtctccaaagaaccttcttcgacacaaggactgcaagtcaaatctgtctgaatttgatgacgtgcaaggccatccaggatttgacaagcagggaacccgatttaagcgtctcattaaggatcagaatgaccactctgatcgagaggaaggcattcagcgtcttttactttgttctggaaagctctactatgaacttgatgaggaaaggcaaagagttgagaggaatgatgttgctatttgtcgagttgaacagctatgcccattcccttatgatctggtccagcgagaactgaagcggtatccaaatgcagagatagtatggtgccaggaagaacctatgaatatgggtgcatatcattatattagtcctcgtcttcatactgccatgaaagcactaggtcgaggtacatttgaagatattaagtatgttggtcgtgctccatcagctgccacagcaacagggtttcatcaggtgcatgtaaaggagcagagagagattgctgagacagcactgcagtcggctccaatcaagtttccttgatgcatatttataagaaaaagagattttaggtttataataatggggatggaaaatgtgcagcattctctcttgcggattcccaagtttcctttttgaagtaatatattctgtaatttgacagcaacatcatctgtttgtatgggttgagtatccatcttgttggaatggggtcgtctatttgttttcttcattcttgtgcctgttttttatccaggtaataaatttgcagaactgatcttagtaacagtacctttggagaactgaagccattgtgtaccggcatgtaatatgcatatagcatgcaaatttttcccagaactattttgtaacacggttctcatcctag

SEQ ID NO: 1823 - DNA, 3534 bp, Papaver somniferum
atctcagtacagaagaaaagaaaaaaataggtccgaaacaacacaaactagggttttcaacaaatcaccgaaatctgatcctctcgggtgctatcaattgtgaaatttgaggtttgattgagtttgaattcagtatggcgtggtttagagcagtatctaatatatcaaaactagcaattaagcgaaatctagcacaagctagatcttcatcacatataagtcgaacacaattaatccgatcacaacaacaacagactcagtatttccattcatcagttattagatcgaaggcagctccatcgagtgcgccggttcctcgtcctgtgcaattatctagattaaccgatagttttctaggtgggactagtagtgtgtacttggaggaattgcaaagagcatgggaagctgatcctaacagtgtagatgaatcatgggataatttctttaggaattttgttggtcaagcgtcgacatcacctggtttatctggtcagaccatacaggagagtatgcgtttgttgttgcttgtgcgagcgtatcaagttaatggtcatatgaaggcgaagttagatccgttagcgttggaggaacgtgaagtaccggatgatttggatcctgcgttgtatgggttcactgaagctgatttagatagagagtttttcctcggggtttggactgtttcggggttttgtctgagaaccgtccggttcagactcttagagcgatattgaacaggcttgaacaagcgtattgtgggagtattgggtttgagtatatgcatattgctgatcgggataagtgtaattggttaagagataaaattgagacacctacacctaggcaatataatttgcagcgtcgtgaagttatgcttgataggcttatgtggagtacacagtttgagaatttcttggctacaaaatggactgctgctaagaggtttgggcttgaaggtggagaaactttgattcctggtatgaaggagatgtttgataggtcagctgatcttggggttgagagcattgttatcggtatgtcacatagaggaagattgaatgttttgggtaatgttgtgaggaaaccacttgcacagattttcagtgagtttagtggaggtataaagcctatcgatgaagttggactgtatacagggactggggatgttaaatatcacttgggtacttcttatgatcgaccaactaggggtggaaaaagacttcatctgtctttggtcgcaaaccctagtcatttggaagctgttgatccacttgtgattggaaagactcgagcaaaacaatactattcgaatgatttagacaggacaaagaatttgggtgtgttgattcatggtgatggtagttttgctggacaaggtgtagtttatgagactctgcatcttagcgcccttcctaattatacaactggtgggactatccacattgtggtgaacaaccaagtggctttcacgactgatccaatgtctgggagatcttcggaatattgtactgatgttgctaaagcgctggatgcccctatctttcacgtaaatgcggatgacttagaggctgttgtttacgtatgtgagctcgcagctgagtggcgacagactttccattctgatgttgttgttgatatagtttgttatcgtcgatttgggcacaatgagattgatgaaccgtctttcactcagcctaaaatgtatcaagtcattcgtaatcatccatcagcactcgagctttaccaaaagaagctcttagaaacagagcagattacagaagaagacgttaaaagaatgcagaataaagtcaacacaatcctcaatgaagaattcattaacagcaaagattatgttcctagaaaaagggactggcttgctgcttattggactggtttcaaatcccctgaacaggtttcacgtgttcgaaacactggggtgaagcctgagattctgaagagcgttggaaaaacaatcacaagtcttccagaaactttcaagcctcaccgagcagtaaaaaagatatttgaacaacgtgcccagatgattgaaactggggaggggattgactgggcagtcggagaagcacttgcatttgctacattgctagtggagggaaatcacgtaaggttgagtggtcaggatgttgaaagaggtaccttcagtcatcggcattcagttattcacgatcaggaaacaggggagaagtactgccctctcgatcatgttaccatgaaccaagacgaggagatgtttacagtcagtaacagctcgctttctgaatttggcgttcttgggtttgaattgggatattcaatggaaaatccaaattcattggttatatgggaagcacagtttggtgatttttcaaatggggcacaggtgatgtttgatcagtttttgagtagtggagagtcaaaatggttacgtcaaactgggcttgtagtgctgcttcctcacggttatgatggtcagggccctgaacattctagtgcaagaatggagcgattccttcagatgagtgatgataatccgtatgtcatacctgaaatggaaccaactcttcggaagcaaatccaggagtgcaactggcaggttgcaaatgtgacaacccctgccaattatttccatcttctgcgccgtcagatacacagggaattcagaaagccgctagttgtcatggcacctaaaaacctgcttcgtcacaaagattgtaagtcgaatctgtctgagtttgatgatgtcaaagggcacccaggttttgacaagcaagggacccgttttaagcgtcttataaaagaccaaaaggaccgttctgaccttgaggagggtgtcaggcgtttggttttgtgctctgggaaggtctattacgagcttgatgaagaaaggaagaaagtcagtggcgatgacgttgcaatctgcagggtggaacagctttgcccattcccttacgatctcatccagcgagagctgaagcgttatccaaatgctgaagttgtttggtgccaagaagagccaatgaacatgggtggatacaactacattgctccacgtctgtgtactgccatgaaggctttaggtagaggaaccatggaggacattaaatatgtcggtcgtggcccatcagctgccaccgccactggtttctactcggttcatacgaaggagcagactgacctagtccacaaggcactccagcctgagccaatcaactatcctttttgaagtaacttttgaaatctatatcctagagataaaggtatgcagaggaaggcacattcaataaactaaatgttattttgtatataccggtttaggttaggatagaggattttatcctaaccctgcaagggagggtggttatgccctgcagatctttcttgttcggttgtaaaatcaaattttgtgtaattttgtttagattactgtgtttgaaaacatatccccccaagtaatagtgcactagccgtgtgctcggggtgtgctgttgcatgaataaatgcattactgtggcagaaattctgaacggataatatttc

SEQ ID NO: 1824 - DNA, 3300 bp, Nicotiana benthamiana
tctaggttgttatcgatgtataatgattgttgttaaggtttgaattaggtcgaggaattattaaaactttccaagagttcattttgatttcagaacttaagttgcagtaatggcgtggtttagagctggttctagtgtggcaaggcttgccattagaagggctctgttgcagggtggttcttacgtcccaagaactcgcattcttccatcacaaggtcgatgttttcacgccacagttgccaggccaaagccacaagctgctcctgtccctagaccagtaccactctctaagttgactgacagtttcttagatggaacgagcagcgtctaccttgaggagcttcagcgagcctgggagcaagacccaaatagtgttgacgagtcatgggataacttctttaggaattttgttggacaagctgccacttcgcctgggatttctggtcagacgatccaagagagtatgcgtcttctgttgcttgtgagagcttatcaggtcaatggtcacatgaaagctaaattggatccattaggtttggaagagagggaaattcctgatgatttggatcccgcattatatgggttcactgaagctgatcttgatagagagttcttccttggtgtttggaggatgtctggattcttgtctgagaatcgtcccgtgcaaactttgagggcaatattaacacggcttgagcaggcttattgcggaagcattggttacgagtacatgcatatttctgatcgtgataaatgtaattggttgagggaacggattgaaaccccaacatctatggagtataatcgtgagcggcgtgaagttattcttgaccgactgatgtggagtacacagtttgagaacttcttggccacaaagtggatggcagccaagagatttgggcttgaaggttgtgagaccttgattcctggcatgaaggagatgtttgatagggcagcagatcttggagttgagagcatagttattgggatgccacatagaggaagattaaatgttttaggtaatgttgttcgaaagccactaaagcagattttcagtgagtttagcggcggcacaaaacctggggatgaagctggttatgtgggaactggtgatgttaagtatcacttgggaacttcttatgatcggcctactaggggtgggaagagaattcatctatctttggttgcaaatccaagccacttggaagctgtggatccggttgttattggaaaaactagagcaaagcaatattacagtaatgacgtggatagaacaaagaacatgggtattttgctccatggtgatggtagttttgcaggacaaggtgttgtctatgagacactgcatctgagtgctcttccaaattactcgactggtgggaccattcacattgtggtaaataatcaagtggcgttcactactgatccaagggctggaagatcatctcagtactgtactgacgtcgcaaaggctttgaatgctccgattttccatgtcaatggtgatgacgttgaggcagttgctcatgtgtgtgaacttgcagctgaatggcgccagaagttccactcagatgttgtggttgatattgtctgttatcgtcgttttggacacaatgaaattgatgaaccgtccttcacccagcctaaaatgtataagatcatcagaaatcatccttcatcattggagatctatcaaaacaaactcttaatatccggtcaggtgacaaaagatgacgtggaaaagatacataacaagattaatagaatccttaatgaagagttcgttgctagtaaagattatgtccctcaaaaaagagattggctttctgccttttgggctgggtttaagtctccttcacagctttcacgtgttcggaacactggtgtcaaacccgagattttgaagaacgttgggaaagcaatcacaacgcttccagatgattttaagcctcacagggcagtgaaaaggatttttgatgatcgccgaaaaatgattgagacaggggagggtgttgactgggcagttggagaagcacttgcttttgcaacattgcttgtggaaggtaatcatgttaggttgagtggtcaggatgttgagagaggaactttcagtcacagacattctgttcttcatgatcaggagacagggtcacagtactgtcctcttgatcatgttatgatgaaccaaaatgaagagatgttcaccgtgagcaacagctccctttcagagtttggtgttctgggatttgaattgggttattcaatggaaaacccaaattcattggtactttgggaagctcaatttggtgatttcgccaatggagctcaggtaatatttgaccagtttgtgagcagtggagaggcgaagtggttgcgccagtctgggttggttgtgcttttgccacatggttatgatggccagggccctgagcattcaagtggacgtttggaacgtttcctccagatgagtgatgacaacccatttgttatcccagagatggaacctacactacgaaagcagattcaggaatgtaattggcaggtggtcaatgtaacaactcctgcaaattatttccatgttttgcggcgtcaaattcacagagatttccgtaagcctctcattgtgatggccccaaagaacttgctccgtcacaaagactgcaagtcaaatctatctgagttcgacgatgtccaaggccacccaggtttcgacaaacaaggtaccaggtttaagcgcctgataaaagatcagaatgaccactcagatcttgaagagggtatcagacggctggtcctttgctcaggaaagatttattatgagcttgatgaggaaagaaagaaagctgatgggaaagatgttgctatctgtcgggtggaacagctttgtcctttcccatatgaccttattcagcgtgaattgaagcgatatccaaatgcagagatagtttggtgccaagaagagccaatgaacatgggtgcattccattacattgcaccacgcctttgtactgccatgaaatcactaggcagaggtaacatggatgacatcaagtatgtcggtcgcgctccttctgctgccacagccactgggttcttccaagttcatgtgaaagagcagtctgagcttgtgcagaaagccgtgcagcgtgatcctgttaactatccgttctcgctccatctgccgccacggccactgggttctaccaagttcatgtgaaagagcaggctgagcttgtgcagaaagctttgcagcgtgatccggttaactatccattctgaagctgaagctgaagcgttcat

SEQ ID NO: 1825 - DNA, 3433 bp, Papaver somniferum
atcaccgaaatctgatcgtctcaggtgtcttatcaattgagaaattttgattgagttttcaatttcattatggcgtggtttagagcggtatctaatatatcaaaactagcaattaagcgtaatctagcacaagctagatcttcatcatacataagtcgaacacaattaatccgatcacaacaacaacaatctcaatatttccattcatcagttattagatcgaaggcagctccatcgagtgcgccggttcctcgtcctgtaccattatctagattaactgatagttttctaaatgggactagtagtgtgtacttggaggaattgcaaagagcatgggaagctgatcctaacagtgtagatgaatcatgggataatttctttaggaattttgttggtcaagcgtctacatctcctggtttgtctggtcaaactattcaggagagtatgcgtttgttgttacttgtgcgagcatatcaagttaatgggcatatgaaagcgaaattagatccgttagcgttggaggagcgtgaagttcctgatgatttggatcctgcattgtatgggtttactgaagctgatttagatagagagttttttctcggggtttggactgtttcagggtttctgtctgagaatcgtcctgttcaaactcttagagcgatattgaataggcttgagcaagcgtattgtgggagtattgggtttgagtatatgcatattgctgatcgggataagtgtaattggttgagggataaaattgagacacctacacctaggcagtataatttgcagcgtcgtgaagttatgcttgatagacttatgtggagtacacagtttgagaatttcttggctacgaaatggactgctgcgaagaggtttgggcttgaaggtggagaaactttgattccgggtatgaaggagatgtttgataggtcggctgatcttggggttgagagcattgttatcggtatgtcacatagaggaagattgaatgttttgggtaatgttgtgaggaaaccacttgcacagattttcagtgagtttagtggaggtataaagcctatcgatgaagttggactgtacacagggactggggatgttaagtatcacttgggtacttcttatgatcgaccaactaggggtggaaaaagacttcatctgtctttggtcgcaaaccctagtcatttggaagctgttgatccacttgtgattggaaagactcgagcaaaacaatactattcaaatgatttggacaggacaaagaatttgggtgtgttgattcatggtgatggtagtttcgctggacaaggtgtagtttatgagactttgcatcttagcgcccttccaaattatacgactggtgggactatccacattgtggtgaataaccaagtggctttcacgactgatccaatgtctgggagatcttccgaatattgtactgatgttgctaaagcgttggatgcccctatctttcatgtaaatggtgatgacttggaggctgttgtttatgtatgtgagctcgcagctgagtggagacagactttccattctgatgttgttgttgatatagtttgttatcgtcgatttgggcacaatgagattgatgaaccgtctttcacacagcctaaaatgtatcaagtcatccgtaatcatccatcagcgctcgagctttaccaaaagaagcttttagaaacagagcaaattacagaagaagacatcaaaagaatgcagaataaagttaacacaatcctcaatgaagagtttgttaacagcaaagattatgttcctaaaaaaagggactggcttgctgcttattggactggtttcaaatcccctgaacaggtttcacgtgttcgaaacacgggggtgaagcctaagattctgaagagcgttggaaaagcgatcacaagtcttccagaaactttcaagcctcaccgagcagtaaagaagatatttgaacaacgtgcccagatgattgaaactggggaggggattgactgggcagtcggagaagcacttgcatttgctacattgctagtggagggaaatcacgtaaggttgagtggtcaggatgttgaaagaggtacctttagtcatcggcattcagttattcacgatcaggcaacaggggagaagtactgccctctcgatcatgttaccatgaaccaagatgaggagatgtttacagtcagtaacagctcgctttctgagtttggcgttcttgggttcgaattgggatactcaatggaaaatccaaattcattggttatatgggaagcacagtttggtgatttttcaaatggggcgcaggtgatgtttgatcagtttttgagtagtggagagtcaaaatggttacgtcaaactgggcttgtagtgttgcttcctcacggttatgatggtcagggccctgaacattctagtgcaagaatggagcgattccttcagatgagtgatgataatccctatgtcatacctgaaatggacccaactcttcggaagcaaatccaggagtgcaactggcaggttgcaaatgtaacaacccctgctaattatttccatctcctgcggcgtcagatacacagggaattccgaaagccactagttgtcatggcacctaaaaacctgcttcgtcacaaagattgtaagtcaaatctatctgagtttgatgatgtcaaagggcacccaggttttgacaagcaagggacccgtttcaagcgtcttataaaagaccagaaggaccgttctgaccttgaggagggtgtcaggcgtttggttttgtgttctgggaaggtctattacgagcttgatgaagaacggaagaaagtcagtggtgatgacgttgcaatctgcagggtggagcagctttgcccattcccttacgaccttatccagcgagaactgaagcgttatccaaatgctgaagttgtttggtgccaagaagagccaatgaacatgggtggatacaactacattgctccacgtctgtgtactgccatgaaggctttaggtagaggaaccatggaggacattaaatatgtcggtcgtggcccatcagctgccaccgccactggtttctactcggtccatacaaaggagcagactgacctagtccacaaggcactccagcctgagccaatcaactatcctttttgaagtaacttttgaaatctaaatcctagagagtaggtatgcagaggaaggcacatttaataaactaaatgttattttgtatatttcggtttaggttaggatagaggattttatcctaacccttcaagggagggtggtgatgccctgcagatgtttcatgtctgtgttacctttcttgttcgattgtaaatctaaattttgtgtaattttgttccgcttactttgtttgaaaacatattcccccaagtaatagtgcaactagccgtgtgcctcgggggtg

SEQ ID NO: 1826 - DNA, 3598 bp, Silene vulgaris
cgtctcttgggcctccttttctatctccccatttccccttcataaagcgcacgacaaatttcaccaaaacccttaaaaattaatcgcaaaaatggaagattctaagttgtagatctcgcaaatcaacatctatcatcgatttcatacgcaagaaatttcaattcaggttagacgtttcgagtagttgaatttgtgatctgtagctatggtttggtttagagctggatcgaggttggctaatctcgctgttaggagaacattatcgcaaggacgaacttatgtgacccgaacacagctcattgatactcagaggcgtgcttttcatagcacgccatttaaaagtgctgcgcctgttcctagggctgtccccttgtctaagcttacagatagttttctggatgggacgagtagtgtttacttagaggctctacagagggattgggaagctgatcctagtagtgtcgatgagtcctgggataatttcttcaggaactttgttggccaagcggcaacttctcctgggatttctggacagactattcaagagagtatgcgtttgttactgcttgtgagggcttaccaagttaatggtcattttaaggctaaactagatcctttgggtcttgagcataggccagttcccgatgatttaaatctagatatgtatggcttcagtgaagctgaccttgatcgggagttttttctaggagtgtggaggatggctggatttttgtcggagaatcgtcctgttcaaacccttagaagtatccttactcgtcttgagcaggcttattgtgggaggattgggtatgagtacatgcatatttctgatcgggagaagtgtaattggttgcgagaaagaattgagactgctactcctacggaatataacaaggaaaggcgacaagtgatgctggacagacttatatggagcacccagtttgaaagtttcttggctactaagtggactactgctaaaaggtttggtcttgagggttgcgagaccctaattcctggcatgaaggagatgtttgacaggtcagctgatctaggggtcgaaaatatagtcattgggatgtctcataggggtaggttaaatgtgctgggtaatgttgtacgtaaaccacttcgacagatattcagtgagtttagtggtggcacaaaacctacagatgaagttggactttacactggaactggagatgtcaaatatcatttaggtacgtcttatgacagacctactagaggtggaaagcggattcatctttcactggttgcaaatccaagtcacttggaagctgtgaatcctgtcgtgcttggaaaaactagagcaaaacagtactattctagtgatgacgacaggacaaagaacctgggtattttgattcatggcgatggtagctttgctggacaaggtgtagtttatgagacattccatctcagtgctcttccaaattacactacgggaggcactattcacattgtggtgaacaatcaagtggctttcacaactgatccaagctcaggaagatcttcccagtactgtactgatgttgctaaagctctagatgtccctattttccatgttaacggggatgatttggaggcggttgttcatgtttgtgagctcgcagcagagtggcgccagacattccattcagatgttgtgattgacatagtctgctatcgtcggttcggtcacaatgagattgatgagccatctttcacacaaccaaagatgtataaggtcatccgtaaccatccttcggctctagaaatttacaaaaagaaagttcttgaagccggagaattgtcgaaggacgaagttgatgtgatccagaaaaaggtgatgacaatcctcaacgaggagtttgaagctagtaaggatcatgtcacaagtaagagggactggctttcagcttactggctaggattcaagtctcctgagcaactttctagaatccgtaacactggggtaaaaccagagatcttgacaaatgttggcaaggcaattaccaccattcccgagactttcaagccacacaaagcagttaaaaggatatatgaccaacgtgcacaaatgattgaaacaggggaaggcattgattgggctgttggagaagcactggcatttgctacattattagtggaaggaaatcacgttaggttgagtggtcaagatgtggaaagaggtacattcagtcataggcattctgtaatccatgaccaagaaactggagaacagtattgtccactggaccatgttatgataaaccaaaatgaggaattgtttacagtcagtaacagctctctctccgagtttggggttcttggatttgaattgggatattctatggagaaccctaattccctggttatctgggaggctcagtttggagacttctctaatggagcgcaagtgatttttgatcagttcttgagcagtggagaggcaaaatggttgcgccaaactggtctgacggtgctacttcctcatggatatgatggtcagggacctgaacattcaagtgcaagattggaacgattccttcagatgagtgatgacaatccctacgtcatacctgatatggattcaacacttaggaagcagatccaagaatgtaactggcaagttgtgaatgtgacaacgccagctaattatttccacgtcttgcgtcgtcagttacacagggaattccgcaagcctctaattgttatggctcccaagaatttgcttcgacacaaagaatgcaagtcaaatttgtccgagtttgatgatgttgaaggccatccagggtttgataagcaaggaacaagattcaaacgtctaattaaagaccagaatatgcactcagatcgtgaggagggtattagacgtctggttctgtgctctgggaaagtttactatgagcttgacgatgaaaggagaaaggtgaatggcagtgatgtagctatctgtagagttgagcagctttgtccattcccttacaaccttatacagcgagagttgaaccgatatccgaatgccgagatagtttggtgccaggaggagccgatgaacatgggtgcctacagttacatcgcacctcgtttgtgcacagcaatgaaatctgtaggtcgtggaaatatcgatgacattaaatatgtgggccgtcctccatcagctgccactgccaccggctttcttatggtccatggtaaagagcagactgagctcgttcacaaggctttgcagcctcaacctatccaatttccttgaggactttatcgtatcaacctgaccaattttgagcttttctatagagttgtgtttgactgctgccactttcccttattttctgggtttggcacatcgtaaaaggctggaatcaagtctagttttggtcgacgtaaacatttttccgctacgttaacaataatgaacggcagaattgactcattattgagaccttcataaaccccttgtcgtagctcctgtacgtgcaaaggccaccgaaatatctatttcctgatattctcaggtgaaactttatcataagttctcatgtgagtttgtatggagtactaagataggttgaaatgctgaaaaccgcatctc

SEQ ID NO: 1827 - DNA, 3469 bp, Solanum phureja
ggcttcgtccactctctacaaagtcattatattcgctccgctcaacccataaacctctcaactcctcaaggttatttctcaaggtataatgattgtgtgttgaagttttgttcgttgaaggtttattgatacttttgaagacttttaaattcgatttgagggcttgatttacagcaatggcatggtttagagctgggtctagtgtggcaaagctcgccattagaagggctgtgtctcagggtggttcttatgtgccaagaactcgcattattccatcacaaagtagatattttcataccacagttgtcaggccaaaagcgcaagctgcaccagtcccgaggcctgtaccactttctaagttgactgatagcttcttagatggcactagcagtgtctaccttgaagagcttcagcgtgcttgggagcaagatccaagtagtgtagatgaatcttgggacaactttttcaggaattttactggcctagctgccacatcacctgggatttctggccaaacaattcaagaaagcatgaatcttctgttgcttgtgagagcttatcaggttaatggtcatttaaaagccaaattggacccattggatttggaggagagggatatccccgatgttttggatccagtatcatatgggttcactgaagctgatctggaccgagagttcttccttggtgtttggaggatggctggtttcttgtctgagaatcgccccgtgcaaaccttgagggcgattttgacaagacttgagcaggcttattgtggcagcattggttttgagtacatgcacatttctgatcatgataaatgtaattggttgagagaacgaattgaaactcctacaccgagggagtacaaccgcgaacgacgtgaagttattcttgaccggttgatgtggagtactcagtttgagaacttcttagccaccaagtgggtggcagccaagagatttgggcttgaaggttgtgagactttgattcctggcatgaaggagatgtttgacagatcagcagatctgggagttgagagcatagtaattgggatgccacatagaggtagattaaatgttttaggtaatgttgttcgaaagccactaaggcaaatttttagtgaattcaccggtggtacaaaacctgcggatggagctggttatgtgggaactggtgatgtcaagtatcacttgggaacttcttatgatcgccctactaggggtggtaagagaattcatctatcattagttgcaaatccaagtcacttggaagctgtggacccagttgttattggaaaaactagagcaaagcaatattattctaatgatgtggatagaacaaagaatatgggtattttgctccatggtgatggtagctttgctggacaaggtgttgtttatgagacattgcatttaagtgctcttccaaattacacaactggtggaaccattcacattgtagtgaataatcaagtggcctttacgactgatccgaaggctggaagatcttctcaatactgcactgatgttgccaaggctttgagtgctccaattttccatgtcaatggcgatgatgtcgagggcgttgttcatgcctgtgaacttgctgcagaatggcgccagacattccactcagatgttgtggttgatattgtctgttatcgtcgatttggtcacaatgagattgatgaaccatccttcacccagcccaagatgtatcaggtcatcagaaatcatccttcttcattggagatctatcaaaacaaactcctacaatatggtcaggtgacaaaagatgatgtggaaaaaatacataacaagatcaatacaatccttaatgaggagtttgttgctagtaaagactatgtccctcaaaaaagagattggctttcagccttttggtctggatttaagtcacctgcacagctttcacgtgttcgaaacactggtgtcaaacctgagatcttgaaggatgtcgggaaagcaatcacctcccttccagatgattttaaggctcacagagcagtaaaaaggatttttgatgaccgtaagaaaatgattgagacaggggagggcgtggactgggcagtgggagaagctcttgcttttgcaacattgcttgtggaaggaaatcatgttaggttgagtggtcaggatgttgagagaggtactttcagtcacagacattctgttattcatgatcaggagacaggggcaaagtactgtcctcttgatcatgttatgatgaaccaaaatgaagagatgttcaccgtgagtaacagttctctttcagagtttggtgttcttggatttgaactgggttattccatggaaaatccaaattctttggttctttgggaagcccaatttggtgatttcgccaacggggctcaagtaatatttgaccagttcttgagcagtggagaggccaagtggttgcgccagagtgggttggttgtgcttctaccgcatggttatgatggccagggccctgagcattccagtgcacgtttggaacgtttcctccagatgagtgatgataacccctatgtcattccggacatggaacctacattaaggaaacagattcaggaatgtaactggcaggtggtgaatgtgacaactcctgcaaattatttccatgttctcaggcgtcagattcacagagatttccgtaaacctctcattgtaatgtccccaaagaacttgcttcgtcacaaggactgcaagtcaaacctatctgagtttgatgatgtccaaggccaccctggttttgacaaacaaggtaccaggtttaagcgcttaataaaagatcagaacgaccactcagatcttgaagagggtatccgacgcctggtcctttgctccggaaaggtctactatgagcttgatgaggagagaaagaaagttgaagggaaagacgttgcaatctgtcgggtggaacaactttgtcctttcccatatgacctcgttcaacgtgaactgaagcgatatccaaatgcggagattgtttggtgccaagaagagccaatgaacatgggtgcataccagtacattgcaccacgtctttctactgcgatgaaagcactggacagaggtaacatagatgacataaaatatgccggccgtggtccttctgctgccacagctactggtttctaccaggttcacgtgaaagaacagaccgggcttgtccagaaagccttgcaacaggatccaattaattctccagtctgaagctgaggctctgttgtattctttgcacaaagtaccaagattgatgctgaaataaatctttcaactccacagtattttgagggtggaagttttgattctttggggaacagggaaatattatttgtcctcctttttttaacttagaattgtacaaataaaatgtcaaaaacaagtctctgttcctcccttttttattcttccaagagaatgaagttcatgattggtttcgg

SEQ ID NO: 1828 - DNA, 3101 bp, Valeriana officinalis
agaattttaggatacgttacatttatagtttgtagcaatggtgtggtttagagctggatctagtgcagcaaagcttgcaattaggaaaactgtatcacaaggaggatcttatattgcacgaacacgagaaatttcatcacgaggtcgatattttcattcaacaattctcaaatcaaaggctcaagcgacacctgtccctcggccagttccactctctaggttaacagatagctttttagatggaacaagcagtgtctacttagaggaactccaaagagcttgggaagctgatcctaacagcgttgatgaatcatgggataatttcttcagaaattttgttggtcaagcgtcttccacttcgccgggtgtttctggtcaaacgattcaagagagcatgcgtttgttgctcctggtgagatcttaccaagtcaacggccatatgaaagcgaaattggaccctttagggttggaaaagagacaggttcctgatgatttagatccatctttatatggattcaccgaagcagatcttgatcgcgagttcttcgtcggggtatggaagatggccggtttttatctgagaaccgacctgtccaaacacttcggtcaattctaacgcggctggaacaggcttattgtggctctattggtttcgaatacatgcatatcgctgaccgtgaaaaatgcaattggctgagagacaggattgaaactccaactccaatgaaatacaataaacaaaggcgtgaagttatgctggatagacttatatggagcacgcaatttgaaaatttcttggcaactaagtggactgcagcaaagagatttgggctcgaaggtggtgagactttgattccaggcatgaaggagatgtttgacaggtcagcagatcttggtgttgagggaatcgtaatcggaatgtctcatagaggaagattgaatgttctgggaaatgttgttagaaaaccactaaggcaaatctttagtgaatttagtggtggaacaaagccagttgatgaagttggtctgtatactggaaccggtgatgtgaaatatcacttgggtacttcatatgatcgtccaactagaggtggaaaacagttacatttatctttagtagcgaatccaagtcatttggaagcagttgatccggttgtagttggaaaaactaggggtaaacaatattactcaaatgattttgatagaaccaagaatatggggattttgattcacggggacggtagttttgctggccaaggtgtagtttatgaaaccctacatcttagtggtcttccgaactatactactggtgggactatacacattgtggtgaataatcaagtggctttcacaactgatccgaaatccggaagatcttcgcaatattgtactgatgttgctaaagcgttgagcgctcctattttcatgtgaatggtgatgatattgaggctgtagttcacgtttgtgaacttgcagctgagtggagacagacatttcattctgatgttgttgttgatatagtttgttatcgacgatttgggcataatgagattgatgagccctcttttactcagcccaaaatgtacaaggtaatcaggaatcacccttctgcattggagatatataaaacgaaacttctcgaatctggtcaggtgaaaaaagaggacattgataggatagagaacaaagtgaacacaattttaaatgaagaatttatggctagcaaagattatgttccgaaacgaagagactggctttcagcttactggtctggtttcaaatcccctgaacagctttcacgtataaaaaacacaggggttaagcctgagattttgaagaacgtgggcaaagcaatcacaagcattccagagaatttcaagcctcacagagctgtaaagaagatattttctgatcgtgcaaagatgatcgaaacaggggaggggattgattgggctgtaggggaagcacttgctttcgcaactttgcttgttgaaggaaatcatgttagattgagcggtcaagatgttgagcgaggaacttttagtcatagacatgctgttcttcatgatcaagaaacaggcgaacgttactgtcctctagaccatgtcaagtctaaccagaatgaagagatgttcaccgtaagcaacagctctctttctgaatttggtgtgctgggattcgagctgggttactcgatggaaaaccctaattctttggtattgtgggaagcgcaatttggcgattttgctaatggagctcaagttatatttgatcagttcttgagcagcggcgaggcgaagtggttgaggcaaactggcttagttgtgttattacctcatggttatgacggtcaaggccctgaacattcaagtgctcgactcgaacgcttcctccagatgagcgatgataatccatatgttattccagagatggatccaacattaaggaagcaaattcaagaatgcaattggcaggttgtaaatgttacaactcctgctaactatttccacgtactgcgacgtcagatacacagggaattccgtaaacctctcgtagtgatgtcaccaaagaacttgcttcgtcataaagagtgtaaatcaaacttatcagagttcgatgacgaacaaggccacgctggttttgacaagcaaggcacccgttttaaacgccttattaaggaccaaataaccattctgatctggaggagggtattcgtcgtcttgttctttgctcaggaaggtttattacgagcttgatgaagaaagaaagaaagccggggctaaggacgttgctatatggcgggtggaacagctttgtccattcccctatgatctcgtccagcgtgagctgaagcgttacccaacgccgagatagtgtggtgtcaggaagaaccgatgaacatgggggcatacaattacataaccccacgtctctgctcggccatgaaatcggtgaacagaggcagtattgatgacatcaactacgtgggccgtgcaccgtctgctgcaacagcaaccggtttttatcagattcacgttaaagaacagaccgaccttgtccagaaagccctgcagcctgaaccgatcaactatccttaattg

SEQ ID NO: 1829 - DNA, 3515 bp, Valeriana officinalis
tttttgcttcgccattggaggcgactctctctcctttttcgagcttttcctcttctcgatctatggatcttcgctgttagggtttgaacttgaccttgaagactagccgtttagcaatctttacataacgatttcacttttttcgcaatgacgtggtttagagctggatctagtatagcaaaacttgctattcgaagaactctttctgagagcaaatcatatgtatcaagagctcgcattattccaccacatagtcgcaacattcacacatcagttttcaaatcaaaggcacaagctgcaccggttcctcgaccggtcccactctctaaactaactgatagcttcttagatggcacaagcagtgtctacctcgaagagcttcagagggcttgggaagcggaccccaacagtgtagacgaatcatgggacaatttcttcaaaaactttgtgggccaggccgccacgtcaccaggaatatcaggccaaacaattcaagaaagtatgaggcttttgttacttctcagagcttatcaagttaacggtcatatgaaagcgaagttggatccattgggtttggaagaaagagagattccaagtgatttggatccagctatttatgggttcactgaagctgatcttgaccgtgaatttttcctcggtgtgtggaacatggctgggtttttgtctgagaatcgtcctgtacaaacccttagagctatattgactaggcttgagcaagcttattgtggaagcataggttatgagtatatgcacatagcagaaagagaaaaatgcaattggttgagggataggatcgaaaccccgactcctatgcagtataatcggcaaagacgtgaggttattctcgatagacttatatggagtactcaatttgagaattttttagctaccaaatggacagctgcgaaaagattcggtcttgaaggtggagagaccttgattccaggtatgaaggagatgtttgaccggtcagctgatctcggggttgaaagcattgtgattggaatgtctcatagaggaagactaaatgtgctgggaaacgttgtcagaaaaccactgcgtcagatttttagcgaatttagcggtggaataaagcccattgatgaagttgggctttacacagggactggtgatgtgaaatatcacttgggtacttcttatgatcgcccgactagaggcggcaaaagaattcacttgtctttagtggcgaatccaagtcatttggaagctgtggaccccgttgtggttgggaaaactagggcaaaacaatactattcgaatgatcttgataggacgaagaatatggggattttgattcacggtgatggtagttttgcagggcaaggtgttgtttatgagactttgcatttaagtggtttgccaaattacactactggtgggactatacatattgtggtgaataatcaagtggcgtttacaactgacccaatggcggggagatcttcacagtattgtactgatgtagctaaagctttgaatgctcctattttccatgttaatggtgatgacatggaggctgtcgctcatgtttgtgagcttgctgcagaatggcgtcagactttccattccgatgttgttgttgatatagtttgctaccgcagattcgggcataatgaaattgatgagccgtcttttacccagcccaaaatgtacaaggtaatccggaatcatccctcagctcttgaaatatacgaaaagaaactgctagaatctggtcaggtgacaaaagaagatgttgacaagatacagaacaaggtgaatacgatccttaatgacgagtttcttgccagcaaagattatgtcccaaaaagaagggactggctttcagcttactggactgggtttaagtctcctgaacagctttcacgtatccgcaatactggggtgaagccagagattttgaagactgtgggtaaagcaatcacaacacttccagagactttcaagcctcacagagcagtgaagaaaatattttcagaacgtgcaaaaatgatagaaacaggagaaggaatcgactgggctgtaggcgaggctcttgcttttgcaacattacttattgaaggaaatcacgttagactaagtggtcaagatgttgaacgaggtacttttagtcatcgccactctgtactccacgatcaagaaagcggtgagaaatactgtccgttggatcatgttataacaaaccaaaacgaagagctctttactgtgagcaacagttctctttcggagtttggagttctcggatttgaattgggttactcgatggaaaaccccaattcgttggtgttgtgggaagcccaattcggtgattttgctaatggggcccatgttattttcgatcagtttataagcagcggcgaggctaagtggttgcgtcagtctggtttagttgtgttgctacctcatggctatgatggacaaggtcctgaacattcaagcgctcgtttggagcgtttccttcagatgagtgatgataatccctacgttataccagaaatggatggtacacttcgaaagcaaatccaggattgcaattggcaggttgtaaacgtcactactcctgcaaattatttccacgttcttcgtcgtcaaataaacagggagttccgtaagcctttaatagtgatggcaccaaagaatttactgcgtcacaaagagtgcaagtcaaatctatcggagtttgatgatgttcaaggccatcctggttttgataaacaaggaaccagatttaagcgcctcataaaagatcagaatgatcactccaacctcgaggagggtatcagacgcttgattctttgctctggaaaggtgtattatgagttggacgaggagagaaagaaagtgggtggaaaagacgttgctatttgtcgggtggaacaactatgtcctttcccgtatgaccttgtacaacgtgaactcaaacgttatccaaatgcagagattgtgtggtgccaagaagagccgatgaacatgggtgcatacacatacattgctccacgtctttgcacagcaatgaaggcagtagaaagaggctcatcagatgatatcaagtacatcgggcgggccccatcagcagcttcagcaactggattctatggggtccatgtcaaagagcagagcgacattgttcacaaagcaatgcaagccgaaccaattaactatcccaggtaaaaaatcgttttttcccacctatacttttttcatacaaaacaactcgaattttatcatgtgctcttttcttcgcataagttggcctgctggatgttttttaacggccaaatgacgttttgtaataatgaaattatgctaaaactgtgttggtcggtgagatgagatacttactgacagagaggtgatttttggtattgagttttggtcttgtttgcaatacatagattttccggtactccaattatagcaacacctttggtgttgagcgagttgcatatatttatagtgttacttttgatctg

SEQ ID NO: 1830 - DNA, 3342 bp, Mimulus guttatus
cggtcgctccaatctcttcttcttcatcatttttctttcacttcagagcaatggcctggttcatggctgggtccaacgtggcaaagcttgctgttaggagaaatttattgcaaaattgttcgtacgttacacggacgagaatcgctccctcacagaatcgctatttccagaccacagtttttagatcgaaggcacaatctgcacctgtacctcgtgccgttccactttccagattgactgataacttcttggatggaaccagcagtgtttacatcgaagagctccagagagcgtgggagcaggatcctaacagtgtggatgaatcatgggataatttcttcagaaacttcgttggtcaggctgccacctcacccggaatttcggggcaaacaattcaggaaagtatgcgtctgttgttgctcgtgagagcttaccaggtgtacggtcacttgaaggccaagttggatccgttaaatttggaagagaggactatacccgatgatcttgatcctggcctttacgggttttcagaagctgatcttgatagagaattcttcgttggtgtatggagaattcacgggttcttgtccgagaatcgtccggtgcaaacattgagggcgatattgaaaagactcgaacaggcttattgtgggaatattgggtacgagtacatgcatatcgctgaccgtgagaagtgtaactggttgagggacaaaatcgagactccgacgccaactcagtacagtccacagcggcgtgaggtgattcttgatcggcttatttggagtactcagttcgagaattttttggcggcgaaatggactgcagcaaagaggtttgggcttgaaggttgtgagacgttaattcctggtatgaaggagatgtttgacaggtcagcagatcttggggtaaagaatatagtgatcggaatgtctcatagaggaagactgaatgttcttggtaacgttgtccggaaacctctcaggcagatttttagtgaatttagtggcggcacaaaacctgtggatgaggttgggctttacactggaactggtgatgttaaatatcatttgggaacttcttatgaccggccgacaagagggggtaagagaattcatttgtcgttggttgcaaatcctagccacttggaagctgtggaccccgttgtgattgggaaaactcgagccaaacagtactactctaatgatgtcgatagaacaaagaatatgggtattttgattcatggtgatggcagtttcgctgggcaaggcgttgtgtatgagacgttgcatcttagtgctcttccaaactacactactggtggcactattcacattgtggtgaacaatcaagtcgcgtttactactgacccaagatcgggtagatcttctcagtactgtacagatgttgcgaaagcgctgagtgctccgattttccatgttaatggtgatgatgtggaagcggttgttcatgtctgtgagcttgcagctgagtggcgtcagacattccatacggatgttgtggttgatatcgtgtgctatcgtcgattcggacacaatgaaattgatgagccgtcgttcactcaacctaagatgtataaggttatcaggaaccatccttcggcgcttcagatttaccaaaacaaacttctggaatccggtcaggttacaaaagagggcattgatcagataaacagcaaagtcctttcaattctcaatgaagaatttctggccagcaaagattacgtgcctcaaagaagggactggctttcagcttactggtctggtttcaaatctcctgaacagctttcacgtattcgtaacactggagtcaagccggagatcttaaaaaatgttggcaaggctatcacagttctgccagaaaattttaaaccacatagagcagtgaagaggatttttgaggatcgtgcaaagatgattgagacaggtgagggcattgactgggcggtgggagaagcactcgcttttgcaaccttgctggtagaaggaaatcatgtacggttgagtgggcaggatgtcgagagaggtactttcagtcatagacattctgttattcatgaccaggaaacaggggaacaatactgccccttggatcatgttatgatgaaccaaaacgaggagatgttcacagtgagtaatagctcgctttcagagtttggagttttgggctttgaattaggttactcgatggaaaaccccaattctcttgtactctgggaagcccaatttggcgatttcgccaatggagctcaggtgatatttgaccaatttctaagcagtggggaggcaaaatggttgcgtcaaactggtttggtggtccttctacctcatggatatgacggtcaaggccctgagcactcaagtgctcgtatggaacgttttcttcagatgaatgatgataacccctatgttattcctgagatggaccccaccctcaggacacagattcaagaatgcaattggcaggtggtgaatgtcacgacccctgcaaattatttccacgttttgcggcgccaaatacatagggaattccgtaagcctctcatagtgatgtcaccaaagaatctgcttcgtcacaaggaatgcaaatcgaatctgtcggagtttgacgatgttcaaggccaccaaggttttgacaaacaaggaacgagattcaaacgcctcattaaggatcaaaatgctcactcagatcttgaagagggtattagacgtttggttctttgctcaggaaaggtttattacgagcttgacgaagagaggaaaaaagtcaacggaaacgacgttgcaatctgtaggattgagcagctctctcccttcccttacgatctcatccagcgtgaactgaagagatatccaaatgcagagatagtgtggtgtcaagaagaaccgatgaacatgggtgcatacaactacatttcagttcgactgggaactgcaatgaaggcactcggtagaggaacatttgacgacatcaagtatgccggtcgtgctccttctgccgccacagctactggcttttaccaagttcacggcaaagagcaaaccgaacttgtccagaaagctttgcagcctgatccaatcagttaagaaacaaaaaatcgatatttttaggttttttttatgagaataaaaagtacatagttcacgaacacgatgatggtgtgaaataatttcgagtctaactcgatgatcccgaaatacgagaatattattgatatttgctttgtatgagttagttgtttgagtttattaggttaaaaacccgattttatgtctggtcatactcgtttcgatccaattttcaacacttcgtttagatttt

SEQ ID NO: 1831 - DNA, 3676 bp, Mimulus guttatus
cggtcgctccaatctcttcttcttcatcatttttctttcacttcagagcaatggcctggttcatggctgggtccaacgtggcaaagcttgctgttaggagaaatttattgcaaaattgttcgtacgttacacggacgagaatcgctccctcacagaatcgctatttccagaccacagtttttagatcgaaggcacaatctgcacctgtacctcgtgccgttccactttccagattgactgataacttcttggatggaaccagcagtgtttacatcgaagagctccagagagcgtgggagcaggatcctaacagtgtggatgaatcatgggataatttcttcagaaacttcgttggtcaggctgccacctcacccggaatttcggggcaaacaattcaggaaagtatgcgtctgttgttgctcgtgagagcttaccaggtgtacggtcacttgaaggccaagttggatccgttaaatttggaagagaggactatacccgatgatcttgatcctggcctttacgggttttcagaagctgatcttgatagagaattcttcgttggtgtatggagaattcacgggttcttgtccgagaatcgtccggtgcaaacattgagggcgatattgaaaagactcgaacaggcttattgtgggaatattgggtacgagtacatgcatatcgctgaccgtgagaagtgtaactggttgagggacaaaatcgagactccgacgccaactcagtacagtccacagcggcgtgaggtgattcttgatcggcttatttggagtactcagttcgagaattttttggcggcgaaatggactgcagcaaagaggtttgggcttgaaggttgtgagacgttaattcctggtatgaaggagatgtttgacaggtcagcagatcttggggtaaagaatatagtgatcggaatgtctcatagaggaagactgaatgttcttggtaacgttgtccggaaacctctcaggcagatttttagtgaatttagtggcggcacaaaacctgtggatgaggttgggctttacactggaactggtgatgttaaatatcatttgggaacttcttatgaccggccgacaagagggggtaagagaattcatttgtcgttggttgcaaatcctagccacttggaagctgtggaccccgttgtgattgggaaaactcgagccaaacagtactactctaatgatgtcgatagaacaaagaatatgggtattttgattcatggtgatggcagtttcgctgggcaaggcgttgtgtatgagacgttgcatcttagtgctcttccaaactacactactggtggcactattcacattgtggtgaacaatcaagtcgcgtttactactgacccaagatcgggtagatcttctcagtactgtacagatgttgcgaaagcgctgagtgctccgattttccatgttaatggtgatgatgtggaagcggttgttcatgtctgtgagcttgcagctgagtggcgtcagacattccatacggatgttgtggttgatatcgtgtgctatcgtcgattcggacacaatgaaattgatgagccgtcgttcactcaacctaagatgtataaggttatcaggaaccatccttcggcgcttcagatttaccaaaacaaacttctggaatccggtcaggttacaaaagagggcattgatcagataaacagcaaagtcctttcaattctcaatgaagaatttctggccagcaaagattacgtgcctcaaagaagggactggctttcagcttactggtctggtttcaaatctcctgaacagctttcacgtattcgtaacactggagtcaagccggagatcttaaaaaatgttggcaaggctatcacagttctgccagaaaattttaaaccacatagagcagtgaagaggatttttgaggatcgtgcaaagatgattgagacaggtgagggcattgactgggcggtgggagaagcactcgcttttgcaaccttgctggtagaaggaaatcatgtacggttgagtgggcaggatgtcgagagaggtactttcagtcatagacattctgttattcatgaccaggaaacaggggaacaatactgccccttggatcatgttatgatgaaccaaaacgaggagatgttcacagtgagtaatagctcgctttcagagtttggagttttgggctttgaattaggttactcgatggaaaaccccaattctcttgtactctgggaagcccaatttggcgatttcgccaatggagctcaggtgatatttgaccaatttctaagcagtggggaggcaaaatggttgcgtcaaactggtttggtggtccttctacctcatggatatgacggtcaaggccctgagcactcaagtgctcgtatggaacgttttcttcagatgaatgatgataacccctatgttattcctgagatggaccccaccctcaggacacagattcaagaatgcaattggcaggtggtgaatgtcacgacccctgcaaattatttccacgttttgcggcgccaaatacatagggaattccgtaagcctctcatagtgatgtcaccaaagaatctgcttcgtcacaaggaatgcaaatcgaatctgtcggagtttgacgatgttcaaggccaccaaggttttgacaaacaaggaacgagattcaaacgcctcattaaggatcaaaatgctcactcagatcttgaagagggtattagacgtttggttctttgctcaggaaaggtttattacgagcttgacgaagagaggaaaaaagtcaacggaaacgacgttgcaatctgtaggattgagcagctctctcccttcccttacgatctcatccagcgtgaactgaagagatatccaaatgcagagatagtgtggtgtcaagaagaaccgatgaacatgggtgcatacaactacatttcagttcgactgggaactgcaatgaaggcactcggtagaggaacatttgacgacatcaagtatgccggtcgtgctccttctgccgccacagctactggcttttaccaagttcacggcaaagagcaaaccgaacttgtccagaaagctttgcagcctgatccaatcagttaagaaacaaaaaatcgatatttttaggttttttttatgagaataaaaagtacatagttcacgaacacgatgatggtgtgaaataatttcgagtctaactcgatgatcccgaaatacgagaatattattgatatttgctttgtatgagttagttgtttgagtttattaggttaaaaacccgattttatgtctggtcatactcgtttcgatccaattttcaacacttcgtttagatttttcacttttttttcttcctttcgtaatgttgatgaatcggacgaccgggtcttggttcagctagcttgtctgatctggttgtgacaacattgcatttgaggttgaccctttcttccaatttcttttaggataagaatattccaaagaaaaggaatcacgttaaagaaaagcaaaagtaggcacacgagggactttttaagtctgattttgaccattttcgagtgtgaatttgacaaaagtcaaagcacgaaatctgtagttctataagttaattttctaattcaacttgaatcacaaagattgtatgttgaatgagaaaggtacggaagaatcaa

SEQ ID NO: 1832 - DNA, 3418 bp, Eutrema parvulum
tccagtggagaacggcgatttgttgaatgcgctattgtggtattgaaagttgaaagcttgggttttttttttgatctgctgaaatggtgtggtttcgagctggttcgagtgtgacaaagcttgctgtgagaaggattctgaatcagggtggttcatatgcgacaaggacacggtcccttccttctcaaagtcgttgctttcactcaactctttacagaccaaaggctcacagtgctccagttcctcgagctgtacctctctctaagctaaccgatagcttcttagatgggacgagcagtgtttatctcgaggagctgcaaagggcttgggaatctgatcccaacagtgtagatgagtcttgggataatttctttaggaactttgtcggtcaggctgcgacgtctcctggcatctctgggcagaccattcaggagagtatgcgtctcttgctgcttgtaagggcttatcaggtgaatggtcacatgaaagcaaagttggatccactaggtctggagcagcgagagatccctgaggatctggacttggctctctatgggttcacagaggctgatcttgacagagagttcttcttgggagtgtggcagatgtccggattcatgtctgagaacaggccggtgcagaccctccgttccatattgacgaggctcgaacaggcctactgtgggaatattgggttcgaatatatgcacattgctgatcgagataaatgtaactggttgagggaaaagattgaaacaccaactccttggcggtacaacagggagcgccgtgaggtgattctcgaccggcttgcatggagtactcagtttgagaacttcttagctaccaagtggacaacagctaagagatttgggcttgaaggtggagaatcattgattcctggcatgaaggagatgtttgatagggcagctgatcttggagtagagagcattgttattggaatgtctcacagaggaagactgaatgttctgggtaatgttgttcggaagccacttcgtcaaatatttagtgagttcagcggtggtattaggcctgtagacgaagttggctacactggaactggtgatgtcaaatatcacttgggaacctcttatgatcgacctacaagaggtgggaaaaaaatccatctctcattggttgcaaatccaagtcacttggaagctgcagattcagttgttgttggcaaaaccagagcaaaacaatactactccaaggatttagacaggaccaagaatttgggtattttgattcatggagatggtagctttgcgggacaaggagtagtttacgaaactcttcatcttagtgctcttccaaactacaccactggtggtaccatacatatcgtggtgaacaaccaagtggctttcacaacggatccaagggctgggagatcttctcaatactgtactgatgttgctaaggctttgagtgctcccattttccatgttaatggggatgatgttgaagctgttgttcatgcctgcgagcttgctgctgagtggcgtcagacttttcattctgatgttgttgttgacttggtttgctatcgtaggttcgggcataatgagatagatgaaccatctttcacgcagccaaaaatgtacaaggttatcaaaagtcacccctcgacgcttcaaatctaccacaagaagctcttggagtgcggtgaaatatcacaacaggacatcgaccagatacaggaaaaggttaacaccatcctcaatgaagaatttgttgctagtaaagattatctacctaaaaaacgagattggctttcaaccaattgggctggatttaagtctcctgagcagatctcacgtgttagaaacactggcgtcaaaccagagatacttaagactgttggcaaggcaatttcatcgcttccagaaaacttcaagcctcacagagcggtgaagaaagtttatgaacaacgtgcgcaaatgattgaatcaggagaaggaattgactgggcacttgcggaagctcttgctttagctaccttagttgtggaaggcaaccatgtccgcttgagtggtcaggatgtcgaacgaggaacatttagtcatcgtcattctgtccttcatgaccaggaaactggagaagagtattgtcctctagatcatctcatcatgaatcaggatcctgagatgttcactgtcagcaacagttctctttcagaatttggtgtccttggatttgaattaggttactcaatggaaagcccaaactcgttggtgctatgggaagctcagtttggagactttgccaatggagctcaggtgatatttgatcagttcatcagcagtggagaagccaagtggctgcgtcaaaccgggcttgttatgctacttccccatggttatgatggtcaaggccctgaacattcaagtgcgaggctggaacgttaccttcagatgagtgacgataatccctatgtcataccagacatggaaccaacaatgcgaaatcaaatccaagaatgtaactggcagatcgtcaatgccaccactcctgccaactatttccatgttctgcgtcgacagatacacagagacttccgtaagcctctgattgtaatggcaccaaagaacttactccgtcacaaagactgcaaatcaaatctctcagagtttgatgatgtccaaggccacccaggttttgacaagcaaggaactagatttaagcgattaatcaaggatcagaacgatcactctgatcttgaagaaggcatcagaagattagtactttgctctggaaaggtttattacgagcttgatgacgagaggaagaaagttggcgcgaatgatgttgctatttgtagagtggagcagctttgtcctttcccatatgatctcattcagcgtgagctcaagagatatccaaatgcggaaatagtgtggtgccaagaagaggcgatgaacatgggagcattcagctacatatcccctaggctatggacagcaatgagaagcttaaacagaggagatatggaagacattaagtacgttggtcgtggaccttctgctgctactgccactggtttctacacgttccatgtcaaagagcaagccgagctcgtccagaaagccatcgggaaggaacccatcaattgaaatactcttcctttttaaaggcattctcagactgaaaagaaaaaggagaaaacttcaaataagaactttgggtgatgcaaagtgataaacaacactgacaaaatcctctgtttctttgttttatttttgataccaatgatttttaattctgcctcgtgttgcaggataatacaactcatctcattttgatagagtttttgttttttcctcttcgtttttcttctttgatacatcttttgtttttgtcataaaaaatacttctcaagactttggatgttcaa

SEQ ID NO: 1833 - DNA, 3436 bp, Brassica rapa
gtcacttcagtgaagaaggctcctccatctttttgatccaggagggtttgtagattcgattaaagctatggtttggtttagaactggctcttctctggcaaagcttgccatacgaagaacactctctcagtctagggttctaccttcttcacacgcgagatgtttccactctacatcactcaaatcaaacgccgcgcccgtcccccgccccgtccctctctccaagctcaccgacagcttcctagacggaaccagcagcgtgtacctcgaggagctgcagagagcttgggaagccgatcccaacagcgtcgacgagtcctgggacaacttcttcagaaacttcgtgggccaagccgccacttcccctgggatctcggggcagaccattcaagaaagcatgcgtctgctcctcctcgtcagagcttaccaggtcaacggccacatgaaggccaagcttgaccctctgggtctagaagaacgagagatccccgaggatctaacgcctggtctctacggattctccgaggctgatcttgacagagagttcttcctcggtgtgtggaggatgtctgggtttctctccgagaaccgtcccgttcagacgctgagagctatactctcgaggctcgagcaggcgtactgtggaaccattgggtatgagtacatgcacattgcggatagggataaatgtaactggctgagagacaagatcgagacgccgacgcctcggcagtataatagcgagcgccgcgtggtgatttacgataggctgacgtggagcacgcagtttgagaacttcttggcgactaagtggaccacggccaagaggtttggactcgagggcgctgagtctttgatccctgggatgaaggagatgttcgacagggccgcggatcttggagttgagaacattgttatcggtatgcctcacaggggtcggcttaatgttttgggtaacgttgttaggaagcctctgcgtcagatcttcagcgagttcagcggtgggactaggccggtggatgaagttgggctctacaccggaacgggggatgtgaagtaccacttgggcacgtcttatgatcgcccgactagaggagggaaacatcttcacttgtctttgttggcgaaccccagtcacttggaagcggtggatcctgtcgtgatgggtaaaaccagagcgaagcagtattacaccaaagacgagagcaggacaaagaacatgggtattttgatccatggggatggtagctttgccgggcaaggtgtggtgtatgagactctgcatcttagcgcgcttcctaactactgcaccggtgggacagtgcacattgtggtgaataaccaagtggctttcacaaccgatccaagggcgggaaggtcttcacagtattgcactgatgtcgccaaggctttagatgctccgatttttcacgtcaatgcggatgatattgaagcggtggtgcatgtttgtgagcttgctgcggagtggcgccagacgttccattctgatgttgttgttgatttggtgtgctaccgtcgctttgggcataacgagatagatgaaccgtcgttcacacaaccaaagatgtacaaggtgatacgcagtcatccctcgtcgcttcaaatctaccaagagaagcttgtggaatctggacaggtaacgaaagaagatattgataagattcaaaagaaagtaagctctatcctcaatgaagaatttgaggcaagtaaagagtatattccacaaaaacgtgattggctggcaagtcattggactgggttcaagtcaccggagcagatttctaggatccgtaacactggtgtaaagccagagattttgaagaacgtggggaaagcaatctcaacctttccagagaacttcaagccacacagaggagtgaaaagagtttatgagcaacgtgctcagatgatcgagtcaggagaaggcattgactggggacttggagaagctcttgctttcgctacactagttgtggaaggtaaccatgttcggctaagtggtcaagatgttgaaagagggactttcagtcataggcactccgtgcttcatgatcaagaaaccggcaaggagtattgtcccttagaccacctgaccatgaaccaggaccctgaaatgttcactgtcagcaacagctctctttcagagtttggtgttctgggattcgaacttggttactcgatggagaacccgaattctctggtaatatgggaggctcagtttggagactttgccaatggcgcacaagtgatgtttgatcagttcataagcagtggagaagccaaatggctccgtcaaaccgggctagtagttctacttcctcatggatatgatggtcagggtcctgaacattccagtggaagattagaacgtttccttcagatgagtgatgacaatccttttgtcatccctgagatggatccaactcttagaaagcagattcaagagtgtaattggcaaattgttaatgttactacacctgccaactacttccatgtcctgcgtcgccagatacacagggatttccgcaagcctcttatagtgatggctcccaaaaacttgcttcggcacaagaagtgtgtatctaacctctcggagttcgatgatgttaaaggacatcctgggtttgacaagcaaggaaccaggtttaaacggttgattaaagatcaaagtggtcactctgatcttgaagaaggtatccgacgtctagtcctctgctcagggaaggtttactatgagctggacgaagagcgacaaaagtctggaacaaacgacatagccatttgcagaatggagcagctttgtccattcccttacgatctcattcagagagaattaaagcgatatccaaatgcagagattgtgtggtgtcaagaagagccgatgaacatgggagcatatcagtatatagcaccaaggctgtgcacggccatgaaagcactgaacagaggaagcttcaacgacatcaaatacgttgggcgtcttccttcagctgctacagccactggtttttaccagcttcatgtcaaggagcaaactgatcttgttcacaaagctcttcaacctgatcccatcacccctatcctcccctgaatgatccatcaaggaaatatataacagcttcagctcttgaagctcatgagagtctgtataaagacgacacaaaaacaaagattcatgagaatctttggttatcatcaaataatttcactgcggaaaccatatgtttgctagagagtttcattccagtttgaatgatttcggtttacttcggttatcaataaaagtaaagtaatcaaacatgaatgattagtctgttttagtgttcaacaaatagctagcggtaactattcggagcttgggatttaagcgttaactaattatttatcttgcttaaacgtgttttatataaatata

SEQ ID NO: 1834 - DNA, 3158 bp, Cephalotaxus harringtonia
ctagcagccatgactttgcagaggctttcgtcgggtttattcagggcagccctgaaaatccgtctggctcaacaaacttcttatgcaaaaagatcgctgtggaccctgccgcaggcccgatcttttcactcaacgccgcataattttcagcaatcggcccccgtgccgagagctgtgccgctatcgaggcttaccgacaattttcttgatggaacgagtagtgtttatttggaagagttgcagagggcatgggaggcggatccacagagcgtggatgagtcatgggacaattttttcaggaattttgtcggtcaggcagcaacgtcgcctggggtttcaggccaaacaatccaggagagcatgaggcttttgttgcttgtgagggcttatcaggtgaatgggcacatgaaggccaagttggatcccttgggtttggagcagcgggaaattccggtggatttggagccgggtctttatggattcaccgaagctgatttggaccgagagttttttctcggtgtatggaagatgtccgggtttttgtcggagaataggcctgtgcagacgctgcggtcgattctcaatagattggagcaggcttactgtggtacaattgggtatgaatatatgcatataccggaccgtgataagtgcaattggctgagggagaagattgagacggtggttcccagcaagtatagccctgaacgaaggcatgttatacttgacaggcttatttggagtacccaatttgagaatttcttggcaacaaaatggactgctgccaaacgttttggtcttgagggtgctgagacattgattcctggtatgaaagagatgtttgatagatcctctgacatgggtgtggaaagcattgtgattggaatgtctcatagaggaagattgaatgtcctgggcaatgtggttaggaagccgttgagacagatttttagcgagtttagtggtggcacgaagccggtagacgaagttggatcttacactggaaccggggatgtgaaataccatttgggtacatcgtatgataggcctactaggggtgggaaaaggattcatctttcactggttgctaatcccagtcatttggaagcggttgatcctgttgtcgttgggaaaaccagagcaaaacagtattattcaaatgacaaggacaggacgaagaacatggctatcttgattcatggagatggaagttttcctgggcagggtgtggtttatgagacattgcatttgagtgctcttcctaactacacgactggagggactattcacattgtagtcaataatcaggttgcatttacaactgaccccaagtccggtagatcttctcaatattgtacagatgttgcaaaagctttgaatgctcctatctttcatgtgaacggtgatgatgtggaagctgtggtgcatgcatgcgaacttgctgccgagtggcgtcagattttccattctgatgttgttgttgatattgtttgctaccgtagatttggacacaatgagattgatgaaccatccttcacacaacctaaaatgtaccaggtgattaaaactcatccacgagcagttgatgtttacgaaaaacagctaattcagtcagggcagttatcagaggaagaaattgatgctttgcacactaaagtcaactcaattttaaatgaagagtttgtaaacagcaaagaatacgagccaaagcgacgagattggcttgcagcatattggactggcttcaaatcaccagagcaattgtctcgtagacgcaatacaggggtcaaaccagagatattgaaaaatgttgggaaagccataactactttaccagaaacattcaatcctcatagggctgtaaagagaatttttgatcagcgtgcacaaatgattgaaaaagaagaaggtgttgattgggctgttggtgaagcacttgcatttgcaacacttttagtagagggtaatcatgtgaggcttagtggccaggatgttgaaagaggtactttcagtcaccgacattcagttgttcatgaccaggaaacaggagaaagatattgtcctctggatcacgttgtcatgaaccaaaatgaagagatgtttactgtaagcaacagctctctctcagaatttggtgtcctcggctttgaattgggttattcaatggaaaatcccaattcattggttctgtgggaagctcagtttggtgattttgcaaacggtgcccaagtcatttttgatcaatttataagcagcggggagtcaaaatggcttcgtcaatctgggcttgttgttctacttcctcatggctatgacggccagggtcccgaacattccagtgcaagattagagcgttttctacagaatagcgatgacaatccttttgtgattcctgaaatggatcctacgttacgcactcaaattcaacagtgcaattggcaagttgtaaatgtgacgactcctgccaattacttccatgttcttcgtcgccagctacaccgggactttcgtaaaccattgattgtcatgtctccaaagaatcttcttcgacacaaggactgcaagtcaaatttgtctgaatttgatgacgtgcaaggccatccaggatttgacaaacagggaacccgatttaagcgtctcattaaggatcagaatgaccactctgatcgagaagaagggattcagcgtcttatactttgttccggaaaggtctattatgaacttgatgaggaacggaaaagagtccagaggaaagatgttgctatttgtcgagttgaacaattatgcccattcccttatgatctagtccagcgagaattgaagcggtatccaaatgcagagattgtctggtgtcaggaagagcctatgaatatgggagcatatcattatattactcctcgtcttctaactgccatgagagcgctagatcgaggtacttttgaagatcttaagtatgtcggtcgagctccatcggctgctacagcaacagggtttagtcaggtgcatgttaaagagcataaagaacttgtcgagactgcactgcagtcggatccaatcaagtttctttgagacttatttataattgaaacagagtttagttttataataatggaatcgaaaatatgcagcatcctctcaccgtctcacgtattactccc

SEQ ID NO: 1835 - DNA, 3707 bp, Mimulus guttatus
tgaaacatcagttggagaaaagtaaacgaaaacccaagaaataggtcaccgcgattagggtttaattccgaccatacgccatctttttcttagggtatggtgtttgggagatataatgacagttcgtagcgcgtaatttcgtttgggaagtgttgaatttcttttttctgctgtggtcgtagtttctcggattcggttgaatagcaatggtgtggtttagagccgggtctcgtgtggcgaagcttgctgttaagcgaactttaacgcaatctggttcttatgtagcacgagcaacgggttcacctgcacagagccgatgctttcagacaacagtttttaggtcaaaggctcaatctgcaccggttcctcgtcctgttccactctctagattgaccgatagtttcttggatggcacgagcagcgtttatctcgaggagctgcagagagcttgggagcaagatcccaatagcgtggacgaatcatgggacaatttcttcagaaactttgtgggccaggccaccacatctcccggaatttcgggtcaaacgattcaagaaagtatgcgtctgttgttgcttgtgagagcttaccaggtttatggtcacatgaaggccaagatagatccactcggcttggaagaaaggaccatccccgatgatctagatccagggctttatggattttcagaagctgatctcgatagagaattctttgttggtgtctggagattgtctggtttcttgtccgagaaccgtcctgtgcaaactttaagggcaatattgacgaggctagagcaggcttattgtgggaacattggctttgagtacatgcacattgccgatcacgaaaagtgtaactggttgagagacaaaatcgagactccaacatcaactcaatatagtcgagatcggcgtgaggtgattctcgaccggcttatttggagtacccaattcgagaacttcttggcagccaaatggactgcagccaaaaggtttgggcttgaaggttgcgagacattgattcctggtatgaaggagatgtttgacaggtcagcagatctcggggtagagagcatagtcattggaatgtcgcacaggggaagattgaatgttttgggcaatgttgtaaggaaacctctaaggcagatatttagcgagtttagtggtggcacgaaacccgtggatgaggtcggcctttacaccggaactggtgatgtcaagtatcacctgggaacttcttacgatcgtccgacgagagggggtaagagaattcacttgtctttggttgcaaatcctagtcatttagaagcagtggacccactcgtggttggaaaaaccagagccaaacagtattactctaacgacgtcgacagaacaaagaatatgggtattttaatccacggtgatggtagttttgccggacaaggtgtcgtgtacgagaccttgcatcttagtgctctgccgaattacactactggtgggaccattcacattgttgtgaacaatcaagtggctttcaccactgacccaacagctggaagatcttcccaatattgtaccgatgttgccaaagctctaagtgctcctattttccatgtcaatggtgatgacgtggaggctgttgttcatgcctgtgaacttgctgcagagtggcgtcagacgtttcatactgatgttgtggttgatatcgtatgctatcgtcgatttgggcataacgaaattgatgagccatccttcactcaacctaaaatgtacaaggttataaggaatcatccttcggcagctgagatttaccaaaagaaacttctagaatctggtcaggtcacaaaagaagaaattgataagataaacagcaaagtcctttcgattctcaatgaagaatttctggccagcaaagattatgtgcctaaaagaagggactggctttcagcttactgggctggtttcaagtctcccgaacaactttcacgtatccgtaatactggggttaaaccagagattttgaagaatgttggcaaggctatcacaactcttccagaaacttttaaacctcatagagcagttaagaggatttttgaagaccgtgcgaaaatgatcgagtcaggggagggtattgactgggcagtagctgaatcactcgcgtttgcaacgttgcttgtggagggaaatcatgttaggttgagtgggcaggatgtcgagagaggtactttcagccatagacattcggttcttcacgatcaggaaactggtgaaagatactgccccttagatcatgttattatgaaccaagatgaagagatgtttaccgtgagtaacagctctctttcagaatttggagttttgggattcgaattaggttactcgatggaaaatcccaattcgctgatactgtgggaagctcagtttggtgattttgccaatggggctcaggtcatgttcgaccaatttctgagcagcggtgaggccaaatggcttcgtcaaactggattagtcgttctcctaccacatggatacgatggtcaaggcccagaacactctagtgcacgcatggaacgtttccttcagatgagtgacgataatcccttcgttatcccggagatggattcgaccctcaggacacagattcaggaatgcaattggcaggtggtgaacgtaaccacccctgcgaattatttccatgttttgcgccgccagatacatagggaattccggaaacctctaattgtgatggcaccaaagaacttactccgtcacaaggactgcaaatctaacttatccgagttcgacgatgttgaagggcatcccggtttcgacaaacaaggaaccagatttaaacgccttattaaggatcaaaatctccactctgatctcgaagagggtattagacgcctcgtcctttgctctggaaagctatactacgagcttgacgaacagaggaaaaaagctgatgcaaaggatgttgcaatctgtagggtggagcagctttgccccttcccatacgatctcgtccaacgtgaacttaagagatacccaaatgcagagatcgtttggtgtcaagaagagccaatgaacatgggagcatacagctatatcgctcctcgtcttggcactgcaatgaaagctctgaaacgaggcaatgtggacgacatcaagtatgtgggccgtgccccttccgccgctactgcgactggcttttacatggtccatacgaaagagcaaaacgaaatagtccacaaagccacacagcctgaaccaatcaatttatcccacacagcctgaaaccaatcaatttcatgataaaaatcgagattgaagttattgataacctatccatctctaccgttttgtctgcgagtattttcactcgatttcgacatttgtttggcaaagtttttttgtgaggaataaacgtacgtactcactctctgaagtcaatgttgtcattgaccaatgaacttcgattcgagtgttgttgtctgaaaaagggatactttgttttcgattttgtgacgatatcttgtatatgtacaagaggtttgtttatgtgctaatatggttgagagataaccacattttttttttctgcacaaagcaattgaggtttgtttttacaacttcaatgttgtgtgttgcacactaaccgaagaaacatcggcatttgtcgtcgatagttttacttgatttatttgttgaaattgtttgcacacg

SEQ ID NO: 1836 - DNA, 3714 bp, Mimulus guttatus
gaaatgaaacatcagttggagaaaagtaaacgaaaacccaagaaataggtcaccgcgattagggtttaattccgaccatacgccatctttttcttagggtatggtgtttgggagatataatgacagttcgtagcgcgtaatttcgtttgggaagtgttgaatttcttttttctgctgtggtcgtagtttctcggattcggttgaatagcaatggtgtggtttagagccgggtctcgtgtggcgaagcttgctgttaagcgaactttaacgcaatctggttcttatgtagcacgagcaacgggttcacctgcacagagccgatgctttcagacaacagtttttaggtcaaaggctcaatctgcaccggttcctcgtcctgttccactctctagattgaccgatagtttcttggatggcacgagcagcgtttatctcgaggagctgcagagagcttgggagcaagatcccaatagcgtggacgaatcatgggacaatttcttcagaaactttgtgggccaggccaccacatctcccggaatttcgggtcaaacgattcaagaaagtatgcgtctgttgttgcttgtgagagcttaccaggtttatggtcacatgaaggccaagatagatccactcggcttggaagaaaggaccatccccgatgatctagatccagggctttatggattttcagaagctgatctcgatagagaattctttgttggtgtctggagattgtctggtttcttgtccgagaaccgtcctgtgcaaactttaagggcaatattgacgaggctagagcaggcttattgtgggaacattggctttgagtacatgcacattgccgatcacgaaaagtgtaactggttgagagacaaaatcgagactccaacatcaactcaatatagtcgagatcggcgtgaggtgattctcgaccggcttatttggagtacccaattcgagaacttcttggcagccaaatggactgcagccaaaaggtttgggcttgaaggttgcgagacattgattcctggtatgaaggagatgtttgacaggtcagcagatctcggggtagagagcatagtcattggaatgtcgcacaggggaagattgaatgttttgggcaatgttgtaaggaaacctctaaggcagatatttagcgagtttagtggtggcacgaaacccgtggatgaggtcggcctttacaccggaactggtgatgtcaagtatcacctgggaacttcttacgatcgtccgacgagagggggtaagagaattcacttgtctttggttgcaaatcctagtcatttagaagcagtggacccactcgtggttggaaaaaccagagccaaacagtattactctaacgacgtcgacagaacaaagaatatgggtattttaatccacggtgatggtagttttgccggacaaggtgtcgtgtacgagaccttgcatcttagtgctctgccgaattacactactggtgggaccattcacattgttgtgaacaatcaagtggctttcaccactgacccaacagctggaagatcttcccaatattgtaccgatgttgccaaagctctaagtgctcctattttccatgtcaatggtgatgacgtggaggctgttgttcatgcctgtgaacttgctgcagagtggcgtcagacgtttcatactgatgttgtggttgatatcgtatgctatcgtcgatttgggcataacgaaattgatgagccatccttcactcaacctaaaatgtacaaggttataaggaatcatccttcggcagctgagatttaccaaaagaaacttctagaatctggtcaggtcacaaaagaagaaattgataagataaacagcaaagtcctttcgattctcaatgaagaatttctggccagcaaagattatgtgcctaaaagaagggactggctttcagcttactgggctggtttcaagtctcccgaacaactttcacgtatccgtaatactggggttaaaccagagattttgaagaatgttggcaaggctatcacaactcttccagaaacttttaaacctcatagagcagttaagaggatttttgaagaccgtgcgaaaatgatcgagtcaggggagggtattgactgggcagtagctgaatcactcgcgtttgcaacgttgcttgtggagggaaatcatgttaggttgagtgggcaggatgtcgagagaggtactttcagccatagacattcggttcttcacgatcaggaaactggtgaaagatactgccccttagatcatgttattatgaaccaagatgaagagatgtttaccgtgagtaacagctctctttcagaatttggagttttgggattcgaattaggttactcgatggaaaatcccaattcgctgatactgtgggaagctcagtttggtgattttgccaatggggctcaggtcatgttcgaccaatttctgagcagcggtgaggccaaatggcttcgtcaaactggattagtcgttctcctaccacatggatacgatggtcaaggcccagaacactctagtgcacgcatggaacgtttccttcagatgagtgacgataatcccttcgttatcccggagatggattcgaccctcaggacacagattcaggaatgcaattggcaggtggtgaacgtaaccacccctgcgaattatttccatgttttgcgccgccagatacatagggaattccggaaacctctaattgtgatggcaccaaagaacttactccgtcacaaggactgcaaatctaacttatccgagttcgacgatgttgaagggcatcccggtttcgacaaacaaggaaccagatttaaacgccttattaaggatcaaaatctccactctgatctcgaagagggtattagacgcctcgtcctttgctctggaaagctatactacgagcttgacgaacagaggaaaaaagctgatgcaaaggatgttgcaatctgtagggtggagcagctttgccccttcccatacgatctcgtccaacgtgaacttaagagatacccaaatgcagagatcgtttggtgtcaagaagagccaatgaacatgggagcatacagctatatcgctcctcgtcttggcactgcaatgaaagctctgaaacgaggcaatgtggacgacatcaagtatgtgggccgtgccccttccgccgctactgcgactggcttttacatggtccatacgaaagagcaaaacgaaatagtccacaaagccacacagcctgaaccaatcaatttatcccacacagcctgaaaccaatcaatttcatgataaaaatcgagattgaagttattgataacctatccatctctaccgttttgtctgcgagtattttcactcgatttcgacatttgtttggcaaagtttttttgtgaggaataaacgtacgtactcactctctgaagtcaatgttgtcattgaccaatgaacttcgattcgagtgttgttgtctgaaaaagggatactttgttttcgattttgtgacgatatcttgtatatgtacaagaggtttgtttatgtgctaatatggttgagagataaccacattttttttttctgcacaaagcaattgaggtttgtttttacaacttcaatgttgtgtgttgcacactaaccgaagaaacatcggcatttgtcgtcgatagttttacttgatttatttgttgaaattgtttgcacacgttt

SEQ ID NO: 1837 - DNA, 3441 bp, Helianthus annuus
tcttcagtcggttcttattcaacgcaatgaaactatacaccgatctctctttctagattcaacggtctgcaaaattaggtgtttgaaattattttaagaaaaagagaacttgaaatttgaagaaaatgacgtggtttagggccggatctagtgtggcaaagcttgcaatcagaagaactataacacaaagtggatcttacgcagcaagaaagcgtgttttccctgcagagagccgatatttccacacaactgtctttaagtcaaaagcacaatctgcacccgtccctagagctgttccgctttccaggttaaccgatagctttctagatggaactagcagtgtctatttagaggaacttcaacgtgcttgggaagatgatccgaacagcgttgatgagtcgtgggacaatttcttccggaattttgtgggccaggccgccacgtcacctggaatatctggccaaacaatacaagaaagcatgcgattgttgttgctcgttagagcataccaagtttacggccacatgaaagccaaaatagatccgttgggccttgaaaaacgagagattcctgatgatttggatcctgctttttacggtttcagtgaagctgatttagaccgtgagttttttcttggtgtatggagaatgtcgggttttttatccgaaaaccgacccgtacaaactcttaggtcgatattaaccagacttgaacaagcttactctggaaacattggttacgaatacatgcacattgctgaccgtgaacgatgtaattggttacgagataaaatcgagaccccaactccaactcagtataacagagaacgccgtgaggttatccttgacagactcatttggagtacgcaattcgaaaactttttagctacgaaatggaccgctgctaaaagattcggacttgaaggtggtgagacgttaatcccgggaatgaaagagatgtttgaccggtcagcagatctcggcgttgaaagcattgtgattggaatgtctcacaggggacgattaaacgttttaggtaatgtggttagaaaaccattacgccaaattttcagtgagtttagtggtggtacgaagcccgttgatgaggtcgggctttatacgggaaccggtgatgtgaaatatcatctcgggacttcttacgatcggccgacacgtggcggaaagaggattcatttgtcgttagttgcaaaccctagtcatttggaagctgtagatcctgttgtgatcgggaaaacacgagcaaaacagtattactcaaatgatgttgatagaacaaagaacatgggtattttgattcatggtgatggaagctttgcgggtcaaggtgtggtttacgagacgttgcatttaagcggtcttccaaattacacaactggtgggaccattcatattgtagtcaacaatcaagttgcttttactacggatccacaagcgggaagatcttcacagtattgtactgatgttgctaaagctttaaatgctccgatatttcatgttaatggtgatgacgtggaagcagttgttcatgcttgtgagctggcagctgagtggcgacaaacgttccactcagatgttgttgttgatatagtctgttatcgtcgatttgggcataatgagatcgatgaaccatctttcacccaaccaaaaatgtacaagatcattaggaatcatccgtcatcgctagagatctaccagaagaagcttctagaaagtggacaagcgacaaaagaagatatcgatagaatacaaagcaaggttaccacaattctcaacgaagagtttcttgccagcaaggattacgttcctcaaagacgagactggctttcggcttactgggccggattcaaatcccccgaacagctttcacgtattcgtaacaccggggttaaaccggagattctgaaaaacgtcgggaaggcgattacaacacttccggaaacttttaagccacacagagcagttaagaaaatattcgcggaccgttataagatgattgaaactggtgaaggtgttgattgggcagttgcggaagcattggcgtttgcaacgttactggtggaaggaaatcacgtgagattaagtggtcaagatgttgaaagaggtacgttcagccacaggcattctgttgttcatgatcaagaaacaggagagcgttactgtccgttggatcatgtaatgatgaatcagcatgaggaaatgtttaccgtaagcaacagttctctttcggagtttggtgtcttgggctttgagttgggctattcaatggaaaaccctaattcactggtattatgggaagctcaatttggtgatttttccaacggggcccaggttatattcgatcaattcttgagcagtggtgaggctaagtggctgcgccggactgggttagtcttgttgctacctcatggttatgatggtcaagggcccgaacactcgagtgcaagacttgagcgtttccttcagatgagtgacgacaatccgtttgtcatacctgagatggaaccaacactacgcaatcaaattcaaacatgcaatatgcagatcgttaatgttacgacgccagcaaattatttccatgtgttacgtcgacagctacatagggagttccgtaagccgcttgtcgtaatgtctcctaaaaatttgcttcgtcacaaagactgcaagtcgaacttatccgagttcgatgatgttcaaggtcaccctggttttgataaacaagggaccagatttaaacgactcattaaggatcaaaatgatcattcggatcttgaagaagggattaggcgtctagttctatgctctggaaaggtttattatgaacttgatgaaaaaaggaagtcggttgacggtaaagatgtagcaatttgtcgtgttgaacaactttgtccgttcccatatgatctcatccagcgtgaattaaagcgttatccaaatgcggaagtagtttggtgtcaagaggagccaatgaacatgggggcctacagttacatcgccccacgacttgcgaccgccatgaaggccctcgatagaggtactattgacgatgtcaaatacgttggccgggctccatctgccgcaactgcaactggtttctacaccgttcatggcagagaacagtctgaaatcgtgcagaaagccctgcagcccgaacccgtcaccaatcctacacttagctagatcctgcacccagggtatctatcttcatccaagtgtcggcttggagtctttttgctttaatttttcgaaagtttttcgcgtattgataaggtctacgcgtgtaataagatacatacaatcgttcaggtgaagttgtacaatggattcatggcgtgatctctttctttgcggttaattattaaacttaccctttgtgaatcttttttttgtattcttagtgacgattctcgggtatgatttattt

SEQ ID NO: 1838 - DNA, 3536 bp, Amorphophallus konjac
cccttcctcatcatgaataccccggatcgtgcatagctagagactccatattgaaggagaagagattgtagtaagaatatagctttgagagtctgcattgggtttgttggtcgagtgtagatggcgtggttcagagccttctcaggcgtggccaggcacgccgtccggcggcatctcgcccaggcctcccaccatgtccccaggccctctcgtggcttccattccacggccctcaggcccaaggcagtcccggtcccccgtcccgtgcctctctccaggctcaccgacagcttcctcgatggcaccagcagtgtctaccttgaggagctccagagggcctgggaagctgaccccaacagcgtcgacgagtcgtgggacaacttcttcaggaactttgttgggcaggctgctacatccccggggatctctgggcagaccatccaggagagcatgcgtctgttgttgcttgtcagagcataccaggtaaacgggcacatgaaggccaagttggatcctttgggccttgaggagagggaggtcccagatgacctggacccagctttctatggcttcacagaggcggatttggacagggagttcttcatcggggtgtggagcatggctgggtttctgtccgagaatcgcccggtgcagacactccgatcaatcctgaatcgccttgagcaggcttactgtgggagtgttgggtacgaatacatgcacattgctaatagggagcaatgtaactggttgagggacaagatagagacggttagtcccatgacttacaccggggaaaggcaagaggtcatccttgacaggcttatttggagcacccaatttgagaactttcttgctaccaagtgggtaacagcaaaaaggtttgggcttgaaggtggggagacgttaattccgggtatgaaagagatgtttgatagggcggctgaccttggtgtggaaagcattgtggttgggatgcctcatagaggtagattgaatgttttgggtaatgtgttcaggaagccgcttcgccagatctttagtgaatttagtggcagtggtacaaaggcagtagatgaggttgggttatacacgggcacaggtgatgttaaataccatctgggtacctcctatgatcggcccacaaggggtggaaatagaattcatttgtctcttgttgcgaatcctagtcatttggaagctgtgaatccagtcgtcattggaaagactcgggcaaagcagtattactctaatgatattgacagaaccagaaatttggcagttttaatccatggagatggaagttttgctgggcaaggtgtggtctacgagacttttcacctgagtgcccttccaattacacgactggtggaaccattcatattgtggtgaacaaccaagttgcattcacaactgatccaaaggctggccgttcatcacagtactgtacagatgtggcaaaagccttggatgctcctatttttcatgtaaatggagatgacatggaagctgtggttcatgtttttgaacttgctgcagagtggcgtcagaccttccataaggatgtggtagttgacattgtatgttaccgcggtttgggcacaatgagatggatgaaccctctttcacacagccaaaaatgtatcaggtgatccgcaatcaccccagtgctattcagatttatcaaaataaacttttggaatctggacatatcacaaaggaatacattgacaaggtacaaaacaaagttagttccatcttgaatgaagagtttaacaacagcaaagattatattccaaaaagacgggattggctttcagcatattgggctggattcaaatcacctgaacagatatcccggattcgcaacactggtgttaaacctgagatcctgaaacgtgttggtgaagctattaccactcttccggaagattttaagcctcacagagttcttaagagggtttttgatgaacgagctcagatgattaaaactggtgaaggtgttgactgggcacttgcagaagctcttgcttttgccacacttttgctggaaggcaaccatgtcaggttgagtgggcaagatgttgaaagaggtacttttagtcatcgacattctgtacttcatgatcagcaaactggggaagtttactgtcctctagaccatgttatgatgaaccaaaatgaagagatgtttaccgtcagcaacagttccctttccgagtttggggttcttggatttgagttgggttattcaatggagaatcctaactccctagtgctctgggaagcacagtttggggactttgcaaatggtgcccaagtaatttttgatcagtttttgagtagtggtgagtctaaatggctgaggcaaactgggcttgttgtgctgcttccccatgggtatgatggacaaggccctgaacactcctctgccagactggaacgttacctgcagatgagtgatgacaatccttatgtgattcctgagatggatccaactttaaggaagcagattcaagagtgcaattggcaagttgtaaatgttacaacaccagcaaactattttcatgttttgcgtcggcagatacatcgggagtttcggaagcctttaatagtgatggctcccaagaatttactcaggcatccaaaatgcaagtcgaatttatctgaatttgatgatgtccaaggccacccaggatttgacaagcaggggacacgtttcaagcgtcttatcaaggatcagaatgatcactctaatctcgaggagggtatcaggcgtctggttttgtgctccggaaaggtgtattatgatcttgatgaagagcggaaggcagctgatgcgaaggacgtggcaatctgtagagtagaacaactgtgcccattcccctacgacctcatccagcgagagctgaaacgatacccaaatgcagagattgtatggtgtcaggaggaaccaatgaacatgggagcatacagctacatttcacctcggctttgtactgccatgaaggcattaggcagaggtacaatggaagacattaaatatgttggaaggccaccatctgctgccacagcaactgggttcttgtgcgttcaccaacaagaacagaaagagcttgtccagcaagccatccaacgagtttgagatctgccttttatgcatcggaccaattgaagaataaggatttgtacttattgcatggttttttggtggacatttgcctgagttatcacaacttgctatggccttgatcaaagttttggccatcggttgtgcaattgtttttatgcatgagttcatgcaattgttgaaaaactgcattcatctccatttttgtggttgtatctacaataacaaacgagaatgtggccggttccacctaagacacatggttttataagaaagcataggtctgatagtcatcccaccttgtgcttgttatgtaatttctgttaatcttttcagcttccttggtgttattatctggactggtccagaatatttggcatagaacatggtaaactttagtctgaac

SEQ ID NO: 1839 - DNA, 3504 bp, Zostera marina
cagttccagtgaagttcgtttcctcagaaaagaaaattaactgctttctttggcactcactgctcgaacagtgtttttccacaaaacggagaattctaggggggttcctgattggtttttcaagtttaggatcaaggtcggacaaatctagattttagaattttcagactactaaacatggtgtggtttcggacagccacaaacataggaagattggctataagaaggagtttagctcaagcttctcatcatgccaaaaggcctcatttgttgccagcttccacagttcgtggatttcactcaacattccctaaatgtgctgctccagtccctcgacctgtgccactctcaaaattaactgacagtttccttgatgcttcaagcagtgtatacttggaggaacttcaaagaacctgggaggttgatccgaatagtgtcgatgagtcatgggataatttcttcaggaattttgttggacaggctgccacctcgcctggaatctctggacagacaattcaggagagtatgaggctgttgttgcttgtcagagcgtatcaagtcaatggacacatgaaggccaagcatgatcctttgggtctggagaagcgtgagatccctcatgatttgaatccagaattttatggattcactcaggctgattttgacagagaattctttattggggtgtggagtatgtcaggattcctttctgagaatcgtcctgtgcagacactccgttctatcataaatcgtctggagcaggcttattgtgggagtgttgggtatgaatacatgcatattgcagataaagaacaatgcaactggctgaggaataaaattgaaacagttaagccaagagaatataatgctgaacgacgtgaggtcattctagataggcttatctggagcacacagtttgagaattttcttgccacaaagtggacagctgccaagcggtttgggcttgagggaggggagtcgttaataccaggtatgaaggagatgtttgatagagcatccgaccttggtgtggaaacaattgttatcgggatgcctcataggggaagactgaatgttttagccaatgttgtcagaaaacctttacgtcagatttttaatgagtttagtggtggaacaaaaccagtggaggaacaagggttatacacaggaacaggtgatgtaaagtatcatctaggaacttcttatgatagaccaacccgaagtggaaaaatgatccatctttctttagtcgcaaatccaagtcatttggaagcagtcgatccagtggttgtaggaaagactcgggcaaaacagtatcattccaacgatgtcgataggaaaaagaatatgggaatattaattcatggagatggaagttttgctggtcagggtgtggtttatgaaactttgcatcttagtgcacttcctaattacacaactggtgggaccattcacttagtggtcaataatcaggtggcattcaccaccgatccaagagcaggaaggtcttcggattactgtacagatgtggctaaatctttgaatgttcccatttttcatgtgaatggggatgacatggaagcagtggttcatgtatttgaactggctgctgaatggcgccagaaattccactgtgatgctgttattgatattgtgtgctaccgtcgatttggacacaatgagattgatgagccctcattcacacaacctaaaatgtatcaggtgattcgaaaccatcctagttcacttgaaatttaccagaacaaacttttgaaacttggggtgatcacaaaagaaggtatcgaagcaatacacaacaaagtaaactccatcctgaatgaagaattcatcaacagcaaagattatgttaccaatcgaagggattggttatcagcttattggacaggattcaaatcacctgagcagatttcacgggttcgaaacactggtgttaatcctgaaataatcaagcgggttggtcaagctatcacaactcttccagaaactttcaagccacatcgggctgtcaagaagatttttgatctacgtgctcagatgattgaaactggagtcggaatagattgggctcttgctgaagctcttgcttttgcgacccttgtaattgaaggtaaccatgtgaggttgagtggccaagatgttgaaaggggtacatttagtcatcgtcattctgttcttcatgatcaagtaacgggggaccggtactgtcctttagatcatcttatcttaaaccaaaatgaagagatgttcactgttagtaacagttctctttctgaattcgcagttcttggctttgaactgggttattccatggaaaatccaaactctcttgtactttgggaagctcaatttggtgattttgcaaatggtgctcatgttatgtttgatcagtttttaagcagtggtgaatctaaatggttgcgccaaactggacttgtttgtttgcttccacatggatatgatggacagggtcccgaacattcatctgctcgagtagaacgatatcttcagatgagtgatgacaatccctacacgatacctgagatggaacccacactcagaaaacagattcaagagtgcaattggcaggttgtgaatgtcactactcctgcaaattacttccatgttcttcggcgtcagatacatagggaattccgcaaaccgttaattgtgatagctcctaaaaatcttctccggcacaaagactgcaagtcaaatctatctgaatttgatgatgttcaaggtcatccaggatttgacatgcaaggaactcgattcaagcgtcttattaaggatcaaaataaccattctgaaagagaagagggtatcagacgtcttgtgttatgttctggaaaggtttactacgaacttgatgaccaaaggaagaaagttgatggcaaggatgtggccatctgcagagttgaacaactttgcccatttccttatgaccttattcagagagaactgaaacgatatccaaatgctgaaatcgtttggtgtcaagaagaaccaatgaacatgggtgcctactcttacatagcaccacgtctttgcactgcaatgaaagcactaggaagaggcaccatggaagatattaaatacgtcggtagaaacacatctgctgccactgcaactggtttctacagcgtccatttgaaggaacaggctggtcttgttgaaaaggcacttcagagtgatccaattaattatccctattgaattgccctccctttttccagagagatctgtgatgaaataataattgggtactccgttttggcggtatctatcttaactctaaacagttcgattataagagatttactatggtttgattttaccaagcatctatatggtttaattttgcagtttaaaacaatattgtaataaatatatttatatttaagcgagtgagtgagaaaatgataacactatgatttgaacacttttgatcgatagttatctgaataaaaacatgtttttttt

SEQ ID NO: 1840 - DNA, 3483 bp, Zostera marina
cagttccagtgaagttcgtttcctcagaaaagaaaattaactgctttctttggcactcactgctcgaacagtgtttttccacaaaacggagaattctaggggggttcctgattggtttttcaagtttaggatcaaggtcggacaaatctagattttagaattttcagactactaaacatggtgtggtttcggacagccacaaacataggaagattggctataagaaggagtttagctcaagcttctcatcatgccaaaaggcctcatttgttgccagcttccacagttcgtggatttcactcaacattccctaaatgtgctgctccagtccctcgacctgtgccactctcaaaattaactgacagtttccttgatgcttcaagcagtgtatacttggaggaacttcaaagaacctgggaggttgatccgaatagtgtcgatgagtcatgggataatttcttcaggaattttgttggacaggctgccacctcgcctggaatctctggacagacaattcaggagagtatgaggctgttgttgcttgtcagagcgtatcaagtcaatggacacatgaaggccaagcatgatcctttgggtctggagaagcgtgagatccctcatgatttgaatccagaattttatggattcactcaggctgattttgacagagaattctttattggggtgtggagtatgtcaggattcctttctgagaatcgtcctgtgcagacactccgttctatcataaatcgtctggagcaggcttattgtgggagtgttgggtatgaatacatgcatattgcagataaagaacaatgcaactggctgaggaataaaattgaaacagttaagccaagagaatataatgctgaacgacgtgaggtcattctagataggcttatctggagcacacagtttgagaattttcttgccacaaagtggacagctgccaagcggtttgggcttgagggaggggagtcgttaataccaggtatgaaggagatgtttgatagagcatccgaccttggtgtggaaacaattgttatcgggatgcctcataggggaagactgaatgttttagccaatgttgtcagaaaacctttacgtcagatttttaatgagtttagtggtggaacaaaaccagtggaggaacaagggttatacacaggaacaggtgatgtaaagtatcatctaggaacttcttatgatagaccaacccgaagtggaaaaatgatccatctttctttagtcgcaaatccaagtcatttggaagcagtcgatccagtggttgtaggaaagactcgggcaaaacagtatcattccaacgatgtcgataggaaaaagaatatgggaatattaattcatggagatggaagttttgctggtcagggtgtggtttatgaaactttgcatcttagtgcacttcctaattacacaactggtgggaccattcacttagtggtcaataatcaggtggcattcaccaccgatccaagagcaggaaggtcttcggattactgtacagatgtggctaaatctttgaatgttcccatttttcatgtgaatggggatgacatggaagcagtggttcatgtatttgaactggctgctgaatggcgccagaaattccactgtgatgctgttattgatattgtgtgctaccgtcgatttggacacaatgagattgatgagccctcattcacacaacctaaaatgtatcaggtgattcgaaaccatcctagttcacttgaaatttaccagaacaaacttttgaaacttggggtgatcacaaaagaaggtatcgaagcaatacacaacaaagtaaactccatcctgaatgaagaattcatcaacagcaaagattatgttaccaatcgaagggattggttatcagcttattggacaggattcaaatcacctgagcagatttcacgggttcgaaacactggtgttaatcctgaaataatcaagcgggttggtcaagctatcacaactcttccagaaactttcaagccacatcgggctgtcaagaagatttttgatctacgtgctcagatgattgaaactggagtcggaatagattgggctcttgctgaagctcttgcttttgcgacccttgtaattgaaggtaaccatgtgaggttgagtggccaagatgttgaaaggggtacatttagtcatcgtcattctgttcttcatgatcaagtaacgggggaccggtactgtcctttagatcatcttatcttaaaccaaaatgaagagatgttcactgttagtaacagttctctttctgaattcgcagttcttggctttgaactgggttattccatggaaaatccaaactctcttgtactttgggaagctcaatttggtgattttgcaaatggtgctcatgttatgtttgatcagtttttaagcagtggtgaatctaaatggttgcgccaaactggacttgtttgtttgcttccacatggatatgatggacagggtcccgaacattcatctgctcgagtagaacgatatcttcagatgagtgatgacaatccctacacgatacctgagatggaacccacactcagaaaacagattcaagagtgcaattggcaggttgtgaatgtcactactcctgcaaattacttccatgttcttcggcgtcagatacatagggaattccgcaaaccgttaattgtgatagctcctaaaaatcttctccggcacaaagactgcaagtcaaatctatctgaatttgatgatgttcaaggtcatccaggatttgacatgcaaggaactcgattcaagcgtcttattaaggatcaaaataaccattctgaaagagaagagggtatcagacgtcttgtgttatgttctggaaaggtttactacgaacttgatgaccaaaggaagaaagttgatggcaaggatgtggccatctgcagagttgaacaactttgcccatttccttatgaccttattcagagagaactgaaacgatatccaaatgctgaaatcgtttggtgtcaagaagaaccaatgaacatgggtgcctactcttacatagcaccacgtctttgcactgcaatgaaagcactaggaagaggcaccatggaagatattaaatacgtcggtagaaacacatctgctgccactgcaactggtttctacagcgtccatttgaaggaacaggctggtcttgttgaaaaggcacttcagagtgatccaattaattatccctattgaattgccctccctttttccagagagatctgtgatgaaataataattgggtactccgttttggcggtatctatcttaactctaaacagttcgattataagagatttactatggtttgattttaccaagcatctatatggtttaattttgcagtttaaaacaatattgtaataaatatatttatatttaagcgagtgagtgagaaaatgataacactatgatttgaacacttttgatcgatagttatct

SEQ ID NO: 1841 - DNA, 3474 bp, Arabidopsis thaliana
ctttcttacttttctttccttctttctctgtctcctagaagccacttcactgggatcgtctccatctttgatccaggttcagagattaaacaatttgaaaaatcggagactctgggattgtatggttcgttgttactgatagattacttaagctatggtttggtttagaatcggttcttctgtggcaaagcttgccataagaaggacactgtctcagtctcgttgtggttcatatgccactagaacaagggttttgccttgtcaaaccagatgttttcactctacaatactcaaatcaaaggcagagtctgctgcacctgttccacgtcctgtcccactttctaagctaactgatagcttcttagatggaacaagcagtgtgtatctagaggagttacaaagagcttgggaggctgatcccaacagtgttgatgagtcgtgggataacttttttaggaattttgtgggtcaggcttctacatcgcctggtatctcggggcaaaccattcaagaaagcatgcgtttgttgttgctagttagagcttaccaggttaatggccacatgaaggccaagcttgatcctttaggtctagagaagagagagattccagaggatctcacgccaggtctttatgggtttactgaggctgatcttgatcgggaattctttctgggtgtatggaggatgtcgggttttctctctgagaaccgcccggttcaaacactgaggtcgatactgtcgaggcttgagcaagcttactgtgggactatagggtatgagtacatgcacattgctgatagggataaatgtaactggttgagagacaagatcgagaccccaactcctcgacagtacaatagtgagcgtcggatggttatttatgataggcttacctggagcacacagtttgagaatttcttggctactaagtggaccacggctaaaaggtttggactggaaggtgctgaatctttgattcctggcatgaaggagatgttcgataggtctgcagatctcggggtagagaacatagttatcggtatgccccataggggtcgacttaatgttttgggtaatgttgttagaaaacctctacgccaaatattcagcgagtttagcggtggtactaggccagtagatgaagttgggctttacaccggaacaggtgatgtgaaataccacttgggtacatcttatgatcgtccaactagaggaggcaaacatctccacttgtctttggtagcaaatcccagtcacttggaagcagtagatcctgttgtgataggtaaaaccagagcgaaacaatattacacgaaagacgagaacagaacaaagaacatgggtattttgatccatggggatggtagctttgccggacaaggagtggtgtatgaaactctccatcttagtgcacttcctaactactgtaccggtggaacagtgcacattgtggtgaataatcaagtggctttcacaaccgatcccagggaaggaaggtcttcacagtattgcactgatgttgcaaaggctttgagcgccccaattttccatgtcaatgcagatgacattgaagcagtagtgcatgcttgtgagcttgctgctgagtggcgccagacgttccattctgatgttgttgttgatttagtatgctaccgtcgctttgggcataacgagatagacgaaccgtcattcacacaaccaaaaatgtacaaggtgatacgcagtcatccctcgtcacttcaaatctaccaggagaagctcttgcaatctggacaggtaacccaagaagatattgataagattcaaaagaaagtaagctctatcctcaatgaagaatatgaggcaagtaaagattatattccacaaaaacgtgactggctggcaagtcactggactggattcaagtctccggagcagatttctaggattcgaaacaccggagtgaagccagagattttgaagaatgtgggaaaggcaatctcaaccttccctgagaactttaagccacacagaggagttaaaagagtttatgaacaacgtgctcaaatgattgaatcgggagaaggcattgactggggacttggagaagcacttgcttttgctacactggttgtggaagggaaccatgttcggctaagtggtcaagatgttgaaagaggaactttcagtcatagacactcagtgcttcatgatcaagaaaccggggaggaatattgtcccctcgatcacctaatcaaaaaccaagaccctgaaatgttcactgtcagcaacagctccctttcagaatttggtgttctcggtttcgaactgggttattcgatggaaaatcccaattctctggtgatatgggaagctcagtttggagactttgctaatggcgcacaagttatgtttgatcagttcataagcagtggggaagccaaatggctccgtcaaactggtctagtagttttacttcctcatggatatgatggtcagggtcctgaacattccagtggaagattggaacgtttccttcagatgagtgatgacaatccttacgttatccctgagatggacccaactcttcgaaagcagattcaagaatgtaattggcaagttgttaatgttactacacctgccaactatttccatgttctgcgtcggcagatacacagggactttcgcaagcctcttatagtgatggcccccaaaaacttgcttcgtcacaaacagtgtgtatctaatctctcggaattcgatgatgttaaaggacatcctggatttgacaagcaaggaactcgatttaaacggttgatcaaagatcaaagtggccactctgatcttgaagaaggtatcagacgtctagtcctctgctctgggaaggtctactatgagcttgacgaagagcgaaagaagtctgaaacaaaggatgtagccatttgcagagtagagcagctttgcccatttccatatgatctcatccaaagagaactaaagcgatatccaaatgcagagatcgtgtggtgtcaagaagagccgatgaacatgggaggataccaatacatagccctaaggctttgcaccgcgatgaaagcactgcaaagaggaaacttcaacgacatcaaatacgttggtcgtcttccctcagctgctacagccacaggattttaccagcttcatgttaaggagcagactgatcttgtgaagaaagctcttcaacctgaccccatcacccccgtcatcccttaaaaaaacacagcttgagaggcttgagcctgtataaaaaagacacaacacaaaaataaaagattcatgagagaatctttggttaccaaagagtgtcactggaaaataaacagatgtttgctagacttacaaatttaagtttattcgatttgtttggtttgttataggatttaatcgagataaaaggaaaaaagatttaaaccgtttggtttagtatgataattcattaatttggttcaactttg

SEQ ID NO: 1842 - DNA, 3584 bp, Phalaenopsis aphrodite
acaaaaaggaaaggtaccgaacaagacgacgaaccaataaatacgaggagccttcaaagcgaggccgaagcttggaggaggaagaagaaggctttggtacaaagttgaattggtgataaagatatcggtgtctcctcaattcggagatactgaaaaggttgaggctcgccgggcttgcgattcaatccgatggcgtggtttcgcgccgcctctactgcggcgagagtcgcgcttcgcagaaacatagctcagtcttctcaccactgcaatagaaccctcgccgcgtcacctctgcccggtttccgagcctttcactcgacggttctccggcgaaaagctgccacgcctgtgccccgtgccgtccctctctcccgcctcaccgacagctttctcaatggtacgagcagcgtctacctcgaggagctccagcgtgcctgggaggcggatcccgacagcgtcgatgagtcatgggacaacttcttccggaactttgttggacaggccgccacttcgccgggaatatctggtcagacgatccaggaaagtatgcgcttgctgctcctcgttagggcttatcaggtctacggtcacatgaaggcaaatctcgatccgttggggctggaacagcgtgagatccctgaagatcttgatcccgctctgtacggattcaccgaggcagatttggatagagaattttttcttggggtgtggaggatggctggctttctttcggagaaccgtcccgttcaaacgcttcgtgcaatcttgaacaggcttgagcaagcttactgtgggactattggttatgaatacatgcacattgcagatcgagagaaatgcaactggttgagggagaggatcgagaccataaagcctcggggctacagtcaggagcgtagcgaggttatcctggacaggctcatttggagttcacagtttgaaaattttcttgccaagaagtggcctgcccagaaaaggtttgggcttgagggcgcagagactctgatcccgggcatgaaggaaatgtttgacagatcatcagatcttggggttgagagtattgtcattggaatgcctcacagagggagactgaatgttctaggaaatgttgtcaggaaaccacttaggcagatttttagtgagtttgacaaaaaaagcccaaggatgaggatggcttatacacgggaactggagatgtaaagtatcatctaggcacatcttatgacagaccaacgagaggtggaaggcaaattcatttgtctttgcttgcaaatccaagccatttggaggcggttgatccagttgtggttggtaaaacaagagcaaagcagtattactccaatgactttgacaggacaaagaacatgggtgttctaatccatggagatgggagctttgctgggcaaggtgttgtttatgagacccttcatctcagcgggttgcccaattacactactggtggaaccatacacattgtagttaacaatcaagttgctttcacgactgatccacaagctgggagatcttcgcagtattgtactgatgttgccaaagccttaagtgctcccattttccatgtcaatggtgatgacgtggaagcagtggtccatgtcagcgagcttgcatcggagtggcgccagaagttccattcagatgtggtggttgatatagtgtgctatcgtcgacatggtcataatgaaggtgacgagccttcatttacccaaccaaaaatgtaccaggtcattcgaaaccatccaaatgcacttgaaatttatgaaaagaaacttgtggagtcgggaacattttctagggaggatattgataagattaaccacaaagtggagaccatcttggaagaagagttcagttatagcaaagactatattccgaataaaagggactggctttctgcttattggactggattcaaatctccagaacagatatctcgtattcgaaatactggtgtgaaacctgaaattcttacgcgagttggggaagccatcacaaccatcccagaaaatttcaaagctcatcgaggtattaaaagagtttttgaccagagagcccagatgattcaaactggagagggcatagactgggcagttgcagaggctcttgcttttgcaacacttatagtggaaggaaaccatgtcagattaagtggccaagatgttgaaaggggcacatttagccatcgccatgctgttattcatgaccaagaaactggagatatatactgccctttagatcatttaactatgaatcagaatgaggagatgttcactgttagtaacagttctctttctgagtttgctgtcctcggctttgaattgggctactctatggagaaccctaattccctagtgctatgggaagctcagtttggtgatttcgccaatggtgcccatattatatttgatcagtttttaagcagtggagagtcaaaatggcttcgccaaactggactttgtgtgctgcttccccatggttatgatggtcaaggcccggaacattcgagtgcaagattggaacgttttcttcagatgagtgatgacaatccatatgttattccagagatggagccaacccttcggaaacagatccaggaatgcaattggcaagtcgtgaatgtcacaactccggcaaattatttccatgttctgagacgtcagctacacagggatttccgtaaaccattaattgtgatgtctcctaagagtcttcttcgtcataaggactgcaaatcaaacctttcagaatttgatgatgtggcagggcaccctggatttgacaaacaaggaacacggttcaaacgcctcattaaagatcagaatgatcacaaagatagggaagaaggcatcagccgccttgttctttgctctggaaaggtatattatgaacttgatgattatcgacagaaaagcaatcggaaggatgttgccatctgtagggttgaacaactttgtccctttccctatgatcttgttcagagagagctaaaacgatatccaaatgcggagattgtttggtgccaagaagaaccgatgaacatgggcgcatatcattatatcgctccgcgcctaggcaccgccctgagatcggttggcagggggactatggaagacatcaaatatgcaggaagggcaccttcggcttccacagccactggcttcttctctgttcatgagaaggagcagcatgagctggtagagaaggcgcttcagcctgagccaattaaattcccattctgattaaatcttatcagctttcaacaaaggaaataggtatctattcctttcgctgaattgaatttttccttgagaacataatttttgaataaactatatgtaattttttagagctttttggttttctcagtgtgaacggtatgttgaataatgcttgtaacatgtcttcttgctgaacttagaaataatgttaattccatataaacttcatatctgggaaggcacattttcacagtaaattacttctgaagtgaatgtattcttatagtttgttttgtgaaaggaaagtattatgaggtcttctctggtttaaaaaaaaaaaaaaaaccacgt

SEQ ID NO: 1843 - DNA, 3213 bp, Triticum aestivum
cgtaccaggagagcgatgcagctgctcctcctcgtgcgcgcctaccacggtcaacggccgacatgaaggcggcggcgtcgacccgcctggggcgtcgacgaccgcgccgtcgcccgacggacctccgacctccgccctcctacggcttcacggaggccgacctcgaccgcgagttcttcctcggggtctggatgatggcgggcttcctctccgagaaccggcccgtgctcaccctccgcgagatcctcagcaagctcgagcgcgcctactgcgggcccatcggcttcgagtacatgcacatccccgaccgcgacaagtgcaactggctccgggagaagatcgagaccgtcgcgcccagggagtaccccaaggaccgccgcctcgtcatgctcgacaggctcatctggagcacccagttcgagaacttcctcgccaccaagtgggccaccgccaagcggttcggcctcgagggcggcgagaccctcatccccggcatgaaggagatgttcgacaggtccgccgatctcggcgtcgagaacattgtcattggcatgccccacagggggaggctcaatgtgctggggaacgtcgtccgcaagcccttgtctcagatattcagtgagtttgctggcgggacgaggcctgtcgaaggcgaggatgggctctacactggaaccggtgatgtcaagtaccatctgggtacctcctacgaccggcccacccgtggtggcaagaggatccacttgtcgttggtcgccaatcccagtcatctggaggccgtcgatcctgttgtcattggcaagacgcgggcaaagcagttctactccaatgatgatgacaggacaaagaacatgggcattcttattcatggagatggcagctttgctgggcagggcgtggtgtatgagacgctccatctaagtgcccttccaaactacacaactggaggaaccattcacattgttgtcaacaatcaagttgccttcacaactgatccaagagccggcaggtcttcccagtactgcacggatgttgccaaggccgtgaatgtccctatattccatgttaatggtgatgatctggaggctgttgtacgtgtctgcgaacttgcagctgagtggcgccagactttccattctgatgtggtggtcgacctgatctgctaccgtcgttttggacacaatgaaattgatgagccatccttcacacagccaaagatgtatcaggtcattaagaaccatcccagttcattgaagctttatgaacagaaactgcttgaaacaggtgaagtcactaaagaagatgttcagaggatccacgacaaagtgaaccgaatcctaaatgaagagttcgctaaaagcaaagattatgttcccaacaagagggattggctctcggcttactggactggctttaagtcacctgagcaaatttcacgtgttcgcaacaccggggttaagccggaggtactgaaacgtgttgggcaagcaattactactctgcctgaaagcttcaagccccacagagcagtaaagaagatttttgagcagcgcgctgcaatgatcgagagtggtgaaggtattgattgggctgttgccgaagcccttgcctttgcagcactcatagttgaaggcaaccatgttaggctgagtggacaggatgtggaaaggggaacttttagccaccggcattcagttgtgcatgaccaggaaactggggcgaaatactgcccgctcgatcatgttgtgatgaatcaaaatgaggagctgtttactgttagcaacagttcactttctgaattcgctgttcttgggtttgaattgggctactccatggagaacccgaattcgctagtactctgggaagctcagtttggtgacttctccaatggtgcacaagtgatgttcgaccagtttctgagtagtggagaggcaaaatggctgcgccaaactggccttgttgttctactgcctcatggttatgatggccaaggtcctgaacactccagctcccgtttggagcgcttccttcagatgagtgatgacaatccttttgtcatacctgagatggacccaacacttcgcaagcagatacaggagtgtaactggcaggttgtgaatgtgacaacccctgcaaactatttccatgtgctgcgtcgtcagatacatagggatttccggaaaccgctgattgtgacggcccccaagaaccttcttcggcataaggagtgtaaatccaacctctctgagtttgatgatgttgaagggcacccaggatttgataagcaaggaacacgtttcaagcggctgataaaggaccgtaacgatcacaaggaagtcgaggagggtatcaaccgccttgtattatgttctggaaaggtgtattatgaacttgacgatgagcggaaaaagtccgagcgcagtgatgttgctatttgcagggttgagcaactttccccattcccatacgaccttatccagagagagctaaaaagatatccaaatgcggagatcgtgtggtgccaagaggagccaatgaacatgggcgcatacagctacatctcaccccgcctctactcagccatgaagaccctcgggcggggcacttttgaggacatcaagtacgtgggcagggcgccttcggccgccacagccaccggcttcttgacggtccacgtgcaggagcagtcggagctggtgaagaaggcattgcaaccggagccgatcaagttcccctgatgtgggaaaccctcgcaaaaataacccttcgcaggctcgggttgtccggcctgtgcacacaccgtcttaaaagttttggtctgtacaagttttttgttctcttttttcgttcttctgtgaggcgtttcgctccgaaggtcgtgaataatcaactgttatgaaccttcttgctgttgaggaggcgtgaggcccgtctcagcacgagcaacattcctgaatcatcatgatagttttactgacagcatggcactgccgtttatagttttttgcactggttgtgtttctgtgttcttctatgaatggtgctgaaggagattaaaacggcagcgggttgttatttctgctgtatctggcaatttgcagccgtgcatctgtaggatattgggagtacacggcttcatcaactgcccaaattgcatctgcatttcagctcagaagagaaactgatgctcgtctgggtatttctgaacttgtt

SEQ ID NO: 1844 - DNA, 3389 bp, Arabidopsis lyrata
ctttcttacttttccttctctctttctctgtctcctagaagctacttcactgggatcgtcttcatcattgatccaggttcagagaaaaaaaaattcgagattctgggattgtatgatttgttgttggctgatagattacttaagctatggtttggtttagaactggttcttctgtggcaaagcttgccataagaaggacactgtctcagtctcagtgttgttcatttgccactagaacaagggttttgccttctcaaacccgatgttttcactctacaatactcaaatcaaaggcagagtctgctgctcctgttccacgtcctgtcccactttccaagctaactgatagcttcttagatggaacaagcagtgtgtatctcgaggagctacaaagagcttgggaggctgatcccaacagtgttgatgagtcgtgggataacttttttaggaactttgtcggtcaggctgctacatctcctggtatctcggggcaaaccattcaagaaagcatgcgtttgttgttacttgttagagcttatcaggttaatggacacatgaaggccaagcttgaccctttgggtctagagaagagagagattccagaagatctcacgccaggtctttatgggtttactgaggctgatcttgatcgggaattctttctgggtgtatggaggatgtcgggttttctctctgagaaccgtccggttcaaacactgagggctatactgtcgaggcttgagcaggcttactgtgggactatagggtatgagtacatgcacattgctgatagggataaatgtaactggttgagagacaagatcgagaccccaacacctcgacagtacaatagtgagcgtcggatggttatttatgataggcttacctggagcacacagtttgagaatttcttggcttctaagtggaccacggctaaaagatttggactcgaaggtgctgagtctttgattccaggcatgaaggagatgttcgataggtctgcagatctcggggtagagaacatagttatcggaatgccccataggggtcgacttaatgttttgggtaatgttgttagaaaacctctacgtcaaatattcagcgagtttagtggtggtactaggccagtagatgaagttgggctttacaccggaacaggtgatgtaaaataccacttgggtacatcttatgatcgcccaactagaggaggcaaacatctccacttgtctttggtagcaaatcccagtcacttggaagcagtagatcctgttgtgatgggtaaaaccagagcgaaacaatattacacaaaagacgagaacagaacaaagaacatgggtgttttgatccatggggatggtagctttgccggacaaggtgtggtatatgaaactctgcatcttagtgcacttcctaactactgtaccggtggaacagtgcacattgtggtcaataatcaagtggctttcacaaccgatcccagggaaggaaggtcttcacagtattgcactgatgttgcaaaggctttgagtgccccaatttttcatgtcaatgcagatgacattgaagcagtagtgcatgtttgtgagcttgctgctgagtggcgccagacattccattctgatgttgttgttgatttagtatgctaccgtcgctttgggcataacgagatagacgaaccgtcattcacgcaaccaaaaatgtacaaggtgatacgcaatcatccctcgtcgcttcaaatctaccaggagaagctcttgcaatctggacaggtaacagaagaagatattgataagattcaaaagaaagtaagctctatcctaaatgaagaatttagggcaagtaaagattatattccacaaaaacgtgactggctggcaagtcattggactggattcaagtcaccggagcagatttctaggatccgaaacactggtgtgaagccagagattttgaagaatgtggggaaggcaatctcaaccttcccagagaacttcaagccacaccgaggggtgaaaagagtttatgaacaacgtgctcaaatgattgaatcgggagaaggcattgactggggacttggagaagctcttgcttttgctacactggttgttgaaggcaaccacgttcggctaagtggtcaagatgttgaaagaggaactttcagtcacagacactcagtgcttcatgatcaggaaactggcgaggagtattgtcccttagatcacctgaccatgaaccaagaccctgaaatgttcactgtcagtaacagctctctttcagaatttggtgttctcggtttcgaactgggttattcgatggaaaatcccaattctctggtgttatgggaagctcagtttggagactttgctaacggcgcacaagttatgtttgatcagttcataagcagtggggaagccaaatggctccgtcaaactggtctagtagttctacttcctcatggatatgatggtcagggtcctgaacattccagtggaagattggaacgtttccttcagatgagtgatgacaatccttacgttatccctgagatggatccaactcttcgaaagcagattcaagaatgtaattggcaagttgttaatgttactacacctgccaactatttccatgttctgcgtcggcagatacacagggacttccgcaagccccttatagtaatgtctcccaaaaacttgcttcgtcacaaacagtgtgtatctaatctctcggaattcgatgatgttaaaggacatcctggttttgacaagcaaggaactcgatttaaacggttgatcaaagatcaaagtggtcactctgatcttgaagaaggtatcagacgtctagtcctctgctctgggaaggtctactatgagcttgacgaagagcgaaagaagtctgaaacaaacgatgtagccatttgcagagtagagcagctttgtccattcccttatgatctcatccaaagagaactaaagcgatatccaaatgcagagatcgtgtggtgtcaagaagagccgatgaacatgggaggataccaatacatagcactaaggctttgcaccgcgatgaaagcactgcaaagaggaaacttcaacgacattaagtacgttggtcgtcttccatcagcagctacagctacaggattttaccagcttcatgttaaggagcagactgatcttgtgaaaaaagctcttcaacctgaccccatcacccccgtcctcccttaaattggacagcttgagaggcttgagcctcttataaagaaagaccaacacaaaaataaagattcctgagagaatgaatctttttggttaccaaatagtgtcactggaaaataaacagatgtttgctagacttacaaatttaagtttattcgatttgtttggtttgtt

SEQ ID NO: 1845 - DNA, 3385 bp, Taxus baccata
gatgctttacggaaacttcagaagccctggatttagcggccatgtacttttcataggctttcctctggtttattgaggacagccctgagggtccgtctggctcagcagtcctcgcatacgaaaagaccattgctatggatccttccacatggccgatctttacactcgacgccacataatttccagcaatcgacggccgcagtgccgcggtcggtgccgctatcgaagctcactgacagtttcctcgatgggacgagtagtgtttatttagaggaattgcagcgagcctgggaatccgatccccagagcgtggatgaatcatgggacatgtttttcaggaattttgttggacaggctgtgaccacgcccggggtttctgggcaaacaatccaggagagcatgaggcttttgctgctggtgagggctcatcaggtgaacggtcacatgaaggctaagctggatcccttgggtttggagcagagggaaattcctttggatttggacccggctctatatggattcaccgaagcggatttagacagagagtttttccttggtgtatggcggatgtccggatttttatcggagaatcggccagtccaaaccctgaggtcgattctgaatagattggagcaggcttactgtggtacaattgggtatgaatacatgcacatacctgaccgtgataagtgcaattggctgagggaaaaaattgagacagtaattcccagtaagtatggcccggaacgaaggcatgttatactcgatagactaatttggagcacacaatttgagaattttttggcaacgaaatggactgctgcaaaacgttttggtcttgaaggtgccgagaccttgattccaggaatgaaagagatgtttgatagatctgctgacatgggtgtggaaagcattgttataggtatgtctcacagaggaagattgaatgtcctgtgcaatgtggtcaggaagccgttaagacagattttcagtgagtttagtggtggcacgaagccgattgatgaagttggaacttacaccggaacaggtgatgtgaaataccatttaggaacatcatatgataggcctaccagaggtgggaaacgtattcatctttctctagttgctaatcccagtcatttggaagcggtcgatcctgttgttgttgggaaaacccgagcaaaacagtattattcaaatgataaggataggacgaagaacatggctgtattgattcatggagatggaagttttgctggacagggcgtagtttacgagacattgcatttgagtgctcttcctaattacacaactggagggactattcacattgtagtcaataatcaggttgcgtttacaactgatcccaaatcagggagatcttcacaatactgcacagatgttgcaaaagctttgaatgctcccatcttccatgtgaatggagatgatatggaagctgtggtgcacgtatgtgaacttgctgctgagtggcgtcagattttccactccgatgttgtggtggatattgtttgctaccgtcggtttggacacaatgagatcgacgagccatccttcacacaaccaaaaatgtacaaggtaattagaaatcatccacgggcgcttgatttgtatgaaaagcagctaattgaatcagggcagttgtcaaaggaagaaattgatgctttgcatgaaaaagtcagctcaattttgaatgaagagtttgtaaacagcaaagaatatgtgccaaagagacgagattggttatcagcatactggtctggcttcaagtcaccagagcaattgtctcgtatacgtaatacaggggtcaaaccggagatattgaaaaatgttgggaaagcaataacttctttaccagaaacattcaatccgcatagagctgtaaagaggatttttgagcaacgtgcacaaatgattgaaaagggggaaggtgtagattgggctgttggtgaagcacttgcatttgcaacactccttgtagagggtaatcatgtgaggctgagtggccaggatgttgaaagaggtacattcagtcaccgacatgcagttcttcacgaccaggaaacaggagaaagatattgccctcttgaccatgttattatgaaccaaaatgaagaaatgtttactgtgagcaacagctctctctcagagtttggtgtgctcggcttcgaattgggctattccatagaaaatcccaattcattggttctgtgggaagcccaatttggtgattttgcaaatggtgcccaagtcatttttgaccaatttataagcagtggggagtcaaaatggcttcgtcaatcaggccttgttgttttgcttccacatggctatgatggccagggtccagagcattcaagcgcaagattagagcgctttctacagggtagtgatgacaatccttttgtgattcctgaaatggatcccacattgcgcactcaaattcaacagtgcaattggcaagttgtgaatgtgaccactcctgccaattactttcatgttcttcgtcgtcagatacaccgggatttccgtaaaccattgattattatgtctccaaagaaccttcttcgacacaaggactgcaagtcaaatctgtctgaatttgatgatgtgcaaggccatccaggattcgacaagcagggaacccgatttaagcgtcttattaaggataagaatgaccactctgatcgggaagaaggcattcatcgtctaatactttgttctggaaaggtctactatgaacttgatgaagaaaggcaaagagtccaaaggaaagacgttgctatttgtcgaattgaacaattatgcccattcccttatgatctagtgcagcgtgaattgaagcggtatccaaatgcagagattgtctggtgccaggaagagcccatgaatatgggaggatatcattatatttctcttcgtcttttaactgccatgaaagcactaggtcgaggtacatttgaagatattaagtatgttggtcgagctccatcagctgcgacagcaacagggttttatcaggtgcatggacaggagcagagagaactcttagagacagcactgcagtctgctccgatcaagtttccttgatgtatatttattagaaaaagaagtttagatttttaataatggggatggaaaatgtgcagcatcctctgtttaatactattccacttccagagtttccttctgaaataatgtatcctgtagtatgaaaccaacatctatttttgggtacaggctgattgagcatccctctttcttgttggaatggggtggtctatttattttttcatttttatgccaaacattttaaggtaataatatgtgtagatctgaccttattgaaatcaagacggttgtattt

SEQ ID NO: 1846 - DNA, 3553 bp, Solanum phureja
agcagccgctcaatgttgaatcttctcatttctccttcaattttttttcattcgccatgttcgttctagggtttcagaacttctaaggtgttatccatgtattatgattgttgttgaggtttgaattaagtgaagagattatcaaagctttcgaagagttcatctattcagaatttaagtcacggtaatggcgtggtttagagctagctcaagtgtggcaaagcttgctattagaagggctctatcacagggtggttcttacatcccaagaactcgcatacttccatcacaaggtcgatattttcataccacagttgtcaggccaaaggcacaagctgctcctgtcccaagaccagtgccactttccaagttgaccgacagcttcttagatgggacgagcagcgtctaccttgaggagctccagcgagcatgggaacaagacccaaacagtgttgatgagtcgtgggataatttcttcaggaattttgttggacaagctgccacgtctcccgggatttcaggccagacgattcaagagagtatgcgtcttctgttgctcgtgagagcttatcaggttaatggtcatatgaaagcaaaacttgatccattagatttggaagcgagggaaatacctgatgatttggatccagcattatatgggttcactgaagctgatctcgatagagagttcttccttggtgtttggaagatgtctggattcttgtctgagaatcgtcctgtgcaaactttgaaggcaatattaacacgacttgagcaggcttattgtggaagcattgggtatgagtacatgcatatttctgatcgtgataaatgcaattggttgagagagcggattgaaaccccaacatctatggagtacaatcgtgagcgacgggaagttattcttgaccgactgatgtggagtactcagtttgagaacttcttggctacgaagtgggcggcagccaagagatttggccttgaaggttgtgagaccttgattcccggcatgaaggagatgtttgacagggcagcagatcttggagttgagagcatagttattgggatgccacatagaggaagattaaatgttttgggtaatgttgttcgaaagccactaaagcagatcttcagcgagtttagcggtggtataaaacctggggatgatgctggttatgtcggaactggtgatgtcaagtatcacttgggaacttcttatgatcggcctactaggggtgggaaaagaattcatctatctttggttgcaaatccaagtcacttggaagctgtggatccagttgttattggaaaaactagagcaaagcaatattatacgaatgacgagaatagaacaaagagcatgggtattttgctccatggtgatggtagctttgcaggccaaggtgttgtctatgagacattgcatctgagtgctcttccgaattacacaaccggtgggaccattcacattgtggtgaataatcaagtggcgttcactactgatccaacggctggaagatcatctcagtactgtactgacgttgcaaaggcattggatattccaattttccatgtcaatggtgatgacgttgaggctgttgctcatgtgtgtgaacttgctgcagaatggcgccagaaattccatgctgatgttgtggttgatattgtctgttatcgtcgatttggacacaatgaaattgatgaaccatccttcacccagcctaaaatgtataagatcatcagaaatcatccttcttcattggagatctatcaaaacaaactcctaaattccggtcaggtggcaaaagatgatgtggaaaagatacataataagatcaatagaatccttaatgaagagttcattgctagtaaagactatgtgcctcaaaaaagagactggctttctgctttttggtctggttttaagtctccttcacagctttcacgtgttcgaaacaccggtgtcaaacctgagattttgacgaatgtcgggaaagcaatcactacgtttccagatggttttaagcctcacagagcattaaaaagggtttttgatgaccgtcgaaagatgattgagacaggggagggtgtcgactgggctgttggagaagcacttgcttttgcaacattgcttgtggaaggtaatcatgttaggttgagtggtcaggatgttgagagaggtactttcagtcacagacattctgttattcatgatcaggagacaggggcacagtactgtcctcttgatcatgttatgatgaaccaaaatgaagagatgttcactgtgagcaacagctccctttcagagtttggtgttttgggatttgaattgggttattcaatggaaaatccaaattcgttggtaatttgggaagctcaatttggtgattttgctaatggagctcaagtaatatttgaccagtttgtgagcagtggagaagcgaaatggttgcgccagactggattggttgtgcttttgccacatggttatgatggtcagggccctgagcattcaagtggacgtttggaacgtttcctccagatgagtgatgacaacccatttgttatcccggagatggaacctacactacggaagcagattcaggaatgtaattggcaggtggtgaatgtaacaactccagcaaattatttccatgttttgcggcgtcaaattcacagagatttccgtaagcctctcattgtgatggccccaaagaacttgcttcgtcacaagagctgcaagtcaaatctatccgagtttgacgatgtccaaggtcatccaggttttgacaaacaaggtaccaggttcaagcgtctgataaaagatcagaaggagcactcggatcttgaagagggtatcagacggctggtcctttgctcaggaaagatctattatgagcttgacgaagaaagagctaaagctgatgggaaagacattgctatctgtcgggtggaacagctttgccctttcccatatgaccttatccagcgtgaattgaagcgatatccaaatgcagagatagtttggtgccaagaagagccaatgaacatgggcgcattcaattacattgcaccacgcctttctactgccatgaaatcactaggcagaggtaacatggatgatatcaagtatgttggtcgtgctccttctgctgcgacagccactggtttcttccaggttcacgtgaaagaacagaccgagcttgtccagaaagcgctgcaacaggatccgattaatcaattctgaagcttgaaccgttgatgtacacccatagcactggcctccaaaaatgacgcgacgatagatatgttaagctatgctctgtgcctggtatagccagtgtgagttttaatttgctttttggaaaaataaggcctttttgtttgtgctagttttcagtcagttacacagtttaaactgatgctttcatacgtatacatatttcagttggttaaacaattttgatcaacaatacaactcactcagacttatccttgttacctctagttcggtattttgcgatacggtaaattagtgaccatatcttgttca

SEQ ID NO: 1847 - DNA, 3364 bp, Fragaria vesca
ctatgaggtggtttagagcaggggctggtgtggcaaagcttgccgttaggaggtcgttatcgactagcggatcctacaatgtgacaaggagtgttgttccggcgcagaatcggtacttgcacaccacaatatgcaagtccaaggcggaggctgcgccggttcctaggccggtgccgctttctaggcttactgatagttttttggatgggaccagcagtgtgtatttggaaggacttcagagggcctgggaagctgaccccaatagcgttgatgagtcgtgggataatttctttaggaactttgtggggcaggcctctacgtcgcctgggatttcggggcagactattcaggagagtatgagactgttgctgcttgtgagggcttaccaggttaatggtcatatgaaggctaaactagatcctttgggcttggagcagagggatatccccgatgatttggaccctgcgctatatgggttcactgaggctgatcttgacagggagttctttttgggggtttggaggatggctgggtttctttctgagaatcgtccagtgcagacccttaggtccatattgactcggcttgagcaggcctattgtgggagcattgggtatgagtatatgcatattgctgatagaaacaaatgtaactggttgagggataagattgagacccctacgacgatgcagtataaccggcagcgccgtgaggttattcttgacaggcttatttggagtacacagtttgagaacttcttggccacaaagtggacaacagcaaagaggttcgggcttgaaggttgtgaaactctcattcctggtatgaaggagatgtttgatagggcagcagatcgtggggttgagagcatagttattggaatgccacaccgaggaagactgaatgtattgggtaatgttgtccgaaaacctttgcgtcagatatttagtgaattcagtggtggcacaaagccggtagatgaagttggactctacacagggactggtgatgtcaagtatcacttgggaacttcttatgatcgaccgactagaggtgggaagagaattcatctctctctagttgcaaatccaagtcacttggaagccgtggatccagttgttgttgggaaaactagagcaaagcaatattattcaaatgatgtggacagaaccaagaatatgggggttttgattcatggagatggtagctttgctggacagggagtggtctatgagactctgcatcttagtgctcttcctaattacaccaccggtgggactatacacattgtggtgaacaaccaagttgccttcacaactgacccaatgtctggtagatcttcagagtactgcactgatgttgctaaagcattgaacgcccctattttgcacgttaatgctgatgacatggaggcagtcgttcatgtctgtgagcttgcagctgagtggcgccagactttccattctgatgttgtagttgatttagtgtgttatcgtcgctttgggcacaatgagattgatgagccatcatttacgcagcctaaaatgtacaaggttatcaggaatcatccaaaccctctaactatttacaaaaacaaacttttagagtctggacaggtgacacaagaagatattgagaggatacagagcaaggttactactatcctaaatgaagagttcttagctagcaaagattacgttcctcaaagaagggactggctttcatcccattggtccgggttcaagtcaccagaacagctttctcgtatccgtaatactggtgtaaaacccgagattttgaagaatgttggtaaagcaatcacagccctaccagaaaattttaagcctcacagagcagtaaagaaggtatatggagaacgtgcacaaatgattgagactggtgaaggcattgactgggccgttggagaagcacttgcctttgctacactgctagtagaaggtaaccatgtacgattgagtggacaggatgttgagagaggtacatttagtcatcgacattctgtacttcacgaccaggaaacaggggaaaggtattgccctctggaccatgttattgcgaaccaagatgaggagatgtttacagttagcaacagctcactgtcggagtttggtgttcttggatttgaattgggctactcgatggagaatccaaatgcattggtgatttgggaagctcaatttggtgattttgcaaatggggctcaagttatttttgatcagtttttgagtagcggggagtcaaagtggcttcgccaaactgggcttgttttactgcttccacatggttatgatggtcagggacctgaacattctagtgcaagattggagcgttttcttcagatgagtgatgacaatccttatgtcatacctgagatggatcctacacttaggaagcaaattcaggaatgcaattggcaggttgtgaatgtgaccactcctgctaattatttccatgtcctgcgtcgtcagataaacagggatttccgcaagcctcttgttgtgatggctcctaaaaacttgcttcggcacaaggactgcaaatcaaatttatctgagtttgatgatgttcaaggccacccaggttttgacaagcagggaaccagatttaaacgcctcattaaagatcaaaatgaccactctgatctggaggagggtattagaagacttgttctttgctctgggaagatttactatgagattgatgaagagcgaagaaaggccagtgcaaaggatgttgcaatatgtagagtggaacagctttgtcccttcccatatgacctcatccagcgagagctgaagcgatatccaaatgctgagatagtttggtgccaggaagagccaatgaacatgggtgcctacaactacattgcgcctcgcctatgcaccgccatgaagtcattgagcagaggaactatcgatgacatcaaatacattggccgcgctccatctgctgcaacagccactggtttctatcaagttcacctcaaggaacaagcagacattgtgcataaagcagtgcagccggagccaatagattaaattgattggagtaggggactctgactgctggaaatcatacaataatgtatttgcttagatactatatgaaatgtcctgaatctgttgattcaaaacaattgcttcaaaacaattgctattgctatattttgatcatctagccaccatggtatcccatcattcccatgcaagttaatagcatgtctagttttgattgttctggttgagaataatgtgaagctgttttgtaataacacaaggcttggtaactttgaatttctgtttgtttgtttatttatttatttacactttcaaggaatctttga

SEQ ID NO: 1848 - DNA, 3523 bp, Solanum lycopersicum
attctcttcagtagcagccgctcaatgttgaatcttctcatttctccttcaaaaaattttcattcgccatgttcgttctagggtttcagaactcttaaggtgttatccatgtataatgattgttgttgaggtttgaatttcgtgaagagattatcaaagctttcgaagagttcatctagatatcagaattcaagtcacggtaatggcgtggtttagagctagctcaagtgtggcaaagcttgctattagaagggctctatcacagggtggttcttacgtcccaagaactcgcatacttccatcacaaggtcgatattttcataccacagttgtcaggccaagggcacaagctgctcctgtcccaagaccagtgccactttccaagttgactgacagctttttagatgggacgagcagtgtctaccttgaggagctccagcgagcatgggaacaagacccaaacagcgttgatgagtcgtgggataatttcttcaggaattttgttggacaagctgccacatctcctgggatatcaggccagacgattcaagagagtatgcgtcttctgttgctcgtgagagcttatcaggttaatggtcatatgaaagcaaaacttgatccaattagatttagaagcgaggcaaatacctgaatgatttggatccagcattatatgggttcactgaagctgatcttgatagagagttcttccttggtgtttggaagatgtctggattcttgtctgagaatcgtcctgtgcaaactttgaaggcaatattaacacgtcttgagcaggcttattgtggaagcattgggtatgagtacatgcatatttctgatcgtgataaatgcaattggttgagagagcggattgaaaccccaacatctatggagtacaatcgtgagcgacgggaagttattcttgaccgactgatgtggagcactcagtttgagaacttcttggctacgaagtgggcagtgctagccaagagatttggccttgaaggttgtgagaccttgattcctggcatgaaggaaatgttcgaccgggcagcagatcttggagttgagagcatagtcattgggatgccacatagaggaagattaaatgttttgggtaatgttgttagaaagccactaaagcagatcttcagcgagtttagcggtggtataaaacctggggatgatgctggttatgttggaactggtgatgtcaagtatcacttgggaacttcttatgatcggcctactcggggtgggaaaagaattcatctatctttggttgcaaatccaagtcacttggaagctgtcaatccagttgttattggaaaaactagagcaaagcaatattatacgaatgacgaggatagaaccaagagcatgggcattttgctccatggtgatggtagttttgcaggccaaggtgttgtctatgagacattgcatctgagtgctcttcccaattacacaaccggagggaccattcacattgtggtgaataatcaagtggcgttcactactgatccaacagctggaagatcatctcagtactgtactgacgttgcaaaggctttggatattccaattttccatgtcaatggtgatgacgttgaggctgttgctcatgtgtgtgaacttgctgcagaatggcgccagaaattccatgctgatgttgtggttgatattgtctgttatcgtcgatttggacacaatgaaattgatgaaccatccttcacccagcctaaaatgtacaagatcatcagaaatcatccttcttcattggagatctatcaaaacaaactcctaaattccggtcaggtggcaaaagatgatgtggaaaagatacataataagatcaatagaatcctcaatgaagagttcattgctagtaaagattatgtgcctcaaaaaagagactggctttctgctttttggtctggttttaagtctccttcacagctttcacgtgttcgaaacaccggtgtcaaacctgagattttgacgaatgtcgggaaagcaatcactacgtttccagatggttttaagcctcacagagcattaaaaagggtttttgatgaccgtcgaaagatgattgagacaggggagggtgttgactgggctgttggagaagcacttgcttttgcaacattgcttgtggaaggtaatcatgttaggttgagtggtcaggatgttgagagaggtactttcagtcacagacattctgttattcatgatcaggagacgggggctcagtactgtcctcttgatcatgttatgatgaaccaaaatgaagagatgttcactgtgagcaacagctccctttcagagtttggtgttttgggatttgaattgggttattcaatggaaaatccaaattcgttggtaatttgggaagctcaatttggtgattttgctaatggagctcaagtaatatttgaccagttcgtgagcagtggagaagcgaaatggttgcgccagactggattggttgtgcttttgccacatggttatgatggtcagggccctgagcattctagtggacgtttggaacgtttcctccagatgagtgatgacaacccgtttgttatcccggagatggaacctacgctaaggaagcagattcaggaatgtaattggcaggtggtgaatgtaacaactccagcaaattatttccatgttttgcggcgtcaaattcacagagatttccgtaagcctctcattgtgatggccccaaagaacttacttcgtcacaagagctgcaagtcaaatctatccgagttcgacgatgtccaaggtcatccaggttttgacaaacaaggtaccaggtttaagcgtctgataaaagatcagaatgatcactctgatcttgaagagggtatcagacggctggtcctttgctcaggaaagatctattatgagcttgacgaagaaagagctaaagctgatgggaaagacattgctatctgtcgggtggaacagctttgtcctttcccttatgaccttatccagcgtgaattgaagcgatatccaaatgcagaggtagtttggtgccaagaagagccaatgaacatgggtgcattcaattacattgcaccgcgcctttctactgccatgaaatcacttggcagaggtaacatggatgacatcaagtatgttggtcgtgctccttctgctgccacagccactggtttcttccaggttcacgtcaaagaacagaccgagcttgtccagaaagcgttgcagcaggatcctatcaatcaaatctgaagcttgaacgttcatgtaccccataacactggcctccaaaaatgatgcgacgatagaaatgttaagctattctctgtgcctcgtatagccagtgtgagttttaattttgctttttggaaaaataaggcctttttgtttgtgctagttttcagtcagttgcacagtttaaactgatgctttcatacatatacgtatttcagttggttaaacaattttgatcaacaatacaactcactcggacttatccttgttacct

SEQ ID NO: 1849 - DNA, 3330 bp, Amorphophallus konjac
cttctgaggtcggtcggccatggcgtggttcagagccgcctccggcgcggtcaggcacgccgtccggaggaacctcgcgcgggcctcccaccatgtccccaggccccgccccctcccgccgcccgcccgcggcttccactccacaccgcttcggcccaaggccgcccccgttcctcgccccgtccccctctccaggctcaccgacagcttcctcgatggcacgagcagcgtctacctggaggagctgcagcgggcctgggaggccgaccccaacagcgtcgacgagtcctgggacaacttcttcaggaacttcgtggggcaggccgccacctccccggggatctccggccagaccatccaggagagcatgcggctgctgctgctcgtcagggcgtaccaggtgaacgggcacatgaaggccaagctggaccctctggggcttgaggagcgcgaggtcccggatgacctggaccccgcgttctacggattcacggatgcggatttggacagggagttctttatcggggtgtggaggatgtccgggttcctgtctgagaaccgccccgtgcagacgctgcggtcgatactgaaccggcttgagcaggcctactgtgggagtgttgggtacgagtacatgcacatcgcgaatagagaacagtgcaattggttaagggacaagatagaaacagttaatccgaggagctacagccgggagcggcaggaggtcatccttgacaggctcatttggagcaccctgtttgaaaatttccttgccacaaagtgggtaactgcgaaaaggttcgggcttgaaggtgcggagactctgattcccggaatgaaggagatgtttgatagagcagctgaccttggtgtggagaatatcgtcgtcgggatgccgcacagaggtagattgaacgttttgggtaatgtcttccgcaagcctcttcgtcagatctttagcgaattcagtggcagtggcacgaaggcagtagatgaggatgggctgtacactggtactggtgatgtgaaataccatctgggtacctcgtatgatcgtcccacgagaggtggaaagagaattcatttgtctcttgttgcaaatcctagccatttggaggctgtggatcctgttgtggtgggaaagaccagggcgaagcagtattactctcatgacaccgaaaggacaaagaatttggcggttctaatgcatggagatggaagttttgctgggcagggtgtggtttatgagactcttcacttaagcgcgcttcctaactacaccactggtgggactgttcacattgtggtgaacaaccaagttgcatttacgactgatccgaagtctgggaggtcctcacagtattgcacggatgttgcaaaagcattaaatgcccctatttttcatgtgaacggagatgacatggaagcagtggtccatgtttttgagcttgctgcagaatggcgccagactttccatacggatgtggtggttgacattgtatgttaccgtcgattcgggcacaatgagatggatgaaccctctttcacacagccgaaaatgtaccaggtgatccgcagtcacccaagtgctcttcaaatttaccaaaaggagcttctggaatctgaacgtatcacaaaagaagaaattgaccaaatacagaacaaggtcaattctatcctgaacgaagagttcaacaacagcaaagattatattcccaaaagacgggattggctttcagcatattggtctggattcaaatcacctgagcagatatcccgtattcgtaacactggtgttaaacctgagattctgaagcgtgttggtgaagccattaccactcttccagaaaacttcaaacctcacaaagttgttaagagagtttttgatgagcgagctcagatgattcaaacgggtgaaggtgttgattgggcagtcgctgaggcacttgcctttgccacacttctagtggaaggtaaccatgtcaggttgagtgggcaggatgttgaaaggggcacatttagccatcgacatgctgtggttcacgatcaagaaactggggaaatatattgtcctctggaccatgtcatcatgaaccaaaatgaagagatgtttaccgtcagcaacagctctctttctgaatttggggttcttggttttgagttgggctactcgatggagaatcctaattccttggttctttgggaagcccagtttggtgactttgcaaatggcgcccaagtaatttttgatcagtttttgagtagtggtgagtccaaatggctgcggcaaactgggcttgtttgcttgctcccccacggatatgatggacaaggacctgaacactcatctgcaagattggagcgttacctgcagatgagtgatgaccatccttatgtgatacctgagatggatccaactctgaggaaacagatccaggagtgcaattggcaaattgtaaatgttactacaccagcaaactatttccatgttttgcgtcgccagatacataggaagttccggaagcctctgatagtgatgtctcctaagaatttgctcaggcaccccaagtgcaagtccaatttatcagaatttgatgatgttcaaggtcaccctggatttgacaagcaaggaacacgcttcaagcgtcttatcaaggatcagaatgaccactctgatcttgaagagggaatcaggcgtttgattttatgttccggaaaggtgtattatgaacttgatgatgaacggaaggcagctgatgccaaggacatagcaatctgcagagtcgaacaactgtgcccattcccatatgacctcattcagcgtgaactgaaacgatatccaaaagcggaggtcgtgtggtgtcaagaggaaccgatgaacatgggagcatacagctacatatctcctcgtctttggactgccatgaaggccctcggcagaggttctatggaagatgttaaatatgtcggccgtccaccatttgctgccacggctactgggttcttgaaagttcatcaacaagagcagaaggagcttctccagaaagccatccagcgtgatcccatcgagttccctggttgagatctgtttcttttcttatatatagggaataaatgtgtggtgctatatcttggtcaaccggctgcttcatacagtatcttggcagcatactgccttcatgttttcacattcttgaaaacacttttagccttgaaacacatctactttcacacgcatttaccttttttttttgagggggagaatgccgtgccccactatatttaagcttttgaatcataaaggtgtgcctctatatcttaacttggttg

SEQ ID NO: 1850 - DNA, 3298 bp, Arnica chamissonis
gccactgtccgtatacttttcattagtcggttctaattgaacgaggcttttcaacgcaatgaaacaatttatcaatctccatttctagattcgagcacaaaaagcagcggtttcaagtttctgcaaatctaggtctttgagatcatttaagaaacagagaacctgaagtttgaagaaaatgacgtggttcagggctggatctagtgtggcaaagcttgcaatcagaagaaccttaacacaaagtggatcatatgcagcaagaaagcgtgttttttcttcagaaagccggtatttccatacaacggtcttcaaatcgaaagcacaatcggcacctgtccctagaccggttccactttctaggttaacagatagctttttagatggaactagcagtgtctacctggaagaacttcaaagagcttgggaagatgatccaaacagtgttgatgagtcatgggacaatttcttcaggaactttgtgggccaggctgccacatcacctggaatatctggccagacaatacaagaaagcatgcggttgttgttgcttgttagagcataccaagtttatggtcacatgaaagccaaaatcgatccattgggtcttgaaaaaagagagattcctgatgatctagatcctgctttttacggtttcagtgaagctgatttagaccgtgaattttttcttggagtatggagaatgtctggatttttatctgaaaatcgacctgtacaaactcttagatcaatattaaccagacttgaacaagcttatagcggaagcatcggttatgagtacatgcacattgctgaccgtgaacgatgtaattggttaagagatagaatcgagaccccaactcgaactcaatataatagcgaacgccgtgaggttattcttgacagactcatttggagtactcagtttgaaaactttttagctactaaatggacagctgctaaaagatttgggcttgaaggcggtgagacattaatcccaggaatgaaggagatgtttgacaggtcagcagatcttggtgttgaaagtattgtgattggaatgtctcacagaggaagattaaatgttttaggtaatgttgttagaaaaccgttacgccaaatcttcagtgaatttactggtggtacaaagccggttgatgatgttgggctttacacgggaaccggtgatgtgaaatatcatcttggaacttcttatgatcgcccaacacgtggtggaaagagaattcacttgtctttagttgcaaaccctagtcatttggaagctgtagatcctgttgtgattgggaaaacaagagcaaaacagtattactcaaatgatgttgatagaacaaagaacatgggtattttaattcatggggatggaagctttgcagggcaaggcgtggtatacgagactttgcatttaagtggtcttccgaattatacaactggtgggaccattcatattgtagtcaacaatcaagttgcttttactactgatccacaggcaggaaggtcttcacagtattgtactgatgttgctaaagctttaaatgttccaatttttcatgttaatggtgatgacgtggaagcagttgttcatgcttgtgagctggcagctgagtggcgacaaacgttccactcggatgttgttgttgatatagtctgttatcgccgatttgggcataatgaaattgacgaaccatcttttacccaaccaaaaatgtacaagatcattaggaatcatccatcatcactagaaatctaccagaagaagcttctagaaagtgggcaagcgacaaaagaagatattgacagaatacaaagcaaggttactgcaattcttaatgaagagtttcttgccagcaaggattatgttcctcaaagaagagactggctttcagcttactggactggatttaaatcccctgaacagctttcacgtattcgtaacaccgggattaaaccagagattttgaaaaatgttgggaaggcaattacaacacttccagaaacttttaagccacacagagcagttaagaagatatttgcagaccgtttaaagatgattgaaactggtgaaggtgttgattgggcagttgcagaagctctagcttttgcaacattactggtggaaggaaatcatgtgagattaagcggtcaagatgttgaaagaggtacttttagtcacaggcattctgttgttcatgatcaagaaacaggggagcgttactgtccgttggatcatgtaatgatgaatcaagatgaggaaatgtttaccgtaagcaacagctctctttcggagtttggtgtgctgggatttgaattgggctattcaatggaaaaccctaattcactggtattatgggaagctcaatttggtgatttttccaatggggcccaggtgatatttgatcaattcttgagcagtggtgaggccaagtggctgcgccagactgggttagttgtgttgctacctcatggttatgatggtcaagggcctgaacactcaagtgcaagacttgagcgtttccttcagatgactgatgataatccgtttgtcatacctgagatggaaccaacactacgcaatcaaattcaaacttgcaatatgcagattgttaatgttacaacaccagcaaattatttccatgtgttacgtcgacagctgcacagggagttccgtaagccacttgttgtgatgtctccaaaaaatttgcttcgtcacaaagactgcaagtcgaatttatctgagtttgatgatgttcaaggtcaccctggttttgataaacaaggaaccaggtttaaacgactcattaaggaccaaaatgaccactcagatcttgaagaagggattaggcgtttggttctttgctctggaaaggtttattatgaacttgatgaaaaaaggaagtcggttgatggaaaagatattgcgatttgtcgtgttgaacaactttgcccattcccttacgacctcatccagcgtgaattaaagcgttatccaaatgcagaagtagtttggtgtcaagaggagccgatgaatatggggccctatagttacattgccccacgccttgcaaccgccatgaaggcactcaatagaggtacaattgatgatatcaaatacgtgggccgcgctccatctgctgcaactgcaactggtttctacatagttcatggcagagagcagtctgaaatcgtgcagaatgccctgcagcccgagaccgtcactagtcctgcacttagttagagcccgcagccagggtatttatctttgtttgagtgtcggcttggcatc

SEQ ID NO: 1851 - DNA, 3101 bp, Brassica napus
ggtgaaaatggtatggtttcgagccggctcgaacgtgacaaagcttgccgtacgaaggatcctaaatcagggcacttcatacgccacaagaacacgctccctcccttctcaaacccgttccttccactcatctctccacagaccaaacccacagagcaccaccgctcctatcccccgagccgtccccctctccaaactaacagacagcttcttagatggcaccagcagcgtctacctcgaggagctccaaagagcctgggaatccgatcccaccagcgtcgacgagtcctgggacaatttctttcgtaacttcgtcggtcaagccgcgacctcgccaggcatctccggccaaactatccaagagagtatgaatctcttgcttctcgtcagagcctatcaggtcaacggccacatgaaagccaacttggatcccttaggtctcgaacaaagagagatccccgaggatcttgacttggctctatacggattcacagaggctgatctcgacagagagttcttcttgggagtctggcagatgtccgggttcatgtccgagaaccgtcccgtgcagacgctccgctccattttggcgaggctccagcaggcttactgtgggagcattgggtttgagtacatgcacattgcggatcgggataaatgcaactggcttagagaaaagatcgagacggccactccctggagatacaacagggagcggcgcgaggtgattctcgacaggctggcctggagcactcagtttgagaatttcttagctaccaagtggaccactgctaagagattcgggctcgaaggtggagagtcgctgatcccggggatgaaggagatgtttgacagggcggcggatctcggcgtcgagagcattgttatcggaatgtctcacagagggaggttgaacgttttgggtaatgtcgttaggaagccgttacgtcagatcttcagcgagttcagcggcgggataaggccggttgatgaagttggatacaccggaacgggtgatgttaagtaccacttgggtacctcttatgataggcccacgagaggtgggaagaagatccatctctcgttggttgcaaacccgagtcatttagaagctgcagattcagttgttgtgggtaaaacaagagcgaagcagtactactccaaggacatggacaggaccaagaacttggggattttgatccacggagacggtagtttcgctggacaaggagtggtttacgagacgcttcatcttagcgctctccctaactacaccactggtggtactatccacattgtggtgaacaaccaagtggcgttcaccacggatccgagagctgggagatcttctcagtactgtaccgatgtcgcaaaggccttgagtgctcccatcttccatgtgaatggtgacgatgtcgaagctgttgtgcacgcctgtgagcttgctgccgagtggcgtcagacgtttcattccgatgttgtggtggatttggtttgttacaggaggtttgggcataatgagattgatgaaccgtctttcactcagccgaaaatgtacaaggtgatcaagaaccatccctcgacgcttcagatctaccacaagaagcttttggagtgcggcgaaatatcgcagcaggatattgataggatacaggagaaggttaacaccattctcagtgaagagtttgttgctagtaaagattatctgtctaagaagcgtgattggctttcgaccaattgggctgggttcaagtctcctgagcagatctctcgtgttagaaacacaggcgtgaagccagagatacttaagactgttggcaaggcgatttcgtcgcttcctgaaaacttcaagcctcacagagcggtgaagaaagtttatgaacagcgtgctcagatgattgaaacgggagaaggtattgactgggcgcttgcggaagctcttgctttagctacattagttgtggaaggcaaccatgtccgtttaagtggtcaagatgtggaaagaggaaccttcagtcatcgtcattctgtgcttcatgaccaggaaactggagaagagtattgtcctctggaccatctcgtcatgaatcaggatcctgagatgttcactgtcagcaacagttctctttcagagtttggggtccttgggttcgagttgggttactcaatggaaagcccaaactcgttggtgctatgggaagctcagtttggagactttgccaatggagctcaggtgatatttgatcagttcatcagcagtggagaagccaagtggctgcgtcaaaccgggcttgttgtgctacttccccatggatatgatggtcagggacctgaacattcaagtgccaggctggaacgttaccttcagatgagtgatgacaacccctatgtcataccagacatggaacctacaatgagaaagcaaatccaagaatgcaattggcagattgtcaatgccaccactcctgccaactattttcatgttctgcgtcgacagatacacagagacttccgcaagcctctgattgtaatggcaccaaagaacttgctccgtcacaaggactgcaaatcaaacctctcagagtttgatgatgtccaaggccacccaggttttgacaagcaaggaactaggttcaagagattgatcaaggatcagaacgatcactctgatcttgaagaaggcatcagaagattggtactctgctctggaaaggtttattacgagcttgatgatgagaggaagaaggttggggcaagcgatgttgctatttgtagagtggaacagctttgtcctttcccatatgatctcattcagcgtgagctcaagagatatccaaatgcggagatagtttggtgccaagaagaggcgatgaacatgggagcatacagctacataactccaaggctatggacagcaatgagaagcttaggcagaggagatatggaagacattaagtacgttggtcgtggaccttctgctgctaccgccactggtttctacactttccatgtcaaagagcaagcggagctcgtccagaagccattggaaaggatccatcagttgaaagaaacttcatttattaaatgaattctttaaataa

SEQ ID NO: 1852 - DNA, 3475 bp, Citrus clementina
attagctcaatgttaaaattcttctcacagcccacactcggtccaaattacagctaaactgacgtgccgtcgttgatcgttcgttgagacgccgtcgccggtattgcagcctctgtcttctctcttacacttcacgtcattcagagtgaggattgatagttatggggtggtttagagctagttcaggcgtggcaaagcttgccattaggaggactctatctcagggttgttcttatacaacaagggcgcaggtctttccttcacgatcccggtgttttcatagcacggttttaaaatcaaaggcacagtctgcacctgtgccgcgccctgtacctttatctaggttgactgataacttcttggatggcactagtagtgtttatttagaggagctccagaggtcctgggaagctgacccgaatagtgttgatgagtcctggcaaaatttctttagaaattttgtgggtcaggctgctacttctcctggaatttcaggccaaacaattcaggagagtatgcgtttgttgttgcttgtgagggcttaccaggttaatggtcatatgaaagcaaagttggacccattggggttggaagaaagagaaatccctgatgacttggacccagctttttatggatttacagaagctgatctggatagggaattttttctgggggtgtggagtatggctggatttttgtcagagaatcgtcctgtgcagacgcttagatccatattaacccggcttgagcaggcttattgtggtagtattgggtttgaatacatgcatatttcagatcgcgagaaatgtaactggttgagagacaaaattgaaaccccaacaccaatgcaatacaacaggcaacgccgtgaggttattcttgataggctcgtatggagtacacaatttgagaacttcttggccactaagtggacaacagcaaagaggtttgggcttgaaggtggggagactttgattcctggcatgaaggagatgtttgatagggcagctgatcttggggttgagagcatagttattggaatgcctcacagaggacgacttaatgtgttaggtaatgttgttcgaaaaccacttcgtcaaatatttagtgagtttagtggtggtacaaggcctgtagatgaagttgggctctacactggaaccggtgatgttaagtatcacctgggaacttcttatgatcggccaactagaggtggtaagagaattcatttatctttagttgccaatccaagtcacttggaagctgtggacccagttgttatagggaaaactagagcaaagcaatactactccaatgatatggacaggaccaagaatatggctgttttgattcatggggatggtagctttgctggtcaaggtgtagtttatgaaactctacatctgagtgcacttccaaattactcaattggtggtactatacatattgtggtgaacaaccaagtggcattcaccactgatccaatgtcggggagatcctctcagtactgcactgatgttgccaaggctttggatgcacctattttccatgtgaatggggatgacatggaggcagttgctcatgtttgtgaacttgcagcagaatggcggcagacatttcattcagatgttgtggttgatttagtgtgttatcgtagatttggccacaatgagattgatgagccatctttcacccagcccaaaatgtacaagatcattcggagtcatccgtcatctcttgagatctaccaaaataaactcttagaatgtcagcatgtgactcaagaagacattaataagatacaagaaaaggtcaatagaatccttagtgaagaatttgtggccagcaaagattatgttccaaacagaagggactggctttcagcatattggtctgggttcaagtcacctgaacagctttcacgcattcgaaacactggggtaaaaccagagatcttgaagaatgttggcaaagcaatcacgactcttccagaaaattttaagcctcacaggggggtaaagaaggtttatgaactgcgtgcacaaatgattgaaacaggagaaggaattgactgggcacttggggaggcccttgcatttgctactttgctggtagagggtaaccatgtgcggttgagtggtcaagacgtggagagaggtacattcagtcaccggcattctgtgttgcatgatcaagaaactggggagcagtattgcccactagaccatgtgatgatgaatcaggatgcggaaatgttcactgtgagcaatagttctctctcagagtttggtgttcttggctttgaattgggttactctatggaaaatccaaactcattggtaatgtgggaagctcaatttggtgactttgctaatggagcacaagtaatttttgatcagtttgtaaatagtggggagtccaagtggttgcgccaatctgggcttgttgtgatgctccctcatggttatgatggtcaaggccctgaacattcaagtgcacgattggagcggttccttcagatgagtgatgacaatccatatgttatacctgagatggattcaactcttcggactcaaatccaagaatgcaactggcagattgtgaatgttacaactcctgctaactacttccatgttttgaggcgtcagatccacagagaatttcgtaagcctctcgttgtgatgtcacccaaaaatctgcttcgtcacaaggaatgcaaatcaaatctttctgagtttgatgatgtacaaggtcacccaggttttgacaaacaagggactagatttaaacggcttataaaggatcagaatgagcactctgatcttgaggagggtatcagacgtctgattctttgttctggaaaagtctattatgagcttaatgaagagcgaaagaagcacagtgcaagtgacattgctatttgtagggtggaacagctttgtcctttcccatatgaccttgtccagcgggagcttaaacgatatccaaatgccgaggttgtttggagccaggaagagccaatgaacatgggtgcgtatacctacattgcacctcgcctttgcactgccatgaaagcagtggatagaggaaccatggaggacatcaaatatgttggccgtgctccatctgctgcctcagccactggcttctatcaggttcacgttaaagaacagtctgagctaatgcagaaagccattcaacccgaaccaattggtaatcctttctgaagtctaataaacccttgagaccagtataagaagatttttgactgcacccagataaaacaagctgtgcagtctgaattcttcttgaaacctttattccgcacatttattttgatgtttgcaatacatttttgccaatttgtccatcgttttgtatccgtagtcatcatctccccttcttcgtcacgatacaaaacagtaaatgtacggggtcaccgtaaatcgtgtcaattatgaaatttttcgctaca

SEQ ID NO: 1853 - DNA, 3475 bp, Citrus sinensis
attagctcaatgttaaaatcctcctcacagcccacactcggtccaaattatagctaaactgacgtgccatcgttgatcgttcgttgagacgccgtcgccggtatcgcagcctctgtcttctctcttacacttcacgtcattcagagtgaggattgatagttatggggtggtttagagctagttcaggcgtggcaaagcttgccattaggaggactctatctcagggttgttcttatacaacaagggcgcaggtctttccttcacgatcccggtgttttcatagcacggttttaaaatcaaaggcacagtctgcacctgtgccgcgccctgtacctttatctaggttgactgataacttcttggatggcactagtagtgtttatttagaggagctccagaggtcctgggaagctgacccgaatagtgttgatgagtcctggcaaaatttctttagaaattttgtgggtcaggctgctacttctcctggaatttcaggccaaacaattcaggagagtatgcgtttgttgttgcttgtgagggcttaccaggttaatggtcatatgaaagcaaagttggacccattggggttggaagaaagagaaatccctgatgacttggacccagctttttatggattcacagaagctgatctggatagggaattttttctgggggtgtggagtatggctggatttttgtcagagaatcgtcctgtgcagacgcttagatccatattaacccggcttgagcaggcttattgtggtagtattgggtttgaatacatgcatatttcagatcgcgagaaatgtaactggttgagagacaaaattgaaaccccaacaccaatgcaatacaacaggcaacgccgtgaggttattcttgataggctcgtatggagtacacaatttgagaacttcttggccactaagtggacaacagcaaagaggtttgggcttgaaggtggggagactttgattcctggcatgaaggagatgtttgatagggcagctgatcttggggttgagagcatagttattggaatgcctcacagaggacgacttaatgtgttaggtaatgttgttcgaaaaccacttcgtcaaatatttagtgagtttagtggtggtacaaggcctgtagatgaagttgggctctacactggaactggtgatgttaagtatcacctgggaacttcttatgatcggccaactagaggtggtaagagaattcatttatctttagttgccaatccaagtcacttggaagctgtggacccagttgttatagggaaaactagagcaaagcaatactactccaatgatatggacaggaccaagaatatggctgttttgattcatggggatggtagctttgctggtcaaggtgtagtttatgaaactctacatctgagtgcacttccaaattactcaattggtggtactatacatattgtggtgaacaaccaagtggcattcaccactgatccaatgtcggggagatcctctcagtactgcactgatgttgccaaggctttggatgcacctattttccatgtgaatggggatgacatggaggcagttgctcatgtttgtgaacttgcagcagaatggcggcagacatttcattcagatgttgtggttgatttagtgtgttatcgtagatttggccacaatgagattgatgagccatctttcacccagcccaaaatgtacaagatcattcggagtcatccgtcatctcttgagatctaccaaaataaactcttagaatgtcagcatgtgactcaagaagacattaataagatacaagaaaaggtcaatagaatccttagtgaagaatttgtggccagcaaagattatgttccaaacagaagggactggctttcagcatattggtctgggttcaagtcacctgaacagctttcacgcattcgaaacactggggtaaaaccagagatcttgaagaatgttggcaaagcaatcacgactcttccagaaaattttaagcctcacaggggggtaaagaaggtttatgaactgcgtgcacaaatgattgaaacaggagaaggaattgactgggcacttggggaggcccttgcatttgctactttgctggtagagggtaaccatgtgcggttgagtggtcaagacgtggagagaggtacattcagtcaccggcattctgtgttgcatgatcaagaaactggggagcagtattgcccactagaccatgttatgatgaaccaggatgcggaaatgttcactgtgagcaatagttctctctcagagtttggtgttcttggctttgaattgggttactctatggaaaatccaaactcattggtaatgtgggaagctcaatttggtgactttgctaatggagcacaagtaatttttgaccagtttgtaaatagtggggagtccaagtggttgcgccaatctgggcttgttgtgatgctccctcatggttatgatggtcaaggccctgaacattcaagtgcacgattggagcggttccttcagatgagtgatgacaatccatatgttatacctgagatggattcaactcttcggactcaaatccaagaatgcaactggcagattgtgaatgttacaactcctgctaactacttccatgttttgaggcgtcagatccacagagaattccgtaagcctctcgttgtgatgtcacccaaaaatctgcttcgtcacaaggaatgcaaatcaaatctttctgagtttgatgatgtacaaggtcacccaggttttgacaaacaagggactagatttaaacggcttataaaggatcagaatgagcactctgatcttgaggagggtatcagacgtctgattctttgttctggaaaagtctattatgagctttatgaagagcgaaagaagcacagtgcaagtgacattgctatttgtagggtggaacagctttgtcctttcccatatgaccttgtccagcgggagcttaaacgatatccaaatgccgaggttgtttggagccaggaagagccaatgaacatgggtgcgtatacctacattgcacctcgcctttgcactgccatgaaagcagtggatagaggaaccatggaggacatcaaatatgttggccgtgctccatctgctgcctcagccactggcttctatcaggttcacgttaaagaacagtctgagctaatgcagaaagccattcaacccgaaccaattggtaatcctttctgaagtctaataaacccttgagaccagtataagaagatttttgactgcacccagataaaacaagctgtgcagtctgaattcttcttgaaacctttattccgcacatttattttgatgtttgcaatacatttttgccaatttgtccatcgttttgtatccgtagtcatcatctccccttcttcgtcacgatacaaaacagtaaatgtacggggtcaccgtaaatcgtgtcaattatgaaatttttcgctaca

SEQ ID NO: 1854 - DNA, 3159 bp, Brassica napus
aacggacaggcaccctccaaactcttcatgacctctacagaccaaaccctcagagctctgccgctcctgttcctcgcgctgttcccctctctaagctaaccgacagcttcctggatgggaccagcagtgtttacctcgaggagcttcaacgagcgtgggaagctgatcccaccagcgttgacgagtcttgggataatttctttaggaactttgtgggccaagctgcgacttctccaggcatctctggtcagacgattcaggagagtatgcgtctcttgttgctcgtgagggcttatcaggtgaacggtcacatgaaagctaagttggatccgttgggtttggagcagagggagatccctgaggatcttgacttggctctttacggattcactgaggctgatcttgacagagagttcttcttgggagtgtggcagatgtctggtttcatgtctgagaaccgccccgtgcagaccttgcgttctatattgacgaggctccagcaggcttactgtgggagtatcgggtttgagtatatgcacattgcggatcgggataagtgtaactggctgagggagaagattgagactcctactccttggaggtacaacagggagcgtcgcgaggtgatcctcgacaggcttgcttggagtactcagtttgagaatttcttagctactaagtggacaacggctaagaggtttgggcttgaaggtggagagtctttgattcctggcatgaaggagatgtttgacagggcggcggatcttggagtagagagcattgttataggaatgtcccacagagggagattgaatgttttgggtaatgttgttaggaagccactccgtcagattttcagcgagttcagcggtggtattaggcctgtggatgaggttggctacactggaaccggtgatgttaagtaccacttgggtacatcttatgatcgacctacgagaggtgggaagaagattcatctctcgttggttgctaacccaagtcacttggaagctgcagactcagttgttgttggcaaaaccagagcgaagcagtactactccaaggatttggacaggaccaagaacttggggattttgatccaatggagatgggagctttgctaggacaaggagtggtttacgaaacgcttcatcttagtgctcttccgaactacaccactggtggtaccattcatattgtggtgaacaaccaagtggctttcaccacggatccaagggctgggaggtcttctcagtactgtactgatgttgccaaggctttgagtgctcccatcttccatgttaacggagatgatgttgaagctgttgttcatgcctgcgagcttgctgctgagtggcgtcagacgtttcattccgatgttgtcgttgatttggtttgctataggaggtttgggcataatgagatagatgaaccatctttcactcagccgaagatgtacaaggttatcaagaatcatccctcgacgcttcaaatctatcataagaagctcttggagtgcggtgaaatatcgcagcaggatattgacaggatacaggagaaggttaacaccattctcaatgaagagtttgttgctagcaaagattatctatctaagaagcgtgattggctttcaaccaattgggctggattcaagtctcctgagcagatctcacgtgttagaaacactggagtcaaaccagagatacttaagactgttggcaaggcgatttcatcactgccggagaacttcaaacctcacagagcggtgaagaaagtttatgaacagcgtgctcaaatgattgaaacaggagaaggaattgactgggcacttgcggaagctcttgcctttgctaccttagttgtggaaggcaaccatgtccgcttgagtggtcaggatgtcgaaagaggaacctttagtcatcgtcattctgtccttcatgaccaggaaactggagaagagtattgtcctctagatcatctcgtcatgaatcaggatcctgagatgttcactgtcagcaacagttctctttcagagtttggagtccttgggtttgagttgggttactcgatggaaagtccaaactcgttggtgctatgggaagctcagtttggagactttgccaatggagctcaggtgatatttgatcagttcatcagcagtggtgaagccaagtggctgcgtcagactgggcttgttgtgctacttccccatggatatgatggtcaaggccctgaacattcaagtgccaggctggaacgttaccttcagatgagtgatgacaacccctatgtcataccagacatggaacctacattgagaaagcaaatccaagaatgcaattggcagattgttaatgccaccactcctgccaactatttccatgttctgcgtcgtcagctacacagagatttccgtaagcctttgattgtaatggcaccaaagaacttgctccgtcacaaagactgcaaatcaaacctctctgagtttgatgatgtccaaggccacccaggttttgacaaacaaggaactagattcaagcgattgatcaaggatcagaatgatcactctgatcttgaagaaggcatcagaagattggtactttgctccggaaaggtgtattacgagcttgatgacgagaggaagaggtcggcgcaagcgatgttgctatttgtagagtggaacagctttgtccttttccatatgatctcattcagcgtgagctcaagagatatccaaatgcggagatagtttggtgccaagaagaggcgatgaacatgggagcatacagctacataactccaaggctatggacagcaatgagaagcttaggcagaggagatatggaagacattaagtacgttggtcgtggaccttctgctgctaccgccactggtttctacactttccatgtcaaagagcaagcggagctcgtccacaaagccattggaaaggaatccatcagttgaaagaaacctcatttattaaatgaattctttaaataagaaaactttcggtgaaacaaagtgataaaacaacactgacaaaatcatgtccttgctttttattggtcccattgatttttgaacctgtctcgtgttggcaggttaacacggatcatactcattttcataaagcttttgtttttcctctacagtttt

SEQ ID NO: 1855 - DNA, 3435 bp, Brassica rapa
ccttcttaatcaaacaatacagatctatcgaatcttgcctcatcttgatttctcgaatatgattctcattaaaaaagaaaaagacttctcttttattcgttctttcctgattctctattcgtaggtattgaaagttgaaagcttttggtggtgatctggtgaagatggtgtggtttcgagccggctcgaatgtgacaaagcttgccgtacgaaggatcctaaatcagggcacttcatacgccacaagaacacgctccctcccttctcaaacccgttccttccactcatctctccacagaccaaacccacagagcaccaccgctcctatcccccgagccgtccccctctccaaactaacagacagcttcttagatggcaccagcagcgtctacctcgaggagctccaaagagcctgggaatccgatcccaccagcgtcgacgagtcctgggacaatttctttcgtaacttcgtcggtcaagccgcgacctcgccaggcatctccggccaaactatccaagagagtatgaatctcttgctgctcgtcagagcctatcaggtcaacggccacatgaaagccaacttggatcccttaggtctcgaacaaagagagatccccgaggatcttgacttggctctatacggattcacagaggctgatctcgacagagagttcttcttgggagtctggcagatgtccgggttcatgtccgagaaccgtcccgtgcagacgctccgctccattttggcgaggctccagcaggcttactgtgggagtataggttttgagtatatgcacattgcggatcgggataaatgtaactggcttagagaaaagatcgagacgcccactccctggagatacaacagggagcggcgtgaagtgattctcgacaggctggcgtggagcactcagtttgagaatttcttagctaccaagtggaccactgctaagaggttcgggctcgaaggtggagagtcgctgatcccggggatgaaggagatgtttgacagggcggcggatctcggcgttgagagcattgttatcggaatgtctcacagagggaggttgaactttttgggtaatgtcgttaggaagccgttacgtcagatcttcagcgagttcagcggcgggataaggccggttgatgaagttggatacaccggaacgggtgatgttaagtaccacttgggaacctcttatgataggcccacgagaggtgggaagaagatccatctctcgttggttgcaaacccgagtcatttagaagctgcagattcagttgttgtgggtaaaacaagagcgaagcagtactactccaaggacatggacaggaccaagaacttggggattttgatccacggagacggtagtttcgctggacaaggagtggtttacgagacgcttcatcttagcgctctccctagctacaccactggtggtactatccacattgtggtgaacaaccaagtggcgttcaccacggatccgagagctgggagatcttctcagtactgtaccgatgtcgccaaggccttgagtgcccccatcttccatgtgaatggtgacgatgttgaagctgttgtgcacgcctgtgagcttgctgctgagtggcgtcagacgtttcattccgacgttgtggttgatttggtttgttacaggaggtttgggcataatgagattgatgaaccgtctttcactcagccgaaaatgtacaaggtgatcaagaaccatccctcgacgcttcagatataccacaagaagctcttggagtgcggcgagatatcgcagcaggatattgacaggatacaggagaaggttaacactattctcagtgaagagtttgttgctagtaaagattatctgtctaagaagcgtgattggctttcgaccaattgggctgggttcaagtctcctgagcagatctctcgtgttagaaacacaggcgtgaagccagagatacttaagactgttggcaaggcgatttcgtcgcttcctgaaaacttcaagcctcacagagcggtgaagaaagtttatgaacagcgtgctcagatgattgaaacgggagaaggtattgactgggcgcttgcggaagctcttgctttagctacattagttgtggaaggcaaccatgtccgtttaagtggtcaagatgtggaaagaggaaccttcagtcatcgtcattctgtgcttcatgaccaggaaactggagaagagtattgtcctctggaccatctcgtcatgaatcaggatcctgagatgttcactgtcagcaacagttctctttcagagtttggagtccttgggtttgagttgggttattcaatggaaagtccaaactcgttggtgctatgggaagctcagtttggagactttgccaatggagctcaggtgatatttgatcagttcatcagcagtggagaagccaagtggctgcgtcaaaccgggcttgttgtgctacttccccatggatatgatggtcagggccctgaacattcaagtgccaggctggaacgttaccttcagatgagtgatgacaacccctatgtcataccagacatggaacctacaatgagaaagcaaatccaagaatgcaattggcagattgtcaatgccaccactcctgccaactattttcatgttctgcgtcgacagatacacagagacttccgcaagcctctgattgtaatggcaccaaagaacttgctccgtcacaaggactgcaaatcaaacctctcagagtttgatgatgtccaaggccacccaggttttgacaagcaaggaactaggttcaagagattgatcaaggatcagaacgatcactctgatcttgaagaaggcatcagaagattggtactctgctctggaaaggtttattacgagcttgatgatgagaggaagaaggttggggcaagcgatgttgctatttgtagagtggaacagctttgtcctttcccatatgatctcattcagcgagagctcaagagatatccaaatgcggagatagtttggtgccaagaagaggcgatgaacatgggagcattcagctacataactccaaggctgtggacagcaatgagaagcttaggcagaggagatatggaagacattaagtcctttggtcgtggcccttctgctgctcctgccactggtttctacactttccatgtcaaagagcaagctgagctcgtccagaaagccatcgggaaggaacccatcagctgaaaaaatcttcatttttaagctgaactttgaataagaagtttcggtgaacaatgtgatacacaacactgacaaagtcttgtctttgcattttttttggccccgttgatttttttgagcctgtcttgtgttgcaggttttatacacatcatctcatttttaataaaactttttgtttttcttcatttttttgttatatggttcatcttttgct

SEQ ID NO: 1856 - DNA, 3295 bp, Brassica napus
ccatacgaagaacactctctcagtctagggttctaccttcttctcacacgagatgtttccactctacatcactcaaatcaaacgccgcgcccgtcccccgccccgtccctctctccaagctcaccgacagcttcctagacggaaccagcagcgtgtacctcgaggagctgcagagagcttgggaagccgatcccaacagcgtcgacgagtcctgggacaacttcttccgaaacttcgtgggccaagccgccacttcccctgggatctcggggcagaccattcaagaaagcatgcgtctgctgctcctcgtcagagcttaccaggtcaacggccacatgaaggccaagcttgaccctctgggtctagaggagagagagatccccgaggatctaacgcccggtctctacggattctccgaggctgatcttgatagagagttcttcctcggcgtctggaggatgtctgggtttctctccgagaaccgtcccgttcagacgctgagggctatcctctcgaggctcgagcaggcgtactgtgggactatcgggtatgagtacatgcacattgcggatagggataaatgcaactggctgagagacaagatcgagacgccgacgcctcggcagtacaacagcgagcgcagggtggtgatttacgataggcttacgtggagcacgcagtttgagaacttcttggcgactaagtggaccacggccaagaggtttggactcgaaggggctgagtctttgatccctgggatgaaggagatgttcgacagggctgcggatcttggagttgagaacattgttatcggtatgcctcacaggggtcggcttaacgttttgggtaacgttgttaggaagcctctgcgtcagatcttcagcgagtttagcggtgggactaggccggtggatgaagttgggctctacaccggaacgggggatgtgaagtaccacttgggcacgtcttatgatcgcccgactagaggagggaagcatcttcacttgtctttgttggcgaaccccagtcacttggaagcggtggatcctgtcgtgatgggtaaaaccagagcgaagcagtattacaccaaagacgagagcaggacaaagaacatgggtattttgatccatggggatggtagctttgccgggcaaggtgtggtgtatgagactctgcatcttagcgcgcttcctaactactgcaccggtgggacagtgcacattgtggtgaataaccaagtggctttcacaaccgatccaagggcgggaaggtcttcgcagtattgcactgatgtcgccaaggctttagatgctccgatttttcacgtcaatgcggatgatattgaagcggtggtgcatgtttgtgagcttgctgcggagtggcgccagacgttccattctgatgttgttgttgatttggtgtgctaccgtcgctttgggcataatgagatagatgaaccgtcgttcacacaaccaaagatgtacaaggtgatacgcagtcatccctcgtcgcttcaaatctaccaagagaagcttgtggaatctggacaggtaacgaaagaagatattgataagattcaaaagaaagtaagctctattctcaatgaagaatttgaggcaagtaaagagtatattccacaaaaacgtgattggctggcaagtcattggactggattcaagtcaccggagcagatttctaggatccgtaacactggtgtaaagccagagattttgaagaacgtggggaaagcaatctcaacctttccagagaacttcaagccacacagaggagtgaaaagagtttatgagcaacgtgctcagatgattgagtcaggagaaggcattgactggggacttggagaagctcttgctttcgctacactagttgtggaaggcaaccatgttcggctaagtggtcaagatgttgaaagagggactttcagtcataggcactccgtgcttcatgatcaagaaaccggcaaggagtattgtcccttagaccacctgaccatgaaccaggaccctgaaatgttcactgtcagcaacagctctctttcagagtttggtgttctgggattcgaactgggttactcgatggagaacccgaactctctggtaatttgggaggctcagtttggagactttgccaatggcgcacaagtgatgttcgatcagttcataagcagtggagaagccaaatggctacgtcaaactgggctagtagttctgcttcctcatggatatgatggacagggtcctgaacattccagtggaagattagaacgtttccttcagatgagtgatgacaatccttttgttatccccgagatggatccaactcttagaaagcagattcaagagtgtaattggcaaattgttaatgttactacacctgccaactacttccatgttctgcgtcgccagatacacagggatttccgcaagcctcttatagtgatggctcccaaaaacttgcttcgacacaagaagtgtgtatctaacctctcggagttcgatgatgttaaaggacatcctgggtttgacaagcaaggaaccaggtttaaacggttgattaaagatcaaagtggtcactctgatcttgaagaaggtatccgacgtctagtcctctgctcagggaaggtttactatgagctggacgaagagcgacaaaagtctggaacaaacgacatagccatttgcagaatggagcagctttgtccattcccttacgatctcattcagagagaattaaagcgatatccaaatgcagagattgtgtggtgtcaagaagagccgatgaacatgggagcatatcagtatatagcaccaaggctgtgcacggccatgaaagcactgaacagaggaagcttcaacgacatcaaatacgttgggcgtcttccttcagctgctacagcaactggtttttaccagcttcatgtcaaggagcaaactgatcttgttcacaaagctcttcaacctgatcccatcacccctatcctcccctgaatgatccatcaagggaatatataacagcttcagctcttgaagctcatgagagtctgtataaagaagacacaaaaacaaagattcatgagaatctttggttatcatcaaataatttcactgcggaaaccatatgtttgctagagtttcattccagtttgaatgatttcggtttacttcggttatcaataaaagtaaagtaatcaaacatgaatgattagtctgttttagtgttcaacaaatagctagcggtaactattcggagcttgggatttaagcgttaactaattatt

SEQ ID NO: 1857 - DNA, 3550 bp, Pinus taeda
aggttttaaaatcagtctggaaaccgccgggattaggtatggtattctgaatgctagggtttgaagattggcaaggtttccttgtctggaatttgaatcaagggtaattgtgagagttattttggggttagggttttgttagtctggaaatcctaggtggcaaccatggtcttgcagaaaatttcctctggtttaattagggcagctctcaaaacccgcttggctcagtcctcatatacgaaaagagccctatggactcttccgcaggctcgatcattgcactccacggggcctaagttccagcaaacggccccggttccgcgctccgtgccgctatcgaggctgaccgataatttcctcgatggcaccagcagcgtgtatttggaagaattgcaaagggcatgggaagtggatccgcagagcgtggatgagtcatgggacaattttttccgcaattttgttgggcaggcatcaacgtccccgggcatctccgggcagacgatacaagagagcatgaggcttttgctcctcgtgagggcttatcaggtgaatggccacatgaaggcgaagctggatcctctagggttggaggagagggagattccggtggatttggatccagcgctgtatggattcacagaggcggatctggaccgggagttttttctcggcgtgtggaggatgtcagggttcttgtctgagaatcgaccggtgcagactttacggtcaattctgaatcgattggaacaagcttactgtggcaccattggttatgaatacatgcacataccagaccgtgataagtgtaattggctgagggaaaagattgagacagtaactcccaggggatacaatgcagagcgcaggctcgttatgcttgatcggctcatctggagtacacagtttgagaatttcttggctacaaagtggactgctgcgaagcggtttgggctcgaaggggctgagaccttgatcccaggtatgaaggaaatgtttgatcggtcagctgatatgggggtggagagcattgttataggtatgtctcatagaggaagattgaatgttttgggcaatgtcgtcaggaagccattgagacagattttcagcgagttcagcggtggcacaaagcccgcgtctggtgaatttggatcgtacaccggaactggagatgtgaaatatcatttggggacgtcatatgataggcctaccagaggtggaaaaaggatccacctttcattagttgctaatcctagtcacttagaagcagttgatcctgttgtggttggcaaaactagagcaaaacagtattattcaaatgacaaagagaggaagaaaaacttggctatattgattcatggagatggaagttttgctggtcaaggagtggtctatgagacattgcatttgagtgctcttcctaattacaccactggagggactattcacatggtggtcaataatcaggttgcattcacaactgatcccatgtctggaaggtcttcgcaatactgtacagatgttgcaaaagccttgaatgctccaattttccatgtaaatggtgatgatctggaagctgtggtgcatgcatgtgaacttgctgccgagtggcgtcagacattccagtctgatgttgttgtggatattgtttgttaccgcaggttcggacacaatgagattgacgaaccatcttttacacaacctaaaatgtacaaggtgattcgaaaccatccacaggcattggatttgtatgaaaagcagctaatagaaatggggcagttgtcaaaggaagaaattgatgctttgcacaagaaggtcaattcaattttgaatgaagagttcattaacagcaaagagtatgttccaaaccgacgagattggcttgcagcatattgggctggttttaagtcaccagagcaactctcacgtatacgtaatacaggggtcaaaccagagatactgaaaaatgttgggaaagcaataacctcgataccagaaacattcaagcctcatagagctgtaaagagggtctatgaccaacgtgcacaaatgattgaaacagaggaaggtgttgattgggctgttggtgaagcacttgcatttgcaacactgctagtggagggtaaccatgtgaggctgagtggtcaggacgttgaaagaggtactttcagtcaccgacattcagttcttcatgaccaggaaacgggagaaagatattgcccactggaccatgttatcatgaatcaacctgaggagatgtttactgtgagcaacagttctctgtcagaatttggtgttctgggttttgaattgggttattcaatggaaaatcccaattcattggtcctgtgggaagctcagtttggtgattttgcaaatggcgcccaagtcatttttgatcagttcataagcagcggggaatcaaaatggcttcgccaatctggacttgttgttttgcttcctcatggatatgatggccagggtccagagcattctagtgcaagattagagcgctatctccagatgagtgatgacaatccttttgtgattcctgagatggaccctacattacgcacccaaattcagcagtgtaattggcaaattgtaaatgtgacaactcctgccaactattttcatgttcttcgtcgccagataaaccgggatttccgtaaacctttgattgtcatgtctccaaagaatcttcttcggcacaaggactgcaaatcaaatctgtctgaatttgatgacgtgcaaggtcatcccggatttgacaagcagggaacccgatttaaacgtctcattaaggatcagaatgatcactctgacctagaggagggcatcaagcgtctgatactttgttctggaaagatctattatgagctggatgaggaaagacagagacttcaaaggaaagatgttgctatttgtcgggttgaacaactatgcccattcccatatgatttggtccagcgggagttgaagcgatatccaaatgcggagattgtttggtgccaggaagagcctatgaacatgggagcatacagctatattaccccacgtcttacaactgctatgacagcattaggtcgaggtaaatatgaggacattaagtatgtcggtcgagctccttcagctgccacagcaacagggttttctcagctgcatgtaaaggaacaaagagaggttatagaaacggcgttgcaatctgctccagtcagctttccttaatgtttatctctaaagacaactgttatttatggatattaataatcagcatggaaaacttcagcatcccgtttctcttattaggtcaaggctagataggaaactcgagtttttaccatgccttttacagtgtgttagtgagttcccttagttgagggcaggcatgccattattcaatagcagtaccattttttctgtatcaataatgttttacataccataagattcaaatctctcatgtttgggatgagagtgacactattttgttaggttcatttttgatccaaaaaataaaggtaataaatatttagagctgacctgactgaat

SEQ ID NO: 1858 - DNA, 3648 bp, Prunus mume
tggtggggctcccatggtgttttatgcctaataaaactcacttacttacaaaatcgttttgtgagtttcattgttatttgggtttaattatgagggtatttcagtctatttaattgggttcttttcgacatttatgacaaaaactccattttgtgatctcatttcgagttgaagttaatgcactcatattccagaatgtgcatgaatgaatgtacgtattaaaaaggtattagcctctccgtacgtgctttcgcgcttgcaagaggcttgataatgggtagttgtgttccataaaaaagggatccattatctgatttttcttttaattttactttttttaatataaaaaaatgtgaatttaccatattatcatcattgaattaataatttcaattcttaatgtttgcattaactaagatatatatagatgatatgatcattgggaaacttatttgattgatttgtttttgcatggttttgattcatgttctgaacaacttgtgattgatgtctgagcttcggaggtataattttctgttggtagccatgacgtggtttagagcagggtctcgtgtggcaaagcttgccattaggagaactctatcaaacagtggatcatatgcggcgaggaggcggctccttccgttgcaaaatcgacactttcacaccacattatgtaaatcaaaggccccagttcctagccctgtgtctctctctaggataactgatagtgtcctggatggaaccagcagtgtttatttggaggggcttcagagggcttgggaagccgaccccaacagcgtcgatgagtcgtgggacaatttcttcaggaatttcgtgggtcatcaggcctctatctcgcctggagtttcaggccaaaccattcaagagagtatgcgtttgttgttgcttgtgaaggcataccaggttaatggtcacatgaaagctaaattggaccctttgggtttggaagagagagcaatcccagatgatttggacccttgtttatatgggttctctgaggctgatcttgatagggagttctttttaggggtgtggaggatggctgggtttttagccgagaaccgtcccgtgcagacccttcggtccatcctgacccggcttgagcaggcttactgtgggactattgggtatgagtatatgcacattgccgatcgtaatagatgtaactggttgagagacaagattgagactccaacaccaatgcagtacaataacaagcgtcgtgaggttattcttgataggcttatttggagtacacaatttgagaacttcttggccactaagtggacagcagcaaagaggtttgggcttgaaggtggagaaactctgattccaggcatgaaagagatgtttgatagggcagcagatctcggggttgagagcatagttattggaatgtctcacagaggaagactgaatgtattgggtaatgtggttaggaagcctatgcggcagatatttagtgaattcagtggtggtacaaagcctgtggaagcagttggaggactatacacagggactggtgatgtcaagtatcacttgggaacctcttatgatcgacccacgagaggcgggaacagaattcatttatctttgcttgctaatccaagtcacttggaagctgtggaccctgttgttgttgggaaaactagagcaaagcagtattgttcgaatgatgcagaccggacgaagaatatggctgtgttgattcatggagatggtagctttgctggacaaggtgttgtcttcgagattctgcatctaagtgctcttcctaattacacaactggtgggactatacacattgtggtgaacaaccaagttgccttcacaactgatccaatgtctggaagatcttcacagtattgtactgatgttgccaaagcattgagtgctcctattttccatgtaaatgctgatgacatggaggcagtcgttcatgtctctgagcttgcagctgaatggcgccagactttccattctgatgttgttgttgatttggtgtgctatcgtcgatttgggcataatgagctggatgagccatctttcacgcagcccaaaatgtacaaggttatccggaatcatccctcagctctaacaatctaccagaacaaacttctagaatctggacaagtgaccaaagaagacattgagaggatacagaacaaggttaattcaattctcaatgaagaattcttggctagcaaggattatgttccccaaaaaagggactggctttcatctcattggtctggatttaagtcacctgaacagatttcccgtatcctgaatactggggtaaaaccagagattttgaagagtgttggcaaagcagtcacagccctcccagaaacttttaagcctcacagagcagtaaagaagaattatgaacaacgcgcacaaatgattgagactggtgaaggaattgattgggcagtagctgaagcacttgcatttgctacactactagtagaaggtaaccatgttcgattgagcggtcaggatgttgaaagaggcacatttactcatcggcattctgtacttcacgaccaggaaactggggaaaagtattgccctcttgaccatattatggaaaaccaagatgaggaaatgtttacagttagcaacagctcactgtctgagtttggtgttcttggatttgaattgggctactcgatggagagtccaaatgctttggtaatctgggaagctcaatttggtgattttgccaatggagctcaagttatatttgatcagtttttgagtagtggggagtccaaatggcttcgtcaaactgggcttgttttgctgcttcctcatggttaccttggccagggccctgaacattctagtgcccgactggagcgatttcttcagatgagtgatgataatcctgttgccatacctgagatggatcccacacatcggaagcaaattcaggaatgcaattggcaggttgttaatgtgacaactcctgccaactacttccatgttctgcgtcgtcagttgcacagggaattccgtaagcctcttattgtgatggctcctaaaaacctactacggcacaaggagtgcaaatcaaatttatccgaatttgatgatgtgcaaggccacccaggttttgacaagcaggggaccagatttaagcgcctcatcaaggaccagaatgaccactctgatctggaggagggtattagacgtctagttctttgctctgggaagctttattatgagcttgacgaagagcgaagaaatgttgaagcaaaggatgttgcaatttgtagaatggaacagctttgccccttcccatatgaccttatccagcgagagctgaagcgatatccaaatgctgagatagtttggtgccaggaagagccaatgaacatgggtgcatacagctatattgcaccccgcctttgcgctgccatgaagtctctcagcagaggaaccatcgacgacatcaaatatgttggccgtgctccatcagcttccacagccactggtttccctcaggttcatgagaaggaacaaagcgagattttgcacaacgctgtgcagccggagccaattgagtatctcacatcatctgaagcccgtgcatatctatccaaaaccaagcaatga

SEQ ID NO: 1859 - DNA, 3660 bp, Abies balsamea
actggagtgccagaaacatcctttctactaaatacaggtattctgggaccaaagctaaacagtaaagaaacgggagcataaagtgcccatcaataattgcggaatcattcatatacagtaagtccagaggatggaggatgccatatgatccaggcagagaggaggcaaaggagccatcgattatatatttacaaggtttttaaatcagtctggaaaccctagggattaggtacagtgctctgaaagttagggattgaaaactggcaattgtgagattattttgggttacggtttgatcagtctggaaaccctaggtgtcagccatggtcttgcagaaaatttcctctggtttaatcagggcagctctcagaacccgcctgggtcagtcctcgtatacgaaaagagctctatggacccttccgcaggctcgatcgttgcactcgacaggggagaaattccagcaggcggccccggtgccgcgcccagtgccgctgtcgagattgaccgataatttccttgacggcaccagcagtgtgtacttggaggaattgcagagggcatgggaagcggatccgcagagcgtggatgagtcatgggacaattttttccgcaattttgtagggcaggcatcaacgtccccgggcatctccgggcagacaatccaggagagcatgaggctgttgcttctcgtgagagcttatcaggtgaacggccacatgaaggcgaagctggatcctctagggttggaggagagggagattcccctggatttggatccggggctgtatggattcacggaggcagacctggatcgggagttttttctcggcgtgtggaggatgtcagggttcttgtctgagaatcggccggtgcagactctacggtcgattctgagtcgattggaacaggcttattgtggcaccattggttatgaatacatgcacataccagaccgtgataagtgtaattggctgcgggagaagattgagacagtggttcccagaggatacaatgccgagcgcaggcacgttatgcttgatcggcttatttggagttcacagtttgagaatttcttggctacaaagtggactgctgccaagcggtttgggctcgaaggagctgagaccttgatcccaggtatgaaggaaatgtttgatcgggcagctgatatgggtgtggagagcattgttataggtatgtctcatagaggaagattgaatgtgttggggaacgttgtcaggaagccgttgagacagattttcagcgagttcagcgttggcacgaagcccgcctctgaagtcgttggatcatacaccggatcaggggacgtgaaatatcatttggggacatcatatgataggcctaccaggggtggtaaaagaatccacctttcattagttgccaatcccagtcacttagaagcagttgatccagtcgtggttgggaaaactcgagcaaaacagtattattcaaatgacaaagagaggaagaaaaacttggctatattgattcatggagatggaagctttgccggacaaggtgtggtctatgagacattgcatttgagtgctcttcctaactacaccactggagggactattcacatcgtggtcaataatcaggttgcattcacaactgatcccaagtctggaagatcttcgcaatactgtacagatgttgcaaaagccttgaatgctccaatttttcacgtgaatggcgatgatgtggaagctgtggtacatgcatgtgagcttgctgctgagtggcgtcagaccttccagtccgatgttgttgtggatattgtttgttaccgcaggtttggacacaatgagatcgatgagccatcctttacacaacctaaaatgtataaggtgattagaaatcatccacgggcattggatttgtatgaaaagcagctaatagaaatggggcagttgtcaaaggaagaaattgatgctttgcacaataaggtcagttcaattttgaatgaagagttcataagcagcaaggagtatgtcccaaaccgacgagattggcttgcagcatactggacaggtttcaagtcaccagagcaactctcccgcatacgtaatacaggggtaaaaccggagatattgaaaaatgttgggaaaacaataacttctctaccagaaacattcaagcctcatagagctgtaaagaggatctttgaccaacgtgcacaaatgattgcaacagaggaaggtcttgattgggctgttggtgaagcacttgcatttgcaactctgctagtggagggtaaccatgtgaggctgagtggtcaagatgttgagagaggtactttcagtcatcgtcattcagttcttcatgaccaggaaacgggagaacgatattgcccactggaccatgttatcatgaaccaacctgaggagatgtttactgtaagcaatagttctctgtcagaatttggtgtcctgggttttgaattgggttattcaatggaaaatcccaattcattggtattgtgggaagctcagtttggtgattttgcaaatggtgctcaagtaatttttgatcaattcataagctgcggggaatcaaaatggcttcgccaatctggacttgttgttttgcttcctcatggatatgatggccaaggtccagagcattctagtgcaagattggagcgctatcttcagatgagtgatgacaatccttttgtgattcctgagatggatcctacactacgcactcaaattcagcagtgtaactggcaaattgtaaatgtgacaactcctgcgaactactttcatgttcttcgtcgccagataaatcgggatttccgtaagccattgattgtcatgtctccaaagaatcttctgcggcacaaggactgcaagtcaaatctgtctgaatttgatgacgtgcaaggtcatcaaggatttgacaagcagggaacccgttttaaacgtctcattaaggatcagaatgatcactctgaccgagaggaaggcatcaagcgtctgatactttgttctggaaagatctattatgaactggatgaggaaagacagagaattcaaaggaaagatgttgctatttgtcgggttgagcaactatgcccattcccatatgatctggttcagcgggagttgaagcggtatccaaatgcagagattgtatggtgccaggaagagcctatgaatatgggagcatacacctatattactcctcgtcttacaactgctatgaccgcattaggtagaggtacatatgaggatattaagtatgttggccgggctccttcagctgccacagcaacagggttttcttcggtgcatgtaaaggaacaaagagaggttctagaaacggcgttgcaatctgctccagtcatctttccttgatgtttatctctaaagacaagtggtgtttatggatattaataatcaggatggaaaaatttcagcatcctgtttctcttattaggttaaggctggatatcaaactttgtttttaccattgagttagtgagttcccttagtagaaggcaggcgtgtcattattcaacagcagtgccatttttttctgtatcattaatgttttgcatatgataaaattcaaatctcttgttgaaatgagggacgctattttgttaggttcttttttgatccataaaataaa

SEQ ID NO: 1860 - DNA, 3504 bp, Eutrema halophilum
gcggtgcactttcttacttttccttctttctctgtctagttttcgaggggtaggagccacttcactgagcctccccatctttgatctaggttgagagaaaaaaaaagacatttgaaaaaattcgggagacctggggtttgtatgaattgttgttgcacatagaacacttgagctatggcttggtttagaactggttcctctgtggcaaagcttgccattagaaggacactgtgtcagtctcagtgtggctcttatgccactagaacaagggttttgccttctcaaagcagatatttccactctacgatactcaaatcaaaggcagagtctgctgcacctgttccacgtccggtcccactatctaagctgactgatagcttcttagatggaactagcagtgtgtatctagaggagctacaaagggcttgggaagctgatcccaactgtgtggatgagtcgtgggataacttcttcaggaactttgtgggtcaagccgctacatcgcctggaatctcggggcaaaccattcaagaaagcatgcgtttgttgttgcttgtcagagcttaccaggttaatggccacatgaaggccaagctggatcctttgggtctagaggagagagagattccagaagatctcacgccaggtctttatggattttcagaggctgatcttgacagggaattctttctgggtgtatggaggatgtccgggtttctgtctgagaaccgccctgttcaaacactaagggctatactgtcgaggcttgagcaggcttactgtgggactatagggtatgagtacatgcacattgctgatagggaaaagtgtaactggttgagagacaagatcgagaccccaacacctcgacagtacaatagtgagcgacgggtggttatttatgataggcttacctggagcacacagtttgagaacttcttggcttctaagtggaccactgccaaaagatttggactcgaaggtgcagagtctttgatccctggtatgaaggagatgttcgatagagctgcagatctcggggtagagaacatagttatcggaatgcctcacaggggtcgacttaacgttctgggtaatgttgtgagaaaaccactacgtcaaatcttcagtgagtttagcggtggcactaagccagtagatgaagttgggctttacaccgggacaggtgatgtgaaataccatttaggtacatcttatgatcgtccgactagaggaggcaaacatcttcacttgtctttgttggcaaaccccagtcacttggaagcagttgatcctgttgtgatcggtaaaaccagagcgaaacagtactacacaaaagatgagaacagaacaaagaacatgggtattttgatccatggggatggtagcttcgccggacaaggtgttgtatatgaaactctgcatcttagtgcacttcctaactactgtactggtggaacagtgcacattgtggtgaataaccaagtggctttcacaaccgatcccagggcaggaaggtcttctcagtattgcactgatgttgcaaaggctttagatgccccgatttttcatgtcaatgcggatgacgttgaagcagtggtgcatgcatgtgagcttgctgcggagtggcgccagaccttccattctgatgttgttgttgatttagtatgctaccgtcgctttggacataacgagatagacgaaccgtcattcacacagccaaaaatgtacaaggtgatacgcagtcatccctcgtcgcttcaaatctatcaggagaagcttttggaatctggacaggtaaaccaaggagatattgataagattcaaaagaaagtaagctcaatcctcaatgaagaatttggggcaagtaaagactatattccacaaaaacgtgactggctggcaagtcattggactggattcaagtcaccggagcagatttctaggatccgaaacactggtgttaagccagagattttgaagaatgtaggaaaggcaatctcaaccttcccagagaacttcaagccacacagaggagtgaaaagagtttatgaacagcgtgcccaaatgattgagtcgggagaaggcattgactggggacttggagaagctcttgcttttgctacactagttgtggaaggcaaccatgtccggctaagtggtcaagatgttgaaagagggactttcagtcatagacactcagtgcttcatgatcaagaaaccggcgaggagtattgtcccttagatcacctgaccatgaaccaagaccctgaaatgttcactgtcagcaacagctctctttcagaatttggtgttctcggatttgaactgggttactctatggaaaatccaaattctttggtaatatgggaagctcagtttggagactttgccaatggcgcacaggtgatgtttgatcagttcattagcagtggggaagcaaaatggctccgtcaaaccgggctagtagttctacttcctcatggatatgatggtcagggtcctgaacattccagtggaagattggagcgtttccttcagatgagtgatgacaatccttatgttatccctgagatggatccaactcttcgaaagcagattcaagaatgtaattggcaagttgttaatgtaactacacctgccaattatttccatgttctgcgtcgacagatacatagggattttcgcaagccgcttatagtgatggctccgaaaaacttgctccgtcacaaaaaatgcgtatcaaatctctctgaattcgatgatgttaaaggacatcctgggtttgacaagcaaggaaccagatttaaacggttaattaaagatcaaagtggtcactctgatctggaagaaggcattagacgtctagtcctctgctctgggaaggtctactatgagcttgacgaagagcgacagaagtctgaaacaaacgatgtagccatttgcagagtagagcagctatgtccattcccttatgatctcattcaaagagaactaaagcgatatccaaatgcagagatcgtttggtgtcaagaagagccaatgaacatgggaggatatcagtatatagcaccaaggctttgcaccgccatgaaagcaatgaaaagaggaatcttcaacgacatcaaatatgttggtcgtcttccttcagctgctacagccacagggttttaccagcttcatgttaaggagcaaaccgatcttgttcagaaagctcttcaacctgaccccatcacccctgtcatcccttagatccgttaaataaacacaaagaaagctcccttgagactctctgtataaagaagagagtaaacagagattcatgagaatctttggttatcaaattgggaaaaaaaaaacatatgtttgctagacattcacaccgctgtttgctaaacatatgtttggtttgaaagtttttcggttcaggttcatatttgagtttagtccggttttggatgataaaaatatacaaattcaaaataaaaattcataattaatgtc

SEQ ID NO: 1861 - DNA, 3373 bp, Triphysaria pusilla
ggacaacattccatagatcaggtcattcagattagggtttactcacagaacgtacgctatctttctcagtttctcggttgggtgaatagcaatggcgtggtttagatctgggtcgaatttgactaagcttgctatcagacgaactttatcacaaaccacatcttacactgcgcgaacaaaaactgctccttcacagagccgatattttcacaccacagtttttaagtcaaaggctcaatccgcccctgttcctcgtcctgttcccctctctaggctgaccgatagctttttagatggcacgagcagcgtttatcttgaggagctacagagggcctgggaacaagatcccaacagcgtcgacgaatcatgggacaattttttccggaactttgtcggccagtccagcacatctcccggaatttccggtcaaacgattcaagagagcatgcgtctcttgttgctcgtcagagcttaccaggtttacggtcacacaaaggctaaattagaccctctaggtttggaacagaggcccattcccgacgatctagatccggccctttacggtttttcagaagccgatttcgatagagagttctttgtcggagtttggagcatggctgggttcttgtctgagaaccgtcctgtccaaaccttaagggctatattgaaaagactggaacaatcttactgtggcagtattggatatgagtacatgcatatcgccgatcgcgaaaagtgtaactggttgagagacaaaatcgagacgcccacaccgactcagtataatcgggaacgacgtgaagtgatccttgaccggcttatttggagtacacagtttgagaacttcttggcagcaaaatggactgcagctaaaaggttcgggcttgaaggctgtgagactttgattcctggtatgaaggagatgtttgacaggtcagcggatcttggggttgagagtattgttattggtatggtaggctgaatgttttgggtaacgttgtccggaagcctctcagacagatatttagtgaatttagcggtggtacgaagcccgtggatgaggttggactttacaccgggaccggtgatgtcaagtatcatctggggacttcttatgatcggccgacaaggggaggtaggaggattcatttgtcattggtcgcaaaccctagccacttggaagcggtggaccccgttgtggttgggaaaactagagcgaaacagtattattctaacgacgttgacaggactaaaaacatgggtattttgattcacggtgatggtagttttgcgggtcagggtgttgtttacgagactctgcatcttagcgctctgccaaattacacgactggtggaaccattcacattgttgtgaacaatcaggtagcgttcactactgacccggcagctggaagatcatcccagtattgtactgatgttgcaaaagcattgagcactccgattttccatgttaacggggatgacgtggaggcggttgttcatgcctgtgaacttgctgctgagtggcgtcagaagttccatactgatgttgtggtcgatattgtgtgctatcgtcgatttgggcataatgagattgatgagccatctttcactcaacctaaaatgtataaggttataaggaatcatccttcggcgcttcagatttaccagaccaaacttgtagaatctggtcaggtcaccaaagaagacattgataagataaacagcaaagtaacttcaattctcaatgaagaatttctggccagcaaagaccatataactcaaagaagggactggctttcagcttactgggctggtttcaagtctcctgaacagctttcacgcatccgtaacactggggtcaagccagagatattgaagaatgttggcaaagctattacgagtcttccagaaaagtttaaacctcatagagcaattaagaggatttttgaagaccgtgcgaatatgattgagtcagggaagggtattgattgggcagtgggtgaagcccttgcctttgcaacattgcttgtggaaggtaatcatgtcaggttgagtgggcaagatgttgagcgaggtactttcagccatagacattctgttcttcatgatcaggaaacaggggaaatatactgccctttggatcatgttatcatgaaccaagatgaagagatgtttactgtgagcaacagctctctgtcagagtttggagtcctgggatttgagttaggttattcaatggaaaatcccaactctttggtactgtgggaagcccagtttggtgatttttcgaatggggctcaggtgatgtttgaccaattcgtgagcagtggggaggctaaatggctgcgtcaaaccggcttagttctcctcctgcctcatggatatgatggtcaaggcccagaacactcaagtgcccgtttggaacgtttccttcagatgagtgatgataatccctatgttatccctgagatggactcgaccctcaggaaacagattcaagaatgcaactggcaggtggtgaacgttactacacctgcaaattacttccatgttttgcgacgccagatacatagggaattccgtaaacctctgattgtgatgtcaccaaaaaacttactccgtcacaaggactgcaaatctaatttatctgagttcgatgatgttgagggccacgcgggtttcgacaagcaaggaaccagatttaaacgcctcataaaggaccaaaatgaccactcagatcttgaagagggtattagacgtcttgttctgtgctccggaaaggtttattatgagcttgatgaacagaggaaaaaagttgaaggaaaagacattgcaatctgtagggtggaacagctttgtcccttcccgtatgaccttgtgcaacgtgaacttaagagatatccaaatgcagaggtagtctggtgccaggaagagccaatgaacatgggtgcatacaactacattttgcctcgtctcggcacagccatgaaagctctgggtagaggttatgtggacgatgtcaagtatgtgggccgtgggccgtcagctgccacggctactggcttttaccaagttcacaccaaagagcaaaatgagattgtccagaaagccgtgcagcctgatccaattgattttctctcagtggtttgaagatatgcattttttgttgttttgcctaaattttccaattatactgtataatggtggttccgtaagtgtgggacgagtcttatgagaataaacctactactctggtctcaactctcaagtcaatgttatcattgatgagtgaatttttttgatgcgaagctgtttgatattttcctataaggaatatataattattccaattttatgacatcttgttttt

SEQ ID NO: 1862 - DNA, 3485 bp, Pseudotsuga menziesii
cggtattttgaatgctagtgtttgaagattggcgacgttgcattgtctgtaatttgaatcaagggcaattgtgagatatttcctcggttagggtttgatcgagtctggaaaccctaggtgtcagccatggtcttgcagaaaatttcctctggtttaatcagggcagctctcagaacccgcctggctcagtcctcatatacgaaaagagccttatggacccttccgcaggttcgatcgttgcactccacggggcataaattccagcaagcggccccggtgccgcgcgccgtgcctctgtcgaggttgaccgataatttccttgacggcaccagcagcgtgtacttagaggaattgcagagggcatgggaagcggatccgcagagcgtggatgagtcatgggacaattttttcgcaattttgttgggcaagcatcaacgtccccgggcatctccgggcagacgatccaggaaagcatgaggctgttgctgctcgtgagggcttatcaggtgaacggccacatgaaggcgaggctggatcctctagagttggaggagagagagattcccgtggatttggatcccgggctgtatggattcacagaggcggatctggatcgggagttttttctcggcgtgtggaggatgtcagggttcttgtctgagaatcggccagtgcagactttgcgggcaattttgagtcgattggaacaggcatactgtggcaccattggctatgaatacatgcacataccggaccgtgataagtgtaattggctcagggagaagattgagaggtaaccccagaggatacaatgcagagcgcaggcatgttatgcttgatcggctcatttggagttcacagtttgagaatttcttggctacaaagtggactgctgccaagcggtttgggctcgaaggcgcggagaccttgatcccaggtatgaaggaaatgtttgatcgggcagctgatatgggtgtggagagcatagttataggtatgtctcatagaggaagattgaatgttttgggcaatgtcgtcaggaagcctttgagacagattttcagcgagttcagcggtggcacgaagcctgtgtctgaagttggatcatacactggaacaggggatgtgaaatatcatttggggacatcatatgataggcctaccagaggtggaaaaaggatccacctttcattagttgctaatcccagtcacttagaagcagttgatccagttgtcgttgggaaaactagagcaaaacagtattattcaaatgacaaagagaggacgaaaaacgtggctgtattgattcacggagatggaagttttgctgggcaaggtgtggtctatgagacattgcatttgagtgctcttcctaactacaccacgggagggactattcacattgtggtcaataatcaggttgcattcacaactgatcccaaatccggaaggtcttcacaatactgtacagatgttgcaaaagccttgaatgctccaattttccatgtgaatggtgatgatgtggaggctgtggtgcatgcatgtgagcttgctgctgagtggcgtcagaccttccactctgatgttgttgtggatattgtttgttaccgtaggttcggacacaatgagatcgacgagccgtcttttacacagcctaaaatgtataaggtgattcgaaaccatccacgggcattggatttgtatgaaaagcagctaatagaaatggggcagttgtcgaaggaagaaattgatgctttgcacaataaggtcagttcaattttgaatgaagagttcataaacagcaaggagtatgttccaaaccgacgagattggcttgcagcatattggactggtttcaagtcaccagagcaactctcacgtatacgtaatacaggggtcaaaccggagatattgaaaaacgttgggaaagcaataacttctctaccagaaacattcaagcctcatagatctgtaaagaggatctttgaccaacgtgcacaaatgattgaaacaggggaaggtgttgattgggctgttggtgaagcacttgcatttgcaactctgttagtggagggtaaccatgtgaggctgagtggccaggatgttgagagaggtactttcagtcaccgacattcagttcttcatgaccaggaaacaggagaaagatattgcccatttgaccatgttaccataaatcaacctgaggagatgtttactgtgagcaacagttctctgtcagaatttggtgtcctgggttttgaattgggttattcaatggaaaatcccaattcattggtcctatgggaagctcagtttggtgattttgcaaatggtgctcaagtcatttttgatcaattcataagcagtggggaatcaaaatggcttcgccaaagtggactagttgttttgcttcctcatggatatgatggccagggtccagagcattctagtgcaagattagagcgctttcttcagatgagtgatgacaatccttttgtgatccctgagatggatcctacactacgcactcaaattcagcagtgcaactggcaagttgtaaatgtgacaactcctgccaactattttcatgttcttcgtcgccagataaatcgggatttccgtaaacctttgattgtcatgtctccaaagaatcttcttcggcacaaggactgcaagtcaaatctgtctgaatttgatgacgtgcaaggtcatcaaggatttgacaagcagggaacccgatttaaacgtctgattaaggatcaaaatgatcactctggcttagaggaaggcatcaagcgtctcgtactttgttctggaaagatctattatgagctggatgaggaaagacaaagaattcaaaggaaagatgttgctatttgccgggttgagcaactatgcccattcccatatgatttggttcaacgagagttgaagcggtatccaaatgcagagattgtctggtgccaggaagagcctatgaatatgggagcatacaactatattgctccacgtcttacaacttctatgacaacattaggtcgaggtaaatatgaggatatcaagtatgtcggtcgagctccttcagctgccacagcaacagggttttctttggtgcatgtaaaggaacaaagagaggttgtagaaacagcattgcaatctgatccaatcatatttccttgatgtttatctctatagacaagtggcgtttatggatattaacaatcagtatggaaaattttcagcatcctgtttctcttattagtcaaggatggatgtcaaaattagtttttaacatatcgtttccagtgtgttagtgagttccctcagttgaaggcaggcatgctattgttaaacagcagtaccaatttttatgtatcattaatgttttgcgtcgataagatttggatctctttcttggaatgagagactattttgttaggttcatttttgatctaaataataaaggtaataaattttcagagctg

SEQ ID NO: 1863 - DNA, 3126 bp, Brassica napus
tccttccactcatctctctacagaccaaacccacagagcaccaccgctcctattccccgagccgtccccctctccaaactaacagacagcttcttagatggcaccagcagcgtctacctggaggagctacaaagagcctgggaatccgatcccagcagcgtcgacgagtcctgggacaatttctttcgaaacttcgtcggtcaagccgcaacctcaccaggcatctccggccaaactattcaagagagtatgaatctgttgctgctcgtcagagcctatcaggtcaacggccacatgaaagccaatttagatccattaggtttggaacaaagagagatccccgaggatcttgacttggctctgtatggattcaccgaggctgatctcgacagagagttcttcttgggagtctggcagatgtccggcttcatgtccgagaaccgtcccgtgcagacgctccgctccattttggcgaggctccagcaggcttactgcgggagcattgggtttgagtacatgcacattgcggatcgggataaatgcaactggcttagagaaaagatcgagacgcccactccctggaggtacaacagggagcggcgcgaggtgattctcgacaggctggcgtggagcactcagttcgagaatttcttagctaccaagtggacgactgctaagagattcgggctcgaaggtggagagtcgctgatcccggggatgaaggagatgttcgacagggcggcggatctcggcgtcgagagcattgttatcggaatgtcacacagaggaaggttgaatgttttgggtaatgttgttaggaagccgttacgtcagatcttcagcgagttcagcggcgggattaggccggttgatgaagttggatacaccggaacgggtgatgttaagtaccacttgggaacctcttatgataggcccacgagaggtgggaagaagatccatctctcgttggttgcaaacccaagtcatctagaagctgctgattcagtagtcgtgggtaaaacaagagcgaagcaatactactccaaggatatggacaggaccaagaacttggggattttgattcacggagatggaagtttcgctggtcaaggagtggtttacgagacgcttcatcttagcgctctccctaactacaccactggtggtactatccacattgtggtgaacaaccaagtggccttcacgacggatccgagagctgggagatcgtctcagtactgtaccgatgtcgccaaggccttgagcgctcccatcttccatgtgaatggagatgatgttgaagcggttgttcatgcctgtgagcttgctgccgagtggcgtcagacttttcattccgacgttgtggtggatttggtttgttaccgtaggttcgggcataatgagattgatgagccgtctttcactcagccgaaaatgtacaaggttatcaagagccatccctcgacgcttcagatataccacaagaagcttttggagtgcggcgagatatcgcagcaggatatcgacaggatacaggagaaggttaacactattctcagtgaagagtttgttgctagtaaagattatctgtctaagaagcgtgattggctttcgaccaattgggctgggttcaagtctcctgagcagatctctcgtgttagaaacacaggcgtgaagccagagatacttaagactgttggcaaggcgatttcgtcgcttcctgaaaacttcaagcctcacagagcggtgaagaaagtttacgaacaacgtgctcagatgattgaaacgggagaaggaattgactgggcgcttgcggaggctcttgctttcgctacattagttgtggaagggaaccatgtccgtttgagtggtcaggatgtggaaagaggaaccttcagtcaccgtcattctgtgcttcatgaccaggaaactggagaagagtattgtcctctggatcatctcgtcatgaatcaggatcctgagatgttcactgtcagcaacagttctctttcagagtttggggtccttgggttcgagttgggttactcaatggaaagccccaactcgttggtgctatgggaagctcagtttggagactttgccaatggagctcaggtgatatttgatcagttcatcagcagtggagaagccaagtggctgcgtcaaaccgggcttgttgtgctacttccccatggatatgatggtcagggccctgaacattcaagtgccaggctggaacgttaccttcagatgagtgatgacaacccctatgtcataccagacatggaacctacaatgagaaagcaaatccaggaatgcaattggcagattgtcaatgccaccactcctgccaactattttcatgttctgcgtcgacagatacacagagacttccgcaagcctctgattgtaatggcaccaaagaacttgctccgtcacaaggactgcaaatcaaacctctcagagtttgatgatgtccaaggccacccaggttttgacaagcaaggaactaggttcaagagattgatcaaggatcagaacgatcactctgatcttgaagaaggcatcagaagattggtactctgctctggaaaggtttattacgagcttgatgatgagaggaagaaggttggggcaagcgatgttgctatttgtagagtggaacagctttgtcctttcccatatgatctcattcagcgagagctcaagagatatccaaatgcggagatagtttggtgccaagaagaggcgatgaacatgggagcattcagctacataactccaaggctgtggacagcaatgagaagcttaggcagaggagatatggaagacattaagtacgttggtcgtggaccttctgctgctactgccactggtttctacactttccatgtcaaagagcaagctgagctcgtccagaaagccatcgggaaggaacccatcagctgaaaaaatcttcatttttaagctgaactttgaataagaagtttcggtgaacaatgtgatacacaacactgacaaagtcttgtctttgcatttttttggccccgttgattttttgagcctgtcttgtgttgcaggtttatacacatcatctcatttttaataaaactttttgtttttctc

SEQ ID NO: 1864 - DNA, 3477 bp, Picea glauca
gtctggtaatttgaatcaaggcaattgtgtagagttttttgggttagtagtttgatcagtctgaaaccctaggtggcagccatggtcttgcagaaatttcctctggtttaattagggcagctctcaaaacccgcctggctcagtcctcatatacgaaaagagccctatggaccctgccgcaggctcgatcattgcactccacaggacataaattccagcaagcggccccggtgccgcgccccgtgccgctgtcgaggttgagcgataatttcctcgatggcaccagcagtgtgtacttagaagaattacagagggcatgggaaatggatccgcagagcgtggatgagtcatgggacaattttttccgcaattttgttgggcaggcatcaacgtccccgggcatctccgggcagacgatccaggagagcatgaggttgttgttgcttgtgagggcttatcaggtgaatggccacatgaaggcgaagctggatcctctagggttggaggagagggagattcccctggatttggatccagggctgtatggattcacagaggcggatctggatcgggagtttttcctcggcgtgtggaggatgtcagggttcttgtctgagaatcggccggtgcagactctaaggtcaattctgagtcggttggaacaggcttactgtggcaccattggttatgaatatatgcacataccagaccgcgataagtgtaattggctgagggagaagattgagacagtggctcccagaggatacaatgcagagcgcaggcatgttatgctagatcggctcatttggagtacacagtttgaaaatttcttggctacaaagtggactgctgccaagcggtttgggctcgaaggcgctgagaccttgatcccaggtatgaaggaaatgtttgatcggtcagctgatatgggtgtggagagcattgttataggtatgtctcatagaggaagattgaatgttttgggcaatgtcgtcaggaagccattgagacagattttcagcgagttcagtggtggcacgaagcctgtgtctgaagttgtcggatcatacactggaacaggagatgtgaaatatcatctggggacatcatatgataggcctaccagaggtggaaaaaggatccatctttcattagttgctaatcccagtcacttagaagcagttgatccagttgtggttgggaaaactagagcaaaacagtattattcaaatgacaaagagaggagaaaaacttggctatattgattcatggagatggaagtttggccgggcaaggtgtggtctatgagacattgcatttgagtgcccttcctaactacaccgttggagggactattcacatcgtggtcaataatcaggttgcattcacaactgatcccaaatctggaagatcttcgcaatactgtacagatgttgcaaaagccttggatgctccaattttccacgtgaatggtgatgatgtggaagctgtggtacatgcatgtgagcttgctgctgaatggcgtcagatcttccagtctgatgttgttgtggatattgtttgttaccgtaggttcggacacaatgagattgacgagccatcttttacacaacctaaaatgtataaggtgattcgaaaccatccacgggcattggatttgtatgaaaatcaactaatagaaatggggcagttgtcgaaggaagaaattgatgctttgcacaataaggtcagttcaattttgaatgaagagttcataaacagcaaggagtatgtcccaaaccgacgagattggcttgcagcatattggaccggttttaagtcaccagagcaactctcacgtatacgtaatacaggggtcaaaccggagatattgaaaaacgttgggaaaacaataacttctctaccagaaacatttaagcctcatagagctgtaaagagggtctatgaccaacgtgcacaaatgattgaaacaggggaaggcgttgattgggctgttggtgaagcacttgcatttgcaactctgctagtggagggtaaccatgtgaggctgagtggtcaggatgttgagagaggtactttcagtcaccgacattcagttcttcatgaccaggaaacgggagaaagctattgcccactggaccatgttatcattaatcaacctgaggagatgtttactgtgagcaacagttctctgtcagaatttggtgtcctgggttttgaattgggatattcaatggaaaatcccaattcgttggtcctgtgggaagctcagtttggtgattttgcaaatggtgcccaagtaatttttgatcaattcataagtagtggggaatcaaaatggcttcgccaaagtggacttgttgttttgcttcctcatggatatgatggccagggtccagagcattctagtgcaagattagagcgctatcttcagatgagtgatgacaatccttttgtgattcctgagatggatcctacattacgcactcaaattcagcagtgcaactggcaagttgtaaatgtgacaactcctgccaactattttcatgttcttcgtcgccagataaatcgggatttccgtaaacctttgattgtcatgtctccaaagaatcttcttcggcacaaggactgcaagtcaaatctgtctgaatttgatgatgtgcaaggtcatccaggatttgacaagcagggaacccgatttaaacgtctcatcaaggatcagaatgatcactctgacctagaggaaggcatcaaacgtctgatactttgttctggaaagatatattatgagctggatgaggaaagacagagagttcaaaggaaagatgttgctatttgtcgggttgagcaactatgcccattcccatatgatctggttcagcgggagttgaagcggtatccaaatgcagagattgtttggtgccaggaagaatctatgaatatgggagcatacaactatattactccacgtcttacaactgctatgaaagcattaggtcgaggtacatatgaggatattaagtatgtcggtcgagctccttcagctgccacagcaaccgggttttctcaggtgcatgtaaaggaacaaagagaggttgtagaaacggcgttgcaatctgctccaatcatctttccttgatgtttacctctaaatacaagtggtgtttatggatattaataatcagcatggaaaattttcagcatcctgtttatcttattaggtcaaggctggatgtgaaacttcggtttttaccatgccttttccagtgttttagtgagttcccttagttgaaggcaggcaacagcattgccatttttcctgtatcattaatgttttgcatacgataatattcggatctctcacgttggattgagagtcacactattttgttaggttcatttttgatccaaaaaataaaggtaataaattttcagagctgaccagattgaataattacaaaaattttgacgaaaaaa

SEQ ID NO: 1865 - DNA, 3411 bp, Eutrema parvulum
aggttgaaacaaaaaaaattcgaaatttcacgagacgcggtttttgtctggggtttgtatggtttgttgttgcacatagatcacttaagctatggcttggtttagaactggttcctctgtggcaaagcttgccataaggaggacactgtctcagtctcagtttggctcatatgctgcaagaacaagggttctgccttctcagagcagatggttccactctacaatactcaaatcaaaggccgagtctgtcgcacccgttccacgtccagtcccactttctaagctaactgatagcttcttagatggaacaagtagcgtgtatctagaggagctacaaagagcttgggaagctgatcccaacagtgttgatgagtcgtgggataacttctttaggaattttgtgggtcaagctgccacgtcgcctggaatctcggggcaaaccattcaagaaagcatgcgtttgttgttgctagtcagagcttaccaggttaatggccacatgaaggccaagctggatcctttgggtctagaggagagagagattccagaggacctcacaccaggtctttatggatttacagaggctgatcttgatagagaattctttctgggtgtttggaggatgtctggctttctgtctgaaaatcgtccggttcaaacactaagggctatactgtcgaggcttgagcaggcttactgtgggactatagggtatgagtacatgcacattgctgatagggaaaaatgtaactggttgagagacaagatcgagaccccggcagctcggcagtataatagtgagcgtagggtggttatttatgataggcttacttggagtacacagttcgagaatttcttggcttccaagtggacaacggccaaaagatttggacttgaaggtgctgagtctttgattcctggtatgaaagagatgttcgatagggctgcagatcttggggtagagaacatagttattggaatgccccacaggggccgacttaacgttttgggcaatgttgtcaggaaacctctacgtcaaatcttcagcgagtttagcggtggtactaggccagtagatgaagttgggctctacaccggaacaggcgatgtgaaataccacttgggtacatcttatgatcgcccaactagaggaggcaaacatcttcacttgtctttgttggcaaaccccagtcacctggaagcagttgatcccgttgtgatgggtaaaaccagagcgaagcagtattacacgaaagacgagagtagaacaaagaacatgggtattttgatccatggggatggtagttttgccggacaaggtgtggtgtatgaaactctgcatcttagtgcacttcctaactactgtaccggtggaacagtgcacattgtggtgaataaccaagtggctttcacaaccgaccccagggcaggaaggtcttcacagtattgcactgatgttgcaaaggctttagatgccccaattttccatgtcaatgcggatgacgttgaagcagtagtgcatgcatgtgagcttgctgcagagtggcgccagactttccattctgatgtggttgttgatttagtatgctaccgtcgctttgggcataacgagatagacgaaccgtcattcacacaaccaaaaatgtacaaggtgatacgtagtcatccctcgtcgcttcaaatctatcaggagaggcttttggaatctggacaggttacccaagaagatattgataagattcaaaagaaagtaagctctatcctcaatgaagaatttggggcaagtaaagactatattccacaaagacgtgactggctcgcaagtcattggactggatttaagtcaccggagcagatttctaggatccgaaacactggtgtgaagccagaagttttgaagaatgtggggaaggcaatctcaaccttcccggagaacttcaagccacacagaggagtgaaaagagtttatgaacaacgtgctcaaatgattgagtcggaagaaggcattgactggggatttggagaagctcttgcttttgctacactggttgtggaaggcaaccatgtccggctaagtggtcaagacgttgaaagagggactttcagtcatagacactcggtgcttcatgatcaagaaaccggcaaggaatattgtcccttagatcacctgactatgaaccaagaccctgaaatgttcactgtcagcaactagctctctatcagaatttggtgtacttggattcgaactgggttactctatggaaaatccaaattctttggtaatatgggaagctcagtttggagactttgctaatggcgcacaggtgatgtttgatcagttcattagcagtggggaagccaaatggctgcgtcaaaccgggttagtagttctacttcctcatggatatgatggccagggtcctgaacattccagtggaaggttggaacgtttcctgcagatgagtgatgacaatccttatgttatccctgagatggatccaactcttcgaaagcagattcaagaatctaattggcaagttgttaatgttactacacctgccaactatttccatgttctgcgtcgacagatacacagggatttccgcaagccgcttatagtgatggctcctaaaaacttgcttcgtcacaaaaaatgtgtatctaatctctcggaattcgacgatgttaaagggcatcctgggtttgacaagcaaggaaccagatttaaacggttaattaaagatcaaagtggtcactctgatcttgaggaaggtatccgacgtctagtcctttgctctgggaaggtctactatgagcttgacgaagagcgacaaaagtctgaaacaaataatgtagccatttgcagagtagagcagctttgtccgttcccttacgatctcattcagagagaactaaagcgatatccaaatgcagagatcgtgtggtgtcaagaagagccgatgaacatgggaggatatcagtatatagcaccaaggctttgcacggccatgaaagcactgaaaagaggaagcttcaacgacatcaaatacgttggtcgtcttccttcagctgctacagccacaggattttaccagcttcatgttaaggagcaaactgatcttgttcagaaagctcttcaacctgaccccatcactcctatcatcccttaagatgatcgataaagaagaggacactcttgaagccctttgagagtctgtataaggaagaaacaaaataaagattcatgagaatctttggttatcaaatagtttcactcgataatacatatgcttgctccttgctagacattcacgtcactgttgctacagaatttcatttcagtttggttttgaatgttttcggttcatggttcatatttgggtttagttcggtttcgcaataataaataca

SEQ ID NO: 1866 - DNA, 3052 bp, Brassica napus
ctcccgttcctcgtgctgttcccctctctaagctaaccgacagcttcttagatgggaccagcagtgtttacctcgaggagcttcaacgcgcttgggaagctgaccccaccagcgttgacgagtcctgggataatttctttaggaactttgttggtcaagctgcgacttctcccggcatctctggtcagacgattcaggagagtatgcgtctcttgttgctcgtgagggcttatcaggtgaatggtcacatgaaagctaagttggatccgttgggtttggagcagagggagattcctgaggatcttgacttggctctgtacggattcactgaggctgatcttgacagagagttcttcttgggagtctggcagatgtctggtttcatgtctgagaatcgaccggttcagaccttacgttctatattgacgaggctccagcaggcttactgtgggagtatcgggtttgagtatatgcacattgcggatcgggataagtgtaactggctgagggagaagatcgagactccaactccttggaggtacaacagggagcgccgcgaggtgattctcgacaggcttgcgtggagtactcagtttgagaatttcttagctaccaagtggacaacggctaagaggtttgggcttgaaggtggagagtctttgattcctggcatgaaggagatgtttgacagggcggcggatcttggagtagagagcattgttatcggaatgtcccacagagggagattgaatgttttgggtaatgttgttaggaagccactccgtcagattttcagcgagttcagcggcggtattaggcctgtggatgaggttggctacactggaaccggtgatgttaagtaccacttggggacatcttatgatcgacctacgagaggtgggaagaagattcatctctcgttggttgcaaacccaagtcacttggaagctgctgattcagttgttgttggcaaaaccagagcgaaacagtactactccaaggatttggacaggaccaagaacttgggtattttgatccatggagatggtagctttgctggacaaggagtggtttacgaaacgcttcatcttagtgctcttccgaactacaccactggtggtaccatccatattgtggtgaacaaccaagtggctttcaccacggatccaagggctgggaggtcttctcagtactgtactgatgttgctaaggctttgagtgctcccatcttccatgttaacggagatgatgttgaagctgttgttcatgcctgcgagcttgctgctgagtggcgtcagacgtttcattccgatgttgttgttgatttggtttgctacaggaggtttgggcataatgagatagatgaaccatctttcactcagccgaagatgtacaaggttatcaagaaccatccctcaacgcttcaaatctatcacaagaagctcttggagtgcggtgaaatatcacagcaggatatcgacaggatacaggagaaggttaacaccattctcaatgaagagttcgttgctagtaaagattatctatctaagacgcgggattggctttcaaccaattgggctggattcaagtctcctgagcagatctcacgtgttagaaacactggagtcaaaccagagatactcaagactgttggcaaggcgatttcatcactgccggagaacttcaagcctcacagagcggtaaagaaagtttatgaacagcgtgctcaaatgattgaaacaggagaaggaatagactgggcacttgcggaagctcttgcttttgctaccttagttgtcgaaggcaaccatgtccgcttgagtggtcaggatgtcgaaagaggaacctttagtcatcgtcattctgtccttcatgaccaggaaactggagaagagtattgtcctctagatcatctcgtcatgaatcaggatcctgagatgttcactgtcagcaacagttctctttcagagtttggagtccttgggtttgagttgggttactcaatggaaagcccaaactcgttggtgctatgggaagcacagtttggagactttgccaatggagctcaggtgatatttgatcagttcatcagcagtggtgaagccaagtggctgcgtcagaccgggcttgttgtgctacttccccatggatatgatggtcaaggccctgaacattcaagtgccaggctggaacgttaccttcagatgagtgatgacaacccctatgtcataccagacatggaacctacattgagaaagcaaatccaagaatgcaattggcagattgttaatgccaccactcctgccaattatttccatgttctgcgtcgtcagctacacagagatttccggaagcctttgattgtaatggcaccaaagaacttgctccgtcacaaggactgcaaatcaaatctctctgagtttgatgatgtccaaggccacccaggttttgacaaacaaggaactagattcaagcgattgatcaaggatcagaatgatcactctgatcttgaagaaggcatcagaagattggtactttgctccggaaaggtgtattacgagcttgatgacgagaggaagaaggttggcgcaagcgacgttgctatttgtagagtggaacagctttgtcctttcccatatgatctcattcagcgtgagctcaagagatatccaaatgcggagatagtttggtgccaagaagaggcgatgaacatgggagcatacagctacataactccaaggctatggacagcaatgagaagcttacgcagaggagatatggaagacattaagtacgttggtcgtggaccttctgctgctactgccactggtttctacactttccatgtcaaagaacaagcggagctcgtccagaaagccattggaaaggaacccatcagttaaaaaagaaactttatttttttgagtgaattctttaaataagaactttgggtgaatcaaagtgataaaacaacactgacaaaatcatgtctttgcttttttattggtcccattgatttttgaacccgtctcttgtgcaggttaatacggat

SEQ ID NO: 1867 - DNA, 3593 bp, Lactuca sativa
caactgttcttatgctctggttaaggtgcaaatggggcgaagctattggtcgcaatgaatgaataaatcgagatctatatacgctatctgcaaacaatcttcataaggagaaacggaagcggtttttgatctctcacagaattaggaattgagctctagaacacaaacttgaaggttaaaaatggcatggttgagagctggaactagtgtagcaaagcttgcaattaggaaaaccctaacacaaggcagatcctatgcatcaagacctcgactccttccatcaagaatccaccattttcacaccacaattcccaaatcaaaaccacaatcacccattccacgatctgttccactttccaaattatcagacaacttcttagatggaaccagcagtgtctacttggaagaaatgcagagagcctgggaggcggaccccactagcgtcgatgaatcatgggacaatttcttcagaaacttcgtaggtcaagcatccatatcccctggagtatccggtcaaaccattcaagaatccatgaaattgttattactcgtgagagcttaccaatttcatggccacatgaaagccaaattagatccattaagcctcgaacaacgagacatcccaggtgatcttgacccgggtttctacgggttcaccgaatccgacctagaccgtgaattcttcctaggggtatggaaaatgtcgggttttttatccgaaaatcgccctgttcaaaccctaagagcaatcttgactagactcgaacaagcttattgtggaagcataggttacgaatacatgcacattgcaaatcgcgatcattgtaactggttaagagacagaatagaaaccccatctccaagtcaatacaatagtaaaaggcgcgaagtcattcttgatagactcatttggagcacacaattcgaaaactttctagcaacaaaatggacagctgcaaaaagattcggtcttgaaggtggtgaaaccctaatcccaggtatgaaagaaatgtttgacagatcagcagatcttggagttgaaagcatcgtcattggtatgtcccacagaggaagattaaatgttttaggaaacgttgttcggaagccattaagacaaatcttcagtgaatttagtggtggaacaaaacctattgatgaagtcggactttatacaggaactggtgatgtgaagtatcatttagggacttcatatgatcgagccacaagaggtggaaaacatattcatttgtcgttagttgcaaaccctagtcatttagaagctgttgatcctgttgtgattgggaaaacacgagcaaaacaatactattctaatgatgtcgatagaacgaagaacatggggattttgattcatggagatgggagttttgctggacaaggtgttgtttatgagactttgcatttgagtgctcttcctaattatacaactggtggaacaattcatattgtcgtcaataatcaagtcgcgtttactactgatcccaaatcgggaagatcttcacagtattgtacggatgttgctaaagctttggatgctccgatttttcatgttaatggtgatgacgtggaagcggttgttcatgcgtgtgagctggcggctgagtggcggcagacgtttcattccgatgttgtggttgatattacgtgttatcgaagatttgggcataatgaaattgatgaaccttttttcactcagcctaaaatgtacaaggttatcagaagccacccatcggcacttgaaatctaccaaaagaagctgttggaaagtggtcaatcaacaaaagaagacatcgacagaatgcaaaagaaggtaaccacaatcttgaatgaagaattcatggcaagtaaagattacgcccaaaagaaaagggattggctttcagcttactggtctggattcaaatcccctgaacaactctcacgcattcgtaacaccggggtccagcctgaaatcttgaagaatgttgggaaggcaatcacaacgcttccagaaagcttcaaggctcacagagcagttaaaaagatatttggcgaccgattaaagatgatcgaatcaggggagggtgttgattgggcggttgcagaagcccttgctttcgcgactttgctggtggaggggaatcacgtgaggttgagtggtcaggatgttgagagaggtactttcagtcatcgtcattctgtcatccatgatcaggacaccggtgaacgatactgtccgttggatcatgttatgtccaatcagcatcccgaaatgttcactgtcagcaacagctctctttcggagtttggtgttctagggtttgaattgggttattcaatggaaaatccaaattcgttggtgttatgggaagcccaatttggtgatttttcaaacggagctcaggtcatgtttgaccaattcttaagcagtggggaggccaagtggctacgtcagactggcttagtcatattgctgcctcatggctacgatggtcaaggccctgaacattccagtgcaaggctcgaacgtttccttcaaatgagcgacgatgatccgtttgttatccccgaaatggaccccacactccgtacgcaaatccaaacatgcaattggcaagtcgtcaatgtcacaaccccagcaaattatttccatgtcttgcgtagacaactgcacagggactttcgtaagccgctaattgtaatgtctcctaaaaatctacttcgccataaagactgtaagtcaaatttatcagaattcgatgatgctgaaggccacccgggttatgacaaacaagggacccgttttaagcgtcttatcaaggatcaaaacggccactcggatctcgaagagggcattagacgcttagttctttgctctggaaaggtgtattatgagcttgatgaagcaaggaagtcaacgggaagcaaagacgttgcgatttgtagggttgaacagctttgccctttcccatatgacctaatccaacgtgaattaaagcgttacccaaatgcggagattgtttggtgtcaggaggagccgatgaacatgggggcatattcctacatttctcatcgccttgctacagccatgaaggtgttgggaagaggtaccatatatgacatcaaatacgtgggccggggaacctctgctgctaccgccaccggattctatggagttcacgggactgaacagtcggagttagtcaagaaagccttgcagcctgaccccatcccctcacctgcttaaacccggttcactataactataactcacaaccaataagggtacgccacctggcgaataagttttacaaattttgttcaccacgagtctcaacaattcggaaatttaataacacgcaatttatatatattctttaataactcataacacacactccaaactagtttatgatattccaaacaaattcaccaatttttatttaaatcaacaatataacatattaaactttgaatcagaacgcatatgcaatttgtaccaaattacaaggactgtttctgtaaagattatagtaaaaaggtaaaagattatataggtattaatgacgcaataaaacatgtgtcatgcacgtgct

SEQ ID NO: 1868 - DNA, 3264 bp, Panicum virgatum
ctcgacgggaccagcagcgtctacctcgaggagctgcagcgggcctgggacggccgaccccaactcggtcgacgagtcgtgggacaacttcttccgcaacttcgtcggccaggcggccaccacctcgcccggcctctccgggcagaccatccaggagagcatgaggctgctgctgctcgtcagggcgtaccaggtgagcggacacttgaaggccatgctcgacccgctggggctggaggagcgcccggtcccggacgtgctggacccggcattctatgagttctctgaagcggatttggaccgtgagttcttcctgggagtgtggaggatggcggggttcctgtccgacaaccggcctgtgcagacgctgcgttctgtggttgagcggctcgagcaggcctactgtggcaccattgggtatgagtacatgcacattgctgaccgtgaaaagtgtaactggcttagggagaagatcgagacggttaacccaagggagtacacctacgatcgtcgccaggtcatgctcgataggcttatctggagcacacagtttgagaatttcttggcgaccaagtggactaccgcgaagcgtttcggtcttgaaggtgcagagactctgatccctggcatgaaggagatgtttgacagggcagctgatcttggtgtagagagtattgtcattgggatgccacacagaggcaggctgaatgttttgggaaatgtcgtgcggaagcccttgcgacagatcttcagcgagttcagtggtggtaccaagcctgttaatgaaggggaagggttgtatacagggactggtgatgttaagtaccatctaggaacttcgtatgatagacctaccaggggtgggaaacatattcatctgtcactggttgcaaacccgagtcatctggaagcagttgatcctgttgttgctgggaagacaagagcaaagcagtactattctaatgatcgtgacaggaccaaaaatttgggggtattgctgcatggtgatggtagtttctcagggcagggagttgtgtatgagaccctgcatctcagcgcccttgagaactacaccactggtgggacaatacatattgtggtcaataatcaggttgcattcactactgatccaaagtcagggagatcctcacagtattgcacagatgttgcaaaagcattggatgctcccattttccacgttaacggtgatgatttggaggcagtggttcatgtctgcgagcttgctgcagaatggcgacaaacatttcactctgatgtggtggtggacattgtatgctaccggcggtttggccataatgaaattgacgagccctcatttacccaacctaaaatgtacaaggtgatccggaaccatccaagtgcgcttgagatttatcaaaataagctgttagaatctgggaagatctcgaaggaagatattgacagattaaacaagaaggtcaacactatactgaatgaggaattcaagaacagcaaagactatgtccccaacaagagggactggctttcagcttactggactgggttcaagtcaccagagcagatttcacgtatcagaaacactggtgtgaagccggagattctaaaacgtgttggagaagccatgactactctgccagaaaatttcaagcctcacagggctgtgaagaagatttttgatcagcggcgtcagatgattgagactggagaaggcattgattgggcagtgggtgaagcacttgcttttgctactcttatagttgaggggaaccatgtcaggttaagtggtcaggatgttgagaggggtacattcagccaccgtcattctgtcatacatgaccaggaaactggagagcggtactgcccgctcgataatcttgttatgaaccaagatgaggagctttttactgtgagcaacagttccctgtcagaatttgctgttctgggctttgagttgggttactccatggagaacccaaactcactggtcctatgggaagctcagtttggtgattttgcaaatggagctcaagttatatttgatcagttcctgagtagtggggagtcaaaatggctccgccagaccggccttgtcgtgtgccttcctcatggatatgatggtcaggggcctgaacattctagtgcaagactggagcgctttcttcagatgagtgatgacaacccgtatgttatacccgagatggatccaacactgcggaagcaaatccagcagtgcaattggcaggttgtgaatgtaacgactcctgcaaattacttccatgttctgcgtcgccagatacaccgggacttcaggaagcctttgattgtgatgtccccaaagaacctccttcgccacaaggattgcaagtcgaatctatctgagtttgatgatcttgcgggccaccctggatttgacaagcaagggacacgcttcaagcggctcataaaggaccagaacaatcacaaggaccttgaggagggaatcaaccgtctagttctttgctctggaaaggtgtactatgaactggatgaagaaagaaggaagacagagcgcactgatgttgccatatgtagagttgagcagctctgcccgttcccatacgacctcatccagcgggagttgaagagatatccaaatgccgagatcgtgtggtgccaggaggagccaatgaatatgggtgcgtacagctacatcaacccccgcctgctgacggcgatgaaggccctgggcaggggcagcatcgatgatatcaagtacgtgggcagggccccgtcggcggccaccgcgacgggcttctactcggtgcacgtgcaggagcagacggagctggtgcagaaggcgctgcagcgcgaccccatcaactacctgttctgattctgaggaaggaaaaccccctgtagattcttggagtagccctggaattggagaccttttctattttgataccactagtaccgtagagagcagcaggtccgattcatacctgtgcagcagccatttggtgaagagaagggaaataatttgtttcggatgtacggtaccggatgaaagaaaaacgatttactcccgttttagcgcgtgttttgctctgcatcccgtaaattttataacgccataagctggtaaatgttgttattacaagtacacggttgaaaattcatgtttttatcagaggggtgatgcgtagatcttgttattacaagtaacaaaatatttacttatgggtgaatgcgcatgattttttgaagtcatggcataacttt

SEQ ID NO: 1869 - DNA, 1111 bp, Setaria italica
cccacccgcacccgacccatacccactccactggtgcgtagctaggacgacgtcaccttcaagctctcagctcagccgcctcgctcgaaccggaaagcgaagcagaggaagcgagccggcggcggcgacggagatgtcggcggggctggtgaccgacgaggtgaccatgggccggctctaccggatccggcggacggtgatgcagatgctgcgcgaccgcgggtacctggtggtggagcacgagctcgccaccagccgccgcgacttcctccgcaagttcggcgagtccttccaccgcgaggacctcctcatcaacaagtacaagaagaacgacccctccgaccagatatatgttttctttcccaacgatgacaaggtggggatgaaacacatcaagaagtatgttgaaatgatgacacatgagaacgtctccagagctgtgttggttcttcagcagaatctcactccattcgccaagtcgtttctcattgaattagagccaaagatacacttggaaattttccaggaggccgagttgcttataaatataaaggagcatgttcttgttcctgagcatcaggtgcttacaaatgaggagaagaagacactattggaacggtacaccttaaaggaaactcagcttccaagaatacagattacggatcctattgccagatactatggcctcaaacgaggtcaggtcgtgaagatcatcagacccagtgagacggccggcagatacgttacataccgctatgttgtatgagtaaactcaaaactcaagtgaactgaagaagagaaccatagatatggtaaattttgaaggtacacaaatccatttgcttggagaaatcagtatcgctttgtagcagaccctatcaacgaccagtgtctgctgtttaagtgaatttgaataagctgagtatatggaccacgcatggaattctcatgctgtacacttgcttgatgaactgtataaacactacatttttagatactggtataaacactacataaaaagaagcttgttttcggagcaatagaagctcctacattgcttatggataaatcttggatattttgagcactcatgatgaattatcttcgtcgt

SEQ ID NO: 1870 - DNA, 1073 bp, Saccharum officinarum
gtcgacccacgcgtccggccgcctcgctcgaagtctcgaaccagaaagcgaagaagcagaggaagcgaggcggcggaagcggagatgtcggcggggctggtgacggacgaggccaccgtggggcggctgtaccgggtccggcgcacggtgatgcagatgctgcgtgaccgtggctacctggtggtggagcacgagctcgccaccagccgccgcgacttcctccgcaagttcggcgagtccttccaccgcgaggacctccaaatcaacaagtccaagaagaacgacccctccgaccagatatatgttttcttccccaatgatgacaaggtagggatgaagcacatcaagaagtacgttgaaatgatgacgcatgagaatgtctccagagctgtgttggttcttcagcagaacctaactccatttgcaaagtcgtttctcatagaattggagccaaagatccatttggaagttttccaggaggccgagttgcttataaacatcaaggagcatgttcttgttcctgagcatcaggtgctcacaaatgaggagaagaagacgctattggagcggtacaccttaaaggaaactcagcttccaagaatacagatttcggatcctattgctaggtactatggcctcagacgaggtcaggtcgtgaagatcatcagacccagcgagacggctggcagatacgttacataccgctatgttgtatgacaaaacgtcagaacgcaggtgaactgaagaagagaaccatagatatggtaattttttgaagctacacatacccccatgtggttggagacatcagtatcgctttgtaccagccactattaacgatcagtggctggtgtgtaagtgaattgaataacctgatttatggaccatacatgaattctatgttgtacactttggtttgttgacttgttaaacacatcaaataataaaggaaccttgttttggagcaacagaaacttctgcgatcaggattttgaataaaaaaaaatattcaattatataaaaaaagggggccgctttaaggaaccaacttatttcgcggggtgggaggtata

SEQ ID NO: 1871 - DNA, 1052 bp, Pennisetum glaucum
tcagcttcaagctctctcagctcagccgcctgcccgcctcgctcgaaaccggaaagcgacgcagaggaagcgagccggcggcggccggcagcggagatgtcggcggggctggtgaccgacgaggtgaccataggccgcctctaccggatccggcggacggtgatgcagatgctgcgcgaccgcgggtacctggtggtggaccacgagctcgccaccagccgccgcgacttcctccgcaagttcggcgagtccttccaccgcgaggacctcctcatcaacaagtacaagaagaacgacccctccgaccagatatatgttttcttccccaacgatgacaaggtggggatgaaacacatcaagaagttcgttgaaatgatgacacatgataatgtctccagagctgtgttggttcttcagcagaatctcacaccattcgccaaatcgtttctcattgaattagaggcaaagatacacttggaagttttccaggaggcggagttgcttataaatataaaggagcatgttcttgttcctgagcatcaagtgcttacaaatgcggagaaaaagacactattggagcggtacaccttaaaggaaactcagcttccaagaatacagattacggatcctattgccagatactatggcctcagacgaggccaagtcgtgaagatcatcagacccagtgagacggccggcagatacgttacataccgctatgttgtatgagcaaagtcaaaaactcaagtggactgaagaaggggaccacagatatggtaaaattttgaaggtacacaaatccatttgcttggggaaaccagtatcggtttgtagcagacactgtcaacgaccagtggatgctgtttaagtgaatttgaataagctgagtatatggaccatgcatggaattcccatgatgtacactttgtatgacgaactgtataaacattacatttttggataatgatatagacactacataattaaaaaaaagtttgttttcggagcggtaaaagcccctgcattgcttatggataaatcttggatgtttg

SEQ ID NO: 1872 - DNA, 1200 bp, Sorghum bicolor
cccggccccgacccttcccatacccactccactgactccagtgctccactggtgcggcgcggagcgagggcgacgtcaccttcttcaggccccgccccgcccgggggtaggcgtaggcggtaggcctcagctcggctcagccgcctcgctcgaagtcgaaccagaaagcgaagcagagcagaggaagcgaggcgcgcgggcgggcggcggaggcgaagatgtcggcggggctggtgaccgacgaggccaccgtggggcggctctaccggatccggcgcacggtgatgcagatgctgcgtgaccgtggctacctggtggtggagcacgagctcgccaccagccgccgcgacttcctccgcaagttcggcgagtccttccaccgcgaggacctccaaatcaacaagtccaagaagaacgacccctccgaccagatatatgttttcttccccaatgatgacaaggtagggatgaagcacatcaagaagtacgttgaaatgatgacccatgagaatgtctccagagctatggtggttcttcagcagaacctaactccatttgcaaagtcgtttctcatagaattggagccaaagatccatttggaagttttccaggaggccgagttgcttataaacatcaaggagcatgttcttgttcctgagcatcaggtgctcacaaatgaggagaaaaagacgctattggaacggtacaccttaaaggaaactcagcttccaagaatacagatttcggatcctattgctaggtactatggcctcagaagaggtcaggtcgtgaagatcatcagacccagtgagacggcgggcagatacgttacataccgctatgttgtatgagacaaaacgtcagaacgcaggtgaacttaagaagagaaccatagatatggtaattttttgaagctacacataccccatgtgcttggagacatcagtatcgctttgtagcagacactattaacgataagtggctgttgtgtaagtgaattgaataagctgagtatatggaccatacgtgaattctcatgttgtacactttgttgtatgaactgtataaacactcaaataataaaaaagaagcctgttttcggagctgacagaagctcctgcaatcaggatttcggatttcagcatcctgtctttttatggatcctagtcgaaaaaaccaaatttcagggtcaaagtcttg

SEQ ID NO: 1873 - DNA, 1365 bp, Panicum virgatum
gactttatttagtactcttaattattagtcaaaatttttgtactactcatgctactgaaaaccaaacaggccctggtcactatttttctggtgaaaatcagagtggtaatttgtaaagcggcacagctgtaaacgatggcccggcccacagctgcttcccgcgtgccgctgccgtgctgtggccccacacgtcacccgcatcgcacacatgcgtggatccggcacgttcgcttcctcgcgcgcatccggaaagcgggcccacccgcacccgacccatacccactccgctggtgcggtgcggagcttggacgacgtcaccttccgctcagctcgcctcgctcgagcggcgagcccggaagaacgcgaagcagaggaagcgagccggcggaggcggcggagatgtcggcggggctggtgaccgacgaggcgaccatgggccggctctaccggatccggcggacggtgatgcagatgctgcgcgaccgcgggtacctggtgggtgagcacgagctcgccaccagccgccgcgacttcctccgcaagttcggcgagtccttccaccgcgaggacctcctcatcaacaagtacaagaagaacgacccctccgaccagatatatgttttcttccccaacgatgacaaggtggggatgaaacacatcaagaagtatgttgaaatgatgacacatgagaacgtctccaaagctgtggtggttcttcagcagaatctaactccatttgccaagtcatttctcatagaattagagccaaagatccacttggaagttttccaggaggccgagttgcttataaacatcaaggagcatgttcttgttcctgagcatcaggtgctcacaaatgaggagaagaagacactattggagcggtacaccttaaaggagactcagcttccaagaatacagatttcggatcccattgcaaggtactatggcctgagacgaggtcaggtggtgaagatcatcaggcccagtgagacggccggcagatacgtcacataccgctacgttgtatgagacaacgtcgtgaaactcagaacacaagtgaactgaagaagagaaccatagatatggtaatttttgaagttataaacacatacaccccatgtgcttggagaaatcagtatcgctttgtagcagacactgtcagcgatcgaacagtggatgccgtttaagtgaatttgaataagccgagtatatgggacacacatgaattctcacgctgtacactttttgatgaatgatctgtataaacactactacataataacagaagcttgttttcggagcgattgaagctcctgaaattgctcatggatgactcttgggcgttcagcactcctgccgaat

SEQ ID NO: 1874 - DNA, 984 bp, Panicum virgatum
gcgtccggcccggaagaacgcgaagcagaggaagcgagccggcggaggcggcggagatgtcgacggggctggtgaccgacgaggcgaccatgggccggctctaccggatccggcggacggtgatgcagatgctgcgcgaccgcgggtacctggtgggtgagcacgagctcgccaccagccgccgcgacttcctccgcaagttcggcgagtccttccaccgcgaggacctcctcatcaacaagtacaagaagaacgacccctccgatcagatatatgttttcttccccaacgatgacaaggtggggatgaaacacatcaagaagtatgttgaaatgatgacacatgagaacgtctccaaagctgtggtggttcttcagcagaatctaactccatttgccaagtcatttctcatagaattagagccaaagatccacttggaagttttccaggaggccgagttgcttataaacatcaaggagcatgttcttgttcctgagcatcaggtgctcacaaatgaggagaagaagacactattggagcggtacaccttaaaggagactcagcttccaagaatacagatttcggatcccattgcaaggtactatggcctgagacgaggtcaggtggtgaagatcatcaggcccagtgagacggccggcagatacgtcacataccgctacgttgtatgagacaacgtcgtgaaactcagaacacaagtgaactgaagaagagaaccatagatatggtaatttttgaagttataaacacatacaccccatgtgcttggagaaatcagtatcgctttgtagcagacactgtcagcgatcgaacagtggatgccgtttaagtgaatttgaataagccgagtatatgggacacacatgaattctcacgctgtacactttttgatgaatgatctgtataaacactactacataataacagaagcttgttttcggagcgattgaagctcctgaaattgct

SEQ ID NO: 1875 - DNA, 1307 bp, Oryza sativa
ttcccgcctggctgcgggggcccacgcgtcatccaccgcggcggcttgcgccgcacgttccacacgcatatccgcacccaactccactcgcacgtgcccgtcgtccccctcccctctccactccaacttgagctctagctctcgcactcgcaagcaagggaaagcgaggcggaaggaagctatcgcctagcagcggagaccgggagatcgagatgtcggcggggctcgtgacggaggaggtgatggtggggcggctggtgcggatccggcggacggtgatgcagatgctgcgggacagagggtacctggtggtggagcacgagctcgccatgggccgccgcgacttcctccgcaagtacggcgagtccttccaccgcgaggacctcctcatcaacaagtacaagaagaacgatccctccgaccagatatacgttttcttccctaacgatgacaaggtgggaatgaaacacataaagaagtacgtcgagatgatgaaagctgagaacgtctccagagcggtattggttcttcaacagaacctcactccatttgcaaggtcatttcttcaagaattagagccaaagatccacttggaaattttccaggaagccgaattgcttataaatatcaaggaacatgttctcgttcctgaacatcaagtgcttaacaatgaggaaaagaagacattattggagcggtacactctaaaggaaactcagcttccaagaatacaaattacggaccctattgcaaggtactatggcctcagacgaggacaggttgtgaagatcatcaggcccagcgagacagccggcagatatgttacatatcgttatgttgtataatagcagaaaaatgagatggagagcaccataaatctggtgatttttgcaggtatacatacatgaccatatgcttggagaaatcatatttctaaggagaagccatgttaatgatcccatggctgttatgtaagtgaattctcgtgagttaagcatatggaccatacataattcctcatgttgtacactttgtttcaagaactgtataaacagtacagaataaaaacaccagttttcagaggctcagagtttttcaaatggaatagtttcttctttttccaatgaattctagttatacgttcgtcgagatatttgtacactatggcaaaggcactaaaaaagaggtttctagagagaattatatgctatatatgatttcctttagaagattgaaaatagagatcaacactgtattttgtccatgtacagtttttgcgaataataaagcaaacgcatatacatctc

SEQ ID NO: 1876 - DNA, 1172 bp, Brachypodium distachyon
ccatgcgtcatagaccgacgcaacttgccgggcgcgtgacaaatattttatccgcccacccaacccactagggcgtgggaaaagcaagtgggggcggacggacgtcgtcgtcagctcagctcaagcttcccacctcggaaccgaaacgaggagccggcggcgggcgggatggcgtcggggctggtaacggatgacgccggcgtggggcggctggtccggatccggagcacggtgatgcacatgctgcgggaccgggggtacctggtggtggagcacgagctggccatgacccgccgcgacttcgagcgcaagtacggcgagtccttccaccgcgaggacctcctcatcaacaagtgcaagaagaacgaccccaacgaccagatatacgttttcttcccgaacgatgagaaggtagggatgaaacacatcaagaagtacgtcgaaatgatgaacgccgagaaagtctccagggctgtggttgtcgttcaacagaacctcaccccattcgcaaaatcgtttcttcaagagctggagccaaagatccacttggaggttttccaggatgctgaaatgcttataaacatcaaggagcatgttcttgttcccgagcatcaagtgcttactaatgacgaaaagaaaacactattggagcggtatactttaaaggaaactcagcttccaagaatacaaattacggatcccatcgcgaggtattatggcctcaaacgaggacaggttgtgaagattatcaggcccagtgagacagccgggcgatacgtcacatatcgctatgtcgtatgacagcacacgagtgaagtgaagcgaaatgaaggaagcaaggaaccataaacatggtgatttttgcagttacacacatgacatacatacccattttgcttggagaaacttgtgctgcttcagttcagagcagatattcttaaggatcacatgcatggctgctatgtaggtggactttttaataagccaatttagccaagtgtatggagcattcacgaaatcctcatgttgtaattgtttcgagaactgtactataaaacatacaggacaagaacacctgtatttgagagcaattaaaggctccgcatttctgcttcttacgatcatttgcatgaagcaccctcggactatatggatgacgaacttatttacta

SEQ ID NO: 1877 - DNA, 792 bp, Avena sativa
ctccacctccacctccaaaccgaagcgacgggcgccgccgccggccggcagagggagcggaggagagagggatgtcgggcctggtgacggatgacgccgccgtggggcggctggtccggatccggcggacggtgatgtgcatgctgcgtgaccggggctacctggtggtggagcacgagctggccatgaaccgccgcgacttccagcgcaagtacggcgagtccttccaccgcgaggacatgcaaatcagcaagtgcaagaagaacgacccaaacgaccagatatacgtcttcttcccgaacgatgagaaggtggggatgaagcacatcaagaagtacgttgaaatgatgacctctgagaaggtctccagggccgtgctggttgtgcagcagaacctcaccccgtttgcaaagtccttcctccaagaactggagccaaagatacacttggaggttttccaggatgccgaaatgcttataaatatcaaggaacatgttcttattcctgaacatcaagtgcttactactgaggaaaagaagacattattggagcggtacactttaaaggaaactcagctaccgagaatacaaattaccgaccccatcgcgaggtactacggcctcaaacgaggacaagtcgtgaagatcatcaggcccagcgagacagctggcagatacgtcacatatcgctatgtcgtatgacaaagtcacacaagtgaatgaaggaaccgtaaacatggtgatttttgcaggtatacacatgacatacacatacccatttgcttggcgaaac

SEQ ID NO: 1878 - DNA, 1000 bp, Pseudoroegneria spicata
  misc_feature (8)..(11): n is a, c, g, or t
  misc_feature (13)..(13): n is a, c, g, or t
  misc_feature (45)..(49): n is a, c, g, or t
gctccccnnnngncctcgaaaccgaagccgccgccgccgccgccnnnnncggaggaggaggagggagatggcgtcgggcctggtgacggaggaattgaccgtggggcggctggtccggatccggcgcacggtgatgcacatgctgcgcgaccggggctacctggtggtggagcacgagctgtccatgacccgccgggacttccagcgcaagtacggcgagtccttccaccgcgaggacatgctcatcaacaagtgcaagaagaacgaccccaacgaccagatatacgtgttcttcccgaacgacgagaaggtggggatgaagcacatcaagaagtacgtggaaatgatgaacgccgagaaagtctccagggctatattggtcgtacagcagaacctcaccccatttgcaaagtcgttcctccaagaactggagccaaagatccacttggaggttttccaggacgccgaaatgctaataaatatcaaggaacatgttcttgttccggagcatcaagtgcttgctaacgaggaaaagaagacgttattggcgcggtacactttaaaggaaactcagcttccaagaatacagattacagatcccattgcgaggtactacggcctcaaacgagggcaggttgtgaagatcatcaggcccagcgagacagccggcagatacgtcacatatcgctatgttgtatgacagtacacaagtgaggtgaaatcaaggaaccaagaacatggtgatttttgcagttacacacgacacacatacccattcgcttgcttggagaaaaccggtattgcttcaagcagccattcttaaggattacgtaagtggatttcttaataagctgagtgtatggagcataagcaaaatcctcatgttgtaccattgtttcaagaactttatagaacatacaaaatagaaactagtgtgctgagagcgatgaaaggttctacaattctgcttgttacattatttgaagcgaatcattcttga

SEQ ID NO: 1879 - DNA, 1284 bp, Triticum aestivum
gtcatccgcggacgcagcttgcaggcgcgcgtgacgatattgtatccgcgcagccaacccactcgcaggattggaaaaaagcagagtgggccgacgtcgtcgccctccgcaggtcaagctcagcagctccagctccgcctcgaaaccgaagccgccgccgccgccgccgccggaggaggaggaggaggaggagggagatggcgtcgggcctggtgacggaggacgtgacggtggggcggctggtccggatccggcgcacggtgatgcacatgctgcgcgaccggggctacctggtggtggagcacgagctgtccatgacccgccgcgacttccagcgcaagtacggcgagtccttccaccgcgaggacatgctcatcaacaagtgcaagaagaacgaccccaacgaccagatatacgtgttcttccctaacgacgagaaggtggggatgaagcacatcaagaagtacgttgaaatgatgaacgccgagaaagtctccagggctatattggttgtgcaacagaacctcaccccatttgcaaaatcgtttctccaagaactggagccaaagatccacttggaggttttccaggatgccgaaatgcttataaatatcaaggaacatgttcttgttccggagcatcaagtgcttgctaatgaggaaaagaagacgttattggcgcggtacactttaaaggaaactcagctaccaagaatacaaattacggatcccattgcgaggtactacggcctcaaacgagggcaggtggtgaagatcatcaggcccagcgagacagccggcagatacgtcacatatcgctatgttgtatgacagtacacaaactgaaggaaccaagaacatggtgatttttgcagttacacacaggacacacatacccattcgcttgcttggagaaaactggtattgcttcaagcagccattcttaaggatcgcatgcctgttacgtaaaaggattcttaataagctgagtgtatggagcataagcaaaatcctcatgttgtaccattgtttcaagaactttatagaacatacagaacagaaactagtgtgctgagagcaatgaaaggctctgcagttctggctgctacatcatttgaacgaaccattcttgaaactccatgattctggtcctgacgttgtgtgagtgtgtgtgtgtgtgtggtggtggtatgcgtgatgaacttcttctttacaatacatggtggatcctggagtagtattgtaagcatttactcaaggtaaaggaaaaattgctctgtttagt

SEQ ID NO: 1880 - DNA, 1226 bp, Hordeum vulgare
cttggaggcgcgcgtgacaatattctatccgcgcagccaacccacttgctggatttggagaaaagcagagtgggccgacgtcgtcgccctccgcaggtcaagctcggcagctgcagctccgcctcgaaaccgaagccgccgccggcagcgggggaggaggaggagggtgatggcgtcgggcctggtgacggaggacgtgacggtggggcggctggtccggatccggcgcacggtgatgcacatgctgcgcgaccgggggtacctggtggtggagcacgagctgtccatgacccgccgcgacttccagcgcaagtacggcgagaccttccaccgcgaggacatgctcatcaacaagtgcaagaagaacgaccccaacgaccagatttacgtgttcttccccaacgacgagaaggtggggatgaagcacatcaagaagtacgttgaaatgatgaacgccgagaaagtctcaagggctatattggttgtgcaacagaacctcaccccatttgcgaaatcgttcctccaagaactggagccaaagatccacttggaggttttccaggacgccgaaatgcttataaatatcaaggaacatgttcttgttccggagcatcaagtgcttgctaacgaggaaaagaagacgttattggcgcggtacactttaaaggaaactcagctaccaagaatacagattacggatcccattgcgaggtactatggcctcaagcgagggcaggtggtgaagatcatcaggcccagcgagacagccggcagatacgtcacatatcgctatgttgtatgacagtacacaaagtgaaatcaaggaaccaagaacatggtgatttttgcagttacacacatgacacatgacacacatacccattcgcttgcttggagaaaaacggcatcgcttcaagccgccattcttaaggatcgtatgcctgttacgtaagtggatttcttaataagccgagtgtatggagcataagcaaaatcctcatgttgtaccattgtttcaagaactttatagaacaatacagaacagaaactagtgtgttgagagccatggaaggctctgcagctccgattgctatatcatttgaatgaaccattcttgaaactccgcagccggcagctccggccatgacgttgtgtctgtgtgtggtattttttttttttagaaaagggtctgtgtgtggtatgggtgatcaacttctttacgatac

SEQ ID NO: 1881 - DNA, 973 bp, Leymus cinereus x Leymus triticoides
cgaagcgacccgggcgccgccgccgcagccgctggcagcggaggaggagggagatggcgtcgggcctggtgacggaggacgtgaccgtggggcggctggtacggatccggcgcacggtgatgcacatgctgcgcgaccggggctacctggtggtggagcacgagctgtccatgacccgccgcgacttccagcacaagtacggcgagtccttccaccgcgaggacatgcttatcaacaagtgcaagaagaacgaccccaacgaccagatatacgtgttcttcccgaacgatgagaaggtggggatgaagcacatcaagaagtacgtcgaaatgatgaacgccgagaaagtctccagggccatattggttgtacagcagaacctcaccccatttgcaaaatccttccttcaagaattggagccaaagatccacttggaggttttccaggatgccgaaatgcttataaatatcaaggagcatgttcttgttccggagcatcaagtgcttgctactgaggaaaagaaagcattattggagaggtacactttgaaggaaactcagcttccgagaatacaaattacggatcctattgcgaggtactacggcctcaagcgaggacaggtcgtgaagatcatcaggcccagcgagacagccggcagatacgtcacatatcgctatgttgtatgacagtacacaaagtgaaatcaaggaaccaagaacatggtgatttttgcagttacacacatggcacacatacccattcgcttgcttggagaaaaccggtattgcttcaagcagccattcttaaggatcgcatgcctgttacgtaagtggaattcttaacaagctgagtgtatggagcataagcaaaatcctcatgttgtaccattgtttcaagaactttatagtacatacagaatggaaactagtgtgctgagagctctgcaattctgcttgctacatcatgtgaacga

SEQ ID NO: 1882 - DNA, 1173 bp, Avena sativa
aaagcagagtgggacgacgtcgtcgcgctccgcaggtcaagcaggctcaccagctccacctccacctccaaacacgaagcgacggccgccgccgccggacggcagcgggagcggaggagagggggatggtcgggcctgggtgacagatgacgccgccgtggggcggctggtccggatccggcggacggtgatgtgcatgctgcgtgaccggggctacctggtggtggagcacgagctgtccatgaaccgccgcgacttccagcgcaagtacggcgagtccttccaccgcgaggacatgcaaatcagcaagtccaagaagaacgacccaaacgaccagatatacgtcttcttcccgaacgatgagaaggtggggatgaagcacatcaagaagtacgttgaaatgatgaactctgagaaggtcttcagggccgtgctggttgtgcagcagaacctcaccccatttgcgaagtccttccttcaggaactagagccaaagatacacttggaggttttccaggatgccgaaatgcttataaatatcaaggaacatgttcttattcctgaacatcaagtgcttaccactgaggaaaagaagacattattggagcggtacactttaaaggaaactcagctaccaagaatacaaatcaccgaccccatcgcgaggtactacggcctcaaacgaggacaagtcgtgaagatcatcaggcccagcgagacagccggcagatacgtcacatatcgctatgtggtatgacaaagttacacacaagtgaatgaaggagccgtaaacatggtgattgtttcaggtatacacatggcatacacacacccatttgcttggcgaagccggtatttcttcagacagccattctcatggatagcatggctgtacaagtgtatggattataagtgaaatcctcatgttgttcaattgtttcagagaactgtatacaacatacagaataggaaacatacctgtgtggagagcagtaaaaggtcctgcggttctgctttgtcacatcatttgagagaatgaatcccatacttcagaaataacgaactttattttttttatcgtggagtagcaatgtatgttttctctcaattatcttactactactacaaatatgttactactgaaactatgcaagtgctccggaaaattcggtg

SEQ ID NO: 1883 - DNA, 1119 bp, Secale cereale
ggcgtcgggcctggtgacggaggacgtgacggtgggcggctggtccggatccggcgcacggtgatgcacatgctgcgcgaccggggctacctggtggtggagcacgagctgtccatgacccgccgcgacttccagcgcaagtacggcgagtccttccaccgcgaggacatgctcatcaacaagtgcaagaagaacgaccccaacgaccagatatacgtcttcttccctaacgacgagaaggtggggatgaagcatatcaagaagtatgttgagatgatgaacgccgagaaagtctcccgggctatattggttgtgcaacagaacctcaccccatttgcaaaatcgtttctccaagaactggagccaaagatccacttggaggttttccaggatgccgaaatgcttataaatatcaaggaacatgttctcgttccggagcatcaagtgcttgctaacgaggaaaagaagacgttattggcgcgctacactttaaaggaaactcagctaccaagaatacagattacggatcccattgcgaggtactacggcctcaagcgagggcaagtggtgaagatcatcaggcccagcgagacagccggcagatacgtcacatatcgatatgttgtatgacagcacacaaagtgaaaccaaggaaccgagagcatggtgatttttgcagttacacacatgacacacatacccattcgcttgcttgaagaaaaccggtatcgcttcaagcagccattcttaaggatcgcatgcccgttacgtaaaaggattcttaataagctgagtgtatggagcataagcaaaattctcatgttgtaccattgtttcaagaactttatagaacatacagaatggaatctactgtatttgagagcggtgaaaggattcgctgttctgcttgttatatcatttgaacaaaacattcttgaaactcccgggactcacgtcatgaagttgtgtgagtgtgtgtggtggtggtggtggtacgcgtaatgaacttctttacagtatgtgtaatgaagtgctaccgatcgatggttgttctagggtttactcttttcatgaaagaaagggtagtgctggatatcttgccggtattatttgtttccg

SEQ ID NO: 1884 - DNA, 887 bp, Lolium multiflorum
gacggccgccgccgccggcagcgcgagcggatatgtcgtcgggtctgatagcggaggacgtcgccgtgaagcggatggtccggatccggcggacggtgatgtgtatgctgcgtgaccgcggctacctggtggtggagcacgagctgtccatgaaccgccgcgacttcgagcgcaagtacggcgagtccttccaccgcgaggacatgctcatcaacaagtgcaagaagaatgaccccaacgaccagatatatgttttcttcccgaacgatgagaaggtggggatgaagcacatcaagaagtatgtcgaaatgatgaacgctgagaaagtctccagggctctgctgatcgttcagcagaacctcaccccatttgcaaaaaacttcatcattcaagaactagagccaaagatccacttggaggtttttcaggatgccgaaatgcttataaatatcaaggaacatgttcttattccggagcaccaggtgcttactaatgaggaaaagaagacattattggcgcgctacactttaaaggaaactcagctaccaagaatacaaatgaccgatcccattgcgaggtactacggcctcaaacgaggacaggttgtgaagatcatcaggcccagcgagacagcaggacgatacgtcacatatcgctatgtcgtatgacaaagtgcccaagcgaagaaggaaggaaccgtaaacatggcgatttttgcagttatacacatgacatacacatacccatttgcttgaagaaaaccagtattgcttcagacacggcattcttaaggatcgcgtggctgttatgtaagtggattcttaataagttgggtgtatggagcatacataaaatccatcgtgttgtacctcggccgcgaccacgct

SEQ ID NO: 1885 - DNA, 2086 bp, Sorghum bicolor
cctcgccatggacccacccgtcggcgggtgaggtcgattgggagccttggtcttgtatgtcgaagcgccccccaagatttaccgatccaaatgtgcgcttccctccctctcgtaatcggaggcgatttatttagacgttaaaaacccgacgcgatacggaaccccgcagcttagcggaaagcttcaaagggaggaagagggagcctgagaggaggtggaggaaatggctgcggcggcggatgtgtcgacggcggcgaggactagtagcagcccggcggcggaggagggggggcagcggggcgagcacgagagcgagagcgagggggaggaggtgggtgtggcggccgtgctggacttcgacatgctgtgcgcgtccgtggcgctgtcggcggagaggaggaaaggcgccgccgcgccggagggggcggctggcgactgcggcggcggaggcggaggggtgcagaggatgtgggagggcgacgtcgtgctggattgcttggaggaccggcgaatcgcgctcgaggcgtcctgctgcccatgctatcggtttggtaagaacatgcggagagccaatctcggatcttgcttccttcagggaatggtttactgcattctgttagctgctgtcctgatcagcctaattgccttttctgtaacaaggcatcatatatatttatatatgggacttggctctgtcctcttgatagcgatctatactggttatttccggagaagaatcaggaagcaattcaacattcggggtactgagagcagtctggacgattgtgttctccatctcatatgtccctgctgtacgctgtgccaggaggctagaactttggagatgaacaatgtccagtgtggtgtctggcatggacgaggtgataccatttgtttagggcgcaacggtgaaggaaacaaggctttcgctgccctgaacaaggcctctcttgtgcctataaagtccccagggttgtgtggcatggatagaacgtcaaatgctgctgacgagcatgagccacttgtcccaccagaccaactggagcaggtttaggtattctgtattgccacaacctctgcactttcccagaagggcttcgacagggctgagaaaaaaaatcattggtgcttcaattctctgccggcttatttaggtgcctgcatccattgatcccaagaactggactttgcagcaaccatacatgggtgatgatgggcgcaatcggcctgctgctgctgttataaaattcagtgatagcttttttttcgcgcagtcgaattgttaaggtccaagacagtacctgcataatgtccctacacgtgctcgggccttttgcctgaatccaactgtaaatttcagattcaacttagcagttcgagtgatacatagacacgaatgaaatggtaatgttctcatcaccgtccgtgcttgttccctatatgtttcttaggctgtcccttgtcatacttgtttccaggagctcgattaactctgtttccttgacgaaatttcattttctatcacaaatgtgtgcacaagaacatactaaacaggaattgcctgcgttcgtagcaaaattacagggctaacaatctgaattttagaccagcacaaaaggcgacctgaaatttgattccaattcagaagacatttgctggagatctcagaaacatgtggctttatttattttttgtcaggataagcagaggcctaagtacaattattgaaagggattatcctgacaaaagccttgcaaagttgcaggccagctgcttggtgggtgtctctctctgcctacccttcttttttctctgtgggatggccttttgagttgttaatatttttgtgggatagtgggctgtgggcgtgggtcagcttcagctcagtcactgtgtgggggatccgggctctggatctgaagtgtggttttccttttgctaaccaaaccattatagcgtctcactctcacgctagaaagaatacgtttgcgtgtgcttctctgcgtgtccacggactattgacatctttagttcatgtggggtgcttttctgaattatcttttgtctcctgcagatcaatcattat

SEQ ID NO: 1886 - DNA, 2983 bp, Panicum virgatum
ccccacagacctgccgccacccccaaccaccgctaaactactcgcctactccgatcacgcgcgcgttattgtcattgtccccacgggtgggtgattgcccgttttaaccagcaccccctgtcgttcgcgcacccaccccttttgactacaaaactgactcgtgggcccatgagcaaacgctttcccggttctcattctggacccacccgtcggcgggtgtggtcgacatgagagtcgggggcgtcgcgtaggttaaactggtgaagagatttaccgatccgtatgcgcgcgccatcctccctctcataatcggaggcggatttcgtagacgttaaaaacccggcgcggcgcggcgcgggacccccgcaacgccaatacgaaacggaaagcttcggagagcgagagggaaaggggagggagaagggagaggaggaggcggaggcgatggccccggaggcggcggaggtgtcgacggcggcgaggagcagtagcggtggtcctgcggcggaggaggagggggagcggcggcggggggagagcgagagcgagggggaggaggccggggtggcggcggtgctggacttcgacatgctgtgcgcgtccgtggcgctgtcggcggagcggaggaaggccgccgccgccgcggcggcgccggccggcgactgcggcggcggcgggggaggaggggtgcagaggatgtgggagggggacgtcgtgctggattgcctggaggaccggcggattgcgctcgaggcagcctgctgcccgtgctaccagtttggcaagaacatgcggagagccaatctcggatcatgcttccttcagggaacggtttacttcattctgttagcggctgttctggtcagcctaattgccttttcagtaacaaggcatcatatatatttatatatgggactcggctctgtcctcttgatagcgatctatactggttacttccggagaagaatcaggaagcaattcaacatccggggtactgagagcagtctggatgattgtgttctccatctcatatgtccttgctgtacgctgtgccaggagggtagaactttggagatgaataatgtccagtgtggtgtctggcatggacgaggtgataccatttgtttagggagcaatggtgaaggaaacaaggtttttgccgccctgaagaaggcctcgcttgtgcctataaagtccccagggttgtgtggcatggacagaacatcaaatgcagctgacgagcacgagccgcttgtcccaccagaccaactggagcaggtataggggacagtagaattggtactctgtatcaccacgacttctgtgcattctaatttccaccaagaagggcttggactgtcctgcgagaaaatcatctgtactgcacttctgcgccttcttattgtgttcttcaatccagtgacatgctggactttgcagcaagtcagcaatcatacatgggtgttgggcgcagtaggcctgttgttgtaaaattcagttatagtttttattgtgcaatcggtttatttaggtccaagactgtatctgcatactgtcacacgtgctcagggcttttgcctgcatccaactgtaaatttctggtacgtagacatgaatgaaatgggaaggttctcttcaccggctgtttgttccttctctttctgatgctgtcccttgtcaaacttgattcctggagcttggttagcaccattatttcctttttgttttccttgagaaatgtaattctccatcacaagtttaagcacaagatattgcaacagaaattgcctgcgtaaaaatattacagggttagcacttatgaacttaacacccgcacaagaagctgtctgagatttgattcccattcagatggcaggcatgtgctggtgatctcagaaacctgtggctttgttcttgtcaggataagcagaagctagcgtaagtacaattattgaaatgggttattaagcctactaaagcattgcaaaggtgcaatgatgcaggtctgctggctgctgcctcatgggtcatgtctaatggagagtgtctctttctgtccctttcttttcttcatgtgggatggccccttttgagttcttaattctgatctctgagggataaggaaggtggccaggtgggcagctcagtgtggtggctttggtctccggggtgtgcttcaccttttgctaaccaaaccactagcggctcgcgctagaaagaatgcgtgtgcgtgtgccacggtttgacatctttagcaagttcattcatgggtggtgctttcttgaattattgtttcgtctctggatcaatcatcatgcctagttgcctactttgtctttgtcatgatcagccccttttttttctgtctggctttatttggctttacttgactgacagcagtagatatattgtgaaacagttaattaccttgcaaagttcaagagaacaggaaaagttttactagagataattaacgtgctaattgatggatccttttattttggttggaataaatgtgcaattgtttaagacaatgagaccggactaagactagtaggttgcgatgttgcatcttgtgttttgatatataaacaggacagtagaggaacggttgggctagatgaaccaaaagacaacctgatgcttcatgcttaagaatattttatatattctgatgcaaagcgaccgtgtaaacttcaggtcatgtttgactttgagcataaatgcatgtgaaggtcatgctctagctaggattctctccaataaaaaaaacaaaaaagcgatcatgtgttcataagccacgcgcttacccgtgcgttgcatgcatattcatgcatgcactccacgagccccatacagtacgcattgcggctataataatcaatcaaccaggcatattccaaatttaggtgaatcctccggcgctcaatattataatcaatctcatgacccttacgtttaggagggctcctcccaaatcaac

SEQ ID NO: 1887 - DNA, 2016 bp, Panicum virgatum
cgtcggcgggtgaggtcgacatgggagtcgggggcgtctcgtaggtggaagccccctcaagatttaccgatccgaatgcgcgccttcctccctctcataatcggaggcggatttcgtagacgttaaaaaaccggcgcgacacgggaccccccgcaacgccaatacgaaacggaaagcttcggagagcgagagggaaaggggagggagagggaggagagaggaggcgatggccccggaggcggcgaggagcagtagcggtagtcctgcggcggaggaggagggggagcggcggcggggggagagcgagagcgagagcgagggggaggaggccggggtggcggcggtgctggacttcgacatgctgtgcgcgtccgtggcgctgtcggcggagcggaggaagggcgccgccgcggcggcggcggccggcgactgcggaggcggcggcggaggcggaggggtgcagaggatgtgggagggggacgtcgtgctggattgcctggaggaccggcggatcgcgctcgaggcagcctgctgcccgtgctaccaatttggcaagaacatgcggagagccaatctcggatcatgctttcttcagggaatggtttacttcattttgttagtggctgttctggtgagcctaattgccttttcagtaacaaggcatcatatatatttatatatgggactcggctctgtcctcttcatagcaatctatactggttacttccggagaagaatcaggaagcaattcaacattcggggtaccgagagcagtctggatgattgtgttctccatctcatatgtccttgctgtaccctgtgccaggagggtagaactttggagatgaataatgtccagtgtggtgtctggcatggacgaggtgataccatttgtttagggagcaatggtgaaggaaacaaggctttcgctgccctgaagaaggcctcgcttgtgcctataaagtccccagggttgtgtggcatggacagaacatcaaatgcagctgatgagcacgagccgctcgtcccaccagaccaactggagcaggtatagggaataatacaattggtactctgtatcaccacgacctctgtgcattctaatttccaagaagggcttggactgtcctgcgagaaaatcatctgtactgcacttctgcgccttcttattgtgttcttcaatccagttacatgatggactttgcagcaagtcagcaatcatgcatgggtgttgggcacaataggcctgttgttgtaaaattcagttatagtttttattgtgcaatcggtttatttaggtccaagaccggatctgcataatgtcacacgtgctcagggcttttgcctgcatccaactgtaaatttctggtacgtagacatgaatgaaatgggaaggttctcttcaccggctttttttgttccttctttttatgctgtcccttgtcaaacttgattccaggagcttgattagcaccattattttcctttcgttttccttaagaaatgtaattatccatcaccagtttatctcaagatattgcaacaagtattgcctgtgtaaaaatattacagggttagcacttatgaacttaacacccgcacaagaagctatgtgagagttgattcccaatgagaaggcatgcatgtgctggagatctcagaaacctgtggctttgttcttgtcaggataagcagaagctagcgtaagtacaattattgaaaggggttattgagcctactaaagcattgcaaagttgcaatgatgcaggtctgctggctgctgcctcatgatgggtcatgtctaatgcagagtgtctctttctgtccctttcttttcttcatgtgggatggccccttttgagttcttaattctggtatctgagggataacgaaggtggccaggtgggcagctcagtgtggtggctctggtctccggggtgtgcttcaccttttgctaaccgtaccactagcggctcgcgctagaacgaatgcgtgtgcgtgtgccacggtttgaca

SEQ ID NO: 1888 - DNA, 1418 bp, Panicum virgatum
aaacggaaagcttcggagagcgagagggaaaggggagggagacggaggagagaggaggcgatggccccggaggcggcgaggagcagtagcggtagtcctgcggcggaggaggagggggagcggcggcggggggagagcgagagcgagagcgagggggaggaggccggggtggcggcggtgctggacttcgacatgctgtgcgcgtccgtggcgctgtcggcggagcggaggaagggcgccgccgcggcggcgccggccggcgactgcggcggcagcggaggggtgcagaggatgtgggagggggacgtcgtgctggattgcctggaggaccggcggatcgcgctcaaggcagcctgctgcccgtgctaccaatttggcaagaacatgcggagagccaatctcggatcatgctttcttcagggaatggtttacttcattttgttagcggctgttctggtgagcctaattgccttttcagtaacaaggcatcatatatatttatatatgggactcggctctgtcctcttcatagcaatctatactggttacttccggagaagaatcaggaagcaattcaacattcggggtaccgagagcagtctggatgattgtgttctccatctcatatgtccttgctgtaccctgtgccaggagggtagaactttggagatgaataatgtccagtgtggtgtctggcatggacgaggtgataccatttgtttagggagcaatggtgaaggaaacaaggctttcgctgccctgaagaaggcctcgcttgtgcctataaagtccccagggttgtgtggcatggacagaacatcaaatgcagctgatgagcacgagccgctcgtcccaccagaccaactggagcaggtatagggaataatacaattggtactctgtatcaccacgacctctgtgcattctaatttccaagaagggcttggactgtcctgcgagaaaatcatctgtactgcacttctgcgccttcttattgtgttcttcaatccagttacatgatggactttgcagcaagtcagcaatcatgcatgggtgttgggcacaataggcctgttgttgtaaaattcagttatagtttttattgtgcaatcggtttatttaggtccaagaccggatctgcataatgtcacacgtgctcagggcttttgcctgcatccaactgtaaatttttggtacgtagacatgaatgaaatgggaaggttctcttcaccggctttttctgttccttctttttgatgctgtcccttgtcaaacttgattccaggagcttgattagcaccattattttcctttcgttttccttaagaaatgtaattatccatcaccagtttatctcaagatattgcaacaagtattgcctgtgtaaaaaatattacagggttagcacttatgaactt

SEQ ID NO: 1889 - DNA, 1374 bp, Setaria italica
attagacgttaaaaaacccggcgcgataccgagaagaaccccccgcaaccgcaacaacgccagtacgaaacggaaagcttcggagcgagagggaaaaggggaggtacaggaggcggaggaggaggtaatggccgcggcggcggaggagttgtcgacggcggcgaggagcagtggtggtggtccgctggggacggaggaggaggaggaggagcggcggcggggggagagcgagagcgagggggaggagtccgggatggcggcggtgctggacttcgacatgctgtgcgcgtccgtggcgctgtcggcggagcggaggaagggcgccgccgcggcggaggcggccggcgactgcggaggcggagtcggaggcggaggggtgcagaggatgtgggagggggacgtcgtgctggattgcctggaggaccgccggatcgcgctcgaggccgcctgctgcccgtgctaccggtttggcaagaacatgcggagagccaacctcggatcttgcttccttcagggaatgttttacttcgttctgttagcggctgttctggtcagcctaattgccttttcagtaacgaagcatcatatatatttatatatgggacttgcctctgttctcttggtagcgatctatactggttacttccggagaagaatcaggaagcaattcaacatccggggtactgagagcagtctggatgattgtgttctccatctcatatgtccttgctgtacgctgtgccaggaggccagaactttggagatgaataatgtccagtgtggtgtctggcatggacgtggcgataccatttgtttagggagcaacggtgaaggaaacaaggctttcgctgccctgaacaaggcctcacttgtgcctagtaagtccccagggttgtgttgcatggacagaacatcaaatgcagctgacgagcacgagccgctcgtcccatcagcccaaccggagcaggtgtaatagaattgctattctgcatcaccacaacctctgcacattccaagaagggcttcaactgtcctgcgagaaaaatcatggttactgcacttctgcgccttcttattgtgtgcttgcatccagtgatctgatgctggacttggcagcaaccatacatgggagatgggcgcaatcggcctgttgttgtaaaattcagtgatatttctattgtgcaatcagtttatttaggtccaagaccgtatctgcataatgtcacacgagctcagggcttttgcctgaatccaactgtaaatttctgatgtaacttagcagtttcaacgatacatagacatgaatgaaatgggattccttctctttccatgctgtcccttgtcaaacttaattccaggagctttgttagcatc

SEQ ID NO: 1890 - DNA, 889 bp, Saccharum officinarum
attagacgttaaaaacccgacgcgatacggaaccccgcaactaagcggaaagcttcaaagggagggagggggagcctgagcaagggaggaggtcgaggaaatggccgcggcggcggaggaggtgtcgacggcggcgaggactggtagcagcccggcggcggaggaggcagagcggcggggcgagagcgagagcgagggcgaggagccgggggtggcggccgtgctggacttcgacatgctgtgcgcgtccgtagcgctgtcggcggagaggaggaaggccgccgcggcgccggcgggggcggccggagactgcggcggcggcggaggcacaggggtgcagcggatgtgggagggcgacgtcgtgctggattgcctggaggaccggcgaatcgcgctcgaggcgtcctgctgcccatgctatcggtttggtaagaacatgcggagagccaatctcggatcttgcttccttcagggaatggtttactgcattctgttagctggtgtcctgatcagcctaattgccttttctgtagcaaggcatcatatatatttatatatgggaattggctccatcctcttgatagcgatctatactggttacttccggagaagaatcaggaagctattcaacatccggggtactgagagcagtctggacgattgtgttctccatctcatatgtccttggtgtacgctgtgccaagaggctagaactttggagatgaacaatgtccactgcggtgtctggcatggacgaagtgataccatttgtttacggagcaacggtgaaggaaacacggcttcgctgcccctgacaccgcctctcttgtgcctattaaagtccccagggtgtgtggcatggatagaatgtcaaatgctgctgacgagc

SEQ ID NO: 1891 - DNA, 1705 bp, Sorghum bicolor
cccacgagacctgccatatcggagcgccaatagacagctcggccagcgagcgtcccacccaaaagtccaaagcccccccaccagccagccaccatcctcctcttcctcgaaaccgtcgaacgcacgcaccgcgccgccgcgtagcctcgcctcgcctcaccgtcgccggccgccgattcgacgcgacgcggcttcgaatctggaaaaggcaccgatgggggcgaagcgggcggtgctggtgggcatcaactacccgggcaccaaagcggagctcaaggggtgccacaacgacgtcgctcgcatgcgccggtgcctcgtcgaccgcttcggcttcgacgagtccggcatccgcgtcctcatcgatgacggctccgcgctgaagcccacgggggccaacatccggcgggaactcgcgcgcctcgtcggggacgcgcggcccggggacctgctcttcttccactacagcgggcacggcacacggctgcccgccgagaccgggcaggacgacgacaccggatacgacgagtgcatcgtgccctgcgacatgaaccttatcacagaccaagatttcacggagcttgtgcaaaaaatccccagtggctgtctctttaccatagtttctgattcgtgccacagtggtggactacttgacaagacgaaggaacagattggccacagcaccaagctgaaccagacccagcgccgggaacttgaagaacggcctgcttctgacactagcttccgggaattcctcaaagatactgttcgggacgtgtttgagtctaaaggaattcacctgccccaccgtagccatagccaccggcaaggtcacggtgacgacgatgatgctgaagagtcacgctacatcaacacagccgatgcccatgtcaaaaaccggtcgctacctctctcgacattgatcgagatgctcaaggagaagactgggaaggatgacgttgatgtaggctcaatccggctaacactatttaacctctttggagacgacgccagtccgaagataaagaagttcatgaaggtcatgctgaacaagttacagcagggacagcatggtggcattgtgggcttcatgggcgccctggcacaggaattcctgaaagccaagcttgatggcaaggaagaagagctcgacccagccatgaaacaaaatgtgcacagcgaccaagaggtgtatgccgggacgacggcgagggtgccaagcaacggtgtcctgatcagtgggtgccagaccgaccagacgtctgcggacgcgaccacaccgaagggtgtgtcctacggtgcgctcagcaatgccatccaggccatcctctcggagcgcgggaaggtaacaaacaaggagctcgtgctgaaagcgcgcaagatgctgtcgaaacagggctacacccaacagcctgggctctactgcagcgatgagaatgcgagtgtggctttcatatgctgattcattgggtttgtcctatggattgcaatatttgtatattgtcactttatggtgtccatgtgaggttgactggtggttatgtttttcgatgaaatttgggaatggattgtttcttcgcaggatgacattctttgaggttactatgtttaaccacattgacttttcaaagaaaaaaaatgtttaaccacatgaccggtacaccgagtttcatgtttgatcataatagtaaataaaatattatttctc

SEQ ID NO: 1892 - DNA, 1623 bp, Setaria italica
cccagcacgcctgccagataggcacgggggccaatagacagctcggcgccgcatcctaaagtcctaagccccaccagccaggcagccaccaccatcttcctcgaacgccccgcgccgcgcctcgcctcgcctcatctcatctcatcgcgccgccgcgtcgcctcgccccaccgtcgccggcggccgatcggcgcgccaccggatccggaaaaggggaacgatgggggagaagcgcgcggtgttggtggggatcaactacccgggcaccaaggcggagctcaagggctgccacaacgacgtcgcccgcatgcgccgctgcctcgtcgaccgcttcggcttcgacgagtccggcatccgcgtcctcgtcgacgacggctccggggggccgcagcccacgggggccaacatccggcgggagctcgcgcgcctcgtcggggacgcgcggcccggggacctgctcttcttccactacagcgggcacggcacgcggctgcccgccgagaccggccaggacgacgacaccgggtacgacgagtgcatcgtgccctgcgacatgaatcttatcacagaccaagatttcacggagcttgtgcaaaaagtccccgaaggctgtctgctcaccatagtctctgattcatgccatagtggtgggctacttgacaagaccaaggagcagattgggcacagtaccaagcagaaccagacccagcgccgggaactagaagagcggtctgattctggtaccagcttccgtgcattcctcaaagagactgtccgggacgtgtttgagtctcaaggaatccacttgcctcaccgtggccaccggcacagcgacgacggggatgatggtgatgaggagccacgctacatcgacgcagcagatgcccatgtcaaaaaccgatcgctacctctctcgacattgatcgagatgctcaaggagaagactgggaaggatgacattgatgtaggctcaatccggctgacgcttttcaacctcttcggagatgacgccagtcccaaggtcaagaagtttatgaaggtcatgctgaacaagctccagcagggccagcacggcggcgtcatgggcttcatgggcgccctggcacaggaattcctgaaagccaagctggaaggacagcaagaccagctcgagccagccatgaaccaagaggtgcacagcgaggaggaggtgtacgccgggacgacggctagggtgccaagcaacggcgtcctgatcagtgggtgccagaccgatcagacctctgccgacgcgaccacaccgaagggcgtctcctacggcgcgctcagcaacgccatccagaccatcctcgcggagcacgggacggtgacgaacaaggagctggtgctgaaagcgcgcaagatgctgtccaagcaggggtacactcagcagcctggcctttactgcagcgatgagcacgctagtgtggctttcatatgctgaagcgttggttatgtactgcaatctttgtacatttttactgtctatggagtgttgtgggctgctggctacgctttcattgagacatgggaatgagttgttttatcggtacatttggtttaaatttctcaaaaaacatttcagactataaagctgcatttgtc

SEQ ID NO: 1893 - DNA, 1682 bp, Panicum virgatum
tctaggctccaaacggggcccatctccaccaacccagaacgacctgccaggctgccagattgaaacgccaatagacagacagcaacaactcggcgccccacccaaaagtccaaagcaccaccagccacgcagtcacctccatcttcctcgaacgcgccggcgcctcgtctcaccgcgccgcctggcctcgcccagtcgccgtcgccggcggccgatcgacacgtcgcgccttcggatccggtcatcctgaagggagcgatgggggagaagcgcgcggtgctggtggggatcaactacccgggcaccaaggcggagctcaaaggctgccacaacgacgtcgcgcgcatgcgccgctgcctcgtcgagcgcttcggcttcgacgagtccggcatccgcgtcctcgtcgacgacggctccgggccgcagcccacgggggccaacatccggcgggagctccagcgcctcgtcggggacgcggcgcccggggacctgctcttcttccactacagcgggcacggcgcgcggctgcccgccgagaccggccaggacgacgacaccgggtacgacgagtgcatcgtgccctgcgacatgaaccttatcacagaccaagatttcacggagcttgtgcgaaaagtccccgagggatgtctgttcaccatagtatctgattcgtgccacagtggtggactacttgacaagaccaaggagcagattgggcacagcaccaagcagaaccaggccgagcggtctgattccggcagcagcggcggcttccgttcattcctcaaaggggctgtccgggacgtgttcgagtcccagggaatccacttgccccaccgtagccaccggcagagcgatgacggggaagatggtgacgaggagccccgctacatcgacacagcagacgcccatgtcaagaaccggtcgctacctctctcgacactgatcgagatgctcaaggagaagaccgggaaggacgacatcgatgtgggctcgctccggctgacgctctttgacctcttcggagacgacgctagccccaagatcaagaagttcatgaaggtcatgctgaacaagctccagcagggccagcacggcggtgtcgtgggcttcgtgggcgccctggcgcaggaactcctgaaagcgaagctggacgggaagcaggagcagctcgaggcggccatggaacaggaggtgcacagcgagcaggaggtgtacgcggggacgacggccagggtgccgagcaacggcgtcctgatcagcgggtgccagaccgaccagacctccgccgacgcgaccacgcccaagggctcctacggcgcgctcagcaacgccatccaggccatcctcgcggagcacgggacggtgacgaacacggagctcgtgatgaaagctcgcaagatgctgtcgaggcaggggtacacccagcagcctggactttactgcagcgatgagcacgccagtgtggctttcatatgctgaagcatcgatttatgtcgtgtcgacttcaatctttgtacgctgttactgtctgtggactatggagtgttgtgggttggtggttacgctattgagatctgggaattaaagtgtctctgcaggttatattgaagcacattatcggcacatttcgtttaagttttgctctgctctcctttcacagactataagggtctgtttgt

SEQ ID NO: 1894 - DNA, 1579 bp, Panicum virgatum
ccttgcgtccgcaaaagtccaaagcaccagccagccaggcgcagtcacctccatcttcctcgaacgcgccggcgcctcgtctcaccgcgccgccgcgcccagtcgccggtggccgatcgacgcgacgcgccttcggatccgggaagggagggagcgagagcgatgggggagaagcgcgcggtgctggtggggatcaactacccgggcaccaaggcggagctcaagggctgccacaacgacgtcgcccgcatgcgccgctgcctcgtcgagcgcttcggcttcgacgagtccggcatccgcgtcctcgtcgacgacggcggatccgggccgcagcccacgggggccaacatccggcgggagctccagcgcctcgtcggggacgcggggcccggggacctgctcttcttccactacagcgggcacggcacgcggctgcccgccgagaccggccaggacgacgacaccgggtacgacgagtgcatcgtgccctgcgacatgaaccttatcacagaccaagatttcacggagcttgtgcgaaaagtccccgagggatgtctattcaccatagtatctgattcgtgccacagcggtggactacttgacaaaaccaaggagcagattgggcacagcaccaagcagaaccaggccgagcggtctgattccggttccggtagcagcggcttccgttcattcctcaaaggggctgtccgggacgcgttcgagtcccagggaatccacttgccccgccgccgtggccaccggcagagcgatgacggggacgatggtgacgaggagccccgctacatcgacacagcagatgcccatgtcaagaaccggtcgctacctctctcgacattgatcgagatgctcaaggagaagaccggcaaggacgacatcgatgtgggctcgctccggctgacgctcttcgacctcttcggagacgacgcgagccccaagatcaagaagttcatgaaggtcatgctgagcaagctccagcagggccagcacggcggcgtcgtgggcttcatgggcgccctggcgcaggaactcctgaaggcgaagctggacgggaagcaggagcagctcgaggcggcggccatggagcaggaggtgcagagcgagcaggaggtgtacgcggggacgacggccagggtgccgagcaacggcgtcctgatcagcgggtgccagaccgaccagacctccgccgacgcgaccacgtccaagggctcctacggcgcgctcagcaacgccatccaggccatcctcgcggagcacgggacggtgacgaacatggagctcgtgacgaaagctcgcaagatgctgtcgaggcaggggtacacccagcagcctggcctttactgcagcgacgagcacgccagtgtggctttcatatgctgaagcatcggtttgtgtcgtgtcgacttcaacctttgtacactgttatgcctgtcgactatcgagtgttgtgggttggtggttacgcttttgagatctgggaataaaagtgtttctgcacaagataggattttccgtggtttatatttaagcacattatcggcaaatttcgtttaagttttct

SEQ ID NO: 1895 - DNA, 1981 bp, Panicum virgatum
atttttggtgtgacgttccgcgcaaggtaaatgagtggggttttcttcatgaaatacctctttgagtttggattggatggccattgagtgaacagtttcatcgtctcttctgtgacttgctactaattccctgatgcagcctgctcacccaaggattggctggaatccaggccatcgatgtccctggcgttgatcaccattcttgtgctcttagttaaatttcgttgctcatctatcaggttatcaggctatcaatcacgacccggtcacaaccacagcccttctccaccaacaagcaacaacccaccacgacccgccaggctgccagatagaaacgccaatagacagacagctcggcgccccacccaaaaagtcaaaagcaccaccagccaggcaggcgcagcgacctccatcttcctcgaacgcgccggcgcctcgtctcgccgcgcccagtcgccggtggccgatcgacgcgacgcgccttcggatccgggaagggagggagcgagagcgatgggggagaagcgcgcggtgctggtggggatcaactacccgggcaccaaggcggagctcaagggctgccacaacgacgtcgcccgcatgcgccgctgcctcgtcgagcgcttcggcttcgacgagtccggcatccgcgtcctcgtcgacgacggcggctccgggccgcagcccacgggggccaacatccggcgggagctccagcgcctcgtcggggacgcggggaccggggacctgctcttcttccactacagcgggcacggcacgcggctgcccgccgagaccggccaggacgatgacaccgggtacgacgagtgcatcgtgccctgcgacatgaaccttatcacagaccaagatttcacggagcttgtgcgaaaagtccccgagggatgtctattcaccatagtatctgattcgtgccacagcggtggactacttgacaaaaccaaggagcagattgggcacagcaccaagcagaaccaggccgagcggtctgattccggttccggtagcagcggcttccgttcattcctcaaaggggctgtccgggacgcgttcgagtcccagggaatccacttgccccgccgccgtggccaccggcagagcgatgacggggacgatggtgacgaggagccccgctacatcgacacagcagatgcccatgtcaagaaccggtcgctacctctctcgacattgatcgagatgctcaaggagaagaccggcaaggacgacatcgatgtgggctcgctccggctgacgctcttcgacctcttcggagacgacgcgagccccaagatcaagaagttcatgaaggtcatgctgagcaagctccagcagggccagcacggcggcgtcgtgggcttcatgggcgccctggcgcaggaactcctgaaggcgaagctggacgggaagcaggagcagctcgaggcggcggccatggagcaggaggtgcagagcgagcaggaggtgtacgcggggacgacggccagggtgccgagcaacggcatcctgatcagcgggtgccagaccgaccagacctccgccgacgcgaccacgtccaagggctcctacggcgcgctcagcaacgccatccaggccatcctcgcggagcacgggacggtgacgaacatggagctcgtgacgaaagctagcaagatgctgtcgaggcaggggtacacccagcagcctggcctttactgcagcgacgagcacgccagtgtggctttcatatgctgaagcatcggtttgtgtcgtgtcgacttcaacctttgtacactgttatgcctgtcgactatcgagtgttgtgggttggtggttacgcttttgagatctgggaataaaagtgtttctgcacaagatagcattttccgtggtttatatttaagcacattatcggcaaatttggttcaagttttctaaaaaacagtagctctgctctcctttcacggactataaagctgcatttgtc

SEQ ID NO: 1896 - DNA, 1341 bp, Saccharum officinarum
cgccggccgccgccatgccgcacctcgtgcgcgagcggctctacttcggcgacatcaaagacgccatcgccgccctcacggagtcctcccccacgccggacttcacgcacgtcctctccgtggtcagctccgcctccatctccttcatcaccgactgccgcccgggcctcgcgatccccaccgaggaggtccgccgcgtcgtcgcgggtgaggagggcgcgccaccggccgccgcggtgccccccgggacgctgatgcgggtggtcgagcgcgccgggcacgggctgcgggtcacgcgcatggccgtgccgctgcgggacaccgaggaggaggacctgctcgaccgcctcgagccctgccttgatttcatcgatgaaggcaggaaagtcgggaatgtcctcgtccattgctttgctggggtgtcgaggagtgcttccatcattgttgcttatcttatgagatcagaacagaaatctcttgaagatgcattagaagctttgaaggagatttctgagtcggcgtgcccgaatgatggttttcttgaccagctgaaattgtttgaagaaatgggcttcaaagttgatacttcaagtcctttgtacaagagattccgcttaaaattattaggtcaatcctacaaatttggggagaaaataggcagctatatgtttgaagatgaccctggccttgctccgcagtctggctcttgtcaagattcttcaaaggttgagcaacgtaaaacagcttaccgctgcaggaaatgcaggagagttattgctgtagaggacaatgttgtaagtcatgttcctggtgagggtgaatcttgctttgattggaaccgaaggaagagtggtcatccatacaacaacaaagaacaagattgctcatctttgtttgtcgaacctctgaaatggatgactgcagtagaagacagtgctttggaaggaaagctaccatgcatccactgtggagctcggttgggatacttcaactgggcaggaatacagtgcaactgcggcagctgggttactcctgccttacaaattgttaagagcaaagttgatatcagcaccatctagacctcgggtataggtaggacccctaccatcggcaagtttgagagacgaggagcatggcactactggcgcctgtcggcttaatattttgtgtacaatatgaactatacagaatacagtgaagcaatagcatcttgtatgtttttccattgctgatcagaagctgtgtgcagcaaacaccgtgtattacggatttgctgacgtaacaagttgccttgatgtcggtgatctatatggctggaaatggatcgaataccatttgagc

SEQ ID NO: 1897 - DNA, 1548 bp, Setaria italica
aactcactcgccggatttcactgattctcaccggtctcttcctccgccgccgccatgccgcacctcgttcgcgagcggctctacttcggcgacatcaaagatgccatcgccgccctcacggattcctcctccaccccgaccttcacccacgtcctctcggtcgtcagctccgcctccatctccttcatcaccgactgccgcccgggcctcgccatccccaccgaggaggtccgccgcgtcgtcgccggcgaggagggcgcgccaccgacagctgcggtgccccccgggacgctgatgcgggtggtggagcgcgctggggaagggctgcgggtcacgcggatggccgtgccgctacgggatacggaggaggagaacctgctcgaccacctcgagccctgccttgacttcatcgatgatggcaggaaggtggggaatgtcctcgtccattgctttgccggggtatctaggagtgcttccatcattgttgcttatctcatgagatcagagcagaaacctctggaagaagcattagaatctttgaaggaaatttctgagttggcatgcccgaatgatggttttcttgaccagttgaaattgtttgaagaaatgggcttcaaagtcgatacttcaagtcctttgtacaagagattccgcttaaaattattaggtcaatcctacaaatttggggagaaaataggcagctatatgtttgaagatgaccctggcctttctccactacctggctcttgtcaagatccttcaaagacagggcaacataaaactgcttaccgctgcaggaaatgcaggagaattattgctgtggaggacaatgttataagtcatcttcctggtgaaggcgaatcttgctttgactggaaccgaaggaagagtggtcattcatacagcaacaaagaacaagattgctcgtctttatttatcgagcctctgaaatggatgactccagtcgaagagggtgctttggaggggaagctatcatgcatccactgcggagctcggttaggatacttcaactggtcaggaatccagtgcaactgtggcagctgggttactcctgccttccaaattgttaagagcaaagttgatatcagcaccatctagacattgggaacggcctgcagagcgaccaaaccattggtgaagtttgagggataatgaggagtgtgacaatactggcaccttgctgatggtggcttcggcttaaggtttggtgtacaatatattcacatacatatagtgaagcaatagcatgttatcagaagctgtgtgcagcaaagattgtacaaaattacgcatttgatgttgtagcaacagattttgctgtgagagacagtcgtctgtaggctggaaatggaccgaatcatattgtgcagagaaaggcacatcagtatctgtaatctttcagtgaactcaaactccacggatgtttttgactttttttccattcttttttcaaggcgcagatgtatcttaaggttcaaacttttgtgatatgcgatcaactaatctatgaagattcaaacagtttcc

SEQ ID NO: 1898 - DNA, 1564 bp, Sorghum bicolor
tgcacgcagtaatttgggggttgggttaatgataatcacgattgaagttaggggttatacggtaaaaacaaaaaacaaaatgattctttgaaaaagaaaaactaggtcttccactcttcctccactcggcagatttcactgactcccaccggcggtctccgcctcctccgccggccgccgccatgccgcacctcgtccgcgagcggctctacttcggcgacatcaaagacgccatcgccgccctcacggagtcgtcccccacgccgcacttcacccacgtcctctccgtggtcagctccgcctccatctccttcatcaccgactgccgcccaggcccctcgattcccaccgaggaggtccgccgcgtcgtcgccggcgagaagggcgcgccgccgaccgcagccgtggcccccgggacgctgatgcgggtggtggagcgcgcgggccaggggctgcgggtcacgcgcatggccgtgccgctgcgggacaccgaggaggaggacctgctcgaccgcctcgagccctgccttgatttcatcgatgagggcaggaaggtcgggaatgtgctcgtacattgctttgctggggtgtcgaggagtgcttccatcattgttgcttaccttatgagatcagaacagaaatctcttgaagatgcattagaagctttgaaggagatttcagagtcggcatgcccgaacgatggctttcttgaccagctgaaattatttgaagaaatgggcttcaaagttgacacttcaagtcctttgtacaagaaattccgcttaaaagtgttagattcttcaaaggttgagcaacgtaaaacagcttaccgctgcaggaaatgcaggagagttattgctgtagaggacaatgttgtaagtcatgttcctggtgagggtgaatcttgctttgattggaaccgaaggaagagtggtcatccatacaacaacaaagaacaagattgctcatctttgttcgttgaacctctgaaatggatgactccagtagaagacggtgctttggaaggaaagctatcatgcatccactgcggagctcggttgggatacttcaactgggcaggaatacagtgcaactgtggcagctgggttactcctgccttccaaattgttaagagcaaagttgatatcagcaccatctagacctcgggtataggaccctcccctaccatcaacaactttgagagacgaggagcatggcactactggcgcctgtcggcttaatattttgtgtacaatatgaactatacagaatacaatgaagcagcgtcttgtatgtttttccattgctgatcagaagctgtgtgcagcgaacaccgtgtattagggatttgctgatgtaacaagttgccgtgatgtcggtgatctatatggctggaaatggatcgaatataatttgagcagagaaaggcacacgaactagtgcattcaaatgcgtgcccaatatgaatagtatttcattcctttttcaaggtgcacatgtatcttattaagattcaaactttttgtgatatgcaaccacctagtctaacagttctcagatttcc

SEQ ID NO: 1899 - DNA, 1630 bp, Oryza sativa
ggatttttgtaaaagattgtataaaaacgaaaaaaccccttgtcgtcttctccattgcgacactgaaactcaggcggcgccaccagccagagtcccacgacgttgctctgctagggttttgctccaccttcctcccacctcgcgccatcggattccaccttcccaggtctcccctcccctcccgtcgccatgcctcacctcgtccgcgagcgcctcttcttcggcgacatcaacgacgccatcgccgcgctcaccaccaccgccgcggacaccggcggcttcacccacctcctctccgtcgtcagctccgcatccatctccttcatcaccgactgccgcccgggcctctccatccccaccgaggaggtccgccgcgtggtcgccggggaggagggcgcgccgccggtctccgccgtggcccccgggcggctgttgcgggtggtggagcgcgctggggtcgggctgcgggtcacgcggatggccgtgccgctgcgggacaccgaggaggagaacctgctcgatcacctcgagccgtgtcttgatttcatcgatgagggcaggaaggaggggaacgtccttgtccattgctttgctggggtctcaaggagtgctaccatcatcgttgcttatcttatgagaacagaacaaaaatctctggaagaagcactagagtctcttaaggaagtcaatgagtcagcctgcccaaatgacggttttcttgagcagttgaaactgtttgaagaaatgggcttcaaagttgatacttcaagtcctctatacaagcgtttccgtttaaaattgctaggccaatcctacaaaattggagagaaaataggaagctatgtatttgaagatgatcctggtctttctggacagcctaattcttctactcaggatttaccaaacaaacaaacccaacaaacagcataccgctgcaaaaaatgcaggagaattgttgctgtgcagggcaatgttgtgagccatactcctggtgagggtgaatcttgctttcagtggcaaaacaaaagaaagggagagcgatcatatagcaaagaacaagattgctcatcgttgtttgttgagcctctgaagtggatgactccagtggaagacggtgctttggaggggaagctatcgtgtatccactgcggagcacggctaggatatttcaactggtcaggaatccagtgcaactgtggcagctggatcaccccagccttccaaatttccaagagcaaagttgatattagtacgacttagatagttttttttttgtggggtgtacgacttagatagttgtcggaggctagcagattatttcaggaccatgtgagctggtgtaaataccgttttatcagaaggatttacgaactcgaaggatctcgaccgaagattttcagatccattgtgcactagatagatatcatgaagcattagcctcagaaacctccactgtattactacttggtgttagaagactatgccatcagttgcaattgttggttctgatgatctgagaggctatcaacacgaatttcattttgttttttgtttttttgtattaaatgcatctgtctgcaaatttgtaatgcagttttgttgtacctgagtccatccattgaaaacattg

SEQ ID NO: 1900 - DNA, 313 bp, Triticum aestivum
cgttgtcccgcaccgctgctgccgctgtcgtggccctgaggtcggcggtccgctccgcgccccttaccggccgcgtcctcggagcgccactaccttcctttgcctcgccttccgctgcccgctccgcccggatcctccgcaggtcggcggccgcggcgtcggcggggctggaaacgctaatgccgctgcacagcgcggtggctgccgcgcggcttaggtcctgcatcgccgtcgactcctcctgctggtgctcgctctcacaaggtttaaacaagcgcatctgaccatggctaggagctgagcagaagagaag

SEQ ID NO: 1901 - DNA, 617 bp, Zea mays
tcggcccaaaccaagtagcgtctagggttttagcctctccaaccgcacgatggacaccgacgcgagaaggcagggggagagaaaatggcgtatttgtcccgcacagccgccgccgtcgccgtcgccgtgaggtcggcggtccgctccgcacctctcactggccgcgtcctcggagcgccactgccttcccttgcctcgccttccgctgcccggtccgcccgaatcctccgcaggacggcggccgcggcgtcggcggggctggagactctaatgccgctgcacagcgcggtggcggccgcgcggcttaggtcctgcatcgccgtcgactcctcgtgctggagctcgctctcgcaaggtttaaacaagcgcatctgatcatggctaggagctgagcacagaagagaagtgaggacaacgagttagaacgaagtcatctcttttgcagatatttgtaacatgtactactttggttgttgctctatgtgtttgctcatgtcttcaatggagcatgcaaaatagttccttgtaacttgcttggctcttattttcagtttggtcatgagctatgctgaaggaaaaaacttgtacttgtaataaaaaaacacttcagttttttc

SEQ ID NO: 1902 - DNA, 817 bp, Sorghum bicolor
ctcaacgaggctataaacctgttctcagtcgcgaatccatccatgggccacccaaatttctccttcctccggcccataccaagtcgtcctgatgaacgccggtcggcccaaacgaaagcagcgtttagggtttagcctctcgaacccccacgaggttttgcttcgacaccgacgcgagaagtcaggggaagagggaaatggcatcgttatcccgcacagccgccgccgccgccgccgccgtgaggtcggcggtccgctccgcaccccttaccggccgcgtcctcggagcgccactgccttcccttgcctcgacttccgctgcccggtccgcccggatcctccgcaggtcggcggccgcggcgtccgcggggctcgaaacgctattgcctctgcacagcgcggtggcggccgcgcggcttaggtcctgcatcgcggtcgattccacctgctggagctcgctctcgcaaggtttaaacaagcgcatctgatcatggctaggagctgagcagaagagaagtgaggacactgagttaaaacaaagtcatttttttttctggagatatttgtaacatgtactacttaggttgttgctctgtgtgtttgctcatgtcttcagaattgagcatgcaaagttgttccatgtaacttgcttggctcttgttttcattttgatcatgatccatgccaaaggaaaaattttgtacttataataaaaacacttcagtttttctttaggtgtgcaaaattactccatttgaaatcatgacagcatatggtattacatcttgtatccgtggcctgacttgctcttgtattt

SEQ ID NO: 1903 - DNA, 581 bp, Setaria italica
aacgcagcgcgcacgactcgaattccgcgaagacaggggaagaaatggcatctctggtccgcaccgccgccgccgccgccgccgtcgtcgtgaggtcggcggcccgcgcctcacccctcacaggccgcgtcctcggtgctccactgccttccctggcgtcgacttccgctgcccggtccgcccggatcctccgcaggtcggcggccgcggcgtcggcggggctggagacgctcatgccgctgcacagcgcggtggcggcggcgaggcttaggtcctgtatcgccgtcgactcctcctgctggagctcgctctctcaaggtttaaacaagcgcatctgatcatggctaggagctgagcagcagagaagtgaggacactgagttaaaaaaaaaagtgcattttttttgcagatatttgtagacatgtaacaatgtactttgatggttgctctatgcgtgtactcatgtcaacagaatggagcatgcaaaatggttccttgtgacttgcttggctcttatttccagtttgatcatgatccatgccaaaaccttgtactataataatgaaaatacttcaaatttt

SEQ ID NO: 1904 - DNA, 353 bp, Panicum virgatum
caaatcaacagaacgccccagaactactcgacgcgagctccgcacgaagacaggagtggcgggacgaaatggcatccctggcccgcgccgccgccgccgtgaggtcggcggccctctccgcgcccctcacaggccgcgtcctcggcgcgccgttgccttccctggcgtcgccttctgctgctgcccggtccgcccggatcctccgcaggtcggcggccgcggcgtcggcggggctggagacgctcatgccgctgcacagcgcggtggcggcggcgcggcttaggtcctgcatcgccgtcgactcctcctgctggagctcgctctcgcaaggtaaaccctgttctagctgttac

SEQ ID NO: 1905 - DNA, 1667 bp, Setaria italica
cacgaacgcctcgcgccgctggtcatcatcaccacccaccggatttgcttcctcctcctgttattctattcgcttatttacccccctccacttcgtccctcctgatcatcagagggcaggccagcggaataatctatcccgctggtaaacaaaacacaaagtatcttccctgccatttccagctcgtcccttcgtcgtcttctagctttcgtcctcgcgcagccgagagagagagggagggagggagggaaggagagagagggattcatggagctggggagccatcacctggcggcgcacagctgcagctacacaaccacctacacccactgctccatcggcttctcccctcgggtccgcaccgccggctggatccgcgcggcggccgacggcggcgacggcggcgccgaccggcggcggaggggcgccagcctcgccgccgatggccccagggtcgtcgaggtcaccgccgccaccgtggccagcggggccgccggggaagccgggactgggagcgcgggcttcggagcccgggacgcggagctcgccatgtgggacaagctcggcgcggtcgtcaggctcagctatggcattgggatttacggagccatggcgctcactggaagattcatatgccaaatggccgggatagactgcacggggggcttccatccgtcgctcacggcgctcgtcgaggggctcggttacgcagctccgccgatcatggctctgctgttcatcctcgatgatgaagttgtcaaatactcacctcatgcgcgcgccatcagagatgtggaggacgaggagcttcgcagcttcttctttggaatgtcaccatggcagttcatgctcattgtgaccgctagctcaattggcgaggagctgttctaccgtgcagctattcagggagctttggctgatattttcctgaggagcacggagctcatgaaagatgctagagggattgcatccctgagtggaattgttcctcctctggttccatttgctcaaacgttcgcagcagtcatcactgcagccctcacaggatccctctactatatcgccactgctccgaaagaccctacttatgtggtgactccagcgatgcgctcacgctcagggcgggataacctcaagaaattatttgcagcttggtatgagaggaggcaaatgaggaagatatactccccgcttctagaaggaatcctggctttctaccttgggttcgagtggatccagaccgacaacatcctggctcctatgatcacccacggcatatactccgccgttgtccttggacatgggctctggaaaatccacgaccacaggagaaggctgcgccagcggattcagcaagttagaagccaagggaaaagctcagactcgttgtaactgcatcgtatgatcgaatcgatcaatcagtcagaagaccaggcgtctgacaagttttgatccagctaaccaacatagctaattaagataggtacaagattgaggaagaaaaaaatatatactcatgtaatgtagatacagtctgtacatatgctgataatagtatgcaggatggaatctacataggcactagtatagtgtacgactccaagtttgtactcctattgtgtatgcaaggaaaatagatagtccactctttgtgttttgtcccttac

SEQ ID NO: 1906 - DNA, 1833 bp, Panicum virgatum
cgggtcgacccacgcgtccgcggtcatcgtcaaaacccgacaaagggacgaggagggccaaactaaaaaactaacggcgcccggaggaagaaggcggctgcccatcatcgtccaccgatttgtttccttcttcccccgtcaattcccttgcttattttactcctcctccgatcgatccacttcgtccctccagatcatcacagggccagcggaataatctatcccggtggcggtgataaacaaaacacaaaagtatcttccctgtccgccatcgccagctcgccgcccctacctcgtcttcttccagttcttcctccgcgcgcagcagagggaggcagagagggattcatggagctggggagccaccaccacctggccgcgcgcagctgcagctacaccgccacctacacccactgctccatcggcttctcccccctggtccgcgccggccggatccgcgcggcggccgagggaggcgacggcggctccgaccgccgccggaggggcgccagcctcgccgccgatggccccagggtcgtcgaggtcaccgcgacccccgtcgccgccggggcggccgggagcgcgggcttccgggcccgggacgccgagctcgccatgtgggacaagctcggggcggtcgtcaggctcagctatggcattgggatttacggagccatggcgctcaccgggagattcatatgccaaatggccgggatagactgcacggggggcttccacccctcgctcacggcgctcgtccaggggcttggctatgcagctccgccaatcatggctctgctgttcatcctcgatgatgaagttgtcaaatattcgcctcatgcgcgcgccatcagagatgtggaggatgaggagcttcgcagcttcttctatggcatggaaccatggcagttcatgctcgtcgtgactgctagctcaatttggtgaggagctcttctaccgtgcagctattcagggagcattagctgatattttcctgaggagcacggagctcatgaaagacgctcgagggattgcatccctgagcggaattgttcctcctttggttccatttgctcaaacgttcgcagcagtcatcactgcagccctcacaggatccctctactatatcgccaccgctccgaaagaccctacttatgtggtaacaccagcaatgcgttcgcgatcggggcgcgagaacctcaagaaactatttgcagcttggtacgagaggaggcaaatgaggaagatatactccccgcttctagaaggaatcttggctttctaccttggcttcgaatggatccagaccgacaacattctggcgcctatgatcacccacggcatatactccgccgttgtccttggccatgggctctggaaaatccacgaccacaggagaagactacggcagaggattcagcaggtcagaagccaagggaaaagttcagacacattgtaactgcagggtaccgtatgatcgatcgatttcaatcagaagacccggcgtccaggcgtctgacaagttttgatccagtttaccagcataggtaattaagataggtgcaagattgagggaaaaatatatatatgctcatgtaatgtagataaagtctgtacatatgctgatagatatgcaggatgaatcaatatggtaggaagtagtatagtgtacgactccaagtttgtactgtagcatttgcaaggaaaatagatagtccactctttgttttcttttcgtccctcactgttgcaaagttgcatgtttgatgcttttaaagatgcatgctgcactggatttccaaggataaaacaagagattgttcgcatgtaagg

SEQ ID NO: 1907 - DNA, 2017 bp, Panicum virgatum
cggagccagcctaaccggatgaccttatcgcgtagcggccgacgtgtggggcgccgattggagcccgcaaatcgcctctcatctcgcacgctgccgccgccggcggccactcgcctcccgccacgaccaccagtctcgccgccgccgccgccgcacgacgacggggctcggccacgccaagtaagcgcgcgcgcggtcaccgtcaaaaccagacaaagggacgaggaggggcaaaactaacggcgcccggaggaagaaggctaccgccgatttgttcccttcttctgcgcacccccccccccccggcccctgcttattttactcctcctccgatccacctcgtccctccagccagatcatcagagggccagcggaataatctatcccggtgcagtggcggtgataaacaaaacacaaaagtatcttccctgtctgccatcgccaccagctcgcccctacctcgtcttcttccggttcttcctcctcgcgcagcagaggggagggaggaacacaggagggattcatggagctggggagccgtcacctggcggcgagcagctgcagctacaccaccacctacacccactgctccgtcgggttccaccccctggtccgcgccggccggatccgcgcggcggccgagggcggcgaccgccgccggaggggcgccagcctcgccgccgatggccccagagtcgtcgaggtcaccgcggctcccgtcgccggcggggccgccgggagcgcggggttcggggcccgcgacgcggagctcgccatgtgggacaagctcggggcggtcgtcaggctcagctatggcattgggatttacggggtcatggcgctcaccgggagattcatatgccaaatggccgggatagactgcacggggggcttccacccctcgctcacggcgctcgtccaggggcttggctatgcagctccgccaatcatggctcagctgttcatcctcgatgatgaagttgtcaaatattcgcctcatgcgcgcgccatcagagatgtggaggatgaggagcttcgcagcttcttctatggcatggaaccatggcagttcatgctcatcgtgactgctagctcaattggtgaggagctgttctaccgtgcagctattcagggagcattagctgatattttcctgaggagcacggagctcatgaaagatgctcgagggattgcatccctgagcggaattgttcctcctttggttccatttgctcaaacgttcgcagcagtcatcactgcagccctcacaggatccctctactatatcgccaccgctccgaaagaccctacttatgtggtgacaccagcaatgcgttcacggtcggggcgggagaacctcaagaaactatttgcagcttggtacgagaggaggcaaatgaggaaaatatactccccgcttctagaaggaatcttggctttctaccttggcttcgaatggatccagaccgacaacatcctggcgcctatgatcacccacggcatatactccgccgttgtccttggccatgggctctggaaaatccacgaccacaggagaaggctacggcagaggattcagcaggttagaagccaagggaaaagttcagacacattgtaactgcagggtatcgtatgatccatcgatctcaatcagaagaccgggcgtccaggcgtctgacaagttttgatccagttaaccagcataggtaattaagacaggtacaagattgggggaaaaatatatatgctcatgtaataatgtagataaagtagataaagtctgtacagatgccgatagatatgcaggatgaatcaatatggtaggaagtagaatagtgtacgactccaagtgtgtactcctatagcatttgtgtaacacctcaggtgtcaaccacctagaattaaattaatcatggtcattgatttcaaacacacgcgacaaatcactaaaccaaacttttcttgtcagctttggccagaccggtctgaccggtcggggcaaccggtctgaccagtt

SEQ ID NO: 1908 - DNA, 2200 bp, Sorghum bicolor
aggcacagcacgcagtcaccgtcaaaatcaggcggacgactactagacgaggaggaggaggggaaactgctgaaaaaactgagaaaactagcggcggccggccggagaggaaggaagagacctgcgttgcgccgctggtctcccatccatccattttgttttgtccgctagcttcttcacctgtcgttccagtaggagtcttgcttatttacccctcctcctccacaacgtccgtccagatcatccgagctagctagagagcaaaacggaataatctattcccggtgatagattaaacaaaacaaagtatcttctctgtctgcgtgcggtgtgccggccatttccacctgttcgttcgcccggctcctcctcctcctcttctggttctagttcgtcgacggcccttgcgccgcagcagagagagggagattcatggagctggggagcgccgtttcggcgcacagatgtagcagctactacacggcgacctacacccactgttccataggcttctccccacgggtccgcgccaccagctgctggatccgcgcggcggctgagggcgacgacggcggggcagaccgccgacggagaggcgccagcttcggcgacgataggcccaaggtcgtcgaagtcaccgccgagctcgccatgtgggacaagctcggggccgtcgtcaggctcagctatggcattgggatctacggggccatggcgctcaccgggagattcatatgccaaatggccgggatagactgcacgggaggcttccatccatctctcacggcacttgtcgaggggcttggttatgcagctccaccaatcatggctctgctcttcatccttgatgatgaagtagtcaagtattcgcctcacgcgcgtgccatccgtgatgtggaggatgaggagcttcgcagcttcttctatggcatgtcaccatggcagttcattctcatcgtggctgctagctcaattggtgaggagctcttctaccgtgcagctattcagggagcattggctgatattttcctgagaagcacagagctaatgaaagatgctcgagggattgcatccctgagtggtattgttcctcctttggttccatttgctcaaacgtttgcagcagtcatcactgcagccctcacaggaaccctctactatattgccacagctcccaaagaccctacatatgttgtgacaccagcaatgcgttcgcgcacagggcgggagaacctcaagaaactatttgcagcttggtacgagaggaggcaaatgaggaagatatactccccgcttctagaaggaatcttggctttctaccttggcttcgaatggatccagaccgacaatatcctagcacctatgatcacccacggcatatactccaccgttgtccttggccatgggctctggaaaatccacgaccaccggagaaggctacggcagcggattcagcaggtcagaagtcaagagagcagctcagacacattgtaactgcaagatgtggcggatagatcagcgtggtgtactactggatagctagctatgctgattgcacgtagtactggatgatcgatcgaccgatcaatcagaagaccagaggcgtctgacaagttttgatctagttaattaaccatcaagataggtaaaagattggggaaaaaaatataatgcatgtagtcatgtaaagtgatgtagatataatctgtacatacatatatggataaatatatgcaggctgtaatcaatataggaagtatagtatacaatagcaacttccaggtatgtaataatcctagtatatcacgtgcgtgcaaggaagatagcagcccactcttttttcccgtccctctctcacaattgcaatgttgcatgattgatactgttaaaaattacttcatcacttttagttcatctgtttggatacctagggtctaaaatttaggtgattaaagcttagcccatggtatccaaataaataggtcctgattagtgactagcactccctcagtctaaaaaaaatagaataggatacaaaacttgtcccacaaaatacgattgatgttttaactattggacaatagattgggccaatatcaatttgagattatgtctccatgactccatgcattccttttaatgaggggcttatattctttaattagcatgattcgcctttaatgaatagggatgtatgtat

SEQ ID NO: 1909 - DNA, 2086 bp, Oryza sativa
aattttttttatataaaaaaatggattactagtaaaagaaatccagcatccaatggtgggtagagtagagaaatataagtctagtaaaccgagggaagagaaagagaaggggagagttgcagagcaaaaccggcggccactagaaaactaatggcggaaacccattaatcaaaatcaaatggcgcatgagtctcctcctcctcctatgctaggagtacatttctactagcgtaggacaacaagatagacagagtatacttctaataggagtaggagtaggagtattaaaacaaaaatcgatcttccgtcctcctagtttagttgtctctcctcttggctctgctttaatttgtctctcctcttgcccctctttgatccgcttggcactctctcctcctgctgctgtagaatcgagatcgagagagagagagagattgaaaaggcagccagggatcttgtgaattaatggagctggccccttttgcggcggcctcctcctcctcctcctcttccacagtcacaaacacgtgcaagctcaggctcaggctcagctacacccactgttccatcggcttcgccccccgagttcgcagatggatccgagcggcagctgagggccgaggcggcgaccaacggaggagcggccgcttggctgcagatggccccagagtcgtggaggtcgctgccccacctgccgcccccgtcgtcaccggcggaggcggaggaggcgggggcttcgcagcccgggacgcggagctggccatgtgggagaggctgggagcggttgtcaggctcagctatggcattgggatttatgccgccatggcacttactgggagattcatatgccagatggccggaatagactgcacagggggcttccatccatctctctctgcgcttgttgagggactcggatatgcagctccgccgattatggctttgctctttatcctcgacgatgaagttgtcaaatattcacctcatgctcgcgccatcagggatgtcgaggatgaggagcttcgcagcttcttctatggcatgtcaccatggcagttcattcttattgtaactgctagctcaattggagaggagctattctatcgtgtcgctgtccagggtgcgttggctgatatttttctgagaggcacagagctcatgaaagacgctcgagggattgcatccctgagtggcatggtgcctccatttgttccatttgctcaaacgtttgcagcagccatcactgcggctctcacaggatcactctattatgtggctactgccccgaaagatcctacttatgtggtgacaccagcaatgcgttcaaatactgggcgagagaatctcaagaaactatttgcagcatggtatgaaaggcggcaaatgaggaagatatattcccctcttcttgaaggaatcttggctttctaccttggctttgagtggatccagacagataatattcttgcacctatgatcacccacggcatatactctaccgttgtgctttgccatgggttgtggaaaatacacgaccacaggagaaggctacggcaaagaattcaggaaatcagacaggaaggaacaacaaattcagacacgttgtaacagatcatgagatggtagctagctagcaccgcttttcttgaatggcaaaatgggatgatcagatcagatcacagaaccatgtacaagacacagctgacaatttttgatgatccttaggtaggtatgtacttgtacgtagaagatagaaagattaagtcaacatgtacatagacagtatatttgttgtatatcctcagtataagtgtgtatacacagtagcaatatttctacacttatgcaactaaaatgggtgagcatttctccgcgcagttgcacgaatagtgactagtactttcccttttggagtgctgagtcctttctgggttcactgaatcctggtatacgcggaagagagatggctgagttcttttcgttgcatcagtaatatgttcttgttttcttttgttagaagcgcagctggaaagcaagtgttgtttgtgcatttccttatgcggttcatgtatatatatagcggctg

SEQ ID NO: 1910 - DNA, 2417 bp, Sorghum bicolor
acggaaagcaccctccacttcaactccgcactcggctcttccattcgtgaccccatcacacccgctcatctcaagatctcagccgccgtcttctccctcgctccgccactccccccaccaccccactaaaaccctaatccctcgccgccatggctgctgctgcggcggcggccacctcgctccttctacgccacaaccgcaacccccacctcctcctcctccgcgccgcgatctcctcctcccgcgcgctgccccagcagccggagctgtctcctgacccgaccgccggcgcccccgaccccgccccactccccccaaaccccagcacggggagccccttctacagccagaactggcgcaaccccgccgccgccaacccgccctcctcgcttctgcccaccgtcctcgccggcggcgccttcggggcggagcaccgcatggccgccttctacgatacgcccaacgccgcggggctcaaggagacgttcgccaagtatatggcggagcagcggtgggaggacatcaagcatctgttcgaccactgggtgcgctccctcgacgccaccacggggaagcccaaccaccccgacgtcgacctcttcaatcactacctccgcgctaacctcatgtcgggggccctgccgcacgagatgctcgatctcgccgaccacatgcgcgagttcgagctcgagcccaacactgcatcgtacaacctcgtgctcaagagcatggtcgccgggcaggagtccgagggcgccgagaagctcattgaacggatgctgcaaacaggaacatttccagatgatgaatcctacaatttggttgtaggcctgcttattagacagaaccttgttgactcatctctgaagtatttggatctgattcttaaatcaggctacacgctatcactaactgtttacactgattatatccgagcatgtatgagatccgggaggttggacacgttgacatcaattatagagaaatgcaagacaactgataagaacaaagttttgtgtccacaatgggccttgtgcattgacatagcagaagctgcatttgaagctaacaatagcaaattagctctttttgctttggaatttctcgcaaaatggattgctcgcggtgagaatgttaaacctcctgttcagctgtcagttaatgaaggtcttgtaatatcagctctgagtgctgctggcagaacttttagtactgacctcttgaatgctgcttggtcgctattacggaagtccctgcgccagaaaagggcacccaccccagagacatatcttgccaagatatatgcccattcatcaattggccagcttcaaagggcttttggtacattgcgtgaatttgaaaatgcctatgggaactctgaggacattgatttagagctcttctcaccatttacttccttgcatcctcttgttgttgcttgctgcaaagatggctttaccacactggattcggtttatgttcagttggagaatctgagtcgtgcagatccaccatacaaatctgtttctgctctcaactgtgttatattagggtgtgcaaacatttgggacatcaatcgagcttatgaaacttttgtggctattaaggaaaaatttgaactcacgcctgacatccattcatacaatgcccttctgtgtgcatttggaaagttgaaacagacaggagaagcatgtaatgtgttccagcatgtattaactcttggtgttaaaccaaattcaacaacatactccctgcttgtcgatgcccatcttgccaacaaagatccaaaagctgctcttgccataattgatgagatggttgatgctggcttcactccttccaaggataccctaaggaaggttcgaagacggtgctctcgtgaatcagactttgacagtgacgagaaagtccaatccctggctaagcagttcaactaccgactgggtggtgagaatcgaagagagatgctttatagcatagaatataatcctgtgtactgaagcagcagttcgtgctgagtttgctggccgtttggagagcacggacatcgtagcgtgtaaattacttggatgtaccaggattcttaagcaattttcagtttctcaatcatcatttttgctcgcagggttgatgctaggacttgctaataaggctggcatactatttgtttgtttgaaaatctgaaaatgtcagttgtttttttttttataaaaattgtagcatctgcatgcccccacttcttacgtgacttctagctgtttttggctttgtttacacttgtaactaacgaagaagtcctgggatgattgggtcgcagcttattctttatgaaaatttaattatgtgaatgactacggtgtccactaatttattggaaactggcaatttaccgtcacctaagagcatctctaactgtt

SEQ ID NO: 1911 - DNA, 2459 bp, Zea mays
atataaactaaactgtcatggacatccgatatgttgtcttcctgacctcatcacgcccgctcatctcaaagatctcagccgccgtcgtctccgtcgctccgccgcacctccccccatcaccgcctctctaaaaccctaatccctagccgccatggcggctgttgcggcggccacctcgcacctcctacgccaccaccgcaacccccaccttctcctcctccgcgcagcgatctcatcctcccgtgctttgccccagcagccggagctgtcccccgacccgaccgccggcacccccgacctcgccggcgcggccccactccctccaaaccccagcacggggagccccttctacacccagaactggcgcaacccagccgccgccaacccgccctcctcgcttctgcccaccgtcgtcgccggcagccccttcggggcgcagcacttcatggccgccttctacgatgcacccgacgtcacggggctcaaggagacgttcgccaagtatatggcggagcagcggtgggaagacatgaagcatctgttcgaccactgggtgcgctccctcgacgccgccacggggaagcccaaccaccccgacgtcgacctcttcaatcactacctccgcgccaacctcatgaccagggccctgccgcacgagatgctcgatctcgctgaccacatgctcgagttcgagctccaacccaacgctgcatcgtacaacctcgtgctcaagagcatggtcgccagccaggagaccgagggcgccgagaagctcattgaacggatgctgcaaacaggaacatttccagacgatgaatcctacaatttggttgtaggcctgcttatcagacagaacctcgtcgattcatctctgaagtatttggatctgatgcttaaatcgggctacacgttatcactaactgttttcacagattatatccgagcatgtatgagatctgggaggttggacacgttgacatcaattatagagaaatgcaagacaactgataagaacaaagtcttgtgtccggaatggacttggtgcattgacatagcagatgctgcatttgaagctaacaacagcaaattagctctttttgctttggaatatcttgcaagatggattgctcgtggtgagaatgttaaacctcctgttcagctgtcagttaatgaaggtcttgtaatatcagctctgagtgctgctggcagaacttataatactgacctcttgaatgctgcttggtcgctattacggaaatccctgcgccagaaaagggcacccaccccagagacatatcttgccaagatctatgctcattcatcaattggccagcttcaaagggcttttggtacattgcgtgaatttgaaaatgcctatgggaactctgaggacattgatttagagctcttctcaccatttacttctttgcatcctcttgttgttgcttgctgcaaagatggctttagcacattggattcggtgtatggtcagttggagaatctgatacatgctgatccaccgtacaaatctcttgctgctctcaactgtgttgtattggggtgtgcaaacatttgggatattaatcgagcttatgaaacttttgtggctattaaggaaaaatttgacctcactccagacattcattcatacaatgctcttctgtgtgcatttgggaagttgaaacagacaggagaagcatgtaatgtgttccagcatgtattaactcttggtgttaagccaaatgcaacgacatactccttgcttgtcgatgcccatcttgcaaacaaagatccaaaagctgctcttgccataattgatgagatggttgatgctggcttcactccttccaaggataccctcaggaaggttcgaagacggtgctctcgtgaatcagacttcgacagtgacgagaaagtccagtccctggcaaagcagttcaactaccgaatgggtggtgagaaccgtagagagatgctttatagcatagaatacaatcctgtgtactgaaacagtaagtacttgttcatctgttggattttgcccatgtagtggttggttatgttttcaccctgacaattagtgttgcatcttgctagttatgctttcctggctgtttctcctgactggtgttgtcttcattttgataagcagttgctactgagtttgctagccattgggagagcacagacattgcagcttgtaaattacttggatgtaccaggattcttaagcaaattttcagtttctcgatcatcatttgtgctcgcagggttcgttttaggacttgctaataagatgacactttgagtctgtttggttgtcaggaccagcatatcctggtcaaagcccagatgcaggctgggcatagcctgcatgcattcgtgcaaatcaaaacaactctacttgtttggttgtttgtccacaattaaccaggatcagcagagcctctgtttggttt

SEQ ID NO: 1912 - DNA, 1866 bp, Saccharum officinarum
ccgtctaccccctcgctccgccactcctctcccaccactccactaaaaccctaagccctcgccgccatggctgcggcggcggcggccacctcgctcctactacgccaccaccgcaacccccacctcctcctactccgcgccgcgatcttctcctcccgcgcgctgccccagcagccggagctgtcccctgacccgaccgccggcgcccccgaccccgccccactccccccaaaccccagcacggggagccccttctacagccagaactggcgcaaccccgccgccgccaacccttcctcctcgcttctgcccaccgtcgtcgccggcagccacttcggggcgcagcaccgcatggctgccttctacgatacgcccgacgccgcggggctcaaggagacgttcggcaagtatatggcggagcagcggtgggaggacatgaagcatctgttcgaccactgggtgcgctccctcgacgccaccacggggaagcccaaccaccccgacgtcgacctcttcaatcactacctccgtgccaacctcatgtcgggggccctgccgcacgagatgctcgatctcgctgaccacatgcgcgagttcgagctcgagcccaacactgcatcggcaacctcgtgctcaagagcatggtcgctgggcaggagtccgagggcgccgagaagctcattgaacggatgctgcaaacaggaacatttccagatgatgaatcctacaatttggttgtaggcctgcttattagacagaaccttgttgactcatctctgaagtatttggatctgattcttaaatcaggctacacgctatccctaactgtttacactgattatatccgagcatgtatgagatccgggaggtggacacgttggcatcaattatagagaaatgcaagacaactgataagaacaaagttttgtgtccacaatgggcctggtgcattgacatagcagaagctgcatttgaagctaacaatagcaaattagctctttttgctttggaatttcttgcaagatggattgctcgtggtgagaatgttcaacctcctgttcagctgtcagttaatgaaggtcttgtaatatcagctctgagtgctgctggcagaacttttagtactgacctcttgaatgctgcttggtcgctattacggaagtccctgcgccagaaaagggcacccaccccagagacatatcttgccaagatctatgctcattcatcaattggccagcttcaaagggcttttggtacattgcgtgaatttgaaaatgcctatgggaactctgaggacattgatttggagctcttctcaccatttacttccttgcatcctcttgttgttgcttgctgcaaagatggctttagcacactggattcggtttatgttcagttggagaatctgagtcgtgcagatccaccatacaaatctgttgctgctctcaactgtgttatattcgggtgtgcaaacatttgggacattaatcgagcttatgaaacttttgtggctattaaggaaaaatttgaactcacgcctgacattcattcatacaatgcccttctgtgtgcatttggaaagttgaaacagacaggagaagcatgtaatgtgttccagcatatattaactcttggtgttaagccaaatgcaacaacatactcccctgttgtcgatgcccatcttgcaacaaaaaatcaaaagcttgtcttgccataaatgaataaaatggtgatgctggtttaactccttcaagaatccccttaggacggttccagacaaagctctcttggaataaaacttttacgtgagagaaaagtcaatccctggctaaccagtcaactacccatgggtggcggaaatccaag

SEQ ID NO: 1913 - DNA, 1172 bp, Sorghum bicolor
gcccaataatgctcaaaattaagcccgtaaaacacctctgtatcatacgccatgaaatttgctatactagacttgcagccagttgacgcgacggaaacaaccaaaaaaaattagcccacacaatgagcttgtcgcttctccagggctactcctccgctgaggaggacgacgaccccgccgccggcaccgagctaagcgagtccggtgattcgtcagccgaggaagccggatcggacggagacgaggggtccgctcctcaaaagccggcccccaagccccgccgccgaccaaaccctaaggggggagatgccggaggcggcgacggggactcctcgctgccctccgcgctggaggccttcgccgatgtctcgggaccaccggactttctgaggcatagggttgccgagcccgaggaagggacggaggccctcggtgtactcgatcgccgtgggaaagaggggagcaagcacccgcctccaggtgctgttgtggtggcgaaaccgcagttagttgccatccgcgagcgagttaccacaactggagccaacccctcaggttcagtgacatctggttctgttgatggaaaaagaataataggtgctgcaaatcctgggccagaagatgcagctgatcttctgaggatgtgtctccaatgtggtgtaccaaagacctattcacatggtaagggtatggtttgccctcagtgtggtgatagacctgtgcagacaaaagagcccgaaaagaaaaagggttccactgtcaaggacaaggagaagatcaagaggatgagggggcaatcgtcgcatgcatcctggaagagtgaaacggagatggctcttcggcagcaatttgactgataactagttagcatggccaatatttagactgagtgcttggtaaactgtacgctgggtaaacctttttaagcctgtgtagtgtaccatatgatgccccttgtgcctcacacgaagttccagagagcgagagtgtgtgttgtatgtgctgcatttttctgctaggaacgattttgtttgttaagctgtcagaattgaatctgagcatgttcgcttgagcttatcagccgaatctgttagtcatttaacaatgttttttcttggaacaaattagtgaatagtattttcagccatagtggcatgctactttttctatca

SEQ ID NO: 1914 - DNA, 1941 bp, Panicum virgatum
aagatcaagcacatgtggaaaagtgacgcacgtgtaagttaccaacgaacctaagaacatggttggtcaattgggagggcatttatttttcgttttggttggactttgaagcatccgggtggatgatgttctttctttaacccacatagattttttttagatgatcttttaaacagttgctgttgaaacctgatgtcgtttgattctattgatcttggcccatagaaatattgagatttggaaaagcccatacttttctatcacaaacccaactaatacagaaaatgaactccctgaaacaaatatgaagcccatatactctacgctattggattgacaaaacgaaacgagcccactgtctacattacccagattaaagcccgtgaaagaggcctatcatatcagtctgaaattgagcccaaatttggcgcatccaagttcaagatcactcccagattattattccacggcagccaatctggagcgttaatttttcttcttcggtgattgatacgccatgaagttgctagagtagacttgcagccacctgacacgacgtcacgaccaggaaaacccaaattacggtgatgagcttaacgcttttgcaaggctactcctccgccgaggaggacgacgaccccaccgccggcgccggcgccggcgccgagctgagcgagtccggcgactcgtcaaccgaggaagccggatcggacggagacgaggcgtccgctcctccgaagccggcctccaagccccgccgccgcccaaaccctaaggggggagatgccggcgtcggcgaagggaacgcctcgctgccgtcggcgctggaggctttcgccgatgtctccggccctccggagtttctgaggcacagggttgccgagcccgaggaagggacggaggcccttggcgtactcgatcgccgcgggaaggagggtagcaagcatccgcctccaggtgctgttgtggtggcgaaaccacagttagttgctatacgcgagcgagttaccacaactagttccaaccctccaggttcagtgacatctggttctgttgatggaaaaagaattataggcgctgcaaatcctggtccagaagatgcagctgatcttctgaggatgtgtctccaatgtggtgtgccgaagacttattcacatggtaagggtatggtttgccctgtctgtggtgatagaccagcccagacaaaagagcccgaaaagaagaagggttcaactgtcaaagacaaggagaagatcaagaggatgagggggcaatcgtcgcacgcttcatggaagagcgagaccgagatggctcttcggcaacagtttgactgataactagttagcatggccaatatttagatggaatgctggggaaacccctgtcgccctttgtagtggaccgtatgatgtccctctgccttacacctcggttccatattgccagagccgttgtttggtttgttgtatcagctgcatttgttttgccaggaacagttttgtttgctaaactgtagcaatttagatgtcagattgcaagaggatttttgttagcacctggaacacgagcgtcacgcgttgtgctggtctaccctgcttgtttaagaaagagaagtttgagatggctcacaacgcttgccgcgaggctgaggtgaaggacagataagttttaccggaaagcggcaagaggagacaaacgcaacgtgaggagttacttgttcttgcaccatttgtttgcttttcattccgtgtaacgtgtattctcgtatcccctttctcgttgatcgaatgctcgacaacgttttgtccctctccaaatgaatttttttcaccacagtagatcgtacgggacccagacagtattcactatggttcctttcttcttcttatttattttgaagaattgccactatgatatcaaggctgtgtgaactgaaaaccc

SEQ ID NO: 1915 - DNA, 1288 bp, Panicum virgatum
cggcaaaacgaccaggagaccccaaaatacggtgatgagcttaacgcttttgcaaggctactcctccgccgaggaggacgacgaccccaccgccggcgccggcgccggcgcagagctgagcgagtccggcgactcgtcaaccgaggaagccggatcggacggagacgaggcgtccgctcctccgaagccggcctccaagccccgccgccgcccaaaccctaaggggggagatgcagccgtcggcgaagggaactcctcgctgccgtcgacgctggaggctttcgccgatgtctccggccctccggagtttctgaggcacagggttgccgagcccgaggaagggacggaggcccttggcgtactcgatcgccgcgggaaggagggtagcaagcatccgcctccaggtgctgttgtggtggcgaaaccacagttagttgctatacgcgagcgagttaccacaactagttccaaccctccaggttcagtgacatctggttctgttgatggaaaaagaattataggcgctgcaaatcctggtccagaagatgcagctgatcttctgaggatgtgtctccaatgtggtgtgccgaagacttattcacatggtaagggtatggtttgccctgtctgtggtgatagaccagcccaaacaaaagagcccgaaaagaagaagggttcaactgtcaaagacaaggagaagatcaagaggatgagggggcaatcgtcgcacgcttcatggaagagcgagaccgagatggctcttcggcaacagttcgactgataactagttagcatggccaatatctaaatgaaatgctggggaaacctctgttgccctttgtagtgtaccgtatgatgtcccattacacccttggttccagattggcagagccctcgttgtgtttgttgtatcagctgcatttgttttgccaggaacagttttgtttgctaagctgtcaaaatttagatgtcagattgcaggaggatttttgttagcacacctggagcacgagcgtctcgcgttctgcttgtttaagaaagagaagtttgagatggctcaggctcacaacgcttgccgcgaggcaggacagataagttgtgcccaccggaaagcgacaagaggagacaaacataacgtgaggaggtacttgttcttgtaccgtttgtttatgtttttctcttgtatccttggataccctctcgcgttggtcgaattatcgatcgacaacgttttgtccttccaaatgcagtttttcaagctttgtaaatcgtacgggacagtgttgcc

SEQ ID NO: 1916 - DNA, 1662 bp, Panicum virgatum
atttgttactggattcttctactgaacaatcatgattgctcattcgtagagcgtcagacttgcagccacctgacacgacgcaaaacgaccaggagaccccaaaatacggtgatgagcctaacgcttctgcaaggctgctactccgccgaggaagacgacgaccccaccgccggcgccggcgccggcgcagagctgagcgagtccggcgactcgtcaacggaggaagctggatcggacggagacgaggcgtccgctcctccgaagccggcctccaagccccgccgccgcccaaaccctaaggggggagatgcagccggcggcgaagggaactcctcgctgccgtcgacgctggaggctttcgccgatgtctccggccctccggagtttctgaggcacagggttgccgagcccgaggaagggacggaggcccttggcgtactcgatcgccgtgggaaggaagggagcaagcatccgcctccaggtgctgttgtggtggcgaaaccacagttagttgcaatacgcgagcgagataccacaattagttccaaccctccaggttcagtgacatctggttctgttgatggaaaaagaattataggcgctgcaaatcctggtccagaagacgcagctgatcttctgaggatgtgtctccagtgtggtgtgccgaagacttattcacatggtaagggtatggtttgccctgtctgtggtgatagaccagcccaaacaaaagagcccgaaaagaagaagggttcaactgtcaaagacaaggagaagatcaagaggatgagggggcaatcgtcgcacgcttcatggaagagcgagaccgagatggctcttcggcaacagttcgactgataactagttagcatggccaatacctaaatgaaatgctggggaaacctctgttgccctttgtagtgtaccgtatgatgtcccattacacccttggttccagattggcagagccctcgttgtgtttgttgtatcagctgcatttgttttgccaggaacagttttgtttgctaagctgtcaaaatttagatgtcagattgcaggaggatttttgttagcacacctggagcacgagcgtctcgcgttctgcttgtttaagaagagaagtttgagatggctcaggctcacaacgcttgccgcgaggcaggacagataagttgtgcccaccggaaagcgacaagaggagacaaacataacgtgaggaggtacttgttcttgtaccgtttgtttatttttttctcttgtatccttggataccctctcgcgttgatcgaattatcgatcgacaacgttttgtccttccaaatgcagtttttcaagctttgtaaatcgtacgggacagtgttgccagttgccactgtcttttttgagttgcaactacggtatcaaagactgaatacccagttgacgccggtttttcaaaaacgcagttgagtagttgacgccacatgtgaggccagtacgtgtagacagcaggtgaaatggccctatccaacatgaatttctcgttgaataatccacagatctctcgatggatctgacaaatatgcagacaaaaaactggagtcaattccctctacgccattgtaaaattgagttgatcccttatgtgccattgaaaattagctcatcccttctatgccatca

SEQ ID NO: 1917 - DNA, 1126 bp, Setaria italica
atgggtgaccactggtcgttggagccctcatgttgggaacggtatggaaaatgtgaggaatttgttactggatcgattctgctaagcaatcatgattgttcatacgaagtgtcagttgctaagacttgcagccacctgacacgacgcaaaacgaccaggaaatacccaggcacggcgatgagcttagcgctcctgcaaggctactcctccgccgaggaggacgacgaccacgccgccggcgccggcgccgagctgagcgagtccggtgaatcctccgccgaggaggccggatcggacggagacgaggcgtccgctcctccgaagccggcctccaggccccgccgccgcccaaaccctaaggggggagatgccggcggcggcgaaggggactcctcgctgccgtccgcgcttgaggccttcgctgacgtctccggtcccccggagtttctgaggcacagggttgccgagcccgaggaagggacggaggcacttggcgtactcgatcgccgcgggaaggaggggagcaagcacccgcctccaggtgccgttgtggtggcgcaaccgcagttagttgctattcgtgagcgagttaccacaactagttccaaccctcctgggtcagtgacgtctggttctgttgatggaaaaagagttataggcgctgcaaatcctggtccagaagatgcagctgatcttctgaggatgtgtctccaatgtggtgtgccaaagacttattcacatgctaagggtatggtttgccctctctgcggtgatagaccagcccagccgaaagagcccgaaaagaagaagggttccactgtcaaggacaaggagaagatcaagaggatgaaggggcaatcgtcgcacgcttcgtggaagagcgagacagagatggctcttcgacaacagttcgactgatagatagttagcatggtcaatgtctagatggaattctggggaaacctttgtcgcctgtgtagtgtaccgtatactgtccccgagtgccttaccctgggttccagatcgccagagccattgttttgcttgttgtatcagcagcatttttttttctgccaggaacagttttgtttactaagctgtcaaaattgaatctcagtagttagca

SEQ ID NO: 1918 - DNA, 944 bp, Pennisetum glaucum
ctttgacttgcagccacctgacacgacgcaaaaatctaccaggcacggcgatgagcttatcgctcctccaaggttactcctccgccgaggaggaggacgaccacgccgccggcgccggcgccgagctgagcgactccggcgaatcctccgcggaggaggccggatcggacggggacgaggcgtccgctcctccgaagccggtctccaggccccgccgccgcccaaaccctaagggcggagatggtggcggcggcgaaggggactcctcgctgccgtccgcgctcgaggccttcgccgacgtctcgggtcccccggattttctcaggcacagggttgccgatcccgaggaagggacggaggcccttggcgtgctcgatcgccgcgggaaggaggggagcaagcatccgcctccaggtgctgttgtggtggcgcagccgcagttagttgctattcgtgagcgagttaccacaactagttccaaccctcccgggtcagtgatggctggttctgttgatggaaaaagagttataggtgctgcaaatcctggtccagaagatgcagctgatcttctgaggatgtgcctgcaatgtggtgtgccaaagacttactcacacgctaagggtatggtttgccctctctgcggtgaccgaccagcccagccgaaagagcctgaaaagaagaagggttccactgtcaaagacaaagagaaggtcaagaggatgcgggggcaatcatcacacgcttcatggaagagtgaaacggagatggctcttcgtcaacagttcgactgatagattgtttagatggaataccggggaaacctttgttgcctgtgtgggtaggtgtaccgtctactgtcccagtgtgccttaccctgggttccttatcgctagagccgtcgctgtgattgttgtatcagctgcatttttacttctaccaggaac

SEQ ID NO: 1919 - DNA, 1010 bp, Cenchrus ciliaris
  misc_feature (256)..(256): n is a, c, g, or t
  misc_feature (615)..(615): n is a, c, g, or t
  misc_feature (640)..(640): n is a, c, g, or t
  misc_feature (699)..(699): n is a, c, g, or t
ctcctgcaaggctactcctccgccgaggaggacgaccacgccgccggcgccggtgccgagctgagcgaatccggcgaatcctccgcggaggaagccggatcggacggagacgaggcgtccgctcctccgaagccggcctccaggccccgccgccgcccaaaccctaaggggggagatgccgccggcggcgaaggtgactcctcgctgccttccgcgttggaggccttcgctgacgtctctggtcccccggagtttntgaggcacagggttgccgagcccgaggaagggacggaggcacttggcgtgctcgatcgccgcgggaaggaggggagcaagcacccgcctccaggtgctgttgtggtggcgcaaccgcagttagttgctattcgcgagcgagttaccacaactagttccaaccctcctgggtcagtaacggctggttctgttgatggaaaaagagttataggcgctgcaaatcctggtccagaagatgcagctgatcttcttaggatgtgtctccaatgtggtgtgccaaagacttattcacattctaagggtatggtttgccctctctgcggtgaccgaccagcccaaccgaaagagcctgaaaagaanaagggttccactgtcaaagacaaanagaaggtcaagaggatgcgggggcaatcgtcgcacgcttcatggaagagtgaaacgganatggctcttcgtcaacagttcgactgatggaaaccattgttgcttgtgtagtgtaccgtctgctatcccagtgtaccttattcctgggttccacatcgccagagccgtcgttgtgtttgttgtatcagctgcatcttgttttcctgccaggaacagttttgtttgctaagctgtcaaaaaggaatcgtagacgtcagattactcagaagagaggacgcttgtgcagtggaagtaaagggtttttgtagttagcgcctggagcacgaggcgccaagacgcaactggtatgtgatatgggcgatcgttgatca

SEQ ID NO: 1920 - DNA, 1031 bp, Cynodon dactylon
ggggaggaaacagagaaccacggcgatgagcttagcgcttctcgaaggctactcctccgcggaggacgacgagcccgccgccggcgcaggccccgagctgagcgagtccggcgactcgtccgccgaggaagccggagctgacggagacgaggcgtccgctcctccgaagccggcatccaagccccgccgccgccgcccaaaccctaggggtgcagatgcgggcggcggtgaggattcctcgctgccgtctgccctggaggccttcgccgatgtctccggaccgcctgattttctgaggcacagggtcgctgagccggaggaggcgacggaggcgcttggcgtgcttgaccgccgcacgaaggaggggaggaagcacccacctccaggttctgtggtggtggcaaaaccacagttggttgccattcgtgaacaagttactacaaacggtgccaatccttcaggttcagtgacatctagttctgttgatggaaaaagaataataggtgccgcaaacccaggacctgaagatgcagctgatcttttgaggatgtgtccccagtgtggcgtaccaaagacatattcacatgctcgaggtatggtttgccctcaatgcagtgatagaccagcagagacaaaggaaccagagaagaagaagggttccactgttaaagacaaggagaagatcaagagaatgcgagggcaatcgtcgcacgcttcctggaagagcgaaaccgagatggctcttcgacaacagttcgattgataactctttagctgggacgctgagtaaactgaactgtggggagtccttggtagtgttgttcaccgagggccttatgatgcctctgcgcctcacactgttccatgttagccagagtcatcgctatgtttgttgtgtctgcaattttctgctagaaacagttttgcttgctatgctatgaaaatcaaatgtgagaaattgtattagttaatacctggctgtttgtgaaaactggtctatttagcgccagacgcgcgagacaaagttggcc

SEQ ID NO: 1921 - DNA, 1338 bp, Setaria italica
taggcatttcgtcgaacaccaacgcggagtcgagcaccagccaccgcagccaccatgctcctcaccaaaccccacctctccaacccgctcgccccatccgcgccgccccccaaccccgctaccagctccagccatgccaggcccctcgccgcccccaccgcccgtcgcggccgcctccgcatctccgccacttccgcggcagcgcccgccgccaccgccgccgccgccgcgctgagccgagtggacgtgctctcggaggcgctccccttcatccagcgcttcaagggcaagacggtggtggtcaagtacggcggcgccgcgatgaagtcgccggagctccaggcgtcagtgatccgcgacctcgtcctcctttcttgcgtgggcctccgccccgtactcgtccacggcgggggcccggagatcaactcctggctgctccgcgtcggcgtcgagccgcagttccgcgacggcctccgcgtcacggacgcgcttaccatggaggtcgtcgagatggtgctcgtcggcaaggtcaacaagaacctcgtctccctcatcaacctcgaggggggcaccgctgtcggcctctgtggcaaggacgcgcgcctcatcaccgcgcgcccgtcacccaacgccgcggccctcggattcgtcggcgaggtcgcgcgcgtcgacgccaccgttctccaccccatcattgcctcgggccatatcccggtcatcgccacagtggccgccgacgagactgggcaggcctacaacatcaatgctgacaccgcggctggcgagatcgccgctgccgtgggcgccgagaagctgctgctgctgacggatgtgcctgggatactggctgaccgtaatgatcctgggagcctggtgaaagagattgacattgccggggttcggcagatggtggccgacgggaaggtagcaggtgggatgatacccaaggtggagtgctgtgtgcgcgccctcgcacaaggtgtgcacaccgcgagtatcattgatgggcgtgttccacactcgttgctgcttgagattctcacagatgagggtacgggcaccatgatcactggctgaggtggtcatgacttatggtattttcttgaacctctcttctcatggtcgtgtattttatgggaatgtagacttgactcaagattgcaatgagaatgtcgttctcacatttgtgggagcataagtttgattgaggtggttctgcagccatttatttgtgactctgttggcatctaactgagaagatgctgagattgtgtagtttgtttagtaaatttgatcagtttgcgttaaaatgcaatctattcaaatgaagtagtattt

SEQ ID NO: 1922 - DNA, 2143 bp, Brachypodium distachyon
tgaagcacgtatgggctaaccacgatttccccccttcccacgacccacgacccacgggccacggcgggggcgggcgggcggcggcggcgagactccaattcagccaccaacactttccctgcccgccgcacgcacgcacgcacgccaagtgaacaccagcgtctccgcaaggagcccctcttccggctaggaatttagtcgaacaccagccccgccggcgccggcgcagccatgctcctcacgaagccccacctctcctcctccctgctcgcatccacggcgctctctaaccgcacctccagccggaaccgcgtcgagccaaacgccgcctccccctcctcccgccgccgcctccgcatctccgccacatccacggctgtttcgccggcggcgacagcgctgagccgcgtcgatgtgctctcggaggcgctccccttcatccagcgcttcaagggcaagacggtggtggtgaagtacggcggcgccgcgatgaagtcccccgagctccagtcgtccgtgatccgcgacctcgtcctcctctcctgcgtcggcctccgccccatcctcgtccacggcggcggccccgagatcaactcctggctgctccgcgtcggcgtcgagccgcagttccgcaacggcctccgcgtgaccgacgcgctcaccatggaggtcgtcgagatggtgctcgtcggcaaggtcaacaagaatctcgtctccctaatcaacctagcaggcggcaccgctgtcggactctgcggaaaggacgcgcgcctcattacggcgcgcccctccctcaacgccgcagccctcggattcgttggcgaagtcgcgcgcgtggacgccacggtcctccatcccatcatcgcctctggtcacatcccggtcatcgccactgttgccgccgatgagaccgggcaggcctacaacatcaacgccgatacggcagcaggagagattgcagctgcggtgggcgccgagaagttgctgctcctaactgatgtctcaggaatactggaggaccgtaatgatcccgggagcctggtgaaggagatcgatattgctggagtgcgtcagatggtatccgatgggaaggtagccggtggaatgatcccaaaggtggagtgctgcgtgcgagcccttgctcagggcgtgcacactgcgagcatcatcgatgggcgtgtcccgcactcactgctgctcgagattctcacagacgagggcactggcaccatgatcactggctaagcttgtcgatgcctttcatgaaggaagaaagataattgagacccgatgccatggaagaaataaggacttttatgtcagcaaaccaggaactggagttatgaagtgttaaaaggagtttttggcattcatctatttctatctgtactcggaatggtgtaccattggtccaaataatagatgttcctctgtctacaacttccactttatgcttttgcatcttacttgaaatcacggatgctgtatccattctgcttgaaattctttctaggaatttccaagctaactcttcaccttattattttgatccagattcttgtattttgtaagcgccagtccaggtgcagaactaagtgcactgtgatgaactgaactgtgaaaccaagtggatggaggaaaggactttgatttggcaccgcaacttcaagggtcaattatgctagccacgaggatgggggaaactgagatagctgagcctggtttactttgcaggcaacatttcttctctttcccttcgaccactatggcatgggcatagtaaactccactcacatctcaaggaacggtgccttttgttttcttcagtatttaagtactgcatttgtgggtactcttctgcgctgctacattgttcaatttgtcggataagaggaaagctctattctctgtgctagtccttgcagaatctattccccactacggtgcgcattttccttatctcgtgagactgaatattggtacgggtactttactgctctgtttatcatctgtcgtattgtcgtcagtagagcacttgagttcctgcgctgttccgtgtggtactcaaaacggttactgctacaatgtaacggtataaattgtgatctaaggagcattttgagcttgatatggttctgcagat

SEQ ID NO: 1923 - DNA, 1934 bp, Hordeum vulgare
acttcccctgcccgccgcaggcacccgcagtcaacacctagcacgacgctaacctgtccagcgcctccacctcctccccctccggctaggcattccgtcgagcaccagcccagcccccgacccaacgaccgccgccgcagccatgctcctcacgaagccccagctctcttcctccctactcgcatccacgccgctctttacccccgcatccacccccaaccacgccaagccaatcgtcgcctctcacgcccccggccgccgcctccgcatctccgccacatccacggcggtctcgccgggggcgacggcgctcagccgcgtcgacgtgctctcggaggcgctccccttcatccagcgcttcaagggcaagacggtggtggtcaagtacggcggcgccgcgatgaagtcccccgagctgcagtcgtccgtgatccgcgacctcgtcctcctctcctgcgtcggcctccgccccgtcctcgtccacggcggcgggcccgagatcaactcctggctgctccgcgtcggcgtcgagccgcagttccgcaacggcctccgcgtcacggacgcgctcaccatggaggtcgtcgagatggtgctcgttggcaaggtcaacaagaacctcgtctccctcatcaacctcgccggcggcacggccgtcggcctctgcggcaaggacgcgcgcctcatcaccgcgcgcccctcccccaacgccgcagcccttggcttcgttggcgaagtcgcgcgggtggacgcctcagtcctccaccccatcatcgcctctggccacatcccggtcattgccaccgtggccgccgacgagacagggcaagcctacaacatcaacgcggacacggctgcaggtgagattgccgctgcggtgggcgcagagaagttgctgctgctcacagatgtgtctgggatactggcggaccgtaatgaccctgggagcctggtgaaggagattgatatcgctggggtgcggcagatggtatccggtgggcaggttgctggtggaatgatcccaaaggtggaatgctgcgtgagagctctcgcccagggtgtgcacactgcaagcatcatcgatgggcgtgtcccgcactcgctgctgctcgagattctcacagatgagggcactggcacaatgatcactggctaaggttcttgtaaaatttcaagcgccagtacaggcgcgcagagctaagtgcgagtgatggatagaactgtggaaaccaagtggatggagaaaaggtcttcgattgagcgctgctacgtcaagggccaaattatgctagccatgaggatgcgggagactgagatgggttgattcttctcgtcggttcgaccaccatgtcatgggcatagtgaactccacccacatctaaaaaggaacggtgcctgccttcttttcagtatttaatttaccgcattcatcgaaactcttacgctgctacatctaatttgttggacggggatattgtgagagaaaagaggaggaaatctgtgaccactgtgctggtcgttgcagaatctattccccattatgttgcctgtttgctattcttccgtgatactgaatattattggcgtgcattgcttagtacccgtattgtttattattatctgtcgtagtgtcttgtttattccctgttgagcttcccttgatttttcatctctgcatgtgttgtgctcagtttggtcagatgaggtaagtggtaaactgtgcatcaccttctttacagattacactggggtttaagcatctgttcagaagccacgtggtgcagggaatcgtcgtattgcctggtagtactcaacacgctcgagacagaagggtggggaaggactggatcttaagcagcctggtggaactgatcaacgacagcgagtggtgctttgtttatgggtgtgtctatgtcatatttagatgtgacata

SEQ ID NO: 1924 - DNA, 1529 bp, Secale cereale
gactcccaattcaacacttcccctgcccgccgcaggcacccgcagtcaacacctactacgccgctaacctgtccagcgcctccacctcctcccttccggctaggcattccgtcgagcaccagcgcccgaccaaccaccgccgccgcagccatgctccccacgaagccccagctctcttcctctctgctcgcatccacgccgctctttaaccccacatccaatcccaaccaggccaggccaatcgccgcctccccctccccccgccgccgcctccgcatctccaccgcatccacggcggtttcgccgggggcgacggcgctcagccgcgtcgacgtgctctcggaggcgctccccttcatccagcgcttcaagggcaagacggtggtggtcaagtacggcggcgccgcgatgaagtcccccgagctccagtcgtccgtgatccgcgacctcgtcctcctctcctgcgtcggcctccgccccatcctcgtccacggcggcgggcccgagatcaactcctggctgctccgcgtcggcgtcgagccgcagttccgcaacggcctccgcgtcaccgacgcgctcaccatggaggtcgtcgagatggtgctcgttggcaaggtcaacaagaatctcgtctccctcatcaacctcgccggcggcaccgccgtcggcctctgcggcaaggacgcgcgcctcatcaccgcgcgcccctcccccaacgccgcagcccttggcttcgttggcgaagtcgcgcgagtggacgccacagtcctccaccccatcatcgcctctggtcacatcccggtcattgccaccgttgccgccgacgagacagggcaggcctacaacatcaacgcggatacggcggcaggtgagattgcagctgcggtgggcgcagagaagttgctactgctcacagatgtgtctgggatactggcggaccgtaatgaccctgggagcctggtgaaggagattgatatctctggggtgcggcagatggtatccgatgggcaggtagccggtggaatgatcccaaaggtggagtgctgcgtgcgagctctcgcccagggcgtgcacactgcaagcatcatcgatgggcgtgtcccgcactcgctgttgctcgagattctcacagatgagggcactggcacaatgatcactggctaaggtgtacaatgcctccttggttcttgtaaaatttaaagcgccagcccaggcgcagagctaagtgcagtatgatggatagaactgtggaaaccaagtggatggggaaaaggacttcgattgagcgccgctacgtcaaggtccaattgtgctagccatgaggatgcgggagactcagatgggttgattcttctctgtcggtttcgaccaccatgttgtcatgggcatagtgaactccacccacagctaaaaaggaacggtgcccgccttcttttcagtatctaattaccgcattcgtcggaactcttccgctgcgacatctaatttgttggacggggatatgctgagaaaatgaagtgcaaatctgt

SEQ ID NO: 1925 - DNA, 1958 bp, Panicum virgatum
tatccatatgctagctcgatcgtgcgctcgccaccaacctgccaccactcaccacaaaggtcgtagatagggcactgcgcatctagctaaacggctgcgacggccctttagttgttgttttttttccgaaagcaacgtgacgatggttgtcaacgtctctgcctttgctgatgggaatagggccaccccaaaagtcagatgtcgcggaaggaaatgggtgcgtcgcaggtcggcgaggatcgagttcgtacgacaaagaggagggagcgggcaagcgttgcttttggtttgtgtggcgcgaatggccaagagatagatctgctttcgcacaagcacagcgaggagaggatccaaaaacccaagaccgggggatgccaggaaacagcgaggagggttaacgcagtaaatacactacactatggaaaaccagaatttgagcatccgcaagagacaaaatggtttacgtactggatcatgttttactttggaaaagtttggattgttcatacaaatcttttactgggattataattaatatacaaatctggtgttacggctgggcctcatcatcatggcgcgcagacctctcagttggcccagcacggggagggaagtgagtgtgttgcctagggctgtctaggcctttgtgccgcgacacttactggcccatctagatttgaccggcgggaggaaaaaaaagaaaaaagagagatgaagaggagagaagcgtagaatgggccgtgggtaggggaaatcgccaatgaaaacgggccggacaagggaaaccctacaagaaaccccccagtcagaggcatttcgtcgaacaccgccaacgcagccatgctcctcaccaaaccccaagtctccaacccgctcctcccgtccgcgccgtcctccaaccccgctcccagctccagccatgccaggcccctcgccgcccgcgccgcccgtcgcggccgcctccgcgtctccgccgggcttagccgagtggacgtgctctcggaggcgctccccttcatccagcgcttcaagggcaagacggtggtggtcaagtacggcggcgccgcgatgaagacgccggagctccaggcgtccgtgatccgcgacctcgtcctcctctcctgcgtcggcctccgccccgtgctcgtccacggcggggggcccgatatcaactcctggctgctccgcgtcggcgtcgagccgcagttccgcgacggcctccgcgtcacggacgcgctcaccatggaggtcgtcgagatggtgctcgtcggcaaggtcaacaagaacctcgtctccctcatcaacctcgaggggggcaccgccgtcggcctctgcggcaaggacgcctgcctcatcaccgcgcgcccgtcccccaacgccgcggccctcgggttcgtcggcgaggtcgcgcgcgtcgacgccaccgtcctccaccccatcgttgcctcgggacatatcccggtcatcgccaccgtggccgccgacgagactgggcaggcctacaatatcaatgccgatacggcggccggggagatcgccgctgccgtgggcgccgagaagctgctgctgctcacggatgtgtctgggatactggcggaccgtaatgatccggggagcctggtgaaggagattgacatcgccggggtgcgacagatggtggccgacgggaaggtggcaggtggaatgatacccaaggtggaatgctgcgtgcgagccctcgcacaaggtgtgcacactgcgagtatcattgatgggcgcgttccacactcgctactgcttgagattctcacagatgagggtactggcaccatgatcactggctgaggtggttatgacttgtggtattttcttgcgtctctctgctcttagccatgtattttatggtaatgtagacttgactcaagattgcaataagaatgcattactcacattgtgagaaaattagtttggttgaggtt

SEQ ID NO: 1926 - DNA, 1779 bp, Panicum virgatum
aacagagagatgaagaggagacaagcgtagaatgggccgtgggtacaggaaatcgccgatgaaaacgggccggacaagggaatttcggcaaaacaggacgcagcaaaaccctagaagaaacacccccggtcagaggcttttcgtcgaacaccaccaacgcggagtcgagcacaaaccaccgcagtcatgctcctcaccaaaccccaactctccaacccgctgctcccgtccgcgccgccctccaaccccgctcccagctccagccatgccaggcccctctccgcccccgccgcccgtcgcggccgcctccgcgtctccgccgggccgagccgagtggacgtgctctcggaggcgctccccttcatccagcgcttcaagggcaagacggtggtggtcaagtacggcggcgccgcgatgaagtcgccggggctccaggagaacgtgatccgcgacctcgtcctcctctccagcgtcggcatccgcctcgtgctcgtccacggcgggggccccgagatcaactcctggctgctccgcgtcggcgtcgagccgcagttccgcgacggcctccgcgtcacggacgcgctcaccatggaggtcgtcgagatggtgctcgtcggcaaggtcaacaagaacctcgtctccctcatcaacctcgccaagggcaccgccgtcggcctctgcggcaaggacgcgcgcctcatcaccgcgcgaccgtcccccaacgccgcggcgctcgggttcgtcggcgaggtcgcgagcgtcgacgcgaccgtcctccaccccatcattgcctcaggccatattccggtcatcgccaccgtggccgccgacgagactggtcaggcctataatatcaatgctgatacggcggcaggggagatcgccgctgccgtgggcgccgagaagctgctgctgctcacggatgtgtctgggatactggcggaccgtaatgatcctgggagcctggtgaaggagattgacattgccggggtgcgacggatggtagctgacggcaaggtggctggtgggatgatacccaaggtggagtgctgcgtgcgcgccctggcacaaggtgtgcgcactgcgagtatcattgatgggcgcgtcgaacactcgctgctgcttgagattctcacagatcagggtaccggcaccatgatcactggctgaggtggttatgacttatggtatttttcttgcgtctctctgctcttagacatgtattttatggtaatgtagacttgactcaagattgcaataagaatgcattactaacattgtgagaaaattagtttggttgaggttgttttgcgcccatttatttgtgactttgctggcttctagttgagaagtgtagagatagttgagaagtaaatttgatcaattcaggttaaaatctattcaaatgaagtagtatttgttgtactgcattcaaatgaaactttttattagattgtcctacaaaggttgtaactatgtaatacatattagctgcacacatcatgagaagtgatatgatgcttggagtagttagtgtttaccttggatgagagaacagagaagactcatgtaaacagagagaggtgctttcagtaagtacagttgacagattaagtttgcaaaataaggcgtttgctttgcatctgagacagcaattgtatagccttttataaatgcttggttgtgaatatgttatatatgtaaatttgacataactatagtatatgcctaaagagaattggtctaaaggcacgtaatgaaatgtttcagttctgctct

SEQ ID NO: 1927 - DNA, 2515 bp, Triticum aestivum
aggaaaccccttccggctaagcaagcaccccggcggcgccaacagaaggctcctcggcggccgcagcaatgctcctaaccaagccccaccccggcctcaccctcccctccgcatccctcccaaatcctaccctaaacgccgcccgcgtcaggccgctcgcctcgtccgcggcccatggacgccgcgggcgccgcgtatcggcctcctcctccccggcgccagcgcaggccgcgtccgcggcgctgaggcgcgtggacgtcctgtcggaggcgctccccttcatccagcggttcaagggcaagacggtggtggtcaagtacggcggcgcggccatgaagtcgccggagctgcaggcgtcggtgatccgcgacctggtcctgctctcctgcgtcggcctgcgccccgtgctcgtgcacggcggcggcccggagatcaactcctggctgcagcgcgtcggcgtcgagccgcagttccgcaacggcctccgcgtcaccgacgcgctcaccatggaggtcgtcgagatggtgctggtcggcaaggtcaacaagcagctcgtctccctcatcagcctcgccggcgccaccgccgtcggcctctgcggcaaggacgcgcgcctcctcaccgcgcgcccctcccccgacgccgcggccctcgggttcgtcggcgaggtcacgcgcgtcgacccctctgtgctccacccgatcatcgcctccggccacatcccggtcatcgccaccgtggccgcagacgagaccgggcaggcctacaacatcaacgccgacactgcggcgggggagatcgcggctgccattggcgccgagaagctgctgctgatcactgacgtgtccggcatactcgcggaccgggacgaccccgggagcctggtgaaggagattgacatcgccggcgtccggcggatggtggccgaggggaaggtgggtgggggcatgatacccaaggtggagtgctgcgtgcgcgcactggcgcagggcgtgcacacggccagcatcattgacggccgcgtcccgcactctctcctgctcgagatcctcaccgacgagggcaccggcaccatgatcaccggctgaaacttgtttgtttgttgtttctttccttttcttttttggttcattcattgggttggatggcttgcatccctcatttgtggcaactgtgttttcgattcgaatcatgaacaaggaatggtgaaagattgcaactttaagcagaatatatacatttcgtggcaagattttccaatcaaaatctgccactggactttcttgtcagcattctatctatcatctgaaactactcgctggcgctgctcaagctctacaagacacgatcaaggatccccactgactttcaattacatattttacaacagtttcatggtcaaatgattacagcccagtaatataacaatcaatgtacaagtttcgtgtggatgtaaatcgcgaggcctgtgatgtcctacaaaacgtgttcgcagaaatcttgcaatcaccacacttcgaaatcccacggctcataactgtatccaaaagcaccaggaaataaaataagataagcacactgcatgcaagcttaaacatttaactacgaccaaccatggttaccacaccggcaatgtaaattctgggcctttcaaaccaagtccgtgatcaatcttgactaaactacgctcactagatgatgtgcccctgcaccataactaagagggcatgaaaacactgaaatttaaagtcgacgggttgttgtgctcacttggtacgagcaaccgccaccacgatgaagacgaacaccgagagcatgaaggacaccttcactgcatcgctgtacagatcgggcttatcttcatcgctttgagggtggaagagcatgctgacaatcttcgctatattatcgaagaattccgttatttttgcctgggtgttggccaggatccacttaagcactacagcagggccgcaagagtttccctttctattaacttctttgccatcctgaaaagatctcctgaattcttgcactgcctcgttattcattacagcatcccagacagtcctatcacatgacaaggacataaccattttctgaacattagggtctctttgcaatagacggaaggcatccaaaacattcctatgctccctggtcagaagagcagtagagttgagaacatatgcagcaggttcgacccaatcgtctgatcctgatgaattggttgatgaagaatgctctgagttggacagcaatgctagttgtttctcagtttcatctgaattcacatcataataagaaccctcaaacacctcctggatgctagagaaggcggcgcggacttcatccccggtgggtggggaccagaagacaaccctgtagtcgctgtccacctccgcatcgccggcgcccggggccgcgccgtcgcccgcggcggcgacgacgacctcctcccagtcgtcctccccgtcgcggcgcagcgtgcgggactcccagcacgcggcggccg

SEQ ID NO: 1928 - DNA, 1370 bp, Hordeum vulgare
cgacgctccatctacaagtaccgtctcttccgctgcgccgcacccgcacgcccagcgccgagcaccaaccccttcccttccgttcaggcaagcaagtcgtcgaacaccacggcggcgcaaacaccgaggctccccgtcggccggccaccgaccgcagcaatgctcctaaccaagccccaccccgcccgcatcctcccctccgcattcctcccgaatcctaacctcaacgccgcccgcgccagcaccctcgcttcgcccgcgccccatggacgccgcgggctcggcgtctcggcctcctccctggcgccggcggggccggcgtccgcttcccatccaacgtccgcggcgctgaaccgcgtggacgttctgtcggaggcgctccccttcatccagcggttcaagggcaagacggtggtggtgaagtacggcggcgcggccatgaagtcgccggagctgcaggcgtcggtgatccgcgacctggtcctcctctcctgcgtcggcctgcgccccgtgctcgtgcacggcggcggcccggagattaactcctggctgcagcgcgtcggcgtcgagccgcagttccgcaacggcctccgcgtgaccgacgcgctcaccatggaggtcgtggagatggtgctggttggcaaggtcaacaagcagctcgtctccctcatcagcctcgccggcgccaccgccgtcggtctctgcggcaaggacgcgcgcctcctcaccgcgcgcccctcccccgacgccgcggccctcgggttcgtcggcgaggtgacgcgcgtcgacccctccgtgctccacccgatcatcgcctccggccacatcccggtcatcgccaccgtggccgccgacgagaccgggcaggcctacaacatcaacgccgacaccgcggcgggggagatcgcggccgccattggcgccgagaagctgctgctgatcaccgacgtgtccggcatactcgcggaccgggacgaccccgggagcctggtgaaggagattgacatcgccggcgtgcggcggatggtggccgaggggaaggttggtggggggatgatacccaaggtggagtgctgcgtgcgggcgctggcgcagggcgtgcacacggccagcatcattgacggccgcgtcccgcactccctcctgctggaaatcctcaccgacgagggaaccggcactatgatcactggctgaacattttcgcggcattgttttctcttttttctactgtatttttgttcattggtttggatggttttgtgtgaagggttgcttcacgtgttgtaactttgagttttcgattcgaattctggatgaggaacatatgtgacagattgcaacttcatgcacgatatatacagtttggcggc

SEQ ID NO: 1929 - DNA, 1366 bp, Triticum aestivum
ccgccgccgcctccgcatctccgccgcatccacggcggtttcgccgggggcgacggcgctcagccgcgtcgacgtgctctcggaggcgctccccttcatccagcgcttcaagggcaagacggtggtggtcaagtacggcggcgccgcgatgaagtcccccgagctccagtcctccgtgatccgcgacctcgtcctcctctcctgcgtcggcctccgccccatcctcgtccacggcggcgggcccgagatcaactcctggctgctccgcgtcggcgtcgagccgcagttccgcaacggcctccgcgtcaccgacgcgctcaccatggaggtcgtcgagatggtgctcgttggcaaggtcaacaagaatctcgtctccctcatcaacctcgccggcggcaccgccgtcggcctctgcggcaaggacgcgcgcctcatcaccgcgcgcccctcccccaacgccgcagcccttggcttcgttggcgaagtcgcgcgggtggacgccacggtcctccaccccatcatcgcctctggccacatcccggtcattgccaccgttgccgccgacgagacagggcaggcctacaacatcaacgcggatacggcggcaggtgagatcgccgctgcggtaggcgccgagaaattgctactgctcacagatgtgtctgggatactggcggaccgtaatgaccctgggagcctggtgaaggagattgatatctctggggtgcggcagatggtatctgatgggcaggtagctggtggaatgatcccaaaggtggagtgctgcgtgcgagctctcgcccagggtgtgcacactgcaagtatcatcgatgggcgtgtcccgcactcgctgttgctcgagattctcacagatgagggcactggcacaatgatcactggctaaggtgtacaatgcctccttggtcttgtaaaatttaaagcgccagcccaggcgcagagctaagtgcagcgtgatggatggaactgcggaaaccaagtggatggggaaaaggacttcgattgagcaccgctacgtcaaggtccaattatgctagccatgaggatgcgggagactgagatgggtttgattcttctcgtcggtttcgaccaccatgttgtcatgggcatagcatagtgaactccactcacagctaaaaaggaacggtgcctgccttcttttcagtatctaattaccgcattcgtcggaactcttccgctgctacatctaatttgttggacggggatatgctgagaaaacgaagagcaaatctgtgcccactgtgctggtcgctgcagaatctattccccattatgttgcctgtttgcttttcttgtgtgatactaaataatactggcgtgcatcgtt

SEQ ID NO: 1930 - DNA, 1437 bp, Setaria italica
aagtcgatcccaaaacgaaaacacgtgctggggtcaaccgccggcggcttcaccagctccggtgtcgccactcgccacctactccgccgccgtccccatctacaattacccacttccgcttcgccgcagcggcacatccagcgccgagcaccacagcccgctcccgctcgacacacagaccaaacgcaaatcgtccaccgggcgaggcatttcgccgagcaccgaagccccgccgccgcagccatgctcctcacgaagccccactcatcctccctcgccgccccctccgcggcgctcccgaagcatggcccgaccgctaaccgcgtcgttacgcccctagcctcgtcgagctcccgccgcggcctccgcgtctccgccgcgtccgtggcggcggcggcggcactgagccgcgtggacgtgctgtcggaggcgctcccgttcatccagcggttcaagggcaagacggtggtggtcaagtacggcggcgcggcgatgaagtcgccggagctgcaggcgtcggtgatccgcgacctggtcctcctgtcctgcgtcggcctccgtcccgtgctcgtccacggcggcgggcccgagatcaactcctggctggcgcgcgtcggcgtggagccgcagttccgcaacgggctccgcgtcacggacgcgatcaccatggaggtcgtggagatggtgctggtcggcaaggtcaacaagcagctcgtctccctcatcagcctcgcgggggccaccgccgtcggcctctgcggcaaggacgcgcgcctcctcaccgcgcggccctcccgcgacgcggcctccctcggcttcgtcggcgaggtgacgcgcgtcgacccctccgtgctccacccaatcattgcggcgggccacatcccggtcatcgctaccgtggccgcggacgaggccgggcaggcttacaacatcaacgcggacacggcggccggggagatcgcggcggcgatcggcgccgagaagctgctgctgctcaccgacgtgtcaggcgtacttgcggaccgtgacgaccccgggagcctggtcagggaggtggacgtcgcctgggtgcggcagatggtggccgagggcaaggtaggcggcggaatgattcccaaggtggagtgctgcgtccacgccatcgcgcagggggtgcgcaccgccagcatcatcgacggccgcgtcccgcactcgctgctgctcgagatcctcacggacgagggcaccggcaccatgatcaccggctgaagcttacaaagctcatcgtgagccttgccattggtatgcgtgaggggtgagtggtgacagttgtcggaattgttttgcacgcatgcattcccgtgactcgatgggtcatgttattcatggactgaatcaaatcaaattcaggttgcaactttatttatacaaataatttcatcgatggaaatttatgcg

SEQ ID NO: 1931 - DNA, 2578 bp, Panicum virgatum
ctttctggctgttttgtacactgcaacgaacacactgcatttcactgtgatctcattatcttcgaaaagaaccgaaaaataatggtcaagtaattcaaggataaacaccagctaaactgcatatggctgcatacaacccagccagaaaagagagctacaaactgcctgtttacaatgtatatggtacgtttctattgtgaccctactcctggacagggccgcaattttcacaagcagcaggggagtatggcggactggtggcaaatccaacaaagccaatccactacagcccaatatctccaaaactccccaaaatgggtcaccctgccgatctacggcccaagaaaatgaaggctacgatgatgatattgggccctcgccatacatcgtattgtgaatgggctgaccaaacctaacccatcatcataaaagggtgtcgggtttattttcataatgggctgggctatactggccttctcacattgcaaaggaagctgatttgggcttaaagacggttcagctcagcctacgctatacccaagactgggctgagacagcagccggggcccgtcaggaaaccctattttttttctttgatattttttcctattttgttctgtgtgtcggcaccagaatactgaaactccatcggatgtctgtgaaaaagacagagaaactccaccagaaagttcacaaggacgaaaagacatctcatgatgggaattgcgcttttcagatttttgacacaaatttctcaatcaaggccccgttcagtttctaaaaaaattcatccaatatccgtcacatcgaatcttcggacacataaaacattaaatgcagttgaaaaaataactaattacacagtcttactaattagcacgagatgaatcttttaaacctaattaatctatgattagacattatttatcaaataacaacgaaatatactacagtgtcaaaacccaaactcttttcatcaactaaacacacaccaaccaaatgtgctgctgctacccgatgccatacggtcaaagctagagcacgcaactaaaaactcgagtctgcgagcaagtcgattcccaaaacgaaaacacgtgctcgggtcaaccgccggcggctctaccagcttcggtgtcgccaccctccacctactccgccgccgtcccatctccctacaattagccacttccgctgcgccgcagcggcacatccagcgccgagcaccagcccgctcccgctcgacacccagacctcaccaaacacagatcgtccaccgggtgaggcatttcgtcgagcaccacggccccccgtcgcagttatgctcctcacgaagccccacccgtcctccctcgccgccccctccccctccgcggcgctcccgaagcctggcccgaccgccaaccgcgtcgctacgcccctaccctcgtccagctcccgccgccgcggcagcctccgcgtctccgccgcgtccgtggcagcggcgcagcccacaccggcgtccccggccgcggcggcgctgagccgcgtggacgtgctgtcggaggcactcccgttcatccagcggttcaagggcaagacggtggtggtcaagtacggcggcgcggcgatgaagtcgccggagctgcaggcgtcggtgatccgcgacctggtgctcctctcctgcgtcggcctccgccccgtgctcgtccacggcggcgggcccgagatcaactcctggctggcgcgcgtcggcgtggagccgcagttccgcaacgggctccgcgtgacggacgcggtcaccatggaggtcgtggagatggtgctggtcggcaaggtcaacaagcagctcgtctccctcatcagcctcgcgggggccaccgccgtcggcctctgtggcaaggacgcgcgcctcctaaccgcgcggccctcccgcgacgcggcctccctcggcttcgtcggcgaggtgacgcgcgtcgacccctccgtgctccacccaatcatcgcgtcgggccacatcccggtcatcgccaccgtggccgcggacgaggccgggcaggcctacaacatcaacgcggacacggcggccggggagatcgcggcggcgatcggcgccgagaagctgctgctactcacagacgtgtccgggatcctcgcggaccgcgacgaccccgggagcctggtgagggaggtggacgccgccggggtgcggcggatgattgcggaggggaaggtgggcggagggatgatacccaaggttgagtgctgcgtccgcgccatcgcgcagggcgtgcgcaccgccagcatcatcgacggccgtgtcccgcactcgctgctgctcgagatccttacggacgagggcaccggcaccatgatcaccggctgaagcttgaaagcttatagtgagccgtgttatttgtttgcgtgagaggtgagtggtgaatcagtgttggccggaattgttttgctcatgcaccaattgttttgctcatgcaccaaagtgtttgtcaactgaaccaaagagtgtattgccgtgacctggtgctggtgggctatatgttattcatggactgcatcaaatcaaattcaacctgcaacttaa

SEQ ID NO: 1932 - DNA, 1200 bp, Brachypodium distachyon
caagtaccccctttctttcgagtttcgatccgccgcacccacacccgcacgccctgcgccgagcaccaaccaccaaacgcaaatcaaatcgtcgaacgcctatcgccccggctcctgtcgtcgggcggctgccgcagcaatgttcctcgccaagccccagccctccgtcctcctcccctccgtctccctcccaaatcctaacctcaacgctgctggccgcatcactcccctcccgtcatccgctcgatcccatcgccgccacggcctccgcgtatcgtgctcctcctccctggcgacagcagcacggcccgcttccacggccccggcccatcccgcggccgcggcgctgaaccgcgtggacgtgctgtcggaggcgctccccttcatccagcggttcaagggcaagacggtggtggtgaagtacggcggcgcggcgatgaagtcgccggagctgcaggcgtcggtgatcagggacctggtcctcctctcctgcgtcggcctgcgccccgtgctcgtgcacggcggcggcccggagatcaactcctggctggagcgcgtcggcgtcaagccgcagttccgcaacggcctccgcgtcacggacgcgctcaccatggaggtcgtcgagatggtgctcgtcggcaaggtcaacaagcagctcgtctccctcatcagcctcgccggggccactgccgtcggcctctgcggcaaggacgcgcgcctcctcaccgcgcgcccgtcccccgacgccgccgccctcggcttcgtcggcgaggtcacccgcgtcgaccctgccgtgcttcgccccatcatcgcctccggccacatcccggtcatcgccaccgtggccgccgacgagaccgggcaggcctacaacatcaacgccgacaccgcggccggcgagatcgcggctgccatcggcgccgagaagttgctgctgatcaccgacgtgtctggcatactggcggaccgagatgaccccgggagcctggtgaaggagatcgacatcgccggggtacggcggatggtggacgaggggaaggtgggcggtgggatgatacccaaggtggagtgctgcgtgcgcgcgctggcgcagggcgtgcgcacggccagcatcatcgacggacgcgtcccgcactcgctgctgctggaaatcctcaccgacgagggcacaggcaccatgatcaccggctgaatctttta

SEQ ID NO: 1933 - DNA, 1469 bp, Panicum virgatum
  misc_feature (334)..(334): n is a, c, g, or t
  misc_feature (452)..(452): n is a, c, g, or t
  misc_feature (483)..(483): n is a, c, g, or t
  misc_feature (993)..(993): n is a, c, g, or t
  misc_feature (1008)..(1008): n is a, c, g, or t
  misc_feature (1011)..(1011): n is a, c, g, or t
  misc_feature (1061)..(1061): n is a, c, g, or t
  misc_feature (1085)..(1085): n is a, c, g, or t
  misc_feature (1096)..(1096): n is a, c, g, or t
  misc_feature (1151)..(1151): n is a, c, g, or t
  misc_feature (1218)..(1218): n is a, c, g, or t
  misc_feature (1308)..(1308): n is a, c, g, or t
gtgctcgggtcaaccgccggcggctctaccagctccggtgtcgccaccctccacctactccgccgccgtcccatctccctacaattagccacttccgctgcgccgcagcggcacatccagcgccgagcaccagcccgctcccgctcgacacccagacctcaccaaacacaggtcgtccaccgggtgaggcatttcgtcgagcaccacggccccccgtcgcagttatgctcctcacgaagccccacccgtcctccctcgccgccccctccccctccgcggcgctcccgaagcctggcccgaccgccaaccgcgtcgctacgcccctaccctcgtncagctcccgccgccgcggcagcctccgcgtctccgccgcgtccgtggcagcggcgcagcccacaccggcgtccccggccgcggcggcgctgagccgcgtggacgtgctgtcggaggcnctcccgttcatccagcggttcaagggcaagncggtggtggtcaagtacggcggcgcggcgatgaagtcgccggagctgcaggcgtcggtgatccgcgacctggtgctcctctcctgcgtcggcctccgccccgtgctcgtccacggcggcgggcccgagatcaactcctggctggcgcgcgtcggcgtggagccgcagttccgcaacgggctccgcgtgacggacgcggtcaccatggaggtcgtggagatggtgctggtcggcaaggtcaacaagcagctcgtctccctcatcagcctcgcgggggccaccgccgtcggcctctgtggcaaggacgcgcgcctcctaaccgcgcggccctcccgcgacgcggcctccctcggcttcgtcggcgaggtgacgcgcgtcgacccctccgtgctccacccaatcatcgcgtcgggccacatcccggtcatcgccaccgtggccgcggacgaggccgggcaggcctacaacatcaacgcggacacggcggccggggagatcgcggcggcgatcngcgccgagaagctgntgntactcacagacgtgtccgggatcctcgcggaccgcgacgaccccgggagnctggtgagggaggtggacgccgcnggggtgcggcngatgattgcggaggggaaggtgggcggcgggatgatacccaaggttgagtgctgngtccgcgccatcgcgcagggcgtgcgcaccgccagcatcatcgacggccgtgtcccgcactcgctgntgctcgagatccttacggacgagggcaccggcaccatgatcaccggctgaagcttgaaagcttatagtgagccgtgttatttgtttgcgngagaggtgagtggtgaatcagtgttggccggaattgttttgctcatgcaccaaagtgtttgtcaactgaaccaaagagtgtattgccgtgacctggtgctggtgggctatatgttattcatggactgcatcaaatcaaattcaacctgcaactttatctat

SEQ ID NO: 1934 - DNA, 1460 bp, Sorghum bicolor
ttcacattttgatcgaaatttctctatcatatcaaatgtgctgctacaccatgccaaataatcaaaaccagagcacgaaacaacatatactcgaatttgcaaagcaagtcgatccccaaacgaaaacacgtgctccggtcaaccgccggccgctccaccagctccggtgtcaccactcgccacctgctacgccgccgtcccaatcttacaattacccatttccgctgcgccgtgggcacacttccagtgccgagcagcaagctcgcttccgcctacacccaaaccaaagcgaggcatttcatcgaacacaacgaccccccgttgcaaaccatgctgctcaccaatccccacccctccctcgccgccgccgccgccgcctccacgccgaccccgaagcatggcctgaacgctaaccgcgttgcggccctgaccccgtcagcctcccaccgcagcggcggtctccgggtctccgccgcttccgtggcggcggcgcagcccacgccggcgtcccctgtagcggcgctgagccgcgtggacgtgctgtcggaggcgctcccgttcatccagaggttcaagggcaagacggtggtggtcaagtacggcggcgcggcgatgaagtcggcggagctgcaggcgtcggtgatccgcgacctggtcctgctgtcctgcgtcggcctccgccccgtgctcgtccacggcggcgggcccgagatcaactcctggctggcgcgcgtcggcgtggagccccagttccggaacgggctccgcgtcacggacgcggtcaccatggaggtcgtggagatggtgctcgtgggcaaggtcaacaagcagctcgtctccctcatcagcctcgcgggggccaccgccgtcgggctgtgcggcaaggacgcgcgcctactcaccgcgcggccctcccccgacgccgcctccctcggcttcgtcggcgaagtgacgcgcgtggaccccgccgtcctccaccccatcatcgcgtccgggcacatcccggtcatcgccaccgtggcggccgacgaggccgggcaggcctacaacatcaacgccgacacggcggccggggagatcgcggcggcggtgggagccgagaagctgctgctgctcacggacgtgtccggcatactggcggaccgcgacgacccggggagcctggtgagggaggtggacgtcgccggggtgaggcggatggtggccgaggggaaggtgggcggcgggatgattcccaaggtggagtgctgcgtccgtgccatcgcccagggggtgcgcaccgccagcatcatcgacggccgcgtcccgcactcgctgctgctcgagatactcacggacgagggcaccggcaccatgatcaccggctaaagctggattattatttgttagcaagaggggattagtcgtgagtgtgtgtgacacattgacattggtctgaattgttttgcacacgcacccaa

SEQ ID NO: 1935 - DNA, 2724 bp, Sorghum bicolor
caaaaggagggaaattacctagtaaaaagaaaaaaggtggatttccagaagctcgttctgacaaccgcccctacccacgaaagacaaatgtctcgcgcacccggatcggagcccacgtatcccctatgcctccctgacatcaggcccactccttcttcgtccccacacgtcagtgacatgtgccaacgcccccatgcgccccccggagctccccaccagtccaccaccacccctttctcacagtttcacacagcagttgcgagtagccgtaggcgagcgagaccgcttccggcggccgaattcgagagcggttccggcggcgtgggcggcggctgtgcccgagattggagagccgcgtggcgtggtgggcggctggcagctggcaactggcggcgtgcgcgatgtggacagcggcaggcgggaggggttcgtccgcggccgctgctgtgctgcgggtgctgctgatcgcgaccgcctgcggcctcgtcttcgcgctcctccacctcccgctccccgatggcggcgcccgccccgccggccccggtgaggagcgccgcggcgttggtgggggcggtggggcccgcctgtcggcgcagcaggggaggattcgagaggccaggaggctgagtgtcgtcaccgaagagatagaagggcaaactgatgaagttgcagcggaagaagacgaaaggatatctaaatctcccccggacactaaagaaaagatatggatgatgcaagatcagctaatcatggccaaggcatacctgcatttcgcttctccccaaggtagtgtacattttgttcgagagctgagattgaggataaaagagatcgaaagggcaataagccactcaagtggaggtacccgtgtacctgggagtgtgttgcaaaaaatgaaggcgatggagctgaccctttccaaggctcagaggatctacccacgttgctgtcagatgacagcaaagctacgtgcaatggtgcataacagtgaagaattggtcagagcacaccaaagtgaatcttcattcctcgagcaggttgctgtgaggacattatccaaaggccatcactgcctagcaatgcaacttactgcagaatacttttcattagatcccagtaaacgtgaattccctaaaagagagagcattcagttggatggttattatcattatgcaatattctcagacaatgtgcttgcaagtgctgtggttgtcaactctacaattgctgcatcaaaggaccctggaaggataatattacatattgtaactgacgcattgaattatcctgcaatgatgatgtggtttctaagaaacccaccaactccagcagcaatccaagtcaaaagcctagatgatttgaaatggttgcctggtgatttcagttccagattcaagctgaagggtgtccgagatccaagatacacttctgcacttaaccacttgcgtttttatttgccagaagtgtttccctctttgggcaaggttgtactcttggaccatgatgtggtagtccagaatgacttaactggactatgggatctggatatgaagggtaaagtaattggtgctgttgagacatgcacttcaagtgaaggttaccatcgattggatagcctggttgacttttctaatccaagcatctttgacaaagttgacccaaaggcctgtgcatttgcatttgggatgaacatatttgacctgaatgaatggcgcaaacaggatttgactacaacttatcataaatggtttcaactgggcaaaattcagaagttatggaagccaggaagcttgccactgggtcagcttaccttttacaacagaacactgcctctggatcaccgatggcatgtctttgggcttggccatgatttcagcattggaagaaatgaacttgagagtgcctctgtcatccactacagtgggaaactcaaaccctggctggagatttctatcccaaagtacagagactactggaacaggtacctcaactatgataatccacacttgcagcagtgcaacattcacggatagagggcgatgggagtgaggtgatttgcaaggtagaacttgatacacaacttcaccgtagaacttattagttgagcaggttgatgtcttttttttttgtttctgttgctagacaccctattatgtacttagggctatgaattttttttgctagtagtcacagtcagtacaaaaacaaaaggaacaacaacatcaaatagaagagctacaatttcactagtgacactaaagttttgacaaaagtaaaaccactagcttacataatcaataaaagattatttgtgcccaagtttttttaagcacagtgaacacacacccaaaatctcatattagtgaagttacaatatacgcttcattgtcaatgagcacgtcgtctaccactcttctgaaagaataatttgtgtcgcctcgtacctgggaaagaagagtgcagattccacggctctcagtttgcattggacaagatagatgtatattttcgcaaacaatattgtattctcttacaaagaagggattactattgtcatttagaaaagtctgccatagtgctggcattgccatgtcttgttttatttccctttctgtcagatatttgtaatttaaactatgggtctccactgtggacatctcaacagagtgatgactctaaaaacgtgtagttatagttacatcttctataatccatttctatttg

SEQ ID NO: 1936 - DNA, 1916 bp, Setaria italica
cggcggcgcgtggtgatgagggcggccgccggcgggagggagtcggcgtcgtcgtcgtcggcgggcgtcgcgctgcgggcgctgctgatcgcgaccgcgtgcggcctcgtcttcgccctcctcaacctccccgacggccgcgccggctccacggccgcccccggtggggagcgcggcgcgggtgggggtgggggagccggggtccgcctgtcggtggagcaggggctgatacgagaggccaggaggctgaatactgtcgccgaagagatagatgggcaaaccgatgaaattgctgctgaagaagatgaaagaatatcaaaatctcccccggacactaaagagaagatatggatgatgcaagatcagctaattatggccaaggcgtacttgcatttcgcttctccccaaggcagtgcacatttagttagggagctgaaattaaggataaaagagattgaaagggcaataagccgctcaagtggaggttcccatgtacctgggagtgcattgcagaaaatgaaggcgatggaacagaccctttccaaggctcagaggacgtacccacgttgctctcagatgacatcaaagcttcgtgcaatgacacatcacagtgaagaactagtcagagcacaccaaagtgaatcttcattccttgagcaggttgctgtgagaacattacccaaaggccaccactgcctagcaatgcaacttaccacagagtacttttcattagatcctaaggaacgtgaattccctaaaagagaaagcaggcagttggatgactattatcattatgcaatattctcagacaatgtacttgcaagtgctgtggttgtcaactctacaattgctgcatcaaaggatcctagaaggataatgttgcatattgtgactgatgcattgaattatcctgcaatgatgatgtggtttctgacaaacccaccaactccagcagcaatccaagtcgaaagcctgaaggatttcaaatggttgcctgatgatttcagttctagatttaagctgaagggtgttcgagatccaagatacacttctgcacttaaccacttgcgtttctatttgccggaagtgtttccctctttgagcaagattctactcttggaccatgatgtggtagtccagaaagacttaagtggattatgggacatagatatgaagggtaaagtaattgctgcagttgagacatgcacttctggtgaagcttaccatcgattagatagccttgttgatttttctaatccaagtgtcttcaacaaatttgatgcaaaagcttgtatctttgcttttgggatgaacatatttgacctgaatgaatggcgcaaacagggtttgtctgcaacctatcataaatggtttcaagtgggcaaaaagcggaagttatggaaggcaggaagcttgccactgggccagctcgtcttctacaaccaaacactgcctctcgaccgtcgatggcatgttctagagcttggccatgattctaccattggaacagatgaacttgagagcggctctgtcatccactacagcgggaaactcaaaccctggctggaaatctccatcccaaagtacagagactactggaacagacatcttaactacgagaacccatacttgcagcagtgcaacatccacggatagaagtgatgggggtgggaagattcgcacagtagaacatgaatacacagttttgctctatagggcttattagtaagatgatcttattccttttttttctttacttttattactagatgccctgttctgtatttaggtgtatgcattggtttaactaatagtcacaatctgtgcaaaagggacattataacaaaatcgaataaaagggctacaattttactaatgattctgaagtggaaaaaaaaacttttagctgcatggca

SEQ ID NO: 1937 - DNA, 2482 bp, Panicum virgatum
cggacgaaggaaaaattacggatttacgggcgaccacagaccagaaatcccaacatatctcagcacctcctcctctgatccatcaaaaaagcaaaaaagaaaaaaaagaaaaagaaaaggagatttccagaagcgcgtcctggcaaccgtccctccccgcgaaagacgagcacctcccgcaccctgatctcaacccacacctcccctttcaaaaaaaaaaaacccacacctcacccatccagcgggccccgctccttccccgaccccaccgtcagggacacgcgtctgcgggccccacgctccccgtccccaccacccgcctccccccaaactctgaactctcaagccttctcctactccgcctgtgcgcttccacactggtgccccagtaagccgtaggcggggcggggcggcggcgcgcgggctccgcctctccccgtgtggccgacggcggcggcgatgagggcggcctccggcgggagggagccgtcgtcgtcgtccgcggcggtcgtcgcgctgcgggcgctgctgatcgcgaccgcctgcggcctcgtcttcgcgctgctcaacctccccgacggccgcgccggctccgcgccccccggtggggagcgcggcgcgggtgcgggaggcggggcccgcctgtcggtggagcaggggctgatccgggaggccaggaggctcaacactatcgccgaagagatagatgggcaaagcgatgaaagtgctgctgaagaagatgaaagaatttcaaaatctcccccggacactaaagagaagatatggatgatgcaagatcagctaattatggccaaggcgtacttgcatttcgcttctccccaaggcagtgcacatttagttcgagagctgaaatcgaggataaaagagatcgagagggcaataagccactcaagtggaggttcccatatacctgggagtgcattgcagaaaatgaaggccatggaacagaccctttccaaggctcagaggacctatccacgttgctctcagatgacatcaaagctacgtgcaatggcacacaacagtgaagaattagtaagagcacaccgaagtgaatcttcattccttgagcaggttgctgtgaggacattacccaaaggccatcactgcctagcaatgcgacttaccacagagtacttttcgttagatcctaaggaacgtcaattccctaaaagagacagcaggcagttagatggctattatcattatgcgatattctcagacaatgtacttgcaagcgctgtggttgtcaactctacaattgctcaatcaaaggatcctggaaggataatgttacatattgtaactgatgcattgaattgtcctgcaatgatgatgtggtttctgacaaacccaccaactccagcagcagtagaagttgaaagcctggatgatttcaaatggttgcctggtgatttcagttctagatttaagctgaagggtgttcgagatccaagatacacttctgcacttaaccacttgcgtttttatttgccggaagtgtttccctctttgagcaaggttctactcttggaccatgatgtggtaatccagacagatttgagtgaattatggggcatagatatgaagggtaaagtaattggtgctgttgaaacatgctcttcaggtgaaggttaccatcgattggataaccttgttgatttttctaatccaactatcgtcaacaaatttgatgccaaggcttgtatctttgcttttggaatgaacatatttgacctgaatgaatggcgcaagcagggtttaactgcaacttatcatacatggtttcaagtgggcaaaaggcagaggttatggaaggcaggaagcctgccactgggccaactcgtcttctacaaccaaacactgcctctcgaccgccgatggcatgttctcgggcttggccatgattttagcattggaagagacgagcttgagaatgcctatgtcatccactacagtgggaaattcaaaccctggctggaaatctccatcccaaagtacagagacaactggaatagacaccttaactacgataatgcatacttgcagcagtgtaacatccacggatagaggtgatgggggtagaggattcacggagtacaacatggatacacagttttgctctatagtgcttattagcaagctgatcttattctttttttcccttctgtttctagatgcgctgttctgtatttaggtgtattcttttaaaaaaaaatagtagccccaatctgtgcaaaagtgacagaatcacaaaatcgaataaaagggctacaatttcacaaatgattatgtaagttatggagaaagaacaattagtagctggcatttctgattattcccctgtttcccttgttaccccggttgagttgagataatggtgcccaagattgattttttttttactttcacggatattattgtatcccttgtttttaaaagaagatgttactactgttgt

SEQ ID NO: 1938 - DNA, 2409 bp, Panicum virgatum
gaaaaaagcaaagaaagggatttccagaagccgcgtactggcaaccgtcccgtcccgtcccgcccgcgggccccgccaccgccacgcttccctgccgcgcggcccccgctccttccgcgaccccactgtcagggacacgcgtctgcgggccccacgatccccgtcccaagctctgaacccaaccccctccctcctcctactccgcctgcgcttccacactggtgtgtgccagcagccgtaggcggggcggcggccgaactcgagctcggggcggcgatgagggcggccgtcgcgctgcgggcgctgctgatcgcgaccgcctgcggcctcgtcttcgcgctgctcaacctccccctccccgacggccgcgccggctccacgccccccggtggggagcgcggcgcgggtgggggaggcgggccccgcctgtcggtggtggagcaggggctgatccgggaggccaggaggctcaacactgtcgccgaagagagagatgggcaaagcgatgaaagtgctgctgaagaagatgaaagaatatcaaaatctcccccggacactaaagagaagatatggatgatgcaagatcagctaattatggccaaggcgtacttgcatttcgcttctccccaaggcagtgcacatttagttcgagagctgaagttgaggataaaagagatcgagagggcaataagccactcaagtggaggttcccatatacctgggagtgcattgcagaaaatgaaggccatggaacagaccctttccaaggctcagaggacctacccacgctgctctcagatgacatcaaagctacgtgcaatgacacacaacagtgaagaattagtaagagcacaccaaagtgaatcttcattccttgagcaggttgctgtgaggacattacccaaaggccatcactgcctagcaatgcgacttaccacagagtacttttcgttagatcctaaggaacgtgaattccctaaaagagacagcaggcagttagatggctattatcattatgcgatattctcagacaatgtacttgcaagcgctgtggttgtcaactctacaattactgcatcaaaggatcctggaaggataatgttacatattgtaactgatgcattgaattatcctgcaatgatgatgtggtttctgacaaacccaccaactccagcagcaatagaagttgaaagcctggatgatttcaaatggttgcctggtgatttcagttctagatttaagcttaagggtgttcgagatccaagatacacttctgcacttaaccacttgcgtttttatttgccggaagtgtttccctctttgagcaaggttctactcttggaccatgatgtggtagtccagaaagacttaagtgaattatggggcatagatatgaagggtaaagtaattggtgctgttgaaacatgcacttcaggtgaaggttaccatcgattggatagccttgttgatttttctaatccaactattgtcaacaaatttgatgccaaggcttgtatctttgcttttgggatgaacatatttgacctgaatgaatggcgcaagcagggtttaactgcaacttatcataaatggtttcaagtgggcaaaaggctgaggttatggaaggcaggaagccagccactgggccaactcgtcttctacaaccaaacactgcctctcaaccgccgatggcatgttctcgggcttggccatgattttagcattggaagagacgaacttgagagcgcctatgtcatccactacagcgggaaattcaaaccctggctggaaatctccatcccaaagtacagagacaactggaatagacaccttaactacgataatgcatacttgcagcagtgtaacatccacggatagaggtgattgaggtgagaggattcacggagtacaacatggatacacagttttcctctaatagtgcttattaacaagctgatcttattctttttcccttctgtttctagatgtactgttctgtatttaggtatattcttttttttaaaaaaaaactagtagccccaatgtgtgcaaaagtgacagaataacaaaatcgaataaaagggctacaatttcacaaatgattatgtaagttttggagaaagaacaatttgtagctggcatttctgattattcccctgtttcccttgttacctcgattgagttgagacattggtccccaagaatgattttttttttgactttcacggatattattgtatcccttgttttttacgaagatgttactactgtcgtttaggaaatcatggcatggtgctgtcattgtcactgaattagagtcatttatgcagtactgggaggaatgattttatgattgtttaaaatgtaccctgactttggtatttttaacatgcgttggggcctgttttt

SEQ ID NO: 1939 - DNA, 1707 bp, Sorghum bicolor
gattaataaacggaagggaaaagtgaaagtcagatggctggatgatttgccgacttgccacacaagagctcctcctccattacctccgtgactccgtgtcttcgtctcgctgtctctctgtgtgtgtgtggccgtgtctccccagcatcaccaactctccaggcctccgcagtcctcacccgcgagggaacgcgccgcgccgtgacgccgcggattcttgggcgccggcattgaggcgggaagcgcggcaggctgcatcaggagctcagaggtgattcatttctgggggcatcaactatattcaattttcaaaagatggtttgctgttttatgtgtgggacaggcatgaaacaaaatactgaaaatgaaggaggaagcaaggtgaagattttttcctatcatgagatgaggaaagctacacatgattttagtagggcaaataagatcggtgagggtggttttggctccgttttcaggggaaagcttaaagatggaacaattgttgcagtgaaggtcctttctgctagttcaaggcagggtatccgagagtttgtaactgaacttacagcaatttcagatatcgtacatgaaaacctaattaccttggttggttgctgtgccgaagggtctcataggattcttgtgtacaactatattgagaacaatagtctttcatatacacttctaggttcaggccggagcaacatccggttcaattggagagctcgtgtcaaaattgctgtaggtgttgctcgtgggcttgcttatcttcatgaagaaattcgcccccctataattcatcgagatataaaggcaagcaatattcttcttgacaaggatcttaccccaaagatttctgattttgggttggcaaggctcctcccaccaaatgcaactcatgtgagcactagggttgcaggaacaataggatacctggctcctgaatatgctgtcaggggacaagttacaaagaaatcagatatctatagtttcggtgttgtgctactggaaattgttactggtagatgtaaccataatagtagattgcctcagggagaccaatttctgcttgagaggatatggacatactatgagcaaagaaaactagaggagatcatagatgctgaagtaggggaggacctgaatgttgaagaggcatgtcgtttcttgaaggttggtctactatgcacccaagacgcgatgaaactgcgtccaaatatggccaacattgtcctaatgctgataggagagaaggaagtctccatggacagggtcaccaaaccagctgtgatcggtgacccatacctcaatggaaacaacgatcagagaactgcagactctaccacattgagatcctttgccacaactgaacctttaacatcatcagaagcaaacacagagtggtcactgtgataaaaaaaaactggtatacaaaaaatgtcatagattaaagggggagagatagatggagaattatttttgtggatgctgcgatgctaaaaaatactgcatcgcttctgttgattatgttcgattgttatttcatctgtctttgtatatactcgaaatgaaaccattggagtgaaatgagggttgaatatacttctctcatctgtgttagaagtacatatattgaatcattagggtttctaccatattcagttttaacagaatctgtctgttatcttttcagaaggatcacctcga

SEQ ID NO: 1940 - DNA, 1352 bp, Setaria italica
aggtgattcatttttgggagcctccattatattcgattttcaaaaatgtcttgctgttttatgtgtgggacagacatgaaacaaaaggttgatggtgaaggaggaaacaaggttaaggttttttcctacagtgagatgaggaaagctacacacagttttagtggtgctaataaaataggtgaaggtggtttcggttccgtgttcaggggaaggcttaaagatggaacaatagttgcagtaaaagtgctgtctgctgattcaaggcagggtatcaaagaatttgtaactgaactcacagcaatttccgatatcgtgcatgaaaacctaattaccctggttggttgttgtgctgaagggtctcataggatccttgtatacaattatcttgagaacaacagccttgcatatacattactaggatcaggccgtagcaacatccgattcaattggagagctcgtgtaaaaatagcggtaggtgttgctcgtgggcttgcttatcttcatgaagaaatccgcccccctataattcaccgagatataaaggcaagcaatattcttcttgaaaaggatctcaccccaagaatctctgatttcggattggcaaggctcctgcctcccaatgcaactcatgtgagcactggagtagcaggaacaataggatacttggctcctgaatatgcggtcaggggacaagtgacaaagaagtcagatatttatagtttcggtgttttgctattggaaattgttaccggcagatgtaaccacaatgctaggttgcctaagggagaccaatttctgcttgagaggacatggacatactatgagcaaggaaaactagaggagatcatagatatagatataggggatgatcttgatgttgaggaggcatgccggttcttgaaagttggtctactctgcactcaagacgcgatgaaactgcgtcccaacatgaccaacatcgtccatatgctgactggagagaagggtgtctccatggacagggtcaaaaaaccagctgtgattggtgacttagacctcaatggcaacaatgagcagagaccaactgatgcagactcaaccacaatgagatcctttgccacgaccgaaccattaacatcgtcagaagcgaacacagagacatctctgtgaatactgttattattgttttttcttgtaaattatagggggagaaagaggtggagaattattctagtggtgccgtgatgctaaaatgatgcatcgattttgttagttgtgttcatttgttgtttcagtttttttttttgtatatacattgaaacaaggtcattggatggataaaaaaaggaataaataaacttagttcctttttg

SEQ ID NO: 1941 - DNA, 1466 bp, Panicum virgatum
tatattcaattttgaaaaatggcttgctgttttatgtgtgggactgacatgaaacaaaaggttgaaggtgaaggaggaaacaaggtgaaggtattttcctacagtgagatgaggaaagctacacatggtttcagtggtgctaataaaatcggtgaaggtggttttggttccgtattcaggggaaggcttaaagatggaacaatagttgcaataaaagttctgtctgctgattcaaggcagggtttccgagagttcataaatgaactcgcagcaatttccgatatcgtgcatgaaaacctaattaccctggtcggttgctgtgctgaagggtctcatagaatccttgtatacaattatcttgagaacaacagccttgcatgtacattgctaggatcaggccgtagtaacatccgattcaattggaaagctcgtgtcaaaattgcggtaggtgttgcctgtgggcttgcttatcttcatgaagaaatccgcccccctataattcaccgagatataaaggcaagcaatattcttcttgataaggatctcaccccaaaaatctctgatttcgggttggcaaggctcctgcctccaaatgcaactcatgtgagcactagagttgcaggaacaataggatacttggctcctgaatatgcggtcaggggacaagtgacaaagaagtcggatatttatagtttcggtgttttgctgttggaaattgtcagtggcagatgtaaccacaatgctagattgcctcagggagaccaatttctgctcgagaggacatggacacactatgagcaaggaaaactagaggagatcatagatatagatgtaggggatgaccttgatgtggaggaagcatgccggttcttgaaaatcggtctactgtgcactcaagatgcaatgaaagtgcgtcccaacatgaccagcatcatccatatgctgactggagaaaagagtgtcaacatggatagggtcacaaaaccagctgtgattggtgactcagacctcaacggcaacaatgagctgagaccaactgatccagactctaccacaatgagatccttcgccacgaccgaaccattaacatcatcagaagtgaacacggagacatctctgtgaaatactggtattaaaaaaagttcttgtaaattatgggcggaaagagagatggagaattattttagtagatgccgtgatgctaaaaatgatgcatcagttttgttagtcgtgttcattttttgtttcagtctttttgtatatacattaaaaggtcattggacgggtaaagggagtaaacaaactttttttggtcatctgtttgttgtcttgttgatcagtttgatcaccttgaatccttgcaaaatgttagtcccaattcatcgaagtgatctggaccaagtttaaccctctgtatcatacttcatctcatcattaatacagcgagcaaccattcaattaggaac

SEQ ID NO: 1942 - DNA, 1716 bp, Sorghum bicolor
tttaatgtgtctgaatccttaacttgcattcagaatggccgcacaaccgtgtctctctcggctagtagcgttgagtgtccacactcattcacaccgcgcataaaatcctccgactccggggcggtcagggccagccggccagccacaccaaccacacgcacgccggcccgctccagcccattcttcggcccggcctgcagccaccgagcagagcaaagagagcggctccgccttcggcgtccgccgccgccgtcgctccgtcgggcttgatgagcctgtgctccaagctcctcgcgttgctccggaagtcccgcgccctcaccaccaccagcaccgccgccgcagccgctgcgacggcctccgcgacggcgtcggccaacgggatggaggaggctgtcgccgcggcgggcccgctgcgcacgcgcgtctgcatcatcggcagcggcccggccgcgcacacggcggccgtctacgccgcgcgcgccgagctcaagcccgtcctcttcgagggctggctcgccaacgacatcgccgcggggggacagctcaccaccaccaccgacgtcgagaacttcccgggcttccccgacggcgtcctcggcgccgaactcatggaccgctgccgcgctcagtcgctcaggttcgggaccaagatcctcaccgagaccgtcacctccgtcgacttctccgcccgcccgttccgggtcgcatccgacgacaccgtcgtgcacgccgactccgtcgtcgtcgccacgggcgccgtcgcgcgcaggctgcacttcgccggctccgacgccttctggaacaggggcatctccgcctgcgccgtctgcgacggggctgcgcctatcttccggaacaagcccatcgccgtcatcggaggcggggactcggccatggaggaggccaacttcctcaccaagtacggctcgcaagtgtacatcatccaccgccgcaacgccttccgggcgtccaagatcatgcaggcgcgcgcgctctccaaccccaagatcaaggtcgtttgggactccgaagtcgtcgaggcctacggtggtggggaaggtggcccgctggccggcgtcaaggtcaagaatgtcgtcactggcgaggtctccgacctccaggtggccggtctcttcttcgccatcggtcacgagccagcgacaaaatttcttggagggcagctcgagctcgactctgatgggtatgtggtgaccaagcccggctccacgcacaccagtgtgaagggggtcttcgcagctggggatgtccaggacaagaagtaccgccaggccattactgccgctggatcaggttgcatggctgctttggatgcagagcactacctgcaggaggttggagcacaggaagggaagaccgattgactatgtctgggacaagcggctcttgggctaaggaaaacttctccaaaagctgctctctagtggtataaacagcacattgttatttggttttaggcctcaaattacattacattggaaactgatttataatatgagcgtgcgcaagcttgtataaatgattctcgttgtttgctgctcctagtcattaatcgcactttacaaagttatatatgcttcctgtatgatattttccgtcgcggttatgtttgttaagttttgtgtaaatcttgcaattaaatcctccaatttctcttttctataataatcctacagaaaatgtaatcatcaaaac

SEQ ID NO: 1943 - DNA, 1710 bp, Panicum virgatum
ctcgaccccattccccggcccagaccggcccaccgagccgaactgccccaaccccgccgccggctccgcccttaggttcggcgtcctccgccgccgccgcgccgccgggcttgatgaccctctgctccaagctcctcgcgctgctccgcaagtcccgcgcgctcaccaccacggccgccgccgccgccgccgcgacggcctccgcgacggccaacgggatggaggaggcggcggcgggcccgctgcgcacgcgcgtctgcatcatcggcagcggccccgccgcgcacacggcggccgtctacgccgcgcgcgccgagctgaagcccgtgctcttcgagggctggctcgccaacgacatcgccgcggggggccagctcaccaccaccaccgacgtcgagaacttcccggggttccccgagggcatcctcggcgccgagctcatggaccgctgccgcgcgcagtcggccaggttcgggaccaagatcctcaccgagaccgtcacctccgtcgacttctccgcccgccccttccgcgtcgcctccgacgacaccgtcgtgcacgccgacgccgtcgtcgtcgccaccggcgccgtcgcgcgcaggctgcacttcgccggctccgacgccttctggaacaggggcatctccgcctgcgccgtctgcgacggggccgcgcccatcttccggaacaagcccatcgccgtcgtcggaggcggggactccgccatggaggaggccaacttcctcaccaagtacggctcgagggtctacatcatccaccgccgcaacgccttccgcgcgtccaagatcatgcaggcccgcgcgctctccaaccccaagatccaggtcgtctgggactccgaggtcgtcgaggcctacagcggcgcagaaggcgggccgttggcaggcgtcaaggtcaagaacgtcgtcagcggccaggtctccgacctacaggttgccgggctcttcttcgccatcgggcacgagccggcgaccaaatttcttggagggcagctcgagctggattccgatgggtatgtggtgacaaagcccggctccacgcacaccagcgtcaaaggggtcttcgccgccggggacgtccaggacaagaagtaccgccaggccattactgccgctggatcaggttgcatggctgctttggatgcagagcactacctgcaggaggttggagcacaggaagggaagaccgattgactatatctgggccaagcagcttgcagccctacgaaaactccaccgttgatgcaaaaagctgctctctaatgtattatggtataagcagtagatatttttggtcttaggcctcaaattacgatacattggaaattgattcatttgagcgtgcacaagctttgcatcgattatttcgaatcagttactagttaattacactatacaagtttgtgcttccgggtgtggaagaaggcaccggtggtgctgatgctatcagtattacgcttatgattggcaaatgagcttcgaaggcagattcttctagccatggccaaggacaaccgccattgggtgctttggtagggttttctgcattggcgattgatgtattgcaaccaattgtattgcttgggaatgtttgacggtgtgtatccgttaaaagcattattagaaaaaaagtattagaaatgttttcatactttgaggtttaatttaaaagtattagaaagatgtgtgg

SEQ ID NO: 1944 - DNA, 1780 bp, Oryza sativa
cagcagcaagtagcactagcaaccaacgcagccgtgcccaacatttgctcttcgcagacagagagatagctgacggccacacaacacacacctcgcataaaatcccataaaatctctccctctcacgacgcgatccacccgcgcgtcggcccgctcgagcccaattacggcccgagacgcgagcccgtagccgccaagaagaagaaaaacttcacctcgggcggccgccgccgccgccgccgccgcccttgatgcgcctctgctccaagctcgcggcgctgctccggaggtcccgccagttcgcgcccgcagccgccgccgcgtccgggtcagcgacggccgcggccgcgtcggcgaacgggatggaggaggcggccgcgggcccgctgcgggcgcgcgtgtgcatcatcgggagcgggccggcggcgcacacggcggcggtctacgcggcgcgcgccgagctcaagcccgtgctcttcgagggcttcctcgccaacgacatcgccgcgggggggcagctcaccaccaccaccgacgtcgagaacttcccgggcttccccgacggcatcctcggcgccgacctcatggaccgctgccgcgcccagtccgtgcgcttcgggaccaggatcctcaccgagaccgtcaccgccgtcgacctctcgtcccgccccttccgcgtcgcctccggcgacaccgtcgtgcacgccgacgcggtcgtcgtggccacgggcgccgtcgcgcgccgcctccatttcgccggctccgacgcattctggaaccgcggcatctccgcctgcgccgtctgcgacggcgccgcgcccatcttccggaacaagcccattgccgtcgtcggcggcggggactccgccatggaggaggccaacttcctcaccaagtacggctcccgcgtctacatcatccaccgccgcaacgccttccgcgcgtccaagatcatgcaggcccgggccctctccaaccccaagatccaggtcgtctgggactccgaggtcgtcgaggcgtacggcggcgccgacggcggtccgttggccggcgtcaaggtcaagaacgtggtgagcggcgaggtctccgacctccaggtcgccgggctcttcttcgccattggacacgagccggcgacaaagtttctcggcgggcagctcgagctggactccgatggctatgtcgtgaccaagcccggctccactcacaccagcgtcaagggagtcttcgccgccggtgatgttcaggacaagaagtatcgccaggccattactgccgcgggatcaggttgcatggcggcgttggatgcggagcactacctacaggagattggagcacaggaagacaagactgattgactatatctgggacaagcaggtcgcagttcttcagctacttcatcgtcggtagcaagagctgcactctaaggcacaaagttgttaattgtggttgctcaaccaaagaaaaacagattggtatttgtctgtaggcctcagattcatgatacgttgttagaaaaatgattcatgtgagcactcagaaacttgtgttacaatttcatcaaattatgcacacttcatggaaatctacaaaatcgtgaatccagaaaggaagcattcatgttacacctggtttcaaatgaaacttattagagcacccgcaatggtaaagtaaggtgctatctataaaacatgtacatctcagcaatagactagattaatagtaaaccatctcaatagtatgtctacatgggtatctatagctctctaatatattgcct

SEQ ID NO: 1945 - DNA, 1506 bp, Triticum aestivum
cttccgatctcgccgcccgcccgcaccccccgccggccttgatgcgcctctgctccaagctcgccgcgctgctccggaggtcccgcccgttcgccgccgccaccgccgccgcgtccgtctccgcgaccgccaccgccgccgcggccgccaacgggatggaggaggcggccgcgggcccgctgcgcacgcgcgtgtgcatcatcgggagcggccccgccgcgcacacggcggccgtctacgcggcgcgcgccgagctcaagcccgtgctcttcgagggctggctcgccaacgacatcgcggcgggcgggcagctcaccaccaccaccgacgtcgagaacttccccggcttccccgacggcatcctcggcatcgacctcatggaccgctgccgtgcgcagtccgtgcgcttcgggaccaagatcttctccgagaccgtcacctccgtcgacttctcctcccgccccttccgcgtctcctccgacgacaccgtcgtccacgccgactccgtcgtcgtcgccacgggcgccgtcgcccgccgcctccatttcgccggctccgacgcgttctggaaccgcgggatctccgcctgcgccgtctgcgacggtgccgcgcccatcttccggaacaagcccatcgccgtcgtcggtggcggggactctgccatggaggaggccaacttcctcaccaagtacggctcgcgcgtctacatcatccaccgccgcgacgccttccgcgcctccaagatcatgcaggcacgggctctctccaaccccaaaatccaggtcgtgtgggactccgaggtcgttgaggcctacggcggctcggacggcggccccttgggcggtgtcaaggtcaaaaacctggtgaccggcgaggtatccgacttccaggtggccgggctcttctttgccattgggcacgagccagcgaccaagtttctcgccggacagctcgagctcgactccgaggggtacgtggccaccaagccgggctccacgcacaccagtgtgaagggggtcttcgctgccggggacgttcaggacaagaagtaccgccaggccattactgccgcaggatcaggttgtatggctgctttggacgcggagcactacctgcaggaggttggcgcacaggaagggaagactgattgactatatgtggggaaagcagctggtagttctacaaaaatttcattggtgccaaaatctgcactctgaggcgcaattgtgatgaatcgtgtcagctcctcaaaatcagcagattgttattgtttttaggccgcaagtatatgatacgctgttggaaatttattcctgtggatggtcaagttgtgctggtgttttcacattcaaaatatctgaatgacaaaacgaatttgtgaatcctgattactgtctccttcctgtggatggaaggaacatttaaactctattaggccaatttcgttctttgagatcatactcctttggattggaatataagtcgggcatcggatttttggttctt

SEQ ID NO: 1946 - DNA, 1623 bp, Brachypodium distachyon
aaagccaccagcgcgtcggcccgttgcagccaccacttgacggcccggcccattctccgccaaaacgcacccaaaatcgtcggcagacgactccgccgccgcccgccggccttgatgcgcttctgctcgaagctcgccgcgctgctccggaggtcccgccccttggctgccacagcagccgccgctaccgccaccggcaccgctaccgctgctaccgcggccgccggcgggatggaggaagcggctgcgggcccgctgcgcacgcacgtgtgcatcatcgggagcgggccggccgcgcacacggcggccgtctacgccgcgcgcgctgagctgaagcccatgctcttcgagggctggctcgccaacgacatcgccgcgggcgggcagctcaccaccaccaccgacgtcgagaacttcccggggttccccgatggcatcctcggcatcgatctcatggaccgctgccgcgctcagtccgtgcggttcggaaccaagatcttcaccgagacggtcacctccgtggacttgtcgtcgcgccccttccgcgtcgcctccgacgacaccgtcgtccacgcggacacagtcgtcgtggccaccggtgccgtcgcccgccggctccatttcaccggctccgatgcgttctggaaccgcggcatctcggcgtgcgccgtctgcgacggtgccgcgcccatcttccgtaacaagcccatcgccgtcgtcggtggcggggactctgccatggaggaggccaacttcctcaccaagtacggctcgcgtgtgtacatcatccaccgccgtgacaccttccgcgcgtccaagatcatgcaggcccgggctctttccaaccccaaaatccaggtcgtgtgggactccgaggtcgtggaggcctacggcggcgcggacaacagtccgttaaccggtgtcaaggtcaagaaccttgtgactggcgaggtatctgaattgcaggtggccgggctcttctttgcaattgggcacgagccagcaaccaagtttctgggcggacagctcgagcttgacgccgagggttatgtggtaacgaagcccggctccacacacaccagtgtgaacggagtcttcgcagctggggatgttcaggacaagaagtaccgccaggccattactgccgcaggatcaggttgcatggctgctttggatgcggagcactacctgcaggaggttggagcacaggaagggaagactgattgactaaagcagctgccagttctgtcagatcttcattggtgccaaaatctgaactttaaggcacaatattatgaattgtggttgctacacaaaaagtgtttctaggtcacaaatatatgaatatgttgttggatatgggttccgacgcacaagaaatggtgcggacgatttcgattaccaattcatgaaggacaacgaatcaattgaattgtgattactgtaagcaggcggcttcatctcaaagagagtcagaagctttgatgcatttctcctctgattcattatcagcaatactaattagtattgttgtgttgctcatttctatttttctggtagggaattgtaaaaagaaggaattattcagtggaatggaaatggatacactatgtgtgcaaacta

SEQ ID NO: 1947 - DNA, 1393 bp, Secale cereale
ttgatgcgcctctgctccaagctcgccgcgctgctccggaggtcccgcccgttcgccgccgccaccgccgccgcgtccgtctccgcgaccgccaccgccgccgcggccgccaacgggatggaggaggcggccgcgggcccgctgcgcacgcgcgtgtgcatcatcgggagcggcccgccgcgcacacggcgccgtctacgcggcgcgcgccgagctcaagcccgtgctcttcgagggctggctcgccaacgacatcgcggcggcggccagcttcaccaccaccaccgacgtcgagaacttccccggcttccccgacggcatcctcggcatcgacctcatggaccgctgccgcgcgcagtccgtgcgcttcgggaccaagatcttctccgagaccgtcacctccgtcgacttctcctcccgccccttccgcgtcgcttccgacgacaccgtcgtccacgccgactccgtcgtcgtcgccaccggcgccgtcgcccgccgcctccatttcgccggctccgacaccttctggaaccgcgggatctccgcctgcgccgtctgcgacggtgccgcgcccatcttccggaacaagcccattgccgtcgtcggtggcggggactctgccatggaggaggccaacttcctcaccaagtacggctcgcgcgtctacatcatccaccgccgcgacgccttccgtgcctccaagatcatgcaggcccgggctctctccaatcccaaaatccaggtcgtgtgggactccgaggtcgttgaggcctacggcggctcggatggcggtcccttggccggcgtcaaggtcaaaaacctggtgagcggcgaggtatccgacgtccaggtggccgggctcttctttgccattgggcacgagccagcgaccaagtttctcgccggacagctcgagctcgactccgaggggtacgtggccaccaagccgggctccacgcacaccagtgtgaagggggtcttcgctgccggagacgttcaggacaagaagtaccgccaggccattactgccgcaggatcaggttgtatggctgctttggacgcggaacactacctacaggaggttggcgcacaggaagggaagactgattgactatatctggggaaagcagctggtagttctacgagaatttcattgctgccaaaatctgcactcagaggagcaattgtgatgaatcctgccagctcctcaaaatcagcagattgttattgtttctaggccacaagtatatgatacgctgttcaaaatttattcctattgacggtcaagttgtgccggtgatttcgcattcaaaatttctgaaagacaaaacgaatttgtgaatcctgattactgtctgctgttccgacgaaatagatggaaggaacatttaaa

SEQ ID NO: 1948 - DNA, 1167 bp, Saccharum officinarum
cacgcacgccggcccgctccagcccattcttcggcccggcctgcagccaccaagcaaacagagctgctccgccttcggcgtcccccgccgccgccgctccgtcgggcttgatgagcatctgctccaagctcttggcgttgctccgcaagtcccgcgccctcaccaccaccagcaccgccgccgcagccgccgcgacggcctcggcgacggcgtcggccaacgggatggaggaggctgtcgccgcggcgggcccgctgcgcacgcgcgtctgcatcattggcagcggcccagccgcgcacacggcggccgtctacgccgcgcgcgccgagctcaagcccgtcctcttcgagggctggctcgccaacgacatcgccgcggggggacagctcaccaccaccaccgacgtcgagaacttcccgggcttccccgacggcatcctcggggccgaactcatggaccgctgccgcgcgcagtcgctcaggttcgggaccaagatcctcaccgagaccgtcacctcggtcgacttctccgcccgccccttccgcgtcgcctccgacgacaccgtcgtgcacgccgactccgtcgtcgtcgccacgggcgccgtcgcgcgcaggctgcacttcgccggctccgacgccttctggaacaggggcatctccgcctgcgccgtctgcgacggggctgcgcctatcttccggaacaagcccatcgccgtcgtcgggggcggggactccgccatggaggaggccaacttcctcaccaagtacggctcgcaagtgtacatcatccaccgccgcaacgccttccgggcgtccaagatcatgcaggcgcgcgcgctctccaaccctaagatcaaggtcgtctgggactccgaggtcgtcgaggcctacggtggtgcggaaggaggcccgctggccggcgtcaaggtcaagaacgtcgtcaccggcgaggtctccgacctccaggtggccggtctcttcttcgccatcggtcacgagccagcgacaaaatctcttggagggcagctcgagctcgacactgatgggtatgtggtgaccaagcccggcttcacgcacaccactgttgaaggggtcttcgcagctggggatgtccttgcccaagacgcgcttggtccaaacataggtttttgggtggccttattgtgtc

SEQ ID NO: 1949 - DNA, 1150 bp, Panicum virgatum
cggcgtcctccgccgccgccgcgccgccgggcttgatgaccctctgctccaagctcctcgcgctgctccgcaagtcccgcgcgctcaccaccacggccgccgccgccgccgccgcgacggcctccgcgacggccaacgggatggaggaggcggcggcgggcccgctgcgcacgcgcgtctgcatcatcggcagcggccccgccgcgcacacggcggccgtctacgcggcgcgcgccgagctcaggcccgtgctcttcgagggctggctcgccaacgacatagcggcggggggccagctcaccaccaccaccgacgtcgagaacttcccggggttccccgagggcatcctcggcgccgagctcatggaccgctgccgcgcgcagtcggccaggttcgggaccaagatcctcaccgagaccgtcacctccgtcgacttctccgcccgccccttccgcgtcgcctcccacgacaccgtcgtgcacgccgacgccgtcgtcgtcgccaccggcgccgtcgcgcgcaggctgcacttcgccggctccgacgcgttctggaacaagggcatctccgcctgcgccgtctgcgacggggccgcgcccatcttccggaacaagcccatcgccgtcgtcggaggcggggactccgccatggaggaggccaacttcctcaccaagtacggctcaagggtctacatcatccaccgccgcaacgccttccgcgcgtccaagatcatgcaggcccgcgcgctctccaaccccaagatccaggtcgtctgggactccgaggtcgtcgaggcctacggcggcgcagaaggcagcccgttggcaggcgtcaaggtcaagaacgtcgtcagcggcgaggtctccaacctccaggttgccgggctcttcttcgccatcgggcacgagccggcgaccaagtttcttggagggcagctcgatctcgattccgatgggtatgtggtgacaaagcccggctccacgcacaccagtgtcaaaggggtcttcgccgccggggacgtccaggacaagaagtaccgtcaggccattactgccgctggatcaggtatagtgtcttcaagcctcactgtggttttattgctgctgtttttcataatcgccagtgccaatagctgatttgcacaattccg

SEQ ID NO: 1950 - DNA, 1550 bp, Saccharum officinarum
cccacgcgtccggtaatttcagatttcagagcgcgcaggccaagccaaaccgccgccgccgccgccgccgtgaagccaagccaaaccgcgtaagcagccatggagggatccgccgccgcgccgctccgcacgcgcgtctgcatcatcgggagcggccccgcggcgcacacggcagccatctacgcggcccgcgcggagctcaagcccgtgctcttcgagggctggatggccaacgacatcgccgcgggcgggcagctcaccaccaccaccgacgtcgagaacttcccgggcttccccaacggcatcatgggcgccgacctcatggacaactgccgcgcgcagtccctgcgctttggcaccaacatcctctcagagaccgtcaccgccgtcgacttttcggcctcccctttccgcgtcactgccgactccacaaccgtcctcgccgatgcggtcatcgttgccacgggagccgtcgcgcggcgccttcacttccccggatccgatgcatactggaaccgcggcatctccgcgtgcgccgtctgcgacggtgccgcccccatcttccgtaacaagcccatcgctgtcataggcggcggcgactccgctatggaggaggccaacttcctcaccaagtatggctcccacgtctacatcatccaccgccggaataccttccgtgcttccaagatcatgcaggccagggctctggagaaccccaaaatcaaggtcgtctgggactcggaggttgtcgaggcctatggcggtgcagacggcggcccattggctggcgtcaaggtcaagaacctgctgaatggtgaggtctcggatcttcaggtggccggcctcttcttcgccatcggacacgagccggcgaccaaattcctgggcgggcagctcgaactcgattcagatggatatgttgcaaccaagccaggttccactcacaccagtgtcaagggggtctttgctgctggcgacgtgcaggacaagaagtatcgccaggccattactgccgctggatcagggtgcatggccgcattggatgctgagcactacctgcaggagattggtgcacaggaggaaaagtctgattgactatatttgggtgtagcaaccagcagtccatcgaatggtcagttgccggtgctgaaagccgctctctgatgtgcgtttatgccatgggttgtcatgaactcaggattgaagaacctgacgatttatgctgcttagtatcacactattcttatcattaggatcagaagtacgtttgaactctgtctgagcttctatttactggatactgattcgtggttactgttttgaagtttttggcctggatatctgtattgctcaagtctctcattattgtgttaatggtggtgttatgctgagctcatctccgtcaatgtcgagcctctcagcttcaggtcagtttctacctttcttttcagagtacattgatattttcatttttgaacgcaaacattgatgttgtctcgacggtctcatataatgctacgaaattgagtcaacttattagatttctgccc

SEQ ID NO: 1951 - DNA, 1348 bp, Hordeum vulgare
ggcccgctgcgcacccgcgtgtgcatcatcgggagcggccccgccgcgcacacggcggccgtctacgcggcgcgcgccgagctcaagcccgtgctcttcgagggctggctcgccaacgacatcgcggcgggcgggcagctcaccaccaccaccgacgtcgagaacttccccggcttccccgacggcatcctcggcatcgacctcatggaccgctgccgcgcgcagtccgtgcgcttcgggaccaagatcttctccgagaccgtcacctccgtcgacttctcctcccgccccttccgcgtcgcctccgacgacaccgtcgtccacgccgactctgtcgtcgtcgccacgggcgccgtcgcccgccgcctccatttcgccggctccgacgcgttctggaaccgcgggatctccgcctgcgccgtctgcgacggtgcagcgcccatcttccggaacaagcccatcgccgtcgtcggtggcggggactctgccatggaggaggccaacttcctcaccaagtacggctcgcgcgtctacatcatccaccgccgcgacgccttccgcgcctccaagatcatgcaggcccgggctctctccaaccccaaaatccaggtcgtgtgggactccgaggtcgttgaggcctacggcggctcggacggcggccccttggctggcgtcaaggtaaaaaacctggtgagcggcgaggtatccgacgtccaggtggccggcctcttctttgccattgggcacgagccagcgaccaagtttctcgccggacagctcgagctcgactcagaggggtacgtggccacgaagccgggctccacgcacaccagtgtgaagggggtcttcgctgccggggacgttcaagacaagaagtaccgccaggccattactgccgcaggatcaggttgtatggctgcattggacgcggagcactacctgcaggaggttggcgcacaggaagggaagactgattgactatatctggtgaaagcggctggtaattctacgagaatttcgttggtgccaaaatctgcactcggaggcccaattgtgaccaatcgtagcagttacccaaaatcagcagattcttattgtttttaggccacaagtatatgatacgctgttgaaaaatttattcctgttgacggtcaagttgtgttggcgatttcacattcaaaattcctgacaaaacgaatttgtgaatcctgattactgtctgccgttccgacgaaatagatggaaggaacattcaaactcaggccaattctgttatttcagatcatactcccctttggatgggaatataagttgggcactggtttttaggttcttgatttcactagca

SEQ ID NO: 1952 - DNA, 1213 bp, Leymus cinereus x Leymus triticoides
  misc_feature (728)..(728): n is a, c, g, or t
  misc_feature (730)..(730): n is a, c, g, or t
  misc_feature (733)..(733): n is a, c, g, or t
  misc_feature (790)..(790): n is a, c, g, or t
gggcccgctgcgcacgcgcgtgtgcatcatcgggagcggccccgccgcgcacacggcggccgtctacgcggcgcgcgccgagctcaagcccgtgctcttcgagggctggctcgccaacgacatcgcggccggcgggcagctcaccaccaccaccgacgtcgagaacttccccggttttcccgacggcatcctcggcatcgacctcatggaccgctgccgcgcgcagtcggtgcgcttcgggaccaagatcttctccgagaccgtcacctccgtcgacttctcctcccgccccttccgcgtcgcctccgacgacaccgtcgtccacgccgactccgtcgtcgtggccaccggcgccgtcgcccgccgcctccatttcgccggctccgacgcgttctggaaccgcgggatctccgcctgcgccgtctgcgacggtgccgcgcccatcttccggaacaagcccatcgccgtcgtcggtggcggggactctgccatggaggaggcaaacttcctcaccaagtacggctcgcgcgtctacatcatccaccgccgcgacgccttccgcgcctccaagatcatgcaggcccgggctctctccaaccccaaaatccaggtcgtgtgggactccgaggtcgttgaggcctacggcggctccgacggcgctcccttggccggcgtcaaggtcaaaaaccttgtgagcggcgaggtatccgacttccaggtggccgggntnttntttgccattgggcacgagccagcgaccaagtttctcgcggggcagctcgagctcgantccgatgggtacgtggccaccaagccgggctccacgcacaccagtgtgaagggggttttcgctgccggagacgttcaggacaagaagtaccgccaggccattactgccgcaggatcaggttgtatggctgctttggacgcggagcactacctgcaggaggttggcgcacaggaagggaagactgattgactatatttggggaaagcagctggtagttttacgggaatttcattggtgccaaaatttgcactttgatgcgcaattgtgatgaatcgtggcagctcctcaaaatcagcagattgttattgtttttgggccacaagtatatgatacgctgttggaaatttattcctgtggatggtcaagttgtgccggcgatttcacattcaaaatttctgaatgacagaaggaatttgtgaatca

SEQ ID NO: 1953 - DNA, 1428 bp, Secale cereale
gactttggctcacgcgcagtactactagtaagattgacctacgactcgagtagtcatttcaatccccccgaaaccctgaaccaccgccgccgccgcagccaagccaagcagccatggagggatccgccgcggcgccgctccgcacgcgcgtgtgcatcatcggcagcggcccggccgcgcacacggcggccatctacgcggcccgcgcggagctcaagcccgtgctcttcgagggctggatggccaacgacatcgccgcggggggccagctcaccaccaccaccgacgtcgagaacttcccgggcttccccaccggcatcatgggcatcgacctcatggacaactgccgcgcccagtccgtccgcttcgggaccaacatcctctccgagaccgtcaccgacgtcgacttctccgcccgccccttccgcgtcgtctccgacgccaccaccgtcctcgccgacaccgtcgtcgtcgccacgggcgccgtcgcgcgccgcctccacttcgccgggtccgacacctactggaaccgcggcatctctgcctgcgccgtctgtgacggcgccgcgcccatcttccggaacaagcccatcgccgtcatcggcggcggcgactccgccatggaggagggcaacttcctcaccaagtacgggtcccaggtgtacatcatccaccggcgcaacaccttccgcgcctccaagattatgcaggccagggcgctctccaatcctaagatccaggttgtctgggactccgaggtcgtcgaggcctacggcggcgcagggggtggcccattagctggggtcaaggtcaagaacttagtgactggtgaggtctctgaccttcaggtgtccgggctcttcttcgccatcgggcatgagccggccaccaagtttctcaatgggcagctcgagctccatgccgatgggtatgtggccaccaagccgggctctacacataccagtgtggagggggtctttgctgctggggatgtgcaggataagaagtatcgtcaggcgattactgccgctggatcagggtgcatggctgctttggacgctgagcactatctgcaggaggtgggtgcacaggagggcaagtctgattgactatctgttggtcaagcgacggtcattagctcgccgaaagccgcactctgagcttgatgaggttggttgtccagttcttcaacggtttcattatgctgcttagcagcaccgcattattctcctgtcattaggcctagatgaacttccattggtgctggaaatgattcttatttatcattggtggaaaactgattcctatgtatcattggggaaatcacattattattctgagatatctgtattgctccaccagatgtgtatggagtatgttattgtatttttttacatgtttcgagcaccatgtattctgagaacatgt

SEQ ID NO: 1954 - DNA, 1598 bp, Zea mays
gtaactttttggtgttccaagtgaccaagtcagtaaccagacaaccatagaccgacgaggtgtgaactgtaatttcagatttcagagcgcgcaagaaccctcttgaccaccgccgccgccgccgcgaagccaagccaaactgagtaagcagctatggagggatccgccgccgctccgctccgcacgcgcatctgcatcatcgggagcggtcccgctgcgcacacggcagccatctacgcggcccgcgcggagctcaagcctgtgctcttcgagggctggatggccaacgacatcgccgcgggcgggcagctcaccaccaccaccgacgtcgagaacttcccgggcttccccaacggcatcatgggcgccgacctcatggacaactgccgcgcgcagtccctgcgctttggcaccaacatcctctccgagaccgtcaccgccgtcgacttttcggcctgcccattccgagttagtgcagactccacaaccgtcctcgccgatgcggttatcgttgccacgggagccgtcgcgcggcgcctccacttccccgggtccgatgcatactggaaccgcggcatctccgcctgtgccgtctgtgacggtgccgcccccatcttccgtaacaagcccatcgccgtcataggcggcggcgactccgctatggaggagtccaatttcctcaccaagtacggctcccacgtctacatcatccaccgccgcaataccttccgtgcttccaagatcatgcaggccagggcgcttgagaaccccaaaattaaggtcctctgggactcggaagttgtcgaggcctatggcggcgcaaacggcggcccattggctggcgtaaaggttaagaacctactgaatggtgaggtctcggatcttcaggtgtctggcctcttcttcgccatcgggcatgagccggcgaccaaattcctgggcggacagcttgaactcgattcagatggttatgtggaaaccaagccaggttccactcacaccagtgtaaagggtgtatttgctgctggcgacgtgcaggacaagaagtaccgtcaggccattactgccgctggatcagggtgcatggctgcattggacgctgagcactacctgcaggagatcggtgcacaggagggaaagtctgattgactatatttaggtgtagcaaccagcaatccatcgaatagtcagttgtcggtgctgaaagccgctctctgatgcgcgtttatgccatgggttgtcatgagctcacgattgagatacctgatgatttatgctgcttagtagcatgctattcttatcgttaggatccagaagtatgtctgaactctgaactatttactggatacctattcgtgattactgccttgaagtttttccttagatatctctattgctcaagtctcacattattgtgttaattgtggtgttatgctgaactcatttgcatcgatgtctagcctcccagctgcaggtcagtttctttctttctttcttttcagagtaaattgatgtctttttaatgcgatcattgatgttgtttctagatggtcacatataatgctacctaattttagaacttgtttggtttgagggac

SEQ ID NO: 1955 - DNA, 1412 bp, Brachypodium distachyon
ccaaccgggtgccaagagtaatttctgtcccgactccaccaagaaaccccttccggcgccgccgccaaagaaaggagagtagccatggacggatccgccgccgcgccgctccgcacgcgcgtctgcatcatcggcagcggcccggccgcgcacacggcagccatctacgcggcccgcgcggagctcaagcccgtgctcttcgagggctggatggccaacgacatcgccgcggggggccagctcaccaccaccaccgacgtcgagaacttcccgggctttccccaaggcatcatgggcgccgacctcatggaaagctgccgcgcccagtccctgcgcttcggcaccaacatcctaaccgagaccgtcaccgccgtcgacttctccgcccgccccttccgcgttgtctctgactccaccaccgtcctcgctgacgctgtcgtcgttgccacgggcgccgtcgcgcgccgcctccatttccccgggtccgacacctactggaaccgcggcatctctgcctgcgccgtctgtgacggcgccgcccccatcttccggaacaagcccatcgccgttataggcggcggcgactccgccatggaggaggggaatttccttaccaagtacggttccaaagtgcacatcatccaccgtcgcaacaccttccgtgcttccaagattatgcaggcccgggcgctctccaatcccaagatccaagtcgtctgggattctgaggtcgtcgaggcctatggcggcgcaggcggcggccccttggctggggttaaggtcaagaacttggtgactggtgaaatctccgatcttccggtgtctgggctcttctttgccatcggacacgagccggcgaccaagtttctcaatgggcagcttgggctccatgctgatgggtatgtggccaccaagcctggctctacacacaccagtgtggagggggtcttcgctgctggggatgtgcaggataagaagtatcgtcaggcgattacagctgctggatcagggtgcatggctgctttggacgcggagcactatctgcaggaggtaggtgcacaggaaggcaagtccgattgactccttggtgaagcaaacagcccttcagaaagtcggatgctggcgctgaaagccgcactctgaacttttgatgccgtgggtttatctcgagactcctgattgcttctgtggatttcttatgctgctcatcagcaccatgttattctttgcaactaggtcccagatcaactaacattcctgtgttgcgatttgtatttttcattgatgaattcatattattatgagatatgactgcgttattgtatttctactgtttggagcactgattaaacatactctgaaaaaatctcctgtgatgtctggactctcttggttcacggcgctattgttca

SEQ ID NO: 1956 - DNA, 1449 bp, Triticum aestivum
atccccccgaaaccctgaatcgccgccgccgccgccgcagccaagccgagcagccatggagggatccgccgtcccggcgccgctccgcacgcgcgtgtgcatcatcggcagcggcccggccgcgcacacggcggccatctacgcggcccgcgcggagctcaagcccgtgctcttcgagggctggatggccaacgacatcgccgcggggggccagctcaccaccaccaccgacgtcgagaacttcccgggcttccccaccggcatcatgggcatcgacctcatggacaactgccgcgcccagtccgcccgcttcggcaccaacatcctctccgagaccgtcaccgaggtcgacttctccgcccgccccttccgcgtcacctccgactccaccaccgtcctcgccgacaccgtcgtcgtcgccacgggcgccgtcgcgcgccgcctccacttccccgggtccgacacctactggaaccgcggcatctctgcctgcgccgtctgcgacggtgccgcgcccatcttccggaacaagcccatcgccgtcatcggcggcggcgactccgccatggaggagggcaacttcctcaccaagtacggatcccaagtgtacatcatccaccggcgcaacaccttccgcgcctccaagattatgcaggccagggcgctctccaatcctaagatccaggttgtctgggactccgaggtcgtcgaggcctacggcggcgcaggcggtggcccattagctggggtcaaggtcaagaacttggtgactggtgaggtctctgaccttaaggtgtccgggctcttcttcgccatcgggcatgagccggccaccaagtttctcaatgggcagcttgagctccatgccgatgggtatgtggccaccaagccgggctctacacataccagtgtggagggggtctttgctgctggggatgtgcaggataagaagtatcgtcaggcaattactgccgctggttcagggtgcatggctgctttggacgcggagcactatctgcaggaggtgggtgcacaggagggcaagtctgattgactatctcttggtgaagcgacgaccatcagctcaccgaaagccgcactctgagcttgatgaagttggttgtccagtttcattatgctgcttagcagcaccgtattattattctccgtcattaggaggccctagatcaactttcattagtgtgctggaaatgattcgtatttaccactggtggaactcaaactgattcctatgtatcattggcgaaatcacattattattctgagatatctatctgtattactccaccaggtatgtatgctgttgtatttttctacatgtttggagcaccgcgtattctgaaaacatgtttctttttacatttcaaaaacacgtctggtatttttttaaagggaaatatctggtctttgttggctcacggtgctata

SEQ ID NO: 1957 - DNA, 1592 bp, Sorghum bicolor
gaacactttttgttccagacttccagtggccacactaccagaggccgacgaggtgtgaactgtaatttcagatttcagagggcgtaggcgcccctttgagtcttgacaccgccgccgccgccgccgccgccgtgaagccaagcaaaacctcgtaagcagagccatggagggatccgccgccgcgccgctccgcacgcgcgtctgcatcatcgggagcggtcccgcggcgcacaccgcagccatctacgcggcccgcgcggagctcaagcccgtgctcttcgagggctggatggccaacgacatcgccgccggcgggcagctcaccaccaccaccgacgtcgagaacttcccgggcttccccaacggcatcatgggcgccgacctcatggacaactgccgcgcgcagtccctgcggttcggcaccaacatcctctccgagaccgtcaccgccgtcgacttttcggctcgccccttccgcgtcactgccgactccacaaccgtcctcgccgatgcggtcatcgttgccacgggagccgtcgcgcggcgcctccacttccccgggtccgatgcgtactggaaccgcggtatctccgcctgcgccgtctgcgacggtgccgcccccatcttccgtaacaagcccatcgctgtcgtaggcggcggcgactccgctatggaggaggccaacttcctcaccaagtacggctcccacgtctacatcatccaccgccggaataccttccgtgcttccaagatcatgcaggccagggctctcgagaaccccaaaatcaaggtcgtctgggactcggaggttgtcgaggcctatggcggtgcagacggcggcccactggctggcgtcaaggtcaagaacctgctgaacggggaggtctcggatcttcaggtggccggcctcttcttcgccatcggacacgagccggcgaccaaattcctgggcgggcagctcgaactcgattcagatggatatgttgcaaccaagccaggttccactcacaccagtgtcaagggggtctttgctgctggcgacgtgcaggacaagaagtaccgccaggccattactgccgctggatcagggtgcatggccgcattggacgctgagcactacctgcaggagattggtgcacaggagggaaagtctgattgactatatctgggtgtagcaaccagcagtccatcgaatggtcagttgccggtgctgaaagccgccctgtgatgtgcgtttatgccatgggttctcatgaactcatgattgaagaacctgacgatttatgctgcttagtatcatacattcttatcattaggatccagaagtacgtttgaactgtctgggcttctatttactggatacagattcatgattactgttttgaagtttttggcctagatatctctattgctcaagtctcattattgtgttaatggtggtgttatgctgagctcatctccgtcactgttgagcctctcagcttcgtttctttctctttcttttcagaatacattgatattttcatttttgaacgcaaacattgattttgtcttgacgtgcaaaattttaagttaacttattagatttctgc

SEQ ID NO: 1958 - DNA, 1368 bp, Panicum virgatum
ccacgcgtccgcagagaccgacgaggtgcgaagtgtaatttcccttcaattcagaggcttccccttgaccgccgccgccaacccgagccagcagccatggacggatccgccgccgcgccgctccgcacgcgcgtctgcatcatcgggagcggcccagccgcgcacacggcggccatctacgccgcgcgcgcggagctcaatcccgtgctcttcgagggctggatggccaacgacatcgccgcgggcgggcagctcaccaccaccaccgacgtcgagaacttcccgggcttccccgacggcatcatgggcgccgacctcatggaacgctgccgcgcgcagtccctccacttcggcaccaacatcctctccgagaccgtcaccgccgtcgacttctcggcccgccccttccgcgtcgcctccgactccaccaccgttctcgccgacgccgtcgtcgtcgccacgggggccgtcgcccgacgcctccacttccccggctccgatacgtactggaaccgcggcatctccgcctgcgccgtctgcgacggcgccgcccccatctttcggaacaagcccatcgccgtcataggcggcggcgactccgccatggaggaggccaacttcctcaccaagtacggctcccatgtctacatcatccaccgccgaaacaccttccgggcttccaagatcatgcaggccagggcgctcgagaacccaaaaatccaggtcatctgggactcggaggttgtcgaggcctatggcggcgaaggcggcggcccattggctagcgtcaaggtcaagaacctggtgagtggtgatatctcggatcttcaggtggccggcctcttctttgccattgggcatgagccggcgaccaagttcctcggtgggcagcttgaactcgattcagatggatatgtggcaaccaagccgggctccactcacaccagtgtgaagggggtattcgctgctggcgacgtgcaggacaagaagtatcgccaggccattactgcagctggatcagggtgcatggccgctctggacgctgagcactatctgcaggagatcggtgcgcaggagggcaagtctgattgactatatttgggtattgcaaccaccagccaatcaaaatgccaattgccggtgctgaaatctaccctctgatgtgtgtcatgccatgggtattcatgatcgagaaactttggatttttgtgctgcttatgagtaacacactattcttctcattagtattcagaagtctgaacgaggcttctcatttagagggagctctccatgtactcgaaattgattcatatttacttatgtcagaacttgtaatattgttttagatatctccattgctcgtattgt

SEQ ID NO: 1959 - DNA, 1965 bp, Panicum virgatum
cattggctgatcggtttcctgaaagagaaattcattcagtccagtgaccagagaccgacgaggtgcgaagtgtaatttcccttcaattcagaggcttccccctgaccgccgccgccaagccgagccagcagccatggacggatccgccgccgcgccgctccgcacgcgcgtctgcatcatcgggagcggcccagccgcgcacacggcggccatctacgccgcgcgcgcggagctcaagcccgtgctcttcgagggctggatggccaacgacatcgccgcgggcgggcagctcaccaccaccaccgacgtcgagaacttcccgggcttccccgacggcatcatgggcgccgacctcatggaccgctgccgcgcgcagtccctccgcttcggcaccaacatcctctccgagaccgtcaccgccgtcgacttctcggcccgccccttccgcgtcgcctccgactccaccaccgttctcgccgacgccgtcgtcgtcgccacgggggccgtcgcccgacgcctccacttccccggctccgatacgtactggaaccgcggcatctccgcctgcgccgtctgcgacggcgccgcccccatcttccggaacaagcccatcgccgtcataggcggcggcgactccgccatggaggaggccaacttcctcaccaagtacggctcccatgtctacatcatccaccgccggaacaccttccgggcttccaagatcatgcaggccagggcgctcgagaaccccaaaatccaggtcgtctgggactcggaggttgtcgaggcctatggaggcgaaggcggcggcccattggctggcgtcaaggtcaagaatctggtgagtggtgatgtctcggatcttcaggtgggcggcctcttctttgccattgggcatgagccggcgaccaagttcctcggtgggcagcttgaactcgattcagatggatatgtggcaaccaagccgggctccactcacaccagtgtgaagggggtcttcgctgctggcgacgtgcaggacaagaagtatcgccaggccattactgcagctggatcagggtgcatggccgctctggatgccgagcactatcttcaggaagttggtgcacaggagggcaagtctgattgactgtatttgggtatatcaaccaccagccaatcaaaatgcctattgccagtgctgaaatctaccctctgatgtgtgtcatgccatgggtattcatgatcgagaaactttggatttttgtgctgcttatgagtagcacactattcttctcattagtattcagaggtctgaacgaggcttctcttttagagggaactctccatgtactcgaaattgattcatatttacttacgtcggaacttgtattattgttttagatatcactattgctcagtattgtatcggcgtgttctcaccacttgcttccaccaattatcgatgatctactcatgaagtcatgagaccatctccatcagtgtctagcttttttaggccagtttcttctttctttcagtggcacttctagtttcagggctaggagtcaagagcagtagaagtggccttccgaacaaacgcaattgcacacgaatgccgcaaccggaacaaccaatcggccctgtctaattcgcgccgagaatactgacaacaaatggaatcacaatggatactggacagcaatgcgactgccagccttccacaaggcgcaacagctcacctcaaatggctctcctcaattgtagccaagataattgacttctaggtagttactgattcagccctttggacttgtgtatatgtacaacatcgaacagatcaatgaattgttattgtttgcgttcattccttcatgcatatcgctcacaaagatgacggctctgactgtctgctcctctctgaagttttgcacatgtggatgaaaagggccattatcatgctatatgcagcatagaattcagaat

SEQ ID NO: 1960 - DNA, 1672 bp, Setaria italica
atgggccacaggatcgtcttgtttattccggtccattccaacaaaacgctgcacccgaaccatcatctctttgaacctttgctccgtgagccaaaaggggagagtgtggacagtcggctgcgtgttcctatgaacgtgtttgtgcttctgcaatctcctgaatcaaaaagcatgacgagctactacttcgttcaacaaagttgcagtgcatcattagagggccctaataaaaaattgaacaaacacgcgtaccatcgccacaataaaagtgcaccatatggatcgcaattcgcaagaacaatgagacgtatctccgtaatttcggaattcagaggcgcccttcttgaccgccgccgccgccgccgccgccgccgtcaacaagccgagcaagcagccatggagggatccgccgcggcgccgctccgcacgcgcgtctgcatcatcgggagcggcccagccgcgcacacggcggccatctacgccgcccgcgcggagctcaagcccgttctcttcgagggctggatggccaacgacatcgccgcgggcgggcagctcaccaccaccaccgacgtcgagaacttcccgggcttccccgacggcatcatgggcgccgacctcatggaccgctgccgcgcgcagtccgcccgcttcggcaccaacatcctctccgagaccgtcaccgccgtcgacttcgcggcccgccccttccgcgtcgcctccgactccaccaccgtcctcgccgacgccgtcgtcgtcgccacgggggccgtcgcccgacgcctccacttccccggctccgatacgtactggaaccgcggcatctccgcctgcgccgtctgcgacggcgccgcccccatcttccggaacaagcccatcgccgtcataggcggaggcgattccgccatggaggaggccaacttcctcaccaagtatggctcccacgtctacatcatccaccgccggaacaccttccgggcttccaagattatgcaggccagggcgctcgaaaaccccaaaatccaagtcatctgggactcggaggttgttgaggcctatggcggcgcaggcggtggcccattggctggcgtcaaggtcaagaacctggtgagtggtgaggtctcggatcttcaagtgtccggcctcttctttgctattgggcacgagccggcgaccaagttcctcggtgggcagctcgaactcgattcagatggatatgtggcaaccaagccgggctccactcacaccagtgtgaagggtgtcttcgctgctggcgacgtgcaggacaagaagtatcgccaggccattactgctgctggatcagggtgcatggccgctctggatgctgagcactatctgcaggaggtcggtgcgcaggagggcaagtctgattgactatattttggtgtaccaaccaccagccaatcagaatgccacttgccggtgctgaaatctaccctctgatgtgcgttatgccatgagtattcatgatcgaatttggacttttgtgctgcttatcagtatagcacactattcttctcattagtattcggatgtctgaacgagggaactatcaatgtactcgaaattgattcgtatttacttacgcttgaacttgtattatcgttttagatatctctttggaatcagcgtgttgttcgtgccactctttgct

SEQ ID NO: 1961 - DNA, 1664 bp, Oryza sativa
atagtttcggtcaacaactcaacatccatctgggggtatgaccgaccgagcgcggtggccgttgattggctcgtcgcctcctcccttctcggtctgacggtctgaccagtgccgggtaggaagcgtaattttgaggagagactccgacccgcgccgccgccgccgcagccaagccatggagggatccgccggggcgccgctccgcacgcgcgtgtgcatcatcgggagcgggccgtcggcgcacacggcggcgatctacgccgcccgcgcggagctcaagcccgtgctcttcgagggctggctcgccaacgacatcgcggcggggggccagctcaccaccaccaccgacgtcgagaacttcccggggttccccgaggggatcctcggcggcgagctcatggatcggtgccgcgcccagtccctccggttcggcaccagcatcatctccgagaccgtcaccgcggtcgacttctccgcccgccccttccgcgtcgcctccgactccaccaccgtgctcgccgacgccgtcgtcgtcgccaccggcgccgtcgcccggcgactccacttcgccggctccgacgcctactggaaccgcggcatctccgcctgcgccgtctgcgacggggccgccccaatcttcaggaacaaacccatcgccgtcatcggcggcggcgactccgccatggaggagtccaacttcctcaccaagtacggctcccatgtgtacatcatccaccgccgcaacaccttccgcgcctccaagatcatgcaggccagggcgttgtcaaaccccaagatccaggttttctgggactctgaggtcgtcgaggcctacggcggcgagggtggaggtccattggctggtgtcaaggtgaagaacttggttactgggaagatctccgaccttcaggtgtccggtctcttcttcgccatcggacatgaaccggcgacgaagtttctcggcgggcagcttgagctcgatgctgatgggtatgtggccaccaagccaggctccacgcacaccagtgtgaagggggtctttgctgctggggatgtgcaggacaagaagtatcgccaggctattactgccgctggatcagggtgcatggctgctttggacgcggagcactatctgcaggaggtcggtgcacaggagggcaaggccgattgactatctcaggaggaagcgaccaccagcgtttcaagaagtccaacgttgtcgctgctgaaagctacactctgaacgtttatgccatgggctgttctgacttctgaatgcttctaccggattttcctgccccttattagcgtcgtattatttgatgtgctggagatttatctgtatttacgctgaagacgacgtattgcttgcgggtatccgcattttctgcatttgcttatgattgagttattgtgacatttggcgtttttagtaccaaactagcaaggaattgtgtattctgaagaccattccgatcaatgctactgatatggtggatatcactattgttttcctggaaagaggagtaattagaagttcactagcaggttgctaaccctgagagaatacagagacatgtatgtagcggtgtacacctacttgcccagccagcctatgttacaggggctcgcaggcagggcgcccagcccatatcatatcgcgg

SEQ ID NO: 1962 - DNA, 718 bp, Saccharum officinarum
catccagtagaagagggcacgacggtgggaaagagcggagccggtccaagaaaccgggcacgccaccagacgcgcccatggaccccaccggcggcgacggcgactccgcggcggcgaggggaagcgcaggcggagggggaacgggggccggcaggtgggcggtgggcgcggtgtgcggggggctggtctactaccactgcgcggtgcggcgagccagcgcggtgtccctcgccgccgacgtgctcctcgtcctcctctgctcgctctccatcctcggcctcctcttccgccaccttcacatctcggtgcctgtagatcctcttgaatggcagatctctcaggagatggcaaatagtatagttgcatccttggctaatacaataggagctgcggagtctgtattaagggtggctgcaactggacatgacaagaagctgtttttcaaggtggtttttacattgtattttctagcagctttgggaagggtggtatcaggcgctgcggttgcttatgctgccctatgcatcttctgcctctacatgtttgcacaaagcaccgatctgtttgatcagctcccttcttgggtccctgtgggaagggattctttgggcggtagtcaggataccgcgtgattttccacatgtacatggattgcagagtttttcttttcctccaccttctgtatatgtgcctgcaggctaaatagcttgaactatag

SEQ ID NO: 1963 - DNA, 1114 bp, Sorghum bicolor
catccagtacaagaggacgtttccttgtcaaaagaggagccggtccaagaagccgggcacgccaccagacgcggagcccatggaccccaccggcggcgacgtcgtcgtcgactccgcggcggcgagagggagcggaggcggagggggaacgggggccggccggtgggcggttggcgcggtgtgcggggggctggtctactaccactgcgcggtgcggcgagccagcgcggtgtcgctggccgccgacgtgctcctcgtcctcctctgctcgctctccatcctcggcctcctcttccgccacctccacatctcggtgcctgtggatcctcttgaatggcagatctctcaggagatggcaaatagcatagttgcatccttggccaacacaataggagctgctgaatctgtattaagagtggctgcaactggacatgacaagaagctgtttttcaaggtggtttttacattgtattttctagcagctttgggaagggtggtgtcaggcgctgcggttgcttatgctgccctatgcatcttctgcctctacatgtttgcacaaagcaccgatctgtttgatcagctcccttcttgggtccctgtgggaagggattctttggggggtactcaggataccgcgtgattttccacatgtaaatggaatgcagagttttccttttcttccactttctgtatatggtcctgcaggctaaatagcttgagctatagcttctatggcagccctacggtatcacaactgtactaggtagctatgatgaagtaatgatctttgtatatatgacacgcttgcaacttgccagatgccagcaccttgtatgtttttggagctctttgcatctctctggcttgacatggttggtcgtgagatggtgttgcctgatggtgtgttttgcctgtaacagttactacctgtaacggttactgcctgtaactgaacctgcagttgcaggatgggctatgacattgcgttgttcgtgtagtctgaggctagtcttaatggatagtttcatggtgttgtttgtgagattattatgtcatatagaataaaatgaaacgtagatgaaacactcactttcaatgcaaagtttcattatat

SEQ ID NO: 1964 - DNA, 983 bp, Setaria italica
atgactcgagtgcgagagcatccgcccagttatccgcatcttttctcagctcgatcgttcgccacgaatcatcagctgcacgggggtcggtcggggtgggggtgctgcttcctgggtcgaattaggggcccattaggatcgtttcgtggttcggttcggcggtccgctccacgcccatctttacgtgggcacccagcgatgacatggacacactcacgtacatctcctctctcatccgggcacgacacgacaccaggatggaccccacgggcggcggcggcggcgacggcgactccgcggcggcgagggggagcggagggggaaccggggctgggaggtgggctgtgggtgcggtttgcggggggctggtgtacctaccactgcgcggtgcggcgcgccagcgcggtgtccctcgccgccgacgtgctgctcgtcctcctgtgctcgctctccatcctcggcctcctcttccgccacctccatatctcggtgcctgtggatcctcttgaatggcagatttcccaggagatggcaaatagtatagttgcatccttggctaatacaatcggagctgctgagtcagtattaagggtggctgcaactggacatgacaagaagctgtttttcaaggtggtttttacattgtattttctagcagctttgggaagagtggtgtcaggagctgcggttgcttatgctgcactatgcatcttctgcctctacatgtttgcgcaaagcaccgatctgtttgatcagctcccttcatgggtacccatgggaagagattcattgggtggcgctcaggataccgcatgatttccacatgtacatgaccgccgagtgttttttcttcccctttgtgtatatggtcctggaggctaatgtcttgaaccgtagcacccacggtggatgtatgtcgcaaatctttgtatatcataacgtgtttccaactgatgagtgtctgattttcgcaatatgttttc

SEQ ID NO: 1965 - DNA, 862 bp, Oryza sativa
ctcgaaagaacccacgtgggagaggagaacaaaaacagagagagagggggaggcggtccaaggcggcggcgcggccggcggcgacgggatggaggccaccggcggcggcgatgcggcggcggaagggaggaggggggaagggggaggaggggccgcgcggtgggcggtgggcgcggtgtgcggcgggctggtgtactaccactgcgcggtgcggcgggccagcgcggtgtcgctcgccgccgacgtgctcctcgtcctcctctgctcgctctccatcctcggcctcctcttccgccacctccacatctcggtgcccgtggatcctcttgaatggcagatttctcaagagatggcgaatagtatagttgcatccttggctaacacaatcggagctgctgaatctgtattgagggtggctgcgactggacatgataagaagctctttttcaaggtggtttttactctgtattttctagcagctttggggagggtggtgtcaggcgccgcagttgcttacgccgcgctctgcatcttctgcctctacatgtttgcacaaagcactgatcttttcgatcagctcccttcttgggttcccgtaggaagagattctcttggcggctctcaggatacaacatgattctgtacatcagctagtttgtgtgtacgatcgactctgcaggtcaatatatagcttcttgaactgtatgtatagcatctgttgcttctttcacggctcacctctgcattgcagttgttcatggtgtcctgtaacagcagcatcacctctgtatatcatatgctgttgctagcaactttgtggaaaagaaaaatatcatttgtggttcttttgccttcctgtccc

SEQ ID NO: 1966 - DNA, 892 bp, Panicum virgatum
acggaaaaggagccggtcaagaagccaccccggggcactacacgagacgcgccgatggaccccaccggcggcggcggcgccggcggcggcggcgaccccgcggcggggagggggagcggaggaggagggggggcagaggccgggcggtgggcggtgggcgcggtgcacggaggcctggtgtactaccacagcgcggtgcggcgcgccagcgcggtgtccctcgccgccgacgtgctcctcgtcctcctctgctcgctctccatcctcggcctactcttccggcacctccaaatctcggtgcctgtggatcctcttgaatggcagatttctcaggaaatggcaaatagcatagttgcatccttggctaataccataggtgctgctgagtctgtgttaagggtggctgcaactggacatgacaagaagctgtttttcaaggtggtttttacattgtattttctagcagctttgggaagagtggtgtcaggagctgcagttgcttatgctgcactatgcatcttctgcctctatatgtttgcacaaagcaccgatctgtttgatcaacttccttcctggggacctgtgggaagggattcattgggcaatgctcaggataccgcgtgattaccacatgtacatgaactacagtgctattcttttcccccccttatgtacatggtcctgcaatagcttgaactatggcatctatggcgactgtactcgatgttttaccaactgtggtgttactacctctgtatatcatgatacgttaccaacttgctaatgatgtcccgtgtatgttactgcctagctaagtgcggatctctctggctagccatgatcttgtgatgcaaggttggtcgtgaaatgtggcctcgtgtgttttgcttga

SEQ ID NO: 1967 - DNA, 835 bp, Pennisetum glaucum
actcctctcttttctacttgcaaactgattctggactccggcgggcgggaacgggggccggccgctgggcggtgggggcggtgtgcggggggctggtgtactaccactgcgcggtgcggcgcgccagcgccgtgtccctcgccgccgacgtgctcctcgtcctcctctgctcgctctccatcctcggcctcctcttccgccacctccacatctcggttcctgtggatcctcttgaatggcagatttcccaggagatggcaaatagcatagttgcgtccttggctaatacaataggagctgctgagtcagtattaagggtggctgcaactggacatgacaagaagctgtttttcaaggtggtttttactttgtattttctagcagctttgggaagaattgtgtcaggagctgcggttgcttatgctgcactatgcatcttctgcctctacatgtttgcgcaaagcaccgatctgtttgatcagctcccgtcctgggtacctgtgggcagagattcattgggtggcgctcaggatactgcatgatttccacgtgtacatgactgcagagttcttttctccccctttgtgtatatggtcctggaggataatgtcttgaaccgtagcatccacggtgggatgtatgtcatcgcgagacagtctacacctaatgttcagcggagtaacaaatctttgtaaatcataacgtgtttccaactagtgagtgtctggttttcgcaatatgttttcatcgacctcattgtggatctcactggtcaaccatcagcccgtggtgtgggtttggtttcgagttgtgtcctgagatctttgtgtttaaa

SEQ ID NO: 1968 - DNA, 917 bp, Panicum virgatum
cggtgggcggtggtcgcggtgtgcggggggctggtctactaccactgcgcggtgcggcgcgccagcgcggtgtccctcgccgccgacgtgctcctcgtcctcctctgctcgctctccatcctcggcctcctcttccgccacctccacatctcggtgccggtggatcctcttgaatggcagatttctcaggaaatggcaaatagcatagttgcatccttggctaataccataggtgctgctgagtctgtgttaagggtggctgcaactggacatgacaagaagctatttttcaaggtggtgtttacattgtattttctagcagctttgggaagagtggtgtcaggagctgcagttgcttatgctgcactatgcatcttctgcctctatatgtttgcacaaagcaccgatctatttgatcaacttccttcctgggtacctgtgggaagggattcattgggcagtgctcaggataccacgtgatttccacatgtacatggactacagtgctcttcttttttcccctccttttgtacatggtcctgcaggctaatagcttgaactatggcatctatggcgactggactcgatgttttaccaactgtggagtcacgacctctgtatatcatgatacgtttccaagtgcggatctctttggctagccatgatctcgtgattcgaggttggtcgtgaaatgtggccttgtgtgttttgcttgatcacggttacctgtgcctgaacctgatgttgcaacagggcctatgagattgcattgtcagttgttcgtgtaattttccttcaaaaaagttgttcgtgtaatctgataaagaatggcatttcaccacatattaatgcttacgcatgtcgaggcatcgcgtcctatctgccagattgatcaccgttattctgaaaacaaggtg

SEQ ID NO: 1969 - DNA, 785 bp, Pseudoroegneria spicata
  misc_feature (8)..(10): n is a, c, g, or t
  misc_feature (31)..(31): n is a, c, g, or t
  misc_feature (556)..(557): n is a, c, g, or t
  misc_feature (686)..(686): n is a, c, g, or t
  misc_feature (766)..(766): n is a, c, g, or t
gagagcannnagcgacagacggacgccaccnccacagccggcggcgggggcagcttggtcgacgccacgcccgcgatgggagcgggaggatcctggcgctgggccgtgggcgcggtctgcggggggctgatttactaccactgcgcggtgcggcgggcgagcgcggtgtccctcgccgccgacgtgctcctcgtcctcctctgctccctctccatcctcggcctcctcttccgccacctacacatctcggtgcctgtggatcctcttgagtggcagatttctcaagagatggcaaatagtatagttgcgtccttggctaacacaattggagctgcggagtctgtattgagggtggctgcaactggacatgacaagaaactcttgttcaaggtggtttttactctgtatttcctagcagctttgggaagggtcgtctcaggcgctgctgttgcttatgctgctctgtgcatcttctccctctacatgttcgcgcaaagcaccgaccagtttgatcagctcccttgggttcctataggaagagactcactgggcggcnnccaggataccacatgatttcagcatgttcatgtcttgccgatccttttttctcttcattcttcaaattctgtatatggccatggaggaggccaatagcttgaaccgtacccagtgttgttttaagatgnacactggtgcgccacgtgtgcagccatgtgcgttcccttttttttttaaaggggagatgaatgtgacattaataaaaaanagaggcattcacacaagca

SEQ ID NO: 1970 - DNA, 826 bp, Secale cereale
tgcgtccaagttgctattcctgtggcctccatccgaattaagcccacggcccatgagaaccaagtccaagatacttgtcctgtgggtgtgatagagagcgacagatggtcatggaggccaccaccagagccggcggcggggcagcttggtcggcgccacgccggcgatgggggcgggaggatcctggcgctgggccgtgggcgcggtctgcggggggctggtttactaccactgcgcggtgcggcgggcgagcgcggtgtccctcgccgccgacgtgctcctcgtcctcctctgctccctctccatcctcggcctcctcttccgccacctacacatctcggtgcccgtggatcctcttgagtggcagatttctcaggagatggcaaatagtatagttgcgtccttggctaacacaatcggagctgcggagtctgtattgagggtggctgcaactggacatgacaagaaactcttgttcaaggtggttctcactctgtatttcctagcagctctgggaagggtcgtctcgggcgccgcgattgcttatgctgctctgtgcatcttctccctctacatgttcgcgcaaagcaccgaccagtttgatcagctcccttgggttccttcgggaagagactcgctgggcggcgcccaggataccacttgatttcttcatgtacatgtcttgccgatcctttttttttctttgttgttcgaattctgtatatggccatggttgttttaagatgaacactggtgcgccacgtgtgcagccatgtgcgttcccttttttttaaaggggagatgaacgtgacatcaataaaaaaaa

SEQ ID NO: 1971 - DNA, 663 bp, Secale cereale
tgggggcgggaggatcctggcgctgggccgtgggcgcggtctgcggggggctggtttactaccactgcgcggtgcggcgggcgagcgcggtgtccctcgccgccgacgtgctcctcgtcctcctctgctccctctccatcctcggcctcctcttccgccacctacacatctcggtgcccgtggatcctcttgagtggcagatttctcaggagatggcaaatagtatagttgcgtccttggctaacacaatcggagctgcggagtctgtattgagggtggctgcaactggacatgacaagaaactcttgttcaaggtggttctcactctgtatttcctagcagctctgggaagggtcgtctcgggcgccgcgattgcttatgctgctctgtgcatcttctccctctacatgttcgcgcaaagcaccgaccagtttgatcagctcccttgggttccttcaggaagagactcgctgggcggcgcccaggataccacttgatttcttcatgtacatgtcttgccgatccttttttttcttcttcattgtttgaattctgtatatggccatggttgttttaagatgaacactggtgcgccacgtgtgcagccatgtgcgttcccttttttttaaaaggggagatgaatgtgacatcaataaaaaaaaa

SEQ ID NO: 1972 - DNA, 1012 bp, Triticum aestivum
ccaccaccagagccgagccggcggcgggggcagcttggtcgacgccacgcccgcgatgggggcgggaggatcctggcgctgggccgtgggcgcggtctgcggcgggctggtctactaccactgcgcggtgcggcgggcgagcgcggtgtccctcgccgccgacgtgctcctcgtcctcctctgctccctctccatcctcggcctcctcttccgccacctacacatctcggtgcctgtggatccacttgagtggcagatttctcaagagatggcaaatagtatagttgcgtccttggctaacacaattggagctgcggagtctgtattgagggtggctgcaactggacatgacaagaaactcttgttcaaggtggtttttactctgtatttcctagcagctttgggaagggttgtctcaggcgctgcgattgcttatgctgctctatgcatcttctccctctacatgttcgcgcaaagcaccgaccagtttgatcagctcccttgggttcctttaggaagagactcgctgggcggcgcccaggataccacatgatttcttcatgtacatgtcttgccgatcatttttttttcttcattgttcgagttctgtatatggccatggaggccaatagcttgaaccgtccccagtgttgttttaagatgaacactggtgcgccacgtgtgcagccatgtgcgttccctttttttaaaggggagatgaatgtgacattaataaaaaagaagagggcattcacacaagcatagtagggtgagcagctagagatttttatctccctgagttactctcttagatccaaaataactgccgtggttttagttcaaatttgaactaaaaccacaacacttattttggattggagggggtgtcacttaaggggaaatggcagtccacaatacaccatgatggttcaacaagtagtagcaatgcaattttaccctttgaaattgttagatgtaaaacaagagagacaagagacagagatgtaaaagt

SEQ ID NO: 1973 - DNA, 1042 bp, Brachypodium distachyon
gacggggatccgacttagctttccccgtccgtccagtccacccaccgaccgacacatggaggccaccgccggcggcagcgctggcctcgggctcatcgacggcgacggcgacggcgacgacgcggcgtcttcctcgaggggagcgggatcatccgggtgttgggccgtgggcgcggtgtgcggggggctggtctactaccactgcgcggtgcggcgggccagcgcggtgtccctcgccgccgacgtgctcctcgtcctcctctgctccctctccatcctcggcctcctcttccgccacctgcacataacggtgcctgtggatcctcttgagtggcagatttctcaagagatggcaaatagcatagttgcgtccttggctaacacaattggagctgcagagtctgtattgagggtggctgcaactggacatgacaagaaactcttgctcaaggtggtttttaccctgtatttcctagcagctttgggaagggttgtctcaggcgctgcggttgcctatgctgctctatgcatcttctgcctctacatgtttgtgcaaagcaccgacctgtttgatcagctcccttcttgggttcccgtgggaagagactctctaggcggcgctcaggacaccacatgattccctcagtgtacatgttctgctgatccattttccttctttggatttctgtatatgcccctggaggccagtagcttgagctgtagccggtgttctgaaattctctaggcagatgaggattagtcaggctcggcggctccctaggcagccgtccggccagatggtggtgcctaatgcctcggcgaccgccttgttaggagcctgtatgtcttgcagctgtacctgatgttgactaaactctgatgtacccctgttcatgtgtaacatccaactgcaacacgcaagttttatttttctctaggactgcatttgcatactggattctgaagattatggcttgacaaatgtagaacttttttgaaactcaaattcagaataaagcacaaccaaaatactcttcgcaca

SEQ ID NO: 1974 - DNA, 2115 bp, Sorghum bicolor
gacggatcagggcagtcaagagatgatccgacggccagcgccatccacgccactccgatctctcaggcctgccgcctgcggatcgaacgggaccaccggaccggccgccgacccaccccacacgccacgggcggcgtccaacgaaatgcgctcgtcaagtcgcctcacgtctcgctgtggtcaccacgcttcacatctctcgcgcggcggtagcgtccgccagacatggccgcctcctctctgctccgctcgctcacccgccgcggctgcgcgggcccgagcgctttcgcttaccgctaccaccaacaacaaccttggtcgcccttctccaccaccgccgctggggcggcggctgcgggtacgcgggacgaagcggcgaagcggttccctggactagggccgacggcgaagggggagaaggccagggtggtggtgttggggacagggtgggcggggtctcggctcatgaaggacctcgacacgcacggctacgacatggtctgcgtcgccccgcgcaaccacatggtgttcacgccgctgctcgcctccacctgcgtcggcacgctcgagttccgctccgtcgccgagccgatcgcgcgcatccagcccgccgtgtccaagtcgccgggctcctacttcctcctcgcccgttgcaccggcgtcgaccccgacagccacacgattgattgcgaaacagttacagatggtgagaaagattccttggagccatggaaattcaaggttgcttatgacaagttggtttttgcctgtggagctgaggcatcaacttttgggatacatggtgttaccgaccatgcaatctttcttcgcgaagttcaccatgctcaagagattcggagacggctcctccttaatctgatgttgtctgatgtccctggaatttcagaagaagaaaagcgcagactattgcactgtgttgttgttggaggtggtccaacaggggtggaatttagtggtgaacttagtgattttattatacgagatgtcaaacaacgttattcacatgtgaaggattatatccatgtgaccctgattgaggcaaatgagatattgtcatcatttgatgttcggctcaggcaatatgctataaagcaactaattaagtcaggtgttaggcttgtgcaaggaattgttaaggatgtacagcccagcaaaataattcttgacaatggagaggaagttccttatggtttactggtatggtccactggagttggtgcttcaccattcgttaagtcattgccatttcctaagtcacctggtggaaggatcggtgtcaatgagtggttacgtgtcccttctgttcaggatgtttatgccattggtgactgcagtgggtttctcgagagcaccggcaaggaagttctccctgctttagctcaggttgcggaacgacaaggcaagtacctggcaagcctgctcaatcatgtcatgaaagctggaggagggcatgcaaactctgtgactgaagcagatctgggtccaccctttgtgtacaagcatctaggcagcatggcaactgttggaagatacaaagctctagtcgatctgaggaaaagcaaggagtcaagggggatatctcttgcaggatttgtgagctggttcatctggcgctcggcatacttaacccgtgttattagctggaggaataggttctatgtggctatcaattggctgaccacactcttatttggccgggacataagcagaatctagagtgtctttgtagatgtacgaacaacaaataagatcgacacggtcacttgcttgccacacacccctccctcttctttttgggtcctcttctaccactgaccctattggctgtggatgtaattcacaggtaaattatgaataaatccaaggatgccgcagttagttacatgtgctatgaatgtataaagtctaaatggcttggaacggactactcgtgtaatcctagttaaatctatgagttttgatttgaggaagattctctggtcaaatagattattttcacggcagtaaataggctgttggacgaggaggaaataatgaaaaagtccagagtacaatctttaaataaagcagtgttcgagattcattctcagtatt

SEQ ID NO: 1975 - DNA, 1963 bp, Setaria italica
cggacggatcagggccgtcaagaggtgatccagcggtccgagcagccccggccctcccgatctctcgggcctgcggagagcggatcgatcgggacgcccggccgccggcccacccgcccaaccaaatgcgctcgttaaagtcgtctcacttctcgctgtggctatcacgctccacacctctcgcgccagccatggccgcctcctccctgctccgctcgctcacccggcacgcgcgcggcgcttccgcttaccgccacctgccttggtcgcccttctccaccaccactgcggcggcggcgggcgcgcgggatgaggcgaggaaggggttccctgggctggggccgacggcgaagggggagaaggcgcgggtggtggtgctggggaccgggtgggcggggtcgcggctcatgaaggacctcgacaccagcggctacgacgtcgtctgcgtcgccccgcgcaaccacatggtgttcacgccgctgctggcctccacctgcgtcggcacgctcgagttccgctccgtcgccgagccgctcgcgcgcatccagcccgccgtgtccaagtcgccgggctcctacttcttcctcgcccgctgcaccggcgtcgaccccgacgcccacacgattgattgcgagacagttacagacggtgagaaagataccttggaaccatggaaatttaaggttgcttatgacaagctggtttttgcaagtggagctgaggcatcaacttttgggataaagggtgtcaccgagcatgctatctttcttcgggaagttcaccatgctcaagagattcgcagaaggctccttcttaatctgatgttgtctgatgtacctggactttccgaggaagaaaagcgcagactattgcactgtgttgttgttggaggtggtccgacaggggtggaatttagtggtgaacttagtgatttcatcatgcgagatgttaaacaacgttattcacacgtgaaggattatatccatgtgaccctgattgaggcaaatgaaatattgtcatcatttgatgttcgcctcaggcaatatgctacaaaccaattaattaagtcaggtgttaggcttgtgcaaggaattgttaaggatgtacaacctaacaaattaatccttgacaatggagaggaggttccttatggtttgttagtatggtctaccggagttggtgcttcaccatttgttaagtcgttgccatttcctaagtcacctggtggaaggattggtgtagatgagtggttacgagttccttctgttcgggatgtgtatgctattggtgactgcagtggatttcatgaaagcactggcaaggatgttctcccagctctagcccaggttgcagaacgacaaggtaagtaccttgccaacctgctcaaccatgtcatgaaagctggaggagggcatgcaaactctgaggtcgaagccgatcctgggccaccctttgtgtacaagcatctaggcagcatggcaactgttggaagatacaaagctctagtcgatctgaggcaaagcaaggagtcgagagggatatctcttgcaggatttgtgagcttttttatctggcgctccgcctacttaactcgtgttgttagttggaggaataggttctatgtggctatcaattggctgaccacgttattgtttggccgggacataagccgtatctaagagtgcctgttcggcgatgtctaaagagtgaacagtacaagttcgatgcagtgctataggtcacggttacttttttttttctctccttgacaatttttatcttgtaagctccagaagcacaattcacaggttaattatgaataaatgtgaggagaccacagttacgtgtcccatgaatgtataatacttgtgtagctatggtttcttccggtgtcaaagaaaacaatttcgaggaagattcactgggcaaatggatggttttcatggcaataaataagctgttg

SEQ ID NO: 1976 - DNA, 1950 bp, Oryza sativa
caaaaaattccaccgcacacgcgacgacgaaaccgcctctggctgggggctttagaccttcaacggtgcccgttcacccgcgatccgacggtgggggagcccctcgccgtccagatctcagcctctcggatcggacggagcgtgaggtcgtcgggtcacccaacattttctccacacgcggcgactttctagcaaaaacgcagttcgtttaacgagagtcgctcacttctcgttcaggttcagcaatcgcaatctcgtctcatcgtcgccggccatggcggcgtcgtccttgctccggtcgctctcccgcatctcgcgccgcggctgcgtgggaggcgcggggccgagcccgttccaccacagccgcctcccgtactcgccgttctccaccgcggcggcggatgcggtggagaggagggggttcgcggggctggggccgacggcgaagggggagaaggcgcgggtggtggtgctggggaccgggtgggcggggtcgcggctgatgaaggacatcgacacgaccgggtacgaggtggtgtgcgtctccccgcgcaaccacatggtgttcacgccgctcctcgcctccacctgcgtcggcacgctcgagttccgctccgtcgccgagcctctcgcgcgcatccagcccgccgtgtccaagtcccccggctcctacttcctcctcgcccgctgcaccgccgtcgaccccgacgctcacacgattgattgcgagacagttactgaaggtgagaaagataccttgaaaccttggaaattcaaggtagcgtatgataagctggtctttgcgtgtggagctgaggcctcaacttttgggatacgtggtgttactgaccatgcaatatttctccgggaagttcaccatgctcaagaaattcgcagaaagctccttctgaacctgatgctatctgatgtacctggaatatcggaggaagaaaagcgcagacttttgcattgcgttgttgttggaggtggtccaacaggtgtcgaatttagtggtgaacttagtgattttatcatcagagatgttaaacagcgttattcacatgttaaagattatatccatgttaccttgattgaggcaaatgagatattgtcatcttttgatgttcgcctcaggcaatatgctacaaatcaactaactaagtcaggtgttaggcttgtgagaggcattgtgaaggatgtacaacccaacaaattaatcctggacaatggagaagaggttccttatggtttgctggtatggtctactggagttggtccttcatcattcgttaagtcgttgccatttccaaagtcaccaggtggaaggattggggttgatgagtggttacgtgttccttctgcccgggatgtgttcgctattggggattgcagtggatttcttgaaagcacaggcaaggatgttctcccagctttagctcaggttgcagaacgacaaggcaagtatctagctcacctgcttaaccatgtcatgaaagctggaggagggcatgcgaactgtgagatcgacgttgatctaggtcctgcctttgtgtataagcatctggggagcatggcaactgtcggaagatacaaagctctagtcgatctgaggcaaagcaaggaatcgaaagggatatctcttgcaggatttgtgagctggttcatctggcgctcagcatacctgactcgtgttgttagctggaggaacaggttttatgtggctatcaactggctgaccacactgttatttggccgtgacattagccgtatttaggtgcctgtttgtagatatctgaacgatgaacagtacagtgcatcctttcccacttctttttttttgtcagatatgtgtaatttccacagaatttttttcttaaataacactatcaaaacaaaccaaggaagcgagttcaaactttaaatactgatgattagtatcgctatctggag

SEQ ID NO: 1977 - DNA, 1973 bp, Brachypodium distachyon
ctcgttcacccagggcggtttcgttaacctcggctcactcctcgcttcgcttccccgtcggctcactcctcgcttcgcttccccgccgcgttcgcatctcgtctcgcttcgcggagcgcaatggccgccctgctccgctcgctctcccgcacctccggcctccgcggctgcgcgagctcgttctaccaccgcaacccgtactcgcccttctccgccgcggcggaagcggtcgcgcgggatgcggcggtggggagggggctcgcggggctggggccgacggccaagggggagaagccgcgggtggtggtgctcgggacgggctgggcggggtcgcggctcatgaaggacctcgacaccaccgggtacgacgtcgtctgcgtctccccgcgcaaccacatggtgttcacgccgctgctcgcctccacctgcgtcggcacgctcgagttccgctccgtcgccgagccgcttgcgcgcatccagcccgcggtctccaactcccccggctcctacttcctcctcgcccgctgcacgggggttgaccccgacgcccacacgattgagtgtgagacagttactgaaggtgagaaagataccttgaagccatggaaattcaaggttgcgtatgacaaactggtctttgggtgtggagctgaggcatcaactttcgggattcatggcgtcactgaacatgcaacctttcttcgggaagtttaccatgcccaagagattcgcagaaagctccttcttaatctcatgctttctgatgtacctggaatatcagaggaagaaaaacgcaggctattgcactgtgtcgttgttggaggtggtccaacaggggttgaatttagtggtgaacttagtgatttcatcatcagagatgtgaaacaacgttactcacatgtgaaagattatgtccatgtgaccctgattgaggcaaatgaaatattgtcatccttcgatgttcgtctcagacaatatgctataaaccagctagtgaagtcaggtgttaggcttgtaagaggcattgtgaaggatgtgctgcctgacaaattaatcctagacaatggagaggaggttccttatggtttgctggtatggtctactggagttggtgcttcatcattcgttaagtcgttgccatttcctaagtcaccaggtggaaggattggtgtagatgagtggttacgtgttccttctgctccagatgtgttcgcaattggtgattgcagtggattccttgaaagcacaggcaaggaagttctcccagctttagctcaggttgctgaacgacaaggcaagtacctcgctagcctgctcaaccatgtgatgaaagttggaggagggcatgcaaactcagtggtcgaaatggatctaggtccaaagtttgtgtataagcatatggggagtatggcaactgttggaaggtacaaagctctagtcgacctgaggcaaagcaaggactcgagaggggtgtcaattgcaggatttgcaagctggtttatatggcgctctgcatacctgactcgtgttgtcagctggaggaataggttctacgtggctatcaattggctgaccacgctgttatttggccgtgacataagccgtatctagggcatctatatgtagatctctacactctggactgcacgacttcgatacagtacacatgccacgatcacaaaaagaaacataggtcatggtcattttgttccttcttttttctctcctgctcctctcttttatcccttttcagacttgtgagttccaaatgtacatcttcgttttcttgtaaattctgaataaatcagatgctatttgagggtactcctgctcgggatttatgcaactgtagtttcttgctcaggattaagatcaggaaatttgaacgagcaaactgttaacttcaagcggacaactaagtccatacccaagacagtgaaaagtaatatcgcatgggaaaattcttggattaa

SEQ ID NO: 1978 - DNA, 1803 bp, Triticum aestivum
ctcgtgagtcgcctcgccatggccgcgtcctccctgctccgctcgctctcccgcgtctcgcgccgcggctgcgcgcccgcgttctacggccgcggcccgctctcgccgctctcgaccgccgcggctgcagcggcgtccgacgcgggggatgctgcggtgctgcggagggggctcgcggggctggggccgacggccaagggggagaagccgcgggtggtggtgctcgggacggggtgggcggggtcgcgcctcatgaaggacctcgacaccaccggctacgacgtcgtctgcgtctccccgcgcaaccacatggtcttcacgccgctgctcgcctccacctgcgtcggcacgctcgagttccgctccgtcgccgagccgctcgcgcgcatccagcccgccgtctccacctcccccggctcctacttcctcctcgcccgctgcaccgccgtcgaccccgacgcgcacacgattgattgcgagacagtcactgaaggtgagaaagataccttgaagccgtggaaattcaaggtttcgtatgacaagttggtctttggatgtggagctgaggcatcgactttcggtatacgtggtgttactgaacatgcaacctttcttcgggaagttcatgacgctcaagagatccgcaggaagctccttctgaatctgatgctgtctgatgtacctggcatatcagagggcgagaagcgcaggctattgcactgtgttgttgttggaggtggtccaacaggggttgaatttagcggggaacttagtgatttcatcatcagagatgtgaaagaacgttactcacatgtgaaagattatgtccatgtgaccctgattgaggcaaatgagatattgtcatccttcgatgttcgcctgaggcagtatgctataaaccaactagttaagtcaggtgttaggcttgtacgaggaatcgtgaaggatgtacaacctgacaaattaatcctggacaatggagaggaggttccttatggtttgctggtatggtctactggagttggtgcttcatcattcgtcaagtcattgccatttcctaagtcacacggaggaaggatcggtgtagatgagtggttacgtgttccttctgtcccagatgtattcgctgttggtgattgctgtggtttccttgaaagcaccggcaaggaagttctcccagccttagcgcaggttgccgagcggcaaggcttgtaccttgctcgcctgctcaaccgtgtgatgaaggctggaggagggcacgcaaattcccaggtcgaagccgatctaggtccaaagtttgtgtataagcatctagggagtatggcaaccgttggaaggtacaaagctctggtggacctgaggcaaagcaaggactcgaagggcatatccatcgcaggatttgcaagctggttcatctggcgctcagcatacctgactcgtgttgtcagctggagaaataggctctatgtggctatcaactggctgaccacgatgatattcggccgtgacataagccgtatctagggtatcgatctgtagatctttgggctctgaactgtatgagttcgatacaacatataggccacgaacactaaaagaaacataggtcttgatcacattgcatctttttccccctcctgctcctctctttatccctttcagacttgtcagccacgtgagttccaaatgcacaatcttttttttttgtaaattatgaataaatgagatgcaatttgatggtcttcaagttacttggtgtgtagacgatgaatacttatgcaactgtagtttctttgctcagga

SEQ ID NO: 1979 - DNA, 1878 bp, Triticum aestivum
cgttaactcgcctcactcctcgcactcgctccccgtagcgttcgcatctcgtgagtcgtctcgccatggccgcgtcctccctgctccgctcgctctcccgcgtctcgcgccgcggctgcgcgcccgcgttctacggccgcggcccgttctcgccgctctccaccgccgcggcggctgcggcggcggacgcgggggatgctgctgtgctacggagggggctggcggggctggggccgacggccaagggggagaagccgcgggtggtggtgctcgggacggggtgggcggggtcgcgcctcatgaaggacctcgacaccaccggctacgacgtcgtctgcgtctccccgcgcaaccacatggtcttcacgccgctgctcgcctccacctgcgtcggcacgctcgagttccgctccgtcgccgagccgctcgcgcgcatccagcccgccgtctcccgctcccccggctcctacttcctcctcgcccgctgcaccgccgtcgaccccgacgcgcacacgattgattgtgagacagttactgagggtgagaaagataccttgaagccgtggaaattcaaggtttcgtatgacaagttggtctttggatgtggagctgaggcatcgactttcggtatacgtggtgttactgaacatgcaacctttcttcgggaagttcacgatgctcaagagatccgcaggaagctccttctgaatctgatgctgtctgatgtacccggcatatcagagggtgagaagcgcaggctattgcactgtgttgttgttggaggtggtccaacaggggttgaatttagcggggaacttagtgatttcatcatcagagatgtgaaagaacgttactcacatgtgaaagattatgtccatgtgaccctgattgaggcaaatgagatattgtcatcctttgatgttcgcctcaggcagtatgctataaaccaactagttaagtcaggtgttagacttgtacgaggaatcgtgaaggatgtacaacctgacaaactaatcctggacaatggagaggaggttccttatggtttgctggtatggtctactggagttggtgcttcatcattcgtcaagtcattgccatttcctaagtcccacggaggaaggatcggtgtagatgagtggttacgtgttccttctgtcccagatgtattcgctgttggtgattgctgtggattccttgaaagcactggcaaggaagttctcccagccttagctcaggttgccgagcggcaaggcttgtacctcgctcgcctgctcaaccgtgtgatgaaatctggaggagggcacgcaaactcccaggtcgaagtcgatctaggtccaaagtttgtgtataagcatctagggagtatggcaaccgttggaaggtacaaagctctggtagacctgaggcaaagcaaggactcgaagggcatatccatcgcaggatttgcaagctggttcatctggcgctcagcgtacctgactcgtgttgtcagctggagaaataggctctatgtggctatcaactggctgaccacgatgatattcggccgtgacataagccgtatctagggtatctacctgtagatctctgggctctgaactgtatgagtccgatacaatatataggccacgaacactaaaagaaatataggtcttgatcacattccatctttttttccctcctgctcctctctttatccctttcagacttgtcagccacgtgagttccaaatgcacaatctttttttttgtaaattatgaataaatgagatgcaatttgatgatcttcaagttacttggtgtgtacacgattgaatacttatgtaactgtagtttctttgctcaggaatgagtgattggtctccaagaaccttac

SEQ ID NO: 1980 - DNA, 1851 bp, Secale cereale
gactggcgggcccaacggcccccgttaactcgcctcactcatcgcactcgctcccgtggtgttcgcatctcgtcaagccatggccgcgtcctcctccctgctccgctcgctctcccgcgtctcgcgccgcggctgcgcgcccgcgttctacggccgcagcccgttctcgccgctctccaccgccgcggcggctgcggcggccgacgcgggggatgccgctgcgctggggagggggctcgcggggctggggccgacggccaagggggagaaggcgcgggtggtggtgctcgggacggggtgggcggggtcgcgcctcatgaaggacctcgacaccggcggctacgacgtcgtctgcgtctccccgcgcaaccacatggtgttcacgccgctgctcgcctccacctgcgtcggcacgctcgagttccgctccgtcgccgagccgctcgcgcgcatccagcccgccgtctccagctcccccggctcctacttcctcctcgcccgctgcaccgccgtcgacaccgacgcgcacacgattgattgtgagacagttactgaaggtgagaaagacaccttgaagccgtggaaattcaaggtttcgtatgacaagctggtctttggatgtggagctgaggcatcgactttcggtatacgtggtgttactgaacatgcaacctttcttcgggaagttcaccatgctcaagagatccgcaggaagctccttctgaatctgatgctgtctgatgtacctggcatatcagaggacgaaaagcgcaggctattgcactgtgttgttgttggaggtggtccaacaggggttgaatttagcggggaacttagtgatttcatcaccagagatgtgaaagaacgttactcacatgtgaaagattatgtccatgtgactctgattgaggcaaatgagatattgtcatccttcgatgttcgcctcaggcagtatgctataaaccaactagttaagtcaggtgttaagcttgtacgaggaatcgtgaaggatgtacaacctgacaaattaatcctggacaacggagaggaggttccttatggtttgctggtatggtctactggagttggtgcttcatcattcgtcaagtcattgccatttcctaagtcacccggaggaaggatcggtgtagatgagtggttacgtgttccttctgtcccagatgtattcgctgttggtgattgctgtggattccttgaaagcaccggcaaggaagttctcccagccttagctcaggttgccgagcggcaaggcttgtacctcgctcgcctgctcaacaatgtgatgaaagctggaggagggcacgcaaactcccaggtcgaagtggatctaggtccaaagtttgtgtataagcatctagggagtatggcaaccgttggaaggtacaaagctctggtggacctgaggcaaagcaaggactcgaagggcatatccatcgcaggatttgcaagctggttcatctggcgctcagcgtacctgacccgtgttgtcagctggagaaataggctctatgtggctatcaactggctgaccacgatgatattcggccgtgacataagccgtatctagggtatctatctgtagatatctgggatctgaactgtacgggttcgatacatacgcaaacactaaaagaaacataggtcgcgacttttttccactcctgctgctctctttatccctttcagacttgtcagccacgtgagttccaaatgcacaatctttttttctttttgtaaattatgaataaatgagatgcaatttgatggtcttgcagttacttagtgtgtacatgatgaatacttatgcaactgtagtttctttgcccagtc

SEQ ID NO: 1981 - DNA, 1658 bp, Triticum aestivum
cggctgcggcggccgacgcgagggatgctgctgtgttaccgagggggctcgcggggctggggccgacggccaagggggagaaggcgcgggtggtggtgctcggaacggggtgggcggggtcgcgcctcatgaaggacctcgacaccaccggctacgacgtcgtctgcgtctccccgcgcaaccacatggtgttcacgccgctgctcgcctccacctgcgtcggcacgctcgagttccgctccgtcgccgagccgctcgcgcgcatccagcccgccgtctccagctccccgggctcctacttcctcctcgcccgctgcaccgccgtcgaccccgacgcccacacgattgagtgtgagacagttactgaaggtgagaaagacaccttgaagccgtggaaattcaaggtttcgtatgacaagttggtctttggatgtggagctgaggcatcgactttcggtatacgtggtgttactgaacatgcaacctttcttcgggaagttcatgacgctcaagagatccgcaggaagctccttctgaatctgatgctgtctgatgtacctggcatatcagagggcgaaaagcgcaggctattgcactgtgttgttgttggaggtggtccaacaggggttgaatttagcggggaacttagtgatttcatcaccagagatgtgaaagaacgttactcacatgtgaaagattatgtccatgtgaccctgattgaggcaaatgagatattgtcatcattcgatgttcgcctcaggcagtatgctgtaaaccaactagttaagtcaggtgttaggcttgtacgaggaatcgtgaaggatgtacaacctgacaaattaatcctggacaatggagaggaggttccttatggtttgctggtatggtctactggggttggtgcttcatcattcgtcaagtcattgccatttcccaagtcacacggaggaaggatcggtgtagatgagtggttacgtgttccttctgtcccagatgtatttgctattggtgattgctgtggattccttgaaagcaccggcaaggaagttctcccagccttagctcaggttgccgagcggcaaggcttgtacctcgctcgcctgctcaaccgtgtgatgaaagctggaggagggcacgcaaattcccaggtcgaagtcgatctaggtccaaagtttgtgtataagcatctagggagtatggcaaccgttggaaggtacaaagctctggtggacctgaggcaaagcaaggactcgaagggcatatccattgcaggatttgcaagctggttcatctggcgctcagcgtacctgactcgtgttgtcagctggagaaataggctctatgtggctatcaattggctgaccacgatgatattcggccgtgacataagccgtatctagggtatctatctgagtatctgtagatctctgggatctgaactgtatgagttcgatacaatatataggccacgaacactacaagaaatatgggtctagatcatcttttttcccctcctgctcctctgtatccccttcagacacgtgagttccaaatgcacaatttttgtttttgtaaattatgaataaatgagatgcaatttgatgatcttcaagttacttggtgtgtacacgattgaatacttatgtaactgtagtttc

SEQ ID NO: 1982 - DNA, 2048 bp, Sorghum bicolor
gcgctctttgcatctccgggtccgtccacggtgtgaatcgcgtgctccgccgaacctcggaatagcccctcgaactgccccataactcccaccgcaccggtcgcctctccgcgccggcgaggtgacccgcgcgacgttgaccggggcgtgcgtccggccgcatcttgtcctccttcctcacggagcggagcgccgctcccaaatcgcagaacccgaaggcctcaaggcgggcgtagcgattagcgaagggatgtcggaggccgtcgccgagggcgagtcggccgtcgagctgctgctccgcgcggcggcgatggtgcccgcggagcgctacgcgctggccgccatcatcgtggcgttcgtctttctgtaccgcttcctcgagctccacgtcattggcgacatcctccgcggcttccggggcggccgcgtcgagctcaccttccaccccgcctcggagatctaccaccgcgtcgcgtccaggtgccgcttgctccacggcaggtatctggcgacgccatggctggcgagcccgcatttgcagacattgttcctgggaatccacgggatgccgccttcattcacgtacaaaagacagttgtacacagtttgtgatggtggaaccattgctttggattggctgctcgcatctgatttcgaagttgcggacggattcatttctgaagatgcttcaacaccccttgtagttgtggttcctggattaactagtgattcttccgctgcttatgcaaaacacttggtttattccatggcaagcaaaggatggaatgttgttgtaagcaaccacagaggtcttggtggtgtgtccattacttcagattgcttctataatggtggttggacagaagatgtcagagaggtcattaaatacctgcatcacagatatccgaaaaccccactgttttgcattggtacaagcataggtgccaatattgtggtcaagtatcttggagaagaaggagagaatactcctgtagctggtgcagtatctatttgctctccatgggatctgttgataggtgacagatttatttcccgcaagcttgtgcagcgtatttacgacaaagcacttgcaattggtctgaagggctatgcaaaattacatcaacctgtcttggcccgacttgcaaactgggaaggtattagaaagtcacgatctatccgggagtttgaccaccatgctacttgtgttattgcaagatatgagacagtggatacctactaccgccggtgcagcagtgctagttacgttggaaatgtttcagttcccttgctttgtatcagtgctttggatgatcccctttgcacaagggaggctattccttgggatgaatgcagggccaataagaacattgttttagcaactactccgaatggtggtcatcttgcattctttcaaggactaactgctcgaagactatggtgggttggagctacttctgagttcctttctgctcttcatgacagctcctacatgcataggcaaaaggcaaatgatcatgttttgcactcttctttggaatcctccattgataagagtccgtatgttaatctcatggaagatggaatggtagctgcagtaacagaagatggccctggcaatgatggctcacctttgaaccatgcagttgatgaagaacaattaagtaacgaggtgggcggtagacgacagaatgtggtatctgcgttgaaccacaatgaaaaggccagtggagtggggaacgaatgccctgcagcggcaacaaaacagcaaggtgatgacgtccacagcaataagcttcatgagatcattgctcctgtcaagagatctataaaccaactgactcgataccaagggaggtcagtctggttgcttgcctatattgcttttgtaacatcctggccgctccttggctccctagctttcatcacctttcggaaaaagttcaggaatccgttgcgagctaaatgaaccctacatgtatatatattattacagttacatcatgcaataccacccttgaagtacaaaggccattttttttccaggt

SEQ ID NO: 1983 - DNA, 2859 bp, Panicum virgatum
ccctagatgcatcacatcaccttacaaactcgcgagcatgtttgagtactggttgaatatgaatactggttgtcatctttttcatgcttgtagaagacataagtgagcatgtttgaatgttttcgtataccatttttatcaatataatgataagatgtttggttgaagaaacacgtggtgcggatccacaattctcaagtttggtgtgtcaagaccacaaaatcaactaatccggcgctagatccaaatgcatccttgactctggaatttaggcttggcgtaatggcgtcctctcggaaaacgacgctcactttccttcaaaaaaaaatgaaaacgacgctcacgtggatggttgctcaaccgctcttcttggccgcaccaaaagatggggaacgccggccctctgaaagtgagcccagacatataatctccactcagctcacgggtcgctccgcttggcgtgaagcccgagtgcccgacgagggtacgcgacgtcacgtctcccaccagagccacgactatctcaaaaaaaaaaaaccagagccacgtgtgtacccgacatccatgccccaccgcgtcacttacgcgaaggtcacttcaaacaaggggacccgggcgctctttgcctctccgtccaccgtgtgaatcgcgtgcggcgtgctccgccggacttcgggatagccgctcggtcggcttcataactcccaccgcacgggtcgcctccgcgcggcggcgaggagggctccacgacggagaccagtgcgtgcgggtgggcgggcgggctcatcttttatcgtgcgcccgcactgagcggatcgctgctcccaaatcgcagaccccagggcgcgcgttgcttccccggcgcagcgcaggatgtcggactcgcaggccgtcgccggcggcgagtcgcccgccgagctgctgctccgcgcggcggcgatggtgcccgcggagcgctacgcgctcgccgccgtcgccgtcgtgtcggtcttcctgtaccgcttcctcgagctccacgtcatcggcgacgccctccgcggctttcggggcggccgcgtcgagctcacctttcacccggcctcggagatctaccaccgcgtcgcgtccaagtgccgctccctccacggcaggtacctggcgacaccatggctggcgagcccgcatctgcagacattgttcctcggcatctctgggaggcccccatcattcacgtataagagacaactgtacacagtccatgatggtggaaccattgctctggattggcttcttgcctctgatctggaagctgcagacggtttcatttctaaagatgattcaacaccccttgtagttgtggttcctggattaactagtgattctgctgctgcttatgtaaaacactcggtttattctatagcaagcaaaggatggaatgttgtcgtaagcaaccacagaggtcttggtggtgtgtccattacttcagattgtttctacaatggcggttggactgaagatgtccgagaggtcattaaatacctccatcaaagatacccacagaccccactgttctgcattggtacaagcataggtgccaatattgtggtcaagtatcttggagaagaaggcgaaaatactcccgtggctggagcagcgtctatttgttctccatgggatctattgataggtgacagatttatttctcgcaagcttgtgcaacgtatttatgacaaagcacttgcaattggtctgaagagctatgcaaagctacatcaacctgtcttggcccgacttgcaaattgggaaggtattagaaagtcacgatctatccgggaattcgaccaccatgctacctgcgttgttgcaagatatgagacggtggatacctactaccgccagtgcagcagtgctagttatgttggaaatgtgtcagttcccttgctttgtatcaatgctttggatgatcccctttgcacacgggaggctataccttgggatgaatgcagggccaataagaacattgttttggcaactactccaaatggtggccatcttgcattctttcaaggactaactgctggaagattatggtgggttggagctgcttctgagttcctctttgctcttcatgaaagctcttacatgcatcggcagaaggcaaatgatcatgttttgcactcttctttggaatcatctattgataagagcccatatgttaatatcatggaagatggaatggtagctccagtaacaaaagatggccctggcaataatgatggctcaccttctgaccatgaggttggagtacagttaagtaacggggtgggtggcagacaacagttagaagtatctggcgagaaacataatgaacaagtaagtggagcagggaacgaaagccccgctggttctgcgaatcggcaaggagatgacatctacagtaataagcttcatgagataattgctcccgtcaagagatccataaaccaactgacacggcaccaagggaggtcaatctggttgcttgcctacattgcttttgtaacatcatggccgctcctcggctccctagcttttatcacgtttaggaaaaagttcagaaatccgttgcaagctaaatgacttaacaggataataaaccctacttgtattcagttcgattgcatcatgcaaaacattagaaacctgaaggcctgtgcatccatttgatttcttcagttacacctatatgtccagaatataagctgccctgctaatggtacatgtacacatccaaataatttcactgcatcacgaagaaaagcttgtattcatctgctaactggaatctggtgtaagaaacatgtcgatgaggaacatgtttttttttccaaatttaaatga

SEQ ID NO: 1984 - DNA, 2274 bp, Setaria italica
gggacccccgggcgctctttgcctctccgctcgtccaccgtgtgaatcgcgtgctccgccgatcctcggaatagccgctcggaccgctccataaactcccaccgcaccggccgcctcggcgcggcggcgacgaggacttgaagagcacgcgacggggaccagtgcgtgccccacaggcccacactgagcggatcgttgctcccaaatcgcagaccccaaggaaggcgaggcatcgcttccccggcgcggcgcaggatgtcgggctcggaggccgtcgccgggggcgagtcggccggcgagctgctgctccgcgcggcggcgatggtgcccgcggagcgctacgcgctcgccgccgccgccgtcgtctcggtcttcctgtaccgcttcctcgagctccacgtcatcggcgacatcctccgcggctgtcggggcggccgcgtcgagctcaccttccacccggcctcggagatctaccaccacgtcgcgtccaagtgccgctccctccacggcaggtaccttgcgacaccatggctggcgagcccgcatttgcagacattattcctgggcatctctgggaggcctccatcattcacgtacaagagacagttgtacacagttcgcgatggtggaaccattgctttggattggcttctggtctctgatctggaagatggagatggtttcatttctgaaaattcttcaacaccccttgtagttgtggttcctggattaactagtgattctgctgctgcttatgtaaaacacttggtttattctatagcaagcaaaggatggaatgttgttgtaagcaaccaccgaggtcttggtggtgtgtccattacttcagattgcttctacaatggcggttggactgaagatgtccgagaggttattaaatacctccaccacagatatccgaagaccccactgttctgcgtcggtacaagcataggtgccaatattgtggtcaagtatcttggagaagaaggtgaaaatactcccgtggctggagcagcagctatttgttctccatgggatctgttgataggtgacagatttatttcccgtaagcttgtgcagcgtatttatgacaaagcacttgcaattggtctgaagggctatgcaaaactacatcaacctgtcttggcccgacttgcaaactgggaaggtattaaaaagtcacgatctatccgggaattcgaccaccatgctacttgtgttgtttcaagatatgagacggtggatacctactaccgccggtgcagcagtgctagttacgttggaaatgtgtcagttcccttgctttgtatcaacgctttggatgatcccctttgcacaagggaggctataccttgggatgaatgcagggccaataagaacattgttttggcaactactccgaatggtggtcatcttgcattctttcaaggattaactgctagaagattatggtgggttggagctgcttctgagttcctctttgctcttcatgacagctcctacatgcattggcagaaggcaaatgatcatgttttgcactcttctttggaatcatccattgataaaagtccatatgttaatatcatggaagatggaatggtagctccagtaacaaaagatggccctggcaataatgatggctcaccttctaaacatgaggttgatggagtacagttaagtaacggggtgggtggcagacaacagttagaagtatctggcgagaaacatgatgaacacgccaatggaacagggaatgatagcactgcaggttctgcaaatcggcaaggtgaagacgtctacaataacaagctccatgagataattgctcccgtcaagagatccataaaccagctgacacgataccaagggaggtccgtctggttgcttgcctatattgcgtttgtaacatcatggccgctccttggctccctagcttttatcaccttccggaaaaagttcaggaatctgttgcgagctaaatgataagtaaaccctacttgtatttattttgactgcgtcatgcaaaaccttaggacctgaaggcctgtacagccacttgatttcttcagttacccacagaacttgtataaaattgcaccacccacctatatgtacaggatataagcagtcatgctcgcggtacatgtacagatccaaataatttcgctgcatcacgaagaaaagcttgtattcatttgctcaccggaagttggtgtaagaaagatgtagatggtggccatgttttatccaagtttaaatagatttttatccaag

SEQ ID NO: 1985 - DNA, 1902 bp, Pennisetum glaucum
cgccgctgccgccgtcgtgtcggtcttcctgtaccgcttcctcgagctccacgtcatcggcgacatcctccgcggatgccggggcggccgcgtcgagctcaccttccacccggcctcggagatctaccaccgcgtcgcgtccaagtgccgctccctccacggcaggtacctggcgacaccatggttggctagcccgcacttgcagacattgttcctgggcatctctgggaggcctccatcattcacatacaagagacagttgtacactgttcgtgatggtgggactgttgctttggattggcttctggcctctgatacggaagatgcagatggtttcatttctaaagatgcttcaacaccccttgtagttgtggttcctggattaactagtgattctgctgctgcttatgtaaaacacttagtttattctatagcaagcaaaggatggaatgttgttgtaagcaaccacagaggtcttggtggtgtatctattacttcagattgcttctacaatggcggttggactgaagatgtccgagagattattaaatatctccaccaccgatatccaaagaccccactgttctgcgttggtacaagcataggtgccaatattgtggtcaagtatcttggagaagaaggggaaagtactcctgtggctggagcagcagctatttgttctccatgggatctgttgataggtgacagatttatttcccgcaagcttgtacagcgtatttatgacaaagcacttgcaattggtctgaagggctatgcaaagctacatcaacctgtcttggctcgacttgcaaactgggaaggtattaaaaagtcacgatctatccgggaattcgaccatcatgctacttgtgttgttgcaagctatgagacggtggatacctactaccgacggtgcagcagcgctagttatgttggaaatgtgtcagttcccttgctttgtatcaatgctttggatgatcccctttgcacaaaggaggctataccttgggatgaatgcagggccaataagaacattgttttggcaactactccgaatggtggtcatcttgcattctttcaaggactaactgctgggagattatggtgggttggagctacttctgagttcctctttgctcttcacgacagctcctatatgcatcggcagaaggcaaatgatcatgctttgcactcttctttggaatcatccattgatagaagtccatatgttaatgtcatggaagatggaatggtagctccagtaacaaaagatggccctggcaataatgacggcccaccttcgaaacaagaggttggagtacagttaagtaacggggtggatggcagacaagtatctggcgagaaacaagatgaacacgccaatgcaacagggaacaaaagcactgcaggttctgcaaatcatcaaggtgacgacatctacagaaataagctccatgagataattgctcccgtcaagagatccataaaccaactgacacgatatcaagggaggtcagtctggttgcttgcctacattgcttttgtaacatcgtggccgctccttggctccctagcttttatgacctttcggaaaaagttcaggaatccgttgcgagctaaatgactaagagggaatccactgcatcatgcaaaaccttagaatcctgaagatctgtacagtcatcttatttcttcagttactcacagatcctgtgtaaaatttcaccacagttatttgtccaggacataagctgtcatgctcgtggtacatgtacacgtccaaataatttcactgcattatgaagaagactctttattcatttgctcatcggaattgggtgtaagaaagatgtagatgggggccatgtttttatcaagtttagttgaccattcgaaatgaaa

SEQ ID NO: 1986 - DNA, 1791 bp, Setaria italica
caattcccaaaaggttccagcctcgcgttgctatcgcccatcagtgattcagtgcatctctcacgtcactatgcgagctctcctgtcccgcatccacccgcccgcggccatctccaccacatccttcctctccacctccctcgcggcctccagaaccctacccccgagccccaccctcgtcccgctccgcctcgtccgccgcttcgccgccatggccgccagcgccgcggaggagtttgtgaagggccgcctcttcccgaacggcgtcgcggtcatcacgctcgaccgccccaaggccctcaacgccatgaacttcaaatggatgttagatacaaggcacttcttgatgaatgggaaacaaatccaagcatcaagtgtattcttgtggaaagcagctctccccgtgccttctcagctgggatggatattaagggtgttgccgcggaaatacaaaaggacaaaagcacaccacttgtgcaaaaggtcttcacagcagaatactctttgatttgcaagatacatgagtatgcaaaaccttatatatgcttgatggatggagtgacgatgggatttggaattggtctatcaggacatggtcgctaccgcattattactgagaagacgctcctagccatgcctgaaaatggtattggcctgttcccagatgttggctttgcttacattggtgcaaaagccccaggagcgggcgcagttggagcttaccttggaattacggggaaaagaatatcatcacctgctgatgctctgttcataggccttggtactcactatgtaccttctggaaatttgggctcactgaaggaatccctcttgagtgctaactttacaaatgatccgcatagagacgttgagtcaatcctgacaggatacaagaaagaaccagaatctgagccacaactagaaaagcttttaccacagatcatttcttcttttggtcctgataagtcagttgctgaatctgtggaagagctaaagaagtgtagtcaaagtgatgatgctgcagtggcagaatgggccaatgaagctttagcaggaataaagaaaggtgctccattttccctttgtttaacacagaggcatttctctcaagttgcatctgcgtacgggaacagtgaacactatttatctaagctggctggtgttatgaaattggaataccgcattgccttgaggtcatcggttagaaatgattttgttgaaggtgtacgtgctgttttagttgacaaggatcagaatcctaagtggaatccagccactctggaagaagtaaacatgggtgaggttgaatcagtttttgagccattaggtgctgaggctgagttgagtgtgtaaactttccatggcaacatgtaggactatcgctacatgaacttcggttctcttattcatggtgcaataagaaactataaacagagatacctgcctatactgaacccataaatactgtttcttcagaaaataattgaagtggtaccgtttcatcaaaatggtacatgagaatccaggtctgtagcttacccttctgttccaatatgttcccccaatccccctgtttgccacttcgatggatattccagccattgtaccagaatgatgatgacctggctattctagaagagcttgccattgggcagctatctacaaatccatgtaatatggcaaactggggtacagaaaccattggtttggccagcagattccaaaggcatgtctagaacaggcgctcaactgacgtgcgcaggtattatatgaatatggcaatatggcatc

SEQ ID NO: 1987 - DNA, 1988 bp, Sorghum bicolor
cggaaaaaaaaaacgagccaatccccaaaagttccagtcacctgctggcatcggtgatcagtcagctcacatcgcaatgcgagctctgctccggatccactcgcccgcggtcatctccaccgcatccttcctccacacctactcaaccgccgcctccaagatcctagccccgagccccaccttcgtcccgctccggctcatccgccgcttcgcggccatggccgccaccgccgcggacgagttcgtgaagggccgcgtcttccccaacggcgtcgccgtcatcacgctcgatcgccccaaggccctcaacgccatgaacgtcgaaatggatgttagatacaaggcacttcttgatgaatgggaagcaaatccaagtgtcaagtgtattcttgtggaaagcagctcttctcgtgccttctcagcagggatggatattaagggggttgctgcggaaatacaaaaggacaaaaacacaccacttgtgcaaaaggtcttcacagcagagtactccttgatttgtaagatacatgagtatgcaaaaccttatatatgcttgatggatggagtgacaatgggatttggaattgggctatcagggcatggccgctaccgcattattactgagaggacactcctagccatgcctgagaatgctattggcctgttcccagatgttggttttgcttacattggtgcaaaagccccaggagggggcgcagttggagcttaccttgggattactggaaaaaggatatcatcacctgctgatgctatgtttataggccttggtactcattatgtaccttctgcaaatttgggttcactcaaggaatccctcctgagtgctaacttcacccatgatcctcatagagatgttgagtcagttctgacaggatacaagaaagaaccagagtctgaatcacaactagaaaagcttttgccatatatcatttcttctttcagtcctgataaatcagtagctgaatctgtggaagagctaaagaaatgtagtcgaagtggtgatgctgcagtggcagaatgggccaatgaagctttagcaggaattgagaaaggtgctccattttctctttgtttaacacagaagcatttctctcaagtggcatcagcgtacaggactagtgaacactatttatctaagctcgctggtgttatgaaattggaataccgcattgccttgaggtcgtcggttagaaatgattttgttgaaggcgtacgtgctgttttagttgacaaggaccagaatccgaagtggaatccagccactctggaagaagtaaacatgggcgaggttgaatctgtttttgagccattaggtgctgaggctgagttgagtgtgtgaactttccatggcctgccactatctgaacatcagttttcttattggtggtgcaataataatctacaaaacagaaatgtgatgcccacagaacgaacaattactgtttctaaataaactaactgaagtggttccattttcttgaaagggcacatgaaaatctaggtctgttgcctgctcttttgtctccaatatggttcccctgtttccgctgggatattccagccatggtaccaggagtgactcgactaaatgctctagaagtgtgtgtgtcacgggtagagctttgtgttacatgtagtttgatgtgagtagtgtaataataactgggtacgaaaaccatggtttcgccagcaaaaaggcgtgtttagaacaagtgtacaacagacgtgctcaggtatcatatgaatatattgcaaatgctacaagaaactcttctggaaggcctagcaagtagcaaagcgactgtcgtaccacaacagggacgtctgtcccgggggcttgacgccgggaccggccgaggcagataagcgctttcgttttcggctttgaagtcgctgcggttttgctagctctaaaaaagtttttgcaaaaagtttcagatttttcgtcatatcgaatcttacagtac

SEQ ID NO: 1988 - DNA, 1588 bp, Saccharum officinarum
gcgagctctcctccggatccacccgcccgcggtcatctccaccgcatccttcctccacacctcctcaaccgccgcctccaagaccctagcccccagccccaccttcgtcccgctccggctcgtccgccgcttcgcggccatggccgccaccgccgcggacgagttcgtgaagggccgcgtcttccccaacggcgtcgccgtcatcacgctcgaccgtcccaaagccctcaacgccatgaacctcgaaatggatgttagatacaaggcacttcttgatgaatgggaaacaaatccaagtgtcaagtgtgttcttgtggaaagcagctcttcgcgtgccttctcagcagggatggatattaagggggttgccgcagaaatacaaaaggacaaaaacacaccacttgtgcaaaaggtgttcacagcagagtactccttgatttgtaagatacatgagtatgcaaaaccttatatatgcttgatggatggagtgacaatgggatttggaattgggctatcagggcatggccgctaccgcattattactgagaggacactcctagccatgcctgagaatgctattggcctgttcccagatgttggctttgcttacattggtgcgaaagccccaggagggggtgcagttggagcttaccttgggattactggaaagaggatatcatcacctgctgatgctatgtttataggccttggtactcattatgtaccttctgcaaatttgggttcactcaaggaatccctcctgagtgctaacttcaccaatgatcctcatagagatgttgagtcagttctgacaggatacaagaaagaaccagagtctgaaccacaactagaaaagcttttgccatatatcgtttcttctttcagtcctgataaatcagtagctggatctgtgcaagagctaaagaaatgtagtcaaagtggtgatgctgcagtggcagaatgggccaatgaagctttagcaggaattgagaaaggcgccccattttctctttgtttaacacagaagcatttctctcaagttgcatcagcgtacgggactagtgaacactatttatctaagctggctggtgttatgaaattggaataccgcattgccttgaggtcgtcggttagaaatgattttgttgaaggtgtacgtgctgttttagttgacaaggaccagaacccgaagtggaatccagccactctggaagaagtaaatatgggcgaggttgaagcagtttttgagccattaggtgctgaggctgagctgagtgtgtaaactttccatggccctgccactatttgaacatcagttctcttattggtggtgcaatgataatctacaaaacagaaatgtgatgcccacagaacccacaattactgtttcttcataaactaactgaagtggttccattttcccgaaagggcacatgagtctaggtctgttgcctgctcttttgtctccaatatggttcccctgttttccgctgggataccagccatgatgctctagaagcggttgcactgggcagagctttgattacatgtagtttgatgtgagtagtgtaataataactgggtacgg

SEQ ID NO: 1989 - DNA, 1574 bp, Oryza sativa
attttttgggggaaaaaaatgtactccaacaacacaccccctccaattctcaatagtcaatttcatcacattaatccccccccccccccccctctcgctctcggcttcttcctctccacatgggttgctctcacgtcactatgcgagctctcctctcccgcatccacccgcccggccccggatcgatctccaccacttccttcctccagtgcccctcctccaccgccgcatccgcctccaaaaccctagccccgaccctcaccttccgccgcttcgccgccatggccgccgccgccgcggaggagttcgtgaagggccgcgtcacccccaacggcgtcgccgtcatcaccctcgaccgccccaaggccctcaacgccatgaacctcgaaatggaccttcgatacaaggcatttcttgatgaatgggaaacaaatccaagtgtcaagtgtgttcttgtggaaagcagttcaccccgtgccttctcagctgggatggatattaagggtgttgcagcagaaattcaaaaggacaagagcacaccacttgtgcaaaaggtcttcacagcagagtactctttgatttgtaagattcatgagtatacaaaaccttatatatgcctgatggatggtgtgacaatgggatttggaattggattatcagggcatggccgctaccgcattattactgagaggacgctcctggctatgccagaaaatggtattggcttgttcccggacgttggctttgcttacattggtgccaaagctccaggaggtggtgctgttggatcttaccttgggatgacagggaaaaggatatcatcacctgctgatgcccttttctttggtcttggaactcattatgtaccttcagcgaacctgggacctctcagggaatccctcttgagtgctaacttcacagatgatcctcacagagatgttgagtcattgctgacaaagttcaagaacgagccagagtcagggccccagctagataagtttttaccatatatcatttcttcctttggtcctgacaaatcagttgctgaatctgtggaagagcttaagaagtgtagtcaaagtgatgatgctgcagtggcagaatgggccaacgaggccttggcaggactcaaaaaaggggctccattttctctatgtttaactcaaaaacatttttctcaagttgcatcagcatataggaataatgaacactatctatcgaagttggctggtgttatgaaagttgaatatcgaattgccttgaggtcatcggttcgaaatgattttgttgaaggtgtacgtgctgtcttagttgacaaggaccagaatccaaagtggaagccagcaactctggaagacgtggacaagggtgaggtggaatcagtttttgaaccattagctgctgaggctgagttaaatgtatgatcttcacagcaaacatgtaatattattggtaccggaataccctcttcaatttccctgttatgttgcaataagaaataacaaggataaaaatgatgattattgagccaataaataatatcatgattacagtatttgtgacttactgaagta

SEQ ID NO: 1990 - DNA, 1647 bp, Brachypodium distachyon
aaaatcaaatcaaattatctcattgttcatctccatcggctacggcacttcagccggcgagtaacccactctagaaaaatcctattactcggctcggagcttcgtcctccagtctcagtcacgtcgctatgcgagctctgctctctcgcatcccgatctcaacagcttccttctcctcctcctcctactccgtcgccacctccaaaaccctagccccgagccctatcctcgtcccgctccgcctcgtccgccgcttcgctgccatggccggcgccgccgtggaggagttcgtgaagggccgcgtcttccccaacggcgtcgctgtcatcaccctcgaccgccccaaggccctcaacgccatgaatctcgaaatggatcttaggtacaaggcactacttgatgattgggaaacaaatgcgaatgtgaagtgcattcttgtggaaagcagttctccacgtgccttctcagcagggatggatattaagggtgttgcagcagaaattcaaaaggacaagagcacatcacttgtggaaaaggtcttcacagccgagtactctttgatttgtaagatacatgagtatgtaaaaccctacatttgcttgatggatggagtgaccatgggatttggaattggattgtcaggacatggccgctaccgtgtgattaccgagaggactctcctggccatgccagaaaatggtattggcttgttcccagatgttggctttgcttacattggtgcaaaagctccaggagggggtgcagttggagcctaccttgggatgacagggaaaaggatatcttcacctgctgatgctctgttcataggtcttggaactcactatgtaccttctggggacttggggtcgctcaaggaatccctcttgagtgctaacctcactgctgatcctcacaaagatgtcgaaacactcctggctgggtacaagaaggagccagagacagagccacaactagaaaagcttttacaacatattatttcttcttttggtcctgataaatcagctgctgaatctgttgaagagctaaaaaagtgtagccaaagtggtgatgctgcagtggcagaatgggccaatgatgctttagcaggacttaagaaaggtgccccattttctctttgcctaacacagaagcatttctctcaagttgcatcagcgtatgggaacaatggacacggtctatctaagttggctggtgttatgaagatggaatatcgcattgccttgaggtcatcagttcgaaatgattttgttgaaggtgtacgtgctgtcttagttgacaaggaccagaatccaaagtggaatccaccaactctggaagatgtaaataccgatgaggttgaatcgatttttgaaccattagctgctgaagctgagttgaatgtatgattttctacagcaacccataatgttactactgcctgaatattccttagtatttaagatattacaaacatgaatactatacccatcgaaccaataaataaatgcttgaaatacagtatctgaaaccagttgaagtatcgccatttgattcagtcatttctttgaccaaaactgaacatcaggattcgggtttgccttctgcggtgccactggccagcgtttcataccatatgacatgtgccat

SEQ ID NO: 1991 - DNA, 1516 bp, Avena sativa
aatcatattgctcggctgagcgcctcgtcatctcgctttcagagtcacgtcgctatgcgagctctgctctctcgcatcccgatctccaccaccgcttccttcttccactcctcctccccggccaaaaccctagccccgacccctagcttcgtcccgctccgcctggtccgccgatttgccgccatggccgccgccgccgcggatgagttcgtgaagggccgcgtcttccccaacggcgtcgccgtcatcaccctcgaccgccccaaggccctcaacgccatgaacctcgaaatggaccttagatacaaggcatttcttgatgattgggaaacaaattcaaatgtgaagtgcattcttgtggaaagcagttctccacgtgctttctcagctgggatggatattaagggtgttgcagcagaaattcaaaaggacaagagtacatcacttgtgcaaaaggttttcactgctgagtactctttgatttgtaagatacatgagtatgcaaaaccttatatatgcttgatggatggagtgaccatggggtttggaattggattgtctggacatggccgctaccgcataattaccgagagaacactcatggccatgccagaaaatgctattggcttgttcccagatgtgggctttgcttacattggtgcaaaagcgccaggagggggtgcagtcggagcttaccttgggatgacaggaaaaaggatatcttcacctgctgatgctctgtttataggtcttggaacccattatgtaccttccgtggacttgggctccctgaaggaatccctcttgagtgccaaattcactgctgatcctcacaaagatgttgagtcacttctgactgggtacaagaaggaacctgagtcagtgtcccagttagaaaagcttttaccaaatattgtttcttcgtttggtcctgataaatcagctgctggatccgtcgaagagctaaagaagtgtagtcaaagtggtgataccgaagtggcagaatgggccaatgatgctttagcaggacttaagaaaggggctccattttctctttgtttaacgcagaagcatttctcccgagttgcatcatcatatgggcataatgaaaaccatctatctaagttggctggtgttatgaagttggaatatcgcattgccttgagatcgtcggttcgagatgattttgttgaaggtgtacgtgctgtcttagttgacaaggaccagaatccaaaatggaatccaccaactctggaagacgtaaacatggacgaggtcgaatcagtttttgaaccattagctgccgaggcagagttgaatgtatgattttctgtagcaacccagagttttatgactacctgaacatctgttttggttcgatgatgtagttggaaattgaaaacataaatacgctgttcagtgattgagccgataaatgcttaaagtaagttatatggaacaaattggagtgtaaccatttgagttggtgaccgattttcatgttgatgttgagctg

SEQ ID NO: 1992 - DNA, 1569 bp, Secale cereale
cttatcgtcctgcccacctgtcgcccagcacctcaccttcagtcacgtcgctatgcgagctctgctctctcgcatcccgatctccaccgctgccttcttctcctcctcatcctcccaaaccctagccccgagccctagccttgcccccctccgccgccgcttcgtcgccatggccgccgttgccgcggaggagtttgtgaagggccgcgtcttccccaacggcgtcgccgtaatcaccctcgaccgccccaaggccctcaacgccatgaacctcgaaatggacctgaggtacaaggcatttcttgatgaatgggaaacaaatccaaatgtgaagtgcattcttgtggaaagcagttctccccgcgccttctcagctgggatggatattaagggtgttgcagcggaaattcaaaaggacaagagcacatcacttgtgcaaaaggtcttcacagctgagtactctttgatttgcaagatacatgagtatgcaaaaccttatatatgcttgatggatggtgtgaccatggggtttggaattggattgtctggacatggccgctaccgcattattacggagagaacactcctggccatgccggaaaatggtattggcttgttcccagatgttggctttgcttacatcggtgcaaaagcgccaggagggggtgcagtcggagcttaccttgggatgacaggaaaaagaatatcttcacctgctgatgctctgttcataggtctcggaacccattatgtaccttccggggacttgggttcactcaaggaatccctcctgagtgctaacttcaccgctgatcctcacaaagatgttgagtcactcctgactgggtacaagaaggaacctgagtcggtgccccaattagaaaagcttttaccggatatcgtttcttcttttggtcctgataaatcagctactgaatctgtggaagagctaaagaagcgtagtcaaagtggtgatgccacagtgtcagaatgggccaatgatgctttagcaggacttaagaaaggtgctccgttttctctttgtttaacacagaaacatttctctcgagttgcatcgtcatacgggaacaatgaaaattatctatctaagttggctggtgttatgaaattggagtaccgcattgccttgagatcgtcggttcgaagtgattttgctgaaggcgtacgcgctgtcttggttgacaaggaccagaatccaaaatggagtccagcaactctggaagacgtaaacatggatgaggtcgaatcagtgttcgaaccattagctgccgatgctgagttgaatgtgtgattctctgtagcagcccagaatgctatgaccacctgaacgccctttatccttccgatgatgtaataggaaattacaaacatacatacggctatccattgagccaataaatatgcctggagtgcattgtctgaaaacagagtttgattatcagcatttgatgcagtggtttatttgatggagctttagcacatgggtgttcaggattttacttctgcagtgccactgggcagtgtgcatcatacatattacttgcttga

SEQ ID NO: 1993 - DNA, 1782 bp, Triticum aestivum
ccacgcgtgccgtcctcaatctctgttttaaaacaacggcattttgcccaaaccacttagtcagtgtccacctgtcgcccagcacttcaccttcagtcacgtcgctatgcgagctctgctctctcgcatcccgatctccaccgctgccttcttctcctcctcccaaaccctagccccgagccctagcctcgcccccctccgcctcggccgccgcttcgtcgccatggccgccgccgccgcggaggagttcgtgaagggtcgcgtcttccccaacggcgtcgccgtcatcaccctcgaccgccccaaggccctcaacgccatgaacctcgaaatggaccttaggtacaaggcatttcttgatgactgggaaacaaatccaaatgtgaagtgcattcttgtggaaagcagttctccccgcgccttctcagctgggatggatattaagggtgttgcagcggaaattcaaaaggacaagagcacatcacttgtgcaaaaggtcttcacagctgagtactctttgatttgcaagatacatgagtatgcaaaaccttatatatgcttgatggatggtgtgaccatggggtttggaattggattgtctggacatggccgctaccgcattattacggagagaacactcctggccatgccggaaaatggtattggcttgttcccagatgttggctttgcttacatcggtgcaaaagcgccaggagggggtgcagtcggagcttaccttgggatgacaggaaaaagaatatcttcacctgctgatgctctgttcataggtctcggaacccattatgtaccttccggggacttgggttcactcaaggaatccctcctgagtgctaacttcactgctgatcctcacaaagatgttgagtcactcctgactgggtacaagaaggaacctgagtcggtgccccaattagaaaagcttttaccggatatcgtttcttcttttggtcctgataaatcagctactgaatctgtggaagagctaaagaagcgtagtcaaagtggtgatgccacagtgtcagaatgggccaatgatgctttagcaggacttaagaaaggtgctccgttttctctttgtttaacacagaaacatttctctcgagttgcatcgtcatatgggaacaatgaaaattatctatctaagttggctggtgttatgaaattggagtaccgcattgccttgagatcgtcggttcgaagtgattttgctgaaggcgtacgcgctgtcttagttgacaaggaccagaatccaaaatggagtccagcaactctggaagacgtaaacatggatgaggtcgaatcagtgtttgaaccattagctgccaacgctgagttgaatgtgtgattttctgtagcagcccagaatgctacgaccacctgaacaccctttgtccttccgatgatgtaataaaaaattattacaaacatacatacggttatccattgagccaataaatttgcctggagtgcatagtctgaaaacaaagtttgattatcagcatttgatgcagcggtttatttgatggagctgaagcacatagattcaggttcagggttttacttctgcagtgccactgggtagtacgtcataccctatgacgtgcctgagaaaacactgaatcccaccggaagaacattgggattgaagaaacatggtccggccggcagattctaacagacgtgtacatgtatttagtacaactgacgtatccacactctaaaagtcttctttgagagcttggtaatgtggtagactagacg

SEQ ID NO: 1994 - DNA, 1473 bp, Pennisetum glaucum
gagagtatctgtgacgtcactatgcgagctcttctctcccgcatccacccgcccacggccatctccaccacacccttcctctccacatcccccgcggcctccagaaccctacccccgagccccaccatcgtcccgtttcgcctcgttcgccgattcgccgccatggccgccagcgccgcggaggagttcgtgaagggccgcgtcttccccaacggcgtcgccgtcatcacgctcgaccgccccaaggccctcaacgccatgaacctcgaaatggatgttagttacaaggcacttcttgatgaatgggaaacaaatccaggcgtcaagtgtattcttgtggaaagcagcactccccgtgccttctcagctgggatggatattaagggtgttgccgcggaaatacaaaaggacaaaagcacaccacttgtgcaaaaggtcttcacagcagaatactcgttgatttgcaaaatacatgagtacgcaaaaccttatatatgcttgatggatggagtgacgatgggatttggaattggtctgtcaggacatggtcgctaccgcgttattaccgagaagacgctcttagccatgcctgaaaatggtattggcttgttcccagatgttggctttgcttacattggtgcaaaagccccaggagggggcgcagttggagcttaccttggaattacgggaaaaagaatatcatcacctgctgacgctctgttcataggccttggtactcactatgtaccttctggaaatttgggctcactgaaggaatccctcttgagtgctaactttacaaatgatccgcatagagacgttgagtcggtcttgacacgatacaagaaagaaccagaatctgagccacaactacaaaagcttttaccacagatcatttcttctttcagtcctgataagtcagttgctgaatctgtggaagagctaaagaagtgtagtcaaagtgatgatgttgcagtggcagaatgggccaatgaagctttggcaggaataaaaaaaggtgctccattctctctttgtttgacacagaggcatttctctcaagttgcatctgcgtacgggagcagcgaacactatttatcgaagctggctggtgttatgaagttggaataccgtattgccttgaggtcatcgatcagaaacgattttgttgaaggtgtgcgtgctgttttagttgacaaggatcagaatcctaagtggaatccaaccactctagaggaagtaaacatgggtgaggttgaatcagtttttgagccattaggtgccgaggctgagttgagtgtgtgaactttcatggcagcatgtaggaccgtcgctacatgaacttcggttctattattatgcaataagaaactataaacagagatacctgcctactgaatcaaatagacactttttcttcagaaaataattaaaatgattgaagtggtaccgtttcatggaaatggtacacga

SEQ ID NO: 1995 - DNA, 1751 bp, Panicum virgatum
atgacaaactttttatcaaaaataatggcccgcccctccgcggccatcatctccaccgcacccttcctcctccccacctcccccgccgcctccagaaccctagccccgaccccgaccctcgccccgctccgcctcgtctgccgcttcgccgccatggccgccggcgccgccgaggagttcgtcaagggccgcgtcttccccaacggcgtcgccgtcattacgctcgaccgccccaaggccctcaacgccatgaacctcgaaatggacattagatacaaggcacttcttgatgaatgggaaacaaatccaagtgtcaagtgtattcttgtggaaagcagctctccccgtgccttctcagctgggatggatattaagggtgttgccgcagaaatacagaaggacaaaaacacaccacttgtgcaaaaggttttcacagcagaatactcgttgatttgcaagatgcatgagtatgcaaaaccttatatctgcttgatggatggagtgacgatgggatttggaattggtctgtcaggacacggccgctaccgtattattactgagaagacactcctagccatgcctgaaaatggtattggcctgttcccagatgttggctttgcttacattggtgcaaaagccccaggagggggtgcagttggagcttaccttgggattacgggaaaaaggatatcatcacctgctgatgctatattcataggccttggtactcactatgtaccttctggaagtttggggtctctgaaggaatccctcttgagtgctaactttacaaatgatccacacagagacgttgagtcagtcctgacaggatacaagaaagaaccagaatctgagccacaactagaaaagtttttaccacatatcatttcttctttcagtcctgataagtcagttgctgaatctgtggaagagctaaagaaatgtagtcaaagtggtgatgctgcagtggcagaatgggccaatgaagctttagcaggaattaagaaaggtgctccattttctctttgtttaacacaaaggcatttctctcaagttgcatcagcgtacaggaatagtgaacactatttatctaagctggctggtgttatgaaaatggaatatcgcattgctttgaggtcgtcggttagaaatgattttgttgaaggtgtacgtgctgttttagttgacaaggaccagaatccaaagtggaatccagcatctctggaagaagtaaacatgggtgaggttgaatcagttttcgagccattaggggccgaggctgagttgagtgtgtgagctttccgtggcaacatactacccttacctgatcttcagttttcttattcatggtgcaataagaagcgataaacagagatacctgcctactgaaccaatatataatgtttcttcaggaactaatgaagtggcactgaggatccaggtctgtagtttgcccttttgttcccatatatgttccccctgtttggcacagtggcacgatgatgacttggtgattctagaagagctttgccactgggcagcgatttacaaatacgtgtagtttcaaagaaactggggcacagaaaccatgggttcggccagcagatttcgaaggcatgtctagaacaactttacaactgacgtgctcaaatactatggccgtgtttagttccgttgcaaaaaaaattttgcaaaggaattttactaatttgaaatactaaatgaagtctatttacaaaactttttgcaca

SEQ ID NO: 1996 - DNA, 1453 bp, Panicum virgatum
agccgttctcacgtcactatgcgagctctcctctcccgcatccacctgcacccgcccgcggccaccgcacccttcctcctccccacctccccggccgcctccaaaaccctagccccgacccccgccctcgccccgctccgcctcgtccgccgcttcgccgccatggccgccggcgccgccgaggagttcgtcaagggccgcgtcttccccaacggcgtcgctgtcatcacgctcgaccgccccaaggccctcaacgccatgaacctcgaaatggacattagatacaaggcacttcttgatgaatgggaaacaaatccaagtgtcaagtgtattcttgtggaaagcagctctccccgtgccttctcagctgggatggatattaagggtgttgccgcggaaatacaaaaggacaaaaacacaccacttgtgcaaaaggttttcacagcagaatactcgttgatttgcaagatacatgagtatgcaaaaccttatatatgcttgatggatggagtgacgatgggatttggaattggtctgtcaggacatggccgctaccgtattattactgagaagacactcctagccatgcctgaaaatggtattggcctgttcccagatgttggctttgcttacattggtgcaaaagccccaggagggggtgcagttggagcttaccttgggattacaggaaaaaggatatcatcacctgctgatgctctattcataggccttggtactcactatgtaccttctggaaatttggggtctctgaaggaatccctcttgagtgctaactttacaaatgatcctcacagagacgttgagtcagtcctgacaggatacaagaaagcaccagaatctgagccacaactagaaaagcttttaccacatatcatttcttctttcagtcctgataagtcagttgctgaatctgtggaagagctaaagaagcgtagtcaaagtggtgatgctgcagtggcagaatgggccaatgaagctttagcaggaattaagaaaggtgctccattttctctttgtttaacacaaaggcatttctctcaagttgcatcagcgtacgggaatagtgaacactatttagctaagctggctggtgttatgaaaatggaatatcgcattgctttgaggtcgtcggttagaaatgattttgttgaaggtgtacgtgctgttttagttgacaaggaccagaatccaaagtggaatccagcatctctggaagaagtaaacatggatgaggttgaatcagtttttgagccattaggtgccgagactgagttgagtgtgtgagctttccatggcaacatgttggactacctgaacttcagttttcttattcatggtgcaataagaagcaataaactgagatacctgcgtactgaaccaataaataatgtttcttcagaaactaattgaagtggcactgagaatccaggcc

SEQ ID NO: 1997 - DNA, 1419 bp, Cenchrus ciliaris
  misc_feature (910)..(910): n is a, c, g, or t
  misc_feature (1399)..(1399): n is a, c, g, or t
ccaccacatccttcctctccacctctcccgcggcctccagaaccctacccccgagccccaccctcgcccccctccgcctcgtccgccgattcgccgccatggccgccaccgccgcggaggagttcgtgaagggccgcgtcttccccaacggcgtcgccgtcatcacgctcgaccgccccaaggccctcaacgccatgaacttcgaaatggatgttagatacaaagcacttcttgatgaatgggaaacaaatccaagtgtcaagtgtattcttgtggaaagcagctctccccgtgccttctcagctgggatggatattaagggtgttgctgcggaaatacaaaaggacaaaagcacaccacttgtgcaaaaggtcttcacagcggaatactctttgatttgcaagatacatgagtatgcaaaaccttatatatgcttgatggatggagtgactatgggatttggaattggtctatcaggacatggttgctaccgcattattactgagaagacgctcctagccatgcctgaaaatggtattggcttgttcccagatgttggctttgcttacattggtgcaaaagccccaggagggggcgcagttggagcttaccttggaattacgggaaaaagaatatcatcacctgctgatgctctgttcataggccttggtactcactatgtaccttctggaaatttgggctcactgaaggaatccctcttgagtgctaactttacaaatgatccgcatagagacgttgagtcagtcttgacagggtacaagaaagaaccagaatctgagccacacctagaaaagcttttaccacatatcatttcttctttcagtcctgataagtcagttgctgaatctgtggaagagctaaagaagtatagtcaaagtgatgatgctgnagtggcagaatgggccaacgaagctttagcaggaataaagaaaggtgctccattttctctttgtttaacacagaggcatttctctcaagttgcatctgcatacgggaacagtgaacactatttatctaagctggctggtgttatgaaattggaataccgcattgccttgaggtcatcagttagaaacgattttattgaaggtgtacgtgctgttttagttgacaaggatcagaatcctaagtggaatccagccactctggaagaggtaaacatgggtgaggttgaatcagtttttgagccactaggttctgaggctgagttgaatgtgtgaactttccacggctacatgtatgaccatcgctacatgaacttcagttctcttattcatgatgcaataagaaactataaacagagatacctgcctacaaaccaatagatactgtttcttcagaaaacaattgaaatgattgaagtggtaccgtttcatcnaaatggtacatgagaatcca

SEQ ID NO: 1998 - DNA, 1797 bp, Hordeum vulgare
acttgtcgtcctgcccacctgtcgcccaggacctcaccttcagtcacgtcgctatgcgagctctgctctctcgcatcccgatctccacctctgccttcttctcttcttcccaaaccctagccccgagccctagcctcgccccactccgcctcggccgccgcttcgtcgccatggccgccgccgccgcgggggagttcgtgaagggccgcgtcttccccaacggcgttgccgtcatcaccctcgaccgccccaaggccctcaacgccatgaacctcgaaatggaccttaggtacaaggcatttcttgatgactgggaaacaaatccaaatgtgaagtgcattcttgtggaaagcagttctccccgcgccttctcagctgggatggatattaagggtgttgcagcggaaattcaaaaggacaagagcacaacacttgtgcaaaaggtcttcacagccgagtactctttgatttgcaagatacatgagtatgcaaaaccttatatatgcttgatggatggtgtgaccatggggtttggaattggattgtctggacatggtcgctaccgtgttattaccgagagaacactcctggccatgccggaaaatggcattggcttgttcccagatgttggctttgcttacatcggtgcaaaagcaccaggagggggtgcagtcggagcttacctcgggatgacaggaaaaagaatatcttcacctgctgatgctctgttcataggtctcggaacccattatgtaccttcaggggacttgggttcactcaaggaatccctcctgagtgctaacttcactgctgatcctcacaaagatgttgagtcactcctgactgggtacaagaaggaacctgagtcggtgccccatttagaaaagcttttaccggatatcatttcttcttttggtcctggtaaatcagctactgaatctgtggaagagctaaagaagcgtagtcaaagcggtgatggcacagtgtcagaatgggccaatgatgctttagcaggacttaagaaaggtgctccgttttctctttgtttaacacagaagcatttctctcgagttgcatcgtcgtatgggaacaatgaaaatgatctatctaagttggctggtgttatgaaattggaataccgcatcgcgttgagatcgtcggttcgaagtgattttgctgaaggcgtacgcgctgtcttagttgacaaggaccagaatccgaaatggaatccagcaactctggaagacgtaaacatggatgaggtggaatcagttttcgaaccattagctgccgatgctgagttgaatgtgtgattttctgtagcagcccagaatgctatgatcacttgaacactctttatccttccaatgatgtaatacgaaattacaaatatacatatggctatccattgagccaataaacgcctggagtgcattgtctgaaaacagagtttgattatcagcatttgatgcagtgatttatttgatggagctgaagcacgtagattcaggctcaggattttacttctgcagtgccaccaggtagcgtgtgtcataccatatgacgtgcctgaggactgaatcccaccgggagaccgttgcccattgggactgaaaaaacatggtccggccagcagattctaacagccgtatacatgtatccagtacaactgacgtatctacacttacaaactctttgagagcttggtaatgggagactgacgaagctgccttgcgacggggaagacgggcacacgttctttcgttttcagctcttaattactttctctgtttcata

SEQ ID NO: 1999 - DNA, 3196 bp, Sorghum bicolor
agtggactaccgactgagagaccggcgttggaactttcccctaagcctcgctcaccgtcgctcaatcgccgaagccggcaactgacaccaaacgcatccgcttggtgtcttcccccggcgggcaacacctactccgtctcggcgcatcggcgtcgcgactcgcgcgcgagccacaccgtcgagcgcggacaccgtaccgccaggcgccagccacacggcacgttgagttgagttcagtcggtcacccaccggcaggcggcaggcatcgccgcaaaagcccggtcccccgctagctactgccgcgcagtcagggcgcactggggggcttgactcgtgtcgcgcatgacagcacccccccgtggaccgtgcggccgtggcatctctgcgcgcacggcgcaccggagaaaaaggctttggcttcccgtcgtgtcaaccccccgtgtttgtcgcctcgcccctgctcctcctctcgcggcggtctcgccgagttgcccatcgttccatccacggaggagggggcctacccccgccgcccgatccccgacccgaccgcgcaaactgcgacagcgaaagcggaaacgagctcgaatcccacgaatttcggccggtcccgtccgtcatttttgtatccgcggcgctgggacaccaacgcacgcacgcttatcggcattcattcggcaacccgcaaaaggccacggcgacgaccgctgccggagcctgccgtgccgcacaacgaaccgggcgcgcccgtccgtccgtccctggcccagaagatcccaaccccgtccgtccgtccgtcgcggactcccggctcggcgcctcgtccgttctgaatcggccgcgcgcgcgcgcggggtatcgcggcgtcgggggggtcggagctcccgggaaccagggcgcaagcgcaatggtggaggtggggaaccgggtgcgggggttcctgcacaaccggtggctggtgttcgtggcggcgatgtggatgcagtcctgcgcgggcgtcgggtacctcttcggcagcctctcgcccgggatcaaggcctcgctcgggtacaaccagcgccaggtggccgggctcggcgtcgccaaggacctcggcgacagcgtcggcttcctcgccggcacgctctgcgccgtgctcccgctctgggccgcgctcctcgtcggcgccgcgcagaacctcgtcgggtacggatgggtctggctcgccgtcacgcgccgcgtccccgtgcccccactctgggcgatgtgcattctaatcttcatcggtaacaatggtgagacgtacttcaacactgctgcccttgtctcatgtgttcagaacttccccaagagccgtggaccaattgttggtatcctcaaaggattcgctggattaagtggtgcaattctaacacagatttatgcaattgtacactctcctgatgatgctgcactcatcttcatggttgcggttggcccaacaatggttgttatagctttaatgttcattgtaagacctgttggaggccacagacaagtgcggccttctgatggcacaagtttcacatttgtatacagtgtctgcttgcttttggcggcttatcttatgggcgtcatgttattggaagaccttgtcgacttaagccagtcagtgactgtcgtgttgaccattgttctaataatctttttattagttccaatagtcatcccagttctactcagcttcttttcggatgatgatgagactttgtatgcactattgttgccatcacctcggaaagaagaaccaagtgcatcaacgtcttctgaggagcaacaggaggttatactcagcgaggtggaggatgaaaagccaagggacgtcgatttacttccagcctcagagaggcaaaaaaggatagcagaactgcagacaaggttatttcaggcagctgctgttggtgctgtcagggttaagagaaggaaaggtccacggagaggagaggatttcacactgatgcaagcgctcatcaaggcagatttctggcttctatttttctcccttctgctgggctctggatctggtctcactgtgattgataatcttgggcaaatgagccagtcattgggttacgaggaaactcacatttttgtgtcaatgattagcatctggaactttcttggacgtattggtggagggtacttctcagagattattgtcaaagattatgcatatccaagggcaattgcattagcaatagctcaagtcctgatggcgattgggcacttcaactttgcaatggcttggcctgggacaatgtacattggcacgctgcttgtcggagtaggctatggtgcccactgggccattgtgccagccgcagcctctgaactgtttggggtgaaaaatttcggagcactctataatttcctcacagtcgcaaatccagcaggctccctggtattctcaggggttatcgccagtggcatctatgacgctgaagcagcaaagcaggctcagcagcgccacaactctatgttgctggcaatgagtggcagagtggttaacatagtctctgaagccgctccatcattgaagtgtgagggcgccatctgtttcttcctctcatccctgatcatgtccgggttctgcatcattgcttttggcttgagcttgatcctggtctatcggacgaagattgtgtacacaagtctatatgggaaaccgcgtacttgaaaaatgaaccttcaagggccagagggcgtgaaatggctccagaattctcaaaacatacgtcaattttgaatttagtctggtacccccatgcttgtacaggtatagtgttggtcttctttctttgaggagagtagaacaggagctttgcgttccattacaaatggaacgctgctgaggcacgcgagtcccagaaggttaatctctcaagcagcatttcaagtttgtggctgcagatgggaggttcattattgtgaagtatacgagagtagaaagttcgtggtggaaatgctgttctttgctcaaattttgctgtatttagtttggaaaaattgtatacacatgtaataagctggagacatttcgacgtatgtcagagtggagaacatattcttttatgatttgctgaaacttgaagttgaaatatattaagttgaaatatagtaataaacatatctggaatctggaatattgaatgcacgaaatgcaccgtggtatatctga

SEQ ID NO: 2000 - DNA, 2495 bp, Setaria italica
tcggaaaccaacaacagagggccacggcgaccgctgcgggaaccgcacatccccgagcccgctgaggcccccaatccccaccgcgcgtcgtctgccggcgaggccctgaatcggcgcgcgtttcctgtgcttggttctttttcgttttgattgggagctccgggctcggaggacgcgggcgggcgcaatggtggaggtggggagccgggtgcgggggttcctgcggaaccggtggctggtcttcgtggcggcgatgtggatgcagtcctgcgccggggtggggtacctcttcggcagcctctcgccggtgatcaagagctcgctgggctacaaccagcgccaggtcgccgggctcggcgtcgccaaggacctcggcgacagcgtcggcttcctcgctggcacgctctgcgccgtgctcccgctctgggccgcgctcctcgtcggcgccgcgcagaacctcgtcggctacggctgggtctggctcgccgtcacgcgccgggcacccacgcccccgctctgggcgatgtgcattctaatcttcattggtaacaatggtgagacatacttcaacactgctgcactcgtctcatgtgttcagaacttccccaagaaccgtggaccaattgttggtatcctcaagggattcgctggattaagtggtgcaattcttacacagatttatgcaatgataaactcgcctgatgatgctgcactgatcttcatggttgccgttggcccaacaatggtagttataggtttagtgttcattgtaagaccagttggaggccacagacaagtgcgtccttctgatggcacaagtttcacatttgtatacagcatctgcttgctcttggccgcttatctgatgggcgtcatgctactggaagaccttgtcgacttaagccagtcaatgactgtcttgttgaccatcattctaatcatgtttttattagttccaatagtcatcccagtgctactcagcttcttttcagatgacgatgagactttgtatgcactattattgccatcacctcggaaagaagaagcaagtgcatcaacatcttctgaggagcaagaggaggttatactcagtgaggtggaggatgaaaagccaaaggacgttgatcttcttccagcctcagagaggcaaaaaaggattgcggagttgcaggcaaggctagttcaggcagctgctgttggtgctgtgagggttaagaggaggagaggtccacgacgaggtgaagattttacactgatgcaagcgctcatcaaggcagatttttggcttctatttttctccctactgttgggctctgggtccggtctcactgtgattgataatcttgggcaaatgagccagtcattgggttatgaggaaacccacatttttgtgtcgatgattagcatttggaacttccttgggcgcattggtggtggttacttctcagagattattgtcaaagattatgcatatccaagggcaattgcattagctatagctcaagttttgatggcaattgggcacttcaactttgcaatggcttggcctgggacaatgtacattggcacactgctcgtcggaattggctatggcgctcactgggccattgtgccagctgctgcctctgaactgtttggggtgaaaaattttggagcactgtacaatttcctcacagttgcaaatccagcaggttctctggtattctcagggattattgccagtggcatctatgacgcggaagctgcaaagcaggctcagcagcgccacaactccacattgttgacaatgcctgcaagagtggttaccatgatatctgaagctgctccagcactgaagtgcgagggtgccatctgtttcttcctctcgtccctgatcatgtccgggttctgcatcattgctgttgtcttgagcttgatcctggtttataggacgaaaattgtgtacacgaatctatacgggaaaccacgcacttgaaagatcagttcccaagggccggagggcatgatatagtttcagagttatgaagacatacttcagttttaaatttagtctgtggtatcccgccgttcctgtacaggcggtggtggactgttggccttcaacttgttctgcaccatgttcctttggagagcaggatgggaattttgcgttctttacgaagtgctgttgatgagcaactcgagtcacagaataagctcccagcaggtgggatcatgggaggtattgggtacgacatcgttaagtatatgaaaataaagtaaatggtagaattgtgtcttttgcagttttgctcaaattttgttgtgtttagttggaaacaaaaaattgtatcacactgtaataagccggagatctttctagtttctacatatcctcacaggtgaaaacatttctttctgattagttgaaaactcgaaatgtaatataatacacaggtctagaatcaggaaaattgtatgaatgactggtgtaacttggtttctctgagctattt

SEQ ID NO: 2001 - DNA, 2332 bp, Zea mays
caactcgcaacccacaaaaggccacggtgaccgctgccggactagcctgccgcacaacgatccgggcgcgcccgtccctggcccagaagaccccaacgccgggcgcgcgtccccatccgtccgtcgcgccgggcgtcgtggggtcggagctccgggtccggggccgggaaggcgggaagcagggcgcaagcgcaatggtggagatagggagccgggtgcgggggttcctgcggaaccggtggctggtgttcgtggcggcgatgtggatgcagtcctgcgccggggtcggctacctattcggcagcctctcgccggtgatcaaggcctcgctcgggtacaaccagcgccaggtggccgggctcggcgtcgccaaggacctgggcgacagcgtcggcttcctcgccggcacgctctgctccgtgctcccgctctgggccgcgctcctcgtcggcgccgcgcagaacctcgtcggatacggatgggtctggctcgccgtcacgcgccgtgtccccgtgcccccgctctgggcgatgtgcattctaatcttcatcggtaacaatggtgagacatacttcaacactgctgcacttgtctcatgtgttcagaacttccccaagagccgtggaccaattgttggtatcctcaaaggattcgctggattaagtggagcaattctaacacagatttatgcaattgtgcactctcctgatgatgctgcgctgatcttcatggttgcagttggcccaacaatgattgttatagctttaatgttcattgtaagacctgttggaggccacagacaagtgcggccttctgataacacaagtttcacatttgtatacagtgtctgcttgctcttggccgcttatcttatgggcgtcatgttattggaagaccttgtcgacctaagccagtcagtgactgtcttgttgaccatcgtcctaataatatttttattagttccaatagtcatcccagttctactcagcttcttttcggatgatgatgagactctgcatgcactactgttgccatcacctcggaaagaagaaccaagtgcatcaacatcttccgaagagcaacaggaggttatactcagcgaggtggaggatgaaaagccaaaggacgttgatttacttccagcgtcagagaggcaaaaaaggatagcagaactgcagacaaggttatttcaggcagctgctgatggtgctgtcagggttaagagaaggaaaggtccacggagaggagaggatttcacactgatgcaagcgctcatcaaggcagatttctggcttctgtttctctctcttctgctgggctctggatctggtctcaccgtgattgataatcttgggcaaatgagccagtcgttgggttacgaggaaactcacatctttgtgtcaatgattagcatctggaactttcttggacgcatcggtggagggtacttctcagagatcattgtcaaagactatgcgtacccaagggctatcgcgctaggaatagcccaaatcctgatagcgatcgggcacttcaacttcgccatggcgtggcccgggacaatgtacgtcggcacgctgctcgtgggggtaggctacggcgcgcactgggccatcgtgccagccgcggcctctgagctgttcggggtgaagaacttcggggcgttgtacaacttcctcacggtcgcgaacccggccggctcgctggtgttctcgggggtcatcgccagcggcatctacgacgccgaagcagcgaagcaggcccagcagcgccacagcacctctaagctgctggcgacgagtgggagagtggtgagcgtagtctctgaagcagctccggcgctgaagtgcgagggcgccatctgtttcttcctctcgtccctgatcatggccgggttctgcgtcgtcgcgttcggcttgagcttgatcctggtctatcggacgaaggtcgtgtacgcaggtctgtatgggaagccgcgtacttgaaagatctaaaccctcaagggccagatggcgtggatgtacaggcagtgttgtgtcttcccttcgttctgcacaagttctttgagagtagaacatgctgctgaatgctgatgcacctgagccatagaaggtgcagatgggaggttcattgtaaagtttacaacgaacgaagtatacggaggtcgaaagttcgcggtggaaatgctgtattttgctcaaattttgctgtatttttagttgcgagaagctgtatacgtatgtaataagtacgccagagtggaggccgaaagaacgtattcttttatgatttgttgaaacttgaaaccgaaatgaatgaacactagaatcag

SEQ ID NO: 2002 - DNA, 2640 bp, Oryza sativa
ggcgagggcgacgtcgtctcgtcctcctccccgtctccccgagttgccgagctcgtctcgtccatagaaacgcagcgaattctcgccggatttctcctcctcctccgtgttccaatctgctctgctttctcggctcgtgctggattaccagtagcaatcactgtttcggcaggtgggggggatcgtcggcgtacaccaatccgccgtggttggaggtggtggtggtgcagcaatggtggaggtggggggaagggtgagggggttcgtgcggaacaggtggctggtgttcgtggcggcgatgtggatgcagtcgttcgccggggtggggtacctgttcgggagcatctcgccggtgatcaaggcctcgctggggtacaaccagcgggaggtggcggggctcggggtcgccaaggacctgggcgacagcgtcggcttcctcgccggcacgctctccgccgtgctcccgctctgggccgcggtcctcgtcggcgccgcgcagaacctcttcggctacggctgggtctggctcgccgtcacccaccgcgcccccgtgcccccgctctgggcgatgtgcattcttatctttattggtactaatggtgagacatacttcaatacggctgctctcgtctcatgtgttcagaacttccccaagagccgtggaccgattgtcggtatcctcaagggatttgctggtttgagtggtgcaatcctaacgcagatgtatgcgatgatacattcacctgatcatgcggcattgatcttcatggttgctgttggtccaacaatggtggttattgcgctaatgttcattgtcagaccagttggaggacacaggcaagtgcggccttctgatggtacaagtttcacgtttgtatacagtgtctgcttgcttttggctgcttatctgatgggtgtgatgatactgggggaccttgtcgacttgagccacacagtgatggtcttgttgaccatcattctaatcgtcctcttgatagttccaatagtcatccctgtgatactcagcttcttctcagataacgatgagagtgcctatgcatcactgttgcaatcaccagggaaagaagaagcaagtgcgtcaacaccatctgaagagcaaactgaggttatattcagtgaggtggaggatgaaaagccaaaggaagtggatctacttccagcctcagagaggcagaagaggatagctgaattgcagacaaagctattccaggcagctgctgttggcgctgtcagggtcaagaggagaaaaggtccacgaagaggagaggatttcacattgatgcaggcattgatcaaggcagatttttggctactattcttctcccttctgttgggatcaggatcaggtcttactgtgatagataatcttgggcaaatgagccagtcattgggttatgaggatagtcacatttttgtctcgatgattagcatctggaacttccttggacgcattggtgggggctacttttcagagcttattgtcaaggactatgcatatccaagggctattgcgttagcgacagctcaagtatttatggcatttgggcacttctcctttgcaatggcttggccgggtgcaatgtacatcggcacactgcttgttggtcttggctatggtgcccactgggcaattgtgccagctgcagcctccgaactcttcggcctgaagaacttcggagcattgtacaacttccttaccgtcgcgaatccagcaggctcccttgtattctcaggcattattgccagtggcatatacgactctgaagctgagaagcaggctcaccagcaccataactcgacattgctggcaatgcctgggagattgcttgccatggcctcggatgctactcagccattgaagtgtgagggggccatctgcttcttcctttcgtctctgatcatgtctgggttctgcattgttgctgctgtcctgagcttgatcctcatctaccggacgaagattgtgtacgccaatctgtatgggaaccccaggacatgaagaatatcatcagtcaagacccagaaggaaacaaaatttataaatgttatcaacgcatatactactatctcggattttcaccccaagtcctgttgattcgttggagagcagaagggtgaagttttgttatcttccttctgtttctgagaggcattcttgcgctatcataagttaatgaagttatcagtggctactgaaagaacgatcgttgttcagtatcttgaagtatcgacgtgtaccggtgcacggtggagatgtgttttgcttttcaacttttgctgtgtaaaaactttaaaaatcgcatgtatacatgtacaaatagcgttgctttgtcaaggaggaacattgttctttccggtatgttgatatataatgaagtgcttctcatatgagggggaaaacaagagagagaaaagttgatcatctgcctgaggatttttgcaagttcaatttatgatcatcgatattgcccgaggatattggcatgtctttactgaaaaacagaaaaagactctgcaccacctgaatctgattttctgaaccgtatctgcaggctgcaacctcgctctgtaacagaatctacgagatttggatatttggatattttccttctgaaatta

SEQ ID NO: 2003 - DNA, 2589 bp, Brachypodium distachyon
ggagggaggacaacacatgcttatcagcaatcaatagcgccagcgccagcgcccagcggagcccgccgtgccgatccttgccgcttctcccgatccccatcccaattccggccgcttccccccacttccccgggccccggcccgctcgcagctgctccctcgcctccaacacaagcccatcgaccggctgctcgcgcgccgccacttcgtctgcttcggattcagttcagccttgagtctcgctcccattggattcccttccttccttcatacggagcgttgatttggggctgaggcgctgctgctgccactgcgagcgcggcgctgcggcaatggtggaggcggggagcagggtgcgggggttcctgaggaaccggtggctggtgttcgtggcggccatgtggatgcagtccttcgccggggtgggctacctcttcggcagcctctcccccgtcatcaagtcctcgctcggatacacccagcgccagctcgccgggctcggcgtcgccaaggacctcggcgacagcgtcggcttcctcgccggcaccctctgcgccgtgctcccgctctgggccgccctcctcgtcggcgccgcccagaacctcgtcggctacggctgggtctggctcgccgtcacccgccgcgtccccgttcccccgctctgggcgatgtgcattctaatctttgttggtaataatggtgagacatacttcaatactgctgcgctcgtctcatgtgttcagaacttccccaagaaccgtggaccgattgttggtatcctcaagggatttgctggtttgagtggtgcaatcctaacacagatctatgcaatggtacactcgcctgatcatgctgcactgatattcatggtcgctgttggcccaacaatggttgtcatcgctttaatgttcatcgtcagaccagttggaggccacagacaagtacggccttctgatggtataagcttcacgtttgtatacagcatctgcttggtcttggccgcttatctgatgggagtgatgctgcttgaagaccttgttggcttgagccatccgttgacagtcctgtgtaccatcattctaatggtcctactgatagttccaatagtcatccctgtgatactcagcttcttctcagacaacgatgaaagtatccatgcagcactgttaccatcacctcggagagaagaagcaagtgcgtcagtaccgtcgagtgaagagcaacatgaggttatactcagtgaggtggaggatgaaaaaccaaaggaagttgatctacttccagcctcagagaggcagaagaggattgctgaattgcagaataggctattccaggcagctgctgttggtgccgtcagggttaaaaggaggaaaggtccacggcgaggagaggatttcacgctgatgcaggcactgatcaaggcagatttttggcttctgtttttctcccttctgttggggtcaggatcaggacttaccgtgatcgataatcttgggcaaatgagtcagtcattgggctatgaggacacccacattttcgtgtcaatgattagcatctggaacttccttggacgtgttgctgggggctatttctcagagattgttgtcaaggactacgcatatccaagggcgattgccttggcaacagctcaagtattcatggcaattgggcacttcatcttcgcgatggcatggccgggcacaatgtacatcggcacactgctcatcgggctcgggtacggcgcgcactgggcgatcgtgccagccgccgcctccgagctgttcggcacgaagaacttcggagcgctgtacaacttcctcaccgccgccaacccggcgggctccctggtcttctcgggcatcatcgccagcggcatctatgaccgtgaagccgagaagcaggctcaccagcacggcaactcggcattgctagctgtggtcttcgacgccgctccggccatcaagtgcgacggtgccatctgcttcttcctctcctcgatgatcatgtcagggttctgcgtcatcgccgccgccctgagcacgatcctggtccaccggacgaaggtcgtgtacacgaatctgtacggtaaaccccccacatgacggggatggatcaaagctccaagagtcatcgatcctcccttgttcttctgaatattcttcgggtagcagcagaagggcgtgaaagttttgttttgctgtgttccttctgtttatgagctatacgtacatatccttatggcaccaggactacgactacggacactactggtggctacggatgggaggtcgagtatatcatcatcatggagcatcaaagtgcatgtattgggttcttgtgtattttgactgaacaacatttcagtgttgagctgcaaatgttgcatgtacatatggttatatgcttcatcaatttgtcacggtgggttgtttttcagtcgtctttgaaaactggtagtaccacattaatttacccaagtttagcaagttagctgcacggtccattttgtgttgtttttgtgaactctgtaatttggtctggcgccttctgcattggatggaaatcggcggagaggccgctgtttcaaag

SEQ ID NO: 2004 - DNA, 2582 bp, Hordeum vulgare
gccatttatgcgcggacacacgtttttgtcagcactaatcaacgccagcggggccgatcgttgctgattccgcatcccgatccacggctccctcaagggtcgtcctcgtcacttcgactcctctcgcggccggttcattgcttgcctccaagaaaccgtcggcttggcctctcattcccctcccaaatccgtcctgttaataggccgagctcggcttcttgcattaggctctcggggctgctgctcgctgcggattccagtgttgattcgggttggagctttggggcaggtgctgcaggcaatggcggaggtgcggagccgggtgcgggggttcctgcggaaccggtggctggtgttcgtggcggcgatgtggatgcagtcggtcgccggggtggggtacctgttcggcagcctctcgccggcgatcaagtcctcgctggggtacaaccagcgccaggtggccagcctcggcgtcgccaaggatctgggcgacagcgtcggcttcctcgccggcacgctctgcgccgtgctgccgctctgggccgcgctcctcatcggcgccgcgcagaacctcgtcggatacggctgggtctggctcgccgtcacacaccgcgtccccgtgccaccgctctgggcgatgtgcatgctaatttttgttggaaataatggtgagacatacttcaatactgctgcactcgtctcatgtgttcagaactttcccaagaaccgtgggccaatcgttggtatcctcaagggatttgctggtttgagtggtgcaatcttaacacaggtttatgcaataatgcactcgcctgatgatgctgcactgatattcatggttgctgttggcccaacaatggtagtcatcgctttaatgttcattgttagaccagttaatggtcacagacaagtacggccgtctgatggtacaagtttcacgtttgtatacagcgtctgtttagtcttggccgcctatctgatgggtgtgatgctgctggaagaccttgttggcttgagccactcattgacaatcctgtgtaccatcattctaatggttcttttgctaatcccaatagtcatccctgtaatgctcagtttcttctcaaatgacgacgagagtgcctatacagcactgttaacatcacctcggagagaagaagcaagtggttcagtatcgtctgaagagcaagaagttatactcagcgaggtggaggagcaaaagccaaaagaaattgatctacttccagcctctgagaggcaaaagaggattgctgaattgcaggctaagctattccaggcagccgctgttggcgctgtcagggttaaaaggaggaaaggtccacgacgaggagaggatttcacattactgcaggcaatgatcaaggcagatttttggcttctatttttgtcccttctgttggggtcaggatcaggtcttactgtgatcgataatcttgggcaaatgagtcaatcattgggtttcgaggattctcacatttttgtgtcaatgattagcatttggaacttccttggacgaatttccgggggcttcttttcagagattattgtcaaggattacgcatatccaagggcgattgccttggcgacagctcaactattcatggcaatcggacacttcatctttgcaatgggttggcccggcacaatgtacattggcacattgcttattgggctcggatacggtgcccactgggcgatcgtgccagctgctgcctccgaactgtttggcgtgaagaatttcggagcattgtacaacttccttacagtcgcaaaccccgcaggctccctggttttctcgggcatcattgccagtggcatctacgactatgaggccaggaagcaagctaaccataaccataactcgacattgctgggaatggtctctgatgttgctccggtgctgaagtgcgaggggtccatctgcttcttcatctcgtcactgatcatgtcagggttttgcatcattgctgccgtcctgagcttgatccttgtccaccggacgaagatcgtgtacacaaatctgtatggtaaaccccggacatgagaggtcaaaggtctgtcgttgaggaacagatgaaaggtacaggtatcaaagcagacgggtgaaggtttttcttttttcgcgtctttcttctgttttcggactttgcatattcttatggtgtcaaaaccacgactactggtggctacagatgggaagttcagtatcatgaagcatggaagtgtatgccatttttgtgcgttttgtccgaacttcttttttttctctttgggggggggggggggggggggtatgaacttcttcagtgttgagctggaactttgcatgtacatgtgatctgttctatgtttcatccaggctgttgaaaccttgaaatgcaataaattatctgtgctctgcaaattggagagcccaaccttgtacatgggcacctgttgtcctaagtctgagagaaactacatgatagctgtgtatttgtttcccatgaatcttgctggagcaccgtcttttatttgtaagattggctgggctgcctccccagtatatgcttacaattttc

SEQ ID NO: 2005 - DNA, 2622 bp, Secale cereale
gctcgctcggctctggtcatttatgcacggacacacgttcttatcagcaataaacaacgccagcggggccgatcgttgctccttctgcatcccgatccgcggctcctcctcaagagtcgtcgtctccactccggctcctcgcggccggtttttgcttgcctccaagaaaccgtcggcctggcctctcattcctgtcccgaatccgtcctgttaataggccgagctcagcttcttgcattagcttctcggggctgctgctcgctgcggactagcggactctagttctagtgtgttgatttgggttggagtttcgggacaggtgctgcaagcaatggcggaggtgcggagccgggtgcgggggttcctgcggaaccggtggctggtgttcgtggcggcgatgtggatgcagtcggtcgccggggtggggtacctgttcggcagcctgtcgccggcgatcaagtcctcgctgggctacaaccagcgccagctggccagcctcggcgtcgccaaggatctgggcgacagcgtcggcttcctcgccggcacgctctgcgccgtgctcccgctctgggccgcgctcctcatcggcgccgcgcagaacctcgtcggatacggctgggtctggctcgccgtcacccaccgcgtccccgtgccaccgctctgggcgatgtgcatgctaatctttgttggaaataatggtgagacatacttcaatactgctgcactcgtctcatgtgttcagaactttcccaagaaccgtgggccaattgttggtatcctcaagggatttgctggtttgagtggtgcaatcttgacacaggtatatgcaataatacactcgcctgatgatgctgcactgatattcatggttgctgttggcccaacaatggtagtcatcgctttaatgttcattgttagaccagttaacggtcacagacaagtacggccgtctgatggtacaagtttcacgtttgtatacagcgtctgcttagtcttggccgcctatctgatgggtgtgatgctgctggaagaccttgttggcttaagccactcgttgacaatcctgtgtaccatcattctaatggttctgttgttagttccaatagtcatccctgtaatgctcagcttcttttcaaatgatgacgagagtgcctacacagcactgttaacatcacctcggagagaagaagcaagtggttcggtatcgtctgaagagcaagaagttatactcagcgaggtggaagagcaaaaaccaaaagaaattgatctacttccagcctctgagaggcaaaagaggattgctgaattgcaggctaagctattccaggcagctgctgttggtgccgtcagggttcaaaggaggaaaggtccacgacgaggagaggatttcacattacttcaggcaatgatcaaggcagatttttggcttctctttttcttccttctgttggggtcaggatcaggacttactgtgatcgataatcttgggcaaatgagtcagtcattgggttttgaggattctcacatttttgtgtcaatgattagcatttggaacttccttggacgtatttctgggggcttcttttcagagattattgtcaaggattacgcatatccaagggcaattgccttggcgacagctcaagtattcatggcaattggacacttcatctttgcaatgggttggcccggcacaatgtacattggcacattgcttatcgggctcgggtacggcgcccactgggcgatcgtgccagctgctgcctctgaactgtttggcgtgaagaatttcggagcattgtacaacttccttacagtcgcaaaccccgcaggctccctggttttctcgggcataattgccagtggcatctacgactacgaagccaggaagcaagctaaccataaccactcaacattgctgggaatggtctccgacgtcgctccggtgctgaagtgtgagggctccatctgcttcttcatttcgtcactgatcatgtcagggttctgcatcattgctgccgccctgagcttgatcctggttcgccggacgaagatcgtgtacacgaatctgtatggtaaaccccggacatgagaagtcaaaggtgtgtcgatgaggaacagatcaaagctacaggtatcaaagcagaagggtgaagttttctttttctttttgcgtcttctgtttatggatttcgcatattcttatggtgtcaaaaccacggctactggtggctacggatgggaaattcagtgtcatgaagcatcgaagcgtatgacgtttttgtgcgttttgtccgaacttcttcggtgttttttttgggggggtatgaacttcttcagtgttgagctggaactttgcatatacgtgtggtctgttctatgtttcatcaaggctgttgaaaacttgaaatgcaataaattatctgagctctgcaaattggagagctcaaccttgtatatgggcacctggtgtcctaagtctgagagaaaccacatgatagcttgtatttgtttcctatgaatctggctggagcaacgtcttttatactccgtatttatataaagattggctgggctagaccttacccaaaaaaaaaaaaactacgagactccgacgacgac

SEQ ID NO: 2006 - DNA, 2578 bp, Triticum aestivum
ctctgctcgctcggctctggccatttatgcgcggacacacgttcttctcagcaataaacaacgccagcggggccgatcgttgctgattccgcatcccgatccgcggctcctcatcaagagtcgtcgtcgtcactccggctcctcgcggccggttctttgcttgcctccaagaaaccgtcggcttggcctctcattcccgtcccaaatccgtcctgttaataggccgagctcagcttcttgcattagcttcttctcggggcggactctagttctagtgtgttgatttggattggagttttggggcaggtgctgcaagcaatggcggaggtgcggagccgggtgcgggggttcctgcggaaccggtggctggtgttcgtggcggcgatgtggatgcagtcggtcgccggggtgggtacctgttcggcagcctgtcgccggcgatcaagtcctcgcttggctacaaccagcgccaggtggccagcctcggcgtcgccaaggatctgggagacagcgtcggcttcctcgccggcacgctctgcgccgtgctcccgctctgggccgcgctcctcatcggcgccgcgcagaacctcgtcggatacggctgggtctggctcgccgtcacccaccgcgtccccgtgccaccgctctgggcgatgtgcatgctaatctttgttggaaataatggtgagacatacttcaatactgctgcactcgtctcatgtgttcagaactttcccaagaaccgtggaccaatcgttggtatcctcaagggatttgctggtttgagtggtgcaatcttaacacaggtttatgcaataatgcacacgcctgatgatgccgcactgatattcatggttgctgttggcccaacaatggtagtcatcgctttaatgttcattgttagaccagttaatggtcacagacaagtacggccatctgatggtacaagtttcacgtttgtatacagcgtctgcttagtcttggccgcctatctgatgggtgtgatgctgctggaagaccttgttggcttgagccactcattgacaatcttgtgtaccatcattctgatggttcttttgctagttccaatagtcatccctgtaatgctcagcttcttctcaaatgacgacgagagtgcctacacggcgctgttaacatcacctcggagagaagaagcaagtggttcagtatcgtctgaagagcaagaagttatactcagcgaggtggacgagcaaaagccgaaagaaattgatctacttccagcctctgaaaggcaaaagaggattgccgaattgcaggctaagctattccaggctgctgctgttggcgccgtcagggttaaaaggaggaaaggtccacgacgaggagaggatttcacattactgcaggcaatgatcaaggcagatttttggcttctatttttctcccttctgttggggtcaggatcaggacttactgtgatcgataatcttgggcaaatgagtcagtcattgggttttgaggattctcacatttttgtgtcaatgattagcatttggaacttccttggacgtatttctgggggcttcttttcagagattattgtcaaggattacgcatatccaagggcaattgccttggcgacagctcaagtattcatggcaattggacacttcatcttcgcaatgggttggcccggcacaatgtacattggcacattgcttatcgggctcgggtacggcgcccactgggcgatcgtgccagctgctgcctctgaactgtttggcgtgaagaatttcggagcattgtacaacttccttacagtcgcaaaccccgcaggctccctggttttctcgggcatcattgccagtggcatctacgactacgaagccaggaagcaagctaaccataaccactcaacattgctgggaatggtctccgacgtcgctccggcgctgaagtgcgagggctccatctgcttcttcatctcgtcaatgatcatgtcagggttctgcatcattgctgccgccctgagcttgatcctggtccaccggacgaagatcgtgtacacgaatctgtacggtaaaccccggacatgagagatcaaaggtcatcgaggacagatcaaagctaaggtatcaaagcagaagggtgaagtttatttttttttgcgtcttccttctgtttatggacttcgcatattcttatggtgtcaaaaccacggctactggtggctacggatgggaaattcagtgtcatgaagcattgaagcatatggcgtttttgtgcgttttgtccgaacttcttcggtgtttctggggggatatgaacttcttcagtgttgagctggaactttgcatatacatgtggtctgttctatgtttcatcaaggctgttgaaaacttgaaatgcaataaattgtctgagctctgcaaattggagagctcaaccttgtacatgggcatgggcacctggtgtcccaagtctgagagaaaccacatgatagctgcgtatttgtttcctatgaatctggctggagcacggtcttttatttataaagattggctgggctgcctccccagtatatgtttaaaatttt

SEQ ID NO: 2007 - DNA, 2131 bp, Sorghum bicolor
acagaaaagtcagaagaaagggacagataaaaatccttctcctcttcttcctcccctctcctcctggcccttgcgagttgtgactgtgaagcagccgcctgcctctccgtctccgtccacgtcgcgtcataaatccccccttcccgagccccgacctagcacctacccccgccatccgcccattcccgcccccaatctgactggtgcacgagccccgaatccaccgtcgcatttgttggcaacctccggttcccggcttcccgctaccctttccgtttcagagaagcggtctactctaggcacctgtttttagatccgcgcctgccttgcggtagtggggggagcggatttaggtgaacaagcatcttgattttttgaccaatctttgctctacccaccctgtggtcttcgcttttaaatcctctggagtctggaggtgggaagacggacgaggcgaagccgaaagcaagaacggtcgtttcaagtatcctcaggaactatcaagtgttccagtggaggtattgggagtttaaagaaaaaaaggattgtagaggttgttgttttacctcgttttcctaacaatgttgaggcagagctctagtagaaatcagagatccaaaggtctgaagctgaagaaagctcttcagattagtctcttgcttctggtttctgtttggttgctctaccaagtaaagcattcttatgagaagaaggcgtatagtgaagatgaagcgaatgatttgcataaagatgacaaagaccagcgagaggcagtcagattaggcaggaaggatctgcctccaaagatggaggctgattcttcaacattggatgaacgggttgaggatgaagagaatgatgaaatggagcaagaaatgaagcatgatgagaacgatgaggatcccatcgatgagcaggacctggagaaggatgaagatcttcctgagcctggtgagcattcttctgagaaggatggagatgtgggtgtgtttgaggatgaagagcggaaggagcggtcgcaggaggatcaagagaagagcttccatggtgacaatgtttctagtgctgttactcacgaccctccatcatctgagcaagatgagctgttccatcatgcccaagagaaggtcttattcgtggatgatgcttcaactgcagtgcctaacgaaaatcatgatgaggctggaagcaaggaggaggaagtgcgcagggctagggagaggagtttcagaggcgatgatgtgtcaagctctgtggatcatgatgccaaggtggcaaaacctctcccagaggaacaattgaacagcatggataggatatttgaaggcaccacaaacttatctaatggaatttcatttcgagctcctggaataaatggatcatatgctacaccaactaattcatcctcccagaaaaacacagacattcctagcgatgacatcaaaagcaagacccatccatctccagcaaatttgaccagcaaccctgagcaaaataattcaactttgaaaggtcatccagatcaacaagtgaattcaacagcagtgctgggcaaccaagtacagcctttgactaaccagacatcgttgcttgagttggattctcctccaaatggcaccttggctctggtaacagatgtccaaaagtccacatctggggctggagatgatggcagcagcaatacctcatcctccacccctgtggacaagaagacggacggcgaagatggtcccaaagaagatgtggatgtgtccactaaaataatgaacaaggcaatgagtgaagatgaagtcgttccagagtgataaggagatctctcttctcagcttctggtgtaacctgtaagtttgtaggacttggtttatctcctagacttggagatgcaatgcaagcaggctatcttgttgcgaccatttttttgtataagtttgataggtgtctgctttgtattgcctaattagtaagtagcccatcataatgatctgggtcaagtgaagaacaagaagcatgtacccacaaagaaatatagcgattctgcagctctgaagctttgctgctggaatcaaatgccaactaggcagctatgaatgaaatgtccatcgcagtccacttttgtgtacttttcaagttt

SEQ ID NO: 2008 - DNA, 2417 bp, Sorghum bicolor
cagtgcgtgagtggcaaaccgggctgacacgctgggcggcgagccctccaatgctcgctgctcccaacctccaaccacacggtgccaaagccccaaccccaaacacaagaagctgatttctcactcctcactcctgagaggcgaaaaaaaaaacttgtagaacagaaaagtcagaagaaagggacagataaaaatccttctcctcttcttcctcccctctcctcctggcccttgcgagttgtgactgtgaagcagccgcctgcctctccgtctccgtccacgtcgcgtcataaatccccccttcccgagccccgacctagcacctacccccgccatccgcccattcccgcccccaatctgactggtgcacgagccccgaatccaccgtcgcatttgttggcaacctccggttcccggcttcccgctaccctttccgtttcagagaagcggtctactctaggcacctgtttttagatccgcgcctgccttgcggtagtggggggagcggatttaggtgaacaagcatcttgattttttgaccaatctttgctctacccaccctgtggtcttcgcttttaaatcctctggagtctggaggtgggaagacggacgaggcgaagccgaaagcaagaacggtcgtttcaagtatccagctgccggcgtccgaaggaactatcaagtgttccagtggaggtattgggagtttaaagaaaaaaaggattgtagaggttgttgttttacctcgttttcctaacaatgttgaggcagagctctagtagaaatcagagatccaaaggtctgaagctgaagaaagctcttcagattagtctcttgcttctggtttctgtttggttgctctaccaagtaaagcattcttatgagaagaaggcgtatagtgaagatgaagcgaatgatttgcataaagatgacaaagaccagcgagaggcagtcagattaggcaggaaggatctgcctccaaagatggaggctgattcttcaacattggatgaacgggttgaggatgaagagaatgatgaaatggagcaagaaatgaagcatgatgagaacgatgaggatcccatcgatgagcaggacctggagaaggatgaagatcttcctgagcctggtgagcattcttctgagaaggatggagatgtgggtgtgtttgaggatgaagagcggaaggagcggtcgcaggaggatcaagagaagagcttccatggtgacaatgtttctagtgctgttactcacgaccctccatcatctgagcaagatgagctgttccatcatgcccaagagaaggtcttattcgtggatgatgcttcaactgcagtgcctaacgaaaatcatgatgaggctggaagcaaggaggaggaagtgcgcagggctagggagaggagtttcagaggcgatgatgtgtcaagctctgtggatcatgatgccaaggtggcaaaacctctcccagaggaacaattgaacagcatggataggatatttgaaggcaccacaaacttatctaatggaatttcatttcgagctcctggaataaatggatcatatgctacaccaactaattcatcctcccagaaaaacacagacattcctagcgatgacatcaaaagcaagacccatccatctccagcaaatttgaccagcaaccctgagcaaaataattcaactttgaaaggtcatccagatcaacaagtgaattcaacagcagtgctgggcaaccaagtacagcctttgactaaccagacatcgttgcttgagttggattctcctccaaatggcaccttggctctggtaacagatgtccaaaagtccacatctggggctggagatgatggcagcagcaatacctcatcctccacccctgtggacaagaagacggacggcgaagatggtcccaaagaagatgtggatgtgtccactaaaataatgaacaaggcaatgagtgaagatgaagtcgttccagagtgataaggagatctctcttctcagcttctggtgtaacctgtaagtttgtaggacttggtttatctcctagacttggagatgcaatgcaagcaggctatcttgttgcgaccatttttttgtataagtttgataggtgtctgctttgtattgcctaattagtaagtagcccatcataatgatctgggtcaagtgaagaacaagaagcatgtacccacaaagaaatatagcgattctgcagctctgaagctttgctgctggaatcaaatgccaactaggcagctatgaatgaaatgtccatcgcagtccacttttgtgtacttttcaagtttaaagccaatgtgttgcgaggtttaggccttgtttacttcctagaaaattttgcaaaatttttcacattccccgtcacatcgaatatttagacgcatgcatggagtattaaa

SEQ ID NO: 2009 - DNA, 2031 bp, Zea mays
accgtttcctcttccttcttcccttctcctgcgagttgccgagttgtgactctggagctgtcgcctgcggcctgcctctccgtctccgtccacgtcgcgtcataaatccccctttccgagccccgacctagcacctacccccgccacccgcccattccattccccaatccgactggtgcacgagccccgaatccactgtcgcatttgttggcggcctctagctcccgctaccctttccgtcccagagaggcggtcgccttgcggtaggcggaagggggatttaggtgaacaagcatcttgattttttgaccaatctttgctctacccgccttgcggtcttcgcctttaaatctctggaggtgggaagactgacgaggcaaaggcgaaggcaagaacggtcgtttcaaggctcctgctggaaccatcaagtgttccggtggagggattgggagtggaggggaaaggatcgtagaggttgttgttttacctcgttttgctaacaatgttgaggcagagctctagtagaaatcagagatccaaaggtctgaagctgaagaaagctcttcagattagtctcttgcttctggtttctgtttggttgctctaccaagttaagcattcttatgagaagaaggcatacagcgaagatgaagtgagtggttcacataaagatgacaaggaccagggagagacagtcagactaggcaggaaggatctgcctccaaagatggaggccgactcttcaacattggatgaacgggttgaggatgaagagaatgatgaaatggagcaagaaatgaaacatgatgagaacgatgatgatcccatcgatgagcaagacttggagaaggatgaggatcttcctgagcctggtgagcattcttctgaaagggatggagatgtgggtgtgtttgatgatgaagagcggaaggagcggtcacaggaggatcaagagaagagcttccatggtgacaatgtttctagtgctgttactcatgaccccccatcatcggagcaagatgagctgttccatcgtggccaagagaaggtcttatttgtggatgatgcttcaactgcagtgcctaatgaaaatcacgaggctggaaacgaggatgaagtgcgcagggctagggaaaggagcttcagaggtgatgatgtgtcaagctctgtagatcatgacggcaaggtgacaaaacctctcccagaggaacaattgaacatcatggataggatatttgaaggcaccacaaacttatctaatggaatttcatttcgagctcctggaataaatggatcatataccaccgcaggcaatgtggctacaccaacgaattcatcttcccagaaaaacacagacattcctagcgatgacattgaaagcaagacccatccatctccaacaaatttgaccagcaaccctgagcaaactaattcaactttgaaaggtcatccggatcaacaagtgaattcaatggcagtgctcggcaaccaagtacagcctttgactaaccagacgtcgcttgagttggattctcctccaaatggcaccttggctctggtaacagatgccaaaaagtccacatctggagctggagatgatggcagcaacagcacctcaccctccactcatgtggacaagaagacggacggcggagatggtcccaaagaagacgtggatgtgtccactaaaataatgaataaggcaattagtgaagatgaagttgttccagagtgataaggagatccaagatctcgtgtcagcttctggtgtgacctgtaagtttgtaggacttggtttatctcctagacctggagatgcaatgcaagcaggctatcttgttgcaccctttttttgtataactagtaactggcacgtgccctacgcttgtagatttttttttgcaatataagtagaaaaaatcgcaatataagtgataacagtgctatattgcttgtaagatgcacattaagtaagctattcatatatattacaagagctagaacaaaggctagttccgactgagtcaacat

SEQ ID NO: 2010 - DNA, 1844 bp, Saccharum officinarum
tctgaagctgccgcctgcctctccgtctccgtccacgtcgcgtcataaatccccccttccccccttcccgagccccgacctagcacctacgccatccgcccattccagtccccaatccgactggtgcacgagccccgaatccactgtcgcacttgttggcggcctccggctcccgctaccctttccgtttcagagaggcggtctacactaggcacctgtatttagatccgcccctgccttgtggtagtggggggagcggatttaggtgaacaagcatcttgattttttgaccaatctttgctctacccaccctgtggtcttcgcttttaaatcgtctggagtctggaggtgggaagacggacgaggcaaagccgaaagcaagaacggtcgtttcaagtatccagctgccggcgtccgaaggaaccatcaagtgttccagtggaggtattgggagtgataaaaaaaaggattgtagaggttgttgttttacctcgttttcctaacaatgttgaggcagagttctagtagaaatcagagatccaaaggtctgaagctgaagaaagctcttcagattagtctcttgcttctggtttctgtttggttgctctaccaagttaagcattcttatgagaagaaggcatatagtgaagatgaagcgaatgatttgcataaagatgacaaagaccagcaagaggcagtcagattaggcaggaaggatctgcctccaaagatggaggctgattcttcaacattggatgaacgggttgaggatgaagagaatgatgaaatggagcaagaaatgaagcatgatgagacctgagcctggtgagcattcttctgaaaaggatggaaacgtgggtgtgtttgaggacgaaaagcggaaggagcggtcacaggaggatcaagagaagagtttccatggtgacaatgtttctagtgctgttactcatgaccctccattgtctgagcaagatgagttgttccatcatgcccaaaaaaaggtcttattcgtggatgatgcttcaactgcagtgcctaatgaaaatcatgaggctggaaacaaggaggaggaagtgcgcagggctagggaaaggagtttcagaggtgatgatgtgtcaagctctgtggatcatgacgccaaggtggcaaaacctctcccagaggaacaattgaacagcatggataggatatttgaaggcaccacaaacttatctaatggaatttcatttcgagctcctggaattaatggatcatatgccaccatggacagcacggctactccgactaattcatctacccagaaaaacacagacattcctagcgatgacatagaaagcaagacccatccatctccagcaaatttgaccagcaaccctgagcaaactaatttaactttgaaaggtcatccaggtcaacaagtgaattcaacggcagtgcttggcaaccaagtacagcctttgactaaccagacatcgtcgcttgagttggattctcctccaaatggcaccttggctctggtaacagatgtccaaaagtccacatctggagctggagatgatggcagcagcaacacctcatcctccacccctgtggacaagaagacagacggcggagatggtcccaaagaagacgtggatgtgtccactaaaataatgaacaaggcaattagtgaagatgaagttgttccagagtgataaggagatctctcttgccagcttctggtgtaacgtgtaagtttgtaggacttggtttatctcctagacttggagatgcaatgcaagcaggctatcttgttgcgaccctttttgtataagtttgatagatggctgctttgaattgcctaa

SEQ ID NO: 2011 - DNA, 905 bp, Sorghum bicolor
tgaccaagcttttccaacgacgtaatctgctccaaaataattgcgtgtgcggtctactgctccaaaacggagtcacgtctgccggcggtgtcgaaaccacagccagccatacaggcggccggcgcaaccatggctcgtccttcgaagctctacctcgtcttctacaactccctccaagcgctcggatggttcctcgccctcctccgcctcctgccctccctcgtccctcccttccctgtccactccgcgtacgtggtcaccggcgacctcatctgtttcctgcagacatgtgcgttccttgaaacggtccacgctgccataggattggtgccgaccgcgccatttcttgctttcttgcaatggggagggaggacccacttcatcctggctgttgtccggcaaattcccgaggttcagaggagtccatctgtgtacataacatttatagcttggagcatatctgaggtcatccgttactctcactatgctctgactaccttaaaagtttgtccaggatggctgacatatctcaggtacactgcttttatcccgctgtatccaatcggggttggaccaggagaaatgtggactatgtatcaagctctcccatttgtgaagaagaggaacctttactcaggtttcttcaagaagttctccatgagctaccattcatttctagtgggtgtgctggtgatctatccgttcctgtggctgaagctgtacctgcatgtgttcaaacaacgcaagtccaagctgggaaaggggagcaggaagaaacgagcctaagaaaaatctggctcagctcagctcaggtgccacttgtcgctgtcatgtgaaactctcacgggtcattgtggaattgttttattgaagaaaattttgtgagttgttaactgatgcaacgg

SEQ ID NO: 2012 - DNA, 1079 bp, Panicum virgatum
ccgacccagtagttggggtttacgtagactttttccacgcctcggcggtgtcgaaaccacagccacaaagtgacacgggcagccgccgctgggcgtccggcggcggcacactgcggcaggccggcagcaatggctcgcccttcgaagctctacctcgtctgctacaactccctccaagcgctcggatggttcgtcgccctcctccgcctcctgccctgcctcgcctctcccgtctccgtccactccgcgtacgcggtctccggcgacctcatctgcgtcctgcagacctgcgcgattcttgaaacggttcacgccacgatcggattggtgcccacagcgccgcttcttgcatttttgcagtggggtgggaggactcacttcgttctcgctgttgttcggcaaatccccgaggttcagagcagtccgtctgtgttcataacgtttatggcttggagcatatctgaggtcatccgctactcccactatgctctgactaccttaaaagtttgtccatcttggctgacttatctcaggtacactgctttcatcccgctgtatccaattggggtcggaccaggagaaatgtggactatgtaccaagccctcccatttgtgaagaagaggaacctctacttaggtttcttcaagaagttctccatgagctaccattcatttctagtgggcgtgctggtgtgctatccgttcctgtggctgaagctgtacatgcatgtgttcaagcaacgcaagtcgaagctgcgaaaggggagcaggaagaaacgagcctgagaaaatttcgactcagctcagcttaggtgtaacttgtcaccggcatgtgaaatgcaaacggtcattgtggatcttaaagaaagtcattgtgaattgtcaagggatcttgcagctgatgcaatggtgaaggctttgctgaatcaacgagcaactgaatataatactagcagattactgcgttttatgtttatttcagttgctctgcatttcgtgattgtttataagatatgttgcgagtctaaaacactaatcaatcaatctgaaggccctgagctgcttgttcaattgctgca

SEQ ID NO: 2013 - DNA, 739 bp, Cenchrus ciliaris
gccggcacgggcagccggcgctcggcatctggcatccggcggcacgccgcggcaggccggcagccatggctcgcccttcgaagctctacctaatctgctaccactccctccaagcgctcggatggttcatcgccctccttcgcctcctgccctgcctcgcccatcccgtatccgcccactccgcgtacgcggtcgccggcgatctcatatgcttcctgcagacctgcgctattcttgagacggtccacgccgcgatcggattggtgcccacggcgccgcttcttactttcttgcaatggggagggaggacgcactttgttctcgctgttgtccgacaaatcccccaggttcagagcagtccctctgtgttcataacgtttatggcttggagcatatctgaggtcatccgctactcccactatgctctgactaccttaaaagtttgtccgtcttggctgacttatctcaggtacacagctttcatcccgctgtatccaatcggggttggaccaggagaaatgtggactatgtaccaagctctcccatttgtgaagaagaggaacctttactcaggtttcttcgacaagttctccatgagctattattcatttctagtgggtgtgctggtgtgctatccattcctgtggttgaagctgtacaagcatgtgttcaagcaacgcaagtcaaagctgggaaaggggagcaggaagaaacgatcctgagaaaattgactcagctc

SEQ ID NO: 2014 - DNA, 1016 bp, Setaria italica
agcagaccgacccggagcacgaaccaacccggaccggaccgctcctcggcggtatcaaaaccacagccacacagcgacacgggcagccggcgctcggcgtccggcggcacaccgcggcaggccggcagccatggctcgcccttcgaagctctacctcgtctgctacaactccctccaagcgctcggatggttcatcgccctcctccgcctcctgccctgcctcgcccatcccgtctccgcccactccgcgtacgcggtcgccggcgacctcatctgcttcctgcagacctgcgcgattcttgagacggtccatgccgcgatcggattggtgcccactgcgccgcttcttactgtcttgcaatggggagggaggactcactttgttctcgctgttgtccgacaaatcccccaggttcagagcagtccctctgttttcataacgtttatggcttggagcatagctgaggtcatccgctattcccactatgctctgactaccttaaaagtttgtccgtcttgggtgacttatctcaggtacacagctttcatccctctgtatccaatcggggtcggacccggtgaaatgtggactatgtaccaagctctcccatttgtgaagaagaggaacctctactcaggtttcttcgagaagttctccatgagctatcattcatttctagtgggtgtgctggtgtgctatccattgctgtggctgaagctgtacttgcatgtgttcaagcaacgcaagtcaaagctgggaaaggggagcaggaagaaacgagcctgagaaaattgaccagctcagctcagatgtaatttgtcacccgcatgtgggtgttaacgggtcattgtgcattgttttgaaacaaaatcactgtgaattgttaaggaatcttgcagatgatgcaatggtgaaggctttggtggattgatcagcaactgagtataatactagcagattactgggttctatgtttgtttcagctgctctgcgtttcatgattgtctataagata

SEQ ID NO: 2015 - DNA, 1235 bp, Triticum aestivum
gcgacgacggctcagaacctcagccacagaactccgtcaatactagccactgctggtatcctaggacaaaccctcactgttccaacacgaagcgtctccccgcctcgggaggttcgccggccagcggcgagaaggaagcgaggcagcggccatggctcgcccgtcgcggctctacctcctcgcctacaactccgtccaggccatcggatggtccgtcgccctgctccgcctcctgccctgcctcgcccctccggtctccgtccgccccgcgtacgccgccgccggcgacctcatatgctttctgcagacctgcgcggttcttgagaccgtccatgccgccgtcggattggtacccacctcgccgtttcttgctttcctgcaatggggagggaggactcacttcattctcgcccttctccggcaaatccctgaggttcagggcagtccctctgtgttcataacgtttatggcttggagcatatctgaggtcattcgatactctcactatgctctgactacgttaaaagtttgtccagcatggatgacttacctcaggtacactgcctttatcccgctgtatccaattggggtaggaccaggagaaatgtggactatgtaccaagctcttccatttgtgaaggagagggacctctactcaggattctttgcaaagttctccatgagctaccattcatttcttgtgggtgtgctactgtgctatccgcttctgtggctgaagctgtacctgcatgtgttcaagcagcgcaagtccaagctgggaaaagggggcaggaagaaacgggcgtgaaagaaataggttcagctcagctgccattatttcgctgaaattcggtaggcgagcaggttgccgggggatcttgcagctgatgcagttgtggaggcttggctgagatgaacagcgaacttactatactactagcagtttactgggggttgattacctttggaacagcaatttattatactactagcagactggtgatctctatcagatttactgaatttgagtgaagatgctgcgcaactcatggttatgacatttgagaaaaatatgacagattatttaacgtatgaaaaaaagtactggactatttgtgcagctaaaaaacaatatgaaacaactttttttgctcttccactttacttaaattacctctgttaattttcatttcagagttgcaaatcagtgtgataatcctaagctgcttgttcat

SEQ ID NO: 2016 - DNA, 1006 bp, Oryza sativa
ttcagggatagaggaagtgtattagaagatacatatgcttcaacaaaagaaaaagaaaagcccaaacggcaaataaccgcagccacagaaaatcccattgccagtagccacggcaagcacactgcagcagtgcagccgccatggctcgcccgtcgcagctctacctcctctcctacaactccgtccaggccctcggatggttcgtcgccttgctccgcctgctgccctgcctcgcccctccctcctccgtccactcgtcatacgccgtcgccggcgacctcgtatgcttgctgcagacgtgggcgattcttgaaacgatccatgccgccatcggattggtgcacacgtcgccgcttcttgccttcttgcagtggggagggaggactcacttcgttctcgctgtggttcggcaaatccccgaggttcagagtagcccttccgtgttcataacgttcatggcttggagcatatctgaggtcatcagatactcacattatgctctgacaaccttaaaagtttgtccaccatggctaacatatctcaggtacactgcctttataccgctgtatccaattggagtaggcccaggagaaatgtggactatgtaccaagctctcccatttgtgaaggagaggaaactctactctggcttctttgggaagttctccatgagctaccattccttcctagtggctgtgctggcagtctacccgtttctgtggatgaagctgtacctgcatgtgttcaagcagcgcaggtcgaagctggggaaatcgggaggcgccaagaaacgagcctgaagaaaccagctccgtctcgatgctcatacatagtagtacatgatccctttttgaaatttctctttgtttatttatttacgagaaagcatgtactcatgattctgattataatggctaaaacattaagcgcgatatgataatggtaaagctgcttggtttttttatagagagaaatgcaagctacttgcttgattgctgattcggag

SEQ ID NO: 2017 - DNA, 870 bp, Panicum virgatum
  misc_feature (297)..(297): n is a, c, g, or t
  misc_feature (594)..(594): n is a, c, g, or t
  misc_feature (618)..(618): n is a, c, g, or t
  misc_feature (634)..(634): n is a, c, g, or t
  misc_feature (691)..(691): n is a, c, g, or t
  misc_feature (837)..(837): n is a, c, g, or t
gggcggcggcacactgcggcaggccggcagcaatggctcgcccttcgaagctctacctcgtctgctacaactccctccaagcgctcggatggttcgtcgccctcctccgcctcctgccctgcctcgcctctcccgtctccgtccactccgcgtacgcggtcgccgccccttccgtctccgtccactccgcgtacgcggtcgccggcgacctcatctgcgtcctgcagacctgcgcgattcttgagacggttcacgccacgatcggattggtgcccacagcgccgcttcttgcatttntgcagtggggtgggaggactcacttcgttctcgctgttgttcggcaaatccccgaggttcagagcagtccgtctgtgttcataacgtttatggcttggagcatatctgaggtcatccgctactcccactatgctctgactaccttaaaagtttgtccatcttggctgacttatttcaggtacactgctttcatcccgctgtatccaattggggtcggaccaggagaaatgtggactatgtaccaagccctcccatttgtgaagaagaggaacctctacttaggtttcttcaagaagntctccatgagctaccattcatttntagtgggcgtgctggngtgctatccgttcctgtggctgaagctgtacatgcatgtgttcaagcaacgcaagtngaagctgcgaaaggggagcaggaagaaacgagcctgagaaaatttcgactcagctcagcttaggtgtaacttgtcaccggcatgtgaaatgcaaacggtcattgtggatcttaaagaaagtcattgtgaattgtcaagggatcttncagctgatgcaatggtgaaggctttgctgagaa

SEQ ID NO: 2018 - DNA, 1048 bp, Secale cereale
gcccttcttcagtcctcccgtccacttcagtacaggcgaggagcgacgacggcgcagaacctcagccacagaactccgtcgatactcatctgcagccacttctgggatcctaggacaaaccctctctgttccaacttccaacacgaagcgtctcggctgcctcggggaattcgccggccagcggcgagaacgaagcgaggcagcggccatggcgcgcccctcgcggctctacctcctcgcctacaactccctccaggccatcggatggtcagtcgccctgctccgtctcctgccctgcttcgcccctcccgtctccgtccgccccgcgtacgccgccgccggcgacctcatatgctttctgcagacctgcgcggttcttgagacggtccatgccgccgtcggactggtgcccacctcgccgtttctcgctttcctgcaatggggagggaggactcacttcattctcgcccttctccggcaaatccctgaggttcagggcagtccctctgtgttcataacgtttatggcttggagcatatctgaggtcattcgatactctcactatgctctgaccacgttaaaagtttgtccagcatggatgacttacctcaggtacactgcctttatcccgctgtatccaattggcgtaggaccaggagaaatgtggactatgtaccaagctcttccatttgtcaaggagagggacatctactcaggcttctttgcaaagttctccatgagctaccattcctttctggtgggtgtgctactgtgctatccgcttctgtggctgaagctgtacctgcatgtgttcaagcagcgcaagtccaagctgggaaagggggagaggaagaaacgggcgtgaaagaaataggctcagctcagctgccattatttcgccgaaattcagtaggcgagcaggttgccaggggatattgcagctgatgcagttgtggaggcttggctgagatgaacagcaaacttactatactactagcagtttactggggttgattacctttggaacagcaatttattatactactag

SEQ ID NO: 2019 - DNA, 1051 bp, Hordeum vulgare
ctggtatcctagaactaaccttctctgctccaacaggaagcgtcctcctctctctctctcaaaaaaaaaaggaagcgtcccgccgccgcctcgggggattcgccggccagcggcgagagcgaagcgaggcagcggcgccatggcgcgcccctcgcggctctacctcctcgcctacaactccctccaggccatcggatggtccgtcgcctttctccgcctcctggcctgcctagcccctcccgtctccgtcgactccgcatacgccgccgccggcgacctcatatgccttctgcaaacctgcgcggtccttgagaccatccatgccgccgtcggattggtgcccacctcgccgtttcttgccttcttgcaatggggagggaggactcacttcgttcttgcccttctccggcaaatccctgaggttcaggacagcccatctgtgttcataacgtttatggcttggagcatatctgaggttattcgatactctcactatgctctgagtaccataaaagtttgtccagcatggctgacttacctcaggtacactgcttttatcccgttgtatcctatcggggtaggaccaggggaaatgtggactatgtaccaagctcttccatttgtaaaggagagggacctctactcaggcttctttgcaaagttctccatgagctaccattcatttcttgtgggtgtgctgctgtgctatccgcttctatggctgaagctgtacctgcatgtgttcaagcagcgcaagtccaagctgggaaaggcggacaggaagaaacgggcatgaggcaaccagattgttgggagggtcttgcagctgtggagtcttagctgagttgagaggcaacttactatactactagcagattactgatctctatcggatttactgaatttgaatgaagatgccaaatttgttgtaacatatgcattttacaaaaattgagcaaagtatgccaaatttgtaaatgtatggggaaaaaaacttgaccatttttatacctaaaaagcaaaatcaaacaacttctttgttcttccactt

SEQ ID NO: 2020 - DNA, 1133 bp, Brachypodium distachyon
gccggcaatagttactgcaagtcgctccttgcagtatccaaggacaaaccctctctgttccaacttccaacaagaaccatctcagcgccccgcagggaagagaacgaagcgagtcggcgacggcaacgccggcggcagccatggctcacccttcgcggctctacctcctcgcctacaactcgctccactccctcggatggttcctcgcgttgctccgtctcctagcctgcctcgcccttcccgtctctgcctccgcccgctccgcgtacgccgttgccggcgacctcatatgcttcctgcaaacttgcgcggttcttgaaacggtccatgctgccgttgggttggttcctacctcgccgtttcttgccttcttgcaatggggagggaggactcacttcgttctcgcccttcttcgccaaatacctgaggtccagggcagtccatctgtgttcataacgtttatggcttggagcatatctgaggtcatccgatactctcattatgctctgactaccttgaaagtttgtccagcatggctgacttatctcaggtacaccgcttttatcccgttatatccagttggggtaggaccaggagaaatgtggactatgtaccaagctcttccatttgtgaaggagagggacctctactcaggcttctttgcaaagttctttatgggctaccattccttcctcgtgggtgtgctgctgtgctatccatttctgtggctgaagctgtacctgcatgtgttcaagcagcgtaagtccaagctgggaaaggtggaccggaagaaacgggtatgagaaaattcagttgagctcagctgtcactttttcactgaaaatcggacacaggcaacttggcgaggaatcttgcagctgatgcagttggaagcttcactgagctgaacaacaacttattatactagcagattactgggttttgcttaccttttgagcaacttattatactactactatctatgagtcacaatgcaagtcgtttcagatgtcgaagcggtcttcattgtgatactttgactatcaatttttatgtaaatatgttatcttcaaacaaaactatgtataaagtatgaaaattcatatttactgttggtcttgcttttatttttg

SEQ ID NO: 2021 - DNA, 596 bp, Saccharum officinarum
cggacgcgtgggctcgaatggtcgaacactggtttggaggcgtttgctcgctatccatggcgacttctacggctgctgccactgctctgctccgctccagcccggcagttccagccaagcggaggtgtctccatgcggttgctggccggtcgacgacgagaaggaggaggggagctgcaggggtcatgcgagcttgcttcaaccctctcggggacgagcgcatcctccgagaagccatcaaggagccagtagcattcatgggtggtgtgtttgctggcctcttgaggcttgacctgaatgaggatcctctcaaggaatggataactcgcacagtggaggcttctggaatagctgaggaaaacagctctgaagaatcaagtgaggcagatcaaaatgatgcacctcagcaaattgagattgagtgaggtgcattgtctaccttttgtccacttgacacttttccctttgtaacttatcctgaatatctgggatacctggtgcttgctcaattttggttgggcttatattgttcttaggtcaaatattggatcagcattggtaatatcaaacattgggctctggttttgttcaccccc

SEQ ID NO: 2022 - DNA, 1469 bp, Sorghum bicolor
cttttgccccgactcgcgcggctgccccgctccatccaaccacggatccacatccaccgtccagctcttgctcgattccgcggactgcaaggaaaatatcctccgccgcatcgggctgcgaggcaaggagttgaggaaacttctcgaatggccgaacgctggtgtggaggcgtttgctcgctatccatggcgacttctacgggtactgccactgctctgctccgccccagcaggccggcagttccagccaagttggcgcagaggaggtgtctccatggggttgatgggcggacgacgacgagtaggaggaggggagctgcagtggtcatgcgagcttgcttcaaccctctcggcgacgagcgcatcctccgagaagccatcaaggagccagtagcattcttgggtggcgtgtttgctggtctgttgaggcttgacctgaatgaggatcctctcaaggaatggataagtcggacagtggaggcttctggaatagctgaggaaaacagctctgaagaatcaagtgaggcagatcaaaatgatgcacctcagcaaattgagattgaatgaggtccattgtctaccttttgttcacttgatacttttccttttgtttacgtgcttgctcaaattttgtttgggcttatattgttctcaagtcaaatattggatcaacattggtaatatcaaacattgggccctggttttgttctaccactcctgttttataatatgaagccccagtcctctagacatggttaaacttggccattagtagaatacagtgtactaccagtaaatggaaagttatatgtgtgaatgaaatgaaagtctattggcatcattttttacagctaactttacatgaatgcagcaattcatttctcaaagtttgcaaactttgactcttgtgatgtgttggggcattatattgttaaatggaggcagtcgttggccaacaataaaatgaattcactgatacatgtattagggggtagctggataatcaaacattatttcgtgtttctacactgactggtgtaagtggtaaggacctgaagtcaattcttgcctgcagtgctgctttattaaaaaagggagaaaggatatttctgtccttcttgttctgttgctgacattagaacagtatattgttcacctcgtgtatccattggcttcaagtgaagttttaagttacatccgttgaatacttaaaatgtaagagactaagaacaaccttcaattgacatgtagaaaggatcccgcagggctttttggtgaataggatttaagtggacatcacatccgaatttggagtatttatggcttactgaaagtgcagtgtattaatttatgatttcgaaatgttttggttttggacagcgtttatagaggattgaactgaatattcaaatggagcagtctgctatactaacaactaactacacatcaaagtaatagtaaaaagaaat

SEQ ID NO: 2023 - DNA, 670 bp, Setaria italica
ctcaattccgcggctgcaagaaaaatatccttcgtcgcctccggctccgggtgaggaagactcccgaacggtcgaacactggtggaagcgtttgcttgccatccatggcgacttctactgctgctgctgctctgctccgcccctgcccgggagttcccgcagcgttgcagttgtcggagaggtggtctccccgtgcggttgctgggcggacgacgaggaggagaaggggagcggcgggggtcgtgcgagcttgcttcaaccctctcggggacgagcgcatcctccgagaagccatcaaggagccagtagcattcatgggtggtgtgtttgctggcctcttgaggcttgacctgaatgaggatcctctcaaggaatggatcactcggacagtggaggcttctggaatagctgaggaaaacagctctgaagaatcaagtgaggcagatcaaaatgatgcacctcaacaaattgaaattgagtgaggtgcactggctaccttttgcctgcttaacatattttccctgtaacttatcctgaatatctgtaatacctgagtcatgacattcttgcaaaaacttttatgtgcttatattgtttttaagtcaaacattggatcaacattgataatataaaacactgggccctggttttgttctcccactcctatttc

SEQ ID NO: 2024 - DNA, 748 bp, Pennisetum glaucum
gggtgaggaagattcctgaacggccgaacactgttacactggtggagtggaggcgtttgcttgctctccatggcgtcctctactgctgccgcagctctgctccgcccctgcccgggagttcccgctgcgttgtcggagaggaggtctccccgtgcggctgctgggttgacgacgaggaggagaaggcgagcggcgggggtcgttcgagcttgcttcacccctctcggggacgagcgcatcctccgagaagccatcaaggagccagtagcattcatgggtggtgtgtttgctggcctcttgaggcttgacctgaatgaggatcctctcaaggaatggatcactcggacagtggaggcttctggaatagctgatgaaaacagctctgaagaatcaagtgaggcagatcaaaatgatgcacctcagcaaattgaaattgagtgaggccaaatcagactgttgggcggtgctttccaactaatccagtgatgggcgtggatcaagcagggatggatatcagaatatccttcgccagtaagtctccagctccaacttgcgaggcgagctgttatggcataggtatgtggttggcactctagaaccagaagctgttattgttgattttgatctcaagtcactgacttgaactggagtgatatagcaatgcaaccactaactacttgacgatgactggaacatatttccactagaatttttatggttctcacttgatgatgactggaacatattt

SEQ ID NO: 2025 - DNA, 1408 bp, Panicum virgatum
acgccacgtgaaaagaaatgcatgatggaattatgccatgggatcgccgagtatatttggggcaagtggtcaactttacacatcatcatgcagccctaaagctccaggggattgagaaacgcgccgaagctcctacctaggattgcaaaatgcatcacactcatgctcgatgtgtgagcaaagtgtgcccggaaaaccggctgaagcaaaagcttttccgttttcctttttttccctttgagagtgcaaaaactgtgggtctctggaggttccgttcctcccgcatccgcaggcggctgacgcgcaagaaaccgaaaaacggcagccggtcagtcagccgggtcttattatattcgacagaatgggccgccgatgctttcttcctctcagcgaacagcccaccaaccgaccttgactggcccaacaaatacggtcgagccaggagccgagcccaatactgcggggtgttgccggacgggccgacgggccgcttcaggcaacgagtggccctccaggcccgcctcgcgcgtctccatccattgccccgtgttccacggctgcaagaaaaatatcctccgtcgccggcctccggctccgaggcgaggaaggctcccgaacggtcgaacactggaggcgtctgctcgctacccatggcgacttctactgttgttgctgctgctcagctctgccccagcccgcggtttcctgccgagttgtcgaagagggggtctcccagtgcggttgctgggcggacgaggaggaggagaaagggagcggcgggggtcgtgcgagcatgcttcaatcctctaggggacgagcgtatcctccgagaagccattaaggagccagtagcattcctgggtggtgtgtttgctggcctcttgaggcttgacctgaatgaggatcctctcaaggaatggatcactcggacagtggaggcttctggaatagctgaggaaaacagctctgaagaatcaagtgaggcagatcaaaatgatgcacctcagcaaattgagattgagtgaggtgcactggctaccttttgtctgcttttttttttatggaataccttttgtctgcttaacatcttttccttgtaacttatcctgaacatctgtaatacctgagtcattacatgcttgctcaaaattttatgtgcttatattgtttttgagtcaaacattggattaacattgataatacaaacatttgggccttggttttgttctaccactcctatttcataatattaggcaccagtcctcaatatggtatcagggccagaggtctctagttcgaatcctggcgggcgcgattaaataaaataattgcagctgacttaatttcgatgtttgaggcctgagggagcctgcacgtgggggagagtgttgaagtataagtgaattgc

SEQ ID NO: 2026 - DNA, 1260 bp, Panicum virgatum
gaaggagctacggagtatgtttgggggcaagtagtagtcaaactttacacatcatcttgcagcccaaaaggctaaatcctccgggatagagaaacgcgttgcagccctgaagcccctaggattgtcaaaatgcgtaatacttgtgctcgatgtgtgagcaaagtgtgcccggaaaaccggctgaagcaaaagcttttccatcttccttttttttcattgagagtggaaactgtggtctttggacgttcctccgttcctcccgcatccgcaggcggctgacgcgcaagaaaccgaaaaacggcagccgaccgtcagctgggccgggagttattatatttgaaaaaatgggccaccgatgctttcttcctctcaacgaacagcccaccaacccaccatgcccaacaaatacggtccagcagtggagcactcccgggcccaattactgcggggtgttgctgtacgggccgaaccttcgcaaaccacggcactctctcgcagtcacgggccgcttcaggcaacgagtggcccgctaggcccgctccatccattgctctgtttccgtggctgcaagaaaaatatcctccgtcgaccgtcgcctccggctccgaggcgaggaaggctccggaaccggaacggtcgaacactgcggctgccggaggcgtttgcttgctacccatggcgacttctgctgttgctgctgctgctctgctctgccccagccagctatttcccgccgcgttgtcgaagagggggtctcccagtgcggttgctgggcggacgaggaggaggagaaggggagcggcgggggtcgtgcgagcatgcttcaatcctctaggcgacgagcgtatcctccgagaagccattaaggagccagtagcattcctgggtggtgtgtttgctggcctcttgaggcttgacctgaatgaggatcctctcaaggaatggatcactcggacagtggaggcttctggaatagctgaggaaaacagctctgaagaatcaagtgaggcaaatcaaaatgatgcacctcagcaaattgaaattgagtgaggtgcactggctaccttttgtctgcataacatcttttccttgtaacttatcctgaatatctgtaatacctgagtcatgacattcttgctcaaaattttaaatgcttatattgtttttgaatcaaacattggattaacattgataacacaaacatttgggccttggttttgttctaccactcctatttcataatattaggcaccagtcctc

SEQ ID NO: 2027 - DNA, 862 bp, Panicum virgatum
ggctccgtttccgtggctgcaagaaaaatatcctccgtcgaccgtcgcctccggctccgaggcgaggaaggctccggaaccggaacggtcgaacactgcggctgccggaggcgtttgcttgctacccatggcgacttctgctgttgctgctgctgctctgctctgccccagccagctatttcccgccgcgttgtcgaagagggggtctcccagtgcggttgctgggcggacgaggaggaggagaaggggagcggcgggggtcgtgcgagcatgcttcaatcctctaggcgacgagcgtatcctccgagaagccattaaggagccagtagcattcctgggtggtgtgtttgctggcctcttgaggcttgacctgaatgaggatcctctcaaggaatggatcactcggacagtggaggcttctggaatagctgaggaaaacagctctgaagaatcaagtgaggcaaatcaaaatgatgcacctcagcaaattgaaattgagtgaggtgcactggctaccttttgtctgcataacatctttttccttgtaacttatcctgaatatctgtaatacctgagtcatgacattcttgctcaaaattttaaatgcttatattgtttttgagtcaaacattggattaacattgataacacaaacatttgggccttggttttgttctaccactcctatttcataatattaggcaccagtcctcaatatggtatcacgtatcagggccagaggtctttagttcgaatcctggcgggcgcgattaaataaaataattgcagctgacttaatttcgatgtttgagcctgagggagcctgcacgtgggggagagtgttgaagtataagtgaattgc

SEQ ID NO: 2028 - DNA, 971 bp, Sorghum bicolor
cgggaccctcgaatgaggccttttcatgtctgatcggcccatttgctctaacatctagcccagggaactcttgtggcacacatcgacgcgacactcccacacgctacacggcctctcggtctcggcggggggccggcagcaacaaaccgggcagcagcacggcagcaatggcgtcgagttcgaccctggatttggcgatgggccccggcgtcctcgtcccccgcagcgcggtcccatacgcctccttcgctcgaggaaggggaaggagcgcgagcgggaggaggagcaggaatctggtgctctccgcttccttctccaacggtgcagcagtgccatccctgacaacagactcagagaagaagggcccagtgataatggaaattccactggaccaaatccggaggccactgatgcgaacgcgtgccaatgatccagtcaaggtgcaagaactcatggacagtatccgtgtcattggcctccaagtacctattgatgtgctggaggtcgatggggtctactatggcttctctggatgccaccgctatgaggctcaccagcgccttggtctgccaaccatccgctgcaaagttcgtcgtgggacaaaagaaacactgaggcaccatatgcgatgagttggatgttattgatggccacatcagctacaaagtgatctgtgtatctagagcttaaacagaaccttctatgggtttttttttccatcgtctgtaattctccatacctgtaaatgttgcccaaacagagttgtgaatagtacttctgtactcagcagcaagaggaaatgttaattctgccaacaacattcttttcgataagtggatcttccatttacatggggtagcacgactggatgagtagctgatgtaatttgaggttggatggatgagtaccacccactcagtacatcattccatttctacacgattcctatttctccgttccaaagggggtat

SEQ ID NO: 2029 - DNA, 638 bp, Saccharum officinarum
cgggcagcagcactgcagcaatggcgtcgaattcgaccatggattgggcgatgggccccggcgtcctcctcccccgcagcgcggtcccatacgcctccttcgctcgaggaaggggaaggagcgcgagcgggaggaggagcaggaatctggcgctctccgcttccttctccaacggtgcagcagtgccatccctgacaacagactcagagaagaagggcccagtgataatggaaattccactggaccaaatccggaggccactgatgcgaacacgtgccaatgatccagtcaaggtgcaagaactcatggacagtatccgtatcatcggcctccaagtacctattgatgtgctggaggtcgatggggtctactatggcttctctggatgccaccgctatgaggctcaccagcgccttggtctcccaaccatccgctgcaaagttcgtcgcgggacaaaagagacactgaggcaccatatgcgatgagttggatgttattgatggttacatcagcttcaaagtgatctgtgtatctagagctaaaacagaaccttccatggtctttttcatcgtctgtaattctccatacctgtaaatgttacccagagtgttgaatagtacttctgtactcagcagcaa

SEQ ID NO: 2030 - DNA, 876 bp, Setaria italica
cgaatataggcctttgccggtcggcccaactcgcccaacatctggcccagcccagggaagtcttgtggcacacatcgacgacgcgacactccgacacgctacggcctctcgggctcggggggccggcaagaaactgccaaactggtagtggtagcaccaccgccgcaggcacaagcgcaaccgcgcaagcatggcgtcgagttcgagcctggatttggcgatgacctccggcgttctcctccaccgccgcgcgctcccacacgcctccttcatcccgggaaggggaaggagcgcgagcgggaagaggagcaggaatctggctctctccgcctcctcctccaatggtgcagcagtcccatctctgacaagtgactcagataagaagggccctgtgatcatggaaattccactggacaagatccgaaggccactgatgcgaacgcgtgccaatgatccagtcaaggtgcaagagctcatggacagtatccgtgtcatcggcctccaagtacctattgatgtgctagaggttgatggggtctactatggcttctctggatgccaccgctacgaggcacaccagcgccttggtctcccgaccatccgctgcaaagtccgtcgagggacgaaagaaacactgaggcatcatatgcgttgagttggatgttattgactaaatcagaagttatctgtgtatctagagctagatcaagaccttccctgttccttttcatcatctgtaaattgtaatcctccgtacctgtacatgttgccgaaacagattggtgaatactactgaactcaacagcatgagaaaatattaactcttgcctacaacattctttttcgaaacggctggacttccttttacatgagtag

SEQ ID NO: 2031 - DNA, 580 bp, Triticum aestivum
ccctggatttggcgatgggccccggcgtcctcgtcccccgcagcgcggtcccatacgcctccttcgctcgaggaaggggaaggagcgcgagcgggaggaggagcaggaatctggtgctctccgcttccttctccaacggtgcagcagtgccatccctgacaacagactcagagaagaagggcccagtgataatggaaattccactggaccaaatccggaggccactgatgcgaacgcgtgccaatgatccagtcaaggtgcaagaactcatggacagtatccgtgtcattggcctccaagtacctattgatgtgctggaggtcgatggggtctactatggcttctctggatgccaccgctatgaggctcaccagcgccttggtctgccaaccatccgctgcaaagttcgtcgtgggacaaaagaaacactgaggcaccatatgcgatgagttggatgttattgatggccacatcagctacaaagtgatctgtgtatctagagcttaaacagaaccttctatgggttttttttccatcggctgtaattctccatacctggaaatgttgcccaaacagagtt

SEQ ID NO: 2032 - DNA, 718 bp, Panicum virgatum
ggacggcctctgactcttgagggccggcaagaaaaactctgctggcagcaccgcagcaggcgcaagcgcaacgcgggcaatggcgtcgagctcgagcctggatttggcgatggcccccggcgtcctcctccaccgccgcgtggtcacgcacgcctctttcatccggggaaggggaaggggcgcgagcgggaggaggagcagcagcaatctggccctctccgcttcctcctccaacggtgcagcagttccatccttgacaagtgactcagataagaagggccctgtgatcatggaaattccactggacaagatccgaaggccactgatgcgaacacgtgccaatgatccagccaaggtgcaagagctcatggacagtattcgtgtcattggcctccaagtacctattgatgtgctagaggttgatggagtctactatggcttctctggatgccaccgctatgaggcacaccagcgccttggtctcccaaccatccgctgcaaagtccgtcgagggacgaaagaaacacttaggcaccatatgcgatgagttggatgttattggtgactgaatcagctagagagtgatctttgtaactagagctaaaacaagaccttctgttctttttcatcatctgtaatcgtccatacttgtaaatgttactcaaacagattggtgaatactaattccgaactcaacagcaagaggaaatgttgactc

SEQ ID NO: 2033 - DNA, 747 bp, Pennisetum glaucum
gccaaactggtaatggtagcaccaccgccgcaggcacaagcgcaaccgcgcaaggcaagcatggcgtcgagttcgagcctggatttggcgatggcctccggcgtcctcctccaccgccgcgcgctcccacaggcctccatcccgggaaggggaaggggctcgaacgggaagaggagcaggaatctggctctctccgcctcgttctctaatggtgcagcagtcccatccctgacaagtgactcagataagaagggcccagtgataatggaaattccactggacaagatccgaaggccactgatgcgaacgcgtgccaatgatccagtcaaggtgcaagagctcatggacagtatccgtgtcatcggcctccaagtacctattgatgtgctagaggttgatggggtctactatggcttctctggatgccaccgctacgaggcacaccagcgccttggtctcccaactatccgctgcaaagtccgtcgtgggacaaaagaaacattgaggcaccatatgcgatgagttggatgttattgatggcaaaattggctagaaagcagtccgtgtatctaggaagctatcaagacctccactgctctttttcataatctgtaatgctccatacctgtaaatgtacccaaacagattggtggatagtagttcagaacaaaacagcaagaggaaatgtttacttttgcctacaacattgtttttctaatcggtggaacttgcatttacatgtagtag

SEQ ID NO: 2034 - DNA, 1003 bp, Panicum virgatum
aaagaagaggcgccaacacgacgttgatagcccgcatgaggcctttcccagggaactcttgtggcacacatcgacgcgccgctccgacacgccacgacggcctctgactctgagtgccggcaagaaaaactctgttggcagcaccgcagcaggcgcaggtgcaacgcgggcaatggcgtcgagctcgagcctggatttggcgatggcccccggcgtcctcctccaccgccgcgtggtcacgcacgcctctttcatccggggaaggggaaggggcgcgagcgggaggagcagcagcagcaatctggccctctccgcttcctcctccaacggtgcagcagttccatccctgacaagtgactcagataagaagggccctgtgatcatggaaattccactggacaagatccgaaggccactgatgcgaacacgtgccaatgatccagccaaggtgcaagagctcatggacagtattcgtgtcattggcctccaagtacctattgatgtgctagaggttgatggagtctactatggcttctctggatgccaccgctatgaggcacaccagcgccttggtctcccaaccatccgctgcaaagtccgtcgagggacgaaagaaacacttaggcaccatatgcgatgagttggatgttattggtgactgaatcagctagagagtgatctttgtaactagagctaaaacaagaccttctgttctttttcatcatctgtaatcgtccatacttgtaaatgttactcaaacagattggtgaatactaagtccgaactcaacagcaagaggaaatgttgactcatgccgacaccattctttttcggatcggtggagcttccatttacatggagtaggatggctggacgagtaaaactgaatgcattgtgatgttggatggatgagcaccagccactcagaagatcattgtgttccaatctggagcttaatttttcaattccaagaacgaaaatgaagattcttgacctgaggaaa

SEQ ID NO: 2035 - DNA, 943 bp, Panicum virgatum
cggcccagcgcactcttaacttgtaaggcccaataacaaagccaacacgaccttaatatcaaagccaacatgcccaataacagcgcatgaggaggcctttcccgggcggcccaacctatccaacatctggcccagggaattcttgtggcacacatgacacatcgagctctgagggccggcaagaaacttctggcagcaggcgccaggcgcaagcgcatcgcaagcaatggcgccgagttcgagcctggatttggcgatggccccgagcgtcctcctccaccgccgcgtggtcacacacgcctccttcatccggggaaggggaaggggcgcgagcgggaggaggagcagcaatctggccctctccgcttcctcctccaacggtgcagcagttccatccctgacaagtgactcggataagaagggccctgtgatcatggaaattccaccggaccagatccgaaggccactgatgcgaacacgtgccaatgatccagccaaggtgcaagagctcatggacagtatttgtgtcatcggccttcaagtacctattgatgtgctagaggttgatggggtctactatggcttctctggatgccaccgctacgaggcacaccagcgccttggtctcccaaccatccgctgcaaagtccgtcgagggacgaaagaaacacttaggcaccatatgagatgagttggatgttattggtgactaaatcagctagagagtgatctgtgtatctagagctaaaacaaaacctttcatcatctgtaatcgtccatacttgtaaatgttactcaaacagattggcgaatactaagtctgaactcaacagcaagaggaaatgttgactcatgcccacaccattctttttcggatcggtggaacttccatttacatggaataggatggctgcatgagtaaccgaatgcattgtgatgttta

SEQ ID NO: 2036 - DNA, 682 bp, Panicum virgatum
ctggcagcaggcgccaagcgcaagcgcagcgcaagcaatggcgccgagttcgagcctggatttggcgatggccccgggcgtcctcctccaccgccgcgtggtcacacacgcctccttcatccggggaaggggaaggggcgcgaacgggaggaggagcagcaatctgcccctctccgcttcctcctccaacggtgcaacagttccatccctgacaagtgactcagataagaagggccctgtgatcatggaaattccactggaccagatccgaaggccactgatgcgaacacgtgccaatgatccagccaaggtgcaagagctcatggacagtattcgtgtcatcggccttcaagtacctattgatgtgctagaggttgatggggtctactatggcttctctggatgccaccgctacgaggcacaccagcgccttggtctcccaaccatccgctgcaaagtccgtcgagggacgaaagaaacacttaggcaccatatgagatgagttggatgttattggtgactaaataagctagagagtgatctgtgtatctagagctaaaacaaaacctttcatcatctgtaatcgtccatacttgtaaatgttactcaaacagattggcgaatactaagtctgaactcaacagcaagaggaaatgttgactcatgcctacacggctacacc

SEQ ID NO: 2037 - DNA, 610 bp, Eragrostis curvula
cggcggggggagagcggtgaccggtgaactagttggtctcgcatctcaggctcgcagtcgcagcagcgcaaaccatggcgtcgagttcgaacccgagttcggtgaagaccatgctcccaggcgtcctcctccaccgccccgcagtcaccaacgcctctttcgcgcggggaacgagaagacgagcgaacgctgggaggggcaggaaccttggattctccgtttcctcctccaacggttcagctgtgacttccctgacaagtgaatcggaaaagaagggacctgtgatcatggaaattccactagaccagatccggaggccactgatgcggacacgtgcaaatgatccggccaaggtgcaagagctcatggacagtatccgtgtcatcggactccaagtacctattgatgtgcttgaggtcgatggagtttactatggcttttctgggtgccatcgttacgaagctcaccagcgcttaggcctccctaccatccgctgcaaggtccgtcgaggaacaaaggaaacactgaggcaccatatgcggtgaattagatggcagtttggtactgatggctgatgaacaactccaatcagaaacttttctgtgtatgt

SEQ ID NO: 2038 - DNA, 851 bp, Sorghum bicolor
gttccctccaaaatacacaaaaataaataagaggataagccaagccttcactgttttccccaccgtctccctccctccctcccctccctgcttcctcagcctctcatcctatccaagaaggcaagaacccgacacaggaactcgcagcagccgttagcgccagccgaagcaggccgcagccatggccgcccccgcaacgacgacctccctgctgagcacgctgccgcagctctcgtcgttctcggggaagagctcgcctccgtccgtggtgcacgtggcgcgccgggcgccgacggcggtggtggctgccaaggggtacaatgtgcagatcctggtggacgagaacgagggggaggagtccatcttccgccggttccggcgggaggtgatgcgcgccggcgtgctgcaggagatcaagcgccgccggaggtacgagagtaagacggacgagaagaagcgcaaggcgcgcgaggccggacgccgcaaccgccgcaggcgtatgatggatgagccaaggttcccagaagaagacgctgacgcaacctcaaaggctcgggacgaggacgatgacaactgggagatcgatggcatcctgtgaaacaaaaacaacgcaatgtccataagctcacaacgtccagatgcacagacccggcaaatttgagttctttttggccccagtacgtaagacgcaaaccgtatgagcgtgttcaattccacctcaattgttacaaacagttgcaatgtacaactaaattttagcaaatgcagcatcctccgattcctttcagtttcattccctgagctcttgtgccgagtgtgtgtttgaaatcctactcttgtgtccgttccag

SEQ ID NO: 2039 - DNA, 1515 bp, Zea mays
gccaaaccttcgctgtccatcgtcaccctccttccttccccagcctctcatcctatgcaagaacccataatccagacccacgaactcgcagcagccattagcgtgcgctagccggccgcagccatggccgcccccgcaacgacctctctactgagcaccctgctgaatctgccgctcgccccgttgtcggggaagagctcgccgccgtccgtggtgcatgtggcgcggcgggggccgatggtggtggtggccgccaaggggtacaatgtgcagatcctggtggacgagaacgagggggaggagtccatcttccggcggttccggcgggaggtgatgcgggccggcgtgctgcaggagatcaagcgccgtcggaggtatgagagcaagacggacgagaagaagcgcaaggcgcgcgaggccgggcgccgcaaccgccgcaggcgtatgatggatgagccgaggttcccagaagaagacgccgacgctaccgcaaaggctcgggacgaggacgatgacaactgggagatcgatggcatcctgtgaaagagaagcaacggagtccatgatttcacaacgtccagacacacagaccccgacagctaatctgagttctttttggcccccggtgagacgcaaaccgtatgagttttggccgtgcccatttccgctttgaatggttacagttgcgatgtacaactaattaaatgttagcaaatgcagcatcccccatgcatgcatccctttcattccctctaacgtccttgtttagcttgccaggttggcaggttcactgtcccaaaaatagcacagtgacacccggccaggtggttgctcgcgagaggcgcctccgtgacacccggtccatgcaaccgcggaggccgcgcgcagccactccattgccgctttttaaagcatcgcgcaccaccttcgcctcgccaaaatccacaagccacttcagtgcttgcgatcgcgtcggccacgatctcttgcgaaaaagcttaccctgtgtctgtctgtccgaccgtcagtccgtctaacaatcgatttccatgacgacgtccccgcgcgtgtggctgctcgccatggcactggcgctcgcctgcgtgctgctcgtgaggtccgccgacgctgctgccgaggcgtccccgactccaggcggctccacctacgggtgcaacccggccacggacaagtcgtgcaagcccgagggcgtgggggtggtgctgccgggcggcggcatcgacctcgacggcgacggtgacgaggacgagctgccgcagttccagccccacctcatgatcctcggccatggccactgatgagtgtaaatggttggttggttggtcgtcctcagccgatctactggacgacacgatggcggtcacatttgcgtccgaatttctcttgttaaattgaggccagagtgattaaatgagcatatgatggtaatttattcaccgtgtattgcctgttcaaacatgaaagtgcactgatacaattttaaaaaacttatgc

SEQ ID NO: 2040 - DNA, 1059 bp, Panicum virgatum
ccttcactatcccctcctcccctcagcctctcatcctatccatccaagaacccagaaaattccagacccgggagcgcgcagaaattagcgccagctagccagccagccagccgaagcaggccgcagccatggccgcccccgcctcgacctccctgctgagcacgctgctgcagctgccccttgccccgttctcggggaagagctcgccgccgtccgtggtgcacgtggcgcggcgggcgccgacggcggtggtggccgccaaggggtacaatgtgcagatcctggtggacgagaacgagggcgaggagtccatcttccggcggttccgccgcgaggtgatgcgcgccggcgtgctgcaggagatcaagcgccgccggaggtacgagagcaagaaggacgagaagaagcggaaggcgcgggaggctgggcgccgcaaccgccgcaggcgcatgatggatgaaccaaggttcccagaagaagatgcaggggcagctgcaagagctcgcgatgaggacgatgacaactgggaaattgacggcctcctgtgaaacaatggagttcataagttcagaaccggtccagatacgaagtttcgacatttgagttcttttttgggcatgcaaagcacaaaactgtattgagttttggcagtgttcatttccacttcaattgtacgatcgcaatgtgtaactaaatcttagctaacgcagcatccttcgctagctttcacggagaccttgtgtccactgcgtttcaaatctgtcttttgcatctgtttcgataccgttttttagatatgtttatgaacagtagcagatgtaggattgagcctagggggctctcctgttcttcttcctcccacctcctcaaatttgtaggaggggctccatgggattttcagcggtaggaggggtttgagcctcttagactgaccgttggatccacccctgaatccacccctgttgatgaaagttcagaaactgatcagcgacggtgtttactaaaccgcatctgttcctcttccgcagagaatattataattacaagctgcattcggat

SEQ ID NO: 2041 - DNA, 809 bp, Setaria italica
ccatcgtctccttcctcagcctctcatcctatccatccaagaaccccgaaaaattccagacccgggagcgcgcagcaccggcagccattagcgcccacttaccagacagccagccagccgaagcaggccacagccatggccgcccccgccacgacgtccctgctgagcacgctgctgcagctgcccctggccccgttctcagggaagagctcgccgccgtccgtggtgcacgtgccgcggcgggcgccgacggcggtggtggccgccaaggggtacaatgtgcagatcctggtggacgagaacgagggggaggagtccatcttccggcggttccggcgggaggtgatgcgcgccggcgtgctgcaggagatcaagcgccgccggaggtacgaaagcaagaaggatgagaagaagcgcaaggcgcgcgaggccggacgccgcaaccgccgcaggcgcatgatggatgagccaaggttcccagaagaagatgcaggcgccgcaaaggctcgtgatgatgatgatgacaactgggagattgacggtctcctgtaaaacaatgaagttcataagttcagatacacagtttcaacgatttgagttctttttttggccctgcaaagcgcaaaactatgtgagttttggcagtgttcatttccacttcaattgtacggttgtaatgtgtaactaaatcttagctaatgcagcatccttacctttcactgagcccttgcgttgactgtgtttcaaatctgtctttgcatccttttcagcacccattgttaagatatgtttatgaaagttcagaaact

SEQ ID NO: 2042 - DNA, 696 bp, Saccharum officinarum
  misc_feature (654)..(654): n is a, c, g, or t
  misc_feature (685)..(685): n is a, c, g, or t
  misc_feature (695)..(695): n is a, c, g, or t
cagcctctcatcctatccaagaaggcaagaacccgacacaggaactcgcagcagccattagcgcgcgctagccagccagccgaagcaggccgcagccatgaccgcccccgcaacgacgacctccctgctgagcacactgccgccgctcgcgccgttctcggggaagagctcgccgccgtccgtggtgcacgtggcgcgccgggccccgacggcggtggtggccgccaaggggtacaatgtgcagatcctggtggacgagaacgagggggaggagtccatcttccgccggttccggcgggaggtgatgcgcgccggcgtgctgcaggagatcaagcgccgccggaggtacgagagcaagacggacgagaagaagcgcaaggcgcgcgaggccggacgccgaaaccgccgcaggcgtatgatggatgagccaaggttcccagaagaagacgctgacgcgacctcaaaggctcgggacgatgacgatgacaactggcagatcgatggcatcctgtgaaacaaaaacaatggagcgtccataagctcacaacgtccagatgcacagacccgacaaatttgtgttctttttggccaacgtaatacgcaagcaaaccgtatgagttttggccgcgttcattcctacttcaattgttacanacagttgcgatgtacaactaaatattagcanatgcagcatnc

SEQ ID NO: 2043 - DNA, 525 bp, Zea mays
gatgccgtcgacctcccagttgtcgttgtcctcgtcccgagccttggaggtcgcgtcggcgtcttcttctgggaacctcggctcgtccatcatacgcctgcagagtttccaacgcaaacacatgaggggaagcacatacctgcgacggttgcggcgtccggcctcgcgcgccttgcgcttcttctcgtctgtcttgctctcgtacctccggcggcgcttgatctcctgcagcacgccggcgcgcatcacctcccgccggaacctgcgaaagatggactcctccccctcgttctcgtccaccaggatctgcacattgaaccccttggccgccaccaccgccgtcggcgcccggcgcgccacgtgcaccacggacggcggcgagctcttccccgagaacggagcgagcggtagctgcagcagcgtgctcagcagggagctcgttgcgggggcggccatggctgctggcctgctgcgagttcgtgggtctcggttctgcgttcttggataggatgaggctgaggaagg

SEQ ID NO: 2044 - DNA, 456 bp, Sorghum bicolor
atgccatcgatctcccagttgtcatcgtcctcgtcccgagcctttgaggttgcgtcagcgtcttcttctgggaaccttggctcatccatcatacgcctgcaagccatgttcatctcatacctgcggcggttgcggcgtccggcctcgcgcgccttgcgcttcttctcgtccgtcttactctcgtacctccggcggcgcttgatctcctgcagcacgccggcgcgcatcacctcccgccggaaccggcggaagatggactcctccccctcgttctcgtccaccaggatctgcacattgtaccccttggcagccaccaccgccgtcggcgcccggcgcgccacgtgcaccacggacggaggcgagctcttccccgagaacgacgagagctgcggcagcgtgctcagcagggaggtcgtcgttgcgggggcggccatggctgcggcctgcttcggctgg

SEQ ID NO: 2045 - DNA, 606 bp, Pennisetum glaucum
gcacgctgctgcagctgcccctggccccgttctcggggaagagctcgccgccgtccgtggtgcacgtgccgcggcgggcgccgaccgcggtggtggccgccaaggggtacaatgtgcagatcctggtggacgagaacgagggcgaggagtccatcttccggcggttccggcgtgaggtgatgcgcgccggcgtgctgcaggagatcaagcgccgccggaggtacgagagcaagaaggacgagaagaagcgcaaggcgcgcgaggccggacgccgcaaccgccgcaggcgcatgatggatgagccaaggttcccagaagaagatgcaggtgccgcgaaggctcgtgatgaggatgatgacaactgggaaattgacggtcttctgtaaaacaatggagttcataagttcagacacagtttcgatgatttgagttccttttttggccctgcaaagcgcaaaactatgtgagttttggcagtgttcatttccacttcaattgtgcgatcataatgtgtaactaaatcttagctaatgcagcatccttacctttcactgagccctcttgtgatgactgtgcttcaaatctgtcctttgcatctgtttcaac

SEQ ID NO: 2046 - DNA, 942 bp, Oryza sativa
aaaatgtattaaatttattcaaagtattcccctccaaaattcacaaataaatttcctaaattataaattagagaggataagtcgccaatcctctctcttttgccttcactatccatccctcctccgcttcttcctcctcagcctctcatccaatttttccattcccagaaatcgagcgaggaagctaagctaaaccaatcgaaggccacggccatggctgccgctccagccaccacgtcactgctgagcgcgctgctgcagcttcccctggccccgttctccgggaggaggtcgccgccgccgccgtcggtggtccacgtggcgcccccgcgctcgccgacggcggcggtcgcggcgaccaaggggtacaatgtgcagatcgtggtggacgagaacgagggggaggagtccatcttccggcggttccggcgggaggtgatgagggccggcgtgctccaggagatcaagcgccgccgccgctacgagagcaagaaggacgagcgcaagcgcaaggcccgcgaggccggccgccgcaaccgccgcaggcgtatgatggaggagcctaggttcccagaagacgatgctgattcagaggccgcgaggagggctcgtgacgatgaaaaggataactgggagattgacggaattctgtgagtgaaacaatggagttcatagccattcagatgcaaagtttccatgttttgagttattgtttttttggtccgcaaagcacaaactatatgagttgtcggccttaatttcctcttcaattgtacggtttgaatgtactaaatcttagctaatgcagcatccttttttttttttacctctgtaccttttccagtttgtttgcaatacattttgcaaatatgagcctataattataaaagagtaaatattatacaatgttatcctatagttgagtaaaaatggagaattcat

SEQ ID NO: 2047 - DNA, 4990 bp, Panicum virgatum
gcgagcccgtcgcctcccccactcactcccctcttccggagacccgatcatggagctcgcacggcaccaccaccaactaccgcactgagacgtgcacgcttgctcgcacacgcagcgccaccggcgccgttcgagcgaagcagcgcgaggggcgtgagaccgagcaccggccgggccggcgcttgaacggcgccgtacgtccaggcgggcatggagggcgcgatggagaaggtgtgggagtcggggcggcgggcgagccggagcatcagccggggcatgggcatggacgcgtggggcgtcgacgacgccttcgtgccgccgcaccaccagtcccgctcccggtcccggcgtgccggcggcagccgcggcgccgacgacgacgaggaggcgctgcgctgggcggccatcgagcgcctcccaacctacagccgcgtgcgcaccgccatcctctcttccgccgccgaccagttcaaggaggtggacgtgcgcaagctcgccgtcggggaccgccaggagttcatcgagcgcgtcttccgcgtcgccgacgaggacaaccagcgcttcctgcagaagctccgcaaccgcatcgacagggtgggcatcgagctgccgacggtggaggtgcggttcgagcaggtgacggtgcaggccaagtgccacgtgggcagccgcgcgctgccgacgctgctcaacacggcgcgtaacgtggcggagggcgccctgggcctctgcggcctccggctggggcggcaggccacgctcacgatcctcaaggacgtctccggcgtggtccggccgtcccggatgacgctgctgctgggcccgccgtcgtcggggaagaccacgctgctgctcgccctcgccggcaagctggacccggcgctccggcgcgccggcgaggtcacctacaacggcttcgcgctgggcgagttcgtgccgcagaagacggcggcgtacatcagccagaccgacgtgcacgtcggcgagatgacggtcaaggagacgctcgacttctccgccaggtgccagggcgtcggcaccaaatacgatcttatgaccgagctgacgaggagggagaaggaggccggcatccggcctgagcctgaagtcgacctcttcatgaaggccacttcaatggaaggggtgcaaagcagtctccaaacggattacactctcaggatactcggactcgacatctgcgccgacaccatcgtcggcgaccagatgcagcgggggatctccggtggccagaagaagcgtgtcaccacaggagagatgattgttggcccgaccaaggtgctattcatggacgagatatcaaccggattggatagttccaccacattccaaattgtcaaatgtctccagcagattgtgcacttgggcgaggccaccatcctcatgtccctccttcagcctgcccctgagacctacgacctatttgacgacatcatcctactgtcagaaggccaaattgtttaccagggacctcgcgaatatgttcttgaattctttgaaacatgtggattccgctgccctgagcgcaagggtactgcagactttcttcaggaggtgacatcaagaaaggatcaggagcagtactgggccgacaagcagaggccttacagatacatttccgtcccagaatttgcacagcggtttaaacgtttccatgtcgggctccagttagagaaccacctctcactgccgtttgacaagagccgttgccatcaagctgctcttgtattctcaaagcactcggtgtcaaccacagagctactcaaggcatcctttgacaaggagtggctcctcatcaaacggaattcatttgtgtacatcttcaagaccatacagctcatcattgtagccctcattgcgtcaacagtgtttctaaggacccacatgcatacaaggaatgtagatgatggctttgtgtacattggagcactgctctttagtctgatagtcaatatgttcaatggttttgccgagctctctttggccataacaaggttaccggtgttctacaagcacagggacctcctcttttaccctgcttggatcttcacactaccaaacgtcgttctcagaatcccattctccataattgaatctgtagtctgggttcttgttacatactacaccatagggtttgctccagaggccgacaggtttttcaagcacttgctgcttgtgttcttgatccagcagatggcaggtgggcttttcagagcaattgccggactttgcagatccatgaccatcgctcaaactggtggagcactatttcttcttatcttctttgttcttggaggctttctcctgccaaaaggtttcatccctaaatggtggatctggggctattggatttcacctttgatgtatggatttaatgctctagcagtcaatgaattctatgctcctcggtggatgaacaagttcgtaatggaccaaaatggtgttccgaaaagactagggatatctatgcttgaaggcgccaacatctttgttgacaaaaactggtactggattggagcagcagggctcttgggtttcaccattttcttcaatgtactttttacactgtcacttatgtatctgaaccctctcggcaaaccacaagctgttatatcagaagaaactgcacaggaagcggaaggcaatgagcatgcaagagggacagtaagaaatggcagcacgaaatcaaaggacggtggtcatagcaaggaaatgaaggagatgagattgagtgcgcgtttgagcaactgctcatcaaatggggtttcacgagtcatgtccattggcagcaatgaagctgctccaagaagaggaatggttcttccatttaaccctcttgccatgtcctttgataatgtgaactactatgtcgacatgcctgcggaaatgaaacagcaaggagtgcaggataacaggcttcaattattgcgtgaggttacagggtcattcaggcctggagtactgacagcgcttatgggtgtcagtggagctggaaagactactcttatggatgtcttggctggaagaaagactgggggttatattgaaggtgatatcagaattgccggctatcccaagaaccaagccacatttgcaaggatttctggttactgcgagcaaaatgatatccattctcctcaggtcacagttagggaatctttgatatactctgccttcttgcgccttcctgaaatgattggagatcaagaaatcactgatgatatcaagattcaatttgttgatgaagttatggaactagtggagcttgacaatctgaaggatgctttagttggcctaccaggaatcacagggctttcaacagagcaaagaaaaaggttaacaatagctgtggaactcgttgccaacccatcgatcatcttcatggatgaaccaacatcaggtcttgatgcaagagctgcagcgattgtcatgagaacagtgcgaaacacagttgatactggacgcacagtggtttgcactatccatcagccaagcattgacatctttgaggcttttgatgagttgctattgctgaaaagaggaggccaggtgatctactctggacaattgggtcgcaactcccagaaaatggttgagtatttcgagacaattccgggagtgcctaagatcaaaggtaagtacaatcctgcaacgtggatgctcgaagtcagttcaattgcagctgaagtgcgactaaagatggattttgctgagtactacaaaacatcagatctgtacaagcaaaacaaggtactggtcaaccagctgagtcaaccagagtcaggaacatcagatctttatttcgctacacagtactctcaatccataataggacagttcaaagcctgcctttggaagcagtggttgacctattggcgcagcccggattacaaccttgttagattttccttcactttgttcgttgccttactgcttggctccattttttggaggataggaaccaaaatgggagatgcaaacactctcaggatggttatgggagcaatgtacacagctgtgatgtttgttggtatcaacaattgctcaactgtacagccaattgtttcaattgagaggacggttttctaccgagagagggctgctgggatgtactctgcaatgccctatgccattgctcaggttgtcatggagatcccctatgtgtttgtccaaacaacttactacaccctcatcgtatacgccatgatgagcttccaatggacagctgccaaattcttctggttcttcttcatttcctacttctccttcctctacttcaccttctacggcatgatgacggtctcaatctcaccgaaccctgaggttgcagccatctttgctgcagctttctattcactcttcaacctcttctcgggcttcttcattccaagaccgaaaattcctagatggtggatctggtactactggatttgtccactggcatggactgtgtatgggctcatagtgacgcaatatggagacctggaagaggtcatcgaagtccccggcgaatccaagcagacaattagctactacgtaacacatcattttggatatcacatgaattttatgccagttgttgcgccggtccttgtgctctttgcagcgttcttcgcattcatgtacgcagtctgcatcaagaagttgaacttccagcaacgataggaccaagatctggcgacaaagctcttgagaattgagatcttttttgaaacaatatatcctttttctccttccacttttgggttacttgtattgtcagtgtacatatagggtgtagttttggtactggacgcgtcgtcaaatgtggcgaggtcctatatggcattctagccatttaactgtggaacattacaagagcgtaattatttgtagaatctgttcatgccctatttattcactggttcatattataaaattccccaattcctcatgcctcttagatgttgatccgatgattcagattgaagtt

SEQ ID NO: 2048 - DNA, 5265 bp, Setaria italica
gatatggagagcgcgatggagaaggtatgggagtcggggcggcggatgagccggagcatcgggcggggcatgggcatggaggcgtggggcgtcgacgaggccttcatgccgcacccgtgggcggggtcccgcgggggcagccgcgggggccggagcggccgcgacgacgacgaggaggcgctgcgctgggccgccatcgagcgcctccccacctacaaccgcgtgcgcaccgccatcctctcctcctccacggaggcagaggccaacgatgccaagcccggcggcaagcagcagttcaaggaggtggacgtgcgcaagctagacgtcggcgaccgccaggagttcatcgagcgcgtcttccgcgtcgccgacgaggacaaccagcgcttcctacagaagctccgcaaccgcatcgacagggtgggcatcgagctgccgacggtggaggtgcggttcgagcagctgacggtggaggccaagtgccatgtgggcagccgcgcgctgccgacgctgatcaacacggcgcgcaacatcgcggagggcgccctgggcctctgcggcatccggctggggaggcaggccacgctgaccatcctcaaggacgtctccggcgtggtccggccgtcgcggatgacgctgctgctcggcccgccgtcctcggggaagacgacgctgctgctcgccctcgccggcaagctggacccgacgctccggtgcgccggcgaggtcacgtacaacgggttcgcgctggacgagttcgtgccccagaagacggcggcgtacatcagccagaccgacgtgcacgtcggcgagatgacggtcaaggagacgctcgacttctcagccaggtgccagggcgtcggcacaaaatacgatcttatgaccgagttgacgaggagggagaaggaggcaggcatccggccggagcctgaagtcgacctcttcatgaaggccacttcaatggaaggagtgcagagcagtctccaaacggattacactctcaggatactggggctggacatctgcgctgacaccatcgtcggtgaccagatgcagcgagggatctccggaggccagaagaagcgtgtcaccacaggagagatgattgttggcccaaccaaggtgctattcatggatgagatatcaaccggattggacagttccaccacattccaaatcgtcaaatgtctccagcaaattgtgcacctgggcgaggccaccatcctcatgtccctccttcagcctgcccctgagaccttcgacctattcgatgacatcatcctactgtcagaaggccaaattgtttaccagggacctcgcgaatacgttctcgagttctttgaatcctgtggattccgctgccctgagcgcaagggtactgcagactttcttcaggaggtgacatcaaggaaggatcaggagcagtactgggctgacaagcagaggccttacagatacatttcggtcccagaatttgcacagcggtttaaacggttccacgtcgggctccagctagagaaccacctctcactgccgtttgacaagagccgttgccatcaagctgctcttgtattctcaaaacattcggtgtcaaccatagaacttctcaaggcatcctttgacaaggagtggctccttatcaagcgcaattcatttgtgtacatcttcaagactatacagctcatcattgtagccctcatctcgtcaacggtgtttctaaggacccacatgcatcaaaggaatgtagatgatggctttgtctacattggagcactactctttagtctgatagtcaatatgttcaatggttttgcggagctctctttggccataacaaggttaccagtgttctacaagcacagggacctcctcttttaccctgcttgggtcttcacactaccaaatgtcgttctcagaatcccattctccataattgaatctatagtctgggttcttgtcacatactacaccatagggtttgctccagaggctgacaggtttttcaagcacttgctgctcgtgtttttgatccagcagatggcaggtgggctttttagagcaaccgccggactttgcagatccatgatcattgctcacactggtggagcactatctcttcttatcttctttgttcttggaggctttctcctgccaaaagatttcatccctaaatggtggatctggggctattgggtttcacctttaatgtatggatttaatgctctagcagtcaatgaattctatgctcctcggtggatgaacaagttcgtactggaccaaagtggtgttccgaaaagactaggtgtatctatgcttgaaggcgccaacatctttgttgacaaaaactggtactggatcggagcagcagctctcttgggtttcaccatcttcttcaatatacttttcacactgtcactcatgtatctgaaccctctcggcaagccacaagctgttatatcagaagaaactgcagaggaggcggaaggcaatgggcatcggacagtaagaaatggcagcacaaaatcaagggacggtggtcatagcaaggaaatgaaggagatgagactgagtgcgcgtctgagcaactcttcatcaaatgggatttcacgaatcatgtccgttggcagcaatgaagctgctccaagaagaggaatggttcttccattcaaccctcttgccatgtcttttgataatgtgaactactatgtcgacatgcctgcggaaatgaaacaacaaggagtgcaggataacaggctccaattattgcgtgaggttacggggtcattcaggcctggagtgctaacagcacttatgggtgtcagtggagctggaaagactactcttatggatgtcttggctggaagaaagactgggggttatattgaaggtgatatcagaattgctggctatcccaagaaccaagccacatttgcaaggatttctggttactgcgagcaaaatgatatccattctcctcaggtcacagttagggaatctttgatatattctgccttcttgcgccttcctgaaatgattggagatcaagaaatcactgatgatatcaagattcaatttgtggatgaagttatggaactagtggagctcgacaatctgaaggatgctttagttggcctaccgggaatcacagggctttcaacagagcaaaggaaaaggttaacgatagctgtggagctcgtcgccaacccatcgatcatcttcatggatgaaccaacatcaggccttgatgcaagagctgccgcaattgtcatgcgaacagtgcgaaacacagttgacactggacggacagtggtttgcacaatccatcagccaagcattgacatctttgaggcttttgatgagttgctattgctgaaaagaggaggccaggtgatctactctggacaattgggtcgcaactcccagaaaatggttgagtattttgaggcgattcctggagtacctaaaatcaaagataagtacaatcctgcgacatggatgctcgaagtcagttcaattgctgctgaagtgcgactaaagatggattttgctgagtactacaaaacatcagatctgtacaagcaaaacaaggtacaggtgaaccggctgagtcaaccagagccaggaacatcagatctttatttcgccacacagtactctcaatccataataggacagttcaaagcctgcctctggaaacagtggctgacctattggcgcagcccggattacaaccttgttagatttttcttcactttgtttgttgccttgctgctcggctccattttttggaggataggcaccaaaatgggagatgcaaacactctcaggattgttatgggaggaatgtacacagctgtgatgtttgttggtatcaacaattgctcaaccgtgcagccaattgtttcaattgagaggacagttttctaccgagagagggctgctgggatgtactctgcattgccctatgccattgctcaggttgtcatggagatcccctatgtgtttgtccaaacaacttactacacccttatcatatacgccatgatgagcttacaatggactgctgccaagttcttctggttcttcttcatttcctacttctccttcctctacttcaccttctatggcatgatgactgtctcaatctcaccgaaccatgaggttgcagccatctttgccgcagctttctattcgctcttcaacctcttctcaggcttcttcattccaagaccgagaattcccagatggtggatctggtactactggatttgcccactggcatggactgtttatgggctcatagtgacacaatacggagacctggaagaggaaatctcagtccccggtggagaaaaacagacaatcagttactacgtaacacatcattttggataccacaggaattttatgccagttgttgcgccggtccttgtgctctttccagtgttcttcgcattcatgtacgcagtctgcatcaagaagttgaacttccagcaaagataggaccaaaatctggcagcaaagctcttgagattattgaaagaacatatccttttctccttccatttttggttacttatgtattgtcagtgtacatagggcgtagtttgggtattccacgcatagccaaatgtggcgaggtcctacacggcattctagccatttaaccatggaacattacaagagcgcaattattagtagaatttgttcatgccctatttattcactgggactttttttatctaacaaagtctcaagggcaagcatgataaagctttgtaaatggtgaatttttttttcgttactctaaagtcaagggcaagaatgaaggctgggatttatagtactctttctataatggaaaaatatctggcttagcctctagaaaaaaatcagtccaaacttattacaaggtgatagccatcaagctgcgagcatcatgcatccatgaggaggaactatgacaaaagcaagcataaaaccttcatagttgaatgggagacattggaaaaatctattggagaatctacatccatgagaggcgaaaatctgcctgaatgttgtttccaacgtacaagacatgctaaaaccaccatctccttgtcttattcactgcggtgcagtaagaaagaattatagatgctgagcagtacttgaacagtaatataatctgtttggatgatttgagaaagtatgcagcggtaaacagtttacacctgtattttactgtgcacaagaaaaaacagtgaaaaacttttcccctgt

SEQ ID NO: 2049 - DNA, 5271 bp, Oryza sativa
cccgcctctctttctcatttcataaaccccaaaaaagaaaaagaaaaaaacaacccccacgtagagaaaaccacccgcgcccgcgcgcgagttgataaaaagcgcgcgcctcgcctcgcctcttccactctctccaccactcccacccccgcgccgccccggccgccgccgccgccgccgctcgccggcgccatcactaccacatgacacgcgcgcttcgtctcactctcacctagctacagcttctcgtcatcagctcgccggcgcggcgcgacgcggcggcgaaactgagagagagagagagagatatggagagcgcgatggagaaggtgtgggagtcggggaggcggatgagccggagcatcgggagggggatggggatggaggcgtggggcgtcgacgaggccttcatgccgcagaactccggcggcggcgggggcagcagggggaggaggaggagcggccgcggcggcaccgccgacgacgacgaggaggcgctccggtgggccgccatcgagcgcctccccacctacagccgcatgcgcaccgccatcctctcctccgccgaagaagaggccgccgccgccgccgccggagcaggcaagcagcagtacaaggaggtggacgtccggcggctcggcgtcggcgagaggcaggagttcatcgagcgcgtcttccgcgtcgccgaggaggacaaccagcgattcctccagaagctacgcaaccggatcgacagggtgggcatcgagctgccgacggtggaggtgcggttcgaggagctgatggtgcaggcgaggtgccacgtgggcagccgcgcgctgccgacgctgctgaacacggcgcgcaacatcgcggaggcggcgctggggctcgtcggcgtccggccggggcggcaggcgacgctgaccatcctcaggggggtctccggcgccgtccggccctcccggatgacgctgctgctgggcccgccgtcgtcggggaagacgaccctcctcctggccctcgccgggaagctggacccgtcgctccggcgcggcggcgaggtgacgtacaacgggttcgagctggaggagttcgtggcgcagaagacggcggcgtacatcagccagacggacgtgcacgtcggcgagatgaccgtcaaggagacgctcgacttctcggccaggtgccagggcgtcggcaccaagtacgatcttctgacagagctggcaaggagggagaaggaggccggcatccggccggagcccgaggtcgacctcttcatgaaggctacttcgatggaaggagtcgagagcagccttcagacagattacaccctcagaatactgggattggatatatgcgcggacacgatcgtcggcgaccagatgcagagggggatctccggtggtcagaagaaacgcgtcaccaccggtgagatgattgtcggtccaacaaaggttctattcatggatgagatatcaactggattggacagctccaccacattccagattgtcaaatgccttcagcaaatcgtgcacttgggcgaggcaaccatcctcatgtcactcctacaaccagcccctgagacttttgagctattcgatgacattatcctactgtcagaaggccagattgtttatcagggaccccgcgaatacgtccttgagttctttgagtcatgcggattccgctgcccagagcgtaagggtactgcagactttcttcaggaggtgacatcaaagaaggatcaggagcagtattgggccgacaagcataggccatacagatacatttcagtctcagaatttgcacagagatttaaaaggttccatgttgggctccaacttgagaatcatctctcagtcccatttgataaaactcgtagccatcaggctgctcttgtcttctcgaagcaatcggtgtcaacaacagagctcctcaaggcatcctttgccaaggagtggctcctcattaagcgcaactcatttgtgtacatcttcaagaccatacagctcatcattgtagcccttgtcgcgtcgacagtgtttcttaggacccagatgcacacaaggaatttagatgatggctttgtgtacattggagcactacttttcagtctgattgtgaacatgttcaatggtttcgctgagctctctttgaccatcacaaggttgccagtgttcttcaagcaccgggacctcctcttctaccctgcttggatcttcactctaccgaatgttattctgagaatcccattttccatcatcgaatctatagtctgggtgattgttacatactacactataggatttgccccagaggctgacagatttttcaagcagttgctgctagtgttcttgatccagcagatggcaggtggccttttcagagcaactgctggtctgtgcagatccatgatcattgctcaaactggaggagccctggcccttctcatatttttcgttcttggaggatttcttctgccaaaagcattcatcccaaaatggtggatctggggttactgggtttcaccactgatgtacgggtataatgctctagcagtcaatgaattctactctcctcggtggatgaacaagtttgtactggataacaatggcgttcctaaaagactaggaatagctctgatggaaggtgccaacatcttcactgacaaaaattggttctggattggagcagcagggctcctgggtttcaccatgtttttcaatgtgcttttcactctgtcactcgtttatctgaatcctctgggcaaaccacaagctgtcatatctgaagaaactgcgaaggaagcggaaggcaatggggatgcaagacatacagtaagaaatggcagcacaaaatcaaatggtggaaatcacaaagaaatgagggagatgagattgagtgctcgtctgagcaatagttcatcgaatggagtttcacgactgatgtccattggtagcaatgaagctggtccaagaagaggaatggttcttccatttactcctctatccatgtcttttgatgatgtgaactactatgtcgacatgcctgcagaaatgaagcagcaaggagtggtggatgataggctccaattgttacgtgacgttactggatcatttaggcctgcagtgctgacagcactcatgggagtcagtggagccggaaagacaactcttatggatgttttggcaggaagaaagactggtggttacattgaaggagatatgagaatttctggttatcctaagaaccaagaaacatttgcaagaatttctggctactgtgagcaaaacgatatccattcacctcaggtcacagttagggagtctttgatatactctgctttcctgcgccttccagaaaaaataggagatcaagaaatcactgatgatatcaagattcaatttgttgatgaagttatggaactagtggagctcgacaatctgaaggatgcgttagttggcctgcctggaatcacagggctttcaacagagcaaaggaagagattgacaatagcagtggagcttgttgcaaatccctcgatcatcttcatggatgaaccgacttcaggtcttgatgcaagagcagcagccattgttatgagaacagtgaggaacacagttgacactggacggacagtggtttgcacaattcaccagccaagcattgacatatttgaggcttttgatgagctgctactactgaaaagaggagggcaggtgatatactctgggcaattgggtcgtaattcccagaaaatgattgaatatttcgaggcaattcctggtgtgcctaaaatcaaagataagtacaatccagctacatggatgcttgaggtcagttcagttgctgcggaagtacgcttaaatatggactttgctgagtactataagacatcagacctgtacaagcaaaacaaggtattggtgaatcagctaagtcaaccagagccaggaacatcagatctgcattttcctacaaaatactctcaatccaccatagggcaatttagggcctgcctctggaagcaatggctgacctattggcgcagcccagattacaatcttgttagattttccttcactctgttcacagccttgctactcggcaccatcttttggaagatcggcaccaagatgggaaatgccaattctcttagaatggtcattggagcaatgtatacagcagtgatgtttatcggtatcaacaattgtgcgactgtgcagccaatcgtgtcgattgagagaacagttttctaccgagagagggctgctgggatgtactctgctatgccctatgccattgctcaggttgtcatggagataccctatgtgttcgtccaaactgcatattataccctcattgtttatgccatgatgagcttccagtggacagcagccaagttcttctggttcttcttcgtctcctacttctcatttctctacttcacctactatggtatgatgacggtggcaatctcaccaaaccatgaggttgcagccatctttgccgcggcgttctattccttgttcaacctattctcaggattcttcattccgagaccaaggattcccaaatggtggatctggtactactggctttgcccattggcatggacagtgtatgggctcatagtgacacagtatggagacctagaacaaatcatctcagtccctggccaatccaaccagacaatcagctactatgttactcatcattttggatatcacaggaaatttatgccagttgttgcgccggtgctcgtgctcttcgctgtgtttttcgcgttcatgtatgccatttgcatcaagaagttgaacttccaacatcgataggggcattgaaacaacaggcaaaatctggttggaaacttttttttggttttgaaccaaatcttcttttgtcctttccccacagataatatcttcttttatcctcacatttttgtggtctatatatgccatgtaaatatgctggtaggttttctgtattccatacatcgccaaatgtggcgaggtttcatatgaccttttagctttggaaatgtaaactttataagagcattgttgtcagaaattttgttcgtggcctattcttccattggattacttttgtcacaacaaattctcaatagaaatcaagtgtagtgaccacagggtcttataaatgattataaggtcctgtttcaaatgcaggaattttccatgtgaaaatgctgcaagttcctgttctcctttcgaatgcaagaatttcatagaaactttgcatgttcttcacaggaat

SEQ ID NO: 2050 - DNA, 5314 bp, Brachypodium distachyon
cgcggggaatatagtcaccagccaaattaaaccccccacgcgcacgatgctgcatataaagaccccgcgagctacacggctgctctccctgtctctcactcgccgtgagctaaaaggccgccaaagctgctgcctccccatggcactcgcgcaacaccagcaagccccgcgctgacgtgcagagcgaagcttcagcttgcgctcgatccacacccagcagactggcttggctgtctccaacaacgtgcctgcacgtacttacttattagccctttttcagactttacactacacatggagagcgcgatggagaaggtgtgggattcggggcggcggatgagccggagcatcgggcgggggatggggatggagacgtggggcgtcgacgaggcgttcctgcacggcggcgggagcaggggccgcgccggcgccgacgacgacgaggaggcgctgcgctgggccgccatcgagcgcctgcccacctacagccgcatgaggaccgccatactctccgccgaagccgcagcttctgcggcggcagaccaaggcgatggcaacaagcagcagcagcagtacaaggaggtggacgtgcggaagctcggcgcgggcgagcggcaggagttcatcgagcgcgtcttccgcgtcgccgaggaggacaaccagcgcttcctccaaaagctacgagaccgaatcgacagggtgggcatcgagctcccgacggtggaggtacggttcgagcggctgacggtggaggcgcggtgccacgtggggagccgggcactgccgacgctgctgaacacggcccgcaacatggcggagggcgccctgggcttgctgggagcgcggctgggccggcaggcgacgctcaccatcctcaaggacgtctccggggtcatccggccctccaggatgacgctgctcttgggcccgccgtcttcggggaagacgaccctgctgctggccctggccggcaagctggaccctacgctggcgtgcagcggcgaggtggcatacaacgggttcccgctggaggacttcgtgccgcagaagacggctgcctacatcagccagaccgacgtgcacgtcggtgagatgaccgtcaaggagacgctcgacttctctgccaggtgccagggcgtcggcaccaaatacgatctcctgaccgagctggcgaggagggagaaggaggctggcatccggccggagccggaagttgacctcttcatgaaggccacttcaatggaaggagtcgagagcagccttcagacagattacacactcaggatactggggttggacatatgtgcggacactattgtcggcgaccagatgcagagggggatatctggtggccagaagaagcgcgtcaccactggagagatgattgttggtccgacaaaggtgctattcatggatgagatatcgactgggttggacagctctaccaccttccagattgtcaaatgtctgcagcaaattgtgcacttgggcgaggcgacaatcctcatgtcgctccttcagccagcccctgaggcttttgagctcttcgatgacatcatcctactgtcagaagggcagattgtttatcagggaccccgcgagtatgtccttgaattctttgagtcatgcggatttcgctgcccagagcgcaagggcaccgcagactttcttcaggaggtaacatcaaagaaggatcaggagcagtactgggctgacaagcagaggccttaccgatatatttcagtctcagaatttgcacagaggtttaaacggtttcatgttgggctacaactcgagaaccatctctcggtgccatttgacaagagccgcagccatcaggctgctcttgtcttctccaagcactcggtgtcaactcgagagctcctcaaggcatcctttgacaaggagtggctcctcataaagcgcaattcatttgtgtacatctttaagaccatacagctaatcattgtagcccttatcgcgtcaacggtgtttctaaggacccagatgcacacaaggaatttggatgacggttttgtctacattggagcattgctttttactctgattgtgaacatgttcaatggttttgctgagctctctttgaccatcacaaggttgccggtgttctacaagcaccgtgacctcctcttctaccctgcttggatcttcacgctaccgaatgtcgtcctcagaatcccattttccattattgaatctgtagtgtgggtggttgtcacatattacaccatgggattcgccccagaggctgacagattcttcaagcagttgctgctagtgttcttgatccagcagatggcaggtgggcttttcagagcaattgctggcctgtgcagatccatgatcattgctcaaactggaggagccctgttccttctcatcttctttgtccttggagggtttcttctgccaaaagacttcatcccaaagtggtggatctggggctactggatttcaccattggtgtatggatataatgctctagcagtaaatgaattctatgctcctcggtggatgaataagtttgtaatggacaagaatggtgttcctaaaagactaggtattgctatgctagaaggcgccaacatctttactgacaaaaactggttctggattggagcagcaggcctgttaggtttcagcatcttcttcaatgtgctcttcactctgtccctcgcgtatctgaatcctttgggcaaaccacaagctgttatatctgaagaaactgcaaaggaagcagaaggcaatggggtccccagagacacagtaagaaatggcagcacaaaaagaaatggaagcacgaaaagaacaggcagcacaaaatcgggggatggtggcaacagcaacgaaataagggaggtgagattgagttctcgtttgagcaatagttcatcaaatgggattgcccgagtcatgtccgttggcagcaatgaagctgctccaagaagaggaatggttcttccattctctcctctatccatgtgttttgatgatgtgaactattatgttgacatgcctgcagaaatgaaacagcaaggagtgacagatgataggctccagttgttacgtgaggttactggatcatttcggcctggagtgctaacagcactcatgggagtcagtggagctggaaagacgactcttatggatgttttggcaggaagaaagaccggaggttacattgaaggagatatcagaatttctggttatccgaagaatcaagcaacattcgcaaggatttctggctactgtgaacaaaatgatatccattcacctcaggtcacgattagggaatctttgatatactccgccttcttgcgtcttccagaaaacatcggagatgaagaaatcactgatgatattaagattcaatttgttgatgaagttatggagctagtggagcttgataatctgaaggatgccttagttggcctgccaggaattacaggactatcaacggagcaaagaaagaggttgacaatagctgtggagcttgtcgcaaatccatcaattattttcatggatgaaccgacatcaggtcttgatgcaagagcagcagcaattgtcatgagaacagtgaggaacacagttgacactgggcggactgtggtttgcacaatacaccagccaagcattgacatctttgaagcttttgatgagttgctcttactgaaaagaggtggccaggtgatatactctgggaaattgggtcgtaactcgcagaaaatgattgaatacttcgaggcaattcctggagtgcctaaaatcaaagataagtacaaccctgcaacgtggatgcttgaggtcagttcagttgctgcagaagtacgcctaaatatggattttgctgactactacaagacttcggatctgtacaagcaaaacaaggtattggtgaatcggctaagtcaaccagaaccaggaacatcagatttgcattttcctacggcatactctcaatccattatagggcagtttaaagcctgcctctggaagcactggctgacctactggcgcagcccggattacaaccttgtcagattttccttcactttgttcacagccctgctgctcggctccatcttttggaaaattggcaccaagatgggagatgccaatactcttagaatggtcattggagcaatgtatacggcagtaatgtttgtcggcatcaacaattgcgcgaccgttcagccaattgtgtcgattgagagaactgttttttaccgggagagggctgctgggatgtatgctgcaatgccctatgccattgctcaggttgtcatggagataccatatgtgtttgtccaagcgtcatattacaccctcatcgtatatgccatgatgagcttccagtggacagctgccaagttcttctggttcttcttcgtctcctacttctccttcctctatttcacctactatgggatgatgactgtatcaatctcaccaaaccatgaggttgcggccatttttgctgcagccttctattccctcttcaacctcttctctggcttcttcattccaagaccgagaatccccaaatggtggatctggtactactggatttgccctctggcatggacagtgtatgggctcatagtgacacagtatggagacatggaagagatcatctctgtcccgggacaatccaaccagacaatcagttactatgtaactcatcattttggataccaccggagcttcatggcggttgttgcaccggtgctcgtgctctttgcagtgttcttcgcgttcatgtacgctctctgcatcaagaagttaaacttccaacaacggtaggagcagataaacagcagacatgatctggcagggaaactagttttttttttaaccgaccccttttttgtcgttccatttttgggtctatttatgcattgtcggtgtaaatatgggtgtagttttttcgttctacacatagccaaatacggtgacgttgcacaaagcctttcaggtttgtaagtgtattgcattgaaagatcatatggtgagcaaaatttaatcacgtggcctattcatcaattggactcctgtcatcaatttcgattggacttgtgtcatcacaagctcacaatcaattttcaagagcagtcaagggtagcagttattttctttcttttataccccacacattttaattttgagctcttgagattgcttttcatatatttatcacataataggtttttatttctgtattttgaagagacatgctatgatgctatattggtgatgtagtgaattacatagttaaaacatcctatttgcggag

SEQ ID NO: 2051 - DNA, 4379 bp, Panicum virgatum
aaacatctctgccgcagggtgggcatcgagctgccgacggtggaggtgcggttcgagcagctgacggtgaaggccaagtgccacgtgggcagccgcgcgctgccgacgctgctcaacacggcgcgcaacatcgccgagggcgccctggggctctgcggcatccggctggggcggcaggccacgctgacgatcctcagggacgtctccggcgtggtccggccgtcccggatgacgctgctgctgggcccgccatcgtcggggaagaccacgctgctgctcgccctcgccggcaagctggacccggcgctccggcgcgccggcgaggtcacctacaacgggttcgcgctggacgagttcgtgccgcagaagacggcggcgtacatcagccagaccgacgtgcacgtcggcgagatgacggtcaaggagacgctcgacttctccgccaggtgccagggcgtcggcaccaaatacgatcttatgaccgagctgacgaggagggagaaggaggccggcatccgcccggagcctgaagtcgacctcttcatgaaggccacttcaatggaaggagtgcaaagcagtctccaaacggattacactctcaggatacttggactcgacatctgcgccgacaccatcgttggcgaccagatgcagcgggggatctccggtggtcagaagaagcgtgtcaccacaggagagatgattgttggcccgaccaaggtgctattcatggacgagatatcaaccggattggatagttccaccacattccaaattgtcaaatgtctccaacagattgtgcacttgggcgaggccaccatcctcatgtccctccttcagcctgcccctgagacctatgacctatttgacgacatcatcctactgtcagaaggccaaattgtttaccagggacctcgcgagtatgttctcgaattctttgaatcctgtggattccgttgccccgagcgcaagggtactgcagactttcttcaggaggtgacatcaagaaaggatcaggagcagtactgggccaacaagcagaggccttacagatacatttccgttccagaatttgcacagcggtttaaacggttccatgtcgggctccagctagagaaccacctctcactaccatttgacaagagtcgttgccatcaagctgctcttgtattctcaaagcactcagtgtcaaccacagagctcctcaaggcatcctttgacaaggagtggctcctcatcaaacgcaattcatttgtgtacatcttcaagaccatacagctcgtcattgtagcccttgttgcgtcaacggtgtttctaaggacccacatgcacacaaggaatgtagatgatggctttgtctacattggagcgctgctctttagtctgatagtcaatatgttcaatggttttgctgagctctctttggccataacaaggttaccggtgttctacaagcacagagacctcctcttttaccctgcttgggtcttcacactaccaaacgtcgttctcagaatcccattctccataattgaatctgtagtctgggttcttgtcacatactacactatagggtttgctccagaagccgacaggtttttcaagcacttgctgctcgtgttcttgatccagcagatggcaggtgggcttttcagagcaatcgccggactttgcagatccatgatcatttctcacactggtggagcactatctcttcttatcttctttgttcttggaggctttctcctgccaaaaggtttcatccctaaatggtggatctggggctattggatttcacctttgatgtatggatttaatgctctagcagtcaatgaattctatgctcctcggtggatgaacaagttcgtaatggaccaaaatggtgttccgaaaagactaggcatatctatgcttgaaggcgccaacatctttgttgacaaaaactggtactggattggagcagcagggctcttgggtttcaccatcttcttcaatgtacttttcacactgtcactcatgtatctgaaccctctcggcaagccacaagctgttatatcagaagaaactgcacaggaagcggaaggcaatgagcatgcaagagggacagtaagaaatggaagcacaaaatcaaaggacggtggtcatagcaaggaaatgaaggagatgagattgagtgcgcgtttgagcaactgttcatcaaatggggtttcacaagtcatgtccattggcagcaatgaagctgctccaagaagaggaatggttcttccatttaaccctcttgccatgtcctttgataatgtgaactactatgtcgacatgcctgcggaaatgaaacagcaaggagtgcaggataacaggctccaattgttgcgtgaggttatggggtcattcaggccaggagtgctgacagcgcttatgggtgtcagtggagctggaaagactactcttatggatgtcttggctggaagaaagactgggggttacattgaaggtgatatcagaattgctggctatcccaagaaccaagccacatttgcaaggatttctggttactgcgagcaaaatgatatccattctcctcaggtcacagttagggaatctttgatatactctgccttcttgcgccttcctgaaatgattggagatcaagaaatcactgatgatatcaagattcaatttgttgatgaagttatggcactagtggagcttgacaatctgaaggatgctttagttggcctaccaggaatcactgggctttcgacagagcaaagaaaaaggttaacaatagctgtggaactcgtcgctaacccatcgatcatcttcatggatgaaccaacatcaggtcttgatgcaagagctgcagcaattgtcatgagaacagtgcgaaacacagttgatactggacgcacagtggtttgcactatccatcagccaagcattgacatctttgaggcttttgatgagttgctattgctgaaaagaggaggccaggtgatctactctggacaattgggtcgcaactcccagaaaatggttgagtatttcgaggcaattccgggagtgcctaagattaaagataagtacaatcctgcgacttggatgctcgaagtcagttcaattgcagctgaagtgcgactaaagatggattttgctgagtactacaaaacatcagatttgtacaggcaaaacaaggtactggtcaaccagctgagtcaaccagagccaggaacatcagatctttatttcgctacacagtactctcaatccataataggacagttcaaagcctgcctctggaagcagtggttgacctattggcgcagcccggattacaaccttgttagattttccttcactctgttcgttgccttactgcttggctccattttttggaggataggaaccaaaatgggagatgcaaacactctcaggatggttattggaggaatgtacacagctgtgatgtttgttggtatcaacaattgctcaactgtgcagccaattatttcaattgagaggacggttttctaccgagagagggctgctgggatgtactcagcaatgccctacgccattgctcaggttgtcatggagatcccttatgtgtttgtccaaacaacttactacaccctcatcgtatatgctatgatgagctttcaatggacagctgccaagttcttctggttcttcttcatttcctacttctccttcctctacttcaccttctatggcatgatgactgtctcaatctcaccaaaccatgaggttgcagccatctttgctgcagctttctattcactcttcaatctcttctcgggcttcttcattccaagaccgagaattcctagatggtggatctggtactactggatttgcccactggcatggagtgtgtatgggctcatagtgacacaatacggagacctggaagaggtcatcgaagtccccggccagtccaagcagacaattagttattacgtaacacatcattttggataccacaggaattttatgccagttgttgcgccggtccttgtgctctttgcggcgttctttgcgttcatgtacgcagtctgcatcaagaagttgaacttccagcaacgataggagcaagatctggcgacaaagctcttgagattctccttccatttttgggttacttatgtattgtcagtgtacatagggtgtagttgttggtgtatatgtgagcccatgtatagaggtccatttagaggcccatgtataggatctatatatcctacccttctagggtttggaggaatacaatccaaacgtgggacctcgtgcagtgtccgtctggttgcaatgtggtgactgtcaagtggatctggacgcataagcgtcaggttgatggcaca

SEQ ID NO: 2052 - DNA, 4466 bp, Triticum aestivum
cggccgccgcggccgccgcctcgccaactgacggggcggcagaaggcaaggagcagtacaaggaggtggacgtgcggaagctggccgtgggcgagcggcaggagttcatcgagcgcgtcttccgcgtcgccgaggaggacaaccggcgcttcctccgaaagctccgcgaccgcatcgacagggtgggcatcgagctcccgacggtggaggtgcggttcgagcggctgacggtgcaggcgcggtgccacgtgggcagccgcgcgctgccgacgctgctcaactcggcgcgcaacatcgcggagggcgcgctggggctgctcggggtgcggctgagccggcaggcgacactcaccatcctcaaggacatctcgggcgccgtccggccctcgaggatgacgctgctgctgggcccgccgtcgtcggggaagaccaccctgctgctggcgctggccggcaagctggacccgtcgctgaggcgcgccggcgaggtggcctacaacgggttcccgctggaggagttcgtgccgcagaagagggcggcgtacatcagccagacggacgtgcacgtcggcgagatgaccgtcaaggagacgctggacttctcggccaggtgccagggcgtcggcaccaagtacgatctcctgaccgagctggcgaggagggagaaggaggccggcagtacggccggagccggaggttgacctttttatgaaggccacgtcgatggaaggagtcgagagcagcctccagacggactacaccctcaggatactggggctggacatatgcgcggacaccatcgtcggcgaccagatgcagaggggcatatccggcggccagaagaagcgcgtcaccaccggagagatgattgtcggtccgacaaaggtgctattcatggatgagatatcgactgggctggacagctccaccactttccagattgtcaaatgtctgcagcagattgtgcacttgggcgaggccaccatcctcatgtccctcctccagccagcccctgagacctttgaactcttcgatgacatcatcctcctgtcagaaggccagattgtttatcagggaccccgcgattgtgtccttgaattctttgagtcctgtggctttcgctgcccagagcgcaagggtactgcagactttcttcaagaggtgacatcaaagaaggatcaggagcagtactgggctgataagcagaggccataccgatatatttcagtctcagaatttgcgcagacgtttaaacggtttcatgttggtctagaactcgagaaccatctctcggtgccatttgacaagagccgcagccatcaggctgccctggtcttctccaagcactcggtgtcaactcgagagctcctaaaggcatcctttgacaaggagtggctcctcataaagcgcaattcatttgtatacatcttcaagaccatacagctcattattgtagcccttatcgcgtcaacagtatttctaaggacccagatgcacacaaggaatctggatgatggttttgtctacgtgggagcactgctttttactctgattgtgaacatgttcaatggttttgccgagctccctttgaccatcacaaggttgccggtgttcttcaagcaccgggacctcctcttctaccctgcttggatattcacactaccaaatgtcgttctcacaatcccattttcaattatcgaaaccacagtctgggtggttgtcacatactacactatgggatttgccccagaagctgacaggctcttcaagcagttgctacttgtgttcttgatccagcagatggctgctgggcttttcagagcaattgctgcactgtgcagatccatgattattgctcaaaccggaggagccttgttccttctcttcttcttttcccttggaggctttcttctgccaaaagcttcatcccaaaatggtggacctggggttattggatttcaccgctggtgtatggatataatgctctagtagtgaatgaattctatgctactcgatggatggacaagtttgtaacggacaagaatggtgtttccaaaagactaggtatagctatgctagaaggcacaaacatctttactgacaaaaactggttctggattggagcagcagggctgttaggtttcacaatcttcttcaatgtgctcttcactatgtccctcgcgtatctgaatcccttgggccaaccacaagctgttatatctgaagaaactgcaaaggaagcagaaggcaatggcctcccaagagaggcagttagcaatgatagtacaagaagaaatggcaggatgaaatcgaaggatggttccagtaataaggaaatgggtgagatgagacctatgactcgtttgggcaatagttcatcaaatgcgatttcacgagtcaagtccattggcagaaatgtatctgctccaagaagaggaatggttcttccattctcccctctatccatgtgttttgaggatgtgaactactatgtcgacatgcctgcagaaatgaaacaaagagtgacggatgataggctccaattgttacgtggcgttactggatcatttagaccaggaatgctaacagcgctcatgggagtcagtggagctggaaagacgactcttatggatgttttagctggaagaaagactggtggttatattgaaggagatgtcagaatttctggttatccaaaaaaccaaacaacatttgcaaggatttctggttattgtgagcaaaatgatatccattcacctcaggtcacgattagagaatctcttatatactctgccttcttgcgtcttcctgaaaagatcggagatcaagatatcactgatgatatcaagatacaatttgttgatgaagttatggagctagtggagcttgacaatctgaagtatgctttagtcggcctgccaggaatttcagggctttcaacagagcaaagaaagaggttaactatagctgtggagcttgtcgcaaatccatcgatcatcttcatggatgaaccgacatcaggtcttgatgcaagagcagcagcaattgttatgagaacagtgaggaacactgttgacactggacggactgtggtttgcacaatccaccagccaagcattgacatctttgaagcttttgatgagttgctattactgaaaagaggaggccaggtgatatactctgggaaactgggtctcaactcacaggaaatggtcgaatactttgaggcaattcctggagtgcctaaaatcaaagataagtacaatcctgcaacatggatgcttgaggtcagttcagttgctgcagaagtacgcttaaacatggattttgctgactactacaagacttcggatctgtttaagaaaaacaaggcattggttaaccggctaagtcaaccagaaccaggaacatcagatctgtattttcctacagaatattctcaatccattatagggcagttcaaagcctgcctctggaagcattggctgacctattggcgcagtccagattacaacctcgtcagattttccttcactttgttcacagccttgctgctcggctccatcttttggaagatcggcagcaatatcggagatgccaatactcttagaatggtcattggagcaatgtatacagcagtgatgtttgtcggcatcaacaactgttcaagcgttcagccaattgtttcaatcgagagaacagttttctaccgagagagggctgctgggatgtactctgcaatgccctatgccattgctcaggttgtcatggagataccttatgtcttcgtccaagcctcgtattacacccttatcatatacgcgatgatgggcttccagtggacggttgccaagttcttctggttcttcttcgtctcctacttttccttcctctacttcacctactatgggatgatgactgtatcaatatcaccaaaccatgagattgcagccatcttcgccgcagctttctattccctcttcaaccttttctctggattcttcatcccaagactgaaaatacccaaatggtggatctggtactactggatttgcccattggcatggacagtttatgggctcatagtgacacaatatggagacctggaagagaccatctctgtaccaggccaatcagaccagacaatcagttactacataactcatcattttggataccacaggagcttcatggcggtcgttgcaccggtgcttgtgctctttgcagtgttcttcgcgttcatgtatgctctctgcctcaagaagttgagcttccaacaacgatagtaggaactgaaagccaacagacaagatctcggaaggcaatatggctgattttttccggaaccaactcctcttttgtacttccatgtttgccggtgtaagtatggatgttagttttttggtattacaatagatacacaatatgtgaggacgcacacaaccttccagcttgtaagagctaac

SEQ ID NO: 2053 - DNA, 4519 bp, Sorghum bicolor
gagacgggtggctagctattagcttgttggacgacaaccggccatgcatatgcaacgaggtggtccaggtccatccatggcgatggcggcggcaacgacgaccgtggttgatcgggtggtgttcgccctgaacgggcagaggtacgaggtggccggagtcgacccgtcgacgaggctgctagagttcatccgcacccggacgcccttcacgggccccaagctcggctgcggcgaaggtggttgtggggcttgtgttgtccttatagcaaagtataacccaaagacggatgaagtgactgagtttactgcaagttcatgcctgacacttctttacactataaatttatgttcagtaatcactaccgagggtcttgggaatagccaagatggctttcatgctgttcagaaaaggatgtctgggtttcatgcctctcagtgtggcttctgcactcctggaatgtgcatgtctattttcacttcccttatcaatgctgacaaatccaataggcctgaaccaccaaaggggttctcaaaactaaaagtatcagaagcagaaaaggctttctctggcaacatgtgcagatgcactggttaccgtccaattgttgatgcctgcaaaagttttgcatcagatgttgacttggaggatttgggccttaatatattctggaagaaaggtgataggaaccccgatgttagtgacttgccatgttacactcttggtggcggagtctgcaccttcccagactttctaaaaactgagattaaatcttcgcttgatcatctgagtaatcgttgtattgcagcctccgtggagggttggtatcatccgagaagtatcaaagagtattatgagttaataaattcttgtttttttagtgactcagtcaaagtggttgttgggaatactagtagtggtataccaggatacaaggatcaagacctctatagtaagtatattgacataggaggcattcctgaactttcaaatattgtaaggagggagtctggctttgaaattggagcagctacaccaatctctagaaccattgagatacttgaggaagaatgtgaatctgtatcctctccaaatggaaatgtcgttttgagaaaacttgcgaaccacatgagcaaagttgctacaccttttgttcgcaacacagctagtattggaggaaacatagttttggcacaaaaattcccatttccatcagacattgcaaccatactcctcggtgctggtgcaactgtttgtcttcaggtcgttgcagaacggagacaaattactttggaagagttcctagagcagcctcctatacatgctactactttactcctgagcatatttattccacactggatttcagattctgggacaaatacaagtttgttatttgaaacatacagagcagcgcctcgtcctcttggcaatgctgtttcatatgtaaattgtgctttcctggggcatgcttctgtggataaacaatcagatactcttgtattaagtaatctgcgcttggcttttggtgcatatggaacagaacatgctattagagcaaagaaggtggaggaattccttactggtaaatcactgactgcatcggttgtacttggtgcaattcaattacttagagaaacggtcgtaccaatggtgggaacatctcatcctgaatatagagtcagtgcagctgttggatttctcttcagttatctatctccgctttctaaaggcatcccagagcctggaaagtctctgaccagtagttgtgctgattcagcagatacagatgatgtctgtaacctgccattatcaacatgtcgagaaacactttccagtggcgaatataaaccagttggtgaaccgattaagaagtatggtgttgaactccaatcttctggggaggcagtatatgtggatgatattcctgctccaaagaattgcctctatggagaatttatttacagcacacgaccccttgcttatgtgaaaagtgtaaaattcaagtcttcattagcatcagagaagatcatctcttttgtttctgcaaaggatattccaagtggagggcaaaatattgggtcatccttgatgtttggtgatgaaccactatttggtgatccgattgctgagtatgctggtcaagctcttggcattgtgattgcagaaacacaaaggtatgctgacatggcagccaaacaggttattgtcgaatatgacacagaagatttgagcccaccgatcataactgtggagcaagcagtggaaaagagtagctactttgatgtcccccacgaattgtatcctaaagaagttggtgatgtttccaagggcatggcagaagcagatcacaagatcccatcaacagaagtaaaacttgcctctgagtactacttctacatggaaacacagacagcactagcagttccagatgaggataacactttggtagtctatagttcgtcacagtaccctgaacatgcacaaagtgtcatagcaaggtgcctaggtattccattcagcaatgtgcgtgtcattacaagaagggttggaggaggctttggtggaaaggcattcagatcattccaagttgcaacagcagctgcactttgtgcgtacaagttacgacgtcctgtgcgaatgtaccttaatcgcaacactgatatggttatgattggtggtagacacccagtgaaagctcattattccattggattcaagtctgatgggaaaattacggccttgcatctagatttgttaattaatgctgggatatctccagatgcaagccccattatgccaggctatattatatctagtgtcaagaagtataattggggtgctctgtcatttgacattaagctctgcaaaacaaataattcatctaaatctgtaatgcgtgctcctggagatacacaaggctctctaattgcagatgctgtaattgagcatgttgcatctgtcttgtcagtggatgctaacagcgtgagggaaaagaattttcacacctatggtactcttcagttattctacccagatagtgcaggcgaagcttctacgtacacattgcattctatttttgataggttggtctcaacttcaagctacctggatcgagctgaatccataaaggaatttaacagtaataacaagtggcagaaacggggcatctcttgtgtgcccctcattttcaaagtagagccatgggcggccccaggaagggtttctgtgctcagtgatggctccatagtggtggaggttggaagaattgaaatagggcaaggcctgtggactaaagtacagcagatgactgcctttggtctgggaaaattgtggcctgatggaggtgaaagtcttcttgagagagtgcgtgttctgcaggctgacaccttgaacttaatacaaggtggacttactgctggcagtacttcttctgaatctagttgtgctgccacccttcaggcatgcaatatgctgtttgacagattaaagccagtcttggataggctgcagcagcaatcagaaaatgtctcatgggatactttgatttcacaggcaagtttatcctcctctattttgtgttcattgtacaatactaattcctgctgtaacagcaatcagaaaatctcctgtaatgtttcccagcaggcctctgaagataatgttaatttatctgcaagtgcatactgggtacctggccaagtttctaataagtacattaactatggagctggtataagtgaggtggagattgatcttcttacaggagcaattactttaatgaggggcgatcttgtgtatgactgtgggaagagcttgaaccctgcgatagacttaggacagattgaaggttcctttatacagggaattggttttttcgtatatgaagagtatattacaaacagtgatggcctgatgattagcaacagcacatgggactacaagatcccaagtgtcgacataatcccaaagcagtttaatgctgaagtgctgaacactggataccataagaaccgtgtgctttcttccaaagctgctggtgaacctgccttggttcttgcctcatccgttcattgtgcactgagagaagctatccgagcagcaagaatggagtttgcaaacagcactgtatctggacgctcaccgctggaattcaagatggatgtcccagcaccaatgacactggtgaaacaactatgcggtttagatattgtggagaagtacttagaaagtctatctacctatgaacgtgaagctgggttgtaatctaacgtcctgttatctcaagagaaaaggagtggtgtcatcttttttttgttgttgtttgcaataaaacgggaaggaggaaggaggttttctgttatccttaatggtaatggggtttcctcatgtagaaaaaaacaacaggaaggagggaggtgttaaattagcacaatatttgaataatgctttcaaccatctgtattcatgaatccttattaaggctactgggagagggttgtgtttaagtaatttattgtt

SEQ ID NO: 2054 - DNA, 4297 bp, Setaria italica
gggtggtatccatggcgtcgtcgatgtcgtcggtggtggggaaggcgacggcggtggagaggttggtgttcgcgttgaacgggcggcggtacgaggtggccgccgccgacgtggatccgtcgacgaggctgctggagttcatccgcacgaggacgccattcaagggcaccaagctcggctgcggcgaaggtggttgtggggcttgtgtcgtacttatagcaaagtataaccccaagacaaatgaagtgactgaatttacagcaagttcatgcctgacacttctttacagtataaatttctgttcagttatcactactgagggtctggggaacacccaagatggctttcatgctgttcagaagaggatgtccgggtttcatgcctctcagtgtggcttctgcactcctggaatgtgcatgtctattttcacctcccttatcaatgctgacaaatccaagaggccagaaccatcaaaagggttctcaaaactaaaagtatcagaagcagaaaaggctttttcaggcaacttgtgtagatgcactggttaccgtccaattgttgatgcctgcaaaagttttgcatcagatgttgacttggaggatttgggccttaatatattctggaagagaggtgataagaatccagacgttagtgatttaccaagttacactcttggtggtggagtctgcactttcccggacttcctaaaatctgagataaaatcttcccttgatgatttgaatgatgcttgtattgcagcatccagggagggctggtatcatcctagaagtatcaaagagtattatgagctaataaattcttgtttatttagtgactcagtcaaagtggttgttgggaacaccagtaccggtattccaggatacaaggatcaagacctctacaataagtatattgagataggtggtattccagaactttcaaatattgtaaggacagagtcaggctttgaaattggagcagctacaacaatttctaggaccatcgagatacttaagcaagagtgtgaatctatatcgtctccaaatggcagtgttgttttcagaaaacttgctgaccacatgagcaaagttgccacaccatttgtccgtaacacagctagtattggaggcaacataattttggcacaaaaatacccatttccctcagacattgcaaccatacttctcggtgctggtgctactgtttgtcttcaggttgttgcaggacggaggcaaattactttggaagagttcctagggcagcctcctttggatcctactactttactcctgagcatattcattccacattggatttcagattatcagacaaaaacaactttgttatttgaaacttaccgggcagcacctcgtcctcttggaaatgctgtttcatatgtaaattgtgctttcttggggcatgcttctgtggatcaacaatcaaatgctcttgtattgaacaatctgcgcttggcttttggtgcatatggaacaaaacatgctattagagcaaagaaagtggaggaattcctagctggtaaatcactcactgcgtcggttgtacttggagcaattcagttacttagggatgtgattgtaccaatggagggaacatcacatcctgaatatagagtcagtgcagctgttggatttctcttcagtttcctatcccctcttgcgaaaggcatcccacagcctggaaaagctctgaccagtggttctgctgattcagcagatacagatgatgtgcgtaacctgccagtatcatcacgtcgagaaacaatttccaatgacgattataaaccagttggcgagccgattaagaagtatggcgttgaacttcaagcttctggggaggcagtttatgtcgatgatattccggctccaaagaattgcctctatggagaatttatttacagcacacaacctcttgctcatgtcaagagtattaaattcaagtcttcattagcgtcagagaagatcatcgatgttgtttctgccaaggatattccaagtggtggagaaaatattggatcgaccttcacatttggggatgaaccactgtttggtgatacagttgctgagtatgctggacaggctcttggtgtcgtgattgcagaaacccaaaggtatgctgatatggcagccaagcaggttattattgaatatgacactaaagatttgagcccaccgatcttaactgtggaacaagcagtcgaaaacagtagctacttcaaagtccccccagagttgtatcctacagaagttggcgatgtttccaagggaatggcacatgctgatcacaagatcccgtcaacagaagtaaaacttgcctctgagtactacttctacatggaaacacagactgcactagccattccagatgaggataacaccttggtggtctacagttcgtcacagtaccctgaacttgcacaaagtgtcatagcacggtgtctgggaattccattcagcaaggtgcgtgtcattacaagaagggctggaggtggctttggtggaaaggcatttagatcattccaggttgcaacagcagctgcactttgtgcatacaagttgcgacgtcctgtacggatgtaccttaatcgcaacactgatatggttatgattggtggtaggcacccagtgaaagctcgttactctgttggattcaagtctgatgggaaaattacagctttgcacctagacctattaattaatgctgggatatctccagatgcaagccctctgatgccaggaacaattatatcaagtgtgaagaaatacaattggggtgctctgtcatttgacatcaaggtctgcaaaacaaataatacatccaaatctgtaatgcgggctcctggggatacacaaggctctctaatagctgatgctatcattgagcatgttgcatcagtactttcagttgatgctaacagcgtgagggaaaagaattttcacacctatggtagtcttcagttgttctacccagatagtgctggtgaagcttctacatacacattacattctattttcaataggttgatctcaacttcgagctacctggatcgagctgaatccatcaagcagtttaacagtagcaataagtggcggaaacggggtatttcttgtgttcccctcattttcagagttgaaccaagggcagctcctggaagggtttctgtgctcaatgatggctccatagtggtagaagttggaggaattgaaatcggtcaaggactgtggactaaagtacaacagatgactgcatttgctttgggaaaattatggccagatggggttgaaggtcttcttgagagagtgcgtgtcctacaggctgacaccttgaacttaatacagggcgggcttactgctggtagcacttcatctgaatctagttgtgcagccacccttcaggcatgcaatatgctggttgacaggttaaagccagtcttggataggctgcagcagcaatccaaagatgtctcatgggatactttgatttctcaggcctctaaagaaaatgttaatttatctgcgagtgcatactgggtacctggccaagagtctaataagtacctgaactatggagccgctataagtgaggtggagattgaccttcttacaggagcaattactttactaaggggcgatcttgtgtatgactgtgggaagagcttgaaccctgcagtggacctaggacagattgaaggttcctttatacagggaattggcttcttcgtatacgaagaatatgttacgaacagtgacggcttgatgatttgcaacagcacatgggactacaagatcccaagtgtcgacataatcccaaagcagtttaatgccgaggttctgaacactggatatcataagaaccgtgtgctttcttcaaaagcttctggtgaacctgccttaattgctgcctcatcggttcattgtgcactgagggaagctatcagagcagcgagaagggagtttgcaaacagcactggatccggaagctcacctctggaattccagatggatgtccctgcgccaatgacactggtgaaagaactatgtggtttcgatattgtggacaagtacttggaaagtctatctacccaggaacgtgcagctggggcgtaatcgataatcatgttatctcattattaaaggagtggtatcattgtcctatcgtatgttgtttacgtaaagtgggtgtaaagctttaggatgtgtgcttctggtgtgacatgtttgtgattgcgtttgtaagtgtcctctaaactttttaaatttgagtgtcgatcaattattaa

SEQ ID NO: 2055 - DNA, 4414 bp, Setaria italica
gcatcatgtgcttgctggaggtggcggcggtggagagggtggtgttcgcgctgaacgggcggcggtacgaggtggccggagccgatccgtcgatgacgctgctggagttcatccgcacgcggacgccgttcaagggcaccaagcttggctgcggcgaaggcggttgtggggcttgtgttgtccttatagcgaagtataaccccacgacagatgaagtgactgaattcaccgcaagttcatgtctgacacttctttacagtataaatttctgttcagttcttactactgagggtctggggaatacccaagatggctttcatgctgttcagaagaggatgtccgggtttcatgcctctcagtgtggcttctgcactcctggaatgtgcatgtctattttcacctcccttatcaatgctgacaaatccaagaggcctgaaccaccaaaagggttctcaaagctaaaagtatcagaagcagaaaaggctttctcaggcaacctgtgtagatgcactggttaccgtccaattgttgatgcctgcaaaagttttgcatcagatgttgacttggaggatttgggtcttaatatattctggaagagaagcgataagaatccagatgctagtgaattgccaagttacactcttggtggcggagtctgcactttcccagatttcctaaaatctgagataaaatcttcccttgatcatttgaatgttgcttgtattcccgcatccagggagggctggtatcatccgagaagtatcaaagagtactatgagctaatagattcttgtctatgtagtgactctgtcaaaatggttgttgggaatactagtaccggtgtaccaggatacaaggatcaagacctctacaataagtatattgatataggtggcattccagaactttcaaatattgtgaaaagagagtcgggctttgaaattggagcagctacaacaatttctaggaccattgagatactgatgcaagaatgtgaatctatatcctctccaaatggcagtgtggttttcagaaaacttgctgaccacatgagtaaagttgccacaccatttgtccgtaacacagctagtattggaggaaacataatcttggcacaaaaatacccatttccttcagacattgcaaccatacttctcggtgctggcacaactgtttgtcttcaggatgttgcaggacaaaggcaaattactttggaagagttcctagagcagcctcctttggattctactactttactactgagcatatttattcctcattgggtttcagattatcaggcagaaacaagtttgttatttgaaacttaccgagcagcacctcgtcctcttggcaatgctgtttcatatgtaaattgtgctttcttagggctttcttctgtggatgaacgatcagacactcttgtatttagtaatctgcgcttggcttttggtgcatatggaacagaacatgctattagagcaaagaaggtggagaaattcctaactggtaaatcactcactgcatcggttgtgcttagagcagttcagttactcagagaaacaattgtaccaatggagggaacatcacatcctgaatatagagtcagtgcagctgttggatttctcttcagtttcctatctccgcttgccaaaggtatcccagagcctggaaaagccttgaccagtggttcatccgattcagcagatacagatgatgtacgcaacctgccattgtcatcacgtcgagaaaaaatttccaacaacgattctaaaccagttggtgagccgattaagaagtatgctgttgaacttcaagcttctggcgaggcagtttatgtggatgacattcccgctccaaagaattgcctctatggggaatttatttacagcacacaacctcttgcttatgtcaagagtattaaattcaaatcgtctttagcatcagagaagataattgatgttgtttctgcgaaggatattccaagtggaggagaaaatattggatcaagcttcatatggggggatgagccattgtttggcgatccaattgctgagtatgctggacaagctcttggcgttgtgattgcagaaacacagaggtacgctgacatggcagccaagcaggttattattgaatatgacacaaaaggtttgagtccaccgatcttaactgtggaacaagcagtggaaaacagtagctatttcagtgttcccccagaatattatcctaaagaagttggtgatgtgatgaggggcatggcagaagctgatcacaagatcccatcaacagaagtaaaatttgcctctgagtactacttctacatggaaacacagacagcactagcaattccggatgaggataacaccttggtagtctacagttcgtcacagtgccctgagcttgcgcaaactgtcatagcaaggtgcctgggcattccattcagtaatgtgcgtgtcattacaagaagagttggaggaggctttggaggaaaggcattcagatcattccaagttgcaacggcagcggcactttgtgcatacaagctacgacgtcctgtacggatgtaccttaatcgcaacaccgatatggttatgattggtggtcggcaccctgtgaaagctcgctattctgttggatttaaatctgatgggaaaattacggcattgcatctagatttattaattaatgctgggatatctgaagatgcaagccccagtataccacgcgttattatatctagtgtcaagaaatacaactggggtgctctgtcatttgacttcaagctatgcaagacaaataattcatctaaatctataatgcgtgctccaggagatacacaaggttctctgattgctgatgctataattgaacatgtcgcgtctgtgctttcacttgatgctaacagtgtgagggaaaagaattttcacacctatgatactcttcagttgttctacccagacagtgcaggcgaagcttctacatacacattacattctatttttgataggttggtctccacttcaagctacctcgatcgagctgaatccataaagatgtttaacagtagcaacaagtggcggaaacggggcatctcttgtgtgcccctcatttttagagctgaaccaagggcagctccaggacgggtttctgtgctcaatgatggctccatagtggtggagattggaggaattgaaattggccaaggactgtggacaaaagtacagcagacgacggctttcgctctgggaaaattatggccagatggggttgaaggttttcttgagagagtgcgtgtcctacaggctgacaccttgaacttaatacaaggcggacttactgctggtagcacttcatctgaatctagctgtgcagcaacccttcaggtgtgcaatatgctggttgacaggttgaagccagtcctggataggctgcagcagcaatccgaagatgtctcatgggatactttgatttctcaggcctcgaaagaaaatgttaatttatctgcgagtgcatactgggtacctggccaagattctaataagtacctgaactatggagctggtataagtgaggtggagattgatcttcttacaggagcaattactttactaaggggcgatcttgtgtatgactgtgggaagagcttgaaccctgcagtggacttaggccagattgaaggttcctttatacagggaatcggcttcttcatatatgaagaatatgttacgaacagtgacggcttgatgattagcaacagcacatgggactacaagatcccaagcgtcgacataatcccaaagcagtttaatgccgaggttctgaacactggatatcataagaaccgtgtgctttcttcaaaagcttctggtgaacctgccttgattgctgcctcatcggttcattgtgcactgagggaagctatcagagcagcgagaagggagtttgcaaacagcactggatccggaagctcacctctggaattccagatggatgtccctgcgccaatgacactggtgaaagaactatgtggtttcgatattgtggataaatacttggaaagtctatctaattatgagcgtgcagctggggcataatctacactcctgttatctcatagaaaggagtgttatcatcctttcctatgttgcttacaataaaggggtggtcaactaggcacaagtatttgaatgctttaaacaatgtacaaggttctgcgcctgtgccttcatgctatctccaattcaaaccatctatattcatatatccttatttgctattatgatgttccaggctgatcttataaattaaaacactctcctgcaaactttagttaacaaagtgcaagccagaattggaaccattttgtttgagtgaacattttcatgacttacgagagcaatgctatatatcagca

SEQ ID NO: 2056 - DNA, 4202 bp, Sorghum bicolor
ggaagacctcgatcgctctccacaccggccggccaacgcgtgttgcaccaccggtttatatatatacacgacgactcgccggtgccggccggccagcccgcgaacgaacccggtacgcctcctcacaagcttaagcgcttatatagcttgctagcttgcacagtgcagtcgatctgatcgacgtactagctacctactagtaatataatgcatgcgagaccaatagctagcagcgacgcgcagcaaggtccatccatggcggcggcgacggcggttgatcgggtggtgttcgccctgaacgggcagcggtatgaggtggccggagtcgacccgtcgacgaggctgctggagttcatccgcacccagacgcccttcaagggccccaagctcggctgcggcgaaggcggttgtggggcttgtgttgtccttatagcaaagtataacccaaagacggatgaagtgactgaatttacagcaagttcatgcctgacacttctttacacattaaatttctgttcggttatcactactgagggtctggggaattcccgggatggctttcatgctgttcaggaaaggatgtcggggtttcatgcttctcagtgtggcttctgcactcctggaatgtgcatgtctattttcacttcccttatcaatgctgacaaatccaatagtcctgaaccaccaaaggggttctcaaaactaaaagtatcagaagcagaaaaggctttctctggcaacatgtgcagatgcactggttaccgtccaattgttgatgcctgcaaaagttttgcatcagatgttgacttggaggatttgggccttaatatattctggaagaaagtcaaagtggttgttgggaatactagcagtggtgtaccaggatacaaggatcaagacctctatagtaagtatattgacataggaggcattccagaactttcaaatatcatacggagggagtctggctttgaaattggagcagctacaccaatctctaggaccattgagatacttgaggaagaatgtgaatctacatcctctgcaaagggaagcgtggttttcagaaaacttgcgaaccacatgagcaaagtttctacaccttttgttcgtaacacagctagtattggaggaaacatagttttggcacaaaaattcccatttccatcagatattgcaaccatactcctcggtgctggtgcaacagtttgtcttcaggtagttgcagaacgaagacaaattactttggaagagttcctagagcagcctcctatagatgctactactttactcctgagcatatttattccacagtggatcccagattctgggacaaagacaagtttgttgtttgaaacttacagagcagctcctcgtcctcttggcaatgctgtttcatatgtaaattgtgctttcttggggcatgcttctgtggatgaacaatcagatactcttgtattgagtaatctgcggttggcttttggtgcatatggaacggaacatgctattagagcaaagaaggtggaggaattccttactggtaaagcactcactgcttcggttgtacttggtgcaattcaattacttagagaaacggttgtaccaatggagggaacatcacatcctgaatatagagtcagtgcagctgttggatttctcttcagtttcctatctccgctttctaaatgcatcccagatccgggaaagtctctgaccagtagttctgctggttcagcagatacagatgatgtccataatctgccattatcatcacgtcgagaaacattttccagtgacgagtataaaccagtcggtgagccgattaagaagtacggtgttgaacttcaagcttcaggggaggcagtatatgtagatgacattcctgttccaaagaattgcctctatggagaatttatttacagcacacaaccccttgcttatgtcaaaagtataaaattcaaatcttctttagcatcagagaagatcgtctcttttgtttctgcaaaggatattccaagtggaggacaaaatattggatcatccttcacgtttggtgacgaaccactatttggttatccaattgctgagtatgctggtcaagctctaggcattgtgattgcagaaacacagagatatgctgacatggcagccaagcaggttattattgaatatgacacagaagatttgagcccagcgatcataactgtggagcaagcagtggaaaagagtagctactttgatgtccccccagaattgtatcctaaagaagttggtgatgtttccaagggcatggcagaagctgatcacaagatcccatcaacagaagtaaaacttgcctctgagtactacttctacatggaaacacagacagcactagcagttccagatgagcataacactttggtagtctacagttcgacacagtaccctgaacttgcacaaagtgtcatagcaaggtgcctaggtattccattcagcaatgtgcgtgtcattacaagaagggttggaggaggtttcggtggaaaggcattcagatcattccaagttgcaacggcagctgcactctgtgcgtacaagttacaacgccctgtacgaatgtaccttaatcgcaacactgatatggttatgattggtggtaggcacccagtgaaagctcattattctgtcggattcaagtctgatgggaaaattacagccttacatctagatttattaattaacgctgggatatctccagatgcaagccccataataccaggcactattatatctagtgtcaagaagtacaactggggtgctctgtcatttgacatcaagctctgcaaaacaaataattcatctaaatctgttatgcgtgctcctggagatacacaaggctctctaattgcagatgctgtaattgagcatgtcgcgtctgtcctgtcagtggatgcgaacagcgtgagggaaaagaattttcatacctatggcactcttcagttgttctacccagatagtgcgggtgaagcttctacgtacacattgcattctatttttgataggctggtctcaacttcaagctacctggatcgagctgaatccataaaggaatttaatagtaagaacaagtggcggaaacgtggcatctcttgtgtacccctcattttcaaagtagagccaaggccggccccaggaagggtttctgtgctcaatgatggctccatagtagtcgaggttggtggaattgaaatcggacaaggtctgtggacgaaagtacagcagatgactgcttttgctctgggaaaattatggcctgatggaggtcaaagtcttcttgagagagcctcgaaagataatgttaatttatctgcaagtgcgtactgggtacctggccaagtttctaataagtaccttaactatggagctggtataagtgaggtggagattgatcttcttacaggagcaattactttaataaggggcgatcttgtgtatgactgtgggaagagcttgaaccctgccgtagacttaggacagattgaaggttcctttatacagggaattggttttttcgtatatgaagagtatattacgaacagtgatggcctgatgattagcaacagcacatgggactacaagatcccaagtgtggacataatcccaaagcagtttaatgctgaggtgctgaacactggataccataagaaccgtgtgctttcttcaaaagcttctggtgaacctgccttggttcttgcctcatccgttcattgtgcactgagagaagctatccgagcagcgagagtggggtttgctaacagcactgtatctggatgctcaccgctggagtttcagatggatgtcccagcaccaatgacagtggtgaaagaattatgtggtttagatattgtcgagaagtacttagaacgtctatctacctatgaacgtgtggctggggcgtaatctaatctgaagtcatgttatctcataaaaaagtgtggtatcagcctattgtttgtttgtatacaataaaacgtgccgcgcggcgtgggctctgtgtgtgtgtgggcacaatatttgaatgttttcaactatctgtattcatgactccttattaaaactactggaagtggttatgtttaagtaatctattgttatgaagtttgagtgctggtcaatttataaaatattctcctgcagcttatagttaaaaaagctggaaaatc

SEQ ID NO: 2057 - DNA, 4314 bp, Panicum virgatum
ctaatttatattgcaggtggttgtggggcttgtgttgtccttatagcaaagtataaccccaagacggatgaagtaactgaatttaacgcaagttcatgcctgacacttctttacagtataaatttctgttcggttatcacgactgagggtctggggaatagccaagatggctttcatgctgttcagaaaaggatgtctgggtttcatgcctctcagtgtggcttctgcactcctggaatgtgcatgtctattttcacctcccttatcaatgctgacaaatccaagaggcccgaaccaccaaaagggttctcaaaactaaaagtatcagaagcagaaaaggccttctcaggcaacatgtgtagatgcactggttaccgtccaattgttgatgcctgcagaagttttgcatcagatgttgacttggaggatttgggccttaatatattctggaagagaagcgataagaatccagacgttagtgaattgccaagttacactcttggtggtggagtctgtactttcccagacttcctaaaatctgagataaaatcttctcttaaccatctgaataatgcttatatttcagcatccagagagggctggtatcatccgagaagtatcaaagagtattatgagttaataaattcttgtttatatagtgactctgtcaaagttgttgttgggcacactagtagcggtgtacccggatacaaggatcaagatctctacgataagtatattgacataagtggcattcctgaactttcagatattgtgaaaaaagagtcaggctttgaaattggagcagctacaacaattgctaggaccattgagatacttgagcaagaatgtgaatctatatcctctccaaatggctgtgtagttttcagaaaacttgctgaccacatgagcaaagttgccaacccgtttgtccgcaacacagctagtattggaggaaacataattttggcacaaaaatacccatttccctcagacattgcaaccatacttctcggtgctggcgcaactgtctgtcttcaggttgttacagaacgaaggcaaattactttggaagagttcctagagcagcctcctttggatcctactactttactccttagcatatttattccacattggatttcagattatcaggcagaaacaagtttgttatttgaaacttaccgagcagcacctcgtcctcttggcaatgctgtttcatatgtaaattgtgctttcttggggctttcttctgtggataaacaatcagatactcttgtattgagtaatctgcgcttggcttttggtgcatatgggacagaacatgctataagagccaagaaggtggagaaattcctaactggtaaatcactcactgcattggttgtacttggagcagttcagttactcagagaaacgattgtaccaatggagggaacatcacatcctgaatatagagtcagtgctgctgttgggtttctctttagtttcctatctccgcttgccaaaggcatcccagagcctggaaaagctctgaccagtggctggtctgactcagcagatacagatgatgtacgtaacctgccgttgtcatcacgtcgagaaacaatttccaacggcgattataaaccggttggtgagccaattaagaagtatgccgttgaacttcaagcttctggggaggcagtttatgtggatgatattcctgctccaaagagttgcctctatggggaatttatttacagcacacaacctcttgcttatgtcaagagtattaagttcaaatcttctttagcatcaagtaagatcatcgatgttgttactgcgaaggatattccatgtggaggagaaaatattggatcagccttcatgtttgggggtgagccattgtttggtgatccaatttctgagtatgctggacaagctcttggcattgtgattgcagaaacacagaggtatgctgacatggcagctaagcaggttattattgaatatgacacaaaagatttgagtccaccgatcttaactgtggaacaagctgtggaaaacagtagctacttcagtattccccaagaatattctcccaaagaagttggtgatttctcgaggggcatggcagaagctgatcacaagatcccagcagcagaagtaaaacttgcctctgagtactacttctacatggaaacacagacagcactagcaattccagatgaggataataccttggtagtctacagttcgtcacagtatcctgagtttgcgcaaactgtcatagcaaggtgtctgggcattccattcagtaatgtgcgtgtcattacaagaagggttggaggaggcttcggaggaaaggcattcagatcattccaagtcgcaacggcagctgcactttgtgcatacaagctacgacgtcctgttcgaatgtatcttaatcgcaacactgatatggttatgattggtggtaggcacccagtgaaagctcgttattctgttggattcaaatctgatgggaaaattacagccttgcacctagatttattaattaacgctgggatatctccagatgcaagccccattataccaggcactattatatctagtgtcaagaagtacaactggggtgctctgtcatttgacatcaaactctgcaaaacaaataatacatctaaatctgttatgcgtgctccgggagatacacaaggctctctaattgctgatgctataattgagcatgtcgcgtccgtgctttcagttgatgctaacagcgtgagggaaaagaattttcacacctatgatactcttcagctgttctacccagacagtgcaggcgaagcttctgcgtacacattacattcaatttttgatagattggtctcgacttcaagctaccttgatcgagctgaatccataaagcagtttaacagtagcaacaagtggcggaaacgcggcatctcttgtgtgcccctcattttcagagctgaacaaaagccagctccaggacgggtttctgtgctcaatgatggctccatagtggtggaggttggaggaattgaaatcggacaaggactgtggactaaagtacagcagatgacggcctttgctctaggacaattgtggccaaatggaggtgaagatcttcttgagagagtgcgtgttatacaggctgacactttgaacttaatacaaggcggacttactgctggtagcactggatctgaagctagttgcgccgcaaccctgcaggcgtgcaatatgctgattggcagattaaagccagtcttggataggctgcagcagcaatctgaaaatgtctcatgggatactttgatttctcaggcttccaaagaaaatgttaatttatctgcaagtgcatactgggtacctggccaagattcttacaggtacctgaactatggagctggaataagtgaggtggagattgatcttcttacaggagcaattactatattaaggggtgatcttgtgtatgactgtggaaagagcatgaaccctgctgtggacttaggccagattgaaggttcctttatacagggaattggcttcttcatatatgaagaatatgttacgaacagtgatggcttgatgattagcaacagcacatgggactacaagatcccaagtgtcgacataatcccaaagcagtttaatgctgaggttctgaacactggataccataaggatcgcgtgctttcttcaaaagcttgtggtgaacctgctctgattgctgcctcatccgttcattgtgcactgagagaagctattagagcagcaagaaaggagtttgccaacagcactggttctggcagctcacctctggaattccagatggatgtccctgcgccaatgacactggtgagagaactatgtggttttgatatcgtggagaagtacttagaaagtctatctgcctgtgaacgtgcagctggggtgtaatctacgctcatgttgtcgcacacaaaaaggagtggtctctctatatcttattatatcttatgttacaatgaagagggggtatggtagtcaaataggcacgaatatttgaatgctttgaacaatgtacaaggttgtgcgcctgtgcctccatactctctggaatttgaacatctatattcgtgtatccttattaaagctacaggaagtggttgtatttatgtaatttaattgttatgaagttcgagtgcagatcaattttattaagcgcactctcctgctaacttggttaaacaaagtgaaagctagagtcagaacttagaagcattttatttgaacgagcatttcatgactcatgagagcaat

SEQ ID NO: 2058 - DNA, 4364 bp, Brachypodium distachyon
aacacccatccacattcatctggtgagcaaggcagcaagagctttgcttgcttgaagatgaaggtggagaaggtggtgtttgcgctgaacgggcggcggtacgaggtggtggacgccgacccttccacgacgctgctcgagttcatccggaccaggacgccattcaagggcacaaaactcggctgtggcgaaggtggatgtggagcttgcgtggttcttatagcaaagtataatccgacaaaagatcaagtgactgaattttccgcaagttcatgtctaacacttctttacaatataaatttctgttcagttatcaccactgagggtctgggaagtacacaagatggttttcatgctattcagaaaagaatgtccggtttccatgcttctcagtgtggtttctgcactcctggcatgtgcatgtccattttcacttctcttgtcaatgctgacaaatccaaaaatcttgaaccacaaaatggcttctcaaagctatcagtttctgaagcagaaagagctttctcaggcaacctgtgtcgatgtactggttaccggccgatcgttgatgtttgcaaaagttttgcttcagatgttgacttggaggatttgggccttaatatattctggaagaaaggtgacaagagtgctgatgttagcaaattgccaagttacactcttggtggcggagtctgcactttcccggactttctaaaatctgagatgaaatcttcacttgattatctgaatgattctaatgttgctgtctccagggagggttggtatcatcctaaaagtatcgaacagtattattacttattaaactctggcatatttagtgactgctctgtcaaagtggtagttgggaacacaagtgctggtgtatacaaggatcaggacctatataacaagtatattgacataggtggcattccagaactttcagccatttcaaggaaagatggtggtattgaaattggagcagctaccccgatttctaggaccatcgaggtacttaagcaagataatgattctatgtcctgtccaaatggaagtgtggtttttagaaaacttgctgagcacatgagcaaagtggctacaccatttgtccgaaacacagcaagccttggtggaaacataattctagcacagaaatacccatttgcctccgacatcgcaaccatacttcttggtgctgcttcaactgtttgtcttcaggttacttcagaaagattagaggtgactttggaagagtttctcgagcagcctcctcttgatcctagtactttactcctgagcatatttattccacattggttttcagattctcaaaaagagactaatgtgatctttgaaacttaccgagccgcaccgcgccctcttggcaatgctgtctcatatattaattctgctttccttggaaatgtttccttgcatggatcatcaagtgatcttgtattgagtaatctgcacttggctttcggtgcctatgggacagaacatgctatcagagcaacaaaagttgaagaatacctcactggaaaattgctgactccatctgttgtgcttcaagcggttcggttacttagaggaacaattgtaccaaaggaaggaacatcacatcctgaatacagggtcagtgtggctgttggatttctcttcagtttcctgtatccacttgttaaaggcatgacagggcctgaaaaaactctgagcattggttgttctagttctgtagaggaggctagcctgccattgtcttcacgtagagaaacagttcccagtgatgaatataaaccagttggtgagccgattaaaaagtatggagttgagcttcaagcttctggggaggctgtatatgtagatgatattcctgctccaaaggattgcctctatggagagttcatttacagtacacaagctcttgcatatgttaagggtatgaaattcaagccttctttagcatcagagaagattattacagttgtttctgcaaatgatattccaagtggagggcaaaacattggatctaccttcatgtttggggatgagccacttttcggtgctccaattgctgagtttgctgggcaagctctcggtgttgtgatcgcagaaacacagaggtacgcagacttggcagcaaaacaggtggttattgaatatgccacagaagatttgaagccgccaatcttaactgtcgaacaggcagtgcaaaacaacagctatttcaaagttcctcctgagaggtatccaaaacaagttggtgatttttcaaagggcatggcagaagctgatcacaaaatcctgtcaacagaagtaaaacttgcctctcagtactacttctacatggaaacacaaacagcactagcggttccagatgaagataacaccatggttgtctacagttcatcacaatatcctgagcttgcacagagtgtcatagctaagtgcctcggcattccattcagcaatgtgcgagtcattaccagaagggttggaggaggctttggcggaaaggcattcagatcatacaatgtagcaacggcagctgcgctgtgtgcaaacaagttacggcgtcctgtgcggatgtatctcaatcgcagtactgacatgatcatggttgggggtcggcacccagtgaaagcttattactcagttggatttaagtctgatgggaaaattactgccctgcacctagatgtactaattaatgctggaatttctccagatgcgagccctataataccagacactattatatcaggtctgaagaaatacaactggggtgctctctcatttgacatcaagctctgtaaaacaaacaatacatccaaatcagtaatgcgtgctcctggagatactcaaggctcttttattgctgatgctatcattgagcatgttgcttctgtactctcactcgacgctaacactgtcaggcaaaagaattttcacacctatgatagtcttgtgttgttctatccagaaagcgcaggcgaatcttctacatacacactacattctatttttgatagattactcatgacatcgagctacctgcatcgagctgaatccatcaagcagtttaacagttgcaacaattggcggaagcggggtatctcttgtgtgcccctcatattcaaggttgcaccaaggccagctcctggaagagtttctgtgctcaatgacggctccattattgttgaggttggaggtattgaaattgggcaaggactgtggacaaaagtacagcagatgacggctttcgcactgggacagttatggcctgatgggtgcgaatgcctccttgacagagtgcgtgttcttcaggctgatacattgaacttaatccaaggtggacttactgctggcagcactgcatctgaatctagttgtgcagcaacccttcaggcctgcaacatgttgactgacagattaaagcctgtcatggataagctcaaacagcaatctggtgctgtttcatgggattctttgatttcccaggcatctcaggataatatcaatttgtcttcaactgcatactgggtacctggccaagaatccagtagctatctgaactatggggctggcataagtgaggtggagattgatcttcttacaggagcaattactttactaaggagtgaccttgtgtatgactgtggaaagagcttgaaccctgcagtggacttgggccagattgaaggttcctttatacaaggaattggtttcttcatatacgaagaacacgagacaaacagtgatggcctggttgtgagcgacagcacctgggactacaagatcccaagtgtcgacaccatcccaaagcagttcaatgccgaggtgctgaacaccggataccataagaaccgcgtgctttcttcaaaagcttccggagaacctgccctagttcttgcatcatcagtccattgtgcggtgagagaagctatctgcgcagcaagaaaggaattcgcacacagcactgggtctggaagctcaccgctcacattccagctcgatgtccctgcgccaatgacagtggttaaggaactgtgtggtttggatattgtggacaagtacttggaaaatctatctacacatcaattccagtgttgacaactggaaggagcggtgtgatcatattatgtaatttgaatggtaattataataatgttccgaatgtttacgatattctgtgttgtgcttgcagtttttctaatcataattccaggttgagaattgtattcacgataccttgttgtataagcgccactttatgtatttctcgtgttataatttggacatttgtggtgcaggtaaagaagaatagtgcatgtatagagtttatggtatgtgtgttttttagtttt

SEQ ID NO: 2059 - DNA, 1197 bp, Sorghum bicolor
aaattccctccctggtgctccactagcctccggcgaactgccggtagcggaaacgccggccgagatgtctgcttcctccttcccaccccgcacggtgatctgtgtgggcgacgtccacggctacgtcacgaagctggagagcctctggtccaacctcgaggccgcgctccccgccgacgccttcgccaccgcgctggtcatcttcctcggcgactacaacgaccgcggcccggacacccgcagggtcctcgacttcctcctcgagctcccaacgcgccaccccgggcagcgccacgtcttcctctgcggcaaccacgacctcgccttcgcggcgttcgtcggggcgctgccgccgccgcccgacggctccccgttctcggccacctgggacgagtacatccacaacgaggagcacgaggggtggttccgcgggccgggatacgaggacatgcacgtgcaggggaggcgctggggcggggtcatcaaggagaggtggaaccccaagaaagggctgccgtacaagggctccatctatgacgcgcagccaaccttcgaatcctacggcgtcgcccatggttcacctgatctcgcaaaggctgtgccagaggagcacaagaggtttctgcatgacttggtttggatacatgaagaggaaaatgtgccaattgatacggatgaaggacaaatcatctgcaatctgattgccgtccatgctggcctagagaggaccatagatttgaatgagcaacttagagttttgagaaccagagacacaagggtgccaaaggttcaaatgcttagtgggcggcaagatgtttggaacacacccaaggatctgactggcaagcaaactatcattgtaagtggccaccacgggaagctccacatcgacggcctccgattcataatcgatgaaggtggtggttatgcagacaaacctattgctgcaattgtgtttccttcaaagacattgatcagaagttccgaggcacattgaacacggtggtgcagttttttttccttgtaattactgcctgtactcatgtatcatatgtcaaacaacaataagaacaactcgaaaggaaataagttggtgaaccagacctgcggcttaacatgtctagtcattagtgtgaagtgtaactatttgaaactgtggaaatgaaataagttggatgagagactgtacatcctctt

SEQ ID NO: 2060 - DNA, 1296 bp, Panicum virgatum
ggcacctcacaggataatctctggcgatccgctcgctacccgcttctctgcagtgaagcagcctccgccctccggcgagccgccgtggcgggaactccggcgcgatgtctgctccctcggccccgccacgcacggtgatctgcgtgggcgacgtgcacggctacatcacgaagctggagagcctctggtccaacctccaatccgcgctccccgccgacgccttcgccaccgcgctggtcatcttcctcggcgactacaacgaccgcggaccgcacacccgcagggtcctcgacttcctcctcgcgctcccgcagcgtcaccccgcgcagcgccacgtcttcctctgcggcaaccacgacctcgccttcgccgcgttcgtcggggtgctgccgccgcctcccgacggctccccattctcggccacctgggacgaatacctccacaacgaggagcacgaggggtggttccgcgggccgggctacgaggacatgcacgtgcaggggaggcgctggggcggggtcatcaaggagaggtggaacccgaagaaggggctcccgtacaggggctccatctacgacgcgcagcccactttcgagtcctacggcgtcgcccatggttcccctgatcttgcaatggctatgccggaggagcataagaggtttctgcgtgacttggtatggatccatgaagaggaaaatgtgcccattgatacggatgaaggccaaatcatttgcaatctaattgcagttcatgctggcctagagaagtccatagatttgaatgagcagcttagagttctaagaactagagacacaagggtgccaaaggttccaatgctcagtgggaggcaggatgtttggaacacaccaaaggatctgactggcaagcgtaccatcgttgtcagcggtcaccatgggcagctccacatcgacggcctccgattcatcattgatgaaggcggtgggtatgaagacaaaccaatagctgctatcgtttttccctcaaagacattgattagaagcacggagggaacaacgtcacaggattgaactggatgtcatgatcatgagcagggaggttctgttttttccccccttgctagttgctacttgctactgcctgtggtcatgtgtcatacgcacaccaaaataattaacaggtgcaacggctatagtaaataagaggttttgggtccagacctgtgttttggcatgtatagtcacaactgttgaactgtaaactttgttatactacacctttggataccgttaaactgaacaagaagatttcccatcc

SEQ ID NO: 2061 - DNA, 1293 bp, Setaria italica
gataactcgctacccgcttctctcggcagtgaagcctccggcgagcagcggtggcggaagcgccggcgagatgtcagctccctcggccccgccccgcacggtgatctgcgtgggggacgtccacggctacatcgcgaagctggagagcctctggtccaacctccagtccgcgctccccgccgacgccttcgccaccgcgctggtcatcttcctcggcgactacaacgaccgcggcccgcacacccgcgaggtcctcgacttcctcctcgcgctcccgggacgccaccccgcgcagcgccacgtcttcctctgcggcaaccacgacctcgccttcgccgcgttcgtcggggtactgccgccgcctcccgacggctccccattctcggcgacctgggacgagtacatccacaacgaagagcacgaggggtggttccgcgggccggggtacgagggcatgcacgtgcaggggaggcggtggggcggggtcatcaaggagaggtggaacccgaagaaggggctcccgtacaggggctccatctacgacgcgcagcccaccttcgaatcctatggcgttgcccatggttcccctgatctcgcaaaggctgtgccagaggaccataagatgtttctgcatgacttggtttggatacatgaagaggaaaacgtgccaattgatacggatgaaggccaaatcatttgcaatctaattgcggttcatgctggcctagagaagtccatagatttgaatgagcagcttagagttctgagaactagagacacaagggtgccaaaggttccgatgcttagtgggaggcaggatgtttggaacacaccaaaggatctgactggcaagcacaccattgttgtaagcggtcaccatgggcagctccacatcgacggcctccgattcatcatcgatgaaggcggtgggtacgaagacaaacctatagctgccatcgtttttccttccaagacattgatcagaagcacagagggagccgcatcacagaattgatatggatgtcatgatcaggagcagggaggtgcagtttttctttttcctcttgcttgttgctatttggccgtggtcacgtgtcatgtttcagacgattcataggtacaccgtcgacaggaaataagaggtttgaggaccagacctgcattttcgcatgtacagtatagtcacaatgtgaactgcaaactttggtattctatacccttggtgctgtcaacttggacatgaaatttcctatccctgcccattcgagatttccaggtctcaggcccctttac

SEQ ID NO: 2062 - DNA, 1492 bp, Panicum virgatum
gggggaagggggaaggttctggatcgggacggacggcctagatcagtcgaccccagcatcgaacggttgatatcgtccaggcggtaatgtaaggtagccggcgccggaggcacctcacagtgagatatctgggctggcgctccgctcgctacccgcttctctgggcagggaagcagcctccggcgagccgccgtggcgggaactcgggcgcgatgtctgctccctcggcgccgccgcgcacggtgatctgcgtgggggacgtgcacggccacatcacgaagctggagagcctctggtccaacctccaatccgcgctccccgccggcgccttcgccaccgcgctggtcatcttcctcggcgactacaacgaccggggaccgcacacccgcggggtcctcgacttcctcctcgcgctcccgcggcgccaccccgcgcagcgcctcgtgttcctctgcggcaaccacgacctcgccttcgccgcgttcgtcggggcgctgccgccgcctcccgacggctcccccttctcggccacctgggaggagtacctccacaacgaggagcacgaggggtggttccgcgggccgggctacgaggacatgcacgtgcaggggaggcgctggggcggggtcatcaaggagaggtggaacccgaagaaggggctcccgtacaggggctccatctacgacgcgcagcccactttcgagtcctacggcgtcgcccatggttcccctgatcttgcaatggctatgccggaggagcataagaggtttctgcgtgacttggtatggatccatgaagaggaaaatgtgcccattgatacggatgaaggccaaatcatttgcaatctaattgcagttcatgctggcctagagaagtccatagatttgaatgagcagcttagagttctaagaactagagacacaagggtgccaaaggttccaatgctcagtgggaggcaggatgtttggaacacaccaaaggatctgactggcaagcgtaccatcgttgtcagcggtcaccatgggcagctccacatcgacggcctccgattcatcattgatgaaggcggtgggtatgaagacaaaccaatagctgctatcgtttttccctcaaagacattgattagaagcacggagggaacaacgtcacaggattgaactggatgtcatgatcatgagcagggaggtgctgttttcccccccttgctagttgctacttgctactgcctgtggtcatgtgtcatacgcacaccaaaataattaacaggtgcaacggctatagtaaataagaggttttgggtccagacctgtgttttggcatgtatagtcacaactgttgaactgtaaactttgttatactacacctttggataccgttaaactgaacaagaagatttcccatccctttcagttgggccctggctgtcttgactatttggagatttccaggtctcgagaataaaggcaaaaggcttgcctagttgccttttcac

SEQ ID NO: 2063 - DNA, 1264 bp, Sorghum bicolor
catcacagttcacaggataatggcttcgctcctctgccgctccgctcgctacccgctttgtctgcggtgaagcctccggcgaacagccgcgccggccgagatgtctgctccctccgcggcaccacccccaccccgcaccgtgatctgtgtgggcgacgtccacggctacgtcacgaagctggagagcctctggtccaacctcgaggccgcgctccccgccgacgccttcgccaccgcgctggtcatcttcctcggcgactacaacgaccgcggcccggacacccgcagggtcctcgacttcctcctcgcgctcccgacgcgccaccccgcgcagcgccacgtcttcctctgcggcaaccacgacctcgccttcgcggcgttcgtcggggcgctgccgccgccgcccgacggctccccgttctcggccacctgggacgagtacatccactacgaggagcacgaggggtggttccgcgggccgggatacgagggcatgcacgtgcaggggaggcgctggggcggggtcatcaaggagaggtggaaccccaagaaggggctcccgtacaagggctccatctatgacgcgcagcccaccttcgaatcctacggcgtcgcccatggttcccctgaactcgcaaaggctgtgccagtggagcacaagaggtttctgcatgacttggtctggatacatgaagaggaaaatgtgccaattgatacggatgaaggacaaattatctgcaatctgattgccgtccatgctggcctagagaggaccatagatttgaatgagcaacttagagttttgagaaccagagacacaagggtgccaaaggttcaaatgcttagtgggaggcaagatgtttggaacacacccaaggatctggctggcaagcagactatcattgtaagtggccaccacgggaagctccacatcgacggcctccgattcataatcgatgaaggtggtggttatgaagacaaacctattgcagctatcgtttttccttcaaagacattgatcagaagtaccgaggaaacggggtgcagttttttttccctggtaattactgcttgtactcatgtatcctatgtcaaacgacaataggaacaacgtccaaaggaaataagtcggtgaaccagaccatgtgtcttcgcatgtttagtcactactgtgaaatgtaactatttgatactgtcaacttggacgagagactgtacatcctcttttttacggcaataattcaataaactttacatccttgtc

SEQ ID NO: 2064 - DNA, 1487 bp, Brachypodium distachyon
cagatggtaattaccgtttcttccattcctgggatcaagctccaacgaaatatcgtcaagatcacatcaataggcttaccaagccagcaaaattggaagcgattgctgccaaacaagtcgatctcaatcgaacttcgcttctgtggctctctgctctccccgcttcttctcccatcccccgcgaggagccgaggaaacgacaccggcgagatggctcctgcatccccgcctccccgcacggtgatctgcgtgggcgacgtccacggtttcatctccaagctggaaagcctgtgggcgaacctacaatccgcgctccccgccgacgccttcgccaccgcgctcgtcatcttcctcggggactactgcgaccgcggcccgcacacccgccgcgtgctcgacttcctcctcgcgctcccggcccgacaccccgcccagcgccacgtcttcctctgcggcaaccacgacctcgccttcgccgccttcgtcggcgctctgccgccgccccctgacggttcccctttcgccgccacctggcccgagtacatcgacaatgaggcgcacgagggttggttccacgggccagggcacgaggatatgcatgttcaagggaggagatggggcggagtaatcaaggagaggtggaaccccaagaaggggctcccgtacaagggctctatctacgatgctcagccaaccttcgagtcctacggcgtcgcccatggatcccctgatctcacgaaagctgtgcctgaggagcacaagaggtttctgcatgacttggtttggatccatgaaggggaaaacgtgcctattgatacagatgaaggccagattgtttgcaaactgattgcagttcatgctggcctggagaagtccatcgatttgaatgagcagcttagagttttgagaactagagacacaagggtgccaaaggttcaaatgcttagcgggaggcaggatgtttggaacataccagaggatcttgccggcaagcagacagtcattgtaagtggccaccatgggaaactccacatcgacggtctccggttcatcatcgacgaaggtggcgggtacgaagacaaacctatagctgccgttgttttcccttcgaagcaattgatcaggagcacagagggaaccgcacccctggattaatctagacaccatcagaacagcaccgatgcagttgtatttcttgttactgccataacactagcagtcagacgactactaggtacaattgccaaatacgatattccacacagagaattactagcgtgttttggatgtataactttgagttcaagttgtaaatcaacaatgtgttaatcgatcccgctccggtctcatttcccggcatgcaatatgcctactgcagcaaggaagttcctgtatgacagcagcatcattatacttccatctggcttgcctttggcaactagccggtgtggatcatgaatgacaacgagtgaactttgtaaacacaa

SEQ ID NO: 2065 - DNA, 1743 bp, Hordeum vulgare
tacggattatgattttatttatcttttcatgagaacacatgtatcccatggggcaatcaacttgtaaatcctaatcgatcggtcgatcgattcgatcgggtcgaaccagcaaagcagcggcacgtgcaaacaccggcctgggcgccgtttacagatggtaattacttcttctgctcccgggattaagctccaagggaatatatgcaagatcacatccatagccttcgcaaggcaacaaaactgcaagcgattgctgccaaacaggtcgatttcaacggatcccctccgcttatgcggttctctgctgtcctctccgcttctcctcccatccccattgtccttgcgcgcacggggaaacgacgccggcgagatggcttcccctccccgcacggtgatctgcgtgggtgacgtccacggctacatctccaagctggagagcctgtgggcgaacctccaggccgcgctccccgccgacgccttcgccgccgcgctcgtcatcttcctcggggactacaacgaccgcggcccgcacacccgccgcgtcctcgacttcctcctcgcgctcccggcccgccacccggctcagcgccacgtcttcctctgcggcaaccacgacctcgccttcgccgccttcgtcggagcgctgccgccgccccccgacggctcccctttcgctgccacctgggcccaatacatcgacaacgaggcccacgagggctggttccgcgggccggggcacgaggacatgcacgtgcaagggaggagatggggcggcgtcatcaaggagaggtggaaccccaagaagggcctcccgtacaagggctctatctacgatgctcagcccaccttcgagtcctacggcgtcgcccatggatcaccagatctcgtgaaagctgtgcctgaggagcataaaaagtttctgcatgacttggtttgggtccatgaagaggaagacgttcctattgatacagatggaggccagattctgtgcaaactgattgcggttcatgccggcctggaaaagtcattggatttgaatgagcagcttagagttttgagaactagagatacacgggtgccaaaagttcaaatgcttagcgggaggcaggatgtttggaacataccacagggtctggccggcaagcagaccatcgttgtaagtggccatcatgcgaagctccacctggacggtctcaggttcatcatcgacgaaggtggtgggtatgcagacaaacctatagctgccgttgttttcccctcgaaggaagtgatcaggagctccgagggaacggcctcccggaattgatctagacatcatcggaacggcaaagatgcaagctcatgttttttgttgctgtcgtaacatgagcaatcggacgactgatatgtacaactgccaaaacggagtggtataatatttcaaaaaacatggaactgatgtttaatgtattataacgtcgagtagatatatatagataaatactccgtcaaaaaaaaaagtgtgaagcggtgctactcgggcttgtcctaatcgcaatgtgccaactagggcaaggaagttcctgtatgtatgcgccagttgacatcatcattatacttgcaacttggctgtcggtatgaatcatgagcgggaatggccatgtttttagacagtaacttttctttcttgttaactgataaagtaatacaacttgcaccttgtacagacagatcgcgaacggtggttgtacatgcctacatggt

SEQ ID NO: 2066 - DNA, 1366 bp, Secale cereale
cttatgcggttctctgccgccctcgccgcttctcctcccatcctccttgtccttgcgcgcacggggaaacgaagccggcgagatggctcctccccgcacggtgatctgcgtgggtgacgtccacggctacatctccaagctggagagcctctgggcgaacctccagtccgcgctccccgccgacgccttcgccgccgcactcgtcatcttcctcggggactacaacgaccgcggcccgcacacccgccgcgtcctcgacttcctcctcgcgctcccggcccgctacccggctcagcgccacgtcttcctctgcggcaaccacgacctcgccttcgccgccttcgtcggagcgctgccgccgccccccgacggctcccctttcgccgccacctgggcccaatacatcgacaacgaggcccacgagggctggttccgcgggccgggccacgaggacatgcacgtgcaagggaggagatggggcggcgtcatcaaggagaggtggaaccccaagaagggcctcccgtacaagggctctatctacgatgctcagcccaccttcgagtcctatggcgtcgcccatggatcaccagatctcatgaaagctgtgcctgaggagcacaagaagtttctgcatgacttggtttgggtccatgaagaggaaggcgttcctattgatacagatggaggccagattctatgcaaactgatcgcggttcatgccggcctggaaaagtccttggatttgaatgagcagcttagagttttgagaactagagacacaagggtgccaaaagttcaaatgcttagcgggaggcaggatgtttggaacataccacaggatctggccggcaagcagaccatcgttgtaagtgggcatcatgcgaagctccacgtggacggtctcaggttcatcatcgacgaaggtggcgggtacgcagataaacctatagcggccgttgttttcccttctaaggaagtgatcaggagcacagagggaatggcctcccagaattaatctgacaccatcggaacgccacggatgcaagctaatgttttttgttactgtcgtaacatgagcaatcggacgactggtatgtacacatctgccaaaacggagtataacatttcaaaaaacacataattggggttttaatgtataacgtcgagtaaataaatcaataatgtgtgatcttcttctcctaagcatgcaatgtgacaactagggcaaggaagttcctgtgtgccagttgacagcatcattatacttgctacttggctgtcggtatgaatcatgaaccgcaatggccctgtttttaaacagcagcttttcttgttaagtggagtaatacaacctgcaccttctata

SEQ ID NO: 2067 - DNA, 1344 bp, Triticum aestivum
ccgcttctcctcccatcctccttgtcctcgcgcgcacggggaaacgacgccggcgagatggctcctccccgcgcggtgatctgcgtgggtgacgtccacggctacatctccaagctggagagcctgtgggcgaacctccagtccgcgctccccgccgacgccttcgccgccgcgctcgtcatcttcctcggggactacaacgaccgcggcccgcacacccgccgcgtcctcgacttcctcctcgcgctcccggcccgccacccggctcaacgccacgtcttcctctgcggcaaccacgacctcgccttcgccgccttcgtcggagcgctgccgccgccccccgacggctcccctttccgccgccacctgggcccaatacatcgataacgaggcccacgagggctggttccgcgggccggggcacgaggatatgcacgtgcaggggaggagatggggcggcgtcatcaaggagaggtggaaccccaagaagggcctcccgtacaagggttctatctacgatgcgcagcccaccttcgagtcctacggcgtcgcccatggatcaccagatctcatgaaagctgtgcctgaggagcacaagaagtttctgcatgacttggtttgggtccatgaagaggaagacgttcgtattgatacagatggaggccagattctatgcaaactgattgcggttcatgccggcctggaaaagtccttggatttgaatgagcagcttagagttttgagaactagagacacaagggtgccaaaagttcaaatgcttagcgggaggcaggatgtttggagcataccacaggatctggccggcaagcagaccatcgttgtaagtgggcatcacgggaagctccacgtggacggtctcaggttcatcatcgacgaaggtggcgggtactcagataaacctatagctgccgttgttttcccttcgaaggaagtcatccggagcacagagggaacggcctcccagaattaatctagacaccatcggaaatgcaagctaatgtcgtaacggagtatcatatttccaaaaacacagaactgaggttttaatgtataacgtcgagtaaataaatcaataatgtgtgatcttctcctaagcatgcaatgtgacaactaggacaagtaagctcctgtgtgccagttgacagcatcattatacttcttgctacttggctgtcgatatgaatcatgaacggcaatggccctgttttaaacagcagcttttcttgttaaccgaagtaatacatcctgcacggcaccttctatagacaaacagatctcggacggtggttgtacatgcctacatggtccaaggcagaacaatag

SEQ ID NO: 2068 - DNA, 1311 bp, Pseudoroegneria spicata
gtccttgcgcgcacggggaaacgacgccggcgagatggctcctccccgcacggtgatctgcgtgggtgacgtccacggctacatctccaagctggagagcctgtgggcgaacctccagtccgcgctccccgccgacgccttcgccaccgcgctcgtcatcttcctcggggactacaacgaccgcggcccgcacacccgccgcgtcctcgacttcctcctcgcgctcccggcccgccatccggctcagcgccacgtcttcctctgcggcaaccacgacctcgccttcgccgccttcgtcggagcgctgccgccgccccccgacggctcccctttcgccgccacctgggcccaatacatcgacaacgaggcccacgagggttggttccgcgggccggggcacgaggacatgcacgtgcaagggaggagatggggcggcgtcatcaaggagaggtggaaccccaagaagggcctcccgtacaagggctctatctacgatgctcagcccacattcgagtcctacggcgtcgcccatggatccccagatctcatgaaagctgtgcctgaggagcacaagaagttcctgcatgacttggtttgggtccatgaagaggaagacgttcgtattgatacagatggaggccagattctatgcaaactgatcgcggttcatgccggcctggaaaagtcattggatttgaatgagcagcttagagttttgagaagtagagacacaagtgtgccaaaagttcaaatgcttagcgggaggcaggatgtttggaacataccacaggatctggccggcaagcagaccatcgttgtaagtgggcatcatgggaagctccacgtggacggcctcaggttcatcatcgacgaaggtggcgggtacgcagataaacctatagccgccgttgttttcccgtcgaaggaagtgatcaggagctcagagggaacgacctcccagaattaatctagacatcatcggaacggcatggatgcaagctcatgttttttgttgctgtcgtaacatgagcaatcggacgactgatatgtacatctgccaaaacggagtataatatttcaaaaaacatagaattagggttttaatgcattataacgtcgagtaaatcaataatgtgtgaggcgatcccacttgggctcgtttcttctcctaaagcatgcaatgtgccaactaggacaagttcctgtatgtatgccagttgacagcatcattatacttgcaacttggctgtcggtatgaatcatgaacggtaatggccctgtttttaaacagcaactttttctttcttgaca

SEQ ID NO: 2069 - DNA, 1556 bp, Triticum aestivum
tcctaatctatcgatcgatccggtcgggtcgaaccagcaaagcagctgcacgtgcaaacaccggcctgggcgccgtttacagatggtaattacttcttccgctcccgggattaggctccaaggaaatatcggcaagatcacatccacagccttcgcaaggcaacaaattgcaagcgattgctgacaaacaggtcgatttcgaccgatctcctccgcatatgtggttctctgctgcccttgccgcttctcctcccatcctccttgtcctcgggcgcacggggaaacgacgccggcgggatggctcctccccgcgcggtgatctgcgtgggtgacgtccacgggtacatttccaagctggagagcctctgggcgaacctccggtccgcgctccccgccgacgccttcgccaccgcgctcgtcatcttcctcggggactacaacgaccgcggcccgcacacccgccgcgtcctcgacttcctcctcgcgctcccggcccgccacccggctcagcgccacgtcttcctctgcggcaaccacgacctcgccttcgccgccttcgtcggagcgctgccgccgccccccgacggctcccctttcgccgccacctgggcccaatacatcgacaacgaggcccacgagggatggttccgcgggccgggccacgaggacatgcacgtgcaagggaggagatggggcggcgtcatcaaggagaggtggaaccccaagaagggcctcccgtacaagggctctatctacgatgctcagcccaccttcgagtcctacggcgtcgcccatggatcaccagatctcatgaaagctgtgcctgaggagcacaagaagtttctgcatgacttggtttgggtccatgaagaggaagacgttcgtattgatacagatggaggccagattctatgcaaactgatcgcggttcatgccggcctggaaaagtccttggatttgaatgagcagcttagagttttgagaactagagacacaagtgttccaaaagttcaaatgcttagcgggaggcaggatgtttggaacataccacaggatctggccggcaagcagaccatcgttgtaagtgggcatcatgggaagctccacgtggacggtctcaggttcatcatcgacgaaggtggcgggtacgcagataaacctatagcggccgttgttttcccttcgaaggaagtgatcaggagcacagagggaacggcctcccagaattaatctagacagcatcggacgccacggatgcaagctaatgttttttgttactggcgtaacatgagcaatcggacgactggtatgtatatctgccaaaatggagtataatatctcaaaaaacacataattggggttttaatgtataacgtcgagtaaataaataaataaataatgtgtgatcttctcctaagcatgcaatgtgacaaccaggacaaggaagttcctgtgtgccagttgacagcatcattatactacttgttacttggctgtcggtatgaatcatgaacggcaatggccctgtttttaaacagcagcttttcttgttaact

SEQ ID NO: 2070 - DNA, 1532 bp, Triticum aestivum
cagatggtaattacatcttccgctcccgggattaggctccaagggaatatcggcaagatcacatccacagccctcgcaaggcaacaaaattgcaagcgattgctgccaaacaggtcgatttcgaccgatctcctccgcatatgtggttctctgctgcccttgccgcttctcctcccacccaccttgtcctcgcgcgcacggggaaacgacgccggtgagatggctcctccccgcacggtgatctgcgtgggtgacgtccacggctacatctccaagctggagagcctgtgggcgaacctccagtccgcgctccccgccgacgccttcgccgccgcgctcgtcatcttcctcggggactacaacgaccgcggcccgcacacccgccgcgtcctcgacttcctcctcgcgctcccggcccgccacccggctcagcgccacgtcttcctctgcggcaaccacgacctcgccttcgccgccttcgtcggagcgctgccgccgccccccgacggttcccctttcgccgccacctgggaccaatacatcgacaatgaggcccacgagggctggttccgcgggccggggcacgaggatatgcacgtgcaggggaggagatggggcggcgtcatcaaggagaggtggaaccccaagaagggcctcccgtacaagggctctatctacgatgcgcagcccaccttcgagtcctacggcgtcgcccatggatcaccagatctcatgaaagctgtgcctgaggagcacaagaagtttctgcatgacttggtttgggtccatgaagaggaagacgttcgtattgatacagatggaggccagattctatgcaaactgatcgcggttcatgccggcctggaaaagtccttggatttgaatgagcagcttagagttttgagaactagagacacaagggtgccaaaagttcaaatgcttagcgggaggcaggatgtttggaacataccacaggatctggccggcaagcagaccatcgttgtaagtgggcatcatgggaagctccacgtggacggtctcaggttcatcatcgacgaaggtggcgggtacgcagataaacctatagcggccgttgttttcccttcaaagtgatcaggagcacagagggaacggcctcccagaattaatctagacaccatcggaaatgcaagctaatgttttttgttactgtcgtaacatgagcaattggacgactggtatgtacatctgccaaaatggagtataatatttcaaaaaacacagaattggggttttaatgtataatgtcgaggaaataagtcaataatgtgtgatcttctcctaagcatgcaatgtgacaactaggacaagtaagctcctgtgtgccagttgacagcatcattatactacttgttacttggctgtcggtatgaatcatgaacggcaatggccctgtttttaaacagcagcttttcttgttaactgaagtaatacaacctgcaccttctacagacagacatatctcggaaagtggttgtacatgcctacatggt

SEQ ID NO: 2071 - DNA, 494 bp, Triticum aestivum
gtgaacgcagcccagtcagtgagccccccgatcccgactccggcgatctccccaaccccatggcctccgccggcgaggcccccagcacgctcctccgcttcctctacttcgtcggcgccggagtaatctgcaccaaggccatcaacacctatcgcgactacgagcacaagaaggagtccaccgccgccctcgccgccgccgaatcggcgttggctgctgccgcggcggccgagcccgctcctgcaaccgccgccgcgaaccctgattgtggacgagggctgtcttcggcggttagggtctcggaatgttgctctccataggggagatagatatttcttttgtttctgatgtttcaactacgtgtatgtgctcctttggcttgaatcaatcaattaataatactctcttcctgtctctgatcaaggtaacgctggcttgaaatttgttacaaatagttccctaagatgataaagttattgcactccgtaactaat

SEQ ID NO: 2072 - DNA, 1562 bp, Sorghum bicolor
taaaaccaactgattaaaacccagtctctccggtcgtcatctccgcgtccaccctccttcacctccacccccaaccccaagagccgaacaaacccatttgcaccgactccgagaggcgacaaggcagtccggaagcgcgtccggtgttgctgctggtgcctggtggtcgccaagcgatgtcgcacgccgacgtggaggcgggcgccccggcagcgagggcggcgccaccggcgacgacggggatcaagccgccgccggggcggtacaacacgaccagcaacgcgccgtacgtgcagccgtcgccgttctactacgaccacgcggcggcgcacgagcggcaccactggtcgtggctggtgccgctggtggtgatcgccaacgtcgccatgttcgtggtggtcatgttctacaacaactgcccgcgcggcggcggcgactgcgtcggccgcggcttcctccgccgcttctccttccagccgctcaaggagaacccgctcctcggcccgacggccgccacgctgcagaagtacggagccctcgactggtacaaggtggtgcacgggaaccaggcgtggcggctggagtcctgcacctggctgcacgccggcctcatccacctgctcgccaacatgatcagcctcatcttcatcggcgtccgcctggagcagcagtttggattctggagggtggggctggtgtacctcgtctccggcttcggcgggagcgtgctctccgtcctcttcatcaggaagggcgtctccgtgggagcctccggcgcgctcttcggcctcctgggagcgatgctgtcggagctcatcaccaactggtccatctacaccaacagatttgcagccatgttgaacctgatcatcatcgccgccatcaacctggcgctcgggatactcccgcacgtcgacaacttcgcgcacatcggcgggttcgcgacgggcttcctgctcggcttcgtgctgctgatccagccccagttcgggtggcttgagcagccctatggatccaagaccaagtccaagtacaaggcatatcagatcattctcctgattgctgccctggtcttgctggctgcagggcttgctgttggattggtcatggtgtttagaggagagaacggcaacgatcactgcggctggtgccactacctcacctgtgtgccgacgtcaagctggaagtgtgacaattgagctgatcggagagatcagtgacggggtagcatgcttgcgtcgtacagaagagagaacatgcgtccccaccacgggagacaatgtcaagatagatacgtgcccctcaccttcgatgacattgtcaatatatggcttttgatttttaaaatctgcattgtatagtagttcccatgtccccactggttgcaaatgaggagttgatgggtaaattttcttgtacgtatatgttaaaacctctgaaaaccactctgcctatgttctgttatatgggtttattctttgatttgttcctctatgtcctgtccaatctttaatttgcaacgttcagactaataatagatgacatctgcttggtgttgaacc

SEQ ID NO: 2073 - DNA, 1548 bp, Setaria italica
taaagccaaccggttaaaacctcctccgacgccgagtctccggtcgtcatctccgcgtccacccccttcttcttcttctccaccccgagagccgaacgaaccattcagctgacgccgaggaggagggagaccagcccagaaccagaagcgcgtccgttggtctagtggccagacgatgtcgaacgccgacgtggaggccggcggcccggcgcgggcggcgccggcgacgacggggatcaagccaccccccgggcggtacaacatgacggccggcaacggcaacggcagcgcgccgtacatgccgccgtcgccgttctactacgacaacgcggcggcgcacgagcggcaccactgggcgtggctggtgcccctggtggtgatcgccaacgtggccatgttcgtcgtggtcatgttctacaacaactgcccgcgcggcggcggcgactgcgttggccggggcttcctccgccgcttctccttccagccgctcaaggagaaccccctcctcggcccctccgccgccacgctgcagaagtacggcgccctcgactggtacaaggtggtgcgcgggaaccaggcgtggcggctggagtcctgcacctggctgcacgccggcctcatccacctgctcgccaacatgatcagcctcatcttcatcggcgtccgcctcgagcagcagttcggattctggaaggtcgggctggtgtacctcgtctcgggcttcggcgggagcgtgctctcggtgctcttcatcaggaagggcgtctccgtcggcgcctccggcgcgctcttcggcctccttggagcgatgctgtcggagctcatcaccaactggaccatctacaccaacagatttgcagccatgctgaacctggtcatcatcgccgccatcaacctggcgctgggcatactcccccacgtcgacaacttcgcgcacatcggcgggttcgccaccggcttcctcctcgggttcgtgctgctgatccagccccagttcgggtggctggagcagcccttcggctccaagtccaaatccaagtacaaggcgtatcagatcatcctcctgcttcttgcactggtcttgttggctgcagggtttgctgttggattggtgatggtgttcaggggagagaacggcaacgaccactgccgctggtgccacttcctcacctgcgtgccgacgtcaagctggaagtgtgacaattgagctgaacggagattagtgacgcgttagcgtgcttgcgtcttgcagaagtgagaacatgcgcccccaccattggaaacaatgtcaagatagatacatgtccctcaccttccatgacattgtcaatatattgctttcaagtttcgttttaaaacgctgccttgtatagaatttcaagtccctttcattctttgcacatgaggagttgatcggtaacgttttctcgtatatgttaagaaccctgtaaatcactctgcctatgctctgtttgatgcgtttattcattgattcttcgtgtgttctgttccatttgcatagtcgagactaataatagaccaaatctg

SEQ ID NO: 2074 - DNA, 2025 bp, Panicum virgatum
tttatttgtcaggttaaaaaaagtacagctctactgtaacatcagactgaaccgacgggtcaacttctaattgcgttattgtaagttcaaaaaaacttctaattgcgttatcaactcaactcctcgaacccacaagctcccccgaaaatgtcgccccaactcctagtctttccaacaaccatgatcggttacaagcaactaatataagcaatctcacaaaattaaacctcccaacaatattgaaggaaatattaaatattaaaagtaaatcgttgagacactttctcagttgcattgaactaaatcctgtacgttggttggaaattcagtggctgcaaaatctttattaggtgcctaaaaaatcacctcggtcgttgattggttggttgcccccttaatttgaacaacaggagattgtgtttttttttcaagagaaaagaccaaacaagaaacacgcaaaaggccaccggttaaaacctcctccaacgccgagtctccggtcgtcatctccgcgtccacccctgcgttcttcttctccacccggagagccgaacaagccattcagctgacgccgagaggggagaccagcccagaggcccaaagccagaagggcgtccgttggtctagtggtccggagatgtcgaaccccgacgtggaggcgggcggcccggcgcgggcggcgccggcgacgacggggatcaagccgccgccggggcggtacagcatggccggcaacggcaacggcagcgcgccgtacgtggcgccgtcgccgttctactacgacaacgcggcggcgcacgagcggcaccactggtcgtggctggtgccgctggtggtgatcgccaacgtggccatgttcgtcgtggtcatgttcgccaacaactgcccgcgcggcggcggggactgcgtcggccggggcttcctccgccgcttctccttccagccgctcaaggagaaccccctcctcggcccttccgccgccacgctgcagaagtacggcgccctcgactggtacaaggtcgtgcacgggaaccaggcgtggcggctggagtcgtgcacctggctgcacgccggcctcatccacctgctcgccaacatgatcagcctcatcttcatcggcgtccgcctcgagcagcagttcggattctggaaggtcgggctggtgtacctcgtctcgggcttcggcgggagcgtgctctcggtgctcttcatcaggaagggcgtctccgtcggtgcctccggcgcgctcttcggcctcctcggagcgatgctgtcggagctcatcaccaactggaccatttacaccaacagatttgcagcgttggtgaacctgatcatcatcgccgccatcaacctggcggtgggcatgctcccccacgtcgacaacttcgcccacatcggcggcttcgccaccggcttcctcctcgggttagtgctgctgatccagccgcagttcgggtggctggagcagcccttcggtgccaagtccaagtccaagtacaaggcgtatcagatcatcctcctgcttcttgcacttgtcttgctggctgcagggtttgctgttggattggtcatggtgttcaggggagagaacggcaacgatcactgcagctggtgccactacctcacctgcgtgccgacgtcaagctggaagtgtgacaattgacctgaacagagattagtgacgcgttagcactctcgcgtcttacagatgaagtgagaacatgcgtccccaccattggagacaatgtcaagatagacatgctcctcaccttgcatgacattgtcaatatattgctttcaagtttggtttttaaatgctgccttgtgtagaatttcaagcttgtccctttcccattctttgcacatgagatcatcagtaatatttcttgtatatcttaagaactctgtaaatcactctgcctgtgttctgattgatgcgtttattcattggttcatcatgtgttctctcccgttttgcaatgtcgagactaataataaatcacatttgatttgatagctgaa

SEQ ID NO: 2075 - DNA, 1731 bp, Panicum virgatum
agtaaaatgtcgagactctttctcagttgcattaagctaaatctttaggcgcctaaaaaaccacctcggtcgttggttcgttgcccccttaatttgaacagcaggagatcgtgttattttttcacaagagaaaaggccaaacaagaaacacgcaaaaggccaccggttaaaacctcctcccacgccgagtctccggtcgtcatcgccgcgcccaccccgtattcttcttcttcttctccacccggagagccgaacgaaccattcagctgacgccagacgccgagaggggagacccgcccagagccccagaaccagaagcgcgtccgctcgtctagtggtccggcgatgtcgaaccccgacgtggaggcgggcggcccggcgcgggcggcgccggcgacgacggggatcatgccgccgccggggcggtacagcgtggtcggcaacggcaacggcagcgcgccgccgtacgtggcgccgtcgccgttctactacgacaacgcggcggcacacgagcggcaccactggtcgtggctggtgccgctggtggtgatcgccaacgtggccatgttcgtcgtggtcatgttcgccaacaactgcccgcgcggcggcggggactgcgtcggccggggcttcctccgccgcttctccttccagccgctcaaggagaaccccctcctcggcccctccgccgccacgctgcagaagtacggcgccctcgactggtacaaggtcgtgcacgggagccaggcttggcggctggagtcgtgcacctggctgcacgccggcctcatccacctgctcgccaacatgatcagcctcatcctcatcggcgtccgcctcgagcagcagttcggattctggaaggtcgggctggtgtacctcgtctcgggcttcggcgggagcgtgctctcggtgctcttcatcaggaagggcgtctccgtcggcgcctccggcgcgctcttcggcctcctcggagcgatgctgtcggagctcatcaccaactggaccatctacaccaacagatttgcagccttggtgaacctgctcatcatcgccgccatcaacctggcggtgggcatactccccctcgtcgacaacttcgcgcacatcggcgggttcgccaccggcttcctcctcgggttcgtgctgctgatccagccccagttcgggtggctggagcagcccttcggtgccaagtcaaagtccaagtacaaggcgtatcagatcatcctcctgcttcttgcactcgtcttgctggctgcagggtttgctgttggattggtcatggtgttcaggggagagaacggcaacgatcactgcagctggtgtcactacctcacctgcgtgccgacgtcaagctggaagtgtgacaattgacctgaacagagattagcgacgcgttagcactctcgcatctttacaggagaagtgagagcatgcgtccccaccattggagacaatgtcaagatagatacatgccccctcaccttgcacgacattgtcaatatattgctttcaagtttggtttttaaattctgccttgtatagaatttcaaacttgtccctttcgcattctttgcacatgaggagttcatcagtaatatttcttgtatatcttaagaactctgtaaatcacactgcctgtcttctgattgatgcgtttattcattggttcatcgtgtgttctctcccgttttgcaatgtcgagactaataatatatcacatttgat

SEQ ID NO: 2076 - DNA, 1508 bp, Panicum virgatum
cttcttcttctccacccggagagccgaacgaaccattcagctgacgccagacgccgagaggggagacccgcccagagccccagaaccagaagcgcgtccgctcgtatagtggtccggcgatgtcgaaccccgacgtggaggcgggcggcccggcgcgggcggcgccggcgacgacggggatcatgccgccgccggggcggtacagcgtggtcggcaacggcaacggcagcgcgccgccgtacgtggcgccgtcgccgttctactacgacaacgcggcggcacacgagcggcaccactggtcgtggctggtgccgctggtggtgatcgccaacgtggccatgttcgtcgtggtcatgttcgccaacaactgcccgcgcggcggcggggactgcgtcggccggggcttcctccgccgcttctccttccagccgctcaaggagaaccccctcctcggcccctccgccgccacgctgcagaagtacggcgccctcgactggtacaaggtcgtgcacgggagccaggcttggcggctggagtcgtgcacctggctgcacgccggcctcatccacctgctcgccaacatgatcagcctcatcctcatcggcgtccgcctcgagcagcagttcggattctggaaggtcgggctggtgtacctcgtctcgggcttcggcgggagcgtgctctcggtgctcttcatcaggaagggcgtctccgtcggcgcctccggcgcgctcttcggcctcctcggagcgatgctgtcggagctcatcaccaactggaccatctacaccaacagatttgcagccttggtgaacctgctcatcatcgccgccatcaacctggcggtgggcatactccccctcgtcgacaacttcgcgcacatcggcgggttcgccaccggcttcctcctcgggttcgtgctgctgatccagccccagttcgggtggctggagcagcccttcggtgccaagtcaaagtccaagtacaaggcgtatcagatcatcctcctgcttcttgcactcgtcttgctggctgcagggtttgctgttggattggtcatggtgttcaggggagagaacggcaacgatcactgcagctggtgtcactacctcacctgcgtgccgacgtcaagctggaagtgtgacaattgacctgaacagagattagcgacgcgttagcactctcgcatctttacaggagaagtgagagcatgcgtccccaccattggagacaatgtcaagatagatacatgccccctcaccttgcacgacattgtcaatatattgctttcaagtttggtttttaaattctgccttgtatagaatttcaaacttgtccctttcgcattctttgcacatgaggagttcatcagtaatatttcttgtatatcttaagaactctgtaaatcacactgcctgtcttctgattgatgcgtttattcattggttcatcatgtgttctctcccgttttgcaatgtccagactaataataaatcacatttgatttg

SEQ ID NO: 2077 - DNA, 1457 bp, Pennisetum glaucum
ccccccaattcttcttcttcaccttctcccgtccgccccgagagccgaaccgaacgaaccagaattccgctgacgccgcgaggagggaggacaagctcagaacaagaagcgcgtccgttagtctggtggtcaggcgatgtccaacaccgacgtggaggccggcgacgacggggatcaagccgccccccgggcggtacaacatgaccgccggtaacggccatgtcaacggcaacggcagcgcgccgtacatgccaccgtcgccgttctactacgacaacgcggcggcgcacgagcggcaccactgggcgtggctggtgccgctggtggtgatcgccaacgtggccatgttcgtcgtggtcatgttctacaacaactgcccgcgcggcagcggcgactgcgtcggccgtggcttcctccgccgcttctccttccagccgctcaaggagaaccccctcctcggcccctccgccaccacgctgcagaggtacggcgccctcgactggaacaaggtggtgcacgggaaccaggcgtggcggctggagtcctgcacctggctgcacgccggcctcatccacctgctcgccaacatgatcagcctcatcttcattggcgtccgcctcgagcagcagttcggattctggaaggtcgggctggtgtacctcgtctcgggcttcggcgggagcgttctctcggtgctattcatcaggaagggcgtctccgtcggcgcctccggcgcgctcttcggcctcctcggcgcgatgctgtctgagctcatcaccaactggaccatctacaccaacagatgtgcagccatgttcaacctgatcatcatcgccgccatcaacctggcgctgggcatactcccccacgtcgacaacttcgcgcacatcggcgggttcgccaccggcttcctcctcggcttcgtgctgctgatccagccccagttcgggtggctggagcagcccttcggctccaagtccaagtccaagtacaaggtgtatcagatcatcctcctgctccttgcactggtcctgttggctgcagggtttgctgttggattggtcatggtgttcaggggagagaacggcaacgatcactgcagctggtgccactacctcacctgcgtgccgacgtcaagctggaagtgtgacaattgagctgaacggaagattagtggcgcgttagcgtgctcgcgtcttacagacgaagtgagaacatgcgcccccaccattggagacaacgtcaagatagatacatgcccctcaccttccatgacattgtcaatatattgttttcaagtttggttttcaaacgctgccttgtatagattttcaagtccctttcattctttgcacatgatgaggagttgatcggtaacgtttcttgcatacgttgagtactctgtaaatcactctgcctatgtttgttttatgcgtttattcattggttcttcctgt

SEQ ID NO: 2078 - DNA, 1523 bp, Brachypodium distachyon
tagtctctattcatcccgagacatcgtccacgcgtccgtccttccgttcgtccgtccatttcctcctctccccaggaactagcccaacaaaacaaaacagaacgaacgaaacgaaacgattactccatcatccatttgcaccgaacacgaacatacagccaagaagctccagcatccagcactccagcgacgactcagcgagagccatgtcgaacggcgacatggaggccggggccccggcgagggcggcgacgacgacggggatcaagccgccgcccgggaggtacaacgcggacgggcacgggccgcagtacgccgcggcgggggcgccggtgtcgccgttctactacgcggcggcggcggcgcaggagaagcagcaccggacgtggcttgtcccgctggtggtgctcgccaacgtggccatgttcatcgtggtgatgtactacaacgactgcccgcgcagcggcaacggcgactgcgtgggccgcggcgtcctccgccgcttctccttccagccgctcaaggagaaccccctcttcggcccctccgccaccacgctggggaaatacggtgggcttgacaggtacaaggtggtgcgcgggaacgaggcgtggcggctggagacgagcacgtggctgcacgccggcctcatccacctcggcgccaacatgatcagcctcatcttcgtcggcgtccgcctcgagcagcagttcggattctggaaggtcggcctggtgtacctcgtgtcggggctcggcgggagcatcctatccgtgctcttcatcaggaacggcgtctccgtcggcgcctcaggcgcgctcttcggcctcctcggcgccatgctctcggagctcatcaccaactggtccatctacaccaacaggatagcggccatggcgaacctgatcatcatcgccgccatcaacctggcgctggggatactgccccacgtcgacaacttcgcgcacatcggaggcttcgccacgggtttcctcctcggattcgtgctgctgatccagccccggttcgggtggctggagcagcccttcggtgccaagtccaaatccaagtacacggcttgccagatcatcctcctggttgtcgccctcatcttatcgattgcagggtttgctgttggattgctcatggtgttccgcggagtgaacggcaacgatcattgcagctggtgccactaccttacctgcgtgccgacgtcgagctggaagtgtgacaactagaaagacgagatcaagcatgccagcctgtggagagaacgtgctggccatcgagataattgcttcagtttggtttcttcttcttcttctttttttctttttttttgcataatatgcttctgttgtatagaactttgtcgaagatgcgctgattagtgcttctgcttgtatatgttaaaactctgtaaaacactctgctgtggacaaatgtgtttattggttgactttactctgttccagttccattttcagtgtcaatatagaaaaaaaaaacagatcatacttcca

SEQ ID NO: 2079 - DNA, 1140 bp, Panicum virgatum
gtctaaatttttattagtgtctaattcacctcctcccctcaaaagctaagcaccctattcctttcaggcggcggcggccgttcgttcttcacggcttggtttctctgcttatgagaggtatgagatgtagaaggcggccaaggctcggcatggggtggctccgggccgtgctctccccgctgcggaggctctggtgccgcgccaacgcggtgcagcgcaagaagagaggcatctacatcctgtacgacgacgtcaagtcgtgccaatgcgaggacgtgcacgtgctctggtcgatcctcgtggagtcccacggcctgccgccggcgaccccgatgctgagcctgaagcggtgacgagggggcggcgggtgctccggctccggctccggctccggcacggcaccctgaataagagaaggtcgatcgacatggccatagcccatgggaggtgaagtatggtagtgcttctgaattctgatgtgcataggatcagtcgctcatagcagtgtgtgttccaccggcgtggtgttctactgccgtcccggatcggcgcctctgttggaggccgctgatgagacgaagggcggtggagcgtagccgctgcgccgggtggctttgatgagtgtggtgtggtgatgagcttcctggagcgcgcccctcgttcgtttgactcattttctaagagacttgcatttggatgcagtcattccgattgtctatcttacgaagaattgtctgaacctgctgtcagcatttttctatttttcgcttatgtatgcggttagcggtcgctggaaggcacaaattctgcttctgcgccggcaaattcatcgtacggaacagttttggaggaagatacgtcacacactcttcataggttgattcatttgtagtctttttttttgacacattcaggcggtagagctttattgatcaagaacagttacatcatcatttgatgaaagattaacaataaagctaggggatcatcgtcccaaatacaataaataaatcttttaaatcatacagttacatcatttgattcatttgtagtttgtagctgctcgtgccgctgactctttttcaatcgaacatgcaactaggactagcctaggagaggctcaggttcttcttcattctc

SEQ ID NO: 2080 - DNA, 2222 bp, Sorghum bicolor
gggcgcgcgcggcttcggccgttcggccggcgccgtagcatgattgtgcggcaagggagtccgttgtggttgtggcagagggagagggagagggagagggagcactctctccgacggaacccaacgcaaggaagagagaacagtgtgggaggctttacccaagtgtaaagcaagccaaaggcaagctctgcgggttacttcaccggcgctcatatacacaggcaccactgcactcactgaccatgaccagtgaccgcaccacaccacctgccctgcccctgcccttcttcctctgcagcagcagctcttgttcttcacgtgctcgtcttcacgacgaaccaacccaccacacggtttggctctggctctgctatagatatgagatgcaggaggcgggcaaggctcggcatggggtggctccgggccgtgctctccccgctcaggaagctctggtgccgcgtcaacgcggtgcagcagcagcgcaagaagagagggatctacatcctgtacgacgacgtcaagtcgtgccaatgcgaggacgtgcacgtgctgtggtccatcctcgtggagtcccacggcctgccgccgccgaccccgatgccgtcgccgccggtgctttagcggccggcctgaagcgatgtcgatgaggtcactgcacccctgaataagcgagaggtcgatggattcatacgcctcgacatggctggctgtgggaggtgaattcaagtagtagtgattctgaattctgatgtgtgtacatagggataaaccgatgtgtgtgtgtgtgtgtgtgtgtcgccggtgtgctgcgcgctgccgcgctctgctgtcggcctggattggcgcctctgttggaggctgccgagacgaggagtggcctgcggctgcgggggggaatgtaggctgctgcgcgtgtccccttgatgagtgtggtgatgagcttcttggagttggagcgcacccctcgttcgtttgacttctaatagtttacgtacgtataggactgcatctggatcggatgcggtccttcagcccacctctattggaatttgaaagggagtagcaagaaaagaaaaaaaaaagaatcctcaacggttttctgaatctggtacctcccgtttttagtcttcgcctatgtattcactttgcactagctgaatagcacaatgcttctgcctgcaacctcatcgtacgagttcaggttcaggaagaagatgcttgttcagacaaccatcataattctctcttttgaaaggaagttgctctaggttgtcttgaacttgctctgtgctaagctagagaaaaagtttgatctgggctgacctcgggggggaaatgggctctggactcctcgtatttggtcgcgtccaggcccagttatgcaaactaggacgggagccagtctgcgagccagaaagaagcccagtagaggtagttcaatggcaaaggatgattgtagagcctttgagccatctctctcctcatatatataggccggcattgcagagttgcgctcatgtgccccactccgccaaccctcacaacagtcactcatgaatcatgatgaacccgggaacagccagccatagcaaggcaaagcgcccacccggcaccacgccgaaccaaggccacctacgtgaccactgttaacctgatggcctctccctccggcccaggcgcccagctctatataacgcttgcctctccccctgtttgtgcatccgccgaaacaagagcgacgggacaagaattctgcttctaatctcgcagacgtcgccactgctaccgaaccatccattcctcttcctcgcatcatctcgatcgacagaagcagctaccgtctaccgaaaagatggcagggcaattgaaggccaaggtcctcgtcgtggccgcggccgccgtggtcatcgcctcctccctcgtcggcgcggcctccgctgccgccgacgcgcccgccccggctcccacctccggcgccacagtcgccgcgccggccttcgctgccgtcactgtcgccgcttttggctacctcttctgctaaaaaaaacacatagcatgccctggttcgttctgagattgtttgccgattctttcattctcgatgtatattcatgtatttcatttcatcccccaattcgaggagtatacgtgacaatgtaaattggttcgtaatatactttccaatagctacacttttgcggtttgcatacgcaagatgtcta

SEQ ID NO: 2081 - DNA, 4750 bp, Panicum virgatum
tcgaaggatcctgaaaggcccagtcgatcggtaatcatgcttaatcaagaaacgcaacctgttcggctaatctattttttacaattgacacacgagcatggccacaacgagaggaaatcaaaatgaagatccccatgtgagtaacgagctcacctgacggaggcgtcgagtgtcgactcaccaccagccatgaaaacttttttgtttcttcgagtcggttgttgcttgctcgctttgctcacctgtccggtaaatcgatgccgtgcattgtaagagttgcccgatgcatgcgttcccacccacgcctacgcctctgcggtgcgccagtccaagtccaagcaagcatcatggacgcgaagaaaaaggaagaggaggagcttccggcgcaagcgttcggcatcctcgccccgacctgtttcttctttaaccccgggatttgcatcttgcttaatccgccggtgaacaaggcccagaaccagaagaaactaacaccagactttggcctgattggtttctcgatcaggcagcaatcaaacaaacaagaggtcaggtaaatgccgtcccgtgcaagatgcggctagcatgcagacaatgcagtgctagctagtttaatactttaatccgcacggcgatccggaaagcgaagggcggccgtacgcgagcgatggatccgcgacggcgacggggcagcgtgaagatccgccgctcgcggcgctcggcgtaggatgattgcgcggcaagggagtctggtgtggcagggcgcaccgagacggagccgaatggggaggagaacagtgtgggaggctttaccccgagtgtaaagcaaggccgccgaaggcgagctccgcgggttacttcaccggctgccgggcgccctgcccatatacactagctcgctgcccagtgaccgcaccacgccacctgcccctcgctattcattctcagccgcagcggccgggcggcggccgtccgttcgtcacggcttggctctcggcttctagcttaggcatgagatgtaggaggcggccaagggtcggcatggggtggctccgggccgtgctgtccccgctgaggaggctctggtgccgcgccaaagctgtgcagcgcaagaagagaggcatctacatcctgtacgacgacgtcaggtcgtgccaatgcgaggacgtgcacgtgctctggtcgatcctcgtggagtcccacggcctgccgccgccgccgccgccgatgctgagcctgaagcggtgacgaggggggcggtgggtgctccggcacggcaacccctgaataagagaaggtcgatcgacatggccatgggaggtgaagtgtggtagtgcttctgaattctgatgtacgtaggatcagtggctcatagcagtgtgtttccgccggcgcggtgttctactgccggcccggatcggcgcctctgttggaggccgctgatgagaccaagggtcgagcgtagccgctgctccgggtggctttgatgagtgtggtgatgggcttcctggagcgcacccctcgttcatttgactcgttttctgcgagacctgcatttggatgcagtaagttcgttcatctatcttggaatgaacatagcaggaacaaaactgaaccatcaacaattgtctgaatctgctgtcagtatttttgtattttcgcttatgtgtacggttaacactcgctggtcagcaccaattctgcgccggcaaattcgtcgtatggaaaggaagatgcgtcacgcactcataggttgcttcatttgtagttgtggctgctcgtgtctgtgactctgaagtctgaactctgttctgtcgaacatgccactgtgaggccattccttctcccagatcaccagagggcttctgttgggccgggccgatcgtcccctggagagctttgtgctgggctcattattataagcttcctcagggcccaattttcaaacgaggctgaccgcggcggacgaagccagcaggaagcccagctcccagtttccagtgaccccaaaatggagtttttgagcagttgcaggtggcagcagcacccttcgagttctagcgatttcttctgagaggccaagtggagaggattgagtgacagcagatggcaggaaaatccgctgcccgtccttcaacaccagcatgacagttacgaacgtgctgtctgccaatggcccaatgcacccaccatccttccggcattcgcagatagcacgaggccggcaccgcgcagttgcgcttgcgcccatgtgccccgcggcgccaacgtacgcaacggcaggccccggcagaccggcaccgccgcgccagcgccgaaaaccaccgtcgcctcctcatgatgaagcctcccaaccaatcagtcacccacggacccacccgaccacaccgaaccgacgccaggtacgcgacagccggtccgtcctcccgttcgccagcccagcttccattaggcgactcttgcggcgcaggcagctatatatatgctcgcctcttcccccgctgcccatccatcgaaacagcgacgatcccgagctgatagcttcttgccgcgctgctttctcagctcctcggtccgtccaaagaagatggcagcagggcagttgaaggccaagatcctcgcggcggccgcggccgccgttgtcgtcgcctcgtctctggtcggcacggcctccgcggccgacgcgcccgccctggcgcccacgtccggcgccacggccgccgcgccggccttcgcggcggtgtccgtcgccgtgtctgctttcggctacctcttctgctaggcggcccgggcagcagggtgcaggcgtgtgcgtgcggggccgcccgccgcgcaccgcccctgatgatgcgcgcgcccacatgtttgtactacgacttcaatattggttgttttacatgggtgtaaagtgtaattcgttatttatttattggttcgaattttgtgcgtgatcacatattcgtttcatcatttgcatacggtgggaagtgaggacgaatttccttacggccgattttatgttccatcacaagacagacaaagcaaagcagctattcttcaaaatcatattccctagactggcaacaatggctatactcttactcttatacgccatggaaagggagggctaggagcgcccggacgttgtgggcgtgacacgtgtcctggagagagagaggaagtccggcgaggagcatggatttggctcatacgcagcaatcagcccattcgtgtcctgagagaggaagctcaacgcgggatatggatttggcccatacgcaacaatcaaccaatttccacgccctccagtgtacttctgtttctgctctatacgcatactaaccatcaacacatcaaccattttactttatatttttaagtaggcgcagcgtagcgcgcaatttaactagttacatatgttccatcacaagcagacagacatgcaaagcaacaggtacatggaagccagaaattgagcagaggctggtgttacatgaacactgtgaccttgtaattaccttgtggttggttcaggtatctggtgatatcactgggaagccagggcacgaaaggcaacaagctattatattcctcactatcaatagcatctctttggcggacaatcagttcatcgatatacaggacacatgagagaaccaacagctgcttcaggtcaacataaattatccacgtcctcccacaaagcccatcttccctcagcacgccgcacaggacatccggatcattctcggtcaggacgggggaactcaggcatgaggggcgccgccggcaggcccagaaccttgtagtcgttttgcgcccagaggtcatcgaggctgatcttacgatggatctcccagctccagatatcggccatcatcatcagattccaaacagtgatcgcccggtcacttgtttggaggtcctgccagtagtcgttgtcgatgtgaacgaaacgtgtatcacgccttggctgacaaacacgttccggaatgactccgggcgccacctctcgatcagcctcttgctggaaaattgctggttgccagggacaggcgtgtagtggagcacaggtgagtcctcatcggagacgtcgcagaacactatgccgctgtagaagtcgacccagcacaggaattgaccggcgaaggggaccaccatgtcgcagtcccagaggcaagggaaccggccctggccatgcggctgcggagcgagcatctctctggtcgttccaatcccccttcttggaggagaacgtgcagagcgcggcatacatcttttttgagcagttaagggcaggtgctctgcctattcatttagtagagttagaggaaaaaatatttacatgagaaactacaaaacgactaaaagaaaccaaaaggcctatacaacaatacacaaaaagtaggaacgacaggagggcctatacaacagaggtggtgaagtctcgctcgtcgggggaataaaccgcttttttcccaggacacgacgaggtctgccaccacgtagctgtttgggtcgccgccgcggcacaggatccccacgtcggtgtgcgactgcgacggcggtggcgtcgtgtgccacggccgcggccgcggcgtcggggtcatcgtagaagtggggacggcccaaccggaacaggagcatccagtcggcaaacacctatggcttcgtcggcgagccgggatcgcgtcggccatctcgctctttttgatctgggatcggtccactagcacccagtcggagaactccg

SEQ ID NO: 2082 - DNA, 650 bp, Eragrostis curvula
gagcactgacgaccacgccacctgcatctttccctcccccgcgagtgcatttcgccccgcacgcgcggcacgagggttcagtctcggtctcgggctatagatatgagaagaagaggtaggaggcggatgaggctcagaagggggtggctccggtcgctgctctcgccgctgcggaagctctggtgccgcgtcaacgcggtgcagcgcaagaagcgacgagggatctacatcctgtacgacgacgtgaagtcgtgccagtgcgaggacgtgcacgtgctgtggtcgatcctcgtcgagtcttacggcctgccgccgccgacgccgccggtgctccggctaaagcgatgatgaatgacaccagcagagggacgcgcgccgtcgccggcacccccttgaataagcaagtgctatgggaggtgaagtagtagcagtgcctctgaattctggtgtacataggatcagtctgtgtgtgtgagtgtgtcgcccgcgtgctgctctgctccagacgcggcctggattggcgcctcttttggaggatgctgggtggcatgagcggcctgcggtagaatgtagctgctgcaccggtagcttgagtgtggtgatgggcttcttcgaaggcacccctcagttgtttgacttctcgtgttgca

SEQ ID NO: 2083 - DNA, 840 bp, Setaria italica
ccggtcgcgcccatatacacagcgccactgcactggccagtgaccgcaccacgccacctgcccctcgctattcattctcaggtcttagcggcagcggagacggttcgttcttcacgtgctcgcctgcgacacacggcttggcgctctgcttataggtatgagatgtaggaggcggccgaggctcggcatggggtggctccggtccgtgctctccccgctcaggaggctctggtgccgcgtcaacgcggtgcagcgcaagaagagagggatctacatcctgtacgacgacgtcaagtcgtgccaatgcgaggacgtgcacgtgctctggtccatcctcgtggagtcccacggcctgccgccgccgaccccgatgccgacgccgccggccctgagcctgaagcggtgacgaggggcggcgggtacggtgctccggctccggaacggcaccccctgaataagcgaaggtcgatgatggatacttcgacatggccatgggaggtgaagtagtagtgcttcttaattctgatgtgcataggatcagtcgatggtagcagtgtgttgccgccggcgtggtgttctactgccggcatgaatcggcgcctctgttggaggccgcgtagacgaagggtggcctgcggtggaacgtagcagctgctgcgccggtggcttgatgagtgtggtgatgggcttcttggagcgcacccctcgttcgtttgacttctcgttttctgcgagacttgcatttggatgcagtctcctttcgttcatctctgatggaatgaatagcaggaagaaatttgaatcatcaactatcatctgaatttggtgtcagtatttttc

SEQ ID NO: 2084 - DNA, 1518 bp, Setaria italica
cttgtggactggacgcaggcgcagctagccgatggcaggcacgacgggcggcgccgctgccaccgcgccgggcaagaagggcgaaacgccggccgccacgcgttctggcgcgctcaagaggctgccgctagctctgctcgtgttcttcgcggcgctgctgtacagccagatccagccgccgccgtcgaaggtccccggcgcgccgggcgggcctccggtgaccgcgcccagaacgaggctcagggacggcaggcacctggcgtacctggaatccggcgtccccaaggaggaggccaggtacaagatcatctttgtccacggcttcgattgctgcagatacgacgtgctgaacgtctcccaggggctgttgcaggagctgggcatctacctgctgtcgttcgaccggcccgggtacgccgagagcgacgcccacccggcccggacggagaagagcatcgccctcgacattgcggagctcgccgacaacctccagctcggccccaagttccatctcatcggcttctccatgggcggcgagatcatgtggagctgcctcaaatacatccctcacaggctcgccggcgtagcgatcctcgccccggtcggcaactactggtggtccggcttcccggcggacgtggtcgaggaggcctggtacgtgcagttcccgcaggaccagcgcgcagtctgggtcgcccaccacctgccgtggctgacgcactggtggaacacccagaacctattccacagctccagcgtcaagggcaagaaccctatcatcttgtccaaggaagacacggctctgtctcaaaagttcttggaccgaacctacaaggagcaggtccggcagctgggggagcacgactccctgcaccgcgacatgatggtcgggttcgggaagtggggctggagccccctggagatggagaacccgttcgccggcgccggggacgaggtgaaggtgcacctgtggcacggcgtcgaggacctcttcgtgccggttcaactgtcgcggtacatcagcaaaaagctcccctgggtcatctaccatgagctcccgacggccggccacctgttcccggccgccgacgggatgccggacgttatcgtcaggtcgctgctgctcggagatgagtgatcggtacttttcttttcttttctttttttatgagcggtcaatattagtgatgcagctgcaggacgacgtgtactcgccttctgcaccgttgtacagctcgatcgctcgtacaaaaattatggcatgagttgatgacttcagtaataaggcttgtttagttgctaaaattgggagtgctaaaattactgtgccggcactgtagcacactgtagcgtttcgtttgtatttgtgaattattatccaaacattgactaattaggctcaaaagatttgtctcgcaaagtacaacaaaactgtgcaattagtttttaatttcatctacataaatgtactccatgcatgtaccgtaagtttgatatgatgggaaatcttctttttgc

SEQ ID NO: 2085 - DNA, 1376 bp, Panicum virgatum
cacacacgtcgtccctgtccggcgcgcgtcgctcgccggtccccgcgcgtgcgtccaggcttcagagagttgaagaccccttcggcgcgcggcggggcctgtggacgcagctggccgatggcaacctccggccggcgtgagggctccaccgcgccaggcaagagcggcgcactgccggccgccgccgcgcgctctggcgcactcaggaggctggcgctcgctctgctcgtcatgctcttctcggcgctgctgtacggccagattcagccgccgccgtccaagatccccggcgcgccgggtgggcctccggtcacggcgcccagaacgaggctcatggacggcaggcacctggcgtacctggaatccggcgtccccaaggaggaggccaagtacaagatcatctttgtccatggcttccattgctgcatatacgacgtgctgaatgtctcccaggggctgttgcaggagctgggaatctacctgctgtccttcgaccggcccgggtacgccgagagcgacgcccacccagcccggacggagaagagcatcgctctcgacatcgcggagctggccgacaacctccagctcgggcccaagttccatctcatcggcttctccatgggcggcgagatcatgtggagctgcctcaagcacatcccgcacaggctcgccggcgtggccatcctcgccccggtcggcaacttctggtggtccggcttcccgccgggaggtggtcgaggaggctggaacgtgcagttcccgcaggaccggcgcgcggtctgggtcgcccaccacctgccgtggctgacgcactggtggaacacgcagaccctgttccccggctccagcgtcaagagcaagaaccccgtcatcctgtccaaggaggacctgcccctgtcccagaagttcatcgaccgaccctacaaggatcaggtccggcagctgggggagcacgactcgctgcaccgtgacatgatggtcgggttcgggaggtggagctggagccccctggagatggagaacccgttcgccggctccggggaagacggcgaggtgaaggtgcacctgtggcacggcgtcgaggacctctacgtgccagtccagctgtcgcggtacatcagcaagaggctcccgtgggtcatctaccatgagctccccacggccggccacctgttcccggtcgccgacgggatgccggacgctatcgtcaggtcgctgctgctcggagatgagtgatcggtattcagtattagagctgcagttgcagggaacttgtacaagccctttgcaccaattcgcagctcgatcgctcgtataaaaaaattatggcatgggttgatagcttcgtcggtaataaaaatacaaattgctggatt

SEQ ID NO: 2086 - DNA, 1457 bp, Pennisetum glaucum
ccgtgtccctagagtcgctcgctcgccgctccgcgcgcgcccaggttccagggagagtataaggcgagagtcccttccgcgccgcagcggctgcgccgggggaccttgcggacgggacggaccccgatggcaggcacaacgagcgacgcagcctccgctgccacggcaccaggcaagaagagcggcgcaccgccggccgccgcgcactccggcgcgctcaagagactgctgctagctctgctcgtgttctccgcggcgctgctgtacaaccagatccagccgccgccgtcgaaggtccccggcgcgccgggcgggcctccggtgaccgcgcccagaacgaggctcagggacggcaggcacctggcgtacctggaatccggcgtccccaaggaggatgccaggtacaagatcatctttgtccacggcttcgattgctgcagatacgacgtgctgaacgtctcccaggggctgttgcaggagctgggaatctacctgctgtcattcgaccgccccgggtacgccgagagcgacgcccacccggcccggacggagaagagcatcgtcctcgacatcgaggaactggccgacaacctccagctgggccccaagttccatctcatcggctactccatgggcggcgagatcatgtggagctgcctcaagtacatcccccacaggctcgccggcgtggcgatcctcggtccggtcggcaactactggtggtccggcttcccggcggacgtggtcgaggaggcctggtacgtgcagttcccgcaggaccagcgcgcggtctgggtcgcgcaccacctgccgtggctgacgcactggtggaacacccagaacctgttccgcagctccagcgtcaagggcaagaaccctatcatcttgtccaaggaagacatgcctctgtctaaaaagttcttggaccggacctacaaggcgcaggtccggcagctgggggagcacgactccctgcaccgcgacatgatggtcgggttcgggaagtggggatggagccccctggagatggagaacccgttcaccggcgccggggaagaagaggtgaaggtgcacctgtggcacggcgtcgaggacctcttcgtgccggttcagctgtcgcggtacatcagcaagaagctcccctgggtcatataccatgagctcccgacggccggccacctgttcccggccgccaacgggatgccggacgttatcgtcaggtcgctgctgctcggagatgagtgatcggtactttctcttccatctttttatgtgtggtcaatactagtgatgcagctgcagaggacgacgtgttctcctcgccttgtgcttcgttgtacagctccactcgtacaaaaaacacggcgtgagttgatgggctccttcagtatcagtaataataaagcatgttgcagagattagcataagctgtgtctagtagctttcataatgtaatt

SEQ ID NO: 2087 - DNA, 2129 bp, Panicum virgatum
aaattttgaaattttgaatgcatgtaaaccagacaagtctcgttgtagctgccgcaagctgagctgcgtgtctcgtcgacgagcgggccccggccggcctccacgcgcgccgtgtccaagatccctccgcccggccatgaaccttccagaatcgccaaccaaacacccgtgtcaaagaaaagaaaacaaaaatcagcggaaccttctcgcagcttcctcgccccaccaccacgcatcacccctgcgccgccatctccaccgctgggcgcccatccggcgggccagaggccgcgcccgcgcgctcgactccccccgttcccctctccgtccaccgcgcgacgcgcggggacctggccgtggcctccgctccttcttcccgtcgccctcgccttattaccgcctcccgcggcgaccgcgtgcctcttctcccgtctcctccgcgcgccctcgcctctctctctcgctcgctctctggccacaaccgcccgctggtttccttctccacgctacgcaacgcggaaacttccagaagccaacacctttcttcttcttccttccgcccttcgtttctctccttcctcgcaggccggataggggcacgacggtgtcgccggcccggatctgcgcaggcggcgccatggccgccgagcaggccgccgccgccacgggaggcgagccgcctccggccacgccgcagccggcggagggcgtgacggcggcggcggggcagaggtcggtgcccaccccgttcctcaccaagacgtaccagctggtggacgacccggcggtggacgacgtcatctcgtggaacaacgacggctccgccttcgtcgtgtggcgccccgccgagttcgcgctcgacctcctgcccaagtacttcaagcacaacaacttctccagcttcgtgcggcagctcaacacctacgggttcaggaagatcgtgccggaccggtgggagttcgccaacgactgcttccggcgaggggagaagcggctgctctgcgacatacaccgccggaaggtgacgccggccatggccacgggggcggcggtcacggtggccgccgccgccgcggccatcccgatggcgctgcccgttggctcgccggtctactcgggcgaggagcaggtgctgtcgtcgagctcgtccccggagcccccgccgctgcagccgcaggcggcatccggctcgggctccggcggcgcggcgtccggcggcgacgcgggcgaggagaacgaccggctgcgccgcgagaacgcgcgcctcgcgcgggagctcggccagatgaagaagctctgcaacaacatcctcctcctcatgtccaagtacgccgccacccagcagctggacgccgccaaggccgcggcggcggggaactgctccggcgagtcgtcggaggccgccgccacgctgccgtcggtgctggagctcctgccctcgtgccgcggcggccccgcgcccgcggccgccctggagccgcccgaggcggcggcggggacggagcgcgagcaggacgacgacgacaaggccggcgcgaggctgttcggcgtctccatcggtcggaagcgcgcgcgcgacgacaccagcaacggccacgccggcggcgcggcggcggaggtgaaggcggagccggtggacgcgcaccccgaccaccacctccaccagctgccgcagctcagggatgatgatcatcatcacggcggaacggagccgcaggcgtggcccatctaccggcccaggcccgtgtaccacccgctccgggcctgcaacgggtcggcgggcagcgccgggaccgggagcgaccacgacgtgtccaactcctccaggtgacacgtcgccgccgacgttagccgtaaattactactactgatgctagtttattgtgattggtggacgctttacaacaggaaagagagatctgatcagcttgggattttactgaccccatgcaaatctttgggattttactgtagtagtatctatgtatagcaaggccacatagaacctagagattaacttatggatcagctacattttctgctcctactagctcttaaccgttcgggcccagccaacacagcacagcacggaataatccttgtcggctagtccgaattgctcatttccg

SEQ ID NO: 2088 - DNA, 3092 bp, Sorghum bicolor
ccccatccccacacgccccggccccgcgcgccgccaccccatctccatctccacctcaggcctcccatccggcgggccagacaccctccacgccatccgggaccggccggacgcccgcccgtaccctcccctccgccccggccgcgccgcgcgacgcgcgcgacttggtttccgctcgcctctttccgcggcacgagttgctggcgggtcgcccgtcctcctcgccatattaccgcctccccgccccgtgaccgcgtccctcttctcccgtctcctcctactcctccgcgccctcgcctcatccgcgctcctaaccgccgctggtttctctccacgctacgccaccggaaacttccagaacccaccacctttcttccttccttcctcttcctctctctatctcttcccgtgccgccgacggtgccccccagccagatccgcgcggccggcgccgccatggccgccgagcatgccgcggccgcggtgggcgagccgccgccgcccgccgccaccacgacgcagcctccggcggagggcgtgacggcggcgccagcggcggcggcggggcagaggtccgtgcccacgccgttcctcaccaagacgtaccagctggtggacgacccggccgtggacgacgtcatctcgtggaacgacgacgggtccgccttcatcgtgtggcgcccgggcgagttcgcgcgcgacctcctgcccagtacttcaagcacaacaacttctccagcttcgtgcgccagctcaacacctacgaagatcgtgccggacaggtgggagttcgccaacgactgcttccgccgaggcgagaagcggctgctctgcgacatacaccgccggaaggtgacggcggccacgggggcggtcacggtggccgcggccatcccgatggcgctgcccgtgggctcgccggtgtactcgggcgaggagcaggtgctgtcgtcaagctcgtcccccgagccctcactgcagcagcagccgccggcgccgtctgggtcgggctccggcggggtgccctccggcgacgtgggcgaggagaacgagcggctgcggcgggagaacgcgcggctggcgcgcgagctcgggcagatgaagaagctctgcaacaacatcctcctcctcatgtccaagtacgccgccactcagcaacagccggacgcagccgccgccaagcaggcggcggcggcggccgggaactgctccggcgagtcggcggaggccaccgccgcggcgccgccgcctccgcttccttcgatccttgagctcctcccctcgtgccgcggcgaccccgcgcctgacgcggccgtcgagaccgcggcggcagtgggaacggagcacgaggtggttgagaaggcgggcgccaggctcttcggcgtctccatcgggcggaaacgaatgcgggacgagagcaacggcggcgtgttcgaggactaccccgcgagccgcgcggcggaggtgaaggcggagccggtggaggccgcgcatcccgaccagcggcagcaggagaacaacgcgacggagccggtgccgcagtcgtggcccatttaccggcccaggcccgtgtaccacccgctccgggcctgcaacggctcgggcagcgccgggagcgaccacgacgggtccaccaactcgaggtgactcgagagcttgcaaagccaatcccgtccgtctcagtaaattattacacttactaatgctagtactttatgttactacaggttaaactagaatgagacctctaattagctggggatttactgaccgatcccatgtaaaactccagtgcttatttggtagtaactctttgctagtttatctcataatcactgcaagtatggagtatcctttagactttgtttggatgtaatcggattcgcatcaatccacgtgtgttggggtggattgaagtagaacttgaactaaatttcacctcaatccactccaacatatgtggattgtggattgaggtgaatccgacaacatccattatgcatagggcgatccataaaactagaggttaacttatggactgtagagtagtaactaatttatgttcttgttgaagttggtgatccaacacaacactggagttgtaaaaaaaaaaaaacacacacacacacacaacactggaatccttgtcagctagtagtccaaattgcgcatctgcagttgcagtttctgttttgggtgggggtgattataatttggatagtcagcatgtgggaacatgtccaaaacgtctagattagctgctgaggtggtggctggtcagagttgagatattccgataaagggggtgtgtgtctgtctgtctatgtcgactcgtcgattccaggtggattacgcagcgtttgttacgcgaaaaatatctggcgatggcgagaaaacgtcgcgttcgcgcctactagaaggtactacgaaaggcgctttcttccaagccaagtcggggatgattgggacgccgatggtgacgcgttgtgtgccaccggcggagaccacggtttgttctcgacttctcgtagttgtttttttccaatctataaacagctctacattgacaggtggtttttggtctacgtactttatcggatgtctccggacagacacgtttaattaccatgtaaccggtgttttattcatttagttgataagttatgatgtagctaacttatcgtgataaaaaacattgttgaatgactgataagtttaactgataaataaataggctcaagttggctgtatgggtcaataggttggcagttaatagttgtgggtaaaaaattaagagtaaattacactcaccatacgacaagtatctaagtgggtgcatgttagtccaatatcttgtaatttgtccaatttaatacaacaacaatataggtgggtgcatattgatccacaatcttctcataagtttaatttgatacaagaacttgcttattcggcatatacggtcaagtattgtaacaacgcatctctgtacactttgaatcactgtcattgcaagctatagaccctagcatgctcatctcatccatcaatcagcttgaatcgtttactatacgatatcatttatgaacgcg

SEQ ID NO: 2089 - DNA, 2124 bp, Sorghum bicolor
gcactctgttcagcgccagcgatctgcacgtggcagcagcaagataccgcgtgggggagcaagagcaagagcaagaggagtcaacgcacgaatggcgggcacggcgtcgccggccgcgggctacggctccgacggcgtgtaccgctcgccgcgcgcggcggcgcagatcgcctcggacccgggcctctccctcgcggacctcgtcctgcgccgcgccgcggcgtgcccctccgcgccggcgctcgtggacgccgcgaccggccgcgcgctcaccttcgggtccctccggtccgcggtgctcgtcgcggccgccgcgctctcctcccgcgctggcgtccgccgcggcgacgccgtgctgctcctcgcgcccaactgcgtgctctacccggtctgcttcctcgcggtcacctcgctcggcgccgtcgccaccacggctaacccgcgctacaccccgcgggagatcgccaagcaggcggccgacgcccgcgccaagctcgtcgtcactgtctccgacctcctgcccaagatcgccggcctccgcctccccaccgtcctcctcgacggcgacggcggcggcgcccccgtgcctagttcggactgccccagcagaagcagtaacgtcactctctactcggacctcgtcgccggggttcaggaggcggagtaccgccgcccgccggccgtggggcagggcgacacggcggcgctgttctactcgtcgggcacgaccggggagagcaagggcgtggtgctcacgcaccgcaacttcatcgcggcggcgacgatggtgacgtcggaccaggacgagctcggggaaggaggccgcaacgtgttcctctgcttcctgcccatgttccacatcttcggcatggccgtggtcaccctcggccagctgcagcgcggcaacgccgtcgtcgtcatggcccggttcgacgtcgacgccgtgctcgccgccgtcgagcgccaccgcgtcacgtacatcttcggcgcgccgccggcgatgatcgcgctcgccaagcacggcgggggccgcaggtacgacctcagctcgctcaggtgcatcggctctggcgccgcgccgctcggcaaggacgtcatggtggctatggctgacagattccccgcgccgacattgtccaggtgggaggtgctcctcttgcagggttatggtatgactgaaacctgcgggataatatctctagagtacgtgcaaaagggtcgtgcccgtcagtttggttcaactggagcacttgtcataggagttgaagcaaagattgttgatacaaagacaatgaagcatctgcctccgaaccagctaggagaaatctgtgttcgaggaccaaacataatggaaggttatttcaacaatgtgcaagccactgagtttacaatcaagcaagggtggttgcatactggtgatcttggatactttgatgaaagaggccagcttcatgttgtcgatagacttaaagagctgattaagtacaaaggcttccagattgctcctgctgagcttgaaggattgcttttgtctcatcctgaaattcttgatgctgctgttatcccgtatcctgatcccgaagcaggggaagttcctatcgcctatgttgtacggtcaccaaagagttcactggctgaagttgatgtccagaaatttatcgaaaagcaggtcgcgcactacaagagactgaggaaggtaaagtttgtggacagtgtaccaaaatctgctgcgggaaagattttgagaagagagctcatcgcccaagtcagatcatccaagctgtagcgaattgatcttctcaatttcattacaggccttgtcgtttattttctgctagacagtacaaagacactaagttttttttaaaaaaaaaggtttgaggaataaagcattctggtttctgatatccatggacgaatgagtatggccgtatgctagacattaaggccttgttcagttctgaatttttttggattttgggtattgtaacacttttgtttttatttgataattattgtccaatcatggactaattagagtaaaaagattcgtctcgcgatttataagaaaactatgtaattaattttgtttttatctatatttaatgcttcaaaactatgtaa

SEQ ID NO: 2090 - DNA, 1778 bp, Setaria italica
ccaacaccagcgatctgccgatccgccgcactagagcaaagcaattcggtcgcagaagcgagagacgaggtaaccatggctgaaggcacggagtcgcccgccgcgggctacggctccgacggcgtgtaccgctcgccacgcccggcggcgcccatcccctccgaccccgcgctctccctctccgacctcgtcctccgacgcgccgccgcgtgtccctccgcgcccgcgctcgtggacgccgcgacgggcgccgcgctcaccttcggggccctccgctccgcggtgctcggcgcggccgccgcgctgtcctcccgcgcgcgcatccgccgcggcgacgtcgtgctcctcctcgcgcccaactgcgtgctctacccggtctgcttcctcgccgtcaccgcgatcggcgccgtcgccaccacggccaacccgctctacaccccgcgggagatcgccaagcaggccgccgacgcccgcgccaagctcgtcgtcacggtctccgacctcctgccaaagatcgccgacctccggctccccaccatactcctcgacggcgatggcgcctccgtgcctccgggccacgccaacgacgtcaccctctaccccgatctcgtcgccggggttcacgagacggagtaccgccggccgccaacgcggcagagcgacacggcggcgctgttctactcgtcgggcacgactggggagagcaagggcgtcgtgctcacgcacggcaacttcattgcggcggcggccatggtgacgtcggaccaggacgagcgcggcgaggggcgcaacgtgttgctctgcttcctgcccatgttccacatcttcggcatgtccgtggtcacgctcgggcagctgcagcgcggcaacaccgtcgtcgttatggcccggttcgacgtggacgccgtgctcgccgccgtggagcggcaccgcgtcacctacctcttctgcgcgccgccggtgatgatcgcgctcgccaagcacaggggcggcggcaggtacgacctcagctcgctcaggtgcattggctccggcgctgcgccgctcggcaaggacgtgatggaggccgtggccgacaaattccccaacgcagagattatccagggttatggcatgactgaaacttgcgggatcatatcgctggagtacccacaaaaggggcgtgcccgtcagtttggttcaactggagcacttgtcactggagttgaagcaaagattgtcgatacaaagacaatgaagcatttgcctccgaatcaactaggagaaatctgtcttcgtggaccaaacataatgcaaggatatttcaacaatgtgaaagctactgaattcacaatcaagcaagggtggttgcatactggtgatcttgggtactttgatgaaagaggccagctttatgttgttgatagactcaaagagctgattaagtacaaaggtttccagattgctcctgctgaacttgaaggattgcttctgtctcatgcacaaattctcgacgccgttgtcatcccgtatcctgatcctgaagcaggggaagttcccattgcgtatgttgtgcgatcacctaagagttcactatctgaagttgatgtccagaaatttattgaaaagcaggtcacgcactacaagagactgaggaaggttacgtttgtggacagtgtaccaaaatctgtctcaggaaagatcttgagaagagagctcatcgcccaagtcagatcatccaagctgtagcaaattgatcttctcaatttcagaacagtcttaagtgttcaggttctgct

SEQ ID NO: 2091 - DNA, 1085 bp, Sorghum bicolor
ggccctacacactatatcaacagcgcccatgttcccttcaatccttcctctccacctccgccccgcggcacggcacgaaagcgcaaaccccaactaaaaagccgccaggcaacgagaaaacgcaacgcgaagcaaacccaacatttcggcgtcccgatccgctcttcccctcacctccgaggctccaggaacggcgggatgaggccggcggcgacggcggcggcggacgcgcaccagtcgcggctgctctacgagctctgcgcgctcctgctcaccgtcctccgggcgtcgccggacgacggggcggtggcgcggccgctgctgccgcggcaggtgacgcccgccggggtggcgtccatgctgctgggcgcgtccatggcgctgatgctctgcggctccgtcaccttcatgctcggcttcttcctcatgccctgggtcgtcggcctcggcttcctcttcctcttcgtcggcttcgtcaccaacctctccgggatctggagggccatcctcctctggccctccgccgcggactcgcccaaggaggcatcctccccatggcatatattttccaagccttcattcatgtcgatgtgaagccaactacaaagtaaggctcccacggaggtgtatagaagcaggggagtttgagcagactgttgtcgttgccaacctatattttccttcctggacaacctccttttttaccatgtaacaccgcagcaagtttgaaatggttttatactgtgactaggaggatacttgtttgtacatacggaaaagatgatctggtctaaacatcacgtggagcttataattgtttcagaaatgttgttccttggttgaaaaaaaaatagaagaaatctcatacgttttccttttcatcggtgagcttgtgtcgtctcaccagtatttctgttccactgggtgtctcatctgactgctgttctgctccaactttgcttatgttttgactttgagagtagtggatgtatgcaatctccgtttcttgtaaaattgaattgccgctaacagttgactctgtatgccttgtgtactcgagccctaaattgaaaacatgttttgac

SEQ ID NO: 2092 - DNA, 922 bp, Zea mays
tggccccagcagtatttcaacagcaacagcgcccatgttcccttcaatgcttccaatccttggtctccagctccgcctcgcgtcttcctttccgctgcaggaaagtgcaaacccccactcaactaaaaaaagccgcaaggcaaagagaaaaagcaacgcgaagcaaaccaccatttcggcctccccacccccatcccatctcatcccctccgaggctccagggacggcgtgatgaggccagcggcgccggctgcggcggcggacgcgcaccagtcgcggctgctctacgagctctgcgcgctcctgctgaccgtcctcggagcgtcgccggacgacggggcgggggcgcggccgctgctgccgcggcaggtgacacctgccggggtggcgtccatgctgctgggcgcgtccatggcgctgatgctctgcggctcggtcaccttcatgctcggattcttcctcatgccctgggtcgtcgggctcggcttcctcttcctcttcgtcggcttcgtcaccaacctctccgggatctggagggccatcctcctctggccctccgccgcgtgctcgcccaaggaagcatcctccccatggcatatacttcccaagccttcattcatgtcgatgtgaatgaaggcaatcacaaagccgggctcccacggaggtgtatagaaacaggggaattcgagcagactgttttgtctttggcagcctatattttccttcctggacaaccttttcttttttaccatgtaacgccgcagcaagtttggaaatggttttatactgtggggctaggaggatacttgtctgtacatacggaaaagatgatctggtctaaacatcacgtggagcttgtaattgtttcagaaacgttgttccttggcaaagaaaacgagaggtcccgtatcgctgctccacc

SEQ ID NO: 2093 - DNA, 865 bp, Pennisetum glaucum
caagagcgcccatgtccccttccttccccagctcgccctccctccctcccacctccgatcaacacgaaaccgcgcaccccaactaaaaaaagccgcaacgaaacgccgacgcgaggcgaggcgaggaaacccattccggagcgcgccgatctcctcctccccaacaccccctcgccctccgagactcaagggatggcggggatgaggccggcggcggaggacgcgcaccagtcgcggctgctctacgagctctgcacgctcctgctgaccgtgctccgggcgtcgccggaggacggtgcggggctgcggccgctgctgccccggcaggtgacgcccgcggggctggcgtccatgctgctgggcgcgtccatggcgctcatgctctgcggctccgtcaccttcatgctcggattcttcctcatgccctgggtcgtcgggctcggatgcgtcttcctcttcgtcggcttcgtcaccaacctctccgggatctggagggccatcctcctctggcccgccgccgcctgctccgcctcgcccaaggaggcgtcgtcctccccatggcatatattttccaagcctccattcatgccaatgtgaaggcaaatacacaaagcaaggctcccacagaggtgtataaaagcaggggagttcgtttgatcggagtgttgtagttgccagcctatgttttcctccccggagatcgtttttttttaccatgtaacgacgcaacaagtttgaaatggttttatactgtgactaggaggatacttctttgtacatacatacggaaagaaatgctcaggtctaatcatcacgtggagcttataaattgtttaagaaatgctgttcctttgcggaacaggaa

SEQ ID NO: 2094 - DNA, 1087 bp, Setaria italica
tggcctagtatttcaagagcgcccatgtcccctgcctgccttccccaactcgccctctccctcctcttctgagcaacacgaaaccgcacacccaactaaaaaaagccgcaaggaaacgcgacgcgacgcgaggcaaacccatttcggcgtgccccgatctcctcctcccccctcgccctccctcccctccgagactccagggacggcggggatgaggccagtggccacggcggcggaggacgcgcaccagtcgcggctgctctacgagctctgcgcgctcctgctgaccgtgctccgggcgtcgccggaggacggggcgggggcggggccgcggccgctgctgccgcggcaggtgacgcccgcgggggtggcgtccatgctgctgggcgcgtccatggcgctgatgctctgcggctccgtcaccttcatgctcggcttcttcctcatgccctgggtcgttgggctcggctgcgtcttcctcttcgtcggcttcgtcaccaacctctccgggatctggagggccatcctcctctggcccgccgccgcgtgctccgcctcgcccaaggaggcgtcgtcctccccatggcatatattttccaagcctccattcatgccgatgtgaagacaaatatacaaagtaaagctcccaccgaggtgtatagaagcaggggagtttgatcagactgttgtcgttgccagcctatattttccttcctggggaaccttttttaccatgtaacgccgcaacaagtttgaaatggttttatactgtgactaggaggatacttctttgtacatacggaaagaatgctctgggctaatcatcacgtggagcttataattgtttaagaaatgctgttccttcgcggaacaagaagttcaatatatatatatatatatatatatatatatattttttcttttcggtgagcttgtgtcgtaccagtaacgttgtttgttccactgggtctttcacctgatcgtgctgttatgctccaactttgctcatgtttgactttgagaggggtggctgcgatttccatttcttgtaaaactgaagtgccacgaacaattgacttcgtttgcc

SEQ ID NO: 2095 - DNA, 2461 bp, Sorghum bicolor
gaaatctgtaaaattttacaaaatttagaagaaactaaacaagggccaagttggcaccgagggttacgacactgctcctacgtaacagcagcacgcacgagtcacgacgacgttacagacactgatgaggcgccggcgcgcagcagtgggggtgtgtgtggagaccgaccggaggagagaacgaaatcgcaaccgatacacaagctcctcttgttgctattgctatgtcgtctatgggagctctagtgcctcaactttcgaaaccaaaggcgttggtggtgatatatcagcttttttcttttcttttctagcttggatagcttatcatcagtggaaaattagcctctcttttttttatgttgacgaatcggcatcgtggctttcgcatcttcgttaccatgcctgtccatatatgcatcgccgtatcggctataaatgcagcgtgttgagccatgtccctcctgggtcgtgcaagcttagctcatttggaaccagcaggtgacaagcagagatagaggagcaatggctggttcgtcttcaatggacactgaagctgcaggccaacagctcaagcatggcagcggctacagcatcccggctactgctcatgcggtggacacagactcgtggcagcaggtgggcctgctgatggtgatcggcttcaactgcgcctacgtgctcagcttctccaacctcatgatggtgcccctgggctgggcatggggcgtcgcctgcctgctgctcgtcggcgccgccgcatggtacgccaactggctcctcgccggcctccatttcgtcgacggacagaggttcattcgctacagggacctcatgggcttcgtattcgggaggaacatgtactacatcacttggttcctgcagttcaccactctacttctgtgcaacatgggcttcattctactaggagcaagagcactcaaggcaatcaacagcgagtttacccacacccctgccaggctgcagtggttcgtcaccgcgacgggattcatctacttcgccttcgcctacttcgtgcccacgatttctgccatgaggaactggctcgccacgtcggccgcgctgacattagcttacgacgtcgctctgctggctatcctcatcagagatgggaaatcgaacaagcagaaggactacaacgtccatgggacccaagccgagaaggtgttcaacgcgttgggcgccgtcgccgccatcgtcgtctgcaacacgtccgggctgctcccggagatacagtcgacggtgcgggagccggcggtgcgcggcatgcggcgggcgctgcttctgcagtacaccgccggcgccgcggggtactacggcatcagcgtggcggggtactgggcgtacgggtcggcggtgtcggagtacctccccaacgagctcggcgggccaaggtgggccgccgtgctcatcaacgccaccgccttcctgcagagcatcgtctcccaacacctgttcacggtgccgatccacgaggcgatggacacgcggctgcagcggctggacgagggcatgttctcccggtacaacctcacgcgacgcctctgcgcgcgggggctcgtcttcggcttcaacgtcttcgtcaccgcgctgttcccgttcatgggggacttcgtcaacctcgtcggctccttcgcgctcgtcccgctcaccttcacgttccctagcatggccatcctcaagatcaaagggaagagcggcgggagatgtaacagactttggcattgggggatcatcgttttctcctcggttctctgcgtcgctaccaccgccgccgccgttcgtctgatcttcaacaatgctaggatctaccacttcttcgctgacatgtagtaaggagtccaaaaaacacgattaggtgatattgccacttctcaattttttttttgttttggtgaggaatgaaagggtcacctcatgtttggtaaggacgaccacatgcatgatcaataagcatcatgtagtcatcctatcgaaatttagaaatgagcttattgtggtggaccacctcctcaaaacaaagatctctgttcttaattaatgcgagcttaaagacaactcgtgaggtgctcttttaaacgccacatgtgacgtactccacgtgcctatttcttgcaagtaccaagagaatggtgttagagttataaacatacgtacgtatcatgtctctagccttttgtctcacacgtgtgttacgtgggccttagagtggtatgcttgaccctaactaatcttattgggctctcaagctcatgcctatatatatatatatatatatatgtaatcgccctcaagtttattaatcaattattgtgtatttagttcaatcttgtatatgtaccatgcttccatggtatatcactagaaggttcgcatctacgaccttatcacttctacttaaaccttagactatcgtcaattcctcgtagttaccatcaccggt

SEQ ID NO: 2096 - DNA, 1641 bp, Setaria italica
atgtccctctccctcctggaggctcatctggaaggaggtgacaagaagagagaagcaatggctagttcgtccatggacactgaagctgcaggacaggagctcaagggcagtgactacaccgtctcagctactgctcatgcagtagattcagactcgtggcagcaggtggggctgctgctggtgatcggcttcaactgcgcctacgtgctgagcttctccaacctcatgatggcgccgctgggctggggctggggcgtcgcctgcctgctgctcgtcggcgccgccgcctggtacgccaactggctcctcgccggcctccatttcgtcgacggccagaggttcatccggtacagggacctcatgggcttcgtcttcgggaggaaaatgtactacatcacttatttcctgcagttcgccactctgcttctctgcaacatgggcttcattttactaggtgcaagagcactcaaggcaatcaacgtggagttcacccactcccctgccaggctccagtggttcatcaccgcgaccgggatcatctacttcgccttcgcctacttcgtgccgacgatttctgccatgaggaactggctcgccacgtcggcggcgctgacgttagcatacgacgtcgctctgctcgccatcctaatcagagatggtaaatccaacaacaaccagaagattcagcgtccatggcagcccatccgagaaggtgttcaacgcgctgggcgcgtcgccgccatcctcgtctgcaacactccgggcttgctcccgggagatacagtcgacggtgcgggagccgtcggtgcgcgggatgcggcgggcgctgctgctgcagtacaccgccggcgccgccgggtactacggcatcagcgtggcggggtactgggcgtacgggtcggcggtgtccgagtacctccccaaccagctcggcgggccgcggtgggccgtcgtgctcatcaacgccgccgccttcctgcagagcgtcgtctcccaacacctgttcgtggtgccgatccacgaggcgatggacacgcagctgcagcggctggacgagggcatgttctcccggtacaacctgacgcgccgcttcttcgcgcgggggctcatcttcggcttcaacgtcttcgtcaccgcgctgttcccgttcatgggggacttcgtcaacctcgtcggctccttctccctcgtcccgctcaccttcatgttccccagcatggtcatcctcaagatcaaggggaagagtggtgggagatggagcaggctttggcattggggcgtcatcgttttctccacgcttctctgcgtcgctaccaccgcctccgcagttcgtttgatcttcaacaatgccaggatctaccgcttcttcgccgacacatgatacttcacgtacctctaattcttctaaatataaatggcatagatgaacaatgcgacggtgagtttgtaaagttagaattgtgcattgattttctgattttgcgaagaatataatatgacgtgttgaaacatgtcgtcataaatcataatcctaaaatcatatcatgtttgttttactattagagtatataggataatgatccaatgaatcaggttgtattgtataatacgattagttctatctttatctttaaggttgct

SEQ ID NO: 2097 - DNA, 1018 bp, Setaria italica
cgtggcggggaggacagataagatcgatgtcgtgaacggcggcgacaaggaggccgggagaaatgccgccgaccacacctgcgccggcgcggccctgtcctccgccagctccagcagcggcgccaatccgtccgcagctcctctcctccgttgcgccgttagcgctcgccgccgcgctcgtctgcggcgcgggccccgccgccgacgccccggccgccagggccgtcccgttcgtccgtcctcctcccctgcagggaaagcccttcgcctcctccacgccgtacgcacagtcgcagaagctgcagcttggcctcgacaagctcgggaagatcaggccgtgcccgtccaccaacccggggtgcgtgtccacgaacgcgctgggatcttccggctccttcgcctccccgctggtcatcccggaatcatccgccggggacaaggccgttgcctcgttgcggcaagccatagagaagacacagagcaatgtggacttcaaggtcgaccaagacaccccttacggtcactacattgaggcggagatggacggcggcgtgggccgggacgtgatggagtttctggtgaagaaagacgccggcgtggtggcgtaccggtgcatggccaccaaggtcaccttcgtctaccccttcaccaccgccgtcggcgactccaaggggcagaagcagaggatcgccgccatctcgcaggagctcggttggtacgccccggacatccagtcctccatggacttcgacgacgccggttatcctccgtgaagactgaagagttgaataccggatgtcggaggaccaaccatcgtcatcgattcatccatcgggtggagcagaggtaaatgtatgttggtgtatataaaagtagctaggattcgggtcgtactgccactgttgttcatattgtcagtgcacgtccggctgtgccgtccaactatgttcctgttatcatgtaatttgtttatacttgattcttgtttaaccaatgttgtatgtagggaatcgttagt

SEQ ID NO: 2098 - DNA, 1025 bp, Sorghum bicolor
aggggagataagatcataagaccgttgtcgtgattcgtgaagggtggcgacaagacatgccgccgggcacaactgctccggcgccggcggcggctccagcagcggcgccgatccggacgcatctcctcacctccgtcgcgaaggtagcgctcacggccgcgctcgtctgcggcggtggcggtggcggcggccccgctgccgtcgtcgtcgtcgttccggccgctgctcatgccgtcccgttcgtccgtcctcctcctcccctgcagctgcagggaaagtccttcgccgcctctactccttacgcgcagtctcagaagctgcagcttggcctcgacaagctcggaaagatcagggcatgtccgtccaccaacccggggtgcgtgtccaccaacgcgctgggatcctcgggctccttcgcctcgccgctgatcatcccggaatcatccgccgccggggagaaggccgtcatctcgttgcggcaagccatcgagaagacgcagagcaacgtggacttgaaggtggatgaagacactccatacggtcactacatcgaggcggagatggacggcggcgttgggcgggacgtgatggagttcctggtgaagaaagacgccggcgtggtggcgtaccggtgcatggccaccaaggtcaccttcgtgtaccccttcaccaccgccgtcggcgactccaagggccagaagcagaggattgcggccatctcgcaggagctcggatggtacgccccggacatccaatcctccatcgactccgacgacgacgctcctccgtgaagaccgtacaacgaatcattatcgatcacttcatcgatcgatcgggagcggaggtacggtatagttgcggagctggttggttttcatgcctgcctagggtcatcatgcatgtaagtatgcaggcatccgtcaaatagtacagatataattaacatataagtaataagatatataatcatataaatgtacaattgtagtagaatatatttcaagctgttgttatatggttgttaa

SEQ ID NO: 2099 - DNA, 1047 bp, Panicum virgatum
cggcccatcgagtcgtgctattggccatttggccctacgccctccccccaatcgagtggcgcggagcagaggagagaaaagtatcgtgaacggcggcgacaaaggggaggccgcgagaaatgccggcgccgccctgtcccccgccggccccagaagcggcgccgatactgccgcggctcctctcctcggtcgctccggcagcgctcgccgccgcgctggcctgcggtgctggcccaggccccgccgccgtcgtcgcccaggccgtcccgttcgtccgcccccctccccagcaggggaggcccttcgccgcccccacgccgtacgcgcagtcccagaagctgcagcttggcctcgacaagctcgggaagatcaggccatgcccgtccaccaaccccgggtgcgtgtccaccaacccgctgggatcttccggctccttcgcctccccgctgctcatcccggaatcatccgccggggacaaggccgtgcaggcgctgcggcaagccatcgagaagacgcagagcaatgtggacttcaaggtcgatgaggatacgccttacggccactacatcgaggcggagatggacggcggcgtgggccgggacgtgatggagttcctggtgaagggagacgccggcgtggtggcgtacaggtgcatggccaccaaggtgaccttcgtctaccccttcaccaccgccgtcggcgactccacggggcagaagcagagggtcgccgccatctcgcaggagctcggatggtacgccccggacatccagtcctccatggactccgacgacgccggctatccgccgtgaagagtggacaccggaggaccgatcatcacttcatccatcgtccatcggatggagcagaggtaaatatacgttggctaggttcgtacctgtgcgttgttatgtgcaacgaaaagtatattaatcaatgtatgaaaataattcaactttgtaaaacttctacaaaattttaactctgatggtaaaagtttttccaaagtaatatatagaatgggtagcacgatgatcattttagtaa

SEQ ID NO: 2100 - DNA, 1782 bp, Sorghum bicolor
ttctaatccccgcgcggccacgaccgcgccgcgcggcctagaacgttccattcccctcttggcaggcctcggaatgaatagcgtcaagccggcggtagccccggtacgagtatttatcaccgccggctgccactctcccgcgcagcaggcaggagcaggagacgacagcaaattccccgcccgcgcttggatcggctcttaggcagcagagcacactgttcgttctggacgttggcctctttcagtcggtaggtggcgagatggaccggatgctgccggggacggtgacggtgaaggaggagtggccgccggaggaggaagaggaggaggaggtggtggtggaggacgtggacgctccgcggccgatggaggggctgcacgaggtcgggccgccgccgttcctgaccaagacgttcgacctggtggccgacccggccaccgacgaggtcatctcctggggccgcgccggcaacagcttcgtggtctgggatccccatgtgttcgccgccgtgctgctccccaggttcttcaagcacaacaacttctccagcttcgtccgccagctcaacacctatggtttcagaaagatcgatccggacagatgggagttcgcgaacgaaggcttcctgaggggccagaggcatcttctgcggctgatcaagcggcggaggccggcgccgccgccgccgtacctccaggcgtcgcagtcgcagtcacaggggtcgtgcctggaggtgggtcagttcgggggactggacggagagatggaccggctgaggcgcgacaagagcatcctgctggcggaggtggtgaagctgcggcaggaacagcagagcacgcgggcgggcatgcgcgccatggaggagcggctgcagcacgcggagcacaagcaggtgcagatgatggggttccttgcgcgggcgatgcagagcccggacttcttccagcagctggcccagcagcaggacaggcggagggagctggagggcgcgctgatgctctccgccgccgcctccaggaagcggaggcggcccatcggcaccgcgccggccctgctggacggcggcgtgcaggaggaggaggaggaggagcaggcggccgacgacgatcccaccgccacgcaggcgctgttcgcggagctggacgagcgggggaccacgtcggagctggagaacctggcgctcaacatccagggtctcggcagcagcaagcgcaggcagggcgggggcggcgcgcggagccagcagcgggccgccgcggtcggtggtggcgagacggcggagctgaccgacgacttctgggaggagctgctgaacgaagggatgagaggcggtgcggcggctgagctgttgccgccggagaggagacggccgggctggtacgtcgacgcgctggcgcagaagctgagctccatgagcaacaccacggcgaagtagagctggcgttcgtgtcgtagtcgcagtttactcctatatgactatagtaatactagattgattaaccctccgattcgtccgatacgcgttagtgaatactcctagtcatagctccattgttgtactagtatttaggagtgcgatcgtgctggttgcatgtgtcatttttttgacaaggggttgcatgtgttgtgtgtagtgtagtgcttaattggtatgtatataccttgtgttgtagtgatatagccggcacaagtatatttcagagtcgccgggtcgtgtcattcttagtggtaattgacattctttctactattaatctatctattactctctccatcctaaa

SEQ ID NO: 2101 - DNA, 1085 bp, Saccharum officinarum
cttgcgcctacaccgccgcctccctcgcttcccggatccgccccgccggtgcgcgcttgtagtcgaggagctgctgcggccaagaccaatcgaccatggcgacccgtattcagtttgagaataactgtgaaattggtgttttctccaagctgacaaatgcttactgtctggtagccatcggagggtcagagaacttctatagtgcctttgaggctgagcttgcagatgccattcctgtggtcaagacctctattggtggaaccagaataatcgggcgactctgtgttggaaacaagaatggacttctattgccacatactacaactgaccaagagcttcagcatctgaggaactgcttgcctgatcaagtggtggttcagcgtattgatgaaaggttgtctgcccttggcaattgcatagcctgcaatgaccatgtagcgcttacacaccctgaccttgacaaggagactgaggagtttattgcagatgtgcttggtgtcgaggtgtttaggcagactattgctggaaatatccttgtggggagttactgcgccttctctaacaggggtggcttggttcatcctcatacatccgttgaagaccttgacgagctctccacgctcctgcaagtcccccttgtcgctggtactgtgaacagaggcagtgaggtcattgctgcaggcatgacagtgaacgactggactgccttttgtggctcagacacaacagccactgagctctcagtcattgagagcgtcttcaagctgagggaagggcagcccactgcgattgtggaggacatgaggaagtctctgatagacagttatgtgtaacttatgccagcagatgtgggtctcaagtattgcctgtgctaagatgtattgcaagctagttgtctgtagcacaacataaccctctgatatgttcgtggtgtatccgtggtttctgaatcgtagactttaaagttgaagctcgtgctatgaaaagtggccactcgttttgttttgtttcggcatggatgtttatgcttcttgattgatataaatagtttttaagtaaagttttgcttacatccatttgccctg

SEQ ID NO: 2102 - DNA, 1362 bp, Sorghum bicolor
attgtcatcgcggctctgccctgccctgcccttcgcacgcattccccttccctcccggccccagaactgcgcccaaaacccttgcgcctacaccgccgcctctctcgttccccggatccgccccgcaggtgcgcgcgcttgtaatcgaggagctgctgcggccaacaccaatcgaccatggcgacccgtattcagtttgagaacaactgtgaagttggtgttttctccaagctcacaaatgcttactgtctggtagccataggaggctcagagaacttctacagtgcctttgaggctgagcttgcagatgccattcctgtggtgaagacctctattggtggcaccagaataattggccgactctgtgttggaaacaagaatggacttctattgccacatactacaactgaccaagagcttcagcatctgaggaactgcttgcctgatcaagtggtggttcagcggattgatgagaggttgtctgcccttggcaactgcatagcctgcaatgaccatgttgcgcttacacaccctgaccttgacaaggagactgaggagttcattgcagatgtgcttggtgttgaggtgtttaggcagactattgctggaaatatccttgtggggagttactgtgccttctctaacaggggtggcttggttcatccccatacatccgttgaagaccttgacgagctctcgacgctcctgcaagtccctcttgtcgctggaactgtgaacagaggcagcgaggtcattgctgcaggcatgacagtgaacgactggactgctttttgtggctcagacacgacggccaccgagctctcagtcattgagagcgtcttcaagctgagggaggggcagcccactgccattgtggaggacatgaggaagtctctgatagacagttatgtgtaacttatttgccagcagatgtgggtctcaagtattgcctgtgctaaaatgtattgcaagctatacttgagttatcagtagcacaacataaccttatgatatgtttgtggtgtatccgtggtttcagaatctcgagacttttccgtggaagctcgtgctatatcagtgaaaattggccactcgttttgttaagtttttttttccggcatggacgttttacgcttcttagttgataaatatcctaggaagtaaaattttgaatacattcattggccctgagttcatttgcctagaaaacccaaatctcgagtgctactgattgttcatgccttttccatttttttgttttcacaccaacagctatatgcctcacgtttcatattacacaaccagttcatgccttttctaatgtttgttcactccaacagctatatgcctaacatgtttcat

SEQ ID NO: 2103 - DNA, 1247 bp, Panicum virgatum
cgggtgtggcgtgtccatctaccgccacgcccatcattgcgtctcctcccccacttcgcattccgccctcgcagaaccgcgactgaaacccttgcgcccgcctcggccgccgcctcccacccgaaatccgcttcgccggtgcgcgcttgtagttgagggaactgctgcttccgcgaacaccggtcgaccatggcgacccgtattcagtttgagaacaattgtgaagttggtgttttttccaagctaacaaatgcctactgcctggtagcaattggagggtcagagaacttctacagtgcatttgaggctgagctagcagattccattcccgtggtcaagacctctataggtggcaccagaataattggtcgactctgtgttggaaacaagaatggacttctattgccacataccaccactgaccaagagcttcagcatctgaggaactgcttacctgatcaagtggttgtacagcgtattgatgagaggttatcagcccttggcaattgcatagcctgcaatgatcatgttgcgcttacacacccagaccttgacaaggagacggaggagtttatcgccgatgtgcttggagttgaggtattcaggcagactattgctggaaatatcctcgtggggagctactgtgcattctctaacaggggtggcttggttcatcctcacacatccattgaagaccttgatgagctctccacgctcttgcaagtcccgctcgtggctggaaccgtgaacagaggcagcgaggtcattgctgcaggaatgactgtgaacgactggacagcattctgtggctcagacacgacggccactgagctctcggtcattgagagcgtcttcaagctgagagaagggcagcccacagcgattgtcgatgacatgaggaagtctctgatcgacagttatgtgtaacgaaggcccagaagatgtgggtctcaagtattacctatgccaagatgcactgcgagctatacttgtgttatctgtagtaaaaccaaagcgtatcctctgacaagctacgtttggtggtttatccttggcatctgaatcatagacttgatgttttaccatgttccttgaggctcattggtatgctttttttttttgggaacaaggctcattggtatgctagtaagaagataatgtttctattcgttatatgatgtttcagcatggagctatggagtatgggcatatggctcatctttccagtttacgtttttgcttttcta

SEQ ID NO: 2104 - DNA, 1173 bp, Panicum virgatum
gcattccgccctcgcagaaccgcgactgaaacccttgcgcccgcctcggccgccgcctcccacccgaaatccgcttcgccggtgcgcgcttgtagttgagggaactgctgcttccgcgaacaccggtcgaccatggcgacccgtattcagtttgagaacaattgtgaagttggtgttttttccaagctaacaaatgcctactgcctggtagcaattggagggtcagagaacttctacagtgcatttgaggctgagctagcagattccattcccgtggtcaagacctctataggtggcaccagaataattggtcgactctgtgttggaaacaagaatggacttctattgccacataccaccactgaccaagagcttcagcatctgaggaactgcttacctgatcaagtggttgtacagcgtattgatgagaggttatcagcccttggcaattgcatagcctgcaatgatcatgttgcgcttacacacccagaccttgacaaggagacggaggagtttatcgccgatgtgcttggagttgaggtattcaggcagactattgctggaaatatcctcgtggggagctactgtgcattctctaacaggggtggcttggttcatcctcacacatccattgaagaccttgatgagctctccacgctcttgcaagtcccgctcgtggctggaaccgtgaacagaggcagcgaggtcattgctgcaggaatgactgtgaacgactggacagcattctgtggctcagacacgacggccactgagctctcggtcattgagagcgtcttcaagctgagagaagggcagcccacagcgattgtcgatgacatgaggaagtctctgatcgacagttatgtgtaactaaggccctgaagatgtgggtctcaagtattacctatgccaagatgcactgcgagctatacttgtgttatctgtagtaaaaccaaagcgtatcctctgacaagctacgtttggtggtttatccttggcatctgaatcatagacttgatgttttaccatgttccttgaggctcattggtatgctttttttttttgggaacaaggctcattggtatgctagtaagaagataatgtttctattcgttatatgatgtttcagcatggagctatggagtatgggcatatggctcatctttccagttt

SEQ ID NO: 2105 - DNA, 1208 bp, Panicum virgatum
catcattgcggcagtgcggctccccccctcacattccgccctcgcagacccgcgcctgaaacccttgcgcccaccgccgccacctcggccgccgccgccgccgcctcccacccgaaatccgcttcgccggtgcgcgcttgtagttgagggaactgctgcttccgtgaacaccggtcgaccatggcgacccgtattcagtttgagaacaattgtgaagttggtgttttttctaagctaacaaatgcctactgcctggtcgcaattggagggtcagagaacttctacagtgcatttgaggctgagcttgcagattccattcccgtggtcaagacctctataggtggcaccagaataatcggccgactctgtgttggaaacaagaatggacttctattgccacataccaccactgaccaagagctgcagcatctgaggaactgcttgcctgatcaagtggttgtacagcgtattgatgagaggttatcagcccttggcaattgcatagcctgcaatgatcatgttgcacttacacatcctgacctcgacaaggagacggaggagtttattgcagatgtgcttggagttgaggtattcaggcagactattgctggaaatatcctcgtggggagctactgcgcattctctaacaggggtggcttggttcatcctcacacatccattgaagaccttgatgagctctccacactcttgcaagtcccactcgtggctggaaccgtgaacagaggcagcgaggtcattgctgcaggaatgactgtgaacgactggacagcattctgtggctcggacacgacggccaccgagctctcggtcattgagagcgtcttcaagctgagagaagggcagcccacagcgattgtcgatgacatgaggaagtctctgatcgacagttatgtgtaggcggatctcaagcattacctgtgccaagatgcactgcgagctatacttgtgttatctgtagtaaaaccaaagcgtaccctctgacaacctacatttggtggtttatccgtggcatttgaatctgagactcgaggttttaccatgttcctttaaggctcatggtatgctagtaagaagataatgcttctgttcgttgttatatgatgtttgagcatggagttatgggagtatggacacatttggctcatctttccagtttatgtttagcaatctgggaagtaagatttttg

SEQ ID NO: 2106 - DNA, 1113 bp, Panicum virgatum
attccgccctcgcagacccgcgcctgaaacccttgcgcccaccgccgccgccgcctcccacccgaaatccgcttcgccggtgcgcgcttgtagttgagggaactgctgcttccgtgaacaccggtcgaccatggcgacccgtattcagtttgagaacaattgtgaagttggtgttttttctaagctaacaaatgcctactgcctggtcgcaattggagggtcagagaacttctacagtgcatttgaggctgagcttgcagattccattcccgtggtcaagacctctataggtggcaccagaataatcggccgactctgtgttggaaacaagaatggacttctattgccacataccaccactgaccaagagctgcagcatctgaggaactgcttgcctgatcaagtggttgtacagcgtattgatgagaggttatcagcccttggcaattgcatagcctgcaatgatcatgttgcacttacacatcctgacctcgacaaggagacggaggagtttattgcagatgtgcttggagttgaggtattcaggcagactattgctggaaatatcctcgtggggagctactgcgcattctctaacaggggtggcttggttcatcctcacacatccattgaagaccttgatgagctctccacactcttgcaagtcccgctcgtggctggaaccgtgaacagaggcagcgaggtcattgctgcaggaatgactgtgaacgactggacagcattctgtggctcagacacgacggccaccgagctctcggtcattgagagcgtcttcaagctgagagaagggcagcccacagcgattgtcgatgacatgaggaagtctctgatcgacagttatgtgtaggcggatctcaagcattacctgtgccaagatgcactgcgagctatacttgtgttatctgtagtaaaaccaaagcgtaccctctgacaacctacatttggtggtttatccttggcatttgaatctgagactcgaggttttaccatgttcctttaaggctcatggtatgctagtaagaagataatgcttctgttcgttgttatatgatgtttgagcatggagctatgggagtatggacacatttggct

SEQ ID NO: 2107 - DNA, 1173 bp, Cenchrus ciliaris
cctcgcctgaaacccttccgcctccgccgcctccccggacccgaatccgccccgccggtgcgcgcttgtagttgaggagtgctgctgctgccgtgaacaccgatcgaccatggcgacccgtattcagtttgaaaacaactgtgaagttggtgttttctccaagctaacaaatgcctactgtctggtagcgattggagggtcagagaacttctacagtgcatttgaggctgagcttgcagattccattcccgtggtcaagacctctataggtggcaccagaattattggtcgtctctgtgttggaaacaagaatggacttctattgccgcataccaccactgaccaagagcttcagcatctgaggaactgcttgcctgatcaagtcgtggtacagcgtattgatgagaggttatcagcccttggcaattgcatagcctgcaatgaccatgttgcccttacacaccctgaccttgacaaggagacggaggagcttattgcagatgtgcttggagttgaggtattcaggcagaccattgctggaaatatccttgtggggagctactgtgcgttctctaacaggggtggcttggttcatcctcacacatccattgaagatcttgatgagctctccactctcctgcaagtcccgctcgtcgctggaacggtgaacagaggcagcgaggtcattgctgcaggcatgaccgtgaatgactggactgccttctgtggctcagacacgacagccaccgagctctcggtcattgagagtgtcttcaagctgagagaagggcagccgaccgcaattgtcgatgacatgaggaaatccctgatcgacagttatgtgtaactgaggccctgcagacatgggtctagtgttacctgtgccgaaggtgcaccgcgagctatacttgttatcagtagtaaaaaccaaaacgtacccactgaggagctacgtttggtggtttatccttggcttctgaatcttagacttaatgttttaccatgcgccataaaggtcatggtatactagtaagaagataacgcttctgttcttatatgattgtttcgtgcatctttcctgcgtatgtttcctgtttgtgcaaccaccagggaagaatttgggctacattcgccatccttgcatcaatttgaaaaatataagaattttggcta

SEQ ID NO: 2108 - DNA, 1214 bp, Setaria italica
ccatcattgcggcttctacccttcgcattcctccctctcaggaccgcgcctgaaacccttgcgcccccgcctccgccgcctcggccaccgcctcccccgacccgaatccgccccgccggtgcgcgcttgtagttgaggagtgctgctgctgctgccgtgaacaccgatcgaccatggcgacccgtattcagtttgagaacaattgtgaagttggcgttttctccaagctaacaaatgcctactgtctggtagcgattggagggtcagagaacttctacagtgcatttgaggctgagcttgcagattccattcccgtggtcaagacctctataggtggcaccagaataatcggccgtctctgtgttggaaacaagaatggacttctattgccacataccaccactgaccaagagcttcagcatctgaggaactgcttgcctgatcaagtggtggtacagcgtattgatgagaggttatcagcccttggcaattgcatagcctgcaatgaccatgttgctcttacgcaccctgaccttgacaaggagacagaggagtttattgcagatgtgcttggagttgaggtattcaggcagaccattgctggaaatatccttgtggggagctactgtgcgttctctaacaggggtggcttggttcatcctcacacatccattgaagaccttgatgagctctccactctcctgcaagtcccgctcgtcgctggaaccgtgaacagaggcagcgaggtcattgctgcaggcatgactgtgaacgactggactgccttctgtggctcagacacgacagccaccgagctctcggtcatcgagagtgtcttcaagctgagagaagggcagtccaccgcgatcgtcgatgacatgaggaagtctctgatcgacagttatgtgtaactgaggccctgcagacgtgggtctcaagtactacctgtgccaaggtgcaccgcgagctatacttgtgttatcagtagtaaaaccaaaacgtaccctttgagaagctacgtttggtggtttatcctttggcttctgaatcgtagacttgatgttttaccatgttccattaaggccatggtatgctagtaagaagataacgcttctgctcttcgttatagatgttacgtgcatctttcctgcgtatgtttactgtttgtgcaaccacctgggaagtaaagaattttggctacattcaccgtcctt

SEQ ID NO: 2109 - DNA, 1217 bp, Hordeum vulgare
ctccgatcggcccgtgctcatataccacgctgccacggctctcccctcgttccccgttctctcggaagtcgcgctcccaaaccctagctcccaccgcagcggccaccgcatccctcccctcccggtgagtgcttgttgctgcagacgagaagcggctgaggcgaagaagaggaatcgaccatggcgacccgtatccagtttgagaacaactgtgaagttggtgttttctccaagctcacaaatgcctactgtctggttgcaattggaggatcagagaatttctacagtacatttgagtctgagcttgcagatgtcattcctgtggtcaagacctctatcggtggcactagaataattggccgcctctgtgttggaaacaagaatggacttctcttgccacacacaaccactgatcaagagcttcagcatctgaggaactgcatacctgatcaagtggttgttcagcgcatcgatgaaaggctgtctgcccttggcaattgcatatcctgcaatgaccatgttgcgctcacacaccctgaccttgacaaggcaactgaggagcttattgcagatgtgcttggggttgaggtattccgtcagacaattgcaggaaatatccttgttgggagctactgtgcattctctaacaggggtggactggtccatcctcacacatccattgaagatcttgatgagctgtccacactcctccaagtccctcttgtcgctggaaccgtgaaccgtggtagcgaggtcattgctgcgggcatgacggtgaacgactggactgccttctgtggctcagacacaaccgctaccgagctctccgtcatcgagagcgtcttcaagttgagagaaggccagcccacggcgatcgtcgatgacatgaggaagtcgctgattgacagctacgtctaaatgatcaaagggcatgggatgtggttcttgaacggtacttttggttgacagtagcaaaaaaacatgcctgtctaagctcttacttctggtgtaccttcgtcttccgaatttggaattacaaacttgtgctttgtcctggtaaagcttacggtatttgaaggtgtgcacttacgctatgtgatattagtatcttagcctgatagtatttgggttttatgtttgagctctggagcaactttggctacaacacctatgttttgtccattgtttttcacataaaaaaaaagtcttgctctgtt

SEQ ID NO: 2110 - DNA, 1370 bp, Brachypodium distachyon
tcccgcgatatttgccacggcagagccaccatctcttctccccccaccattccctcggaagtcggaagtcgtgcgccgaaaccctagcccccgttccaccgcccccgtcgtcggccgtcgccaatccccttccccgtttgcgcgtgcttgttactcgagagaaagcctctgcgtctgcgtctgcggcggcggcgaagcggaatcgacgaccatggccacccgtattcagtttgagaacaactgtgaagttggtgttttctccaagctgacaaatgcctactgtctggttgctattggaggatcagagaacttctacagtacatttgagtctgagcttgcagatgtcattcccgtggttaagacctctatcggcggtactagaataattggtcggctgtgtgttggaaacaagaatggacttctcttgccacatactaccactgaccaagagcttcagcatctgaggaactgcttgcctgatcaagtggttgttcaacgtatcgatgaaaggctgtctgcccttggcaattgcatatcctgcaatgaccatgttgcgcttacacacccagaccttgacaaggcaactgaggagcttattgctgatgtccttggggttgaggtcttccgtcagacgattgctggaaatatccttgttgggagctactgtacattctccaacaggggtggactggttcatcctcatacatccattgaagatcttgatgagctctccacactcctccaagtccctcttgttgctggaaccgtgaaccgaggcagcgaggtcattgctgcaggcatgacagtgaatgactggactgccttctgtggctcagacactacggccactgaactctcagtcattgagagtgtgttcaagctaagggaaggccagcccacagcgattgtcgatgacatgaggaagtcgctgatcgatagttacgtctaaagatccaaggtcatgcagtgtggttcttgagtatcaactctaaactgtacttctgacagacagtaggaaaacctgctctcctgagttgttacttctggtggtgtatcctatagtgttctggattaaaaacctatgctttgttctggtaaaagctcacgctgttggaattgatagctcgtgctctttgtgataatttgaacctgcagcttcagtatgtggatttcaagctgcatatggtcgcatagatatttagttctggattctgttgaagtaggtttctagtttaaaaaattatttcaaaatacatggcgtattttccatcaagactatgtttattccactaatggtttgtgtgataacagtttgtcacactaagttttttatactaatacagtatataattgttggtcgactgccaaaa

SEQ ID NO: 2111 - DNA, 1120 bp, Avena sativa
aagtcgcgcgccgaaaccctaaactcccaccgccgcggccaccgcctcccgatccctcccggtgagtgcttgttggtcgagaagcagccgccgcgaagaggaatcccaccatggcgacccgtattcagtttgagaacaactgtgaagttggtgttttctctaagctgacaaatgcctactgtctggttgcaatcggaggatcagagaacttctacagtacatttgagtctgagcttgcagacgtcattccggtggtcaagacctctatcggaggcactagaataattggtcggctgtgcgttggtaacaagaatggacttctcttgccacatactaccactgatcaagagcttcagcatctgaggaactgcctgcctgatcaagtggttgttcagcgcattgatgaaaggttgtctgcccttggcaactgcatatcctgcaatgaccatgttgcgctgacacaccctgaccttgacaaggcgactgaggagcttattgctgatgtgcttggggttgaggtgttccgtcagactgttgctggaaatatccttgttgggagctactgtgcattctcaaacaggggtggattggtccatcctcacacatccattgaagatcttgatgagctgtccacactcctccaagtgcctcttgttgctggaaccgtgaaccgaggtagcgaggtcattgctgcaggcatgacagtgaatgactggactgccttctgtggctcagacacaacagctactgagctctctgtcatcgagagcgtcttcaagttgagagaaggtcagcccacagcgattgtcgatgatatgaggaagtcgctgattgacagctatgtctaaaagatcaacggtcatgtggtttggttcttgagtactctaagctgtactcttgacagacattagtgaaaaaaccttcctgtctgagctgttacttctgctctacctttgtcttctgaatttcgaattacaaacttatgctgtgtattggtaaagcttacggtattggaagacatgctctcgctcttgtgatatttaatcctgcaatgctagcgtgggggtcatattgagaaatctggttgcactatcacctttgagatggggtgtagtactag

SEQ ID NO: 2112 - DNA, 1124 bp, Pseudoroegneria spicata
  misc_feature (8)..(8): n is a, c, g, or t
  misc_feature (506)..(506): n is a, c, g, or t
  misc_feature (1099)..(1099): n is a, c, g, or t
ctggacgntgtcgcgcttccaaaccctagctcccaccgcagcggccaccgcctctcgaccccccccccccccctcccggttcgccgcctggctccttctcctgtaccagcgatccctctcccctatccggtcgctcgttgaatcatccgcgcgtttgatctgcaggtgcgtgcttgttactgcagacgagaagcggctgaggcgaagaagaggaatcgaccatggcgacccgtatccagtttgagaacaactgtgaagttggtgttttctccaagctcacaaatgcctactgtctggttgcaattggaggatcagagaatttctacagtacatttgagtctgagcttgcagatgtcattcctgtggtcaagacctctatcggcggcactagaataattggtcgcctctgcgttggaaacaagaatggacttctcttgccacacacaaccactgatcaagagcttcagcatctgaggaactgcatacctgatcaagtggttgttcancgcatcgatgaaaggctgtctgcccttggcaattgcatatcctgcaatgaccatgttgcgctcacacaccctgaccttgacaaggcaactgaggagcttattgcagatgtgcttggggttgaggtgttccgtcagacaattgcaggaaatatccttgttggcagctactgtgcattctctaacaggggtggactggtccatcctcacacatccattgaagatcttgatgagctgtccacactcctccaagtccctcttgttgctggaaccgtgaaccgtggcagtgaggtcattgctgcgggcatgacggtgaacgactggactgccttctgtggctcagacacaaccgctaccgagctctccgtcatcgagagcgtcttcaagttgagagaaggccagcccacggcgatcgtcgatgacatgaggaagtcgctgattgacagctatgtctaaatgatcaaagggcatgcggtgtggttcttgagctgtactcttggttgacagtagcaaaaaaacgtgcctgtctaagctgttacttctgtcttctgaatttgggattacaaacttatgctttgtactagtaaagcttacgntattgggagaagatgtgctcttaca

SEQ ID NO: 2113 - DNA, 1343 bp, Triticum aestivum
ctccgagcggcccgtgctcatataccacgctgccacggctctcccctcgttccccattctctcggaagccgcgctcccaaaccctagctcccaccgcagcggccaccgcctctcgacccccgcccctctcccggtgcgcgcttgttgctgcagacgagaagcggctgaggcgaagaagaggaatcgaccatggcgacccgtatccagtttgagaacaactgtgaagttggtgttttctccaagctcacaaatgcctactgtctggttgcaattggaggatcagagaatttctacagtacatttgagtctgagcttgcagatgtcattcctgtggtcaagacctctatcggtggcactagaataattggtcgcctctgcgttggaaacaagaatggacttctcttgccacacacaaccactgatcaagagcttcagcatctgaggaactgcatacctgatcaagtggttgttcagcgcatcgatgagaggctgtctgcccttggcaattgcatatcctgcaatgaccatgttgcgctcacacaccctgaccttgacaaggcaactgaggagcttattgcagatgtgcttggggttgaggtgttccgtcagacgattgcaggaaatatccttgttggcagctactgtgcattctctaacaggggtggactggtccatcctcacacatccattgaagatcttgatgagctgtccacactcctccaagtccctcttgtcgctggaaccgtgaaccgtggtagcgaggtcattgctgcgggcatgacggtgaacgactggaccgccttctgtggctcagacacaacggctaccgagctgtccgtcatcgagagcgtcttcaagttgagagaaggccagcccacagcgatcgtcgatgacatgaggaagtcgctgattgacagctatgtctaaatgatcaaagggcatgcggtgcggtgtggttcttgagctgtactcttggttgacagtagcaaaaaagcgtgcctgtctaagctgttacttctgtctgtcttctgaatctggaactacaaacttatatgctttgtactcgtaaagcttacggtatcggaagacgtgctcttgcgcttttgtgatattggaatcttataactgcgagtgatgttggttttactatattcgagcattggccaactttggctacatctgcattgacgattcatgtatcaaaagtataatcggcacatgccttttgctcgcttattgtatacgagtacaaaatcattacacacatataacctgccatataacacgacaggcacggatgatgttgtagtccatttgaaacatctaaaaagacttatatttag

SEQ ID NO: 2114 - DNA, 1008 bp, Lolium multiflorum
gcacgccgaaaccctagactcccaccgccgcggccaccgcctctcgatcccctcccggtgcgcgcttgttagtggagaagcggctgctgcgaagagggatcgaccatggcgactcgtattcagtttgagaacaactgtgaagttggtgttttctccaagctgacaaatgcctactgtctggttgcaattggagggtcagagaacttctacagtacatttgagtctgagcttgcagacgtcatccctgtggtcaagacctctatcggcggcactagaataattggtcgactgtgcgttggaaacaagaatggacttctcttgccacatactaccactgatcaagagcttcagcatctgaggaactgcctgcctgatcaagtggttgttcagcgcattgatgaaaggctgtctgcccttggcaactgcatatcctgcaatgaccatgttgcgcttacacaccctgaccttgacaaggcgactgaggagcttattgctgatgtgcttggggttgaggtgttccgtcagacgattgctggaaatatccttgttgggagctactgtgcattctctaacaggggtggattggtccatcctcacacatccattgaagatcttgatgagctgtccacgctcctccaagtcccatggttgctggaaccgtaaccgaggtagcgaggtcattgctgctggcatgactgtgaatgactggactgccttctgtggctcggacacaacggctactgagctctcagtcatcgagagtgtcttcaagttgagagagggacagcccacggcgatcgtcgatgacatgaggaagtcgctgattgacagctatgtctaaagtatcaatggtcaagcctagttcttgagtatcaggtctaagctgtactcttgacagacagtagccaaaaatccttcccgtttgagctgttacttctgctgtacctttgtgtgctgaatttggaattacaaacttatgctgtgtattggtaaagtttatgttattgg

SEQ ID NO: 2115 - DNA, 1048 bp, Leymus cinereus x Leymus triticoides
cttccaaaccctagctcccaccgctgcggccaccgcctctcgccctccctcccggttcgtgcttgttactgtagacgagaagcggctgaggcgaagaggaatcgaccatggcgacccgtatccagtttgagaacaactgtgaagttggtgttttctccaagctcacaaatgcctactgtctggttgcaattggaggatcagagaatttctacagtacatttgagtctgagcttgcagatgtcattcctgtggtcaagacctctatcggtggcactagaataattggtcgcctctgcgttggaaacaagaatggacttctcttgccacacacaaccactgatcaagagcttcagcatctgaggaactgcatacctgatcaagtggttgttcagcgcatcgatgaaaggctgtctgcccttggcaattgcatatcctgcaatgaccatgttgcgctcacacaccctgaccttgacaaggcaactgaggagcttattgcagatgtgcttggggttgaggtgttccgtcagacaattgcaggaaatatccttgttggcagctactgtgcattctctaacaggggtggactggtccatcctcacacatccattgaagatcttgatgagctgtccacactcctccaagttcctcttgtcgctgggaccgtgaaccgtggtagcgaggtcattgctgcaggcatgacagtgaacgactggactgccttctgtggctcagacacaacggctaccgagctgtccgtcatcgagagcgtcttcaagttgagagaagcccagcccacggcgattgtcgatgacatgaggaagtcgctgattgacagctacgtctaaatgatcaaagggcatgcggtgtggttcttgagctgtactcttggctgacagtagcaaaaaaaggtgcctgtctaagctgttacttctgtcttctgaatttggaattacaaacttatgttttgtactggtaaagcttacggtatcgggagatgtgctcttacactttgcgatattaagatcttaactgcgagtatgttggttta

SEQ ID NO: 2116 - DNA, 1582 bp, Oryza sativa
gtccgtctccgcccaagcggtggcggctcatataccgccgcgagagagagaccattcccccccgtctcggcctcggaagtcgcgcgcacccccaaaccctagccgcgcctccacctcccgattcgccgccttttcgttccaggtgtgtgttgattagtagaagagaagcggcggctgcgacgaggcggaatcgaccatggcgacccgtattcagtttgagaacaattgtgaagttggtgttttctccaagttgacaaatgcctattgtcttgttgcaattggaggatcagagaacttctacagtgcctttgaatctgagctcgcagatgttattcctgttgtcaagacctccataggtggtactagaataattggtcgtctctgtgtcggaaacaagaatggacttctcttgcctcacactaccaccgatcaagagcttcagcatctgaggaactgcttgcctgatcaagtggttgttcagcgtattgatgaaaggctatctgcgcttggcaattgtgtagcttgcaatgaccatgtcgcgcttacacaccctgacctcgacaaggccactgaggaacttattgcagatgtgcttggggttgaggtgttccggcagacaattgcaggaaacatccttgtgggaagctactgtgcgattacaaacaggggtggcctagtccatcctcatacatccattgaagatcttgatgagctgtccacgctcctgcaagtccctcttgttgctggaaccgtgaaccgaggcagcgaggtcattgctgcgggcatgacagtgaatgactggactgctttctgtggctcagacactacggctactgagctatcggtcattgagagcgtcttcaagctgagagaagggcagcctgccgcgattgttgatgacatgaggaagtctttgatcgacagttatgtgtaaaagaccaaagttagtgaatgtgtggttgtgggagtattaactgtgctaaaatcgacacaaactgtactcgtgtaatcagtagcagaaacataccgtcctggtggtgaatttctgtcttctgaattacagacttatcttttacctttgtctccttgaagcctacaatatattttgcagcttaagatttattgattgagcaacacagcaaaaattttggctaatatgcgacatttacgttcctgcaaggtgttcttcaggttcaaaacgacttttctcattagttactgcaaaaccattttatgaactcaaatttggcaaacagagtatatgagaagcttacaagaacagcagaacctcacataattcacattacgaaaaggctatcagaacatcagcgaacaagttctcgcaaaacatcactctatagaagtgcacatagaatacagaaatcagcaagctctccttaaagcataactctagcaggccatcgataatgatgtggcattggcaccaagggatggtgctatcgatacactaccaggccagactggcaagttgcttgctttggcattccagaatgcaactcatggctagttccttcagctgttcttccacaacttccatgggaagggagccatcaacaaccta

SEQ ID NO: 2117 - DNA, 1170 bp, Secale cereale
tctcggaagtcgcgcttccaaaccctagctccccaccgcagcggccaccgcctctcgaccccgcccctcccggtgcgcgcttgttgctgcagacgagaagcggctgaggcgaagaagaggaatcgaccatggcgacccgtatccagtttgagaacaactgtgaagttggtgttttctccaagctcacaaatgcctactgtctggttgcaattggaggatcagagaatttctacagtacatttgagtctgagcttgcagatgtcattcctgtgatcaagacctctatcggtggcactagaataattggtcgcctctgcgttggaaacaagaatggacttctcttgccacacacaaccactgatcaagagcttcagcatctgaggaactgcatacctgatcaagtggttgttcagcgcatcgatgaaaggttgtctgcacttggaaattgcatatcctgcaatgaccatgttgcgctcacacaccctgaccttgacaaggcaactgaggagcttattgcagatgtgcttggggttgaggtgttccgtcagacaattgcaggaaatatccttgttggcagctactgtgcattctctaacaggggtggactggtccatcctcacacatccattgaagatcttgatgagctgtccacactcctccaagtccctcttgtcgcaggaaccgtgaaccgtggtagcgaggtcattgctgcgggcatgacggtgaacgactggaccgccttctgtggctcagacaccacggctacggagctgtccgtcatcgagagcgtcttcaagttgagagaaggccagcccacggcgatcgtcgatgacatgaggaagtcgctgattgacagctatgtctaaatgatcaaagggcacgcggtgcggtgtggttcttgagcggtgctcttggctgacagtagcagaaaaaaaacgtgcctgtccaagctgttacttctgtcttctgaatttggaattacaaacttatgctttgtacggtaaagcttacggtatcgctcttgtgttcttgtgacgttaaaaccttaaaacttctagtccagtatatgttggttttatgttcgagcattgaggaaatttggctacatctacgtcgacggttcatgcattgttaaaaaacgtcttgctctgttacataaaaatattcaca

SEQ ID NO: 2118 - DNA, 1088 bp, Secale cereale
gaagtcgcgcttccaaaccctagctccccaccgcagcggccaccgcctctcgacccccgccccctcccggtgcgcgcttgttgctgcagacgagaagcggctgaggcgaagaagaggaatcgaccatggcgacccgtatccagtttgagaacaactgtgaagttggtgttttctccaagctcacaaatgcctactgtctggttgcaattggaggatcagagaatttctacagtacatttgagtctgagcttgcagatgtcattcctgtgatcaagacctctatcggtggcactagaataattggtcgcctctgcgttggaaacaagaatggacttctcttgccacacacaaccactgatcaagagcttcagcatctgaggaactgcatacctgatcaagtggttgttcagcgcatcgatgaaaggttgtctgcacttggaaattgcatatcctgcaatgaccatgttgcgctcacacaccctgaccttgacaaggcaactgaggagcttattgcagatgtgcttggggttgaggtgttccgtcagacaattgcaggaaatatccttgttggcagctactgtgcattctctaacaggggtggactggtccatcctcacacatccattgaagatcttgatgagctgtccacactcctccaagtccctcttgtcgcaggaaccgtgaaccgtggtagcgaggtcattgctgcgggcatgacggtgaacgactggaccgccttctgtggctcagacaccacggctacggagctgtccgtcatcgagagcgtcttcaagttgagagaaggccagcccacggcgatcgtcgatgacatgaggaagtcgctgattgacagctatgtctaaatgatcaaagggcacgcggtgcggtgtggttcttgagcggtgctcttggctgacagtagcagaaaaaaaacgtgcctgtccaagctgttacttctgtcttctgaatttgattacaaacttatgctttgtactggtaaagcctacggtatcggggagatgcgctcttgtgctcttgtgacgttaaaaccttaaaacttttagtccagtatatgttggttttatgtt

SEQ ID NO: 2119 - DNA, 1025 bp, Avena sativa
gatctccgagaaagtcgcgcgccgaaaccctaaactctcaccgccggggccaccgcctcccgatcccctcccggtgcgtgcttgttggttgagaagcagccgctgcgaagaggaatcgaccatggcgacccgtattcagtttgagaacaactgtgaagttggtgttttctctaagctgacaaatgcctactgtctggttgcaatcggaggatcagagaacttctacagtacatttgagtctgagcttgcagatgtcattcctgtggtcaagacctctatcggaggcactagaataattggtcggctgtgcgttggaaacaagaatggacttctcttgccacatactaccactgatcaagagctacagcatctgaggaactgcctgcctgatcaagtggttgttcagcgcattgatgaaaggctgtctgcacttggcaactgcatatcctgcaatgaccatgttgcgctgacacaccctgaccttgacaaggcgactgaggagcttattggtgatgtgcttggggttgaggtgttccgtcagactgttgctggaaatatccttgttgggagctactgtgcattctctaacaggggtggactggtccatcctaacacatccattgaagatcttgatgagctgtccacactcctccaagtgcctcttgttgctggaacagtgaaccgaggtagcgaggtcattgctgcaggcatgacagtgaatgactggactgccttctgtggctcagacacaacagctactgagctctccgtcattgagagcgtcttcaagttgagagaggggcagcccacggcgatcgtcgatgatatgaggaagtcgctgattgacagctatgtctaaaagatggtcatgtggtgtggttcttgagtactctaagctgtaatcttgacagacattagtgaaaaaaccttcctgtctgagctgttacttctgctctacctttgtcttcgaattacaaacttatgctgtgtattggtaaagcttacggtattggaagacatgctct

SEQ ID NO: 2120 - DNA, 1156 bp, Arachis hypogaea
tcaaataccctaacaagcctcgcgctgtcttcttccccgcctctcttccctccataccgcgctttccagctcaggcagcttctcctccggcgccgccgttagttccgtcgtgatcacctcaaaggattcgccaagatcttcaatctggttatttgggtcaaagatctctgttattctcaatcatggcaactagactacagtttgagaataattgtgaagttggagtgttttctaaacttactaatgcctattgtttggttgccataggaggatccgaaaacttctatagtgtgtttgaatctgagttagcagacgtcatccctgtagtcaaaacatccattggtggaactcgaattattggtcgcctttgtgcaggaaacaaaaatgggcttctgctgccccatacaactacagaccaagaacttcaacatttgagaaactgtctgcccgatcaagtagtcgttcagagaatagaagaaagattatctgctctcggaaattgtatagcttgtaatgaccatgtggctctcactcacaccgatcttgacagggagacggaggaaatgattgcagatgttcttggagtagaagttttcaggcagaccattgccggcaatattcttgtcggtagctactgtgccttctccaacagagggggcttggtccaccctcatacttccatagaagacttggatgagctttctacacttcttcaggttcctttggtggctgggacggtgaaccgtggcagtgaagtgatagctgctggaatgacagtgaatgactggacggcattttgcggctcggacaccacagcgacagagctgtctgtgattgagagtgttttcaaactgagggaggcacagcctagtgccattgtggatgagatgagaaaatctctcattgatagctatgtctaaattgtgggttaatattgtgattgtattatctttcctaagatattgcacttttaattgttaaataatcttttcaagttttggtgatagtgactcatgcactgtgaagtgtgaacatatatgttttttttgggtgaactgaacatatatagtttttttttttggtgactgaacatatatatgtttgaatcataaattgtaattttacacattttcgttcaaaaaagaaaaaaacaaaa

SEQ ID NO: 2121 - DNA, 1271 bp, Arachis hypogaea
aatcataaacacccccgccccctcttttctctctccctcacaaacggaaccctagcagcaggagtagccagccccccagtcgcactgttgccgatcctcttcttctggatcccttctcctcgcgtcgccagaaggtcttctctgagctgctcgtgaacccgcctctgtcctcattgtcgtcggccgtcctgaactcgtgtatccgtcctcgtcgtcgagccctctccctctctctctcgtcaagcctctgtcttcgagtctccttctctctgtccgagctcactttccttcctccatcgccgttactttccttcctttcttgccgccattcttagctgcagttgggcaaagatttttctcatctctgtcatggcaactagacttcagtttgagaataattgtgaagttggagtcttctcaaaacttaccaatgcctactgtttggttgccattgggggttccgaaaatttctacagtgcctttgaggctgagttagcagatgttatccctgttgtcaaaacctccattggtggaactcgtatcattggtcgtctttgtgttggaaacaagaatggtcttctcttgccccataccacaacagaccaagaacttcaacatttgaggaatagtttacccgatcaagttgttgttcaacgcgtagatgaaagattatcggctctgggaaattgtatagcatgtaatgaccatgttgccctcgcacacaccgatctcgacaaggaaactgaggagttaattgcagatgttcttggagtagaagttttcaggcaaactatcgcgggcaacattcttgttggcagttactgcgccttatcaaacaggggtggtttggttcacccacatacttcaattgaagacttggatgagctttcgacccttcttcaggtgcccttggtggctgggactgtcaaccgtggcagtgaagtaatagcagccggcatgacagtaaatgactggacagcattttgcgggtcagatacgacggcaacggaactgtccgtgattgagagtgttttcaagctgagagaagcacagcccaatgcaattgcgaatgagatgaggaaatctctcattgatagttatgtatgagtgataaaactgtagccactttgcataccgtagtgttctgcttattttgtgctaaggtattaaagttttggtgatagcttttgtgatatttttctatttttccttttgtggaacaacttggtcatagtgtgtcgtctaaattataaacacttaattcaatcaag

SEQ ID NO: 2122 - DNA, 1292 bp, Cajanus cajan
atgctacacagatatgatattcgaaggccataaaatatcttgttagggaagcattattttgggccttatttacgtgtttttttttttttgaaccttttaaattttaatagtatttttatttatattatgaaattgactaggttcggcggtaccctacactttgttgttgtgttgtgttgctttctcttccgctttgatcctctctctgtccagatattaagctagttactcgggtcaaatatttctagcatctctgtcatggcaactagacttcagtttgagaacaattgtgaagttggagtcttctcaaagcttacaaatgcctactgtttggttgccattggaggttctgaaaacttctacagtgcatttgaggctgagttagcagatgttatcccagtggttaagacctccatcggtggcactcgtattgttggtcgtctttgtgttggaaacaagaatgggcttctcttgccccataccaccacagaccaagagcttcaacatttgagaaacagtctacccgatcaagttgttgttcaacgtatagaagaaagattatctgctctgggaaattgtatagcatgtaatgaccatgtggctctcacacacactgatcttgacagggaaactgaggagatgattgcagatgttcttggagtagaagtttttaggcagacaattgcgggtaatattcttgttggcagttactgtgcattctccaacagaggtggtttggtccaccctcacacttccattgaagacttggatgaactttctacacttcttcaggttcctttagttgccgggaccgtcaatcgtggcagtgaagtaatagctgctggcatgacagtaaatgattggacagcattttgtggatcagacaccacagcaacagagctctctgtgattgagagtgttttcaaactgagagaagcccaacctagtgccattgtggatgagatgagaaaatcactcattgatacttatgtctaaaatttggtcactttttatacgatgtactgcttgttgctaagatctttttgttgtcagttttgcctggtaaacagtttgtgatagtttgtcttctaaaatagaacacatttcaatcaagaatggtggtttccattaattgtatgtgatattttattttaatttttggttaccgtccatagatgaaaaaggctgatatgggtggtttaatgtactctcttggattcggaaatgatttgtaatccattaagtttctttttataagaatcaatttaaaatgactttggcatcaacattaa

SEQ ID NO: 2123 - DNA, 1065 bp, Vigna unguiculata
ggcattccgttcggcggcaccctacactttattgtagtgttgcggtgaccttttctcttccgcgttgatcttctttgcagatattaagttgattacttgggtcaaagtttgatttctggcatctctatcatggcaactagacttcagtttgagaataattgtgaagttggagtcttctcaaaacttaccaatgcctattgtttggttgctattggaggttctgaaaacttctacagtgcatttgagactgaattagcagatgttatccctgtgatcaagacctccattggtggcactcgaatcgttggtcgtctttgtgttggaaacaagaatggccttctcttgccccataccaccacagaccaagagcttcaacatttgagaaacagtctacctgatcaagttgttgttcagcgtatagaagaaagattatccgcactgggaaattgtatagcatgtaatgaccatgttgctctcacccatactgatctagacaaggaaactgaggagatgattgcagatgttcttggagtagaagttttcaggcagactattgcgggtaatattcttgtgggcagttactgtgcattctccaacaggggtggtttggtacaccctcatacttccattgaagacttggatgagctttctacccttcttcaggttcctttggttgctgggactgtcaatcgtggtagtgaagtgatagctgctggcatgacagtaaatgattggacagcattttgtggttcagacaccacagcaacggagctctctgtgattgagagtgttttcaagcttagagaagctcaacctagtgccattgtcgatgagatgaggaaatcactcgttgatagttatgtctaaatttttgtcactagttgacacttgtgccaacagctttcagttttatttcggtttttcctggtaaacagtttggtttttaagatatgaacacatttcaatcagaaatgtggttttcattaattgtttgttttcttttgattcaattttgtggttgtcgtccataaatcaaaggcaatatatgggtggttttacgttaag

SEQ ID NO: 2124 - DNA, 1205 bp, Elaeis guineensis
cttgggtccgattcagagtgggatcgggagctcgaccaattttaaggccctgatgtccggaggagcaaaacctaaatctccaaccaaaccctagaagaagtcctccaaaatactggtgcccaagaagtcgatccggctattttccgctcttcgcaggcttctctcgcgaccccttctggtattttgatcttcgttgctccaccgaagctcgccccttgcgccttcgatcctagtgtttaaatcttgccgatccaattccatcatggcaactcgaattcaatttgagaactcgtgtgaagttggggttttctcgaagctgacaaatgcatactgtttggttgcaattggaggatcagaaaatttttacagtgcatttgaagctgagcttgctgatgttatacctgttgtcaagacctctatagcaggcacaagaataattgggcggctgtgtgctggaaataagaatgggcttctactgccacacacaaccactgaccaagaacttcaacatctgaggaacagcctacctgaccaagtggtggttcagcgtatcgaggaaagactgtctgctttaggcaattgcatagcctgcaatgaccatgttgctcttacacatcctgatctcgacagggaaacggaagagctcattgcagatgttcttggagttgaagtatttaggcagacaattgctggaaacattcttgttggtagttattgtgctttttcaaatagaggcggcttggttcatccacacacatccattgaggatcttgatgaactgtctacgcttcttcaagtcccccttgttgcagggactgtgaacagaggcagcgaggtcattgctgctggtatgactgtgaatgactggactgcattctgtggctcagacaccactgcgactgagctctctgtcgtcgaaagtgttttcaaactgagagaagcccagccaagctcaattgttgatgagatgcggaaatcacttatcgacagctatgtttaggattgtaagattataagtgatttttttgatccaacttaatttgtcttctggccatgctaacattgttttcgtttagtgtttgatgttatgtttcatgtcatgtgtgcagctatgcatgcgctgatgttgtctatgctagttttgccacaccaacccccaccaatatatatatatatatatatatatatatatatatatatagata

SEQ ID NO: 2125 - DNA, 1145 bp, Cajanus cajan
agcccacggcccccgcaggtacaaaacacaataccctaatttctctctccgcctctctctctctctccatttccccttttcgtgtttttagctccgacaatatctccggcgccgcccttatctccgccgtgaccttccatcctaaacgccacaccagatcttcaatttgattacttgggtcaaagatttctgtcattctcaatcatggcaactagacttcagtttgaaaataattgtgaagttggagtgttctctaaacttacaaatgcctactgtttggttgccattggaggttctgaaaacttctacagcgtatttgaatccgagttagcagatgttatccctgtggtcaagacatccattggtggtactcgaattattggccgtctttgtgctggaaacaagaatgggcttctcttgccccataccaccacagaccaagaacttcaacatttaagaaacagtctacctgatcaagttgttgttcagcgaattgatgaaaggttatctgctctgggaaattgtatagcatgtaatgaccatgtggccctcacacacactgatcttgacagggagactgaggagatgattgcagatgttcttggagtagaagttttcaggcagaccattgctggtaatattcttgttggcagctactgtgccttctccaacagaggtggtttggtccaccctcatacttccatagaagacttggatgaactttctacacttcttcaggttcctttggtggctgggactgtgaaccgtggtagtgaagtaattgcggctggaatgactgtcaatgattggacagcattttgtggttctgacaccacagcaacagagctatctgtaattgagagtgttttcaagctcagagaagcccagccaagtgccattgtggatgagatgaggaaatccctcattgatacctatgtctgaactatggtagtattaatagtgttttgttttgtgcaagaagatattgcactgctcattgttaagatctgagttttggtgatagtttgttttgtgtattgttgagatatatgttccaatcatggattgtactcattaaaattgtcaagaacacaaaatatcgtcgctatattataatttttaccctaaattttattgcaactttt

SEQ ID NO: 2126 - DNA, 1314 bp, Musa acuminata
ctttcttgcacatcacgcatcgagagaatctatataacacgttgcgtccgcacgaccacgaatagaaaaccctaaagccgagccgatccgatccaaatcctagtcttggggcgacgcctccgtgcgcattcttttgtgcccaccggcgatctcttggggcttcctatcctcctcgttccttcccaacctcgcgttcccgatcccggattaaggtctttaaaggtgtttgcagccggccgtcatggctactcggattcagtttgagaactcttgcgaagttggagtgttctcaaagctgacaaatgcctactgtttggttgcaattggaggatcagagaacttctacagcatttttgaagctgagttggctgatgttatccctgttgtcaagacatctattggaggcactagaataatcgggcgactttgtgctggcaataagaaaggacttcttttgccgcacaccaccaccgaccaagagctccaacatctgaggaatagtctacctgatcaggtggtggttcagcgaatagatgaaagattgtctgctttaggcaattgcatatcctgcaacgaccatgttgctcttacacaccctgatctggacaaggataccgaagagctcattgctgatgtacttggtgtagaagtattccggcagacggttgctggcaacatactggttggaagttactgtgcgttttcaaacagagggggcctggttcatccgcatacatccatcgaagaccttgatgagctctcaactcttctccaagtacccctggtcgccggaacagtgaatcgaggcagtgaggtcattgctgcaggtatgacagtgaatgactggacagctttctgtggatccgacaccacagcaacagagctctctgtcattgaaagcgtcttcaaactcagggaagcccagccaagctctattgtggatgagatgaggaagtctctcatcgacagttacgtataagatctcgagtttttgggacgtgcaactcttttgtcaccctagttgttgaagatgtatcttcattttcgtcaatatcctcaaaactatttatatgcgagtgcttggttttctttgtaacctagtggagatgttaaggaaatgtcaactatttatctctgatggtttctaattcttaggcttgtttgatttaataagtcggtgatttatgttgacggtatattgtaaatggagaataaatcatgtgcttgaagtatatgataagggaaaagatgtgtagaacttcacgctaaggtttctgtaacttgatagttcaattcgattaaatacaattcatc

SEQ ID NO: 2127 - DNA, 1237 bp, Phaseolus vulgaris
acggtatgcacaactacaaaaacaacacaataccctaatttttctgcctgactctcattacctgttttctgctccggcaacttctcttccggcgccgccgctatttccgccttctaacttcgccgtgaccttctatccctaagcgctgcaccagtgctgtagatcttcaatttgattacttgggtcagatttctgtcattctcaatcatggcaactagacttcagtttgaaaataattgtgaagttggagtcttctctaaacttaccaatgcctactgcttggttgccattggaggctctgaaagcttttacagtgtatttgaaactgagttagctgatgttatccctgtggtcaagacatccataggcggtactcgtattattggtcgtctttgtgctggaaataagaatgggcttctcttgccccataccaccacagatcaagaacttcagcatttgaggaacagtctacctgatcaagttgttgttcagcgtatagacgaaaggttatctgctctggggaattgtatagcatgtaatgaccatgtggccctcacacacactgatcttgacaaggaaactgaagagatgattgcagatgttcttggagtagaagttttcaggcagaccattgcaggcaacattcttgttggtagttactgtgccttctccaataggggtggtttggtccaccctcatacttccatagaagacttggatgagctttcaacacttcttcaggttcctttggtggctgggacagttaaccggggcagtgaagtgatagcagctggaatgacagttaatgattggacagcattttgtggttcagacaccacagcaacagagctatctgtaattgagagtgttttcaagctgagagaagctcagcctagtgccattgtggacgagatgaggaaatccctcgttgatacctatgtgtgaactgtgttagtaataatgttttgttttgtgcaacaagatattgcactgctgattgttaagatgtaagttttggctatagtttgctttggtagtgtggacatatatgttgttcccatctggttgtacttttcattaactgtgatatcatctaatatctggtgatcttcgttatacacagatcaaatgcatgtattttcctgttgactgcttaaatagttgcttgagataactcaaagcacaaatgcatctgttgacagcttaaatagttgtttgagataactcaaagcaatca

SEQ ID NO: 2128 - DNA, 1095 bp, Vigna unguiculata
ccgactctcttaccctgttttcagctccggcaacttctcttccggcgccgccgctacctccgcttttatctttgccgtgaccttccattcctacgcgcttcaatagatcatcaatttgattacttgggtcagatttctgtcattctcaatcatggcaactagacttcagtttgaaaataattgtgaagttggagtcttctctaaacttaccaatgcctactgcttggttgccattggaggttctgaaagcttctacagtgtatttgaagctgagttagctgatgttatccctgtggtcaagacatcaattgggggtactcggattattggtcgtctttgtgccggaaacaagaatgggcttctcttgccccataccaccacagatcaagaacttcaacatttgagaaacagtctacctgatcaagttgttgttcagcgtatagacgaaaggctatctgctctggggaattgtatagcatgtaacgaccatgtggccctgacacacactgatcttgacagggagactgaagagatgattgcagatgttcttggagtagaagttttcaggcagaccatagcaggcaacattcttgttggtagttactgtgccttctccaataggggtggtttggtccaccctcatacttccatagaagacttggatgagctttctacgcttcttcaggttcctttggtggccggaactgttaaccggggcagtgaagtgatagcagctggaatgacagttaatgactggacagcattttgcggttcagacaccactgcaacagagctatctgtaattgagagtgttttcaagctgagagaagctcagcctagtgccattgtggacgagatgaggaaatccctcgttgatacctatgtctgaactgtgttagtaataatgttatgttttgtgcaacaagatattgcactgctgattgttaagatataagttttggcgatagttttgattttgtaatgtggacatatttgttcccatctgtttgtacttttcattaactgtgatatcatgtaatatctggtgatcttcgtgatacacagatcaaatgcatgtgtggctgttattgcgta

SEQ ID NO: 2129 - DNA, 895 bp, Flaveria ramosissima
aacctcctcgtgcacaagatacctttactctctaaacaaatcttcatctgttgcttttctgatggccacaagacttcagtttgagaattcatgtgaaattggggtgttctcaaagctgactaatgcttactgtttggtagcaattggtggttctgaaaatttctacagtacatttgaggctgagctggcagatgttattcctgtggttaagacctccattggtggcacacgaattattggacggctttgcattggtaacaaaaatgggctacttttgcctcataccactaccgaccaagagcttcagcacttgaggaacagtctgcctgatgcagttgtggttcagcgaattgatgagagactatctgcccttggaaattgcatagcatgcaatgaccatgttgcccttacccatactgatcttgacagggaaactgaggaaatgatagcagatgttcttggtgtagaagttttcagacagacaattgctggtaatattcttgtgggcagctactgtgcattttcaaatagaggtggcctggtgcaccctcatacctccattgaagacttggatgagttgtcaaccctgcttcaggttcctttggtggcgggaaccgtgaaccgtggtagtgaagtcatagctgcgggcctaacggttaatgactggaccgcattttgtgggtcagatactaccgctacagaattgtctgtgattgagagtgttttcaagctgagagaagcccagcccagtgccattgttgatgagatgaggaagtcattgattgacacttatgtctgataagtagtaagttggttggttatttgcaagtcagtaataaccaattatggttagtattttgtttgctttgttctgtttttgctactgttttatgtg

SEQ ID NO: 2130 - DNA, 913 bp, Flaveria ramosissima
caaaacttcaattgaagctcaagctttcaccatctacctcgtgcacaagatacctttactctctaaacaaatcttcatctgttgcttttctgatggccacaagacttcagtttgagaattcatgtgaaattggggtgttctcaaagctgactaatgcttactgtttggtagcaattggtggttctgaaaatttctacagtacatttgaggctgagctggcagatgttattcctgtggttaagacctccattggtggcacacgaattattggacgactttgcattggtaacaaaaatgggctacttttgcctcataccactaccgaccaagagcttcagcacttgaggaacagtctgcctgatgcagttgtggttcagcgaattgatgagagactatctgcccttggaaattgcatagcatgcaatgaccatgttgcccttacccatactgatcttgacagggaaactgaggaaatgatagcagatgttcttggtgtagaagttttcagacagacaattgctggtaatattcttgtgggcagctactgtgcattttcaaacagaggtggcctggtgcaccctcatacctccattgaagacttggatgagctgtcaaccctgcttcaggttcctctggtggcaggaacggtgaaccgtggtagtgaagtcatagccgcgggcctaacagttaatgactggaccgcattttgtggatcggatactactgccaccgaattgtctgtgattgagagtgttttcaagctgagagaagctcagcccagtgccattgttgatgagatgaggaagtcattgatcgacacttatgtctgataagttgtaagttgattggttttttacaagtcagtaataaccaattatggttagatttttgtttgttttgttctgtttttgct

SEQ ID NO: 2131 - DNA, 1080 bp, Flaveria ramosissima
aagaagcaggcgtccgacattttaaaccctaaatattcatccaaacctcatattttcaattaaagctcaacgtttcaccgtctaccttctacatcaagatacctttaatctctaaacaaatcttcatctgttgcttttctgatggccacaagacttcagtttgagaactcatgtgaaatcggggtgttctctaagctgactaatgcttactgtttggtagcaattggtggttctgaaaatttctacagtacatttgaggctgagctggcagatgttattcctgtggttaagacctccattggtggcacacgaataattggacgactttgcattggtaacaaaaatgggctacttttgcctcataccactactgaccaagagcttcaacacttgaggaacagtctgcctgatgcagttgtggttcagcgaattgatgagagactatctgcccttggaaattgcatagcttgcaatgaccatgttgcccttacccatactgatcttgacagggaaactgaggaaatgatagcagatgttcttggtgtagaagttttcagacagacgattgctggtaatattcttgtgggcagctactgtgcattttcaaatagaggtggcctggtgcacccacatacctccattgaagacttggatgagctgtcaaccctgcttcaggttcctttggttgcgggaacagtgaatcgtggtagtgaagtgatagctgcgggtctaacggttaacgactggaccgcattttgtgggtctgatactaccgcaacagaattgtctgtgattgaaagtgttttcaagctgagagaagcccaacccattgccattgttgatgagatgaggaagtcattgatagacacttatgtctgataagttgtaagttggttggtttgttacaagtcagtaataaccaattatggttagttgtttgtttgttttgttctgtttttgctactgtttaatgtgataatatgttcaacttgttggaaggtttgaaaattgttaaaatggatgtctttaaagttgtttttaattaaaaagtattaatttataaattggtctactgatcta

SEQ ID NO: 2132 - DNA, 1079 bp, Flaveria ramosissima
caagctttcaccatctacctcgtgcacaagatacctttactctctaaacaaatcttcacctggtgcttttctgatggccacaagacttcagtttgagaactcctgtgaaattggggtgttctccaagctgactaatgcttactgtttggtagcaattggtggttctgaaaatttctacagtacatttgaggccgaactggcagatgttattcctgtggttaagacctccattggtggcacacgaataattggaagactttgcattggtaacaaaaatgggctacttttgcctcataccactactgaccaagagcttcagcacttgaggaacagtcttcctgatgcagttgtggttcagcgaattgatgaaagactatctgcccttggaaactgcattgcatgcaatgatcatgttgcccttacccatactgatcttgacagggaaactgaggaaatgatagcagatgttctaggtgttgaagttttcagacagaccattgctggtaatattcttgtgggcagctactgtgcattttctaacagaggaggcctggtgcaccctcatacctccattgaagacttggatgagctgtcaaccctgcttcaggttcctctggtggcaggaacggtgaaccgtggtagtgaagtcatagctgcgggcctaacagttaatgactggaccgcattttgtgggtcggatactactgcaacagaattgtctgtgattgagagtgttttcaagctgagagaagcccaacccagtgccattgttgatgagatgaggaagtcattgattgacacttatgtctgataagttgtaagttgattggctttttacaagtcagtaataaccaattatggttagatttttgtttgttttgttctgtttttgctactgttttatgtgataatatgttcaacttgttggaaggtttgaaaattgttaaaatggatgcttttaagttgtttttattaaaaactgtttataaatggtcactgatcatttttgacaaaaaaaaaaaagaaaaaaaaaagtaaactctgcgtgtatacactgctactagggcggcgtgggaggg

SEQ ID NO: 2133 - DNA, 1243 bp, Glycine max
acggtacatacaagtacaaaacactaccctaatttctttctgtctctctttagtctttctctttttctctctctccattccgtgttttcagctccggtaacctctccttctccgccgccgttgctatctccgccgtgaccttccatccctcaacgccccacagatcttcaatttgattgcttgggtcaacaatttctgtcattctcaatcatggcaactagacttcagtttgaaaataattgtgaagttggagtcttctctaaactcaccaatgcttactgtttggttgcgattggaggttctgaaagcttctacagtgtatttgaagctgagttagcagatgttatccctgtggtcaagacatccattggtggtactcgtatcattggtcgtctttgtgctggaaacaagaatgggcttctcttgccccataccaccacagaccaagagcttcaacaattgagaaacagtctacctgatcaagttgttgttcagcgaatagatgaaagattatctgctctgggaaattgtatcgcatgtaatgaccatgtggccctcacacacactgatcttgacagggagactgaagagatgattgcagatgttcttggagtagaagttttcaggcagaccattgctggtaatattcttgttggtagttactgtgccttctccaacagaggtggcttggttcaccctcatacttccatagaagacttggatgaactttctacacttcttcaggttcctttggtggctgggaccgtgaaccggggtagtgaagtaatagcggctggaatgacagttaatgattggaccgcattttgtggttccgacaccaccgcaacggagctatctgtgattgagagtgttttcaagctgagagaagcacagcctagtgcaattgtggatgagatgaggaaatccctcattgatacctatgtctgaactgtggtagtaatagtgttttgttttgtgcaatatattgcactgctgattgttaagattttctaatttaagttttggtgatagtttgtcttttgtaatgtgggcatatatattcccatcgtgttgtactcttttttcgttaattgtgatatcatataatatcatgtgctgatttgtgtgaccaacacaaacaaatcaaatttatgtaggggttttcttgcgttccactcgtggtgacgacctcaaaatagccttaggttgattccgaagcaatcaaattctgtcatgttagaac

SEQ ID NO: 2134 - DNA, 1311 bp, Glycine max
aaaaatctcaatttcaattaaatataaataataaataataaatagataaatcaccgtgcagcccacggtacatacaagtacaaaacactaccctaatttctttctgtctctctttagtctttctctttttctctctctccattccgtgttttcagctccggtaacctctccttctccgccgccgttgctatctccgccgtgaccttccatccctcaacgccccacagatcttcaatttgattgcttgggtcaacaatttctgtcattctcaatcatggcaactagacttcagtttgaaaataattgtgaagttggagtcttctctaaactcaccaatgcttactgtttggttgcgattggaggttctgaaagcttctacagtgtatttgaagctgagttagcagatgttatccctgtggtcaagacatccattggtggtactcgtatcattggtcgtctttgtgctggaaacaagaatgggcttctcttgccccataccaccacagaccaagagcttcaacaattgagaaacagtctacctgatcaagttgttgttcagcgaatagatgaaagattatctgctctgggaaattgtatcgcatgtaatgaccatgtggccctcacacacactgatcttgacagggagactgaagagatgattgcagatgttcttggagtagaagttttcaggcagaccattgctggtaatattcttgttggtagttactgtgccttctccaacagaggtggcttggttcaccctcatacttccatagaagacttggatgaactttctacacttcttcaggttcctttggtggctgggaccgtgaaccggggtagtgaagtaatagcggctggaatgacagttaatgattggaccgcattttgtggttccgacaccaccgcaacggagctatctgtgattgagagtgttttcaagctgagagaagcacagcctagtgcaattgtggatgagatgaggaaatccctcattgatacctatgtctgaactgtggtagtaatagtgttttgttttgtgcaatatattgcactgctgattgttaagattttctaatttaagttttggtgatagtttgtcttttgtaatgtgggcatatatattcccatcgtgttgtactcttttttcgttaattgtgatatcatataatatcatgtgctgatttgtgtgaccaacacaaacaaatcaaatttatgtaggggttttcttgcgttccactcgtggtgacgacctcaaaatagccttaggttgattccgaagcaatcaaattctgtcatgttagaacaagt

SEQ ID NO: 2135 - DNA, 1282 bp, Glycine max
acggtacagtcaagtacaaaacgcaataccctaatttgtttctctgtctctgtctctgtctctctctccattcgtgctttcagctccggcaacctctcttccggcgccgccgctatctcggccgcgcaccagttattcttctcttcatatcttcaatttgattacttgggtcaacgatttctgtcattctcaatcatggcaactagacttcagtttgaaaataattgtgaagttggagtcttctctaaacttaccaatgcctactgtttggttgccattggtggttctgaaagcttctacagtgtatttgaagccgagttagcaggtgttatccctgtggtcaagacatccattggcggtactcgtattattggtcgtctttgtgctggtaacaagaatgggcttctcttgccccataccaccacagaccaagaacttcaacatttgagaaacagtctacctgatcaagttgttgttcagcgaatagacgaaaggttatctgctctgggaaattgtatagcatgtaatgaccatgtggccctcacacacactgatcttgacagggagactgaagagatgattgcagatgttcttggagtagaagttttcaggcagaccattgctggcaatattcttgttggtagttactgtgccttctccaatagaggtggcttggttcaccctcatacttccatagaagacttggatgaactttctacacttcttcaggttcctttggtggctgggaccgtgaaccggggtagtgaagtaatagcagctggaatgacagttaatgattggactgcattttgtggttccgacaccacagcaacagagctatctgtaatcgagagtgttttcaagctgagagaagcgcagcctagcgcaattgtggatgagatgaggaaatctctcattgatacctatgtctgaactgtggtagtaatagtgttttgttttatgcaagatattgcactgctcattgttgagatcttctaagttaagttttggtgatagtttctgttgttgtgtgggcatatatgttcccatcatgttgtgctcttttccttagttgtgatatcgtataatatcaggtgctgatttttgttaccaacaaatcaaatgcatgtaagggtgctcttgcgttccactcatggtgacggcctaaataatagccttaggttgattcgaagcaatcaaattttgtcacgttaagaaaaatttcttacatttcttgatgtataaattctgcattttttaactctttgaaagaaagaaaaaa

SEQ ID NO: 2136 - DNA, 1267 bp, Glycine max
aagtacaaaacgcaataccctaatttgtttctctgtctctgtctctgtctctctctccattcgtgctttcagctccggcaacctctcttccggcgccgccgctatctcggccgcgcaccagatcttcaatttgattacttgggtcaacgatttctgtcattctcaatcatggcaactagacttcagtttgaaaataattgtgaagttggagtcttctctaaacttaccaatgcctactgtttggttgccattggtggttctgaaagcttctacagtgtatttgaagccgagttagcaggtgttatccctgtggtcaagacatccattggcggtactcgtattattggtcgtctttgtgctggtaacaagaatgggcttctcttgccccataccaccacagaccaagaacttcaacatttgagaaacagtctacctgatcaagttgttgttcagcgaatagacgaaaggttatctgctctgggaaattgtatagcatgtaatgaccatgtggccctcacacacactgatcttgacagggagactgaagagatgattgcagatgttcttggagtagaagttttcaggcagaccattgctggcaatattcttgttggtagttactgtgccttctccaatagaggtggcttggttcaccctcatacttccatagaagacttggatgaactttctacacttcttcaggttcctttggtggctgggaccgtgaaccggggtagtgaagtaatagcagctggaatgacagttaatgattggactgcattttgtggttccgacaccacagcaacagagctatctgtaatcgagagtgttttcaagctgagagaagcgcagcctagcgcaattgtggatgagatgaggaaatctctcattgatacctatgtctgaactgtggtagtaatagtgttttgttttatgcaagatattgcactgctcattgttgagatcttctaagttaagttttggtgatagtttctgttgttgtgtgggcatatatgttcccatcatgttgtgctcttttccttagttgtgatatcgtataatatcaggtgctgatttttgttaccaacaaatcaaatgcatgtaagggtgctcttgcgttccactcatggtgacggcctaaataatagccttaggttgattcgaagcaatcaaattttgtcacgttaagaaaaatttcttacatttcttgatgtataaattctgcattttttaactctttgaaagaaagaaaaaaaaactgtttaaa

SEQ ID NO: 2137 - DNA, 1244 bp, Glycine max
atgaaattgacttctttgggttcggcggtaccctacacttagttgttgtgttgctgtgcacccggtgagcggtgacctcttccgctttgatcttcttctgtccaggtgttgggaaatgaggtggaggagttgaaccttttgcatgtgcatgaagcttgatgcttattcgtatattagaactagatagccaatacaagtttgttacttgagttgtagcttgttggattggtcacttgttctatgttgcttgcaaaaatcaaaggggtattttgcagcttactggttacttgggtcaaagatttctggcatctctgtcatggcaactagacttcagtttgagaataattgtgaagttggagtcttctcaaaacttaccaatgcctattgtttggttgctattggaggttccgaaaacttctacagtgcatttgaggctgagttagcagatgttatccctgtggtcaagacctccattggtggcactcgtattgttggtcgtctttgtgttggaaacaagaacgggcttctcttgccccataccatcacagaccaagagcttcaacatttgagaaacagtctacctgatcaagttgttgttcagcgtatagaagaaagattatccgctctgggaaattgtatagcatgtaatgaccatgtggccctcacacacactgatcttgacaaggaaactgaggagatgattgcagatgttctgggagtagaagttttcaggcagacagttgccggtaatattcttgtgggcagttactgtgtattctccaacagaggtggtttggtccaccctcatacttccatcgaagacttggatgaactttctacacttcttcaggttcctttggttgccgggactgtcaatcgtggtagcgaagtaatagctgctgggatgacggtaaatgattggacagcattttgtggttcagacaccacagcaacagagctctctgtgattgagagtgttttcaagctgagagaagcccaacccagcgccattgtcgatgagatgaggaaatcactcattgatacttatgtctaaatattgctcatgttctactgcttgttgctaagatattccagttttgtgtcagtttttcccggtgaacagtttgtgatagttttatcatctaaaatatgaatgtttatttcaatcaagaatcatggtttccattaattgtatgtcatcttttatttcaatcaaagatatggatgcttttacgttacatgga

SEQ ID NO: 2138 - DNA, 1255 bp, Glycine max
tccgatattcgaaggccgtaataaaatatctagttagggaaccaatggttttacgtattttttttctaaggaaccttttcatttttcaatagtatttatatttaagtttttaataattgcattatgaaattgacttctttgggttcggcggtaccctacacttagttgttgtgttgctgtgcacccggtgagcggtgacctcttccgctttgatcttcttctgtccaggctggttacttgggtcaaagatttctggcatctctgtcatggcaactagacttcagtttgagaataattgtgaagttggagtcttctcaaaacttaccaatgcctattgtttggttgctattggaggttccgaaaacttctacagtgcatttgaggctgagttagcagatgttatccctgtggtcaagacctccattggtggcactcgtattgttggtcgtctttgtgttggaaacaagaacgggcttctcttgccccataccatcacagaccaagagcttcaacatttgagaaacagtctacctgatcaagttgttgttcagcgtatagaagaaagattatccgctctgggaaattgtatagcatgtaatgaccatgtggccctcacacacactgatcttgacaaggaaactgaggagatgattgcagatgttctgggagtagaagttttcaggcagacagttgccggtaatattcttgtgggcagttactgtgtattctccaacagaggtggtttggtccaccctcatacttccatcgaagacttggatgaactttctacacttcttcaggttcctttggttgccgggactgtcaatcgtggtagcgaagtaatagctgctgggatgacggtaaatgattggacagcattttgtggttcagacaccacagcaacagagctctctgtgattgagagtgttttcaagctgagagaagcccaacccagcgccattgtcgatgagatgaggaaatcactcattgatacttatgtctaaatattgctcatgttctactgcttgttgctaagatattccagttttgtgtcagtttttcccggtgaacagtttgtgatagttttatcatctaaaatatgaatgtttatttcaatcaagaatcatggtttccattaattgtatgtcatcttttatttcaatcaaagatatggatgcttttacgttacatggactcactttgcttcgtaaatttgtattttttttgttttatcttttgaaaagttaatatttaa

SEQ ID NO: 2139 - DNA, 1156 bp, Phaseolus vulgaris
aaagcatatttgtatcatgaaattggttcctttccgttcggcggcaccctacagtgtgctgtagttttgcggtgacctcttctcttccgcattgaacttctgtgcagatattaagctgattacttgggtcaaagtttgatttctggcttctctctgtcatggcaactagacttcagtttgagaataattgtgaagttggagtcttctcaaaacttaccaatgcctattgtttagttgctattggaggttctgaaaacttctacagtgcatttgagactgagttagcagatattatccctgtgatcaagacctccattggtggcacccgtattgttggtcgtctttgtgttggaaacaagaatggccttctcttgccccataccaccacagaccaagagcttcaacatttgagaaacagtctacctgatcaagttgttgttcagcgtatagaagaaagattatctgcattgggaaattgtatagcatgtaatgaccatgtggctctcacccatactgatcttgacaaggaaactgaggagatggtcgcagatgttcttggagtagaagttttcaggcagactattgcgggtaatattcttgttggcagttactgtgcattctccaacaggggtggtttggtccaccctcatacttccattgaagacttggatgaactttctacccttcttcaggttcctttagttgctgggactgtcaatcgtggtagtgaagtgatagctgctggtatgacagtaaatgattggacagcattttgtggttcagacaccacagcaaccgagctctctgtgattgagagtgtttttaagctgagagaagctcaacctagtgccattgtcgatgagatgaggaaatcactcgttgatacttacgtctaaattttcgtcgctcgttgatacttgtgccaacatatttcagttctgtctcagttttttcctggtaaacaattttgatttctaaaatatgaaaacatttcaatcagaattttggtttccattaattctatgtcgtcttttaattcaattttgtggttgtggtccataaatcaaatgcaatatatggctgattttacgttacatggaatcctttggcttcataaataatttctattcagtaaagagattgatataactctcat

SEQ ID NO: 2140 - DNA, 1029 bp, Cirsium arvense
tcagctcctatcttcactttgccaccaaaccctagctgcatcccactctatcgtcgcccccaaagccatctgctcgccggccatctgagtctccggtcaccaggcgtcgtctccgaccaccaaagcccttctccaaccaccagccaacgtcgccggccaccaacgtccttctccatactttttctctctgtaaatatccatctgctgcgtttctccacaatggccacaagacttcagtttgagaattcatgtgaaattggagtgttttcaaagctaacaaatgcttattgcttggtagcaattggagggtctgaaaacttttacagtacatttgagtccgaattagcagacgttattcctgtggttaagacctctattggtggtacaagaataattggaaggctttgcattggtaacaagaatgggcttcttttgcctcatactactactgaccaagagcttcaacacttgaggaacagtctgcccgatgcagttgtcgtccagcgtattgatgagagactatctgcccttggaaattgcatagcgtgcaatgaccatgttgcccttacccacaccgatcttgatagggaaaccgaagaaatgatagccgatgttcttggtgtcgaagtattcaggcaaacaattgctggtaacattcttgttggcagctactgtgcgttttcaaatagaggtggtctggttcatccacatacctctattgaagatttggatgaattgtcaaccctcctacaagtacctttagtggcgggcacagtgaatcgtggtagtgaagtgatagctgccggcataactgtcaacgattggactgctttttgtggttcagacactactgcaaccgagttatctgtgattgagagtgttttcaagttgcgagaagcccaaccgagtgccattgtggacgagatgaggaagtctttgatcgatacctacgtttgattatgattaacgggcgaactccacaataactatgtggttgcttgttttttagctttatttaaaggacgaaaa

SEQ ID NO: 2141 - DNA, 1083 bp, Cirsium arvense
aaccaatcttctgccctctagcgtctctcaatcgatctgctgccttttgacttgtgttatctgtatcgaatcagatactgtttctctctataagcaaattttcgtctgctgcatttctctacaatggccacaagacttcagtttgagaattcatgtgaaattggggtgttttcaaagctgacaaatgcttactgccttgtagccattggagggtctgaaaatttctacagcacatttgagtccgaattagcagacgttattcccgtggttaagacctccattggtggtacgagaataattggaaggctttgcattggtaacaaaaatgggcttcttttgcctcatactactactgaccaagagcttcaacacttgaggaacagtctgcctgatgcagttgtcgttcagcgtattgatgagagactatctgcccttggaaattgcatagcgtgcaatgaccatgttgcccttacccatactgatcttgatagggaaacagaagaaatgatagccgatgttcttggtgttgaagttttcagacagacaattgctggtaatattctcgtgggcagctactgtgcgttttcaaatagaggtggtctggttcacccgcatacctctattgaagatttggatgaattgtcgacccttcttcaagtacctttagtggcgggcacggttaatcgtggtagtgaagtgatagctgccggcataacggtcaatgattggacggctttttgcggttcagacactactgcaaccgagctgtctgtgatcgagagtgttttcaagttgcgagaagcccaaccgagtgccatcgtggatgagatgaggaagtctttgatcgatacttatgtttgatatcgttgaatgggcatacttcataataactatggttactgcttttttagctttctaaattaaggatgaaagtttgtacctttttttactttattttatagctttgtttttatgtttgtttttgctactttttagttattattatacatgcatttcagttttgggttgtaatgaaatgtatggtttgattggtaatggtattcataattgtttaaaaaagaa

SEQ ID NO: 2142 - DNA, 946 bp, Coffea canephora
aaaagctctcaccgtttggattctttattttgatttggtcataagccccaaccctaaaaccctaatcagagtttactgttctcgttgattagcgtctactcaacgttcaaatcattctcccagcaaatcccttttagatctaatatcgagtaggtgtttatatttgtttgatatccttggaatcatggctaccagattgcaatttgagaattcatgcgaagttggagttttttctaagttgaccaatgcttattgcttggtcgccattggaggttctgagaacttctacagtacgtttgaggcagaattggctgatgcaattccggtagtgaagaccgcgattggtggcactaggatcattggaagactttgtgctggaaacaagaatgggcttctcttaccgcatactaccaccgatcaagaacttcagcatttgaggaatagtctaccagattcagttgttgttcagcgcactgatgagagactttctgcattgggaaactgcattgcctgcaacgatcatgttgcacttacacacaccgatctcgacagggaaactgaggagatgattgcagatgttcttggagtagaagtttttagacagacaattgctggaaatattttggtgggcagctattgtgcattttcaaataggggtggcctggtgcatcctcacacgtccatagaggacctagatgaactctctacgctcctacaggttccactggtggcagggacagtgaatcgtggtagtgaagtaatcgctgctggcctgacagttaatgactggacagccttttgtggatctgacactaccgcaacagaattgtctgttatagagagcgttttcaagttaagagaagctcaacctagtgccattgttgatgagatgaggaagtcattgattgacagctatgtatgagctgcatgcccaagctgagtgtat

SEQ ID NO: 2143 - DNA, 938 bp, Taraxacum officinale
cttatgtttattaacggaagggtttatctttcaagcaaacccttgttcgctttctccatctttgcagccgacacgcaattctctatctccgtctccacatcgccgttctcctcgactgtgtcttcttcagctctcaaagatacttcttctgtttaggcaaatattcctctgctgcttttctgatggccacaagacttcagtttgagaacaattgtgaaattggggttttctcaaaattaacaaatgcttactgcttggtagcaattggaggctctgaaaacttttacagtacattcgagtccgagttagcagatgttattcctgtggttaagacctccattggtggcacaagaataatcggaaggctttgcattggtaacaaaaacgggcttcttttgcctcatactactacggaccaagagcttcaacacttgagaaacagtctacctgatgcggttgttgttcagcgaattgacgagagactttccgcccttggaaattgcatcgcgtgtaatgaccatgttgccctcacccatactgatctcgaccgggaaaccgaagaattgatagcggatgttctcggtgtagaagttttccgccaaacaattgctggaaatgttctcgtgggcagctactgtgccttttcaaatcgaggcggtctggtgcacccacatacatcaattgaagacttggatgagctgtcgacccttcttcaagtcccgttggtggctggcacggttaaccgtggaagtgaagtgattgcagccgggttaaccgtgaacgactggaccgcgttctgtggttcggacaccacggctacagagttgtcggtgatcgagagtgtgtttaagctcagagaagcgcaaccgagtgccattgttgatgaaatgaggaagtctttgatcgatacttacgtctgaatggttacagacgtactt

SEQ ID NO: 2144 - DNA, 1187 bp, Lactuca sativa
aaactcccaacaagcattactatattcgtttcggttaaaaccctaaataccaaaaccctaattggagacgcacaattgaaacccagccccatactggtttctcgctgaatttttcaatacaaccttcagctttctccatctcaatcgtatatccagatacttcttctttctaagcaaatttccatctgctgttattcagatggccacaagacttcagtttgagaactcatgtgaaattggggtgttctcaaaattaacaaatgcttattgcttggtagcaattggagggtctgaaaacttttacagcacatttgaatctgagttagcagatgttattcctgtggttaagacctccattggtggcacaagaataattggaaggctctgcgttggtaacaaaaacgggcttcttttacctcatactactactgaccaagagcttcaacacttgagaaacagtctacccgatgcggttgttgtccaacgcattgacgaaagactatccgcccttggaaattgcatagcgtgcaatgaccatgttgcccttgtccacactgatctcgacagggaaaccgaagaaatgatcgccgatgttctcggtgtcgaagttttccgccaaacaatcgccggaaacatcctcgttggcagctactgcgcgttttccaacagaggtggcttggtgcaccctcatacttccattgaagacttggatgagctttcgactcttcttcaagtcccgttggtggctggcacggttaaccgtggcagtgaagtgattgccgccgggttaaccgtgaacgactggaccgcgttctgcggttcggacaccacggctacggaactgtcggtgattgaaagtgtgtttaagctgagagaagctcaaccgagtgctattgttgatgaaatgaggaagtctttgattgatacctatgtctgatgtctgaatacttacagacttatatgcttgctttttcttcttttttggacttttggtttatccctttttgttacattgttacaatggaactgatgtgtttttggttatttattttgtatcttttaattggtaaagtcttaattgtctttttactaaatgtaagcaattattaaatgttttttttttctcgctctttttaagttaactagtttaattatctgtgtatcaagaatgttgtatgaagttctca

SEQ ID NO: 2145 - DNA, 1059 bp, Platanus occidentalis
agccttaaactaacgcgatccggtggtatttgctagagttcctcgaaaatcgttgcaggtcttgtggtaattggtgttgttcatcctttcattatggcaactcgacttcagtttgagaactcctgtgatattggggttttctccaagttgaccaatgcatactgtcttgttgcaattggaggatcagaaaacttttacagcacatttgaagctgagctggctgatgttattcctgtggttaagacgtccataggaggcactaggattattgggcggctatgtgctggaaacaagaaagggcttctcttgccacacactaccactgaccaagagcttcaacacatacggaacagtttacccgatcatgttgtggttcaacgcattgacgagagactatccgctttgggaaattgcatagcttgcaatgaccatgttgctctcacacatactgatcttgacaaggaaactgaggagatggtagcagatgttttgggagtagaagttttcaggcagacaattgcaggaaacattcttgtgggtagttactgtgccttttccaacagaggcggattggtccacccccacacatccattgaagacttagacgagctttctacactccttcaagtccctctggtggctgggactgtaaatcgaggaagtgaagtcattgctgctggtatgacagtcaatgactggacagcattctgtgggtcagacaccacagcaacagagctttcagttattgagagtgtcttcaagttaagggaagcccaacctagtgccatcgttgatgagatgagaaaatcgttaatcgacagctatgtctgagttacttttgttgaggttttccccaaggtattaactatatacaaagatgccttttaattattgttgcaagtctttacagttttggcgtcttatagattgcctcatgtaagttatattgtggacccctaatatacatacggatgaaccctggttatttttgttggaaaaaaaaaggttgaacattttgatgtttactggagcgggacagaatacatgcaaaagcatttt

SEQ ID NO: 2146 - DNA, 1169 bp, Centaurea maculosa
ttacaaggaaggtttcaaaagtcagctcctgtcttcactttgccaccaaaccctagctgcatcccactctatcgtcgcccccaaagccatctgctcgccggccatctgagtctccggtcaccaggcgtcgtctccgaccaccaaagcccttctccggccaccaacgtccttctccatactttttctctctgtaaatatccatctgctgcgtttctccacaatggccacaagacttcagtttgagaattcatgtgaaattggagtgttttcaaagctaacaaatgcttattgcttggtagcaattggagggtctgaaaacttttacagtacatttgagtccgaattagcagacgttattcctgtggttaagacctctattggtggtacaagaataattggaaggctttgcattggtaacaagaatgggcttcttttgcctcatactactactgaccaagagcttcaacacttgaggaacagtctgcccgatgcagttgtcgtccagcgtattgatgagagactatctgcccttggaaattgcatagcgtgcaatgaccatgttgcccttacccacaccgatcttgatagggaaaccgaagaaatgatagccgatgttcttggtgtcgaagtattcaggcaaacaattgctggtaacattcttgttggcagctactgtgcgttttcaaatagaggtggtctggttcatccacatacctctattgaagatttggatgaattgtcaaccctcctacaagtacctttagtggcgggcacagtgaatcgtggtagtgaagtgatagctgccggcataacggtcaacgattggactgctttttgtggttcagacactactgcaaccgagttatctgtgattgagagtgttttcaagttgcgagaagcccaaccgagtgccattgtggacgagatgaggaagtctttgatcgatacctacgtttgattatgattaacgggcgaactccacaataactatgtggttgcttgtttttttagctttatttaaaggacgaaaagtcgacttttttactttaagcttgttttgtgtttgtttttgttactttttagtgtttatacatgcatttcagttttgggttgtaatgaaatgtatgctttgattggtaatggtatccaaaactatttaatgttaggct

SEQ ID NO: 2147 - DNA, 1046 bp, Centaurea maculosa
gttcttcgacttcaccattgcagctctctctactcgaagactattcagatactttttctctctgtaagcaaatattcatctgctgcttttctccacaatggccacaagacttcagtttgagaattcatgtgaaatcggagtgttctcaaagctaacaaatgcttattgcttggtagcaattggagggtctgaaaacttttacagtacatttgagtctgaattagcagacgttattcctgtggttaagacctccattggtggtacaagaataattggaaggctttgcattggtaacaaaaatgggcttcttttgcctcatactactaccgaccaagagcttcaacacttgaggaacagtctaccggatgcagttgtcgttcagcgtattgatgagagactatctgcccttggaaattgtatagcatgcaatgaccatgttgcccttacccataccgatcttgatagggaaaccgaagaaatgatagccgatgttcttggtgtggaagttttcaggcaaacaattgctggcaatattcttgtcggcagctactgcgcgttttcaaatagaggtggtctggttcacccacatacctctattgaagatttggatgaattgtcaaccctccttcaagtgcctttagtggcgggcacggtgaatcgtggtagtgaagtgatagctgctggcataacggtcaatgattggactgctttttgtggttcagacactactgcaaccgagttatctgtgatcgagagtgttttcaagttgcgagaagcccaaccaagtgccattgtggacgagatgaggaagtctttgatcgatacctacgtttaattatgatcaactggcgaactccacaataaccatgtggttacctgttttttagctttgtttaagggatgaaagttgactttttttttactttaagcttgttttatgtttgtttttgttactttttagtgttcacatatgcatttcagttttgggttgtaatgaaatgtatgttttgattggtaatggtattcaaaactatttaagttggaac

SEQ ID NO: 2148 - DNA, 884 bp, Centaurea maculosa
agctttttccgtcaagctctcattcagtcgctattcagatactttttcactctgtaagcaaatatccatctgctgcatttctccacaatggccacaagacttcagtttgagaattcatgtgaaatcggagtgttctcaaagctaacaaatgcttattgcctggtagcaattggagggtctgaaaacttttacagtacatttgagtccgaattagcagacgttattcctgtggttaagacctccattggtggtacaagaataattggaaggctttgcattggtaacaaaaatgggcttcttttgcctcatactactaccgaccaagagcttcaacacttgaggaacagtctgcccgatgcagttgtcgttcagcgtattgatgagagactatctgcccttggaaactgcatagcgtgcaatgaccatgttgcccttacccataccgatcttgatagggaaaccgaagaaatgatagccgatgttcttggtgtcgaggttttcaggcaaaaacaattgctggcaatattctcgtcggcagctactgtgcgttttcaaatagaggtggtctggttcacccacatacctctattgaagatttggatgaattgtcaaccctccttcaagtgcctttagtggcgggcacggtgaatcgtggtagtgaagtgatagctgccggcataaccgtcaatgattggactgccttttgtggttcagacactactgcaaccgagttatctgtgatcgagagtgttttcaagttgcgagaagcccaaccgagtgccattgtggacgagatgaggaagtctttgatcgatacctacgtttgattatgatcaacgggcggactccacaattactatgtggttacttgttttttagctttg

SEQ ID NO: 2149 - DNA, 1061 bp, Ambrosia trifida
ctctaaataaattttgattgaaagctcctacaccaagattcttgtgtctttaaacaaatcttcatctgctgcttttctgatggctacaagacttcagtttgagaattcatgcgaaattggggtgttctcaaagctgactaatgcttactgtttggtagcaattggtggttctgaaaatttttacagtacatttgaggccgagctagctgatgttattcctgtggttaaaacctccattggtggcacacgtataattggccgactttgcattggtaacaaaaatggcctacttttacctcacaccactaccgaccaagaacttcaacacttgaggaacagtctgccagatgcagttgtggttcagcgaattgatgagagactatctgcccttggaaattgcatagcatgcaatgaccatgttgcccttacccataccgatcttgacagagaaaccgaggaaatgatagctgatgttctcggtgttgaagtttttagacagacaattgctggaaatattcttgtgggcagctactgtgcattttcaaatagaggtggcatggtgcatcctcatacctctattgaagacctggatgagctatcaaccctgcttcaggttcctttagtagctggaacagtgaaccgtggtagtgaagtaatagcggcaggcctaacggttaatgactggactgcatttgcgggtcagataccactgcgacagaattgtctgtgattgagagtgttttcaagctgagagaagcccaacccagtgccattgtggatgagatgaggaaatctttgatcgacacttacgtttgataagtttttaagtttgttattgctactgtttttatgtgataaattgttttaagctgttggaagtttttgaatattgttaaaacgaacacatttatttagattgttctattacaaaagttgtataaatggtcaacgatcattttaacattagtctaaatatgagataaaaatgacaagtgtatgtcttgtgaccatttatatctggatcgaaccgacatgacaaattaatcgacattaatacagtc

SEQ ID NO: 2150 - DNA, 1438 bp, Prunus mume
atggaagaaaatataattagcctgactttggttttattgggtgccctacttatacacataaaaaaccctaattttcctcctccctccaaaaccctagctcataacaaactcatacctcaggcgttccttgaatccatggctaccaggttgcaattcgagaactcgtgcgaggttggggtgttctcgaagctgacgaatgcctactgtttggtttccatcggaggctctgagaatttctacagcacattcgaggccgagttggcagatgtcatccctgtcgttaaaacctccattggcggcactcgcatcattggccgcctctgtgctggaaacaaaaacgggcttcttttgcctcacacgaccacagaccaagaactccagcacttgaggaacagtttacctgatcatgttgttgttcagcgcattgaagagagactatctgctcttggaaactgtattgcttgcaatgatcatgttgctcttacacacactgatcttgacagagaaactgaggagatgatcgcagatgtacttggcgtggaagtttttaggcagacaattgctggtaatatccttgtgggcagttactgtgccttcaccaacagaggtggcatggttcatccccacacatctgttgaagacttggacgagctttcaacgcttctacaggttcctctggttgctggaacagtcaatcgtggcagtgaagtgatagctgcaggcatgacggtgaatgactggacagcattctgtggatcagacaccactgccacagaactctcagttattgaaagtgttttcaagttgagggaagctcaacctagtgccattgtggatgaaatgaggaaatcattgattgacagctatgtctgagcaaaatatctgtgctagtcccatgaataggtgctgttttctttcttgttaattgttttaaaacaaaatatctttttaaattcttaatcataagaattctggtgttgccaagttgtataattatgttgccaagctgtacaatttgttataacaaatgtgttttgcctcttttcttcccaaaagtatcatgtttttagtttgttttcatcctgcttgtaggagttggttcctagttgcttgaatgcattggatggtttggaattgtgtgtaatggtctgaaaccaatccaaatcagtcttgacttgaaaagtagtggatttggtttatctgggctaattatgttcttatcttaggttcaatgtgatcagttggatcatatgtgctattatctgtttgctttccagtggtaaatagatctacaaggagaaagcctgtccaaaccatcatcaagattcttgcactagtattttccccccattcaggacttcagatttcttgcattgtgcatcatgttgtagcttctttttgaactctgtacatgaggtttcagggccactagatgtct

SEQ ID NO: 2151 - DNA, 1056 bp, Ambrosia trifida
atacatatacaccaagatacatcttctcctaaagtcaaattttcatccgctgcttctctgatggccacaagacttcagtttgagaattcatgtgaaattggtgtgttctcaaagctaacaaatgcatactgtttggtagcaattggtggctctgaaaatttctacagcacatttgagtctgaactagcagacgttattcctgtggttaagacctccattggtggcacaagaataattggacgtctttgcattggtaacaaaaatgggcttcttttgcctcatactactaccgaccaagagcttcaacacttgagaaatagtctgcccgatgcagttgtggttcaacgcattgatgaaagactatctgcccttggaaattgcatagcatgcaatgaccatgtcgcccttactcatactgatcttgatagggaaaccgaggaaatgatagctgatgttcttggtgtagaagttttcaggcagacaattgctggtaatatacttgtgggcagctattgtgccttttcaaatagaggtggcatggtgcatcctcatacttctattgaagacttggatgagttgtcaaccctgcttcaggttccgttggtggcggggaccgtgaaccgtggtagcgaagtgattgctgcaggtctaactgttaatgattggaccgcgttttgcggttcagatactaccgcaacagaattgtctgtgattgagagtgttttcaagctgagagaagcccagcctagtgccattgtggatgagatgaggaagtcattgatcgatacctatgtctgataagtttcatgttagttgttgattataagtcaacagtgtttttttcctttaagttttcatcttgttttatgtttctttttgcttctatttttatgataggaacttgttggaaggattgaaagttatttaattgcacacttctaaattgtaatgttcagggctgcatctgagaatagcacaaaagggtctggtagataaatattgacaatgtagatatgtataaaagaagttataattatgtctttcgagaaaaaagaa

SEQ ID NO: 2152 - DNA, 832 bp, Ambrosia trifida
aattgaagctcatacatatacaccaagatacatcttctcctaaagtcaaattttcatccgctgcttctctgatggccacaagacttcagtttgagaattcatgtgaaattggtgtgttctcaaagctaacaaatgcatactgtttggtagcaatcggtggttctgaaaatttctacagcacgtttgagtctgaactagcagacgttattcctgtggttaagacctccattggtggcacaagaataattggacgtctttgcattggtaacaaaaatggacttcttttgcctcatactactaccgaccaagagcttcaacacttgagaaatagtctgcccgatgcagtcgtggttcaacgcattgatgaaagactatctgcccttggaaattgcatagcctgcaatgaccatgtcgcccttactcatactgatcttgatagggaaactgaagaaatgatagctgatgttcttggcgtagaagtttttaggcagacaattgctggtaatatacttgtgggcagctattgtgccttttcgaatagaggtggcatggtgcatcctcatacttctattgaagacttggatgagttgtcaaccctgcttcaggttccgttggtggcggggaccgtgaaccgtggtagcgaagtgattgctgcaggtctaacggttaatgattggactgcgttttgtggttcagacactaccgcgacagaattgtctgtgattgagagtgttttcaagctgagagaagcccagcctagtgccattgtggatgagatgaggaagtcattgattgatacctatgtctgataagtagttgattacaagtcaaa

SEQ ID NO: 2153 - DNA, 900 bp, Arnica chamissonis
acatccattgaaaggcagctcgctgaagatttcaattgaagctctagtctttcccgtcgatctcgttcatcaagatcccttttctctttaagacaattttcattcgctgcttatctgatggccacaagacttcagtttgagaattcatgtgaaattggggtcttctcaaagcttacaaatgcttactgtttggtagcaattggtggctctgaaaatttctacagcacattcgagtctgaactagcagatgttattcctgtggttaagacctccattggtggtacaagaataattggacggctttgcattggtaacaaaaatgggcttcttttgcctcacacgactactgaccaagagcttcaacacttgcgaaacagtctgcctgatgcagttgtggttcaacgcattgatgaaagactatctgcccttggaaattgcatagcatgcaatgaccatgttgcccttactcatactgatcttgatagggaaactgaggaaatgatagctgatgttcttggtgtagaagttttcaggcagacaattgctggaaatattcttgtgggcagctattgtgccttttcaaatagaggtggcatggtgcaccctcatacttccattgaagacttggatgagctgtcaaccctgcttcaggttccgttggtggcggggactgtgaaccgtggtagcgaagtgattgctgcgggactaactgttaatgattggaccgcgttttgcgggtcagacactacagcaacagagttgtctgtgattgagagtgtttttaagctgagagaagcccagcccagtgccattgtggatgagatgaggaagtcattgatcgatacctatgtctgataagttttaagttagttgattataagtcaacggtaactaactatg

SEQ ID NO: 2154 - DNA, 1964 bp, Chelidonium majus
tgtattcggaaattcccaagtttaacttgagaaatcgatctcaacaacgacgtctatcgataggtagtactagtaggaggattcatgtattgagagaaatcaatggtggcggtggtggtagtggtggtggtggtagtagctaatcctgcatacgatgccgcggccgccgtaggagtacttggtaaaatccagctttgaatctcatcatcaatgtcccaaaaccccttaatctcatcatgattaatttgatgttgatgtgataatctactactcacattactactaatcatagtactacttgttgttgttccagtatttggaaccaccaccattttctccgtttggggaaaattaatctgcgacgccgccaccgccgacaattcattattaaactgttgatgattgtgttgctgattctgtatttgttgttgatgattgatttgagtagtaggagcttctgttataactgaagagttataatcagtagggaaaggaaaattaagcttcgcacgaggaccccggaaatcaatggcggctttatcgtaagcacgggcagcttcttccgcggtggcgaaagtaccaagccaaacccgagctgctcttcgtgggtctctaatttcagctgcccatttcccccacggcctttgtctaactcctctgtaattcttcttcttctccaacttattattattattatccaccatcatcgttaatttcctcttctttttcttctcttcttggaagaaattacaacccaaacaaccgtcgattccacataatggacacgcatcagcatctggaagaggcaaaacagagtctgtaactagtaatttctctgtgctggatgtgctggtggcggtggtggtggcggcggaagaagaggctgtataatgagtactatcgaaagcatcgaagacgacgtcggaagaagaagaggaggaagaagacatgacgtgtgtgagagcagcgactataattgaattctcttcatctaggcttaatcttcgtggagatgttgatgaagacgatggttgttgtactcggttttttcttcttcttccttttctctctctctttttttggtctaccgaccgaattcggctgcaaatcttgaatttattcagaggttgaatatttggaaactgtttgattttgttctgtgatttataatggcaacccgacttcaatttgagaacaactgtgaagttggggtattctcgaagttaacaaatgcttattgtctggttgcaattggagggtctgagaacttttacagtacattcgagtctgaattagcagatactatccctgtggttaaaacttctattggaggcactaggataattgggcgtttatgcgctggaaacaagaatgggcttcttgtgccacacactaccaccgaccaagagcttcagcacctgaggaacagtttaccagatcaagttgttgttcagcgaattgatgagagactatctgcactgggaaattgcattgcctgcaacgactatgttgctcttacacatactgatcttgacagggacacagaggagattattgcagatgtccttggagttgaagtgttcaggcagacaattgctggaaacattcttgtgggaagctactgtgccttctccaacaaaggtggactggtccatccccatacatccattgaagacttggatgaactctcaacccttcttcaagtccctctggtggctgggactgtgaacagaggtagtgaagtcattgctgccggtatgactgtcaacgattggacagcattctgtgggtcagacactactgctacagagctctctgtgattgaaagtgtctttaagttgagggaggcccaacctactgccattgttgacgagatgaggaaatcgttgatcgacacctatgtttgattacctcggattctctaaaattactaatcgttgaatattaaatttctatctttgaag

SEQ ID NO: 2155 - DNA, 989 bp, Flaveria ramosissima
agtttgcaaaacaagaaataaattagcacaaaaatatataatttgttattgttgacttacaatcaacagccaacttaaaacttagcagacgtagaaatctcgacgcttacaaaccctaaatatccattgaaatctctctctgtcgagctcatacatcaagatacctgacatcactaagcaatttttcattagctgctttctgatggcgacaagacttcagtttgagaattcatgtgaaattggtgtgttctcaaagctaacaaatgcttactgtttagtagcaattggtggctctgaaaatttctacagcacatttgagtctgaactagcagatgttattcctgtggttaagacctccattggtggcacaagaataattggacggctttgcattggtaacaaaaacgggctacttttgcctcatactactactgaccaagagcttcaacacttgagaaacagtctacctgatgcagtcgtggttcaacgcattgatgaaagattatctgcccttggaaattgcatagcatgcaatgaccatgttgcccttactcataccgatcttgatagggaaactgaggaaatgatagctgatgttcttggtgtagaagttttcaggcaaacaattgctggaaatatacttgtgggcagctattgcgccttttcaaatagaggtggcatggtgcaccctcatacatctattgaagacttggatgagctgtcaaccctgcttcaggttccgttggtggcggggacggtgaaccgaggtagtgaagttattgctgcgggcctaaccgttaacgactggaccgcattttgcgggtcggatactacagcaaccgaattgtctgtgattgagagtgttttcaagctgagagaagcccagcccagtgccattgtggatgagatgagaaagtcattgattgatacctatgtctgataagttttaagttggctgttgattgtaagtcaacaataacaaattatat

SEQ ID NO: 2156 - DNA, 1187 bp, Carpinus betulus
caaatttcatcataggcgttcatatttttcccccaacccctaaatcatatttttaagtccacctacactcgctctgcaacccaaagtccccaacactcatcagactcagacggcgcaaaacccacagcagccgcacatctcgttctcaccccccctggacccctcctcgctgaactgccatcgccgttaacttcttcgccgagctgcatcgtcgccgttaagcatcatctcgttcaggataaagttggcagatttctcatttgaagttttatcatggcgacgagacttcagtttgagaactcgtgcgaggtgggtgtgttctcaaagctcaccaatgcttactgtttagttgctattggtggttccgaaaatttctacagtacgtttgagtcggagttagcagatgctatccctattgttaagacctcaattggcggtactcgcattattggacgcctttgtgctggaaacaaaaatgggcttctcgtgcctcacaccaccactgaccaagaacttcagcacttgagaaacagtctaccggatcaagtagttgttcagcgcatcgatgagagactttctgctctgggaaattgtatagcgtgcaacgaccacgttgctctcgcacatacagatcttgacagggaaactgaggagatgattgctgacgtactgggagtagaagtttttaggcagacaattgctggtaatattcttgtgggcagctactgtgctttctctaacagaggtggtttggtccatccccatacctcaattgaagacttggatgaactctcaacacttcttcaggtccctctggtggctgggagtgtgaaccgcgggagtgaagtgatagccgctggcatgacagtgaacgattggacagcattctgtggttcagataccacagcaacagaactctctgtcattgagagcgttttcaaattgagggaagcccagcctagtgcaatcgtggatgagatgaggaaatcattaattgacagctacgtttgaagttgaagcaacatgttaatgacttgtttggctgttattattattctgtttttctgacgtttcgatcaagaagcatgaattttggaattctttctttcaatggtacgaaagaatgaatcaactgtatctgttaatctgacagacacacacctacctctataaatgcttgtttgaat

SEQ ID NO: 2157 - DNA, 1038 bp, Ipomoea nil
gggaacatcactagtcttcgtcgctccaccgttaccgacgctgccgccgccaccaccaccaccgctaccgttcggcctgtttaggaatttcaggcactctctgagaaagcgattacactgaaaaagtcctttttgacaaggaaaaagctgctcgttttgtccttaccatggcaactaggttgcagttcgagaattcatgtgaaattggggtcttctccaagctgacaaacgcttactgcttggtcgcaattggtggatcagaaaacttttacagcacgtttgaagctgagttagcagatgccattccagttattaaaacctccataggtggaacccggatagttggacggctttgtgctggaaacaaaaatggtcttattctgcctcatactactactgaccaagagcttcaacacttgagaaacagtttgccagatagtgttgttgttcagcgtgctgatgagaggctatccgctttgggaaactgcattgcttgcaatgaccatgttgctcttacgcacactgatcttgatagggaaactgaagagttgattgcggatgttctcggagttgaagtctttaggcagacaatagctgggaatatacttgttggcagctattgtgctttttctaacagaggtggcttggtgcatcctcatacatccgtcgaagacttggatgaactttcgacgctcctccaggttcctctggtggccggaactgtgaaccgaggtagtgacgtgattgctgctggattgacagtcaacgactggaccgcgttttgtggctctgacactaccgcaacggagttgtctgtcatcgagagcgttttcaagctgagagaggctcagccaagcgctatcgtcgatgaaatgcggaaatcgttgatcgacagctatgtttaagttctgtgcttcacatccacataatgtaagttttgtgctgaaaattcacataatgtgtgttgaaaattttaaagctcataactaaattgctttgctttttatgtgcacaagtactcctccaagaatgattgca

SEQ ID NO: 2158 - DNA, 1062 bp, Prunus persica
atggaagaaaaaataattagcggtttgctgactttgtttttgggtgccctacttatacacataaaatcccctaattttcctcctccctacctccaaaaccctagctcataacaaactcatacctcaggcgttccttgaatccatggctaccagattgcaattcgagaactcgtgcgaggttggggtgttctcgaagctgacgaatgcctactgtttggtttccatcggaggctctgagaatttctacagcacattcgaggccgagttggcagatgtcatccctgtcgttaaaacctccattggcggcactcgcatcattggccgcctctgtgctggaaacaaaaacgggcttcttttgcctcacacgaccacagaccaagaactccagcacttgaggaacagtttacctgatcatgttgttgttcagcgcattgaagagagactatctgctcttggaaactgtattgcttgcaatgatcatgttgctcttacacacacggatcttgacagagaaactgaggagatgatcgcagatgtacttggcgtggaagtttttaggcaaacgattgctggtaatatccttgtgggcagttactgtgccttcaccaacagaggtggcatggttcatccccacacatctgttgaagacttggacgagctttcaactcttctacaggttcctctggttgctggaacagtcaatcgtggcagtgaagtgatagctgcaggcatgacagtgaatgactggacagcattctgtgggtccgacaccactgccacagaactctcagttattgaaagtgttttcaagttgagggaagctcaacctagtgccattgtggatgaaatgaggaaatcattgattgacagctatgtctgagcaaaatctctgtgctagttccatgaataggtgctgttttcttccttgttaattgttttaaaacaaaatatctttttaaattcttaatcataagaattctggtgttgccaagttgtataattatggtgccaagctgtacaatatgttataacaaacgtgttttgccttttttcttcccaaaa

SEQ ID NO: 2159 - DNA, 1066 bp, Helianthus annuus
actgcaaatcggtaccgaaggaggcggtgctgtacaaactataaaacccttacagacgctggtatctcgacatttgaaaccctaaatattcatcgataggcagctcgctgaaagcttcaattgaagctcatacatcacgatacattttcttgttgagcaagttttcatcagctgcttctctgatggccacaagacttcagtttgagaattcatgtgaaattggcgtgttctcaaagctaacaaatgcttactgtttggtagcaattggtggctcggaaaatttctacagcacatttgagtctgaactagcagacgttattcctgtggttaagacctctattggtggcacgagaatcattggacgtctttgcattggtaacaaaaatgggcttcttttgcctcatactactactgatcaagagcttcaacacttgagaaacagtctgcccgatgcagtcgtggttcaacgcattgatgaacgactatctgcccttggaaattgcatagcgtgcaatgaccatgtcgccctcactcataccgatctcgatagggaaaccgaggaaatgatagccgatgttctcggtgtagaagttttccgacaaacaattgccggtaatatccttgtgggcagctattgtgccttttcaaatagaggtggcatggtgcacccacatacttctattgaagacttggatgagctgtcaaccctgcttcaggttcccttggtggcggggaccgttaaccgtggtagcgaagtgattgctgcgggcctaactgtcaacgattggaccgcgttttgtgggtcagatactactgcaacggaattgtctgtgattgagagtgttttcaagcttagagaagctcagcccagtgctattgtggatgagatgagaaagtcgttgatcgatacctatgtctgataagtattgagttctatgtttgttgttgattataagtcaacactaactctgtgtttttttgttttaactttttgttttatgtttggttttgctactgtttttatgttaggaacttgttggaaggctctttaaaagtatcatttttg

SEQ ID NO: 2160 - DNA, 938 bp, Helianthus annuus
ctaaaaaacaattgaagctcaagcattctccgcacatcaagattccttttgtctctaaacaaatcttcatctgctgcttttctaatggcgacaagacttcagtttgagaactcatgtgaaatcggggtgttctcaaagctaactaacgcttactgtttagtagcaattggtggttccgaaaatttctacagtacatttgagtccgagctagctgatgttattcccgttgttaagacctccatcggcggcacacgtatcattggccgactttgcatcggtaacaaaaacgggctacttttacctcataccactaccgaccaagagcttcaacacttgaggaacagtctgccagatgcggttgtggttcaacgaatcgacgagagactatcggctcttggaaattgcatagcgtgcaatgaccatgttgcccttacccatactgatcttgacagagaaaccgaggaaatgatagctgatgtcctcggtgtagaagttttccgacagacaattgccggaaatattcttgtcggcagctactgtgcgttttcaaatagaggtggcatggtgcaccctcatacctctattgaagacttggatgagctgtcaactcttcttcaggttcctttggtggcgggaacagtgaaccgtggtagtgaagtaatagcagcagggctaacggttaatgactggactgcgttttgcggatcagatactaccgcaacagaattgtctgtgatcgagagtgttttcaagctgagagaagcccaacctagtgccattgtggacgagatgaggaagtctttgatcgacacttacgtttgataagtgttaagtttgtttgatttttgatgctatttttatgtgataaaatgttttagactgttatgttacaaaaattgtataacgatcattcggtattagtcaaaaggttttatttt

SEQ ID NO: 2161 - DNA, 985 bp, Helianthus annuus
acaattgaagctcaagcattctccgcacatcaagattcctttcgtctctaaaacaaatcttcatctgcggcttttctaatggcgacaagacttcagtttgagaactcatgtgaaattggtgtattctcaaagctaactaacgcttactgtttagtagcaatcggtggttccgaaaatttctacagtacatttgagtccgagctagctgatgttattcccgttgttaagacctccatcggcggcacacgtatcatcggccgactttgcatcggtaacaaaaacgggctacttttacctcataccactactgaccaagagcttcaacacttgaggaacagtctaccggatgcggttgtggttcaacgaatcgacgagaggctatcggctcttggaaattgcatagcgtgcaatgaccatgttgcccttacccatactgatcttgacagagaaaccgaggaaatgatagctgatgttctcggtgtagaagttttccgacagacaattgccggaaatattcttgtcggcagctactgtgcgttttcaaatagaggtggcatggtgcaccctcatacctctatcgaagacttggatgagctgtcaactcttcttcaggttcctttggtagcgggaacagtgaaccgtggtagtgaagtgatagcagcgggcctaacggttaatgactggactgcgttttgcggatcagatactaccgcaacagaattgtctgtgattgagagtgttttcaagctgagagaagcccaacctagtgccattgtggacgagatgaggaagtctttgatcgacacttacgtttgataagttttaagtttgtttgatttttgatactatctttatgggataaaatgttttagcctgttggaaggtttgagaattgttaaaaagaatgcttttagactgttatgatacaaaaattgcacaacaatcattctgtattagtcaaaggttttattttgttggaaatttt

SEQ ID NO: 2162 - DNA, 1049 bp, Olea europaea
cgtaaaacctgtctcaaacgtaatccttcccagaaaccctaagctttaaaatcgtctagccctcacgctgtttaatcgattcagacaaattagtttgaatccataatctattttacaccacaaacgtttcatccttcgacccaatcaatctcgatggcaactagattgcaatttgagaacaactgtgaagttggtgttttttccaagttgaccaatgcatattgtttggtcgcaattgggggttctgaaagcttttacagcacctttgaggctgaattggcggatgttattccggtggtcaaaacctcgattggtggcactagaattataggacgcctatgtgctggaaataaaaatgggctactcttgcctcacaccaccaccgatcaagaactgcaacacttgaggaacagtctgccagattccgttgttgttcagcgcattgaggagcgattatctgctctggggaactgcattgcatgcaatgatcacgttgctcttacacaccctgatctggacaaggaaactgaggagatgattgcagatgttcttggggtagaagttttcagacagacagttgctggtaatatacttgtgggtagttactgtgcattttctaacagaggtggcttggtccatcctcatacatctatagaggacttggatgaattgtcgacccttcttcaggttcctttggtggctgggactgtgaatcgtgggagtgaagtgatagccgctggcttgacggtcaatgactggacagcattttgcggatcagacacaactgcaacggaattatcagtaattgagagcgtcttcaagttgagagaagctcaacccagtgctctcgtcgatgagatgagaaaatcattgattgacacctatgtttgagtttcatttcaagttaaatgtgcggatgtttatactgcacttttactctggttttaattagtttccagttttatggagagattttcgatctctgtattatgacatgcaagttaatatttcctgtatccgttgtctttgatgaagtaacttccttcttc

SEQ ID NO: 2163 - DNA, 939 bp, Centaurea maculosa
  misc_feature (53)..(53): n is a, c, g, or t
ccacaatggccacaagacttcagttggagaattcatgtgaaattggagtgttntcaagctaacaaatgcttattgcttggtagcaattggagggtctgaaaacttttacagtacatttgagtccgaattagcagacgttattcctgtggttaagacctctattggtggtacaagaataattggaaggctttgcattggtaacaagaatgggcttcttttgcctcatactactactgaccaagagcttcaacacttgaggaacagtctgcccgatgcagttgtcgtccagcgtattgatgagagactatctgcccttggaaattgcatagcgtgcaatgaccatgttgcccttacccacaccgatcttgatagggaaaccgaagaaatgatagccgatgttcttggtgtcgaagtattcaggcaaacaattgctggtaacattcttgttggcagctactgtgcgttttcaaatagaggtggtctggttcatccacatacctctattgaagatttggatgaattgtcaaccctcctacaagtacctttagtggcgggcacagtgaatcgtggtagtgaagtgatagctgccggcataacggtcaacgattggactgctttttgtggttcagacactactgcaaccgagttatctgtgattgagagtgttttcaagttgcgagaagcccaaccgagtgccattgtggacgagatgaggaagtctttgatcgatacctacgtttgattatgattaacgggcgaactccacaataactatgtggttgcttgtttttttagctttatttaaaggacgaaaagtcgacttttttactttaagcttgttttgtgtttgtttttgttactttttagtgtttatacatgcatttcagttttgggttgtaatgaaatgtatgctttgattggtaatggtatccaaaacta

SEQ ID NO: 2164 - DNA, 1093 bp, Gerbera hybrid cultivar
gatttggagacgcatcgattgaaagccagccagctccagattggtttgtcgctcaacttttcaatagaactcaagctttctcgatttacagatactttttctctctaaggaaatctccgtccaccgcttttctccacgatggccacaagacttcagtttgagaattcttgtgaaattggggtgttctcaaaactcaccaatgcttactgtttggtggcaattggaggctctgaaaacttctacagcacatttgagtcggagttagcagatgttattcctgtggttaaaacctccattggtggtacaagaataattggaaggctttgcattggcaacaaaaatgggcttctcttacctcatactactacggaccaagagcttcaacacttgaggaacagtcttcctgatgcggttgttgttcagcgcattgatgagagactatccgcccttggaaattgcattgcatgcaacgaccatgttgctcttacccatactgatcttgacagggaaacagaggagatgatagctgatgttctttggtgtggaagtttttaggcagacaattgctggtaatgttctggtgggcagttactgcgccttttcaatagaggtggcctggtccacccgcatacctccattgaagacctagatgagctgtcgactcttcttcaagtccctttggtggcaggcacggtgaatcgaggaagtgaagtgatagcggctgggttaacggtgaacgattggactgcattttgtgggtcggacactacggccactgagttgtcggttatcgagagtgttttcaagctgagagaagcccaaccaagtgccattgttgacgagatgaggaagtctttgattgacacctatgtttgatcaaacttttcccctcttttattggctacctccctttgtttgctgagtacaatatggtatcaaatttggaattcttagagaaattaaccatcatatgctttttaaaaggaatgggtattgctttgttcttcatttcttttaggagttgtgttttgagtaacatcatcaaattgttaagaaagaatatattataatatcaaacatgaaaagtatctca

SEQ ID NO: 2165 - DNA, 1116 bp, Platanus occidentalis
gtcgggccagagtcggcaagtcaagccctgaaagaaaattatttactttctgattcttcgtatactggttccgactctccgttgaaaccctaattctaaagcgaaccagcgtttttcggttgagttccgctaaatctttgcaggtcttgtggtttgcagctgtctgaatttgtgttctttattgtgttattatggcaacccgacttcagtttgagaactcttgtgaagttggggttttctccaagttgaccaatgcatattgtttggttgccattggaggatcggagaacttttacagcacatttgaagctgagctggcagatgttatccctgtggtaaaaacatccatagcaggcactagaattattggtcggctgtgtgctggaaacaagaatgggcttctttgcctcacaataccactgaccaagagcttcaacacttgaggaacagtttacctgatcaagttgttattcaacgcattgaagagagactatctgctctggggaattgcatagcttgcaatgatcacgttgctcttacacataccgatcttgacagggaaactgaggagatgattgcagatgttcttggggtagaagtgttcagacagacgattgcagggaacattcttgtgggcagttactgtgccttctctaacagaggcggattggtccatccccatacatccattgaagatttggatgagctatcaacgctccttcaagtccctctggtggctgggactgtcaatcgaggtagcgaagtaattgctgctggtatgacagtcaatgactggacagcgttctgcggatcagacactacggcaacagaactttctgtcattgagagtgtcttcaagttaagggaagcccaacctagtgccattgttgatgagatgagaaaatcattgattgacagctatgtttgagttcttcatttatgctttcgccaaggtatatttatggaaaagaatcctacgttgcctaaaattgcaacttttgcatggcttcgtgacttcggtttgtctgatgttaagtttcttattgtggatccatgcatgtacagatgagattttttaacaaacttgaactgctagtattacaaggaaaaaaaagt

SEQ ID NO: 2166 - DNA, 901 bp, Helianthus annuus
tctccgcacatcaagattccttttgtttcaaaaacaaatcttcgctcgctgcttttctaatggccacaagactccagtttgagaactcatgtgaaatcggggtgttctcaaagctaactaacgcttactgtttatagcaatcggtggttccgaaaatttctacagtacatttgagtccgagctagctgatgttattcccgttgttaagacctccattggcggcacacgtatcatcggccgactttgcatcggtaacaaaaacgggctacttttacctcataccactaccgaccaagagcttcaacacttgaggaacagtctgccggatgcggttgtggttcaacgaatcgacgagagactatcggctcttggaaattgcatagcgtgcaatgaccatgttgcccttacccatactgatcttgacagagaaaccgaggaaatgatagctgatgttctcggtgtagaagttttccgacagacaattgccggaaatattcttgtcggcagctactgtgccttttcaaatagaggtggcatggtgcaccctcatacctctattgaagacttggatgagctgtcaaccctgcttcaggttcctttggtagcgggaacagtgaaccgtggtagtgaagtgatagcagcgggcctaacggttaatgactggactgcattttgcgggtcagatactaccgcaacagaattgtctgtgattgagagtgttttcaagctgagagaagcccaacctagtgccattgtggacgagatgaggaagtctttgatcgacacttacgtttgataagtgttaaagtttgtttgatttttgatgctatttttatgtgataaaatgttttagactgttatgttacaaaaattgtataacgatcattcggtattagtcaaa

SEQ ID NO: 2167 - DNA, 758 bp, Ambrosia trifida
tttaaacaaatcttcatctgctgcttttctgatggccacaagacttcagtttgagaattcatgcgaaattggggtgttctcaaagctgactaatgcttactgtttggtagcaataggtggttctgaaaatttttacagtacatttgaggccgagctagctgatgttattcctgtggttaagacctccattggtggcacacgtataattggccgactttgcattggtaacaaaaatgggcttcttttacctcataccactaccgaccaagaacttcaacacttgaggaacagtctgccagatgcagttgtggttcagcgaattgatgagagactatctgccctcggaaattgcatagcatgcaatgaccatgttgcccttacacataccgatcttgacagagaaaccgaggaaatgatagctgatgttctcggtgttgaagttttcagacagacaattgctggaaatattcttgtgggcagctactgtgcattttcaaatagaggtggcatggtgcatcctcatacctctattgaagacctggatgagctatcaaccctgcttcaggttcctttggtagcaggaacggtgaaccgtggtagtgaagtaatagcggcaggcctaacggttaatgactggactgcattttgcgggtcagataccaccgcaacagaattgtctgtgattgagagtgttttcaagctgagagaagcccaacccagtgccattgtggatgagatgaggaaatctttgatcgaca

SEQ ID NO: 2168 - DNA, 981 bp, Malus domestica
atggcctaattgccctctctcttgctcaacctcaaaaactctagtttttcccacactcgtgccttgcaaggcttgcagtctggcatcgccctcaatccatggcaaccagattgcaattcgagaactcgtgcgaggttggggtgttttcgaagctgacgaatgcgtactgtttggtctccatcggaggctctgagaacttctacagcacctttgaggcggagttggctgatgtcatccccgtcgtgaaaacctccatcggcggcactcgcatcataggccgcctctgtgctggaaacaaaaacgggcttcttttgcctcacactaccaccgaccaagaactccagcacttgaggaacagcttacctgataatgttgttgttcagcgtatcgaagagaggctatcggctcttggtaactgtatcgcgtgcaatgatcatgttgctcttacacacactgatcttgacagggaaactgaggagatgattgcagatgttcttggagtggaagtttttaggcagactattgctggtaatattcttgtgggcagctactgttccttcaccaacagaggtggcttggttcatccccatacatctgttgaagacttggatgaactgtcgacgctccttcaggtccctcttgttgctggaacagtaaaccgtggtagtgaagtgatagctgcaggcatgacagtgaacgactggacagcattctgcgggttagacaccactgccacagaactctcggttattgaaagcgttttcaagttgagggaagctcaacctagtgctattgtggatgaaatgaggaaatctttgattgacagctatgtctaaatcttgtgcgtaaaactcattgatatttcctgttttctttctggtcaatgtttttaaatagtattaatgagttgtgtacgtttgaaaatcttaaatcataagaactctgattttgcaaagttgtatagttaagttgcgcaatctg

SEQ ID NO: 2169 - DNA, 1036 bp, Manihot esculenta
aaattattattccaaccataatcaaaggaggttctcgctagcccttatccttctctctctctctacagccgacaaggaggattatctcagattccttccgatcatggcgactaggcttatgtttgagaactcatgtgaagttggagtattttccaagctcaccaatgcttattgcttggttgccattggaggctctgaaagcttctatagcacattcgaagctgagttagcggacgttattcctgtagttaaaacttccattgggggaactaggattattggccgtctttgcgctggaaacaaaaatgggcttctcttgccccacaccaccaccgaccaagaacttcaacatttgaggaacagtctacctgataatgttgtggttcagcgcattgaggagagattatctgccttgggaaattgtatagcctgcaatgaccatgttgctctgacacatacagatcttgacagggaaacagaggaaatgattgcagatgttcttggtgtagaagtttttaggcagacaattgctggtaatattcttgtgggcagctactgtaccttgtctaatagaggtggcttggttcatcctcatacctccattgaagacctggatgaactttctaccctccttcaggtgcctttggtggctgggactgtaaaccgtggcagtgaagtgatagctgctggcatgactgtgaatgactggacagcattctgtgggtcagatactacagctactgagctctctgtaattgagagtgttttcaagctgagggaagctcagcctagtgccatagttgaagaaatgaggaaatcattaattgacagctatgtgtaagccattaatgttgttctgttgtgcaaggtatgaatggtacctgatgttatcttataatgctgaagagatcaatatttctctatatgtgtttgattatttggtgataacatgttatatcctgaactgaaaaaggatcaagttttgaaattgattggttctgtaataggtattcaatttcatgctatgcttgaaatc

SEQ ID NO: 2170 - DNA, 1571 bp, Ricinus communis
aatgtccttaccagattttattttaaatttaataagtgtagtatagattttcatgtattgtaaattaagtttaaattaaacataagatgatttctatttttactttgttattgttagagataaaattgtcatccattgcggtccaataataaaaataaataaaggatataaaatggaatataacgaagaaagtgtgggtatttatggaagataaaagatgacaccctttgggatggtgctgtgtctctcaaacgaggccctacataactgtctattgcaaaaccctaatcatctcccaaataatatctttctgtgaattgctaattaaattcaaagaacttctactctctctcttcctctctactcaagaacagatacactttattactcctctgtttcttgttgggtttatcgcacactccttttaaatcatggcgacgaggcttatgtttgagaactcatgtgaagttggagtattttccaagctcactaatgcttattgtttggtagccattggtggctctgaaagcttctacagtgcatttgagtccgagttagcggatgttatccctgtggttaaaacgtccattgctggcactaggataattggccgcctttgtgctggaaacaaaaatgggcttctcttgcctcacaccaccactgaccaagaacttcaacatttgagaaacagtctacccgataatgttgtggttcagcgcattgaagagagactatctgccttaggaaattgtatagcctgcaatgatcatgttgctctaacacatacagaccttgataaggaaacagaggaaatgattgcagatgttcttggtgtagaagtttttaggcagacaattgctggtaatattctcgtgggcagctactgtgccctctccaacagaggtggtctggttcatcctcatacatctatagaagacttggatgaactttcaaccctccttcaggttcctttagtggctggaactgtaaatcgtggcagtgaagtgatagctgctggcatgactgtgaatgactggactgcattctgtgggtcggatactacagctactgaactctctgtcattgagagtgttttcaagctcagggaagctcagcccagtgcgatagttgatgagatgaggaagtcattgattgacagttatgtttaagttgttaatgttggttgtggcaagctgttaaatggtatctaatctcttttataaagagcgagcaaaatgtatgttcatgctcaacaatatgttttctgacttcaacagaaagaatataagaattgtatccttttcatcggttttgtaatagccattcaatgccttcttagtttatgcttttaatgggatgggatttgatggattgagataatcacaggcctttctgtcgtctttgtatttctcgcaaattgcaaagaacgaatactgaaagttagaccgtcgctgccattctgccaatggtttgggaatgtgtatttgcatcaataatagaagaaatagctgaacctgtaacgttaggtgtgagaaaaccgaaccgattagttctaaaatactaattcttca

SEQ ID NO: 2171 - DNA, 970 bp, Centaurea maculosa
  misc_feature (67)..(67): n is a, c, g, or t
  misc_feature (101)..(101): n is a, c, g, or t
  misc_feature (159)..(159): n is a, c, g, or t
  misc_feature (190)..(190): n is a, c, g, or t
  misc_feature (613)..(613): n is a, c, g, or t
  misc_feature (622)..(622): n is a, c, g, or t
  misc_feature (640)..(640): n is a, c, g, or t
  misc_feature (673)..(673): n is a, c, g, or t
  misc_feature (680)..(680): n is a, c, g, or t
aaatatccatctgctgcatttctccacaatggccacaagacttcagtttgagaattcatgtgaaatnggagtgttctcaaagctaacaaatgcttattgcntggtagcaattggagggtctgaaaacttttacagtacatttgagtccgaattagcagncgttattcctgtggttaagacctccattggnggtacaagaataattggaaggctttgcattggtaacaaaaatgggcttcttttgcctcatactactaccgaccaagagcttcaacacttgaggaacagtctgcccgatgcagttgtcgttcagcgtattgatgagagactatctgcccttggaaactgcatagcgtgcaatgaccatgttgcccttacccataccgatcttgatagggaaaccgaagaaatgatagccgatgttcttggtgtcgaggttttcaggcaaacaattgctggcaatattcttgtcggcagctactgtgcgttttcaaatagaggtggtctggttcacccacatacctctattgaagatttggatgaattgtcaaccctccttcaagtgcctttagtggcgggcacggtgaatcgtggtagtgaagtgatagctgcnggcataacngtcaatgattggactgcnttttgtggttcagacactactgcaaccgagttntctgtgntcgagagtgttttcaagttgcgagaagcccaaccaagtgccattgtggacgagatgaggaagtctttgatcgatacctacgtttaattatgatcaactggcgaactccacaataaccatgtggttacctgttttttagctttgtttaagggatgaaagttgactttttttttactttaagcttgttttatgtttgtttttgttactttttagtgttcacacatgcatttcagttttgggttgtaatgaaatgtatgttttgattggtaatggtattcacaactatttaag

SEQ ID NO: 2172 - DNA, 1215 bp, Eucalyptus grandis
gggggcaagtggccgagcacacaaaggcaaagcagctcctataaaaatatccccttttaccttgccccgctttggctctgtcgcttcttcgattctccctgccctaaaaccctaaaggacgctgatttccatcgggagagaaaccctcgaaaagcttcctcttttaagggcggagggatatcgattcactgctgagctacagcccgcgtcctcgcatcaacttattgttctttgcatctcctgaacgcacgcacgtcgatatggcaacaaggctccagtttgagaactcgtgcgaagtgggtgtcttctccaagttgacgaatgcgtactgtttggttgcaattgggggatcagagaacttctacagtacgttcgagactgatttggccgatgttatcccggttgttaagacgtccattgcgggcactaggatcattgggcgactttgtgcaggaaacaagaatgggctacttttgccgcacaatactactgaccaagagcttcaacacttgagaaatagtctgccagatcaagttgttgttcaacgtattgaagaaaggctatctgccctggggaacggcatagcatgcaatgatcatgttgcccttactcatactgatcttgacaaggaaaccgaggagataattgcagatgttcttggagtggaagtctttaggcagactattgctggcaacattcttgtgggtagctattgtgccttctccaacagaggtggactggttcatccacatacatccattgaagacttggacgagctctcgaccctcctccaggttcctttggtcgctggaactgtgaaccgaggtagtgaagtaatcgcagccggtatgactgtgaatgactggacagcattttgtggctcagacaccacggctaccgaactatctgtgatcgagagcgttttcaagttgagggaagcgcaacccagtgccattgtggatgagatgaggaaatccttgatcgacagctatgtttagtcatttatcctaattttatatgttcgtctgaatttgcaatttacagtctttatcaagttgtagactgcgaactgaatttcaagtttgtttgctgtaagatccctcaaatatgaaagtcgtttttgagtataaagttgggtgtcacctatctgtaagcaaaagttctctcagagaataataggtatgatggcacctgaaggaaaaatttacaacctta

SEQ ID NO: 2173 - DNA, 1063 bp, Elaeis guineensis
ccacaccctgggagttctccaaaaccttgttccccaagaaacgatccggctcccttcctctcttcgccggcttctctcgcgacccctttgggtctttggatcctccttgctcgtccgaagctcgcgcgttcgatcctggtgtttagagcttgctggtccaattccatcatggcaactcgacttcaatttgagaactcttgtgaagttggggttttctcgaagttgacaaatgcatactgtttggttgcaattggaggatcagaaaatttttatagtgcatatgaagctgagcttgctgatgttattcctgtggtcaaaacctctataggaggcactagaataattgggcggctgtgtgctggaaacaagaacgggcttctattgccacatacaaccactgaccaagaacttcaacatctgaggaacagtctacctgaccgggtggtggttcagcgtattgaggaaaaactgtctgctttaggcaattgcatagcctgcaacgaccatgttgctcttacacatcctgatcttgacagggaaacagaacagcttattgcagatgttcttggagtagaagtatttaggcagacaattgctggaaacattcttgttggcagttattgtgctttttcaaacagaggaggcttggttcatccacacacatccatcgaggaccttgatgaactttctacgctacttcaagtccctcttgttgcagggactgtgaacagaggcagtgaggtcattgctgctggtatgactgtgaatgactggactgccttctgtgggtcagacaccacggcgactgagctctctgttgttgaaagtgtgttcaaattgagagaagcccaaccaagcacgatcgtcgatgagatgcggaaatcacttattgacagctatgtttagtattttaagatagtctgctatttttaatgcaacataatttttctcctgaggacctttaaacaaggattctgttcaatgttgtgatgttatgtttcatgtcatggttatgtcaatgcatgtgcttatgttgtttatgatagttttgacaaaaaaaaaa

SEQ ID NO: 2174 - DNA, 1051 bp, Lippia dulcis
ctctcatccggtgacgcttatatttgtaggtttgtgatttctctgtgatcagcctccgcctctttaaccaccgagcaccgccgtcctcttttccttcttccgtgcctccgccgcctatttttcttgtcggctcgttgtttggtaccttctcctttcactatggcaacaagattgcagtacgagaataattgcgagattggggttttctccaagctcaccaatgcatattgtctggttgccattgggggttctgagaacttctacagcacatttgaggctgatttggctgatgtaattccagtggttaagacctccatttctggcactagaattattggaaggctttgtgctggcaataagaacggcttgctcttgcctcacaatactactgatcaagagcttcaacacttgaggaacagtctaccagactcggttgttgttcagcgcattgatgagagattatcggcactagggaactgcatcgcatgcaatgatcatgttgcacttacgcatcctgatcttgacaaggaaactgaggagctgattgctgatgttcttggagtggaagttttcagacaaacgattgctggtaatattctcgttggcagttactgcacattctccaaccgaggtggtttggttcatccccacacatccattgaggatctggacgagctctcgactctccttcaagtcccgttggtggctgggactgtgaaccgtggcagtgaagtcattgctgctggattgactgtcaatgactggactgccttttgtggctccgacacaactgctactgagttatccgttatcgagggcgttttcaagttgagagaagctcaacccagtgctattgttgatgagatgagaaagtcattgatcgatacctacgtttgatatttcagtgatggcttgtttatgtgtctatgaagctgcaaattcgttccaaaaacaatcttctgctttgttttttggttgtaatagagaacctacagtttttatgttaaagtttgttctgcaaatgtatgcaagttggtaccctttttgagtt

SEQ ID NO: 2175 - DNA, 743 bp, Vinca minor
catggcgacaagattacaatttgagaattcatgtgaaattggggtattctcgaagctgactaatgcttattgtttggttgctattggaggttctgagaacttctacagtacgttcgaggcggaattggctgatgttattccggttgtaaagacctcgatttctggcactaggatcattggaaggctctgtgcaggaaacaagaatgggcttctgttacctcataatactactgatcaagagcttcagcatttgaggaacagtcttccagattcggttgttgttcagcgcattgacgagagactatctgcattgggtaactgcatcgcatgcaatgatcatgttgccctcacacacacagatcttgatagagaaactgaggagatgattgctgatgttcttggggtggaagttttccgacagacaattgctggaaatattctggtgggaagttattgtacattttccaacagaggaggcttggttcaccctcacacatccatcgaggatttggatgaactttcaacactcctccaggttcccctagtggcaggaactgtgaatcgtggtagtgaagttatagcagcaggattaacagttaatgactggacggccttctgtgggtcagatacgactgcaactgaactgtcagtcattgaaagtgtgttcaagcttagagaagctcaaccaagcgctattgttgatgagatgaggaagtcattaatagacacttacgtgtgagtcc

SEQ ID NO: 2176 - DNA, 1159 bp, Vaccinium corymbosum
ccaaaagaatacaaataaggtaacctacctacttacttcctttttagtcgcaaaacctaacgacgtataaacctaacttgaaccttgtctattggtgaaataagggccgaacctgttcgatcaaagctgtctgtaaagcttcccacagatcctgtaatactctgattcttttgtacgttcagctgattgtcttatcataatggcaactagacttcaattcgagaactcatgtgaagttggggtattctcaaagctgaccaatgcttactgtctggttgccattgggggttcggaaagtttctacagcacgtttgagtctgagttggcagatgttattcctgtggttaaaacctcaattggcggtactcggattattggtcgactttgtgctggaaacaaaaatgggcttctcttgcctcacaccaccactgatcaagaactgcaacacctgagaaacagtttgccagatcaagttgttgttcagcgcattgacgaaaggctatccgctcttggtaattgcatagcatgcaatgattacgttgctctaacgcacactgatcttgacagggaaactgaggagatgatcgctgatgttcttggggtagaggttttttaggcaaaccattgctggtaatattcttgtgggtagctactgttccttctccaataaaggtggtctggtccatcctcatacgtccattgaagacttggacgagctttcaaccctccttcaggttcctctggtggcggggacagtaaaccgtggtagtgaagtaatagctgccggattgacagtaaatgactggacagcattttgtggatcagacaccacagcaacagagttgtctgtcattgagagcgtcttcaagttgagagaagcccaacctagtgccattgttgacgagatgaggaaatcgttgatcgacagctatgtttgaatcaattggccgtcttgggcatttagttctgtctcaacctcgttgcccttgctctttaagtcaaagcccttcctcctgcgtttgatacttttcttcaattgtttgttttgcttttgttgtttccaatttatatgttaagaatctattgtatccgatgggtttttctgtcctgaaatgcgcataccaaccaaggtgtatccgttttcacctttctatgagag

SEQ ID NO: 2177 - DNA, 1040 bp, Fraxinus spp
cggccgggggacgacacgacctttagaagtcgaatatcttctccgtaccacccaaggcccaaccctcggcattgcaaacacttacgcgccgcccacttccacccctacaaactcatttccagaaaccctaaatcgttttgtgcgatacctttcttccttctctgaccctatcagtcgcgatggcaaccagattgcaatttgagaacaactgtgaagtggggagttttttccaagttaaccaatgcatattgtttggtcgcaattgggggttctgagagcttttacagtacctttgaggctgagttggcagatgttattccggtggtcaaaacctcaattggtggcactagaattattggacgcctatgtgctggaaataagaatgggctactcttgcctcacactactaccgatcaagaactccaacacttgaggaacagtctaccagattcagttgttgttcagcgcattgaggagagattatctgctctggggaactgcatttcatgcaatgatcacgttgctcttacacaccctgatcttgacagggaaactgaggagatgattgcagatgttcttggtgtagaggttttcagacagacaattgctggtaatatacttgtgggcagttattgtgcattttctaacagaggtggcttggtccatcctcatacatccattgaggacttggatgaactgtcgacccttcttcaggttcctttggtagctgggactgtgaatcgtggtagtgaagtgatagctgctggcttgatagtcaatgactggacggcattttgtggatcagacacaacagcaacagaattatctgttattgagagcgtcttcaagttgagagaagctcaacctagcgctctcgtcgatgagatgagaaaatcattgattgacacctatgtttgagtttcatttcaagttaaatgtgtggatgactatactgcacttctactatggtttttttagtttcagttttatgaaagagagatacttatccctgtaatatgacacgcgagttaatatttcat

SEQ ID NO: 2178 - DNA, 1061 bp, Olea europaea
tcttaaccctttctttgttcttattttgttcttaaacttacttttgtcgtcgtccgtcgttactttccaccctacaaattcattcccagaaaccctaaatcggattgtgcctttgactcgtatatccatcacccaatttaattgattcaaacaaattaatttggtatcccataccttttttccttctttgaccctatcaatcgcgatggcaactagattgcaatttgagaacaattgtgaagtgggagttttttccaagttgaccaatgcatattgcttggtcgcaattggaggttctgagagcttttacagcacctttgaggctgagttggcagatgttattccggtggtcaagacctcaattggtggcactagaattattggacgcctatgtgctggaaataagaatgggctactcttgcctcacactactactgatcaagaactccaacacttgaggaacagtcttccagattcagttgttgttcagcgcattgaggagagattatctgctctgggaaactgcatttcatgcaatgatcacgttgctcttacacaccctgatcttgacagggaaactgaagagatgattgcagatgttcttggggtagaagttttcagacagacagttgctggtaatatacttgtgggcagttattgtgctttttctaacagaggtggcttggtccatcctcatacatccattgaggacttggatgaactgtcgactcttcttcaggttcctttggtagccgggactgtgaatcgcggtagtgaagtgatagctgctggcttgacggtcaatgactggacggcattttgtggatcagacacaacagcaacagaactatctgttattgagagcgtcttcaagttgagagaagctcaacctagcgctcttgtcgatgagatgagaaaatcattgattgacacctatgtttgagtttcttttcaagttaaatgtgtgactgactatactgcacttctaatctggtttttattagttttcagttttatgaaaaagagattcttatccctgtaatatgacatgcaagttaata

SEQ ID NO: 2179 - DNA, 1701 bp, Amorphophallus konjac
attttgcgtccctaccgtccgcctccgatcgcctcctcccacctctgcgtccaccccagtcgacaagcggattctggtcgacgcgtctcaagatcgaatcgatacctctgtccgatcttgaaggagaaccgctgtgaagcaaggaagcagcctttgttgctgatatccgcgaagatggcaacccgtatccaatttgaaaattcttgcgaagttggtgttttctccaagttaacaaatgcatattgtttagtggcaattggggggtcggaaaacttttacagtgcatttgaatctgagttggctgatgttatccccgtggttaaaacgtccatagcgggcacgagaataatcgggcgcctttgtgcagggaacaagaatgggcttctcttaccgcacactaccacagaccaagagcttcaacacctgaggaacagtttgcctgaccaagttgttgttcagcggattgaagaaaggctatctgcgttgggcaattgcattgcttgcaatgaccatgtcgcacttgcacatacagatctggacagggaaactgaggagctcattgcagatgttcttggggtagaagtattcaggcagacgattgctggcaacattcttgttggcagttattgtgcattctctaacagaggtggcctggtgcatccgcacacatcaatcgaagatcttgatgaactctcgacactgctccaagtccctctggttgcgggaacggtgaacaggggtagcgaggtcgtcgccgccgggttgacggtcaacgactggacggctttctgcggctcggacaccactgccacagagctctctgtcatggaaagcgtgttcaagttgagggaagctcagccaagtgcaatagttgatgagatgagaaagtcacttattgatagttatatttgagctccgttgctcggccgtctcttctaaaatggcaagaactcccccgcgtccgaagggccagaggtttacctcgtctttggttttaacttggtgtggatatatttctctaggtttgtcatacttctgagccgcctccttgtggatttatatctagatttcgaacagattcaggtgtgcccacattgtgtaccagtggtgaatagcttcgtcgcttgccactgtggatcgagcatgtgcacagtccgcatggcacaccctctgaaatagcctctgctaatctgctactctgccactcactgggggtgcgaccaatcgttcgggcatttgccaccaagacccatctcatcactgttgcgatcgtctggggtgtgcgcagagatcacggtcgtctatcgtgtggtttgagattaatcgtggtgctgaaaatatgattgcagtggctgtggcgggcgagggtggcagtggtggccgtggacggtggtggtcgtagggaggtgagaagggctggtggaagaaagtatgaaggagtggggaaggacatggtgagaggttagaatggaggtcgcttgctatcactaatgtcagatgatgtaaggcatgtaacagaatggaggcggtaagttatccttcaccatctgatgatgttaaacggcgatggggatgcatcgatagcaacccaacatgcacacaaagtcatgcgaggatcatctgatgtggggaaagatatgtacgccagaccttgcaaaccagtcggcaaaaatgacagaataattctaggttagatcgtag

SEQ ID NO: 2180 - DNA, 1137 bp, Amsonia hubrichtii
tttctctcgccgatcttttcttttttctatataatatatatagaaccctaaccctaaaactttactcagagttccggccatcttgttgttccccgcgtatcgttccttcttttattctcgcagatccttgcttgaatttctgtttatctctgttggattcctgttttctcgcagcatggcaacaagattgcaatttgaaaattcatgtgaagttggggtattttctaagctaaccaatgcttattgcttggttgcaattggaggttctgaaaacttctacagtacgtttgaggcagaattggctgatgttattccggttgtgaagacctccatttctggaaccaggataattggaagactctgtgctggaaacaagaatgggcttctcttacctcacaatactactgatcaagagcttcagcagttgaggaacagtcttccagattcagttgttgttcagcgcattgaggagagactatctgcactgggtaactgcattgcgtgtaacgatcatgttgctcttacgcatactgatcttgatagagaaactgaggagatgattgctgatgttcttggggtggaagttttccgacaaacaattgctggaaatattctagtgggaagctattgtgcattttccaataggggaggcttggtccatcctcatacatccattgaggatttggatgaactttcaactctcctccaagttcctctagtagcaggaactgtgaatcgcgggagtgaagtgatagctgcgggcttaacagtcaatgactggacagccttctgcggatctgatacaactgcaactgaattgtcggtcattgaaagtgtgttcaagcttagagaagctcaaccaagtgctattgtcgacgagatgaggaagtcattgatagacagttacgtgtgagttccaacagtccaagtcaagtaatgacagcatgtaatacgttctatttatatgggcaccttttgggtatttttactgtttcctggcaattgttattacttttgccccaagcttttgagactgtttttaatttgtataacttatgtctttctagctttgatttggtattaaaaaagctgtaaattcatgcagttaacttttgatgataacaaaatgtttacttc

SEQ ID NO: 2181 - DNA, 1241 bp, Aristolochia fimbriata
ctgctagggttctctgacttctctccttctctggactttcattctccgtctctgcttgtctgcgacgatcttcgatcaatcacattcaagctgcttggggacgaatagtgggcggcgtgcagattttcttctgtgctaagaaactcgattagtctttgggtgctgttttgacaaactttcctaaggaaatcttcgttaacgtgttagttttcttatcatggctactcgacttcaatttgagaataattgtgaaattggagttttctctaagctgaccaatgcctactgcctggttgctattggaggttctgagaatttctatagcacatttgaagctgagcttgctgatgttatccctgtggtgaagacctctatagcaggcactagaataattgggcggttgtgtgctggcaacaagaatggccttctgcttccacataatacaactgatcaagagcttcaacatttgaggaacagcttgccagaccaggttgttgtccaacgaattgaagagagattatctgcacttgggaattgtatagcttgcaatgatcatgttgcacttacacataccgatcttgacagggagacggaacagctgattacagatgttcttggagtcgaagttttcagacaaacaattgctggtaatattctggtgggaagttactgtgcattctccaacagaggaggattggtccatccgcatacatcaattgaggatctcgatgaactatcaacactccttcaggtgcctctcgttgccggaaccgtgaataggggtagcgaagttgtagcagctggtctgattgttaatgattggacggcattctgtggatccgacaccacagctactgagctctctgtcattgaaagtgtcttcaaattgagagaagctcaaccaagtgctatcgtagatgagatgaggaagtcattgatagacagctacgtttaagttttctggtacactgtccttttgaacccctgttttaatcaaagctccaaacagttcctcttaagttatccatcggttgattacactcatattgcccaagtaattatgtctagaatttccatatctgttcaggggctgaactcctttgttgaacataatggtacaagttgtattggataaaactccctgtgacttttttgtgacatttgagcaattagtaagtttttgtgactttttcagtcaagtttttctttttagtatcgattttcagtggtcagaggtgtaa

SEQ ID NO: 2182 - DNA, 1142 bp, Cicer arietinum
tttcggtattggttacccaccctacacttttgttgcgttgcatccctccagtcaccgcttcctctgtgctcctccgacccgatattaagttggtttgttggatcaaagatttctgtcctctctgtcatggcaactagactcaagtttgagaattcttgtgaaattggagccttctcaaaacttaccaatgcctattgtttggttgccattggaggttctgaaaatttctacagtgcttttgaggctgagttatcagatgttatccctgtggtcaaaacctccatcggtggcactcgtattgttggccgtctttgcattggaaacaagaatgggcttctcttgccccataccaccacagaccaagaacttcaacatttgagaaacagtctacctgatcaagttcgcgttcagcgcatagaagaaagattatctgctctaggaaattgtatagcatgtaatgaccatgtggccctcacgcacactgatctcgacaaggaaactgaggaggtgattgcagatgttcttggagttgaagttttcaggcagacagttgctggtaatattcttgtgggcagttactgcgctttctccaacaaagggggtttggtccaccctcatacttctgttgaagacttggatgaactttctacacttcttcaagttcctttggttgctgggactgtgaaccgcggtagcgaagtaatcgctgctggcatggtagtaaatgattggacagcattttgtggttcagacaccacagcaacagaactctcagtgattgagagtgttttcaagctgagggaagctcagcctagtgccattgtggatgagatgaggaaatctctcattgaaagctacgtctgagtttcactaaagtactcacttttcaataccaagttgtactgcttgttgtaaagagcatcttactttgatgatagtatcttttctttaccgtaaacagttgctgtgatagagtatgtcttttcaaatatgatcacaatcacataattcaatcaagatttgtggtttcactattgtaagtcatctttcatttcagtttgttgttgttcacagatcaaatatgggttctcttgctttgcatagacccccgcgttataaataaaaaagttttatttgaaagc

SEQ ID NO: 2183 - DNA, 1188 bp, Cicer arietinum
gaaaaatgaaaattatcaagcaattgaaaattttcggtattggttacccaccctacacttttgttgcgttgcatccctccagtcaccgcttcctctgtgctcctccgacccgatattaagttggtttgttggatcaaagatttctgtcctctctgtcatggcaactagactcaagtttgagaattcttgtgaaattggagccttctcaaaacttaccaatgcctattgtttggttgccattggaggttctgaaaatttctacagtgcttttgaggctgagttatcagatgttatccctgtggtcaaaacctccatcggtggcactcgtattgttggccgtctttgcattggaaacaagaatgggcttctcttgccccataccaccacagaccaagaacttcaacatttgagaaacagtctacctgatcaagttcgcgttcagcgcatagaagaaagattatctgctctaggaaattgtatagcatgtaatgaccatgtggccctcacgcacactgatctcgacaaggaaactgaggaggtgattgcagatgttcttggagttgaagttttcaggcagacagttgctggtaatattcttgtgggcagttactgcgctttctccaacaaagggggtttggtccaccctcatacttctgttgaagacttggatgaactttctacacttcttcaagttcctttggttgctgggactgtgaaccgcggtagcgaagtaatcgctgctggcatggtagtaaatgattggacagcattttgtggttcagacaccacagcaacagaactctcagtgattgagagtgttttcaagctgagggaagctcagcctagtgccattgtggatgagatgaggaaatctctcattgaaagctacgtctgagtttcactaaagtactcacttttcaataccaagttgtactgcttgttgtaaagagcatcttactttgatgatagtatcttttcttttaccgtaaacagttgctgtgatagagtatgtcttttcaaatatgatcacaatcacataattcaatcaagatttgtggttttcactattgtaagtcatctttcatttcagtttgttgttgttcacagatcaaatatgggttctcttgctttgcatagacccccgcgttataaataaaaaagttttatttgaaagccatcatgtttgtc

SEQ ID NO: 2184 - DNA, 1176 bp, Gossypium hirsutum
atacaaaacctgacttgtttctcctcttcctctgaacgccggcctctcaaactccaaccaaggaagcaccaaactatttatttgagtttcttcctctggtttcatcatcgatcctttttttttcgctttataatggcaactaggctacagtttgaaaattcatgtgaagttggagtgttttccaagctgaccaatgcttattgcttggttgcaattggagggtctgaaaacttctacagtgcttttgagtctgagttagcggatgtcattcctgtcattaagacctctcttggcggcactagaataataggacggctctgtgctggaaataagaatgggcttcttgtccctcacaccaccacagatcaagaacttcaacacttgcgaaatagtctaccggatcaagttgttgttcagcgcatagaggagaaactatctgctcttgggaactgtatagcttgcaatgaccatgttgctctgacgcatacagatctagatcgggaaactgaggagataattgctgatgttcttggtgtagaagttttcaggcaaacaattgccggaaatattcttgttgggagctactgtgcattttcaaaccgaggtggcttggttcatcctcacacatccattgaagacttggatgagctttcgacgcttcttcaggttccattggtggctggcaccatcaaccgtgggagtgaagtaatagctgcaggaatgactgtaaatgactggactgccttctgtgggtcggataccacagcaaccgaactttctgtcatcgagagtgtctttaagctgagagaagcacaacctactgctatcgtagatgagatgaggaaatcgttgatagacacctatgtttaattcgttggtgtttggttggttgttgctcatcgtcgagacaatgctcgctctgtcgtattttatgtcatgttaaaattacaacactaatgaataaattcgttggtgtttggttggttgttgctcatcgtcaagacaatgctcgctctgtcgtattttatgtcatgttaaaattacaacactaatgaatgtgtaaatcttaatctgactgttcatttttttaaagtatttttgtcctaacgatgcatgttcgtctggaatgtaattttttgaaaaaagttaaaatatattgggatttgattaccatct

SEQ ID NO: 2185 - DNA, 1135 bp, Zingiber officinale
  misc_feature (272)..(272): n is a, c, g, or t
  misc_feature (803)..(803): n is a, c, g, or t
ggcgaattatccggccttcttcttcttcttctcttagcttctcctcgtctttcgaggctctcgttctcgatctcgatctctgtctgattcaggtgtatctaaatttcgcagcagccaccaatatggctactcgtgttcagtttgaaaacaattgtgaagtcggggtattctctaagttaacaaatgcctactgtttggttgcaattggaggatcagagagcttttacagtgtgtttgagtctgagttggctgatgttatccctgtggtcaanacctctatagcaggaactagaattattggacgactttgcgctggaaataagaatgggcttcttttgccacacaccacaactgaccaagagctacaacatctgaggaacagtctgcctgatggtgtggttgtccaaagaatagacgaaaggctatctgctttaggcaattgcattgcttgcaatgaccatgttgctcttacacatcctgatctggatagggaaaccgaagaactcattgcagatgtacttggtgtggaagtgtttaggcaaacaattgctggaaacatacttgtgggaagttactgtgcattttcgaataaagggggtctggtacaccctcatacatctatcgaagaccttgatgaactctcaactcttctccaagtccctctggtcgcaggaacagtgaaccgtggcagcgaggttattgcttctggaatgactgtcaatgactggacggctttctgtggatctgacaccactgcgacagagctctccgtcattgaaagtgtcttcaaactaagagacgcncagccaaacattattgtagatgagatgaggaagtcgctcatcgacagctacgtgtgatatcttggatctagatagcaatggaatactatggagctaagattgctcaggagtcgactatggattcaaccttatggtggccaaaattattgtaatacagagtttgttatttgctgagtgtggattgtgaaagttagctaatggagattaagctaagaaagagcttcacttagtttggtgaaataccaagtgaattggtatggagataacggagggttgtgaaggactttgtttttttgtactcgataatctaaattagaaatgcctttatattt

SEQ ID NO: 2186 - DNA, 1334 bp, Gossypium raimondii
caaattcaagagaaaaccaatccaaaatatttttctcaatagtttttctcttaaccctagatttttcaaagcacactgttacggaccacgacgtcgtttggtggagcgcgtttgatttaccttttaagccgctacataaaagattcattaacccatacaaaacctgacttgtttctcctcttcctctgaacgccggcctctcaaactccaaccaaggaagcaccaaacatttatttgagtttcttcctctggtttcatcatcgatcctttttttttcgctttataatggcaactaggctacagtttgaaaattcatgtgaagttggagtgttttccaagctgaccaatgcttattgcttggttgcaattggagggtctgaaaacttctacagtgcttttgagtctgagttagcggatgtcattcctgtcattaagacctctcttggcggcactagaataataggacggctctgtgctggaaataagaatgggcttcttgtccctcacaccaccacagatcaagaacttcaacacttgcgaaatagtctaccggatcaagttgttgttcagcgcatagaggagaaactatctgctcttgggaactgtatagcttgcaatgaccatgttgctctgacgcatacagatctagatcgggaaactgaggagataattgctgatgttcttggtgtagaagttttcaggcaaacaattgccggaaatattcttgttgggagctactgtgcattttcaaaccgaggtggcttggttcatcctcacacatccattgaagacttggatgagctttcgacgcttcttcaggttccattggtggctggcaccatcaaccgtgggagtgaagtaatagctgcaggaatgactgtaaatgactggactgccttctgtgggtcggataccacagcaaccgaactttctgtcatcgagagtgtctttaagctgagagaagcacaacctactgctatcgtagatgagatgaggaaatcgttgatagacacttatgtttaattcgttggtgtttggttggttgttgctcatcgtcaagacaatgctcgctctgtcgtattttatgtcatgttaaaattacaacactaatgaataaattcgttggtgtttggttggttgttgctcatcgtcaagacaatgctggctctgtcgtattttatgtcatgttaaaattacaacactaatgaatgtgtaaatctttatctgactgttcatttttttcaagtatttttgtcctaacgatgcatgttcgtctggaatgtaattttctgaaaaagtttaaatattttgggatttgattaccatctaagtta

SEQ ID NO: 2187 - DNA, 938 bp, Rosa hybrid cultivar
tccgtcgatccttgcgatcccgactgcaattgaagttccgatcaatcgccgttgactctgcgtctaaccatggctaccagacttcaattcgagaactcgtgcgaggttggggtgttctcgaagctgacgaacgcttactgtttggtctcgatcggaggctccgagagcttttacagcacatttgaggcggagctggctgacgtcatccctgtcgtcaaaacctccatcggaggcagtcgcatcattggtcgtctctgtgctgggaacaaaaatgggctgcttttgcctcacaccaccactgatcaagagctgcagcacttgaggaacagcttgcctgatcaagttgttgttcagcgagtcgacgagaggctatctgcacttggcaactgtattgcgtgcaatgatcatgttgctcttacacatactgatctcgacagggaaactgaggagatgattgcagatgttcttggagtggaagtctttaggcagacaattgctggtaatattcttgtgggcagttactgtgccatctccaacaaaggtggcttggttcatccgcatacatccgtggaagacttggatgaactttcaacacttcttcaggttcctcttgtagctggtacagtcaaccgtggtagtgaagtgatagctgctggcatgacagtgaatgactggacagcgttctgtggctcagacaccacagccacagaagtctcggttattgaaagtgttttcaagttgagagaggcccaacctagtgccattgtggatgaaatgaggaaatcgttgatcgacagctatgtttaagctaattctctggtagtcattctgttcatattgttggcttgcctatggttaaacatcttatccaaagcaagtctaatgttgtgaatctttttagtcttgcttataagaactccgatgctgcctagttgtgt

SEQ ID NO: 2188 - DNA, 1107 bp, Tabernaemontana elegans
ctaatcagagttctggccatctagttgttccccgcctggcgttccttcttttagatccttgcttggatttgtgtttatctctgttgggttcctgttttcttgcagcatggcaactagattgcaatttgagaattcatgcgaagttggagtattttcaaagctgaccaatgcttattgcttggttgcaattgggggttctgaaaacttctacagtacctttgaggcagaattggctgatgttattccggttgtgaagacgtcaatctctggaactaggatcattggaagactgtgtgctggaaacaagaatggtcttctcttacctcataatactactgatcaagagcttcagcatttgaggaatagtcttccagattcagttgttgttcagcgcatcgaggagaaactatctgcactgggtaactgcattgcatgcaatgatcatgttgctctcacgcataccgatcttgatagagaaactgaggagatgattgctgatgttcttggggtggaagttttcaggcagacaattgctggaaatattctcgtgggaagctattgtgcattttccaataggggaggcttggtccatcctcatacatccattgaggatttggatgaactttcaacgctcctccaggttcctctggtggcaggaactgtgaatcgcgggagtgaagtgatagcagcgggcttaacagtcaatgattggacagccttctgtgggtctgatacaactgcaactgaattgtcggtcattgaaagtgtgttcaagctcagagaagctcaaccaagtgctattgtggacgagatgaggaagtcattgatagacagttacgtgtgagtaccatcagtccaagtcaagcacatcaatggcagtctgtaatacaagaacttgagctgctgccatttgatttatgtgcgcctcttggatagtttcgctgcatcctggcaattggtatcatttttgcccagggcaacaccttttgtgagtatttttagtaattgtgtaacgaatttacttctagtactgattttggtttttttaaaaaaaaaaactgtaaattcatgcagtaaacttttgatgataatgaaatgttcactttt

SEQ ID NO: 2189 - DNA, 1054 bp, Nicotiana tabacum
  misc_feature (551)..(551): n is a, c, g, or t
  misc_feature (608)..(608): n is a, c, g, or t
  misc_feature (613)..(613): n is a, c, g, or t
  misc_feature (621)..(621): n is a, c, g, or t
  misc_feature (674)..(674): n is a, c, g, or t
  misc_feature (929)..(929): n is a, c, g, or t
  misc_feature (933)..(933): n is a, c, g, or t
cagacagctacgaactttcaacgcttaacctctcttcagccgcccagttctcctgcaaaatatctctctgttcggcgcaatccaattgtaaagttcccatctttctctctttctcacgacgtcttccaagctcctaacgattctttattttccaactagcaatggctactaggcttcagtttgaaaattcatgtgaaattggagttttctcaaagctgaccaatgcttattgcttggtagctattgggggttctgagaacttctacagcacctttgagtcggagttagcaggcatcatcccagtgatcaaaacctccattggaggaacgaggataattggaagactctgtgctggaaacaaaaatgggcttctcttgcctcacactactacagatcaagaacttcagcacttgaggaacagtctgccggatggagttgtggttcagcgcattgacgagcgattatcggccctggggaactgcatagcatgcaatgatcatgttgctcttacgcatacagaccttgacaaggaaactgaagagatgattgcngatgttcttggtgtggaagtttttaggcagacaatagcagggaatattcttgttggnagctnttgttctntctcaaacaggggaggcttggtacatcctcatacgtccattgaagacttggangaactttcaactctccttcaggttcctcttgttgcgggaacagtgaatcgtggcagtgaagtgatagctgctggattgactgtcaatgactggactgccttttgtggctcagacactactgctacagagttgtccgttattgaaagcgtattcaagttgagagaggctcaacctagtgctattgttgatgagatgaggaagtcattgatcgacagttacgtttgagttatatggttcaagttgcatgtacttcanagtngtgtgtgacagtatgacctactgctttaattttgtgtttcctgtgttaaaatgtcttacttgataatgcacagatttatggtcaatcttaatggcgatttccaattttcaagtgtataatg

SEQ ID NO: 2190 - DNA, 846 bp, Musa acuminata
tcgtcatctaactttttacaggtattcaatttgagaactcttgtgaagttggggttttctcaaagctgaccaatgcctattgtttggttgcgattggaggatcagaaaacttctacagcatgtttgaagccgagttggctgatgttatccctgtggtgaagacctctatagcaggcactagaataattgggcgactttgtgctggaaataaaaatgggcttctcttgcctcacaccacgacggaccaagagctccaacatctgaggaatagtctacctgatcaagtggttgttcaaagaatagaggaaagactatctgctttaggcaattgcatagcttgcaacgatcatgttgctctcacacaccctgatctagacagggaaactgaagagctcatcgccgatgtacttggagtagaagtattcaggcagacaattgctgggaatatactggttggcagttattgtgcaatttcgaacagagggggtctggttcacccgcatacatccattgaagacctcgacgagctctccactcttctccaagtcccactcgttgccggaacagtgaaccgaggcagtgaggtaattgcttctggtatgactgtgaacgactggacagccttctgtggatccgacaccactgcaactgagctctctgtcattgagagcgttttcaaactaagagaagcccggccaagctctatcgttgatgagatgaggaagtcactcatcgacagttatgtttaggattctgagattatatttcttccaaagtaactgcttgtatttatataactagatgtgcgttaccaatgtgctgacattctctcaactacagctttca

SEQ ID NO: 2191 - DNA, 1013 bp, Eschscholzia californica
tttcagtcctccattcattctcttcttcttctttctttaagagcgattccgcaaaaccctaaagaactctgaaggttatttagttggaatctgattgaatttgtgttgtttttgatataaactatggcaattcgtcttcagtttgagaactcatgtgaagttggggtattttcgaagttgacgaatgcatattgtttagttgctattgggggttcagaaaacttctatagtacattcgagtctgagttagcggatgttatccctgtggttaaaacatctattgggggtactcggattattgggcgtctttgtgccggaaacaagaatggacttctcgtgccacacactactacggaccaagagcttcaacacttgaggaacagtttacccgatcaagttgttgttcagcgaattgacgagcgactatctgcacttggaaattgtattgcatgtaatgatcatgttgccctcactcatactgatctcgacagggacactgaggaaattatagccgatgtccttggagttgaagttttcaggcagacaattgccggaaacatacttgtgggcagttactgtaacttctctaacagaggtggattggttcatccccatacctccattgaatttggatgaactatcaactcttcttcaagtacctctagttgcaggaactgtgaacagaggtagtgaagttattggagctggtatgactgtcaacgactggacagcattttgtgggtcagatactacagcaactgagctctctgtcattgaaagtgtttttaagttgagggaagcccagcctagtgccattgtcgacgagatgaggaaatccttgatcgacagctatgtttgaactctaattagaagtctttgaacattaagaatctggtaatgtttgtgttgtcctaacttgcttcttcgttttcgtcgaaggtagactattttgggtttctatttacgagtttatgtggatgaacttaatttatatataatattagacttctgtc

SEQ ID NO: 2192 - DNA, 923 bp, Phaseolus vulgaris
acggtatgcacaactacaaaaacaacacaataccctaatttttctgcctgactctcattacctgttttctgctccggcaacttctcttccggcgccgccgctatttccgccttctaacttcgccgtgaccttctatccctaagcgctgcaccagtgctgtagatcttcaatttgattacttgggtcagatttctgtcattctcaatcatggcaactagacttcagtttgaaaataattgtgaagttggagtcttctctaaacttaccaatgcctactgcttggttgccattggaggctctgaaagcttttacagtgtatttgaaactgagttagctgatgttatccctgtggtcaagacatccataggcggtactcgtattattggtcgtctttgtgctggaaataagaatgggcttctcttgccccataccaccacagatcaagaacttcagcatttgaggaacagtctacctgatcaagttgttgttcagcgtatagacgaaaggttatctgctctggggaattgtatagcatgtaatgaccatgtggccctcacacacactgatcttgacaaggaaactgaagagatgattgcagatgttcttggagtagaagttttcaggcagaccattgcaggcaacattcttgttggtagttactgtgccttctccaataggggtggtttggtccaccctcatacttccatagaagacttggatgagctttcaacacttcttcaggttcctttggtggctgggacagttaaccggggcagtgaagtgatagcagctggaatgacagttaatgattggacagcattttgtggttcagacaccacagcaacagagctatctgtaattgagagtgttttcaagctgagagaagctcagcctagtgccattgtggacgagatgaggaaatc

SEQ ID NO: 2193 - DNA, 1009 bp, Artemisia annua
aaaaagaaaagaagcaaagcaaaaccctagtttcatccccaaattttcagtcctttcatcgccgctttcagattcccttctccagccatctttgttttctgcttacatacctattccacttaagcaagtttttatcctctgattcatcatggcgacaagacttatgtttgagaactcatgtgaaattggggtgttttcaaaattgactaatgcttattgcttggtagcaattggaggctcagaaaatttctacagcacatttgagtctgagctagcagatgttattcctgtggttaagacctcaattggtgggacaagaattattgggcgtctttgcattggtaacaaaaatgggcttcttgtgcctcacactactactgaccaagagcttcaacacttaaggaacagtctccccgatgcagttgtggtccagcgtattgatgagaggctatctgcccttggaaattgcatagcctgcaatgaccacgttgcccttactcatactgatcttgatagggaaactgaggaaatgatagcggatgttcttggtgtggaagttttcagacagacaattgctggtaatattctcgtgggcagctattgtgcgttttcaaaccgaggtggcctggtccaccctcatacctccattgaagacttggatgagctgtcaaccctccttcaagttcctttggtagcaggcactgtgaaccgtggtagtgaagtgataggtgcgggtataattgttaatgactggaccgccttctgtggatcagataccacagcaacagaattgtctgtgattgagagtgttttcaagttgagagaagctcaaccaagtgccattgtcgacgaaatgaggaagtcattgatcgacacctatgtctgattacttgcaagtcaactataactcaacattgctggatttcttcttttgaactttcattgacttgttttatgtttgttttcgctactggtattatgtaagatcttagagttgcaattacttatc

SEQ ID NO: 2194 - DNA, 1062 bp, Ocimum basilicum
ctttcatataacttccctttttctcctctctcaaaatttttcactctcactcgttcgttcggcgccggcaacaccctctcctcaactcatccttcccatcacctctaactgatttgattctggtttcccttctgctccagtgccatctccttcgctatggctacaagattgcagtacgagaataattgtgagattggggttttttctaagctgaccaatgcgtattgtttggttgcaatggggggatctgaaaacttctacagcacatttgaggctgagttggctgatgtgattcctgtcgttaaaacgtccatttctggcactcgaatcattgggcgcctatgtgccggaaataagaatgggctgcttttgccacacaatactacggatcaagagctccaacacttgaggaacagtctaccagactcggttgtcgttcaaagaattgatgaaaggctatctgctctggggaactgcattgcctgcaatgatcatgttgctcttacacaccctgaccttgacaaggaaacggaggaaatgattgcagatgtgcttggtgtggaagttttccgtcagactatagcaggcaatattcttgttggcagttattgtgctatttccaacagaggtggcttggttcatcctcatacatcgatagaggatctagacgaactttcaaccctccttcaagtcccgttggtagctgggacggtgaatcgtggtagtgacgtgatagctgctgggttgacagtgaatgactggactggtttctgtgggtccgacaccactgctactgagttgtctgttattgagagcgttttcaagttgagggaagctcaacctagtgctctggtcgatgaaatgagaaaatcattgatcgacacctatgtgtgagtactagatagatatcgttgtggttgacactgaagaatgtgagttgttaaggtggtgatggatggatgggtctttaaagaaaggtgtgtaatatcccttttcgggtggtgctactcttttactatttcataactaatcgtattcagtgttttcagtgatgacaatttt

SEQ ID NO: 2195 - DNA, 1142 bp, Vaccinium corymbosum
acgtacaatttactaattccgccttcatcttttgggcaaaaggcagaacaaaagacctgcgcaaaaaccctaaacgcttataaaaccctaacttgaaccttgctattggtgaattaagggccgatttccgaacctatctgatcaaagctgtccgtaaaacttccctcagatcctgtattactctgattctttgtacgttcagctgattatcttatcatcatggcaactagacttcaatttgagaactcatgtgaagttggggtattctcaaagctgaccaatgcttattgtctggttgccattgggggttcggaaagtttctacagcacgtttgagtctgagttggcagatgttattcctgtggttaaaacctcaattggcggtactcggattattggtcgactttgtgctggaaacaaaaatgggcttctcttgcctcacaccaccactgatcaagaactgcaacacctgagaaatagtttgccagatcaagttgttgttcagcgcattgacgaaagactatctgctcttggtaattgcatagcatgcaatgattacgttgctctaacacacactgatcttgacagggaaactgaggagatgatcgctgatgttctgggggtagaggttttcaggcaaacaattgctggtaatattcttgtgggtagctactgttccttatccaataaaggtggtctggtccatcctcatacgtccattgaagacttggacgagctttcaaccctccttcaggttcctctggtggcggggacagtgaaccgtggcagtgaagtaatagctgccggcttgacagtaaatgactggacagcattctgtggatcagacaccacggcaacagagttgtctgtcattgagagcgtcttcaagttgagagaagcccaacctagtgccattgttgatgagatgaggaaatcgttgatcgacagctatgtttgaatcaattggctgtcttgggcatttagttctatgtctgaacctcattgcccttgtttcttcaagtcgaaccctttaagttgatacctatttttaattatttgttttgcttttgttgttccctatttgtatatgtgaagaatctattgtactcgatggggttgtctgtcctgagattcgcataacaa

SEQ ID NO: 2196 - DNA, 1499 bp, Theobroma cacao
ctgtgttgatataagattctttatgtaggcttatgtctatgatactgtcattggtttaaccaaaaactagttgtttttcgtatgtgatagtcattatttctgtagtcaccatattttacacttaatgttctaggccgtcataagattttgttccccgtagtccatggttgataaggttctattagctatagggaactaaagccgcccgctacaatccggctgtagctcgttagctactcttttcttccaaaagaaccaaaaccctaagcatcaagttaaaactctaattgggttgtggtatcctatcctcattcaaagcagcttaagctcatcaattttttgttttgatcatggctaccagacttatgttcgagaactcatgcgaagttggggttttttcaaagttgactaatgcttactgcttggttgcaattggaggatcagagagcttctatagcacattcgaggccgagttagcagatgtcattccagtggttaaaacatctattgccggcactaggattatcggccgtctttgcgcagggaacaaaaatggtcttctcttgccgcacaccactactgaccaagaacttcaacacttgagaaacagcctacctgatcaggttgttgttcagcgtgttgacgagaggctatcagccttggggaattgcatagcatgcaatgatcatgttgctcttacacacactgatcttgaccgggagacagaggagttgattgcagatgttctgggagtggaagtctttaggcagacaattgctggcaatattcttgtgggcagctactgtgctatctctaatagaggtggcttggtccacccccatacgtccattgaagatttggatgaactctcgactctccttcaggtacctttggtggcagggactattaaccgtggtagtgaagtgatagctgctggtatggtagtgaatgattggacagcattttgtggggcagataccactgcaactgaactctctgtcattgagagtgttttcaagttgagggaggcccaacctactgccattgtggatgagatgagaaaatctttaattgacagctatgtctaagttttcaatgttactactgctattagaacactggagcactagctctgctaatgtttgcgcatatgtttagccgatcggtatttgtatcactgttctcattgtatcactttgaataagcatatatctttaaagtagtccttttcttttactcttttatccaattggatttgaacctgggttccatgactggatttgttgtaagcatttcactaaaaggagaatgtatcttttaaagctgttcagtcttgtctgataggagttaaacctgatggaaggaacccatagttagcatttcatagaaatatataccaaacttgtcaaacctcaattggtttggggcaaaatttggctcaaatggttcattcagtctcttagctgcagtctcttgcaaaatacattaaaagaatagtg

SEQ ID NO: 2197 - DNA, 1137 bp, Gossypium hirsutum
acccatactcatttcgattcacacatacatcctccgccgccagccgagccatttgtcttccacttgttatatccctcttttgccttccgaaaagagcagcaaaatcaagtaaggttgatttaaacccagcttctttatcacagagcttcttcctttctgttcttatctttttgatcaatcgtctctgcttgataatggcaactaggcttcaatttgaaaattcatgtgaagttggagtcttttccaagctgaccaatgcctactgcttggttgcaattggagggtcagaaaacttctatagtactttcgagtcggagctggcagatgtcattccagttgttaagacctctattgctggcactagaataataggacgtctatgtgctggaaataagaatgggttacttgtaccccacaacacgaccgatcaagaacttcaacacttgcggaatagtctaccggatcaagtcgttgttcagcgcatagaggagaaactatctgctcttggcaactgtatagcttgcaatgatcatgttgctctgacacacactgatctagacaaggaaaccgaggagataatcgctgatgtgctcggcgtagaagttttcagacagacaattgctggtaatattcttgtagggagctactgtgccttttctaacagaggtggcttggtccatcctcatacatccattgaagacttggatgaactttcaacgcttcttcaggttccattggtagctggcaccatcaaccgtgggagcgaagtgatagccgccgggatgaccgtaaatgactggacagccttttgcgggtcagacaccactgcaacggagctttctgtgatagagagcgtgttcaagctgagagaagcgcaacctagcgccattgtcgatgagatgaggaagtcattgattgatacctatgtttaagcttccccttcctttggttaatctaaaattgaagtccttcatataaatatggtattacactgttttatgtgagaaacataatataagtgtaaattaagtgagatgttgatgtttgatgaaaatcacttggatgcatctttgcatcattacgtcgtattttattcttatgttatgctacatagcaaccattctatatatgtaattc

SEQ ID NO: 2198 - DNA, 1109 bp, Humulus lupulus
gaaaatcttttacaaaactttaataaagatatttttcctgttgaccagattgcattgcagagaactcatacctcaattcatgtccaaaccgaaacactgttcaatcaaaccctttaaaccctaacatattccattaaacctggtcatagcaatcgcgtgatcgagcttccgaacatggccgtccgtcttcaattcgagaactcgtgcgatgtcggggtgttctccaagctcaccaatgcctactgtttggttgccataggaggttctgagaatttctacagcgcttttgaatcggagctggctgatgtgattccggtggtgaagacctccatctccggcactcgcatcattggtcgcctttgcgctggtaacaaaaatgggcttttgatgcctcataataccactgaccaagagcttcagcacctgagaaacagtttacctgatcaagttgttgttcagcgcatagaagagaaactatctgctcttgggaattgtatagcttgcaatgaccatgtggctctcactcacaccgatcttgacaaggaaactgaagagatgatagcagatattctgggagtagaagttttcaggcagacaattgccggaaatattcttgttggcagctactgtgccttctccaatagaggtggcttggttcacccccacacatctgttgaagacttggacgaactttcaacacttcttcaggttcctttggttgctgggacggtcaaccgggggagtgaagtgattgcggctggcatgacggtgaacgactggacggccttctgtggctcagacaccactgcaactgaactctctgttatagagagtgtcttcaaattgagggaggcacaacctagcgctattgtcgatgaaatgaggaaatcattgatcgatacttatgtctgattttctattattattattattattagtggcgttagatcgcttgcaatgtttgaaatatcaacgctgttaatatatgacaatgtctgtaacttttcgaagtatgttttaaagctcttgtcgttgctccgtttacttgttataaagaaatttacaagtgcagaatgtaataatgtgtacattttatttggttacaagtt

SEQ ID NO: 2199 - DNA, 985 bp, Ipomoea nil
aagggttttgcagagtagaacctggtagggccgtaggggtttttttcgcggcttgcagagaaccagagagggttttgagctacgagggccgccaattgtttcagtctttcagagaagttgaaagccgctggtttggttaataccatggcaactaggttgcagttcgagaattcatgtgaaattggggtcttctccaagctgacaaatgcttattgcttggtcgccataggtggatcagaaaacttttacagcacgttcgaatctgagctcgcagatgtcattccagtaattaaaacctccataggtggaacccggatagttggacggctttgtgctggaaacaaaaatgggcttattttgcctcatactactactgaccaagagcttcaacacttgagaaacagtttgccagatggtgttgttgttcagcgtgttgatgagagattgtctgctctgggcaactgcattgcttgcaatgaccatgttgctcttacacacacagatcttgatagggaaactgaagagttgatcgctgatgttcttggagttgaagtctttaggcagacaattgccggaaacatccttgttggcagctattgtgctttttctaatagaggtggattggtacatcctcatacatctattgaagacttggacgagctttcaactctcctccaggttcctctggtggctggaactgtgaatcgtgggagtgacgtgattgctgccggattgacagtgaatgactggacagcgttctgtggctctgataccaccgcaacggagttgtctgtcattgagagcgtgttcaagttgagggaggctcaacctagtgctattgtcgatgaaatgcgaaaatcgttgattgacagctatgtctaaagttttgttcacatttaagcatccttggcaccaatactatatagaagggaattgatttttctgctctttgctttgttcttgtgtttgtaatgtgaaatgatgt

SEQ ID NO: 2200 - DNA, 1190 bp, Mimulus guttatus
aaacctaaacctaatttttctgatacaattttcatccgtcgcctcaaagcactctttcgcacatccgccgcttaattcctccgccgttccttcacacccgccgcttcattcttattaaatttcagtttttcttcatcctttttctcctttcacaaatggcaacaagattgcagtacgagaacaatagcgagattggggttttctccaagcttacgaatgcgtattgccttgttgcaattggtggttctgaaaacttttacagcacgtttgaggctgagttggccgatgtaattccggtcgttaaaacttccattgccggcactagaatcatcggacgcctctgcgctggaaataaaaatgggttgctgttgcctcacaatactactgatcaagagcttcaacacttgaggaacagtctaccagattcagtggttgttcagcgcattgatgaaagattatctgccctagggaactgcattgcttgcaatgaccatgtcgctcttacacatcccgatcttgacagggaaactgaggaaatgattgctgatgttctaggcgttgaagttttccgacaaactgttgccggcaatatacttgtggggagttactgtgcactttcaaatagaggtggcttggtccatcctcatacatcaatcgaggatctagatgaactctcgacacttcttcaagtccctttggtggctggcacagtgaaccgtggtagtgaagtgatagctgctggtctgacggtcaatgattggacagcattctgtggttcagacacgactgcgactgagttgtctgtcctcgagagtgttttcaagttgagagaagctcaaccgagtgctattgttgatgagatgagaaaatcattgatcgacacctatgtttgaattacccttttgaactttggataaacctttctccttttcaatgtgtagatgaagctactacgattccttccgggcttgagctttattttgtggaaagacttttttttttgtccttgttaaattttgttactccattatgtaagcttcgtaactgttggattaaaagtatcatcttgttttctgttcgtttcagtcactttgcggcggtgtttattcgttaatgaattgctctacttgggtgacatgtattattcgcacaatatcttgttatccgtgaaaaatctgttcttgatctgt

SEQ ID NO: 2201 - DNA, 1263 bp, Mimulus guttatus
gatttgcgctaaaataaaattaaagaattagaaaaggaataatttatcctctgagtaccgactcaaaacccccaaacctaaacctaatttttctgatacaattttcatccgtcgcctcaaagcactctttcgcacatccgccgcttaattcctccgccgttccttcacacccgccgcttcattcttattaaatttcagtttttcttcatcctttttctcctttcacaaatggcaacaagattgcagtacgagaacaatagcgagattggggttttctccaagcttacgaatgcgtattgccttgttgcaattggtggttctgaaaacttttacagcacgtttgaggctgagttggccgatgtaattccggtcgttaaaacttccattgccggcactagaatcatcggacgcctctgcgctggaaataaaaatgggttgctgttgcctcacaatactactgatcaagagcttcaacacttgaggaacagtctaccagattcagtggttgttcagcgcattgatgaaagattatctgccctagggaactgcattgcttgcaatgaccatgtcgctcttacacatcccgatcttgacagggaaactgaggaaatgattgctgatgttctaggcgttgaagttttccgacaaactgttgccggcaatatacttgtggggagttactgtgcactttcaaatagaggtggcttggtccatcctcatacatcaatcgaggatctagatgaactctcgacacttcttcaagtccctttggtggctggcacagtgaaccgtggtagtgaagtgatagctgctggtctgacggtcaatgattggacagcattctgtggttcagacacgactgcgactgagttgtctgtcctcgagagtgttttcaagttgagagaagctcaaccgagtgctattgttgatgagatgagaaaatcattgatcgacacctatgtttgaattacccttttgaactttggataaacctttctccttttcaatgtgtagatgaagctactacgattccttccgggcttgagctttattttgtggaaagacttttttttttgtccttgttaaattttgttactccattatgtaagcttcgtaactgttggattaaaagtatcatcttgttttctgttcgtttcagtcactttgcggcggtgtttattcgttaatgaattgctctacttgggtgacatgtattattcgcacaatatcttgttatccgtgaaaaatctgttcttgatctgt

SEQ ID NO: 2202 - DNA, 1100 bp, Tropaeolum majus
ccatcgtttccttggttcttgtaacatcttccgattattcttgcggtttcagttgcaggcgaggtatttcatcaggaaccagcatcttctgcacttcctgtcaggtttccgcgactttcgatctatcccaaggattacacacgcccaaattaaacgcagagagctcgtggaatttcgaggcgtaatcttccatccaatttttttatgattagatcttgatcctcgtttgatcattctccatcaatcatggctactagacttcagtttgagaattcatgcgaaataggagtgttctccaagctcactaatgcgtattgcctagttgcaattggagggtctgaaaacttctacagtactttcgaggcggagttagcagatgttattccagtggttaaaacctcgatatcaggaactagaatcattgggaggctatgtgctgggaacaaaaatggacttcttgtgccacacaacactacggaccaagagcttcaacacttgaggaatagtctacctgatcaagtcgtcgttcagcgcatagatgagaaactatcagctctagggaactgcattgcatgcaatgatcatgtggcgcttacgcacactgatcttgacagggaaactgaagaaatcatttcagatgttcttggtgtggaagttttccgacaaaccattgcaggaagtattctggtgggaagctactgtgcgttctccaacagaggcggcattgtccatccccatacctctgtggaagacctggatgagctttcaactcttctccaggttcctttagttgccggaactgtcaaccgtggtagtgaagtaattgctgctggaatgacagtaaatgactggacagcattctgcggatcagacacaacagcaacagaactttcggtcatcgagagcatcttcaagttgagagaagcacagcctagtgcgatcgtggatgagatgaggaaatctttgatcgacacttacgtttgaactgttactgttctttttatatgataccgaaacacttttaacagtttatccatggaagaagaaactagaaaatgttgttctacttttttttagttgctctttatttaagtttttaa

SEQ ID NO: 2203 - DNA, 1507 bp, Citrus sinensis
agttaaggtatgtttttgatattttgcgtagaaggggagttatatccacgcaattccctcattttttcagtaaacagacagacagacagaagaaatacactatattattgtataaatataaacgaggacaggcagaggcatcgcttcgtctgaatagaaagtaggaagcagaaaccctcttctcatctcatattgggtggggtactggggtttgtttccggccgaaagggtagcaagtgaagggccgcctcatcatcattatcatcagcgctttggcatttcgagttttcgacatcgttttccgtcattttgctttttaatcaattcaatttctgtcaatctgtaatcatggcaaccaggcttatgtttgagaattcatgtgaggttggtgtgttttccaagctcactaatgcttattgcttggttgcaataggaggttctgaaagcttctacagcacatttgaggctgagttagcagatgtttttcctgttgttaaaacatctattggtggcactaggattatcggccggctttgtgctggaaacaaaaatgggcttctcttgccgcacactaccacagaccaagaacttcaacacttgaggaacagcctacctgatcaagttgtcgttcagcgtattgaagagaggctatctgccctgggcaactgtatagcatgcaacgaccatgttgctcttacacacacagatcttgacagggaaacagaggaaatgattgcagatgttcttggagtagaagtttttaggcagacaattgctggtaatatccttgttggcagttactgttccttctccaacagaggaggcttggttcaccctcacacatccattgaggacttggatgaactttcaactctcttgcaagtacctttggtggctgggactgtgaaccgtggaagcgaagtcatagctgctgggttaactgtgaatgactggacagcattctgtggatcagacaccacagcaactgaactctctgttattgagagtgttttcaagttgagggaagctcaacctagtgcccttgtggacgagatgaggaaatctttaattgacagttatgtctaagttactttggcttacagtcttttttgtcatgaagttgaagcggtgtttgtcaactctgaagatgttttcccttaatgatagtatgttattttccagaatcttgtatctcaatcagaagtatcatattcagaaaaaggacagatgctgagcttttttttttttaattcaagttgtttttaaccccatgaacggagagtttttggttttgtgcaattttgttctcaaaaggtaagtgtggactgtagatccatgatttattgagagtaggagcaatattcatacttgatcacaggctattcatctcactggtgcctggttaacttagctacacttactaggacgagagtagccaaaaatttctgaaaataacaatgtagtacagttaaaaaatgctacttgaatttgttgcaatttgaaatgc

SEQ ID NO: 2204 - DNA, 1023 bp, Capsicum annuum
aatatctttcttcgccaaatccaaattatcttccaagctcctagaaatcctgttttttccaactagcgatggctactaggcttcaatttgaaaattcatgtgaaattggagttttttcaaagctgaccaatgcatactgcttggtagctattgggggttctgaaaacttctacagcacatttgaggctgagttatcaggcattatcccagtgatcaaaacctccattggaggaacgaggataattggaagactctgtgctggaaacaaaaatgggcttctcttgcctcataccactacagatcaagaacttcagcacttgaggaacagtctgccggatagtgttgtggttcagcgcattgatgagcgattatctgccctgggaaactgcatagcatgcaatgaccatgttgctctgacacatacggatcttgacaaggaaactgaagagatgattgctgatgttcttggtgtggaggttttcaggcaaacaatagcagggaatattcttgttggcagctattgtgctatctcaaacacgggaggcttggtacatccgcatacatccattgaagacttggatgagctttcaactcttcttcaagttcccctggttgctggaaccgtgaatcgcggtagtgaagtgattgctgctggattgactgtcaatgactggacagcatttactggatcagacactactgcaacagagttgactgttattgaaaatgttttcaagctgagagaggctcaacctactgctattgttgatgagatgaggaaatcattgatcgacagttacgtttgagttataatttaaattgcgtgtactacaaaattctgtgaggaagtttgagttgctgctattaattttgagtttcctatgttaaaaattcaacttgataatgcacagatttatggttaatcttagttgggttttctgatttcaagtgtataatgtagtacatttgggtcttaagaaaattagatctccttataatatttcctccattgatgcctcgtgc

SEQ ID NO: 2205 - DNA, 1118 bp, Fragaria vesca
tcataaaaagtgcatgaagaagttggttcgtacttcatactgtttacatgagtcggtcaaaatccaaaactaaatcacagccgtcgatctaactgttgatacgacccactccaatgactccactctaccttcctcccactactaaccaggacaaccagaaagtgatcatttccttctgcaatccaaaaccctaactccgtcggcgctcgcgattccggctgaaactgaggctccgatcagtcgccgttgactcgtcatttcaccatggctaccagaatccaattcgagaactcgtgcgagatcggagtgttctcgaagctgacgaacgcgtattgcttggtctcgatcggaggctccgagagcttctacagcacatttgagtcggaactggctgacgtcatccccgtcatcaagacctccatcggaggcactcgtatcatcggtcgtctctgtgctgggaataaaaatgggctgcttttgcctcacaccaccactgatcaagagttacagcatctgaagaacagcttgcctgatcaagttgttgttcagcgcgtcgacgagaggctatctgcacttggtaactgcattgcgtgcaatgatcatgttgctcttacacatactgatctcgatagggaaactgaggagatgattgcagatgttcttggagtggaagtgtttaggcagacaattgccgggaatattcttgtaggcagttactgtgctatctccaacaaaggtggcttggttcatcctcatacatccgtggaagacttggatgaactttcaacacttcttcaggttcctcttgtagccggtacagtcaaccgtggtagtgaagtgatagctgccggcatgacggtgaatgactcgacagcattctgtggctcggacaccacagcaacggaagtctcggttatcgaaagcgttttcaagttgagagagtcccaacctagtgccattgtggatgaaatgaggaaatccttgatagacagttatgtttaagcggattctctgggagtaatatgatgattattcgttcatgtttttggttccccttatggttaaagatatttgaggtgtgtgaatccattttaaagtcttgctacctagttgtgtag

SEQ ID NO: 2206 - DNA, 1067 bp, Solanum lycopersicum
ataatcaaatcgctgcaaacgttcaccgctgtgaaaccttttcagccgccgagttcctcaaaatatctttttttcgcccaaatccaatcatctttcaagctccaagcaattctgtttttttactagcaatggcaactagacttcaatttgaaaactcgtgtgaaattggagttttctcaaagctgaccaatgcatattgcttggtagctattgggggttctgaaaacttctacagcacatttgagtctgagctatcaggcattatcccagtgatcaaaacctctattggaggaacaaggataattggaagactctgcgctggaaacaaaaatggtcttctcttgcctcacactactacagatcaagaacttcagcacttgaggaacagtctgccagatggagttgtggtccagcgcattgatgagcgattatctgccctgggcaactgcattgcttgcaacgatcatgttgctctgacacatacagatcttgacaaggaaacggaagagatgattgctgatgttcttggtgtggaagttttcaggcaaacaatagcagggaatattcttgttggcagctattgtgctatctcaaacacaggaggtttggtacatcctcatacgtccattgaagacttggatgagctttcaactcttcttcaggttcctctggttgcaggaactgtgaaccgcggtagtgaagtgattggtgctggattgactgtcaatgactggacagcatttactggctcggacactacggcaacagagctatctgttattgaaagtgttttcaagctgagagaagctcaacctactgctattgttgatgagatgaggaaatcattgatcgacagttatgtctaagttattatttaaattgtatgtactacaaaattatgggttgctgctttaattgtgtttcctatgttaaatggtctcacttgataaaaagcagatttatgtttttaatcttatttgcgttttctgtttttcaaatgtataatgtagtacatttgagtataagaaatttctatctccatataatattttccattttcatagtgt

SEQ ID NO: 2207 - DNA, 1128 bp, Triphysaria pusilla
aaatatatgtcatttaagcaaaaataatttgaaatattgatttgttccctttctatatatttaaccctaattcgttcatcctcccactttctctcaaaatctcccttcaattaacttctatctctgctccagctgaacggttcatcagttttggaggtagcaggtctcattgtctctcttccaacctttccctttcaccatggcgacaagattgcagtacgagaataattgtgaggttggggttttctccaagctcaccaatgcatattgtcttgttgcaatagggggctctgaaaacttctacagcacatttgaagctgagttggctgatgttattccggtggttaaaacctccattgctggcaccaggatcattggacgtctctgtgctggaaataaaaatgggttacttttgccccacaacactactgatcaagagcttcagcatctgaggaacagtctaccagattcagtagttgttcagagaattgaggagaggttatctgctctaggtaactgcatttcctgcaatgatcatgttgctcttacacaccctgatcttgacaaggaaaccgaggagctgattgctgacgttctcggggtggaggttttcaggcagactgttgctggtaatatacttgtgggaagttactgtgctttttccaacaggggtggcttggttcaccctcatacctcgatagaggatctagatgagctctcaaccctccttcaggttcctttggtggctgggactgtgaatcgtggtagtgaagtcatagctgctggcctgactgtcaatgactggacggccttctgtggatcggataccactgctactgaattatcagtcatagagagtgttttcaagctgagggaatcccagcccagtgctcttgtcgacgagatgaggaaatcgttgatcgacacctatgtttgaggattttcgacttattattatgtgtagatgaagtttatgctgtggtttgtgcactagtttgggttttatggagaaaaaactgttttatgttactcttgcatgttgtttgtgccgttgttttggcaatggatcatgacttgaatttggattgtgtgtttacgtgtaatggcagcagtagatcttgtcatttt

SEQ ID NO: 2208 - DNA, 784 bp, Vinca minor
catggcaacaagattgcaatttgagaattcgtgtgaaattggagtgttctcgaagctgaccaatgcttattgcttggttgctattggaggttctgagaacttctacagtacgtttgagacagaattagctgatgttattccggttgtgaagacctcgatttctggtaataggataattggaaggctctgtgcaggaaacaagaatgggcttctgttacctcataatactactgatcaggagcttcaacatttgaggaatagtcttccagattcggttgttgttcagcgcattgacgagagactatctgcattgggtaactgcattgcatgcaacgatcatgttgccctcacacataccgatcttgatagggaaaccgaggaaatgattgctgatgttcttggggttgaagtttttcgacagacaattgctggaaatattctggtgggaagttattgtacattttccaacagaggaggcttggttcatcctcacacatccatcgaggatttggacgaactttcaaccctcctccaggttcctctagtggcgggaactgtgaatcgcggtagtgaagtgatagcagcaggcttaacagtcaatgactggacggccttctgtggttcagatacgactgcaactgaattgtcagtcattgaaagtgtgttcaagctcagagaagctcagccgagtgccattgttgatgagatgaggaagtcgctgatagacacttacgtgtgagtcccagcagttcaagtatatgaattgtagtctgtattacaagaa

SEQ ID NO: 2209 - DNA, 953 bp, Nicotiana benthamiana
ttgtaatgattctaattgatttcagggcttcagtttgaaaattcatgtgaaattggagttttctcaaagctgaccaatgcttattgcttggtagctattgggggttctgagaacttctacagcacgtttgagtcggagttagcaggcatcatcccagtgatcaaaacctccattggaggaacgaggataattggaagactctgtgctggaaacaaaaatgggcttctcttgcctcacactactacagatcaagaacttcagcacttgaggaacagtctgccagatggagttgtggttcagcgcattgacgagcgattatcggccctggggaactgcatagcatgcaatgatcatgttgctcttacgcatacagaccttgacaaggaaactgaagagatgattgctgatgttcttggtgtggaagtttttaggcagacaatagcagggaatattcttgttggcagctattgctctttctcaaacaggggaggcttggtacatcctcatacgtccattgaagacttggacgaactttcaactctccttcaggttcctcttgttgcgggaacagtgaaccgcggtagtgaagtgatagctgctggattgactgtcaatgactggactgccttttgtggctcagacactactgctacagagttgtccgttattgaaagcgtattcaagttgagagaggctcaacctagtgctattgttgatgagatgaggaagtcattgatcgacagttacgtttgagttatatggttcaagttgcatggacttcggagttgtgtgtgacagtatgacctactgctttaaatttgtgtttcctgtgttaaaatgtcttacttgataatgcacagatttatggttcatcttaattgcgattttcagttttcaagtgtataatgttgtataagaaaaattaatttccttataaattttgttatgtagca

SEQ ID NO: 2210 - DNA, 1200 bp, Populus trichocarpa
gcatcgtattacagagaaagggcataagaaaaatatctgcgcgggtctaaaaccacacaacccttcattttctctccctcgcagacgccagtgtttccgccactgcaaaaacatcaaacactcttgtttatctctgtgtccgactttgtaatcttcatggcgagcagacttcagtttgagaataactgtgaagttggtgtgttttccaagttgaccaatgcgtactgcttagttgcaatcggtggatcagaaagcttctacagcacttttgaggcagagttagctgacgtcattcctgtcgttaagacctcaattgctggcactaggataattggacggctatgtgctggaaacaaaaatgggcttcttgtgcctcacaccaccactgatcaagaactccagcatttgagaaacagcctacctgatcaagtcgttgttcagaggattgacgagaaactatctgctttgggtaattgcatagcatgcaatgatcatgttgcccttgcacacactgatctggacagggaaactgaggagataattgctgatgttctcggggttgaagtgtttaggcagacaattgctggcaacattcttgtggggagctactgtgccttctccaacagaggtggtttggtccatcctcatacatccattgaagacttggatgagctctccacccttcttcaggtccccttagttgcaggtactgtaaaccgtggtagcgaagtgatcggtgctggaataacagtaaacgactggacagccttctgtgggtccgacactacagctaccgaactatctgtaattgaaagcgtcttcaagttgagggaagctcgacctagtgccattgttgatgagatgaggaaatcattaattgacagttatgtttgaattgacgttacctattctcccacctgtcaacgggctccttatcctcctgtaatggaaacattaatattttaaccttcttaagtcggattttgttttccaattaagaatacatgcttttgaaatggggttttaagttccctgtattttaccggctctcaatgtctctacaattgattctccttttgttcctcattgtccctgctaaattatattgttccctctcatctgtgttgtttcatgtagctacaaatttcacatgaattagatagagaaaaaaaatgttatttaatggtagcttttcatgga

SEQ ID NO: 2211 - DNA, 1068 bp, Catharanthus roseus
tttctctttgactatataaaccctaaccctaaaacctaatcggagtaccgacaatctagttcttcccgtgttgcatctcttcttcagatacttgtttggatttctgtttatctcggttgggattccggttttcttgcagcatggcgacaagattgcaatttgagaattcatgtgaagttggggtattctcaaaactgaccaatgcttattgcttggttgctattggaggttctgaaaacttctacagtacctttgagtcagaattggctgatgttattccagttgtgaagacctcaatttctgggactagaatcattggaaggctctgtgctggaaacaagaatgggcttctgttacctcataatactactgatcaagagcttcagcatttgaggaacagtcttccagattcagttgttgttcagcgaattgaggagagactatctgcactaggtaactgcattgcctgtaacgatcatgttgccctcacacataccgatcttgatagagaaacagaggagatgatcgctgatgttcttggggtggaagttttcagacaaactattgctggaaatattctggtgggaagctattgtgcattttccaataggggaggcttggtccatcctcatacatccattgaggatttggatgaactttcaacacttctccaggtccctctagtggcaggaactgtgaatcgggggagtgaagtgatagcagcaggcttaacagtgaatgactggacagccttctgcggatctgatacgactgcaactgaattgtcagtgatcgataatgtgttcaagctcagagaagctcaacctagtgctattgttgacgagatgaggaagtcattgatagacagttatgtgtaggctgtaatacaagaattagagttcctactattctgcttttggataaaagtttgataattttctcgcatttgttatccttttcgacatctgctgactggaatttgtattttactcatttctggttctaattttgggtgtaagaattataattgtaatgaaatgtcttatacatgcagcatagtttctaaag

SEQ ID NO: 2212 - DNA, 1500 bp, Citrus clementina
agttaaggtatgtttttgatattttgcgtagaaggggagttatatccacgcaattccctcattttttcagtaaacagacagacagacagaagaaatacactatattattgtataaatataaacgaggacaggcagaggcatcgcttcgtgtgaatagaaagtaggaagcagaaaccctcttctcatctcatattgggtggggtttgtttccggccgaaagggtaacaagtgaagggccgcctcatcatcattatcatcatcgctttggcatttcgagttttcgacatcgttttccgtcattttgctttttaatcaattcaatttctgtcaatctgtaatcatggcaaccaggcttatgtttgagaattcatgtgaggttggtgtgttttccaagctcgctaatgcttattgcttggttgcaattggaggttctgaaagcttctacagcacatttgaggctgagttagcagatgtcattcctgttgttaaaacatctattggtggcactaggattatcggccggctttgtgctggaaacaaaaatgggcttctcttgccacacactaccacagaccaagaacttcaacacttgaggaacagcctacctgatcaagttgtcgttcagcgtattgaagagaggctatctgccctgggcaattgtatagcatgcaacgaccatgttgctcttacacacacagatcttgacagggaaacagaggaaatgattgcagatgttcttggagtagaagcttttaggcagacaattgctggtaatatccttgttggcagttactgttccttctccaacagaggaggcttggtccaccctcacacatccattgaagacttggatgaactttcaactctcttgcaagtacctttggtggctgggactgtgaaccgtggaagcgaagtcatagctgctgggttaactgtgaatgactggacagcattctgtggatcagacaccacagcaactgaactctctgttattgagagtgttttcaagttgagggaagctcaacctagtgcccttgtggacgagatgaggaaatctttaattgacagttatgtctaagttactttggcttacagtcttttttgtcatgaagttgaagcagtttttgtcaactccgaagatgttttcccttaatgctagtatgttattttccagaatcttgtatctcaatcaggagtatcatattcagaaaaaggacagatgctgaactttttttttttttaattcaagttgtttttaaccccatgaacggagagtttttggttttgtgcaattttgttctcaaaaggtaagtgtggactgtagatccatgatttattgagagcaggagcaatattcatacttgatcacaggctattcatctcactggtgcctggttaacttagctacacttactaggacgagagtagccaaaaatttctgaaaataacaatctagtacagttaaaaaatgctacttgaatttgttgcaatttgaaatgc

SEQ ID NO: 2213 - DNA, 1321 bp, Gossypium raimondii
ctccaagtaatatatatatcaaaaagttttctttaaaaaattttgctttaaaaattcccgacccatactcatttcgattcacacatacatcctccgccgccaaccgagccatttgtcttccacttgttatatccctctcttgccttccgaaaagagcagcaaaatcaaataaggttgatttaaacccagcttctttatcgcagagcttcttcctttctgttcttatctttttgatcaagtctctgcttgataatggcaactaggcttcaatttgaaaattcatgtgacgttggtgtcttttccaagctgaccaatgcctactgcttggttgcaattggagggtcagaaaacttctatagtacttttgagtcagagctggcagatgtcattccagttgttaagacctctattgctggcaccagaataataggacgtctatgtgctggaaataagaatgggttacttgtaccccacaacacgaccgatcaagaacttcaacacttgcggaatagtctaccggatcaagtcgttgttcagcgcatagaggagaaactatctgctcttggcaactgtatagcttgcaatgatcatgttgctctgacacacactgatctagacaaggaaaccgaggagataatcgctgatgtgctcggcgtagaagttttcagacagacaattgctggtaatattcttgtagggagctactgtgccttttctaacagaggtggcttggtccatcctcatacatccattgaagacttggatgaactttcaacgcttcttcaggttccattggtagctggcaccatcaaccgtgggagcgaagtgatagccgccgggatgaccgtaaatgactggacagccttttgcgggtcagacaccactgcaacggagctttctgtaatagagagcgtgttcaagctgagagaagcgcaacctagcgccattgtcgatgagatgaggaagtcattgattgatacctatgtttaagcttccccttcctttggttaatctgaaattgaagtccttcatataaatatggtattacactgttttatgtgagaaacataatataagtgtaaattaagtgagatgttgatgtttggtgaaaatcacttggatgcatctttgcatcattacgtcgtattttattcttatgttatgctacatagcaaccattctatatatgtaattcctcaacttcccagcttttttatataaataatattaaataaataaataattatcaaaatggaatagattaaaaattaaatacgaaaataggtaaaatgcacggtgcccgtacagcacgggcggcacc

SEQ ID NO: 2214 - DNA, 1158 bp, Vitis vinifera
attcatatataactcatatggagattgatattctttcgttgactcttaccttctattgtctttctaaaaccctaacctcacaaaaccctaattctcgctaacgattaagactgcaagctttgtttttttgactttcatcatggcaaccaggcttcagtttgagaactcgtgcgaagttggggtgttctccaagctcaccaatgcgtattgtttggttgcgatcggtggttccgaaagcttttacagtgtgtttgaatcagagttggctgatgttatccccgtggttaaaacctcgattggtggtacgagaattattggtcggctttgtgctggaaacaaaaaagggcttctcttgccacacaccaccacggaccaagaacttcaacacctgaggaacagcctccctgatcaagttgttgttcagcgtatagaagagaagctatctgctctaggaaattgcatagcttgcaatgaccatgttgctcttgcacacactgatcttgacagggaaactgaggagatggttgcagatgttcttggagtagaagtttttaggcagaccattgctggtaacattcttgttggtagctactgcaccttttccaacagaggtggcttggtccatccccatacatccattgaagacttggatgaactttcaacactccttcaggtccctttggtggctgggacagtgaatcgcggtagtgaagtgatagctgcagggatgactgttaatgactggacagcattctgtggatcagacactacagcaacagaactatctgtcatcgagagtgtcttcaaattgagggaggcccaacctagtgccattgtggatgagatgaggaaatcgttgattgacagctatgtctgaatttctttttgtatttatgttattattttggggtatgaatgcaacaaaatctatgctagtcttgtgtggtataaatgccaccaatcatgtcctgttaatttaaacatgcctagtttgccaagttttgtgtctcaatacttttgttccaatctgaagcaaacaacttttggattggtgcattatattgccgtttatgatatttgttgttggtttaatgtaatgtttgtttactattatttgctgaaaatcaagtcccgtctatttcccttactttaaacaaa

SEQ ID NO: 2215 - DNA, 1120 bp, Humulus lupulus
ttacggccgggggttgaccagattgcattgcagcgaactcatacctcaattcatgaccaaaccgaaacactgttcaatcaaaccctttaaaccctaacatattccataaaacctgatcatagctatcgcgtgatcgagctaccgaacatggccgtccgtcttcaattcgagaactcgtgcgatgtcggagtgttctccaagctcaccaatgcctactgtttggttgccataggaggttctgagaatttctacagcgcttttgaatcggagctggctgatgtgattccggtggtgaagacctccatctccggcactcgcatcattggtcgcctttgcgctggtaacaaaaaagggcttttgatgcctcataataccactgaccaagagcttcagcacctgagaaacagtttacctgatcaagttgttgttcagcgcatagaagagaaactatctgctcttgggaattgtatagcttgcaatgaccatgtggctctcacccacaccgatcttgacaaggaaactgaagagatgatagcagatgttctgggagtagaagttttcaggcagacaattgccggaaatattcttgttggcagctactgtgccttctccaatagaggtggcttggttcacccccacacatctgttgaagacttggacgaactttcaacacttcttcaggttcctttggttgctgggacggtcaaccgggggagtgaagtgattgcggctggcatgacggtgaacgactggacggccttctgtggcacagacaccactgcaactgaactctctgttatagagagtgtcttcaaattgagggaggcacaacctagcgctattgtcgatgaaatgaggaaatcattgatcgatacttatgtctgattttctattattattattagtcgcgttagatcgcttgcaatgtttgaaatatcaacgctgttaatatatgacaatgtctgtaacttttcgaagtatgttttaaagctcttgtcgttgctctgtttacttgttataaaagaaatttataagtgtagaatgtaatgtgtacattgtatttggttacaagttattcaatcttaaaaattttagtattttaactactaaaatactatcc

SEQ ID NO: 2216 - DNA, 1006 bp, Jatropha curcas
cgaattccaaagtaggaaagcctttctgttccatctcttcgcgttgtctctaatctctacgattaataacagatacttgtatctctctctgcttgtttgttgttgggataagctgagattattttcaataatggcaactaggcttatgtttgagaactcatgtgaggttggagtattttccaagctcaccaatgcttattgcttggttgctattggaggctctgaaagcttctacagcacatttgaggctgagttagcagatgttatcccagtggttaaaacttcaattgcaggcactaggattgttggccgtctttgtgctggtaacaagaatgggcttctcttgccccacaccaccacagaccaagaacttcaacacttgagaaacagcctacctgacaatgttgtggttcagcgcattgaagagaaattatctgcattgggaaattgtatagcctgcaatgaccatgttgctctaacacatacagatcttgaccgagaaacagaggaaatgattgcggatgttcttggtgtagaagtttttagacagacagttgctggtaatattcttgtgggaagttattgtgcattctccaatagaggtggcttggttcatccacatacatctatagaagacttggatgaactttcgaccctccttcaggtgcctctagttgctgggactgtaaaccgtgggagtgaagtaatagcagctggcatgactgtgaatgactggacagcattctgtgggtcagatactacggctactgagctatctgtcattgagagtgttttcaagttgagggaagctcagcctagtgctattgttgatgagatgaggaaatcattgattgacagctatgtttaggtcatcaatgttgttcgattaccaaaggtattaatgttatcttaatttgtcttataaagctgaagtaatgatatagttttgtgttctaaacagaaagtggatcaagttttgaaattcaattgttattgttggttgttt

SEQ ID NO: 2217 - DNA, 874 bp, Actinidia deliciosa
aggacgaagatttcagaccctcttcacatcatcttccgggtaatccatatcctttaaatactctgactccgtcttcgtccagttcactgttttctcatcatggcaactagacttcaatttgagaactcatgcgaagttggggtgttctcgaagctgaccaatgcctactgtctggttgctattgggggttcggaaagtttctacagcacatttgaaggcgaattagctgatgttatccctgtagttaaaacctccattggcgatactcggataattggacgactttgtgctggaaacaaaaatgggcttctcttgcctcatacgaccactgatcaagaacttcaacatctgagaaacagtttaccagatcaagttgttgtccaacgcattgatgagagactatctgctcttgggaattgcgtagcatgcaatgattatgttgctctaacacacactgatcttgacaaggaaactgaggagatgattgctgatgttctcggggtggaggtttttagacagacaattgctggcaatattcttgtgggcagctattgtgccttctccaataaaggtggcctggtccatcctcatacatccatcgaagacttggatgaactttcaaccctccttcaggtccctctggtggcggggactgtgaaccgtggtagcgaagtgatagctgctggcttgatggtaaacgactggacagcgttttgtggatcagacactacagcaacagaattgtctgtgattgagagcgtcttcaagttgagagaagcccaacctagtaccatcgttgatgagatgaggaaatcgttgatcgacagctatgtttgagccgttgattcttggcctcaacgacattggccttgtt

SEQ ID NO: 2218 - DNA, 1198 bp, Citrus sinensis
gtagttagttatatttgattttattgatatggatattctgtacatgttcggtggctaacagaaaaatcgaatttgtatgttattcttgcaggtcttgtgctttgattcggtccatcttttaatcggttcaattctgttaatttgtaatcatggcaaccagacttatgtttgagaattcgtgtgaggttggtgtgttttccaagctcactaatgctttttgcttggtcgcaattggaggttctgagagcttctacagcacatttgaggcggagttagcagatgttattcctgttgttaaaacatcaattggtggcaacaggattatcgggcggctttgtgttggtaacaaaaatgggcttctcttgccacacacaaccacagaccaagagcttcaacacttgaggaatagtctacctgatcaagttgttgtccagcgtattgaagagaggctatctgctctgggaaattgcatagcatgcaatgaccatgttgctcttgcacacacagatcttgacagggaaacggaggaaattattgcagatgttcttggagtagaagtttttaggcagacaattgccggtaatatccttgttggcagttactgttccttcagcaacaggggtggcttggtccaccctcatacatccattgaagacttggatgaactctctacactcttgcaagtacctttggttgctggcactgtgaaccgtggaagtgaagtgataggtgctgggttaactgtgaatgactggacagcattctgtgggtcagacaccacggcaaccgaactctctgttattgagagcgttttcaagttgagggaagctcaaccaaatgccattgtggatgagatgaggaaatctttaattgacagctatgtctaagttatctgggataagcagtcttgtgttttgtcttattgtgtgaaacactatttcctaactttcttgagagctattagaatgttttctttctcatgttggagtacgtagtagcttgagcaatactcgattacatgaaatccttgctcacaaactctgtatttcactgttgcctgcttaacttggttgcccgctttctgaaggtgacaattgagtctgtatgtatgtatattttgaaagacgacaatcgatataatgatattcataaattggccaaatagcattttttttaaaaataaaataaatacgtggcc

SEQ ID NO: 2219 - DNA, 1229 bp, Populus trichocarpa
atggtaagtcgcttatcagtcttttctgctggttggtggagcttctacctagagattgaagggtgcagcttagacagacatgcccagctgtttacacgcagtgagggaaacactggtcctggttttcatgccagcagggaaaaatatctgcgcgggtctaaaaccacacaacccttcattttctctccctcgcagacgccagtgtttccgccactgcaaaaacatcaaacactcttgtttatctctgtgtccgactttgtaatcttcatggcgagcagacttcagtttgagaataactgtgaagttggtgtgttttccaagttgaccaatgcgtactgcttagttgcaatcggtggatcagaaagcttctacagcacttttgaggcagagttagctgacgtcattcctgtcgttaagacctcaattgctggcactaggataattggacggctatgtgctggaaacaaaaatgggcttcttgtgcctcacaccaccactgatcaagagctccagcatttgagaaacagcctacctgatcaagtcgttgttcagaggattgacgagaaactatctgctttgggtaattgcatagcatgcaatgatcatgttgcccttgcacacactgatctggacagggaaactgaggagataattgctgatgttctcggggttgaagtgtttaggcagacaattgctggcaacattcttgtggggagctactgtgccttctccaacagaggtggtttggtccatcctcatacatccattgaagacttggatgagctctccacccttcttcaggtccccttagttgcaggtactgtaaaccgtggtagcgaagtgatcggtgctggaataacagtaaacgactggacagccttctgtgggtccgacactacagctaccgaactatctgtaattgaaagcgtcttcaagttgagggaagctcgacctagtgccattgttgatgagatgaggaaatcattaattgacagttatgtttgaattgacgttacctattctcccacctgtcaacgggctccttatcctcctgtaatggaaacattaatattttaaccttcttaagtcggattttgttttcctattaagaatacatgcttttgaaatggggttttaagttccctgtattttaccggctctcaatgtctctacaattgattctccttttgttcctcattgtccctgctaaattatattgttccctctca

SEQ ID NO: 2220 - DNA, 1091 bp, Solanum tuberosum
cgctaaccttttcagccgccgagttcctcaaaatatctttttccgcccaaatcaatcatctttcaagctccaagcaattctgtttttttacaagcaatggcaactaggcttcaatttgaaaattcatgtgaaattggagttttctcaaagctgaccaatgcatattgcttggtagctattgggggttctgaaaatttctacagcacatttgagtccgagctatcaggcattatcccagtgatcaaaacctctattggaggaacgaggataattggaagactctgcgctggaaacaaaaatggtcttctcttgcctcacactactacagatcaagaacttcagcacttgaggaacagtctgccagatggagttgtggtccagcgcattgatgagcgattatctgccctgggcaactgcatagtttgcaatgatcatgttgctctgacacatacggatcttgacaaggaaaccgaagagatgattgctgatgttcttggtgtggaagttttcaggcaaacaatagcagggaatattcttgttggcagctattgtgctatctcaaacacaggaggtttggtacatcctcatacatccattgaagacttggatgagctttcaactcttcttcaggttcctctggttgcaggaactgtgaaccgcggtagtgaagtgattggtgctggattgactgtcaatgactggacagcatttactggctcggacactactgcaacagagctatctgttattgaaagtgttttcaagctgagagaggctcaacctactgctattgttgatgagatgaggaaatcattgatcgacagttatgtctaagttattatttaaattgcatgtactacaaaattctgggtggaagtttgagttgctgctttaatgttgtgtttcctatgttaaaaggtctcacttgataatgcagatttatgttttttttttaatcttaattgcgttttctgttttttcaagtgtataatgttagtacatttgagtataagaattatttatctccatataatattttccattttcatacgtgtaaacaaacaaaatacaaacaacaatacaaaaagaga

SEQ ID NO: 2221 - DNA, 1334 bp, Sesamum indicum
gattctccctcctgaagcaccgagcgacgttcttcctgcacctcttcttccagatttgatcgtgtttggttctttgttgggtgccttctcgtttcagcatggcaacaagattgcaatatgagaataactgcgaaattggagtcttctcgaagctcaccaatgcatattgtctggtggcaattgggggttctgagaacttttacagcacatttgaggctgagttggctgatgtaattcctgtggttaaagcctccattgctggtactagaatcattggacgtctctgtgctggaaataaaaacggattgcttttgcctcacaatactactgatcaagaactacaacacttgaggaatagtctaccagattctgttgtggttcagcgaattgaggaaagattgtctgctctaggaaactgtattgcctgcaatgatcatgtggctcttacacatcctgatctggacagggaaacggaggagatgattgctgatgttctcggggtagaagttttcaggcagacaattgctggtaatatactcgtggggagcttctgtaccttctccaatcgaggtggcttggttcaccctcacacttctatagaggatctagatgaactttcaaccctccttcaggtccctctggtggctgggactgtgaaccgtggtagtgaagtgataggtgctggcttgacagtcaacgactggactgcattctgtggatcagatacaactgctactgagttgtccgtaatcgagagtgttttcaagttgagagaagctcaacctagtgctcttgtcgatgagatgagaaagtcattgatcgacagttacgtctgagtccccaagtttagtctactatgcataacatgaaagctaagattctcttgagcaaagcttctgctctggttttatagtagtttcagtgttgaggaattctgtccatcatgttctatacagaagtacattccataagtctattttcaccccatccgttctgcttctcaagttgtatcagtgagacttttacaattcgtctttccttttggtttcaagctctgtagcatggtgttttggcattgaagtcttgcaatgtggcaagtgttgggttgactctcacaaacttgatatttatgaatctgtaatttccgatatataacagaagcaagagatttcttggtcagatgacaacattctgcattcttcagtttaattcaataacggtggtgcaatgttgttagacgaggagcaggagaggggaatactttcttgttgcctgtgcatccattagtgccagatctcagccattttacttctgggagattgtttacagagatt

SEQ ID NO: 2222 - DNA, 1066 bp, Solanum phureja
tcaaatcgctgcaaacgttcaccgctaaccttttcagccgccgagttcctcaaaatatctttttccgcccaaatcaatcatctttcaagctccaagcaattctgtttttttacaagcaatggcaactaggcttcaatttgaaaattcatgtgaaattggagttttctcaaagctgaccaatgcatattgcttggtagctattgggggttctgaaaatttctacagcacatttgagtccgagctatcaggcattatcccagtgatcaaaacctctattggaggaacgaggataattggaagactctgcgctggaaacaaaaatggtcttctcttgcctcacactactacagatcaagaacttcagcacttgaggaacagtctgccagatggagttgtggtccagcgcattgatgagcgattatctgccctgggcaactgcatagtttgcaatgatcatgttgctctgacacatacggatcttgacaaggaaaccgaagagatgattgctgatgttcttggtgtggaagttttcaggcaaacaatagcagggaatattcttgttggcagctattgtgctatctcaaacacaggaggtttggtacatcctcatacatccattgaagacttggatgagctttcaactcttcttcaggttcctctggttgcaggaactgtgaaccgcggtagtgaagtgattggtgctggattgactgtcaatgactggacagcatttactggctcggacactactgcaacagagctatctgttattgaaagtgttttcaagctgagagaggctcaacctactgctattgttgatgagatgaggaaatcattgatcgacagttatgtctaagttattatttaaattgcatgtactacaaaatttttgagttgctgctttaatgttgtgtttcctatgttaaaaggtctcacttgataatgcagatttatgttttttttttaatcttaattgcgttttctgttttttcaagtgtataatgttagtacatttgagtataagaattatttatctccatataatattttccattttcatagtgta

SEQ ID NO: 2223 - DNA, 1077 bp, Triphysaria pusilla
gcgcaaggatacgttgttaagagatttctcgtctccccctttattcttagccctaactcgtcttcgccccacctctcttacaaaaaatactcccttcaatcaacttttatctctgctccagttgaacggttcaataggttttggaggtagcaggtctcattgaactattccaacatttctcttacaccatggcgaccagattgcagtacgagaataattgtgaggtcggggttttctccaagctcaccaatgcatactgtcttgttgcaattggaggctctgaaaacttctacagcacatttgaagctgagttggctgatgtgattccagtggttaaaacctccattgcaggaactagaatcattggacgtctctgtgctggaaataaaaatgggttgcttttgccacacaacactactgatcaagagcttcagcatctgaggaacagcctaccagattcagtagttgttcagcgaattgaggaaaggttatctgctcttgggaactgcatttcgtgcaatgatcatgttgctcttacacatcctgatcttgacaaggaaaccgaggagctgattgctgatgttctcggggtggaggttttcaggcagactgttgctggtaatatacttgtgggaagttattgtaccttttctaacagaggtggcttggttcatcctcacacctcaatagaggatctagacgagctctcgacccttctccaggtccctttagtggctgggactgtgaaccgtggtagtgaggtcatagctgctggtctgactgtcaatgactggacagcgttctgtggatcagatacaactgctactgaattatctgttattgagagtgttttcaagctgagggaagcccaaccaagtgctcttgttgacgagatgaggaaatcattgatcgacacctatgtttgagacttttcgacttattattattattatatgtagatcacgtttatgctgtggtttgtgcactagttttggttttacggagaaaaaactgctccggtttgttatttgtgctgttaatttacctggatttgggttattattatgtttactttat

SEQ ID NO: 2224 - DNA, 935 bp, Vinca minor
gcaaacatggcaacaagattgcaatttgagaattcatgtgaaattggtgtcttctcgaagctgactaatgcttattgcttagttgctattggaggttctgagaacttttacagtacgtttgagtcggaattggctgatgttattccggttgtgaagacatctatttctggcactaggatcattggaaggctctgtgctggaaataagaatgggcttctgttacctcataatactactgatcaagagcttcagcatttgaggaacagtcttccggattcggttgctgttcagcgcattgacgagagactatctgcattgggtaactgcatcgcatgcaacgatcatgttgccctcactcataccgatcttgataaagaaactgaggagatgattgctgatgttcttggggtggaagtctttcgacagacaattgctggaaatattctggtgggaagttattgtacattctccaacagaggaggcttggttcatcctcacacatccattgaggatttggatgagctttcgacactcctccaagttcctctagtggcaggaactgtgaatcgcggtggtgaagttattgcagcaggcttaatagttaatgactggacggctttctgtggatccgatacgactgcaactgaattgtcagtcattgaaagtgtgtttaagctcagagaagctcaaccaagtgctattgttgatgagatgaggaagtcattgatagacacttacgtgtgagtccactagttttgagtatatgacttgtagtctgtaatacaagaatttgaattcctactttctgtttatgttttaccatctcccgacaattgttaatgtttttgttcctggtaacagtctttttaagattggtttgtttttgttatttactttattttacttctggttcgtaatttggtaaaattggctgt

SEQ ID NO: 2225 - DNA, 1200 bp, Aquilegia formosa
cagcgcaacaaaactccacttctgtagtcctgtgtttggcagatagtttgtaataagaaaaaaaaaagccctaaaaccaaacccttgtttctctcaatcgattttcttcttcatctccaaaacaaagccaagctacaaacttccccgaaaaaacaaaaatccttaaaaggttgagctttgtcttttgagtatttggagtgatttgggaatcaacacatcatggcaactcgacttcagtttgagaataattgtgaaattggggtgttttcaaagcttaccaatgcatattgcttggttgccattggcggatcagaaaatttctatagcacatttgaatctgagctagcagatcatattcctgtggtgaaaacctctatagcaggaagtagaatagttggaagactatgtgctggaaacaaaaaaggacttttgctgccacacactactaccgatcaagagcttcagcacttgagaaacagtttaccagatggagttgttgtccagcgtattgaagaaagactttctgctctggggaactgtattgcttgcaatgaccacgttgctcttacacatactgatctcgacagggaaactgaggacctgattgcagatgttcttggagttgaagtgtttagacagacaattgcagggaacattcttgttggcagttattgtaccttttccaatcgaggcgggctggtgcatcctcatacatccattgaagatctggatgaactttccacacttcttcaagttcctcttgttgccgggactgttaatcgaggtagtgaagtcattgctgctggtatagtcgtcaatgattggaccgctttctgtgggtcggacactacggctacagaactctctgttattgaaagtgtcttcaagttgagagaagctcagcccactgcgattgttgatgaaatgaggaaatcgttgattgatacctatgtttgagtttctgatgacttctccaaggtatcaagtcgaacacaattgcccttagaacatacagaccatcaaaagatccacctaagttgatgtttctttatttttgttgattaaatgtttgctaagttgtgaaattatggaattggctacactgtttgttgtccttcctgaagtgattcttaattttgaagtacagagaacatatcattttgaaagtagtgtattgaatgaatgaattcgtcttatttt

SEQ ID NO: 2226 - DNA, 997 bp, Arabidopsis lyrata
tcttctctcttcttattcgccgcttcttctcgctctatttcatccatctcaagtgtacgttagcctcctctctctaatggcgactcgtcttcagtttgagaacaactgtgaagttggtgtcttttccaaactcactaatgcctattgcttagtcgctataggaggctctgagaacttttacagtgcttttgagtcggagttggccgatgttatccctattgttaagacctctatcggaggaacacgaattattgggcgtctttgtgctggaaacaagaatgggcttcttgtacctcatacaactactgaccaagagcttcaacacttgaggaacagtctacctgatcaagttgtggtccagcgaattgatgaacgtctgtctgctcttggaaattgcattgcctgcaatgaccatgtcgctcttgcccacactgatcttgataaggaaactgaggaaataataacggatgttcttggcgttgaagttttccgtcagacaattgcaggcaacattcttgtgggcagttactgtgccttatccaacagaggtggaatggtccatcctcgcacctcagtggaagacttggatgaactctcaacacttcttcaggtccctcttgttgcaggaactgtaaaccgtgggagtgaagttatagctgcgggtatgaccgttaatgattggacctctttctgtggttcagacacaaccgcgaccgagctctctgttatagacagcatcttcaagctaagggaagcccaacccagctctatcgtcgatgagatgaggaagtcattgatcgatacctatgtttaaattttgtttgtttggatgacacacacaacaacatccccaatgtcagagattttcatactctactgtgtgcaagaattagctgttttcttatatttttgtgtggttttaacagtttaaaagtaatctgttgatgtctctttgaatctttttgagtaagtgataagaaaactctcgttaaaacta

SEQ ID NO: 2227 - DNA, 972 bp, Brassica napus
cctttttctcttcctcctcaaaaacctttttaactccatttattgcctcttctttctcgccgctcgattcatccctctcccaagtgtgcgttagcaaagttcctacctttctcaactccatggccactcgtcttcagtttgagaacaactgtgaagttggtgtcttttcaaagctcactaacgcctattgcttagttgctattggaggctctgagaacttttacagtgcttttgagtcggagttagctgatgttatccctatcgttaagacctctcttggtggaacacggattattggccgtctttgtgctggaaacaagaatgggcttcttgtgcctcatacaactactgaccaagagcttcaacacttgaggaacagtctacctgatcaagttgtggtccagagaatcgaggagcgtctctctgctcttggtaattgcattgcttgcaatgaccatgttgctcttgctcacaccgatcttgacaaggaaactgaggaaataatagcggatgttctcggtgttgaagttttccgtcagacgattgcaggcaacattcttgtaggcagctactgtgccttgtccaacagaggtggcattgttcatcctcacacctcagtggaagacttggacgagctctcgacactacttcaagtcccactcgttgcaggaactgtgaaccgtggtagtgaagttataggcgcgggaatgaccgttaatgattggactgctttctgcggttcagacacaactgcaacagagctctctgttatagacagcatcttcaagctaagggaagcccaacctagctctattgtcgacgagatgaggaagtctttgatcgatacctatgtttaatttttgctttgattggacgacacaacaacaacatcatcccaagtgtcattccttatgtttttcatatcttttactgttgcaagaattagttttattccccttttgtttttactgt

SEQ ID NO: 2228 - DNA, 1201 bp, Citrus clementina
gtagttagttatatttgattttattgatatggatattctgtacatgttcggtggctaacagaaaaatcgaatttgtatgttattcttgcaggtcttgtgctttgattcggtccatcttttaatcggttcaattctgttaatttgtaatcatggcaaccagacttatgtttgagaattcgtgtgaggttggtgtgttttccaagctcactaatgctttttgcttggtcgcaattggaggttctgagagcttctacagcacatttgaggcggagttagcagatgttattcctgttgttaaaacatcaattggtggcaacaggattatcgggcggctttgtgttggtaacaaaaatgggcttctcttgccacacacaaccacagaccaagagcttcaacacttgaggaatagtctacctgatcaagttgttgtccagcgtattgaagagaggctatctgctctgggaaattgcatagcatgcaatgaccatgttgctcttgcacacacagatcttgacagggaaacggaggaaattattgcagatgttcttggagtagaagtttttaggcagacagttgccggtaatatccttgttggcagttactgttccttcagcaacaggggtggcttggtccaccctcatacatccattgaagacttggatgaactctctacactcttgcaagtacctttggttgctggcactgtgaaccgtggaagtgaagtgataggtgctgggttaactgtgaatgactggacagcattctgtgggtcagacaccacggcaaccgaactctctgttattgagagcgttttcaagttgagggaagctcaaccaaatgccattgtggatgagatgaggaaatctttaattgacagctatgtctaagttatctgggataagcagtcttgtgttttgtcttattgtgtgaaacactatttcctaactttcttgagagctattagaatgttttctttctcatgttggagtacgtagtagcttgagcaatactcgattacatgaaatccttgctcacaaactctgtatttcactgttgcctgcttaacttggctgcccgctttctgaaggtgacaattatgtctgtatgtatgtatattttgaaagacgacaagcgatataatgatattcataaatcggccaaatagcatttttttttataaaaacataataaatacgtggcc

SEQ ID NO: 2229 - DNA, 870 bp, Euphorbia peplus
ttcgcctcctcgtctttttacctattagctcttcggactatctctgaataatatcaatcatggcaactaggcttatgtttgagaactcatgtgaggttggagtattttctaagcttacaaatgcttactgtttggttgccattggaggctctgaaagcttctacagcgcgtttgagtctgagttatcagatgttattccggtggttaaaacttcaattgctggcactaggatcatcggccgtctttgtgctgggaacaaaaatgggcttcttttgccccataccaccaccgatcaagaactccaacacttgaggaacagcctgcctgatagcgttgttgttcagcgcgttgaggagagactatctgccttgggaaattgtatagcctgcaatgaccatgttgctttgacacacacggatctcgacagagaaaccgaggaaatgattgcagatgttcttggtgttgaggtttttaggcagacaattgctggtaatattctcgtgggaagctactgtgcattctccaatagaggtggcttggttcatcctcacacgtcaatagaagacttggatgagctttcaacactacttcaggtgcctttagttgctgggactattaaccgtggtagtgatgtgatagctgctgggatgaccgtgaatgactggacagctttctgtggttcagataccacagctaccgaattatccgtgattgagagtgttttcaagctgagggaagctcagcccagtgccatagttgatgagatgagaaaatcattgattgatagttatgtttgatgttggtttattgacacttactattattatgttctagagacctcgagttttggaggtataaattgtaagattg

SEQ ID NO: 2230 - DNA, 1135 bp, Fagopyrum esculentum
taacccaaaacaagataggggttcacttctctgataaaataaaatattcttccacttacgtgtaatctaatcagccgccgcccccacccccaccgcattcagcctctcccgccttgctccccaagacttttttgagtttcgatttgtttatttaccttcgcaatcgtcgttttatcctcatggcgacaaggcttcaatttgagaacaactgtgaagttggcgttttctctaagctgactaatgcctattgtttggttgcaatcggaggatctgagagcttctacagcacgttcgaggcagagttgacagattatattcctattgttaagacatccattggtggaactcgaataatcggacgattatgtgctggaaacaaaaatgggcttcttctgcctcacaccactactgatcaagaacttcagcatgtaaggaacagtctaccagatgaagtagttgtgcagcgcattgacgaaaaactatctgctcttggaaattgcatagcctgcaatgattacgttgcacttacccacaccgatcttgacaaggaaacagaagaaatgattgctgatgttctcggtgtagaagtgtttagacatacaattgccggcaacattctcgtaggcagctactgtgctttctccaacaagggaggactagtgcatccccacacttctgtggaagacttggatgaactctcgacacttcttcaggttcccttggttgcgggaactgtgaaccgtggtagtgatgtcatagcagctggcttgaccgtcaacgactggactgcattctgtgggtctgacactacagccacagaactatctgtcatcgagagcgtgttcaagttgagggatgctcaaccaaccgccgttgtcgacgagatgaggaaatcattgattgacagttatgtctaactgcttatcaaaatctacaacaatgtttctatttatacctgtttttcccccatctatcgtcactcttatctggactgcatgttttcaacgttgaatggagtattctaattatcaacagaatttgtaaatgtttgaaattccttagggagtttacacatgttatgctggtcagtaatcttgactaaagagtaagaccatgtgcggcaaatttattgtgt

SEQ ID NO: 2231 - DNA, 974 bp, Raphanus sativus
tttgtctctctgtctcctcctcgattcatttctcgtgtaagtttgcaaagttcgtagctttctcttcctcaatggccactcgtcttcagtttgagaacaactgtgaagttggtgtcttttcaaaactcaccaacgcctattgcttagtcgctattggaggctctgagaacttctacagtgcttttgagtcggagttagctgatgttatccctatcgttaaaacctctattggtggaacacgaatcattggtcgtctctgtgctggaaacaagaatggccttcttgtgcctcatacaactactgaccaagagcttcagcacttgaggaacagtctacctgattcagttgttgtccagagaatcgaggaacgtctgtctgctcttggaaactgcattgcctgcaatgaccatgttgctcttgctcacaccgatcttgacaaggaaactgaggagataatagcagatgttctcggtgttgaagttttccgtcagacaattgcaggcaacattcttgtgggcagttactgtgccttgtccaacagaggtggaattgtccatcctcacacctcagtggaagacttggacgaactatcaacacttcttcaagtccctctagttgcaggaaccgtgaaccgtggtagtgaagtcataggcgctggtatgacggttaatgactggactgctttctgcgggtcagacacaaccgcaacagagctctctgttattgacagcatcttcaagctaagggaagcccagcccagctccattgtcgacgagatgaggaagtctctgatcgatacctacgtttaaattttgctttgtttggatgacattacacaagaacatcatccaacgaatgtcgcaatgccataaaattttcatctttttgtggtctcctgaatgaaacatctctttatgttttgttgaatcttatccatgaaaaaaaaatcaaacaatcttttaatttgggggtca

SEQ ID NO: 2232 - DNA, 1014 bp, Raphanus sativus
tttaactccatttgttctctcttctccgccgattcatccaatctcccaagtttaccttagcaaagtttctacctttatccgctccatggccacccgtcttcagtttgagaacaactgtgaagttggtgtcttttcaaaactcactaatgcctattgcttagttgctattggaggctctgagaacttttacagtgcatttgagtcggagttagctgatgttatccctattgttaagacctctattggaggaacacgaatcattggccgtctatgcgctggaaacaagaatgggcttcttgtgcctcacacaactactgaccaagagcttcaacacttgaggaacagtctacctgatcaagttgtggtccagcgaatcgaggagcgtctctctgctcttggaaattgcattgcctgcaatgaccatgttgctcttgctcacaccgatctcgacaaggaaactgaggagataatagctgatgttcttggtgttgaagttttccgtcagacaattgcaggcaacattcttgtgggcagctactgtgccttgtccaacagaggtggcattgttcatcctcacacttctgtggaagacttggacgagctctcaacactacttcaagtcccgctcgttgccggaaccgtgaaccgtggtagtgaagttataggtgcgggaatgaccgtcaatgattggacttctttctgcggttcagacacaaccgcaacagagctgtctgttatagacagcatcttcaagctaagggaagcccaacctagctctattgtcgacgagatgaggaagtctttgatcgatacctatgtttaagttttgctttgttttgatgacacaacaacaacatttccaagtgtcaaatgtcttaaaagtttcagatcttttatggtttttgtaggctcggaatatttcctttactgtttcaagaattgtgtgttttattgtcatatcaaaagttatgagttttttatggtctcatgaatctcttagtttttatggtctcg

SEQ ID NO: 2233 - DNA, 934 bp, Raphanus sativus
  misc_feature (846)..(846): n is a, c, g, or t
gtgtaagttagcaaagttcgtagctttctcttcctcaatggccactcgtcttcagtttgagaacaactgtgaagttggtgtcttttcgaaactcaccaacgcctattgcttagtcgctattggaggctctgagaacttctacagtgcttttgagtcggagttagctgatgttatccctatcgttaagacctctattggtggaacacgaatcattggtcgtctctgtgctggaaacaagaatggccttcttgtgcctcatacaactactgaccaagagcttcagcacttgaggaacagtctacctgattcagtcgtggtccagagaatcgaggaacgtctgtcagctcttggaaattgcattgcttgcaatgaccatgttgctcttgctcacaccgatcttgacaaggaaactgaggaaataatagcggatgttcttggcgttgaagttttccgccagaccattgcaggcaacattcttgtgggcagttactgtgccttgtccaacagaggtggcattgtccatcctcacacctcagtggaagacttggacgaactatcaacacttcttcaagtccctctagttgcaggaaccgtgaaccgtggtagtgaagtcataggcgctggtatgacggtgaatgactggactgctttctgcgggtcagacacaaccgcaacagagctctctgttattgacagcatcttcaagctaagggaagcccaacccagctccattgtcgatgagatgaggaagtctctgatcgatacctacgtttaatttttgctttgtttggatcacatacacaagaacatcatccaaatgaatgtcgcaatgtcataaaattttanctttttgtggtctttcttgtctgaatagacatctctttacgttttgttgaatcttatccatgaaaaagaaaaatcaaacaatctttta

SEQ ID NO: 2234 - DNA, 994 bp, Silene vulgaris
cgatcatggctacaaggcttcagtttgagaacaattgtgaaatcggcgtcttttcaaaattgactaatgcttattgtttggtcgcaattggcggttctgagaacttttacagcacattcgagtccgagttggctgatcatatccctgttgtcaaaacctcaatagcggggacaagaattattggccgcatgtgcgctggtaataaaaacggtcttcttgtgcctcacaccacaactgatcaggaactccagcatttgaggaacagtctgcctgatgaagtagttgtgcagcgtatcgaagaaaggctttctgcgctaggaaattgcatagcatgcaatgactatgttgctcttacacacacagatcttgataaggaaaccgaggaaattatagccgatgtgctgggcgtcgaggttttcaggcagaccattgctggtaatatcttggtggggagctactgttctatttccaacaaaggcggtttggtacatcctcacacatcaatagaggacttggacgagctttcaacccttctccaggtcccgcttgtggctgggacagtaaatcgaggaagtgaggtaattgctgctgggctgacagtgaatgactggaccgcattttgtgggtccgacactactgctaccgagttgtcggtcatcgagagtgtgttcaaactgagagaagcccaacccagtgccattgttgatgagatgaggaagtcgttaatcgatacctatgtctgagctctggccttgccccttgaacttgattgatgtgaagaagtagttgatgatttgttggctagtttatgctgtttatttactgattgtgaacaagattttattaacaatggatagatgatgaattatgaggcaaagactctttacatatccttgagattaaggagagtcttgctcataatcataccctaaactgcgcattgatgtctagtttggaactcggatttgtttatgtttttattacagctacaacg

SEQ ID NO: 2235 - DNA, 1223 bp, Tripterygium wilfordii
gttatgccctaaaccccaagagcagagaaggatcggattctctctcccgctagccacccagctctcgcggaggcgctctctcattcacagtcaatcacagcgacgtgcgtccgttgcttctctatcatctttggactactcgttctagtcatctttcggagatattttgaaaatccagtgactacctttgcttggttaatctcctcctatcatggcaacaagacttcagtttgagaattcatgtgaaattggggtattctccaagttgaccaatgcatactgtctggttgccataggaggatcagaaaacttctatagcacttttgagacagagttagcagacgtcattcctgtagtcaagacctcaattggaggcactaggataattgggaggctatgcgccgggaataaaaatgggcttcttgttccacacacgactactgaccaagaactacaacacctgaggaatagtctacctgatcaagtcgttgtccagaggatagaggagaaactatcagctctgggtaactgcatagcttgcaacgaccatgttgctcttacacataccgacctggacagggagactgaggagattgttgcggatgtacttggtgtggaagttttcaggcagacaattgctggtaacatcctcgtgggcagcttctgtaccttctccaacagaggtggcttggtccatccccatacttccattgaagatctggatgaactttccacacttcttcaggtcccattggttgctgggactgttaaccgtggaagtgaagtgatagctgccggaatgacagtaaatgactggacagccttctgtgggtcagacactacagctaccgaactgtccgtcatcgagagcgtcttcaagctgagggaagcacagcctagttccattgttgacgaaatgaggaaatcattagtcgacacttatgtttgagttactattatgtttgagttatactgtgctagtgacactttcctttgtatcttttgtcaaagtatcgacatgccgtgtttcgaattctgtaattctgccaacgggatgtttttgttccattttcaagcaaagtgtttgaatgtccatgttgttagtgttttttgttaaaagtgcaatttgttgatctcggtagctctttacgcaggtaggaagtcgtgagtttgaattctgtaattcaaactctcgacatgcagtgtttcgaattctgtaattc

SEQ ID NO: 2236 - DNA, 1040 bp, Tripterygium wilfordii
agctactaagaaaatctgagaatcacagccgcgtgcgtccttgcttctctgtcatctttggactcgttctaatcggccatctgagttctttgacaagccagtttctgcagctcttgttgctcttgactacctttgcttggttaattcccttctatcatggcaacaagacttcagtttgagaattcatgtgaagttggggtgttctccaagctgaccaatgcatactgtctggttgccataggtggatcagaaaacttctatagcacctttgagacggagttagcagacgtcattcctgtagtcaagacctcaattgggggcactaggataattgggaggctatgcgcagggaataaaaatgggcttcttgttccacacacaactaccgaccaagaacttcaacacctgaggaatagtctacctgatcaagttgttgtccaaaggatagaggagaaactatctgctctgggtaattgcatagcttgcaatgaccatgttgctcttacacacaccgacctggacagggaaaccgaggagattgttgcggatgtacttggtgtagaagttttcaggcagacaattgctggtaacattcttgtgggcagctactgtaccttctctaacagaggtggcttggtccatccccatacttccattgaagatctggacgaactttcgacacttcttcaggttccattggttgctggaactgttaaccgtggaagtgaagtgatagccgctggaatgacagtaaatgactggacagccttctgtgggtcggacactacagctactgaactgtctgtcattgagagcgtgttcaagttgagggaagcacaacctagttccattgttgatgaaatgaggaaatcattagtcgacacttatgtttgaagtacgattagcaagttatactctgctagtgaaacttgtgtacttttctaagtatagatatgcagtgtttctaattctgtaattctatcaacaacccaacaagatggtttgttccattttcaagcagagtattggaatatccatat

SEQ ID NO: 2237 - DNA, 1043 bp, Valeriana officinalis
tttcattcccaatcttcgtctctctcgaacaaatctctcgatcttccgtcgcagtttgttcttatctacatctcagagagtcaacgaagatcttccaatcatggcgactaggctgcagtttgagaataactgtgaaattggagtgttctcgaagctaaccaacgcttattgcttggttgcaatcggtggctctgagaatttctacagcatatttgagtccgatttggcagatcatatcccagttgttaaaacctctattggtggcacacgaattattggaagactttgtgccggaaacaaaaatgggcttctattgccacacactactactgatcaagaacttcaacacttgaggaacagtctgcctgatcaagttgtagttcagcgtgtcgatgagagactgtctgctcttggaaattgcatagtgtgtaatgaccatgttgcccttacacataccgatcttgacagagaaactgaggaattgattgctgatgttcttggagtcgaggtttttaggcagactattgccggtaatattcttgttggcagctactgtgtcttctcaaatactggtggattggttcatcctcatacatcgatagaagacttggatgagttgtcgaccctacttcaggttcctttggtggctggcacggttaaccgtggtagcgaagttgtgggagccggtttgattgtaaatgactggactgctttctgtggttctgacaccacggccaccgagttgtcagtgattgagagcgtttttaaattgagagaagctcagcctggtgccattgttgacgagatgaggaaatcgctcattgatacctatgtttaagtacctgttatctttctttaggactcgccttgttttatgatattgttattttgttttcatgtttggtgtgagattgttgttgcgaaactttattacgctgtctttgtttttaattgtctaaatgtacttgttaaggatctgaatttgtcgaatctcttgtataatgaacacaaggagaaatggaaatttaggtgctgttattttg

SEQ ID NO: 2238 - DNA, 1121 bp, Arabidopsis thaliana
gtggcttcttttagattataacccagggccggcgcaacccttcttcttaacaaaaaccttttgattccaattgttcttctctcttcttcttcttcttcttcttcttcttcttcgccgcttcttctctctcgaattcaccccatctcaagtgtacgttagcctcctccctctaatggcgactcgtcttcagtttgagaacaactgcgaagttggtgtcttttccaaactcactaatgcctattgcttagtcgctataggaggctctgagaacttttacagtgcttttgagtcggagttagcagatgttatccctattgttaagacctctattggaggaacacgaattattgggcgtctttgtgctggaaacaagaatgggcttcttgtacctcatacaacaactgaccaagagcttcaacacttaaggaacagtctacctgatcaagttgtggtccagcgaattgatgaacgtctgtctgctcttggaaattgcattgcctgcaatgactatgtagctcttgcccacaccgatcttgataaggaaaccgaggaaataatagcggatgtacttggcgttgaagttttccgtcagacaattgcaggcaacattctcgtgggcagttactgtgccctatccaacaaaggtggaatggtccatcctcacacctcagtggaagacttggaagaactctcaacacttcttcaagtccctctcgttgcaggaaccgtgaaccgtggtagtgaagttatcgctgcgggtatgaccgttaatgattggacctctttctgcggttcagacacaactgcgactgagctctctgtcatagacagcatcttcaagctaagggaagcccaacccagctctatcgtcgatgagatgaggaagtcattgatcgatacctatgtttaaattttgtttgtttggatgacacacacatcccaacatcgccaatgtgtcaatgtcagaaaattttcatactctactgtttgcaagaattagctgttttattttatttttgtgtggtttttaacagtttaaaggaaatctgttgatgtctctttgaatctttctgagtaagtgataagaaaattctccttaatactacacacattttcaattt

SEQ ID NO: 2239 - DNA, 985 bp, Brassica rapa
tctcttcgccgctagcttttgtctctgtgtcgccttcctcctcctaagtttgtaaacctaattttgagcaaagttcatagcttttatcttcctcatggccactcgtcttcagtttgagaataactgtgaagttggagtcttttcaaaactcactaacgcctattgcttagtcgctattggaggctctgagaatttttacagtgcttttgagtcggagttagctgatgttatccctatcgttaagacctctcttggtggaacacgaatcattggccgtctttgcgctggaaacaagaatggtcttcttgtgcctcatacaactactgaccaagagcttcagcacttgaggaacagtttacctgatgcagttgtggtccagagaatcgaggaacgtctgtctgctcttggaaattgcattgcctgcaatgaccatgtcgcccttgctcacaccgatcttgacaaggaaactgaggagataatagcagatgtgcttggtgttgaagttttccgtcagacaattgcaggcaacattcttgttggcagttactgtgccttgtccaaccgaggtggcattgtccatcctcacacctcagtggaagacttggacgaactgtcaacacttcttcaagtccctctagttgcaggaaccgtgaaccgtggtagtgaagttataggtgcgggtatgacggttaatgactggactgctttctgcgggtcagacactaccgccacagagctctctgttatagacagcatcttcaaactaagggaagcccaacccagctccattgtcgatgagatgaggaagtctttgatcgatacctacgtttaaatttcgctttttttttaatcactacaacaacatccccgaagtgttacaatgtctgaaaatttctcatcttttgtggtcttttaagtctttgaatgaacatctctttacgttttgttaaatcttatccataaaatctcttgaaaatgcaaacta

SEQ ID NO: 2240 - DNA, 1112 bp, Brassica napus
ctcttcttcttcctccaaaaccttttaactccatttgttgcctcttcttcgccgctctctctctccctctcgattcatccctctcccaagtgtgtgttagcaaagttcctacctttatccactcaatggccactcgtcttcagtttgagaacaactgtgaagttggtgtcttttcgaagctcactaacgcctattgcttagttgctattggaggctctgagaacttctacagtgcttttgagtcggagttagctggtgttatccctatcgttaagacctctattggaggaactaggattattggccgtctatgcgctggaaacaagaatgggcttcttgtgcctcatacaactactgaccaagagcttcaacacttgaggaacagtctacctgatcaagttgtggtccagagaatcgaggagcgtctctctgctcttggaaattgcattgcctgcaatgaccatgttgctcttgctcacaccgatcttgacaaggaaactgaggaaataatagcggatgttctcggtgttgaagtattccgtcagacaattgcaggcaacattcttgtaggcagctactgtgccttgtctaatagaggtggcattgttcatcctcacacctcggtggaagacttggacgagctctcgacactacttcaagtccctctcgttgcaggaactgtgaaccgtggtagtgaagttataggcgcgggaatgaccgttaatgattggacttctttctgcggttcggacacaactgcgacagagctctctgttatagacagcatcttcaagctaagggaagcccaacctagctctattgtcgacgagatgaggaagtctttgatcgatacctatgtttaatttttgctttgttttgatgagacacaacaacaacaacattctcaagtgtcaaatctcttaaagtttcatatcttttatggtttttgtaggctctgaatatttattttactgttgcaagaataattttgtttcttctcccttgtgttttattatgttgaatcttttttttttattgatctagttcaactgggtccatggttggttcatattccagtgagttgtcagcttacaagaacgcattggatgcaa

SEQ ID NO: 2241 - DNA, 964 bp, Brassica napus
agcttttgtctctgtgtcgccttcctcctcctaagtttgtaaacctaattttgagcaaagttcatagcttttatcttcctcatggccactcgtcttcagtttgagaataactgtgaagttggagtcttttcaaaactcactaacgcctattgcttagtcgctattggaggctctgagaatttttacagtgcttttgagtcggagttagctgatgttatccctatcgttaagacctctcttggtggaacacgaatcattggccgtctttgcgctggaaacaagaatggtcttcttgtccctcatacaactactgaccaagagcttcagcacttgaggaacagtttacctgatgcagttgtggtccagagaatcgaggaacgtctgtctgctcttggaaattgcattgcctgcaatgaccatgtcgcccttgctcacaccgatcttgacaaggaaactgaggagataatagcagatgtgcttggtgttgaagttttccgtcagacaattgcaggcaacattcttgttggcagttactgtgccttgtccaaccgaggtggcattgtccatcctcacacctcagtggaagacttggacgaactgtcaacacttcttcaagtccctctagttgcaggaaccgtgaaccgtggtagtgaagttataggtgcgggtatgacggttaatgactggactgctttctgcgggtcagacactaccgccacagagctctctgttatagacagcatcttcaaactaagggaagcccaacccagctccattgtcgatgagatgaggaagtctttgatcgatacctacgtttaaatttcgcttttttttaatcactacaacaacatccccgaagtgttacaatgtctgaaaatttctcatcttttgtggtcttttaagtctttgaatgaacatctctttacgtttgttaaatcttatccataaaatctctcgaaaaaaa

SEQ ID NO: 2242 - DNA, 1028 bp, Eragrostis curvula
  misc_feature (29)..(30): n is a, c, g, or t
  misc_feature (38)..(38): n is a, c, g, or t
  misc_feature (43)..(43): n is a, c, g, or t
  misc_feature (46)..(47): n is a, c, g, or t
  misc_feature (50)..(50): n is a, c, g, or t
  misc_feature (73)..(73): n is a, c, g, or t
  misc_feature (76)..(76): n is a, c, g, or t
  misc_feature (102)..(102): n is a, c, g, or t
  misc_feature (106)..(106): n is a, c, g, or t
  misc_feature (671)..(671): n is a, c, g, or t
  misc_feature (799)..(799): n is a, c, g, or t
  misc_feature (839)..(839): n is a, c, g, or t
  misc_feature (846)..(846): n is a, c, g, or t
  misc_feature (853)..(853): n is a, c, g, or t
  misc_feature (860)..(860): n is a, c, g, or t
  misc_feature (873)..(873): n is a, c, g, or t
  misc_feature (885)..(885): n is a, c, g, or t
  misc_feature (890)..(890): n is a, c, g, or t
  misc_feature (895)..(895): n is a, c, g, or t
  misc_feature (914)..(914): n is a, c, g, or t
  misc_feature (919)..(920): n is a, c, g, or t
  misc_feature (925)..(926): n is a, c, g, or t
  misc_feature (930)..(931): n is a, c, g, or t
  misc_feature (941)..(941): n is a, c, g, or t
  misc_feature (954)..(954): n is a, c, g, or t
  misc_feature (964)..(964): n is a, c, g, or t
  misc_feature (967)..(967): n is a, c, g, or t
  misc_feature (979)..(980): n is a, c, g, or t
  misc_feature (995)..(996): n is a, c, g, or t
  misc_feature (1010)..(1011): n is a, c, g, or t
  misc_feature (1013)..(1013): n is a, c, g, or t
  misc_feature (1026)..(1026): n is a, c, g, or t
aggaaaaagagaaaaaacacaagaaacanncaaaggtntcgcncgnnaancctcgcgcctccgccaccgcaancgncgctcctgcctcggccaccgcctccntttncgctccgtcggtgccgtgccctacctgtagaagtcgaggagcagcggcttcgaagaccaatcaatcatggcgactcgtatccagtttgagaacaattgtgaggttggtgttttctccaagctgacaaatgcttactgcctggtggcaatcggagggtcagagaacttctacagtgcctttgaggctgagcttgcagatgtcattcctgtggtgaagacatcaataggtggcactagaatcatcgggcggctctgtgttggaaacaagaatggacttctcctgccacacactactaccgaccaagagcttcagcatctgcggaactgcttgcctgatcaagtggttgtccagcgtattgatgagaggttgtctgcccttggcaattgcatagcctgcaatgaccatgttgctcttacacaccctgaccttgacaaggagactgaggagcttattgctgatgtgcttggtgttgaggtgttccggcagacgattgcaggaaatatccttgtggggagttactgcacattctcgaacaggggtggcttggtgcaccctcatacctccnttgaagaccttgatgaactgtcgactctcctgcaagtccccctcgttgctggaactgtgaacagaggcagtgaggtcatcgccgcaggcatgactgtgaatgactggactgcattttgtggctcgganacaacggccactgagctgtcggtcattgaaagtgtcttcnagctganagaaggncacccanggcaattgttgangacatgaggaantctcngatanacagttatgtgtaactganatcannattanngtgnnaagatctacnggaaactataccngtgcaatcantantaaaactggcanngtaaacttggtgatnnacccctgggttctnnangattaacttgatntt

SEQ ID NO: 2243 - DNA, 1150 bp, Fragaria vesca
acccagaaagcgtctatctctctcgtttcgtttttgcgtgagccgccgccgattttgcttggcttgcttccacctagaggttttcgggaactcgccgctaaacatacatatactttccatctgttgcaaagttttgctgtgaaaccatggcgaccaggctgcaatttgagaactcatgtgaggttggggttttctccaagctgactaatgcttactgtttggttgccatcggaggctctgagagcttctacagcacatttgaggctgagttggcagatgttatccctgtggttaagacctctattggtggcacccgcatcattggtcgcctctgtgctgggaataaaaatgggcttcttctgcctcacaccaccacagaccaagaactacaacacttgaggaacagcttgcctgaccaagttgttgttcagcgcattgaagagagactatctgctcttggtaactgcattacgtgcaatgatcatgttgctcttacacaccctgatcttgatagggaaactgaggagatggtcacagatgttcttggggtggaagtttttcggaacactattgctactaatgttcttgttggcagcttttgtgccttgtccaacagaggtggcttggttcatccacacacatctgttgaagacttggatgaactttcaacacttcttcaggttcctctggttgctgggacagtcaaccgtggtagtgaagtcatagctgctggcatgatagtgaatgattggacagcattctgtggatctgatacaactgccacagaagtctcagtgattgaaagtgtgttcaagttgagggaagctcaacctagtgccattgtggatgaaatgaggaaatcattgattgacagctatgtctgagctaaatctctttgatacttgatacgaaactgaagaagctttgtttaaagtcttaagtagaaaagatctaatttctccaagatgtataattcttgcattgtttatgttaggactttgttgaatttgagtaattttgttgttggttatgttgggaagagctgaaccagtattggctgggttatgttaagagaatgccatctgtgtaagaagactcccatatgtttactcatatatgtttctgttacatgtgttttctaatgttgctc

SEQ ID NO: 2244 - DNA, 839 bp, Brassica napus
ggtcttgcgtctccttcccgattctttcctcgtgtaagttatcaaagttggtagctttctgttcctcatggccactcgtcttcagtttgagaacaactgtgaagttggagtattctccaaactcactaacgcctattgcttagtcgctattggaggctctgagaacttttacagtgcttttgagtcggagttagctgatgttatccctatcgttaagacctctcttggtggaacacggattattggccgtctttgtgctggaaacaagaatggcctccttgtgccccacacaactactgaccaagagcttcagcacttgaggaacagtttacctgattcagttgtggtccagcgaatcgaggaacgtctgtctgctcttggaaattgcattgcctgcaatgaccatgttgcgcttgctcacaccgatcttgacaaggaaactgaggagataatagcagatgttcttggtgttgaagttttccgtcagacaattgctggcaacatccttgttggcagtaactgtgccttgtccaacagaggtggcattgtccatcctcacacctcagtggaagacttggacgaactatcaacacttcttcaagtccctctagttgccggaaccgtgaaccgtggtagtgaagtcataggtgctggtatgacggttaatgactggactgctttctgcgggtcagacacaaccgctacagagctctctgttatagacagcatcttcaagctaagagaagcccaacccagctccattgtcgatgagatgaggaagtctctgatcgatacctacgtttaaaatttgctttgtttggatgacatacacaacaaca

SEQ ID NO: 2245 - DNA, 951 bp, Podocarpus macrophillus
ctgcgccatcacagaggttgtggtctccttgcccttgggttcgaaaagccttttgttttacacgacaaggaggagaatttgttttctaggcgctgcatcatggcaacaagaactcagttcgaaaattcatgtgaaattggagtattttcaaagctgacaaatgcgtattgcctagtggccattggtggatcagagaacttttacagtacatttgagtctgagctagccgatgtcattcctgttgtcaagacatcagttgctggcactagaatcattggacggctctgtgttgggaacaaaaatggtctgcttctgccaaataccacaactgaccaagagcttcaacacttgaggaacagtttgcctgatcaagttgtggtgcagagagttgaagaacggctgtctgctcttggcaattgtgtggtgtgcaatgaccatgtggcactaattcatactgacttggacagggagacagaagagctgatagcagatgttctaggagttgaagttttcaggcaaactattgcaggaaatatactagttgggagttactgtgcattttccaacagaggtggtctggttcatccccacacatctattgaagatctagatgaattatcaacacttctccaagtaccacttgtggcagggacagtcaatcgtggaagtgaagttgtggctgctggaatggttgtgaatgactggactgctttctgtggtttggacacaactgcaaccgaattgtcagttattgaaagtgtcttcaaattgagggaatcacagcccagtgctattgttgatgagatgaggaaatctctgatagatagttttgtttaaaggattgttgatgtcttattttatatgatcaactttggtttggacacaacagcaaccgttattttcagttattgaaagtgtcttcaaattgaggaaatcacagcccagtgctat

SEQ ID NO: 2246 - DNA, 1199 bp, Brassica rapa
tttaaattagggccaaagcggtgtccagagccgccagtgtttaaaagggcaaaacccttttccttctcttcttcttcctccaaaaccttttaactccatttgttgcctcttcttcgccgctctctctctccctcctcgattcatccttctcccaagtgtgcgttatcaaagttcatacctttctccactccatggccactcgtcttcagtttgagaacaactgtgaagttggtgtcttttcaaagctcactaacgcttattgcttagttgctattggaggctctgagaacttttacagtgcttttgagtcggagttagctggtgttatccctatcgttaagacctctattggaggaactaggattattggccgtctatgcgctggaaacaagaatgggcttcttgtgcctcatacaactactgaccaagagcttcaacacttgaggaacagtctacctgatcaagttgtgggccagagaatcgaggggcgtctgtcggctcttggcaattgcattgcctgcaatgaccatgttgctcttgctcacaccgatcttgacaaggaaactgaggaaataatagcggatgttctcggtgttgaagtattccgtcagacgattgcaggcaacattcttgtaggcagctactgtgccttgtccaacagaggtggcattgttcatcctcacacctcggtggaagacttggacgagctctcgacactacttcaagtcccactcgttgcaggaactgtgaaccgtggtagtgaagttataggcgcgggaatgaccgttaatgattggacttctttctgcggttcagacacaactgcaacagagctctctgttatagacagcatcttcaagctaagggaagcccaacctagctctattgtcgacgagatgaggaagtctttgatcgatacctatgtttaatttttgctttgttttggatgagacacaacaacaacaacattctcaagtgtcaaatctcttaaagtttcatatcttttatggtttttgtaggctctgaatatttattttactgttgcaagaataattttgtttcttctcccttgtgttttattatgttgaatcttttttttttattgatctagttcaactgggtccatggttggttcatattccagtgagttgtcagcttacaagaacgcattggatgcactgttgtctatgatcacattc

SEQ ID NO: 2247 - DNA, 1029 bp, Catharanthus roseus
gattgcaatttgagaattcatgtgaagttggggtattctcaaagctgaccaatgcttattgcttggttgccattggaggttctgaaaacttctacagcaccttcgagtcagaattggctgatgttattccagttgtgaagacctcgatttctgggactagaatcattggaaggctctgtgctggaaacaagaatgggcttctgttacctcataatactactgatcaagagcttcagcatttgaggaacagtcttccagattcagttgttgttcaacgaattgaggagagactatctgcactgggtaactgcattgcctgtaacgatcatgttgccctcacacatactgatcttgatagagaaaccgaggaaatgattgctgatgttcttggagtggaagttttcagacagaccattgctggaaatattctggtgggaagttattgtgcattttccaataggggaggcttggtccatcctcatacatcaatcgaggatttggatgaactttcaacacttctccaggttcctctagtggccggaactgtgaatcgagggagtgaagtgatagcagcagggttaacagtcaatgactggacagccttctgcggatctgatacaactgcaactgaattatcggtcattgagcgtgtgttcaagctcacagaagctcaaccaagtgccattgttgatgagatgaggaagtcattgatagacagttatgtgtagaccatcactccttggaatacaagaattttataattcctcgcgttctgcttttatgtacaccattttgataggttttgccatttcctggcatttgttatcgtttttgtcgtcatttatgtctgtttactatttatgcacggttaaaaatgtcctaatgtggcggaaaccggtgaatgaaattgctcatgtaagcggagtttggggtgaaaacagggagagaacgggaaggagtatgtaaatcatgatgtagttttgttacaatgtaagattgtgcatgatgtaaatatgaagtgaacgtttt

SEQ ID NO: 2248 - DNA, 1214 bp, Cicer arietinum
gcgctcctcctgtgctctgagagccgccacgccgccgagtcgtagtacgggtcccggctaccaaaggattgaagaagtgtagaagttcatccaaatctctgttgaagtgtgagggtttccgttcactattatcgtctcttactatttcacccaacaccaccgaccttccaccttccgccaccgttttccggcaaaccggcaccatccttccatttttccgatcttacagtttgatctttgcatttgagtactttggttaaaggtttcttccagtctcaaccatggcaactagacttcagtttgagaataattgtgacattggagtgttctctaaacttaccaatgcctattgtatggttgctattggaggctctgaaagcttctacagtgtatttgagtccgagttatcaggtgttatcccagtggtgaagacatctattgctggcacacgcattgttggtcgtctatgtgctggaaacaagaatggtcttctcttgccccataccaccacagaccaagaacttcaacatttgagaaacagtctacctgatcaagttgttgttcagaggatagaagaaagattatctgctctgggaaattgtatagcatgtaatgaccacgtggctctcactcacaccgatctcgacagggagactgaggagataattgcagacgttcttggagtagaagttttcaggcagaccattgctggtaatattcttgttggtagtttctgcgccctctccaatagaggtggtttggtccaccctcacacttcaatagaagatttggatgaactttctacacttcttcaagttcctttggtagccgggaccgtcaaccgaggtagtgaagtgatagctgctggaatgacagttaatgattggacagcattttgtggttcagacaccacagcaactgagctctctgtcgttgagagtgttttcaagctgagggactcacagcctagtgtcattgtggatgagatgaggaaatcactcattgatagctatgtttgaaaattaattgatagtattgatgacttttggtaaacatgttttaaatttggttatagtttttgtcttgtaatgtgaagacttttggtgaagatgttattttgttatagttttggcttatgcaatgtgaacacttatgttctaaaaggattgattgtaatttacttgtttgtgatatcggttattgagtgttgggta

SEQ ID NO: 2249 - DNA, 1301 bp, Cicer arietinum
tttatgttttaaaaataaaacacgttggtttaaaatgaggttgaagtaatctcttaccttaatttgaaaccattttgtattaaaacttaaaaaccatataaataggtttagggtttccgttcactattatcgtctcttactatttcacccaacaccaccgaccttccaccttccgccaccgttttccggcaaaccggcaccatccttccatttttccgatcttacagtttgatctttgcatttgagtactttggttaaaggtttcttccagtctcaaccatggcaactagacttcagtttgagaataattgtgacattggagtgttctctaaacttaccaatgcctattgtatggttgctattggaggctctgaaagcttctacagtgtatttgagtccgagttatcaggtgttatcccagtggtgaagacatctattgctggcacacgcattgttggtcgtctatgtgctggaaacaagaatggtcttctcttgccccataccaccacagaccaagaacttcaacatttgagaaacagtctacctgatcaagttgttgttcagaggatagaagaaagattatctgctctgggaaattgtatagcatgtaatgaccacgtggctctcactcacaccgatctcgacagggagactgaggagataattgcagacgttcttggagtagaagttttcaggcagaccattgctggtaatattcttgttggtagtttctgcgccctctccaatagaggtggtttggtccaccctcacacttcaatagaagatttggatgaactttctacacttcttcaagttcctttggtagccgggaccgtcaaccgaggtagtgaagtgatagctgctggaatgacagttaatgattggacagcattttgtggttcagacaccacagcaactgagctctctgtcgttgagagtgttttcaagctgagggactcacagcctagtgtcattgtggatgagatgaggaaatcactcattgatagctatgtttgaaaattaattgatagtattgatgacttttggtaaacatgttttaaattttggttatagtttttgtcttgtaatgtgaagacttttggtgaagatgttatttttgttatagttttggcttatgcaatgtgaacacttatgttctaaaaaggattgattgtaattttacttgtttgtgatatcggttattgagtgttgggatactttgatccaaggcatatttggtttaatacgatagatgtgcatcaagaacacaaatttgaataaggaaacagtggaattggaca

SEQ ID NO: 2250 - DNA, 1098 bp, Euonymus alatus
aaaccccaagaccataggattggattttctctcgccctagccacccggctctcacggagtctcacagccaatcacagccgcttgcgtccgttgcgtctctatcatcgttggactacttgctctagtcgtccgtcggagatatttgaaaatccagctcttatttctctcagtgactgcctttgcttggttaatcccctcctatcatggcaacaagacttcagtttgagaattcatgtgaaattggggtattctccaagttgaccaatgcatactgtctggttgccataggaggatcagaaaacttctatagcacctttgaggcagagttagcagatgtcattcctgtagtcaagacctcaatcggaggcactaggataattgggaggctatgtgctgggaataaaaatgggcttcttgttccacacacaactaccgatcaagaacttcaacacctgaggaatagtctacctgatcaagttgttgtccagaggatagaggagaaactatctgctctgggtaattgcatagcttgcaatgaccatgttgctcttacacacaacgacctggacagggagaccgaggagattgttgcagatgtactgggtgtagaagttttcgggcatacaattgctggtaacattcttgtgggcagctactgtaccatctccaacagaggtggcttggtccatccccatacttccattgaagagctggatgaactttccacacttcttcaggttcctttggttgctgggactgttaaccgtggaagtgaagttatagctgctggaatgacagtaaatgactggacatccttctgtgggtcagacactactgctactgaactgtccgtcattgagagtgtcttcaaactgagggaagcacagcctagttccattgttgacgaaatgaggaaatcattagtcgacacttatgtttgaattactattagcaagttatacagtgctggtgataccttaccttttgtgtattttttcaaagtatggacatgcagtgtttctaattctgtacttctaccaacaagatgtttttgttccattttcaagccgagtattttaatatccatatcagtttttg

SEQ ID NO: 2251 - DNA, 1059 bp, Euonymus alatus
cctaaaccccaagaccattggattggattttctctcgccctagccacccggctctcacggagtctcacagccaatcacagccgcgagcgtccgttgcgtctctatcgtcgttggactacttgctctagtcgtccgtccgagatatctgaaaatccagctcttatttctctcggtgactgcctttgcttggttaatcccctcctatcatggcaacaagacttcagtttgagaattcatgtgaaattggggtattctccaagttgaccaatgcatactgtctggttgccataggaggatcagaaaacttctatagcacctttgaggcagagttagcagacgtcattcctgtagtcaagacctcaatcggaggcactaggataattgggaggctatgtgctgggaataaaaatgggcttcttgttccacacacaactaccgaccaagaacttcaacacctgaggaatagtctacctgatcaagttgttgtccagaggatagaggagaaactatctgctctgggtaattgcatagcttgcaatgaccatgttgctcttacacacaacgacctggacagggagactgaggagattgttgcggatgtactgggtgtagaagttttcgggcatacaattgctggtaacattcttgtgggcagctactgtaccatttccaacagaggtggcttggtccatccccatacttctattgaagagctggatgaactttccacacttcttcaggttcctttggttgctggaactgttaaccgtggaagtgaagttatagctgctggaatgacagtaaatgactggacatccttctgtgggtcagacactactgctactgaactgtccgtcattgagagtgtcttcaagctgagggaagcacagcctagttccattgttgacgaaatgaggaaatcattagtcgacacttatgtttgaattactattagcaagttatacagtgctggtgataccttaccttttgtgtcttttttcaaagtatggacatgcagtgtctaattctgtacttctaccaacaagatgtttttgttcc

SEQ ID NO: 2252 - DNA, 1037 bp, Mimulus guttatus
aatccagaataatccaaaatgaaataaaaatatccattcttctaatcaaaccctaatttctttacaattgtatctctctcttgcaccttcccctccaatttcaatttgcgccatggcaacaagattgcaattcgagaacaattccgaaattggggttttctccaagctcacgaatgcctactgtttggttgcaattgggggttctgaaaatttctacagcacatttgagtcggagttggccgatgtaattccggtggttaaagcctccatcggcggcactagaatcatcggccgcctctgtgccggaaataaaaaggggttgcttttgccgcacaatacaaccgatcaagagcttcaacacttgaggaatagtgtaccggattcagtcgttgttcagcgtattgatgagaggttgtctgctctagggaactgcattgcatgcaacgatcatgttgctcttacacatcctgatctcgacaaagaaactgaggaaatgattgctgatgttcttggagtggaagttttccgacagactgttgccggtaatatgctcgtcggaagtttttgtgcactcaccaatagaggtggattggttcatccacatacatcgatagaggatctagacgaactatcgacactacttcaagtacctttggtggccggcaccgtgaatagaggtagtgaagtcataggagctggtttgatcgtcaatgattggacggccttttgtgggtccgacacaactgctaccgagttatctgttctcgagagtgttttcaagttgagagaagctcagcccactgctattgtcgatgagatgaggaaatcattgatcgacacctatgtttgagcttttccaaaactctcggattttccttggaaagctttgtgatttggttttaacgcagtttcggttttatgggcattgtttgtttcattctatatatataagccctggaattacagacaccttattatctcaattttgtgttattagttccctaattcaaaaaaaatatatataatgttgttttggg

SEQ ID NO: 2253 - DNA, 1178 bp, Mimulus guttatus
aatccagaataatccaaaatgaaataaaaatatccattcttctaatcaaaccctaatttctttacaattgtatctctctcttgcaccttcccctccaatttcaatttgcgccatggcaacaagattgcaattcgagaacaattccgaaattggggttttctccaagctcacgaatgcctactgtttggttgcaattgggggttctgaaaatttctacagcacatttgagtcggagttggccgatgtaattccggtggttaaagcctccatcggcggcactagaatcatcggccgcctctgtgccggaaataaaaaggggttgcttttgccgcacaatacaaccgatcaagagcttcaacacttgaggaatagtgtaccggattcagtcgttgttcagcgtattgatgagaggttgtctgctctagggaactgcattgcatgcaacgatcatgttgctcttacacatcctgatctcgacaaagaaactgaggaaatgattgctgatgttcttggagtggaagttttccgacagactgttgccggtaatatgctcgtcggaagtttttgtgcactcaccaatagaggtggattggttcatccacatacatcgatagaggatctagacgaactatcgacactacttcaagtacctttggtggccggcaccgtgaatagaggtagtgaagtcataggagctggtttgatcgtcaatgattggacggccttttgtgggtccgacacaactgctaccgagttatctgttctcgagagtgttttcaagttgagagaagctcagcccactgctattgtcgatgagatgaggaaatcattgatcgacacctatgtttgagcttttccaaaactctcggattttccttggaaagctttgtgatttggttttaacgcagtttcggttttatgggcattgtttgtttcattctatatatataagccctggaattacagacaccttattatctcaattttgtgttattagttccctaattcaaaaaaaatatatataatgttgttttgggaaaactttggtgaactgctatagtgtggtttacgtttctcgtatggtttgtaaataaaatttgaggtgcaccattgtgtttcaagaaaccaaaacatattcaaaatgttacaatgtcaaaatttggacaaaaaacaataaa

SEQ ID NO: 2254 - DNA, 1049 bp, Lippia dulcis
tagtaaaataatctgaatccctaggatcaagattcatgaaccgcgccgcgcttcttcttcattaatcagcaccgccgcgccgttcttctcctcctcctccaacctctactacgagttggtcggttgttgttcctcgttcaaagccctatcttttactatggcaacaagattgcaatacgagaataattgtgagattggggttttctccaagcttaccaatgcatattgcctggttgcaattgggggttcggagaatttttacagcacatttgaggctgagttggctgatgtaattcctgtggtcaaaacctccattgctggtactagaatcatcggacgcatgtgtgctggaaataagaaagggttgctcttgcctcacaatactacggatcaagagcttcaacacttacggaacagtctcccagactccgtggttgttcaacgaattgaggagagattatctgctctcgggaactgtatttcctgcaatgatcatgttgctcttacacatcctgatcttgacaaggaaactgaggagttgatcgcagatgtgcttggtgtggaagttttccgccagactgtagcaggcaatattcttgtcggcagttattgtaccttctcaaacataggtggcttggttcatccccacacatccatagaagatctagatgaactctccaccctcctccaagttcctttggtggctgggacagtgaatcgcggtagcgacgtgatagctgccggcttgacagtcaatgactggacagctttctgtgggtcggacacgactgctacggagttgtctgtcatcgagagcgtgttcaagttgagagaagctaaacctagtgccctcgtcgatgaaatgaggaaatcattgatcgacacctacgtgtgagaacacatcttatgtttctgaagtaacaagttgcttgtacttgggcagtatgaactgatttcgttaatgtgtgtgtgagtgtgtgtgtgcagaacatgttttgttgtggcgttttgattgtgatgtattactacattgaaaattcataaaagtt

SEQ ID NO: 2255 - DNA, 1125 bp, Silene vulgaris
agaaaagtcatagaacaaggcctcccaatcaatctgctatacttctcttcgaccaatctctcacaacacttaaccttcaccgccgcttcttgatttttctgtcacccttttctcttttatctccttcacccttctcatcacaggttttgatatatttgggttcgtgggttttgcttaattttccaatcatggctacaagacttcaatttgagaacaattgtgaagtgggtgtcttttccaagttaactaatgcctattgtttggttgcaattggcggttctgagaacttttacagcacatttgaatctgagctggcagaacatatgcctgttgtgaagacctccattgcagggactagaattattggccggatgtgtgccggtaacaaaaatggtcttcttgttcctcactccacaactgatcaggaactccaacacttgaggaacagtctacctgatgaggtggttgtacaacgcatcgaagaaaggttgtctgcgctcggaaactgcatagcatgcaatgattatgttgctctgacccacacagaccttgataaggaaaccgaagaaataatagctgatgttcttggtgttgaggttttccgacaaactattgccggcaatattttggtggggagctactgtgctctttccaacaaaggcggcctggtccatcctcatacatcaattgaagaccttgatgagctttcaacccttcttcaagtcccgcttgtggccgggactgtgaaccgtggaagtgaagtaattgcagctgggttaactgtgaacgactggactgcattctgtgggtctgacactacagccactgaactatcagtgatagagagcgttttcaagttgagagaagcccagcctagtgctattgtggatgagatgaggaaatccttgattgatacttatgtttgaaattacttggtgtcttcgagtgctttaagttgctagaatgatgtaacgatgatgatatcgtgttgtgtttttccaatttaaactgttttgtgaacaagagtatctttaatccttgcaacgggaaatttattactgtaattctagagttgatgctgtagcatgtaatccttttttaatttataagcatgaatttggtatc

SEQ ID NO: 2256 - DNA, 1039 bp, Silene vulgaris
aaaacttaaccttcaccgccgcttctttatttttctgtcacccttttccttcatcttcttcctctcttaccctcttcatcacaggtttttggtatatttggcttcgtgggttttgcttaattttccaatcatggcgacaagacttcaatttgagaacaattgtgaagtgggtgtcttttccaagttaactaatgcctattgtttggttgcgattggtggttctgagaacttttacagcacatttgagtctgagctggctgaacatatacctgttgtgaagacctccatcgctgggactagaattattggccggatgtgtgccggtaacaagaatggtcttcttgttcctcactcgacaactgatcaggaacttcaacacttgaggaacagtctacccgatgaggtggttgtacagcgcattgaagagaagttgtctgccctcggaaactgcatagcatgcaatgattatgttgctctgacccacactgacctcgataaggaaactgaagaaataatagctgatgtccttggtgtcgaggttttccgacagactattgccggcaatattttggtgggaagctactgtgccctttccaacaaaggcggcctggtccatcctcatacatcaattgaagaccttgatgaactttcaaccttacttcaagtcccacttgtggccgggactgtgaaccgtggaagtgaagtaattgcagctgggttaaccgtgaacgactggactgcgttctgtgggtctgacactacagccactgaactatcagtgatcgagagcgttttcaagttgagagaagcccagcctagtgcaatcgtggatgagatgaggaaatccttgattgatacttatgtttaaaactcgttggtgtcttggtattgcttcgagtgctttatgttagaatgatctagcgatcatatcatgtcgtgtttttcctatttaaactgatttgtgaacaagagtatgtttaatccttgcaacgggaattttattagtgtaattcaagagttaatggtcaagcatgtaacc

SEQ ID NO: 2257 - DNA, 803 bp, Eutrema parvulum
taatatgcaggtcttcagtttgagaacaactgtgaagttggtgtcttttccaaactcactaatgcctattgcttagtcgctataggaggctctgaaaacttttacagtgcttttgagtcagagttagcagatgttatccctatcgttaagacttctattggaggaacacgaattattgggcgtctatgtgctggaaacaagaatgggcttcttgtgcctcatacaactactgaccaagagcttcaacacttgaggaacagtctacctgatcaagttgtggtccaacgaattgaagaacgtttgtctgcacttggaaattgcattgcctgcaatgaccatgttgctcttgctcacactgatcttgacaaggaaactgaggaaataatagcggatgtccttggtgttgaagttttccgtcagacaatcgcgggcaacattcttgtgggcagttactgtgccttatccaacagaggtggaatggtccatcctcacacctcagtggaagacttggacgaactctcaacgcttcttcaagttcctcttgttgcaggaaccgtgaaccgtggtagtgaagttatagctgcgggtatgaccgttaatgactggacctctttctgcggttcagacacaaccgcaacagagctctctgttatcgacagcatcttcaagctaagggaagcccaacccagctctatcgtggacgagatgaggaagtcgttgatcgatacatatgtttaaattttgctttgtttgagtcaatgttagaaattttcttatcatttgtggtctctgtagctctgaat

SEQ ID NO: 2258 - DNA, 765 bp, Eutrema parvulum
ggggtttgggggtaatatgcaggtcttcagtttgagaacaactgtgaagttggtgtcttttctaaactcactaatgcctattgcttagtcgctataggaggctctgaaaacttttacagtgcttttgagtcagaattagcagatgttatccctatcgttaagacctctattggaggaacacgaattattgggcgtctctgtgctggaaacaagaatgggcttcttgtgcctcatacaactactgaccaagagcttcaacacttaaggaacagtctacctgatcaggttgtggtccagcggattgaagaacgtctgtctgctcttggaaattgcattgcctgcaatgaccatgttgctcttgctcacaccgatcttgacaaggaaactgaggaaataatagcggatgtccttggtgttgaagttttccgtcagacaatcgcgggcaacattcttgtgggcagttactgtgccttatccaacagaggtggaatggtccatcctcacacctcagtggaagacttggacgaactctcaacacttcttcaagttcctctcgttgcaggaactgtgaaccgtggaagtgaagttatagctgcgggtatgactgttaatgactggacctctttttgcggttcagacacaactgcaacagagctctctgttatagacagcatcttcaagctgagggaagcccaaccgaactcgattgtcgacgagatgaggaaatcgttgattgatacttatgtttaaatgtcaattacaact

SEQ ID NO: 2259 - DNA, 1350 bp, Theobroma cacao
accataaatacagtttttaatttaagaattttcaacttgaaaattataccttgaaatattaaataaaataaaaacataaaaaataaataaaaaattcaaagagtggagcttaaattctatggttgtaataagagctatgtgcaagtacaaacgatacagcgcctcactttcccttttacccctcaacgccggtcttccaaccctcaagaaagcaccgaatttatgcatattttgtaaatgtttatttattttaattttaattttttttcatattatttctttgcttcaatttatttctggggcttcttcctctctgtttctatcattgatccgttgttttcctgctttataatggcgactaggctaaagtttgaaaattcatgtgaagttggtgtcttttccaagctgaccaatgcttactgcttggttgcaattggagggtcagaaagcttctgtagtgcctttgagtcagagttagcagatgttattccagtcattaagacctctattgctggcactagaataattggaaggctatgtgctggaaataagaatggccttcttgtcccccacaccaccacagatcaagaacttcaacacttgcgaaatagtctaccggatcaagttgttgttcggcgaatagaggagaaactttctgctcttgggaactgtattgcatgcaatgaccatgttgctctgacacacactgatctagacagggaaactgaggagataattgctgatgtcctgggtgtagaagttttcaggcagacaatcgctggtaatattcttgtagggagctactgtgccttctctaacagaggcggcttggtccatcctcatacatccattgaagacttgaatgagctttcgacacttcttcaggttccattggtggctggcactatcaaccgagggagtgaagtaatagctgctggaatgactgtaaatgactggacggccttctgtgggtcagacaccacagcaacagaactttctgtcattgagaatgtcttcaagctgagggaagcgcaacctagtgctattgtagatgagatgaggaaatcattgatcgacagttccgtgtaatctccctttgtctagttctgctcatcctttgtctaaattcaagtcgataaaatgttcgggtgttgtttttatgtcatgttaaactccaaaatggaaagtgtaaattttgaaacagtgtgaagggttgatgtctgatgaagtaaaagaacaccggaaaattatttattttcatctcatgtaaacgtttaatgcatctttctcttgtggtgtgtagaaatgcatcattaagacttttaactattactattataaaattctatc

SEQ ID NO: 2260 - DNA, 1270 bp, Papaver somniferum
atccgtttctgtcgaagagttacaaaagcctaacctagcaatcgtaactataacaaaagagttttgatattcttccaacttaaagtcccaacccctctctcggtttgtaatcttttgtcttccgcctgcacatatttgaagaaatcttcaactttttctaaggtttgagttgttgaaaattgtgggatttttgttttattcccaatcatggcagttcgtcttcaatttgagaacaactgtgaagttggggtgttttctaagttgacaaataagtattgtttggtcgcaataggaggatcagagaacttctacagtacattcgagtccgagttagctgatgttatccctgtggtgaaaacctctataggaggtacaaggattattgggcgtctatgtgcaggaaacaagaatggtcttctagtgccacacactactactgaccaagagcttcaacatttacggaacagtataccggatgaagttgttgttcagcgtattgacgaaagactgtctgcgttggggaattgcattgcttgtaacgatcatgttgctcttactcatactgatctcgacagggacacggaggagattattgcggatgtccttggtgttgaagtgttcaggcagacaatagctggaaacattctcgttggcagttactgtaccttctctaacaaaggtggattggttcatccacatacatccgttgaagacttggatgaactttcaactcttcttcaagtccctctggtggctggtactgtcaatagaggtagcgaagtcattggtgctggtatgatagtcaatgactgggctgcattttgtggttcagacaccacagctactgagctatctgtcatcgaaagtgtgtttaaattgagagaggctcaacctagctccattcatgatgagatgaggaaatctttgattgacagctttgtttgaccttttaaaagtgcaagtccttggataggacttatgcccgttaagttaacgtcttttgctttcttgttctttcgagaaagaaatggaaaccttctgatagtgtagttcctactttgtacaatgtggaaagtactttattaaaatccgttaggattatgttgacaggccaattcggtatcagtgaaccgtttttgtttagtttttgaatcttatataaaaaagtgtaatgtatgtcctggttccccccacttagctatataacaagaagcacaaatgcataatgtcttgtattaggtttcggttaccctatttaactagttcctta

SEQ ID NO: 2261 - DNA, 924 bp, Primula obconica
ttttactttttggtcgttcgtctcacgatggcaactaggcttcaatttgagaattcatgtgaaattggggtcttttcgaagcttacaaatgcttactgtttggtggcaattgggggttcagagaatttttacagcacttttgagaatgaattagcagatgttatcccggtggtgaagacctccatcggtggtaatcggataatagggcgtctttgtgctgggaacaaaaatggacttctcgtaccgcataccaccaccgatcaggaacttcaacacctgaagaatagtcttcctgaccgagtgattgttcagcgcattgatgagaagctgtgcgctcttgggaattgtatagcaaccaatgattatgttgctctaacgcacaccgaccttgacaaggagactgaggagttaatcgctgatgtactgggggttgaggtttttaggcaaacagttgcaggcaatattctcgtgggaagctattgttccttcaccaataaaggaggcttggtacatccacatacatcagttgaagatttggatgagctgtcaaccctactccaagtcccattggtggcaggtaccgtgaaccgtggtagtgaagtcatagctgctggattaaccgttaatgactggactgcgttttgtgggtcagacactacagctaccgagttgtctgttatcgagagcgtgttcaaattaagagaggccgaaccaagtgctattgtcaaggagatgaggaaatcattgatcgacagctatgtttaaatggttttatttatactggatcgtcttttattattcttttgattgcaagaatgtttgtactaagctaaatgccgatttcgtttggtgattctggtttgttttgtgcctgttatattcccaaatttctaacacttgatattgtattatgctgtgttctct

SEQ ID NO: 2262 - DNA, 1044 bp, Citrullus lanatus
aggggttgcaagggactttgagtttatcattaagggaggtagttgttgattgttcgaggttatagtgtgctactcatggcgaccaggcttatgtttgagaattcttgtgaaattggggttttctccaagctcactaatgcttactgcttggttgcaattggtggctctgagaatttctacagtaccttcgaaactgaattaggtggtgtcattccggttgttaaagcatctattgatggcactcgcattattggccgtctttgtgctggaaacaaaaatggacttcttgtaccacacaccactactgaccaagaacttcagcatttgaggaacagtctacctgaccaagttgttgttcaacgtatacaagagagactgtctgctctggggaatacaattgcttgtaacgatcatgttgctctcacacatactgatcttgatcgggaaactgaagagctcattgctgatgttcttggagtagaggtctttaggcagacagtagcaggcaacgttctcgtgggaagctactgtaatttcacgaataggggcggcttggttcatccacatacatctgttgaagatttggatgagctatcaacccttcttcaagtccctttagttgctggaaccgtgaatcgtggaagtgaagtgattgctgctggattgacagcaaatgactggactgcattttgtggttctgacaccactgccaccgagttatcggtcattgagagcgttttcaaattgagggaggctcaaccaagttccattgttgaagaaatgaggaagtcgctaatagacagttatgtgtgaggcgtctcttctgatacacctgggatcttgcaagcaaggaattgctattactctgctgcctttttccttctgttatatttaactaactttgtgagtatgaaattcaactttgcacttacagcgttttgattgaaattgggatccaaatttgctattacagatgtgttctatttgtgtaaccaaaattttgtttcgatggcccttctgtttcagtgtgtctaccactaacta

SEQ ID NO: 2263 - DNA, 896 bp, Linum usitatissimum
gattctttatcatggcgactagacttcaatttgagaataactgtgaagttggcgttttctctaagctgactaatgcatactgcctagtcgcagtcggagggtctgaaagtttctacagcatttcgaatcagagttggcagatgtcatccccgttgttaagacctctattggaggcactagaattattggacggctatgcgctggaaacaaaaacgggcttcttgttccacacaccaccactgatcaggagcttcagcacttgagaaacagtctccctgattcagtggttgtccagaggatagaggagagattgtcagcactcggtaactgtatcgtttgtaatgaccatgttgctcttgcacatactgatctcgaccgggaaactgaagagatgattgctgatgtccttggagttgaagtgttcagacagacgattgctgggaatattcttgttggaagctattgtgccttgtctaatagaggtggcttggtccacccgcacacttcaatggaagacatggacgagctttccactcttctccaagtccctttggttgcagggactgttaaccgtggcagtgacgttatagcagcagggatgactgtaaatgactggacagcattctgtggttcggacactacagcaacagaactatctgttattgagagtgtattcaagttgagggaagctcaaccaagtgccatcatggacgagatgaggaagtctctggttgacacttacgtctgatgatgattatcgtgcatcctgggggtttgcttacatgctattatgctttgttgatcgcacaaaatgtcaggtgaagttttggaaaagacaagattgttcatttatcttctgcaacttctgttttctacttataaaagcaaacattatt

SEQ ID NO: 2264 - DNA, 1686 bp, Medicago truncatula
gcagatataaacttggtttattaggtcaaagatttctctcatggcaactaggcttcaatatgagaattcttgtgaaattggagctttctcaaaacttaccaatgcgtattgtttgactgctattggaggttctgcaaatttctacagtgcatttgaggctgaactagcagatattatccctgtggtcaaaacatccattgctagcactcgccttgttggtcttctttctgttggaaacaagaatgggcttttgttgccccataccaccacagaccaagagcttcaacatttgagaaacagtctacctgatcatgtacttgttcagcgtatagaagaaaaattgtctgctctgggaaattgtatagcatgcaatgaccatgttgcccttgcacacgctgatctcgacaaggaaactgaggagctgattgctgatgttcttggagttgaagttttcaggcagacagttggtggtaatattctttctggcagttactgtgctctgtccaacagaggtggtttggtccaccctcatacttctgttgaagacttggatgaactctctacacttcttcaaattccgttggttgcagggactgtcaatcgcggtagtgaagtaatagcatctggcatggtagtaaatgattggacggcattttgtggctcagacactacagcaacagagctctctgtgattgacactgttttcaagctgaggcccaatattaagttggtttcttggatcaaacatttctgtctgtcctccctctctgtcatggcaactagacttcagtttgagaattcttgtgaagttggagtcttctcaaaacttaccaatgcctattgtttggttgccattggaggttctgaaaatttctacagtgcatttgaggctgagttatcagatgttatccctgtgattaaaacttccattggtggtactcgtattgttggtcgcctttgtattggaaataagaatgggcttctattgccccataccaccacagaccaagaacttcaacatttgaaaaacagtctacctgatcgagtttgtgttcagcgcatagaagaaagattatctgctctgggaaattgtattgcatgtaatgaccatgtggccctcacgcacaccgatctcgacaaggaaactgaggaggtggttgcagatgttcttggagtagaagtatttaggcagacagttgctggtaatattcttgtgggaagttactgtgctttttcgaacaaaggtggtttggttcaccctcatacttccattgaagacttggatgaactatctacacttcttcaagttcctttggttgccggaactgtgaaccgtggtagcgaagtaatagcagctggcatgacagtaaatgattggacagcattttgtggttcagacactacagcaacagaactctcagtgattgagagtgttttcaagctgagggaagccaagcctagtgcccctgtggatgagatgaggaaatctctctttgatggctataactgagtttctctaaaagttttcacttttcatactaagttatactgcttgtaaagttctttttactttgatgatagttttttttttctttcccaagtaaaccgttgctgtcttttcaaatatgatcatagtttaatcaagatttgtggttttcactaattgtgctatatcttttacttcaa

SEQ ID NO: 2265 - DNA, 1086 bp, Sarracenia psittacina
attgaacattttcatttgtgaaacgaaccaaagttatccgcaaaacatcgcaaggtaaccctaaaattgaacattttcatttgtgaaacgaaccaaagctatctgcaatacatctcaagttcctgtaattctctggctccatcttcgttcagttcatttcggtctcatcatggcaaccagacttcaatttgaaaactcatgtgaagttggggtgttctcaaaactgactaatgcgtactgtttggttgccattggaggatcagaaatttctacagcacgttcgagtctgaattaacagacgttatccctgtggtgaaacctcaattggtggtactcggataattggacgtctttgtgctggaaacaaaatggacttctttgcctcacaccacaactgaccaagaacttcaacacctgaggaacagtctgccagatcaagttgttgttcagcgtattgaggagagattatctgctcttgggaattgcatagcatgcaatgattacgttgctctaacacacactgatcttgacagggaaactgaggagatgattgcagatgttcttggggtagaagtttttaggcagacaattgctggtaatattctcgtgggcagctattgtgccctctccaataaaggcggcctggtccatcctcatacctccattgaagatttggatgaactttcgaccctccttcaggtcccgttggtggcgggaacgtgtgaaccgtggcagcgaagtgatagccgctgggttgacggtaaacgactggacagcattatgtggatcggacactaccgcaacagaactctctgtcatcgagagcgtcttcaagctaagagaagcccaaccgagtgccattgttgatgagatgaggaagtcattgatcgatgcctatgtttgagtcgtcgattcttggacacaagatcaatatatcaaacagcattggccttttgaagcacttactcttgaattgttgacgtttgctttaggtgatgaattgtttttcttccatttcactctatttaatggtgtcgtgattgtatgttaagagtctctgatacatcgggggtatattcatctttt

SEQ ID NO: 2266 - DNA, 833 bp, Euphorbia esula
  misc_feature (768)..(768): n is a, c, g, or t
atctctgctcttccctcaccgttccggaagcagattcgcctctacacctttttacctattagctgttcggattatatctgaataatatcaatcatggcgacaaggcttatgtttgagaactcatgtgaggttggagtattttctaagcttacaaatgcatactgtttggttgccattggaggctctgaaagcttctacagtgcgtttgagtccgaattatcagatgtgattcctgtggttaaaacttccattgctgcactcggattattggtcgtctttgtgctgggaacaaaaaagggcttcttttgccccacaccaccactgatcaagaactgcaacacttgagaaacagcctgccggatagcgtttgttcagcgtgttgaagagagactatctgccttagggaattgtatagcctgcaatgaccatgttgctttgacacacaccgatctcgacagagaaactgaggaaatgattgcagatgttctaggcgttgaggttttcaggcagacaattgccggtaatattctcgtgggaagctactgtgccttctccaatagaggtggcttggttcatcctcatacttcaatagaagacttggacgagctttcaacactacttcaggtgcctttagtagctgggactattaaccgtgggagtgacgtgatagctgctgggatgaccgtgaatgactggacagctttctgtggttcagataccactgctactgaactctccgtgattgagagtgtttttaagctgagggangctcagccaagtgccattgttgatgagatgagaaaatcattgattgacagttatgtttgattttg

SEQ ID NO: 2267 - DNA, 949 bp, Utricularia gibba
gccggcgctcccaacccgttcgtatcatcctcgtcggattttctacttttgagaatggccacgaggctccagtacgagaataattgtgacattggggtgttttcgaagctcacaaatgcttattgtctggttgcaattgggggttcagagaatttttacagcacgtttgaagctgagttggctgatgtgattccggtggtgaagacctcgatcgcgggcacaagaatcattggtcgcatgtgtgctaggaaaataaaaatggattgttgctaccacacacgactactgatcaagagcttcagcacttgaggaacgccctaccagataacattgtcgtgcagcgtgtcgaggagagattatctgcactgggaaactgtattgcatgtaacgatcatgttgctcttacacatcctgatcttgactcggacacggaagaaatgatctctgatgttcttggcgtcgaagtgtttaagcagaccatcgccggcaatatacttgtcgggagctactgtgcattttccaatcttggtggcttggtacacccccatacatccatagaagacttggatgagctctcaacgctcctccaagtccccctggtggccggcacagtgaaccgtggcagcgaagtgatcgccgccggcatggtggtcaatgactggacagccttctgcggatccgacaccacagccacagagctgtccgtcatcgagaatgttttcaaactgcgtggcggcgctcaccccacttctttagtcgaggagatgagaaaatctctcatcgacacctatgtctgaacctcaagatttccgatgtatcagttggtcttcatgtcctgtcgaatgatgatgcttcttttacttcccgtttcagtgtaagaactcccccgttcccaaaagtttacaatgataataaacatccatttgcacgcaagtaaaaaaaaaaaaaa

SEQ ID NO: 2268 - DNA, 942 bp, Zostera marina
tttcatcatcgccataaccgacgttacgatctattgcttcctctcgattcatatatcccggcgacgagggcttacatatcccctactctctcgagttcttgttaaaaagaggtgctgtctacagccttgtatttcacaacagctacatggctaccaggcttcaatttgaaaattcatgtgaaatcggtgttttttctaagctgacaaatgcttattgcctggttgcaattgggggttccgagaatttttacagtgcatttgaatctgagttggcagatgctatacctgtagtgaaggcatccattggtgatacacgaatgattggccgactatgtgttgggaacaagaatggtctcttgttgccacacacaaccaccgaccaagaacttcaacacttgaggaacagcatacctgatagcgttgttgttcagcgtattgacgagagaatgaatgctttgggtaattgtatagcttgcaatgaccatgttgctctgacacatactgacttggataaggaaactgaggagttgattgcagatgttcttggagtagaagtctttcgacagacaatagctgggaacatccttgttggcagttactgtactttttccaacagaggcggcatggtccatcctcatacatctgttgaggatcttgatgaactttctaccttactccaagttccactagtagctggaactataaaccgagggagtgatgtcattgctgctggtatgatcgtgaatgactgggctgctttctgcggcttggacactactgcaacagagctctctgtgattgaaaatattttcaaattgggggattcacatccaactgcgatagtcgatactatgaggaagtctttgatcgatacttacgtttgagtttcttcttcatattttaacagacggaatgcaatttctattttcgatggttaaaata

SEQ ID NO: 2269 - DNA, 1027 bp, Actinidia deliciosa
  misc_feature (697)..(697): n is a, c, g, or t
ctcatcatggccactcgacttcaatttgagaactcttgcgaagttggggtgttctccaagctcaccaatgcctactgtctggttgcaatcggaggttcagaaagtttctacagtacgtttgaggctgagttagcagatgttgtccctgttgttaaaacctccattggtggtactcggattattggaaggctctgtgctggaaacaaaaatgggcttctcttgcctcacaccaccactgaccaagaacttcaacacttgagaaacagtcttccagatcatgttgttgttcagcgcattgatgagaggctatctgctctagggaattgcatagcatgcaatgattatgttgctctaacacacactgatcttgacaaggaaactgaggagatgattgcagatgttctcggggtagaagtttttcggcagactattgctggtaatattctcgtgggcagctattgtgccttctccaataaaggtggcctggtccatccccacacatcaattgaagacttagatgaactctcaaccctccttcaggtccctttggtggcggggactgtaaaccgtggcagcgaagtaatcgctgctggcttgacggttaacgactggaccgcattctgtggatccgacactacagctacagaattatctgttattgagagtgtcttcaagttgcgagaagctcaacctagtnccattgttgatgagatgagaaatcactgattgacagctatgtttgagtcatcaattcttggccatttatggcattgccattgttttatggagttgaggcccttgcccttaaattgtaatactcagtctcttcgtaaaatcaacgaatattatgtccaaattataagttattttttacttgtttgtaagtttttttcttgtgtgagggtagttgttttgcgcttatcccttagttgaactttctctagtcttgtattttgaaactccttgtattctctttcataaatgttcttcagcccaaataaacaaaacaagaaaaatggatttgtca

SEQ ID NO: 2270 - DNA, 943 bp, Populus trichocarpa
aaaataccctctatgtataaaccctatttggtaaaattctctccttgcaaacgtgcattccttttattttcctaaccaggtagcccctctctctctccctctctacaatcaacaaaagcaacaacagtattaagtttttttgcaatcatggcaacaaggcttatgttcgagaattcatgtgaagttggtgtcttttcaaagctcactaatgcatattgtttggttgctattggtggttctgagaacttttatagcacatttgaagcagagttaggagatgttattcctgttgttaaaacttccattggaggttctagaatcattggtagactttgtgcaggaaacaaaaatggaattctcttgccgcatactactaccgatcaagaacttcaacacttaagaaacagtctacctgatcaagttgtggttcagcgaattgaagagagattatctgcattgggaaatggtgtagcttgcaatgaccatgttgctctaacacacactgatcttgacaaggaaacagaggaaatgatatctgatgttcttggagtagaagtgtttaggcagactgttgctggtaatgttcttgtgggcagctactgtgctttctccaacagaggtggactggtgcacccccacacatccattgaagacttggatgaactctcaaccctccttcaggtgcctttagtggctggaaccataaaccgtggcagtgaagtgatagctgctggcttgactgtgaatgactgggctgccttttgtggggcagacactactgctactgaactttctgttattgagagtgttttcaagttgcgggaagctcagccaaatgccatagtgaatgagatgaggaactctttgattgacagctatgtatgaaccagtgatgttggccaactgtcaaatatattaatggtgctatcttgccgtaaagctg

SEQ ID NO: 2271 - DNA, 1366 bp, Populus trichocarpa
aggcaccacgaaaaatagtcaaatccaaaagtcatagccgcatagaccgacgagttgtcgtttacacataaacctcgaaccgagctaaaaaataaaggaaaataccctctatgtataaaccctatttggtaaaattctctccttgcaaacgtgcattccttttattttcctaaccaggtagcccctctctctctccctctctacaatcaacaaaagcaacaacagtattaagtttttttgcaatcatggcaacaaggcttatgttcgagaattcatgtgaagttggtgtcttttcaaagctcactaatgcatattgtttggttgctattggtggttctgagaacttttatagcacatttgaagcagagttaggagatgttattcctgttgttaaaacttccattggaggttctagaatcattggtagactttgtgcaggaaacaaaaatggaattctcttgccgcatactactaccgatcaagaacttcaacacttaagaaacagtctacctgatcaagttgtggttcagcgaattgaagagagattatctgcattgggaaatggtgtagcttgcaatgaccatgttgctctaacacacactgatcttgacaaggaaacagaggaaatgatatctgatgttcttggagtagaagtgtttaggcagactgttgctggtaatgttcttgtgggcagctactgtgctttctccaacagaggtggactggtgcacccccacacatccattgaagacttggatgaactctcaaccctccttcaggtgcctttagtggctggaaccataaaccgtggcagtgaagtgatagctgctggcttgactgtgaatgactgggctgccttttgtggggcagacactactgctactgaactttctgttattgagagtgttttcaagttgcgggaagctcagccaaatgccatagtgaatgagatgaggaactctttgattgacagctatgtatgaaccagtgatgttggccaactgtcaaatatattaatggtgctatcttgccgtaaagctgaatcgcttgatattccaaattgaaagtatgctgatgctcgaaatcacatgttttgttattaaagatcaagtttggttcaaacaattttttccccactggttttggcatggtgattcatgtcttgttacgtttaaaaatactatttttgaccgatgaaacaatcacaatctctgttattttattaaatttcttcataaccatgaagaacaaaaactgatactgagttggcttactgttgttgattttgtattatcaatattgctaagattgctaagatacgtggctcaactctattaaattgtccaattgggtgcctattttcccc

SEQ ID NO: 2272 - DNA, 1002 bp, Papaver somniferum
gtacaaaaggccaaaatcctaaaacctcaaccattgtaacctaaaaacactgatactgatagttcctccgttttgctgttcccttttcttggaattctacagaggtttttattagttggaagttttgggatttaacttgtacttatcatggcaacccgtctacaatttgagaacaattgtgaagttggggtgttctcaaagttaaccaatgcgtattgtttggttgcaattggaggatctgagaacttttatagtacatttgaatctgagttagcagatcacatccctgttgtcaaaacctctataggtggcactaggatcgttgggcgtttatgtgctggaaacaagaatggacttttggtgccgcacactacaacagatcaggaacttcaacacttgaggaatattttaccagatgaagttgtcgttcagagaattgacgagagactatccgcattgggaaattgcgttgcctgtaacgaccatgttgctcttgtacatactgatcttgatagggatactgaggagattatcgcagatgttttaggagttgaagtgtttaggcagacaattgctggaaatattctcgtgggaagttactgtaccttctctaacacaggcggattggttcatccccatacatccattgaagacctggatgaactgtcaactcttcttcaagttcctttagtggctgggacggtgaacagaggtagcgaagtcattggtgctggtatgattgttaatgactggactgcattctgtggatcagacactacggcaacagaactctctgtcattgaaagtgtgttcaagttgagggaagcccaacctagtctcgtaaaagatgagatgcggaaatcattgatcgacagtttcgtttaatactttactttgtttagactatcttttacttctatgtattacaagtccataattatcctatagtgtgatgaaggttactttgcagagattttatcatatttgaaagaaaaatgtcat

SEQ ID NO: 2273 - DNA, 1069 bp, Sciadopitys verticillata
gacagcacatcgatttttgtttaagcgcagttgccactgttactgatattgctattactattgcttaggcgagatcaaagcgagtttctgccacagcatacacaatctagtatctcgaggcttgcaggagaggaggaggtttatttggatctgcatcatggcgacaagaactgagtttgagaattcctctgaagttggtgtcttttcaaagcttacaaatgcatattgcctggttgccattggtgggtcggagaacttttacagcacatttgaggctgagctagcagatgttattcccgttgtaaagacatccgtagctggcaccagaatcattggacgactttgtgctgggaataaaaatggtctgctgctgccaaatactacaacagaccaagagcttcagcacttgaggaatagtttgcctgatcaagttgtggtgcaaagagttgaagaacggctgtctgcacttggcaattgtgttgtgtgcaatgaccatgtggctctaattcacactgatttggacagggagacagaagaactgatagcagatgttttaggagttgaggttttcaggcaaactattgcaggaaatattcttgttggtagttattgtgcgttttccaacagaggtggtctggttcacccacacacatccattgaagatctagacgagttatcaacactccttcaagtaccgcttgtggcaggcactgtcaaccgaggaagtgaagttgtggctgctggtatggttgtaaatgattggacagctttctgtggactggacacaacagcaactgagttgtcagttattgaaagcgtgttcaaattgagagaatcacagcccagtgccattgttgatgagatgagaaagtcattgatagatagttttgtctaaaggttgatcatgttacatattttatttggtcagcttttctcaggattgcttcctattataagttttaaggaagatcatttgactttttggtatctttctgtaaaactttccgtttgagaaagttgtaacatagcattgggtttttaccctcaactccatgatttttattggccc

SEQ ID NO: 2274 - DNA, 1371 bp, Taxus baccata
gacaagtaggtaatcaacgcagagtacgtcgggggaccctggaaggaagtttaacttactaattgattaattgtgtgatgaatatgtttatttgcttggccttcacgtttcctcctgcctctaaatacatacttcgattaccactcttatgtcagaattccctctttggtgcgtcttagagtttgcttctaccactctgaaaatcctcagttctcttccttaattggacggtcgaatctatttttcagttagaagcgtgtcaatacagccatcaaaattattatccacaggcacttattctgcacaaaagagaagtgttctttttttggctttgcagaatggcgacaagaactcagtttgaaaattcttgtgaaattggcgttttttcaaagcttacaaatgcatattgcttggtggccattgggggatcagagaacttttacagcacatttgagtctgagctagcagatatcattcctgttgtaaagacatcaataggtggaaccagaattattggacggctttgtgctgggaataaaaagggtctgttattaccaaatagcacaactgatcaagagcttcagcacttgaggaatagtctgccagatcaagtcgtggtgcaaagagttgacgaacgtttgtctgcacttggcaattgtgtggtctgcaatgatcatgtcgctctaattcataccgacttggacagagagacagaagaactgatagcagatgttctaggagttgaggtttttaggcaaacgatagccggaaatattctcgttggcagttatggtgtgttttctaacagaggtggactggttcatccacacacatctattgaagatctagatgagttatcaacacttctccaagtaccacttgtggcaggcagtgttaatcgtggaagtgaagttgtggctgctggaatgattgtaaatgattggactgctttctgtggattggacacaacagcaactgaattgtcagttattgaaagtgtgttcaaattgagagaatcacaacctagtgctatagttgatgagatgagaaagtcattgatagatagcttcgtgtaaattatgtcatttcatattatgtcttcagctttctctgcattgtttcctattgtgactttcaagcaaggttaaggccttgctacaaagattatatgacctttgatgtgtccgaaagctgtggtttataaacatgttatttttagaaagcttgccccaggacatgaaagaaccactcttatagagggcaataaccgtgtcttagtaacctcctatgcaaaccttttgagagctgcagttataagttattttgtttttagaaagcctgctacaggatatgaaagaactgagtatcccc

SEQ ID NO: 2275 - DNA, 1116 bp, Zostera marina
cggcggccatcgtcgttttcatcatcgccataaccgacgttacgatctattgcttcctctcgattcatatatcccggcgacgagggcttacatatcccctactctctcgagttcttgttaaaaagaggtgctgtctacagccttgtatttcacaacagctacatggctaccaggcttcaatttgaaaattcatgtgaaatcggtgttttttctaagctgacaaatgcttattgcctggttgcaattgggggttccgagaatttttacagtgcatttgaatctgagttggcagatgctatacctgtagtgaaggcatccattggtgatacacgaatgattggccgactatgtgttgggaacaagaatggtctcttgttgccacacacaaccaccgaccaagaacttcaacacttgaggaacagcatacctgatagcgttgttgttcagcgtattgacgagagaatgaatgctttgggtaattgtatagcttgcaatgaccatgttgctctgacacatactgacttggataaggaaactgaggagttgattgcagatgttcttggagtagaagtctttcgacagacaatagctgggaacatccttgttggcagttactgtactttttccaacagaggcggcatggtccatcctcatacatctgttgaggatcttgatgaactttctaccttactccaagttccactagtagctggaactataaaccgagggagtgatgtcattgctgctggtatgatcgtgaatgactgggctgctttctgcggcttggacactactgcaacagagctctctgtgattgaaaatattttcaaattgggggattcacatccaactgcgatagtcgatactatgaggaagtctttgatcgatacttacgtttgagtttcttcttcatattttaacagacggaatgcaatttctattttcgatggttaaaatagtaaaatcaaatatgatattttctattttttttaaatttggataagtggataatctttttttttttatgatttacgatttaagatgtaatttttatttttaggtaccagtaccactagcaaatagcaatgattgaattataattttgtgtaaaaaaaa

SEQ ID NO: 2276 - DNA, 994 bp, Eutrema halophilum
ctttaatgggggtaatatgcaggtcttcagtttgagaacaactgtgatgttggtgtcttttccaaactcactaatgcatattgcttagtcgctataggaggctccgagaatttttacagtgcttttgaggcggagttagcagatgttatcccaattgttaagacctctattggaggaacaaggattattgggcgtctctgtgctggaaacaagaatgggcttcttgtgcctcatacaactactgaccaagagcttcaacacttgaggaacagtctacctgatcaagttgttgtccagagaatcgaggaacgtctgtctgctcttggaaattgcattgcctgcaatgaccatgttgctcttgctcacactgatcttgacaaggaaactgaggaaattatagcagatgttcttggtgttgaagttttccgtcagacgattgcaggcaacattcttgtgggcagttactgtgccttatccaacagaggtggaatggtccatccccacacctcagtggaagacttggacgaactgtcaacacttcttcaagtccctctcgttgcaggaaccgtgaaccgtggttgtgaagttatagctgcgggtatgaccgttaatgactggacgtctttctgcggttcagacacaaccgcaacagagctctctgttatagacagcatcttcaagctaagagaagcccgacccagctctattgtcgatgagatgaggaagtctttgatcgatacctatgtttaaatattgcttgtttggatgaaacacacgacagtatccccaagcgtcaatgtcgaaaattttcattatctattgtggtctttgtaggctctgaatatctctttactgtttcaagaattagtttttttttattttctcgtgttttaagtattaacactttaacaggttaatgtttttttgaatctttttgagtgatccataaaagaatctcttgagaaattgaggtccacatttgcttcatattcta

SEQ ID NO: 2277 - DNA, 737 bp, Ambrosia trifida
agaattcatgcgaaattggggtgttctcaaagctgactaatgcttactgtttggtagtcaattggtggttctgaaaatttttacagtacatttgagtccgagctagctgatgttattcctgtggttaagacctccattggtggcacacgtataattggccgactttgcattggtacaaaaatggcctgctttacctcataccactaccgaccaagaacttcaacacttgaggaacagtctgccagatgcagttgtggttcagcgaattgatgagagactatctgcccttggaaattgcatagcatgcaatgaccatgttgcccttacccataccgatcttgacagagaaaccgaggaaatgatagctgatgttctcggtgttgaagtttttagacagacaattgctggaaatattcttgtcggcagctactgtgcattttcaaatagaggtggcatggtgcatcctcatacctctattgaagacctggatgagctatcaaccctgcttcaggttcctttagtagcaggaacagtgaaccgtggtagtgaggtaatagcggcgggcctaacggttaatgactggaccgcattttgcgggtcagataccaccgcaacagaattgtctgtgattgagagtgttttcaagctgagagaagcccaacccagtgccattgtggatgagaatagaaggaagtctttgatcggacacttacgtttgaattaagtttttaagtttg

SEQ ID NO: 2278 - DNA, 1071 bp, Trifolium pratense
tgaaaatgaagaatctgggtatcgttaagtagtgatcgttgcgtccctccattcattccatttccattcaccgcttcatcttccttccttcctgatattaagttgttgctttattggattcaacatggctactagactcaagtttgagaattcttgtgaagttggagtcttctcaaaactaaccaatgcttattgtttggttgcaattggtggttctgaaaatttctacagtgcatttgaagctgagttatcagatgttatccctgtcattagaacctccattggtggcactcgtattgttggtcgtctttgtattggaaacaagaacgggcttcttttgccccataccaccacagaccaagaacttcaacatttgaaaaacagtttacctgatcaagttcgtgttcagcgcattgaagaaaagttatctgctctgggtaattgtatagcatgtaatgaccatgtggccctcacacacactgatctcgacaaggaaactgaggaggtagttgctgatgttcttggagtagaagttttcaggcagacagttgccggtaatattcttgttggcagttactgcgctttctccaacaaaggtggtctggtccaccctcatacttcggtcgaagacttggatgaattatctacacttcttcaagttcctttggttgccgggacagtcaaccgtggtagcgaagtaatagctgcgggaatgacagtcaatgattggacagcgttttgtggtgcggacaccacagctacagaactctcggtgattgaaaatgttttcaagctaagggaagccaagcctagtgccattgtggatgagatgaggaaatctctctttgatagctaaaactgagtttctctaaaagtattctcttttcataccaagttgtactgcttgttgtgaagttcttttttactttgatgatagtttcttatctttccctgtaaacagttgctgttattagtttctcttttcaaagatgatcacataagttcaatcaagatttgtggttttcactaattgcattgtcgcatcttttaaatcaaaggtgaaatatgatt

SEQ ID NO: 2279 - DNA, 978 bp, Cucurbita pepo
ctgccgctgccgctcattttcggatccctaggggttgcaagggattttgagtttatcgtcgaggaaggtagttgttaattgaaggttatcttgtgctaccatggcgaccaggcttatgtttgagaactcatgtgaaattggggttttctccaagctcacaaatgcttattgcttggttgcaattggtggctctgagaacttctacagtgcctttgaatctgaattaggtggtgtcattccggtcgttaaaacatccatcgatggcacgcgcattattggtcgtctatgtgctggaaacaaaaatgggcttcttgtaccacacaccactactgatcaagaacttcagcacttgagaaacagcctacctgaccaagttgttgtccaacgtatacaagagagactgtctgctctggggaatacaatttcttgtaatgatcacgttgctctgacacatactgatctcgaccgggaaactgaagagctcattgctgatgttcttggagtagaggtctttaggcagacggtagcgggcaacgttctcgtgggaagctactgtagcttcacaaataggggtggcttggttcatccacatacgtccattgaagatttggatgagctatcaacccttcttcaggtccctttagttgctggaacagtgaatcgtggaagtgaagtgattgctgctggattgatagcaaatgactggactgcattttgtggttcagacacgactgccaccgagttatcggtgatcgagagcgttttcaaattgagggaggctcaaccaagctccattgttgatgaaatgaggaagtcgctaatagacagttacgtgtgaagtgtcatgtaatgctacacctgattcttgcaagcaagcaattgttattactgctgcctttttccttttgttatatttaacaactttgtgagtgtgtaattcgactctgcccttaatagtgttttggttgaaaaaaaaaa

SEQ ID NO: 2280 - DNA, 977 bp, Distylium racemosum
gactgcaacatcggcgggagttcctgcaaatattttgagggttttggatttggctgatattcaaagtatctgttctgcaccaaggagaagcggttttctaaggtttttgcatcatggcgacaagaactcagtttgaaaattcttgtgacgttggtgtcttttccaagcttacgaatgcatattgcctagtggccatcggtggatcagagaacttttacagcacatttgagtctgagctagcagatgtcattcctgtagtgaaaacatctgtagcaggcaccagaattattggacggctttgtgttgggaataaaaatggcctgttgctgccaaacaccacaacggaccaagagcttcagcacttgaggaatagtttgcctgatcaggttgtggtccaacgagttgaagaacgattgtctgcacttggcaattgtgtggtttgcaatgaccatgtagctctcattcatactgatctggacagggagacagaagagttgatagctgatgttctgggagtagaggttttcaggcaaactattgcaggcaatattcttgttgggagttattgtgcactttccaacaggggtggtctggtccatccacacacatccattgaagatctagatgagttatcaacactcctccaagtaccacttgtggcaggcactgtcaatcgtggaagtgaagttgtggctgcagggatgatcgtaaatgattggactgcattttgtggtctggacacaacagcaactgaattggcagtcattgaaagtgttttcaaattgagagagtcacagcctacagccattgttgatgagatgagaaagtccttgatagatacatttgtctaaggcaccgatgtcatgtcttttatgtggtcagctttctcagtatgtttcttgttataagtttgaagcaaggtaaaagtactttctgacatacttctgtacaagattgttttgggaaagttgtaacat

SEQ ID NO: 2281 - DNA, 895 bp, Flaveria ramosissima
agtctcacttcacaaacacccccgcaggaggcagtggcatatacatcgcaagctcccaaaacccttgcagacgcataaatctcgacacttacaaaccctaaacatccattgaaatccctcactatcgacctcatacatcaagataattgatatccttgagcaatttttttcatcagctgctttgtgatggcgacaagacttcagttcgagaattcatgtgaaattggtgtgttctcaaagctaacaaatgcttactgtttggtagcaattggcggctctgaaaatttctacagcacgtttgagtctgaactagcagatgttattcctatggttaagacctccattggtggcacaagaataattggacggctttgcattggtaacaaaaatgggctacttttgcctcatactactaccgaccaagagcttcaacacttgagaaacagtctacctgatgcagtcgtggttcaacgccttgatgaaagactatctgcccttggaaattgcattgcatgtaatgaccatgtcgcccttactcataccgatctcgatagggaaactgaggaaatgatagctgatgttcttggtgtagaagttttcaggcagacaattgctggaaatatacttgtgggcagctattgtgccttttcaaatagaggtggcatggtgcaccctcatacgtctattgaagagttggatgagctgtcgactctgcttcaggttccgttggtggcggggaccgtgaaccgtggtagtgaagtgattgctgcgggtctaactgttaacgactggactgcattttgtgggtcggatactacagcaactgaattgtctgtgattgaaagtgttttcaagctgagagaagcccagcccagtgccattgtggatgagatga

SEQ ID NO: 2282 - DNA, 1199 bp, Medicago truncatula
gtgcaccccacggaaaagagcagtacaaaaacaaaccctaatttcgtttcatctctcaaacacacggcaacctcttctcggtcgccgtcgcttccaccaccgtccctttctcatcgccgcttcagatcttctttttgtgtacctgggttaaagatttgtgacagtctcaacaatggcaactagacttcagtttgagaataattgtgatattggagtgttctctaaacttaccaatggctattgtatggttgccattggaggctctgaaagcttctacagtgtattcgaatctgagttaggtggtgttatccctgtggtgaagacatctattgctggcacccgcatcgttggtcgtctttgtgctggaaacaagaatggccttctcttgccccataccaccacagatcaagaacttcaacatttgagaaacagtctacccgatcaagttgttgttcagaggatagaagaaaaattatctgctttgggaaattgtatagcatgtaatgaccatgtggctctcactcacaccgatcttgacagggaaactgaggagataattgcagatgttctcggagtagaagttttcaggcagaccattgctggcaatattcttgttggtagtttttgtgctctctccaacagaggtggtttggtccaccctcacacatctatagaagatttggatgaactttctacacttcttcaagttcctttggtggccggaacagtgaacagaggtagtgaagtgatagctgctggaatgatagttaacgactggacatcattttgtggttcagacaccacagcaacagaactctctgttattgagagtgttttcaagttgagggactcgcaacctagtgtcatcgtcgatgagatgaggaaatcactcatcgatagctatgtctgaaattggtaatagtaataacttatgttgagttttggttatagtattgtgtgtctaatgcaatgatgaggtgagaaaatcactctttgatagcaatgtctgaaaatttgataatagtaatgacttttggtatgatgttttaaattttggttatagttttgtcttgtgcaatgtgaacatgtatgctctaaaaaagattggttgtacttttccatgtttatggtatcagttattgattgttggcacctataaatcctagccatgtttggtttaattcgaatcaatagaaaag

SEQ ID NO: 2283 - DNA, 1106 bp, Cucumis melo
gtctcagtcccgcctctcgctccactcattctcctctccacgccggccgccgcaaacgcaatttcacttctcctattctttgaggtttcaattgggatctttttgacacagcggttgtgaatttcttcttcatcttcattcttcaaccttttcatggcgaccaggcttatgtttgaaaactcatgtgaaattggagttttctccaagctcaccaattcgtactgtctggttgcaattggtggttctgaagatttctatagtacctttgaagctgaattaggtgctgtcattcccgtggttaaaacatctattcatggcactcgcattattggtcgtctatgtgctggaaataaaaatgggcttcttctaccacacaccactactgaccaagaactccagcacttgaggaacagcctacctgaccaagttgttgttcaacgtatacaagagagattgtctgctttggggaatacaattgcttgtaatgatcatgtcgctctcacacatactgatcttgatcgggaaactgaagatctcattgctgatgttcttggagttgaggtctttaggcaaacaatagcaggcaacgacctcgtgggaagctactgtagctttacaaacaggggtggcttggttcatccacatacatccattgaagatctagatgagttatcaactcttcttcaggtcccattagtcgctggaactgtgaatcgtggaagtgcggtgattgctgctgggttgacagcaaatgattggactgcattttgtggttcagacaccagcgccactgagttatcggtcatcgagagtgttttcaaattgagggaggctcaaccaagttccattgttgaagaaatgaggaagtcactaatagacagttacgtatgaggaggaggagtctcttctactacacctaagatcttgcaagcaattaattgttattactcttgtgtctgtatccttcagttttatttaacaacattgtgagtaaaaaagtcgactctgcacttatagtgttttggtcgaaattgtggttccatatttgctaatatagatctgtttttgtaatggttaaccaatattttatttgatatccccttccg

SEQ ID NO: 2284 - DNA, 1209 bp, Phalaenopsis aphrodite
ccgagtcttctcctcctctcaaaatcgcgaaaggctttcggccgcggtagcgcttagggtttgcagtttgtgctcgttttctaatctctacttcgatttgtcttggatactatctctttgtttcggcgagtcatcgttggctcgactgctccgttttcttgcttggttgctcgaaattcttgcccggttgcttgtttggatagtgaggtgttatatcggagtatcttttctctaatatttcatatttatcttcaggttttcagtatttcttgtttgctatcctccatcatggctactcgacttcagtttgaaaactgctgcgatattggtgtgttctcgaaacttacgaatgcctattgtctggttgctattggagggtcagagaacttctacagtgtgtttgaatctgagcttgctgatgttattcctgtggtgaaaacttctattgcaggcactagaataattggccgtatgtgtgctggaaataagaatgggcttcttgtacctcactcaaccactgatcaagagcttcaacatctgcgtaatagtctaccagatcaagtgatcgttcaacgaattgaagagaaattgtctgctttaggcaactgcatcgcctgcaatgatcatgttgctctcactcatcccgacctcgaccgggaaactgaagatctcattgctgatattctgggagtggaggtattcagacagactgtagctggtaacattcttgttggcagctattgtgcattttctaacaaaggtggcctggtgcatcctcatacgtccatcgaggaccttgacgagctttcgacgcttcttcaagtacctctcgtggcgggaacggtgaaccgaggcagcgaggtcattgccgccggcatggccgtcaatgactggactgcattctgcggcctggacaccacagcgaccgagctctcggtaatcgagagcgtgtttaaactgagagaagctcatccaaatatgattgtcgacgagatgaggaagtcgctgatcgacagctatgtctgaaattcgaccgttgaggtagatttgaatttgtacgtactgtttggaattttaagatttttattgatcattttcttttaatttatgttatgaaataatttgatgttctttgttagattacttctgtagcgaattggctagatgttgggttgtaacatgaatgaacgcttgcttctagatgatatg

SEQ ID NO: 2285 - DNA, 1233 bp, Phalaenopsis aphrodite
cttctcctcctctcaaaatcgcgaaaggctttcggccgcggtagcgcttagggtttgcagtttgtgctcgttttctaatctctacttcgatttgtcttggatactatctctttgtctcggcgagtcatcgttggctcgactgctccgttttcttgcttggttgctggaaattctttcctggttgcttgtttggctactgtggtgttatatcggagtatcttttctctaatatttcatatttatcttcaggttttcagtatttcttgtttgctatcctccatcatggctactcgacttcagtttgaaaactgctgcgatattggtgtgttctcgaaacttacgaatgcctattgtctggttgctattggagggtcagagaacttctacagtgtgtttgaatctgagcttgctgatgttattcctgtggtgaaaacttctattgcaggcactagaataattggccgtatgtgtgctggaaataagaatgggcttcttgtacctcactcaaccactgatcaagagcttcaacatctgcgtaatagtctaccagatcaagtgatcgttcaacgaattgaagagaaattgtctgctttaggcaactgcatcgcctgcaatgaccatgttgctctcactcatcccgacctcgaccgggaaactgaagatctcattgctgatattctgggagtggaggtattcagacagactgtagctggtaacattcttgttggcagctattgtgcattttctaacaaaggtggcctggtgcatcctcatacgtccattgaggaccttgacgagctttcgacgcttcttcaagtacctctcgtggcgggaacggtgaaccgaggcagcgaggtcattgccgccggcatggccgtcaatgactggactgcattctgcggcctggacaccacagcgaccgagctctcggtcatcgagagcgtgtttaaactaagagaagctcatccaaatatgattgtcgacgagatgaggaagtcgctgatcgacagctatgtctgaaattcgaccgttgaggtagatttgaatttgtacgtactgtttggaacttcttttaatttatgttatgaaataatttgatgttctttgttagattacttctgtagcgaattggctagatgttgtgttataacatgaatgaaggcttgcttctagatgatatgtatgcatgcatgattgatacttgttttacatctatatgcattttattgtcac

SEQ ID NO: 2286 - DNA, 1446 bp, Pinus taeda
atttatctcgtcaacaggcgcatgtatgttattgagctatcgagcttgcagcgaaacaggcatttaatgccctatggcaagttcattagcccttgccctaaaccacaacttttcaggccaaaccctctctgtcaattcaaacaatacccgagggtaaccacacggttgcttataccaaacgatcgactcgtcactggctattgctcgattatatgattagtcctctcttccctactaacatttcagtgtgatatacatctattggcttgggtacagaagactactttactctgaaatttcgatcccggatcaagtgcgattacatctattggcttgggtgccaaagactacacgactctgaaatttcgaaccccggatcgggccgaatttgccaggacttgacggagattaaatacttttgttctgcggcaggagtaaatcatctctttggctgtgcatcatggctaccagaactcagtttgaaaattccagtgagattggtgtcttttcaaaacttactaatggatattgcctggtggccattggaggatcagagaacttttacagcacatttgaggcagagctggcagatgttattcctgttgtgaagacatctataggaggcaccaggattgttggccgtctttgtgctgggaacaaaaatggtcttttgctgccaaacacaactaccgaccaagagcttcaacacttgaggaatagtttgcctgatggagttgtggtgcaacgtgttgaagaacgactatctgcgcttggcaattgtgtggtgtgcaatgatcatgttgctctcattcataccgacctggacagggagacagaagaattaatagcagacgttctgggagttgaggttttcaggcaaactattgcgggaaatattcttgttgggagttatagcgctttttccaataggggtggtctggtccatccacacacgtcaatagaagatctggatgaattatcaactcttcttcaagtgcctcttgtggcaggcactgtcaatcgtggaagtgaagtaataggcgctggaatgattgtaaatgattggacagctttttgtggtctggacacaactgcaactgaattgtctgttatcgaaagtgttttcaagttgagagaatcacaacctagcgctatcgttgatgagatgagaaagtcattgatagatacttttgtctgagtatcaatggcatgtcttatgtctcatcgcttgttagttaaacttactatcagtcctgtctaaaatttcaattgacaatcttgtcattttgcgaaattgctgtgaaagttcatgctttacaaagttgtgagacaacattgttacaattggaaaaactataaggtgcaaagacatgtaaataggatggttaaattggaaaaactatactttgattttgatttccgtaattaagctgatatattttgaaa

SEQ ID NO: 2287 - DNA, 910 bp, Cannabis sativa
gctaacaaaactgttgaacttgaaggtcttcaattcgagaactcgtgcgaagttggagtgttctctaagctcacaaatgcttactgtttggttgctattggaggctctgagaatttctacagcacttttgaatcggagtttgctggtgtgattcctgtggtgaagacctctatttccggcactcgaatcatcggtcgcctttgtgctggtaacaaaaatgggcttttggtacctcataataccactgaccaagagcttcaacacttaaggaacagtctacctgatcaagttgttgttcaacgcattgaagagaaattatctgctcttggaaattgtatagcatgtaatgaccatgtggctctcacacacactgatcttgacaaggaaaccgaagagatgatagcagatgttcttggagtagaagttttcaggcagacaattgccgggaacatactagtcggaagctactgcaccttctccaacagaggtggcttggttcacccccatacatctgttgaagacttggatgaactttcaactcttcttcaagtccctttagttgctgggacggttaaccgagggagtgaagtgattgcagctggcatgacggtgaatgactggacggccttctgtggctcggacacaactgcaactgaactctctgttatagagagtgtcttcaagttgagggagggacaacctggtgctattgtggatgaaatgagaaaatcattgatcgatacttatgtctgattatttatttttacttatatttttattattagtcgagtttgatagctaagaatgtttggaaaaatatcaacgctgttaatatatgacaatggtttttagtgtttgaagctcttctttatgctatgtttacaaattgtaaaagaaatttttataattt

SEQ ID NO: 2288 - DNA, 1312 bp, Beta vulgaris
atacaacaaagttaaaaacgccacaaggcggcatcgccaaaagtagctacatctatttaactacccatacgcactgcacagcttttgttagcagtccgtcgctcgcatttcacaaacctccgctgcccgccgctttgttcttccttcaggagtctttctctctttaatctttacaccctcgcttccaccgtctcgtttttgcctgcttttacctttctgcttcgtccattttcttgaatcgtctaatcatggcaactaggcttcaatttgagaataattgtgaagttggggttttctctaagttgaccaatgcgtattgtttggtcgcaattggtgggtcggagaatttctacagtacatttgagactgaattggcagattatatccctgttgtgaagacttctattgctggtacaaggattatagggccgaatgtgtgcaggaacaagaatgggcttcttgtgcctcacaccacaactgaccaggaactccaacacttgaggaactgtcttcctgattcagtagttgttcaacgtattgaagaaaagctatctgctttaggaaactgcatagcatgcaatgactatgttgctctgacccacactgatcttgataaggaaacagaggagcttattgcagatgttcttggcgttgaggtcttcgggcagacaattgctggaaacattcttgtgggaagctactgtgcgatcaccaacaaaggtggtttggtccatcctcacacctcaattgaagatttggatgagctttctaccctacttcaggtccccctggtggctggaacagttaaccgaggtagtgaagtaattgctgctggtttgacagtaaatgactggacggcgttttgtggttctgatacaacagctactgaactatcagtaattgagagtgtcttcaggttgagggaagcccaacctagtgctattgttgatgagatgaggaagtcattaatcgacagcactatatgagcgtctttgatttttctgttcctgttacctatcattgcaggaaatgtagttaataattaaaggagctccatattgtgtcctcaaagtcatcgacgttgaacttcagtataggaagaagtgttggtccaactgtttggaattatatctggaacttttggctttgtaatgaactattagaattattatgtttggaatgttggctatgttagaatgaacatttaaccagatatggtagaattctcaacaatgattgttatagcttactgtgatttttgatggatatgatttcattattagtgtttcagcaacagaaaatgaattattgg

SEQ ID NO: 2289 - DNA, 883 bp, Fagus grandifolia
aaaaaaacaagaagaaagagaaagagatacgagacgaaaaggtcttggagcgatatttactgattcttgaattcaaacttacttttgttttctttgccaatcatggccactagacttcaatttgagaactcgtgtgaagttggagtattttcaaagctaaccaataaatactgtttggttgccattggtggttccgagagcttttacagtgcgtttgagtctgagttagcgggtactatccctgtcgttaaaacctccatcgccggcactcgcattattggacgcctttgtgctggaaacaaaaatgggcttctattgcctcacaacaccaccgatcaagaacttcagcacttgagaaacagtctaccagatggagtggtggtacagcgcacagaagaaagactctctgctctgggaaattgtatagcatgcaatgattttgttgctcttacacacacagatcttgacagggagactgaggagatgattgcagatgttcttggagttgaagtttttaggcagacaattgctggtaatattcttgtgggcagctattgtgccttctcaaacagaggtggtctggttcatccccatacatccattgaagacatgactgaacttgcaacacttcttcaggttcctttgttggctgggactgtgaaccgcggtagtgaggtgatagctgctggcatgacagtaaatgactggacagcattttgtggttcggataccacagcaacagaactcgctgttattgaaagtgctttcaaattgagggaagcccagcctagcgccattgtggatgagatgaggaaatcattgattgacacctatgtctaagtcgtgcatctcatccttctgccaatgattgatgacaaatata

SEQ ID NO: 2290 - DNA, 1403 bp, Pinus pinaster
cgggtacttctaccaaacgatcgactcgtcactggctgttgctcgattatatgattagtcctctcttaccgattaacatttcagtgtgatatacatctattggcttgggtacggaagtctactttactctgaaatttcgatccccggatcaagtgcgattacgtctattggcttgggtgccgaaggctacactactctgaaatttcgaaccccggatcaggccgaatttgccaggacgaacatcactttaagcttgcagcaatacgcactgctatctacttacggctgtaagctcaaaggagtaaatcatctctttggctgtgcatcatggctaccagaactcagtttgaaaattccagtgagattggtgttttttcaaaacttactaatggatattgcctggtggccattggaggatcagagaacttttacagcacatttgaggcagagctggcagatgttattcctgttgtgaagacatctataggaggcaccaggattgttggccgtctttgtgctgggaacaaaaatggtcttttgctgccaaatacaactaccgaccaagagcttcaacacttgaggaatagtttgcctgatgaagttgtggtgcaacgtgttgaagaacgactatctgcgcttggcaattgtgtggtgtgcaatgatcatgttgctctcattcataccgacctggacagggagacagaagaattaatagcagacgttctgggagttgaagttttcaggcaaactattgcgggaaatattcttgttgggagttatagcgttttctccaataggggtggtctggtccatccacacacttcaatagaagatctggatgaattatcaactcttcttcaagtgcctcttgtggcaggcactgtcaatcgtggaagtgaagtaataggcgctggaatgattgtaaatgattggacagctttttgtggtctggacacaactgcaactgaattgtctgttatcgaaagtgttttcaagttgagagaatcacaacctagtgctatcgttgatgagatgagaaagtcattgatagatacttttgtctgagtatcaatggcatgtgttatgtctcatcgcttgttagttaaacttactatcaggcgtgtctaaaatttcaatggataatcttgtcattttgcgaaattgctgtgaaagttcatgctttacacagttgtgagacaacattgttacaactagcaattgccccaaaaggtgcacagacttaacaattgccccaaaaggtgcaaagacatgtaaataggatggttaaattgcaaaaactatactttgattttgatttctgtaattaagctgatatattttgagataattgtatttatatttatgtgctgtggtgaacacgggtagaatattagcgggctggt

SEQ ID NO: 2291 - DNA, 1237 bp, Quercus alba
gaaagtgaaaagcaagatagatattttaagctaatccgtccgatcgaaaaccctaaaacacaaaacagagaaaaaaagagagagcagccacgacacgataccgatacacaaaaacagaaaagtagtaggtcttggagttgaagagctacatattttgtgaataacaacaacaaaagttagtgtttttatttattatttttgggctttccctcaaacaatcaatcatggccaacagaattcaatttgagaactcatgtgatgtgggtgtattttcaaagctcaccaatgcttactgtttggttgccattggcggttctgaaagcttctacagcgcatttgaggctgagttagccgatgttatccctgttgttaagacctccattgctggcactcgcattatcggacgcctttgtgctggcaacaaaaatgggcttctattgcctcacaacaccaccgaccaggaacttcagcacttgagaaacagtcttccggatcaagtagttgttcaacgcatagatgaaagactttctgctctggggaattgtatagcatgcaatgatcatgttgctcttactcacactgatcttgataaggaaactgaggagatgatagcagatgttcttggagtcgaagtttttaggcagacaattgctggtaatattcttgtgggcagttattgtgccttctcaaacaaaggtgctctggttcatccccatacatccgttgaagacatgaacgaacttgcaacacttcttcaggttcctgtgtctgctgggactgtgaaccgtggtagtgaggtgataggtgctggcttgacagtgaatgattggacagcattttgtggttcagataccacagcaaccgaactcaatgttattgaaactgcattccaattgaagccagcccagcctagcgccattgtggatgagatgaggaaatcattgatcgacagctacgtctgagtcttgcatctcactcagccttcagccaaggattgattacaatatagttgtatgaagttgaaacacttttgtttattttgacttatttccttttgttagttatttatttgactctgccaatgttatgatgtttcaatcaagaagcattaatttgaagtctggcagttttgtttgtttttgacattggaattctggtagtggttataacgatatgtaattgagtacaaaaaaaaaaaaagttaattaatcgcgatctagaactagtgctgatacta

SEQ ID NO: 2292 - DNA, 1454 bp, Pinus taeda
cctcaaatgtgctgtaaaagttttctgatcctccaatggccaccaggcaatatccattagtaagttttgaaaaggcaccaactgctcttaataactctcatcgtcggaaaaccacgtgaacggttttccaagtgaagcttggtaaagcgaacggaatataaaagggaggctattaaaataggaggagactattgaaagggtttttgagactgaatcattttttttataacgcgagactatagcatcggttgattcctgctcggagaagcggaagccttcgccaatatacatctttttgaaaacaagccgatgccgttgtcgccatgaagctcgtcagttaggactttacggagattaaatactttgttgtgcaggagtaaatcatttctttgcctgtgcatcatggctaccagaactcagtttgaaaattccagtgaggttggcgtcttttcaaaacttactaatggatattgcctggtggccattggaggatcagaaaacttttacagcacatttgaggcagaactggcagatgctattcctgttgtgaagacatctattggaggcaccaggattgttgggcgtctttgtgctgggaacaaaaatggtcttttgctcccaaacacaactaccgaccaagaacttcagcacttgaggaatagtttgccggatgaagttgtggtgcaacgagttgaagaacgactatctgcgcttggcaattgtgtggtgtgcaatgatcatgttgctctcattcatactgacctggacagggagacagaagaattaatagcagacgttctgggagttgaggttttcaggcaaactattgctggaaatattcttgttgggagttatagtgttttttctaatagaggtggcctggtccatccacacacttcaatagaagatctggatgaattatcaactcttcttcaagtgcctcttgtggcaggcactgtcaatcgtggaagtgaagtaataggcgctggaatgattgtaaatgattggacagctttttgtggtctggacacaactgcaactgaattgtctgttatcgaaagtgttttcaagttgagagaatcacagcctagtgctattgtcgatgagatgagaaaatcattgatagatacttttgtctgagtatctaagtttcatttggttgtgtaccatttctatacttgagtgaatgttgaattcttattattatgttgaacgagttctggaactaaactccatggctaacatgtgggtagctgttatgtctgttaaaccttgagaatattgagttattatgttgaacaagttctgtaactacactccatggctaacatgtgtgtagcagttatgtcttttaaatttgtatttgtctaagagtgacttacgtttgttgtaaacgcttgggaatattgtaaatgtatgtcttgctgcagatacaccaaaaaaaaaaaaaaaaa

SEQ ID NO: 2293 - DNA, 1267 bp, Pinus taeda
attgaaagggtttttgagactagaatcaatttttttataacgcgggtttaactatagcatcggttgattcctgctcggagaagcggaagccttcgccaatatacatctttttgaaaacaagccgatgacgttgtcgccatgaagctcgtcagttaggactttacggagattaaatacttttgttgtgcaggagtaaatcatttctttgcctgtgcatcatggctaccagaactcagtttgaaaattccagtgaggttggcgtcttttcaaaacttactaatggatattgcctggtggccattggaggatcagaaaacttttacagcacatttgaggcagaactggcagatgctattcctgttgtgaagacatctattggaggcaccaggattgttgggcgtctttgtgctgggaacaaaaatggtcttttgctcccaaacacaactactgaccaagaacttcagcacttgaggaatagtttgccggatgaagttgtggtgcaacgagttgaagaacgactatctgcgcttggcaattgtgtggtgtgcaatgatcatgttgctctcattcatactgacctggacagggagacagaagaattaatagcagacgttctgggagttgaggttttcaggcaaactattgctggaaatattcttgttgggagttatagtgttttttctaatagaggtggcctggtccatccacacacttcaatagaagatctggatgaattatcaactcttcttcaagtgcctcttgtggcaggcactgtcaatcgtggaagtgaagtaataggcgctggaatgattgtaaatgattggacagctttttgtggtctggacacaactgcaactgaattgtctgttatcgaaagtgttttcaagttgagagaatcacagcctagtgctattgtcgatgagatgagaaaatcattgatagatacttttgtctgagtatctaagtttcatttggttgtgtaccatttctatgagtgaatgttgaattcttattattatgttgaacgagtcctgtaactaaactccatggctaacatgtgggtagctgttatgtctgttaaaccttgagaatattgagttattatgttgaacaagttctgtaactacactccatggctaacatgtgtgtagcagttatgtcttttaaatttgtatttgtctaagagtgacttacgtttgttgtaaacgcttgggaatattgtaaatgtatgtcttgctgcagatacaccaaaatctcgattcttcaa

SEQ ID NO: 2294 - DNA, 1361 bp, Picea glauca
ttacaatatgggctaggttgacccggcaccttgcccaattatataaataaaatatcaacatggatcatggtaatggggacgagatgatcatgtggactgttatttaatccctaccattagtgttgtctctcagattgacttcgcattgatattggtcttttgcctttgggctctgacagtccgttatagcctgaaattttacagcttgaaacagtccgaattctgccagacagtacttcacagagaaaaaaacatctgttcctcaggaagagcgagtcgtttctttggctgtgcatcatggctacaagaattcagtttgaaaattccagtgaggttggtgtcttttcaaaacttacaaatgcatattgcctggtggccattggaggatcagaaaacttttacagcacatttgaggctgagttggcagatgtcattcctgttgtaaagacatctataacaggcaccaggatcattgggcggctttgtgctggaaataaaaatggtcttttgctgccgaatatgactaccgaccaagaacttcaacacttgaggaatagtttaccggatgaagtcgtggtgcaacgagttgaagaacgactatctgcacttggcaattgtgtggtgtgcaatgatcatgttgctctgattcatactgatctggacagggagacggaagaattgatagccgatgtgctgggagttgaggttttcaggcaaactattgcaggaaatattcttgttgggagttattgcatgttttccaacagaggtggtctggtccacccacatacttcaattgaagatctagatgagttatcaactcttcttcaagtacctcttgtggcaggcactgtcaatcgtggaagtgaaataataggtgccggaatgattgtaaacgactggacagctttttgtggtttggacacaacagcaactgaattgtctgtaattgaaagtgttttcaaattgagagaatcacaacctagtgctattgtcgatgagatgagaaagtcattgatagatacctttgtctgaatatcaatggcttctctcatgtctcatctcttattagtttaaattattgctccatctagaattacaagagtatcttatgtctttttggcaacttgttgtgcatgttcacattttataaagttctaacataccatcggtacatccatttcaagtttttttatctgcaccattgctagagtcagagtaaatatgtagtaaaagagaattgcaacctagtgttgttgatgagatgagaaaatcattgatatgtacttttttgagtatcagtgtcatctctcatgtctcatctcttattattttaatctcactatcgcttctatctaaaa

SEQ ID NO: 2295 - DNA, 1094 bp, Picea glauca
tgccagacagacttcacagagaaaaacaatctgttcctcaggagagcgagtcgttctttggcagtgcatcaatggctacaagaattcagtttgaaaattccagtgaggttggtgtcttttcaaaacttacaaatgcatattgcctggtggccattggaggatcagaaaacttttacagcacatttgaggctgagttggcagatgtcattcctgttgtaaagacatctataacaggcaccaggatcattgggcggctttgtgctggaaataaaaatggtcttttgctgccgaatatgactaccgaccaagaacttcaacacttgaggaatagtttaccggatgaagtcgtggtgcaacgagttgaagaacgactatctgcacttggaaattgtgtggtgtgcaatgatcatgttgctctgattcatactgatctggacagggagacggaagaattgatagccgatgtgctgggagttgaggttttcaggcaaactattgcaggaaatattcttgttgggagttattgcatgttttccaacagaggtggtctggtccacccacatacttcaattgaagatctagatgagttatcaactcttcttcaagtacctcttgtggcaggcactgtcaatcgtggaagtgaaataataggtgccggaatgattgtaaacgactggacagctttttgcggtttggacacaacagcaactgaattgtctgtaattgaaagtgttttcaaattgagagaatcacaacctagtgctattgtcgatgagatgagaaagtcattgatagatacctttgtctgaatatcaatggcttctctcatgtctcatctcttattagtttaaattattgctccatctagaattacaagagtatcttatgtctttttggcaacttgctgtgcatgttcacatttataaagttgtaaacataccattggtacatccatttcaaggttttttatctgcaccattgctagagtcagagtaaatatgtagtaaaagagaattgcaacctagtgttgttgatgagatgagaaaatcattgatatgtacgtttttgagtatcagtgtcatctctcatgtctc

SEQ ID NO: 2296 - DNA, 756 bp, Raphanus sativus
  misc_feature (115)..(115): n is a, c, g, or t
  misc_feature (436)..(436): n is a, c, g, or t
  misc_feature (499)..(499): n is a, c, g, or t
  misc_feature (580)..(580): n is a, c, g, or t
  misc_feature (715)..(715): n is a, c, g, or t
  misc_feature (719)..(719): n is a, c, g, or t
gtgtaagttatcaaagttcgtagctttctcttcctcaatggccacccgtcttcagtttgagaacaactgtgaagttggtgtcttttcaaaactcaccaacgcctattgcttagtngctattggaggctctgagaacttctacagtgcttttgagtcggagttagctgatgttatccctatcgttaaaacctctattggtggaacacgaatcattggtcgtctttgtgctggaaacaagaatggccttcttgtgccccatacaactactgaccaagagcttcagcacttgaggaacagtctacctgattcagttgttgtccagagaatcgaggaacgtctgtctgctcttggaaattgcattgcctgcaatgaccatgttgctcttgctcacaccgatcttgacaaggaaactgaggaaataatagcagatgttctnggtgttgaagtcttccgtcagaccattgcaggcaacattcttgtgggcagttactgtgccttntccaacagaggtggaattgtccatcctcacacctcagtggaagacttggacgaactatcaacacttcttcaagtccctctngttgcaggaaccgtgaaccgtggtagtgaagtcataggcgctggtatgacggtgaatgactggactgctttctgcgggtcagacacaaccgcaacagagctctctgttatagacagcatcttcaagctaaggagnccancccagctccatgtcgacgagatgaggaagtctctgat

SEQ ID NO: 2297 - DNA, 1492 bp, Pinus pinaster
gcacaacctcactcaaattataacatttgggaaaaacaaaacatgtattcgtacaaagcacataaacgacaactttccatgccaaaccctctcagtcaattcaaacaatacccgagggtaaccacacgggtacttctaccaaacgatcgactcgtcactggctgttgctcgattatatgattagtcctctcttaccgattaacatttcagtgtgatatacatctattggcttgggtacggaagtctactttactctgaaatttcgatccccggatcaagtgcgattacgtctattggcttgggagccgaaggctacactactctgaaatttcgaaccccggatcaggccgaatttgccaggacgaacatcactttaagcttgcagcaatacgcactgctatctacttacggctgtaagctcaaagctataatactctgtggagtaaatcatctctttggctgtgcatcatggctaccagaactcagtttgaaaattccagtgagattggtgttttttcaaaacttactaatggatattgcctggtggccattggaggatcagagaacttttacagcacatttgaggcagagctggcagatgttattcctgttgtgaagacatctataggaggcaccaggattgttggccgtctttgtgctgggaacaaaaatggtcttttgctgccaaatacaactaccgaccaagagcttcaacacttgaggaatagtttgcctgatgaagttgtggtgcaacgtgttgaagaacgactatctgcgcttggcaattgtgtggtgtgcaatgatcatgttgctctcattcataccgacctggacagggagacagaagaattaatagcagacgttctgggagttgaagttttcaggcaaactattgcgggaaatattcttgttgggagttatagcgttttctccaatagggtggtctggtccatccacacacttcaatagaagatctggatgaattatcaactcttcttcaagtgcctcttgtggcaggcactgtcaatcgtggaagtgaagtaataggcgctggaatgattgtaaatgattggacagctttttgtggtctggacacaactgcaactgaattgtctgttatcgaaagtgttttcaagttgagagaatcacaacctagtgctatcgttgatgagatgagaaagtcattgatagatacttttgtctgagtatcaatggcatgtgttatgtctcatcgcttgttagttaaacttactatcaggcgtgtctaaaatttcaatggataatcttgtcattttgcgaaattgctgtgaaagttcatgctttacacagttgtgagacaacattgttacaactagcaattgccccaaaaggtgcacagacttaacaattgcccaaaaggtgcaaagacatgtaaataggatggttaaattgcaaaaactatactttgattttgatttctgtaattaagctgatatattttgagataattgta

SEQ ID NO: 2298 - DNA, 1373 bp, Abies balsamea
tttctggatgacgggatccgtctccggcagcagtggaacctccacgctggcggatcctctgcggatctggatctggatcggatccgtggatccctgtctccacccccgcggatctggtaacacagctttgcaccttttggggcaattgctagtcataatcgcctgttatttcatcacataagtagtcatctccttcccattcactttgcattgtgagctgggtttacgttattggcttgggtactgaagactatttaccctgaaatttcgtagcccggaatcggccgaattctgcctggattttacagagatttttttttgttctgcgtagtaagtcactttttggctgtgcatcatggctaccagaattcagtttgaaaataacagtgaggttggtgtcttttcaaaacttacaaatgcatattgcctggtagccattggaggatcagagaacttttacagcacatttgaggctgagctggctgaggtcatccctgttgtaaagacatctatagcaggcaccaggatcgttgggaggctttgtgctgggaacaagaaaggtcttttgctgccaaacacgactactgaccaagaacttcaacacttgaggaatagtttgccagatgaagttgtggtgcaacgagttgaagaacgactatcagcacttggcaattgcgtggtgtgcaatgatcatgttgctctgattcataccgacctggacagggagacagaagaattaatagcagatgtgctgggagttgaggtttttaggcaaactattgcgggaaatattcttgttgggagttattgtgtgttttccaacagaggtggtctggtccatccacacacttcaatagaagatctagatgagttatcaactcttcttcaagtacctcttgtggcgggcactgtcaatcgtggaagtgaagtagtaggtgctggaatgattgtaaatgactggacagctttttgcggtctggacacaactgcaactgaattgtccgttatcgaaagtgttttcaaattgcgagaatcacaacctagtgctattgttgatgagatgagaaagtcattgatagatacttttgtctgagtatcaatgccacgtctcatgttgtcgcttatgagtttgaacttactatcgatcctatctataatttcaagcagcaatcttttgtcaggatgtgaacttgcagattgtgaacttgctctgcaagagctttacaaagttgtaacatagcattggtacatttattctaagtttcggtttgctgtgcacccattgtcctatatttgtagtaaatattgagaagattgtaattcctgattacttatgttgaacgagttttctaactacagtccatggctaagat

SEQ ID NO: 2299 - DNA, 1182 bp, Cedrus atlantica
cgatacagaatcacaagcaaaatcacaagcaagctcttttgatcataaatccaaccaacccttagattacatgattctgggtcggtgtcaatcgtaattgtctttttcatcctaaattaccagtcctctcccgtccatttacttcgcattgtgatctgggtttacatctattcgtttggcttcagcagactactttaccctgaaatttcgtatcccggaacaggccgaattttgccaggattttacagagattagaaaatttttgttctgcagccagagtaggtcatttctttggccgtgcatcatggccaccagaactcagtttgaaaattccagtgagatcggtgtcttttcaaaacttacaaatgcatattgcctggtggccattggaggatcagagaacttttacagcacatttgaggctgaactggcagatgtcattcctgttgtaaaggcatctatagcgggcacccggatcgttgggaggctttgtgctgggaacaagaatggtcttttgctgccaaacacaactactgaccaagaacttcagcacttgagaaatagtttgcctgatgaagttgtggtgcaacgagttgaagaacgattatcagcgcttggcaattgtgtggtgtgcaatgatcacgttgctctgattcatactgaccttgacagggagacggaagaattaatagcagatgtgctgggagtggaggttttcaggcaaactattgcgggaaatattcttgttgggagttatagtgtgttttccaatagaggtggtctggtccatccacacacttcaatagaagatttagatgagttatcaactcttcttcaagtaccgcttgtggcgggcactgtcaatcgtggaagtgaagtaataggtgctggaatgatcgtaaatgattggacagctttttgtggtctggacacaactgcaactgaattgtcagttatcgaaagtgttttcaaattgcgagaatcacaacccagtgctattgttgatgagatgagaaagtcattgatagatacttttgtttgagtatcaatgtcatgtcttatgtcacattgcttatgaatttgaacttactatcgatcctatctaaaatttcaagcgataatcttttatcattttgttaaattgttgtgcaagttcatgctttacgaagtttgtaacatagc

SEQ ID NO: 2300 - DNA, 1202 bp, Cryptomeria japonica
  misc_feature (1192)..(1195): n is a, c, g, or t
gcatcgctaacttctctaccctacttattttctcaaataaaaaaaaaattcttagtttcagacttttctcatctcatacgtccaggcgcaccagtaaaatacagacccaaaaacaccacttttgggttctgtaatttgataaatttgtcgtcgttttgcctcttgtcattcagtaaatgtaaacctagcctcctattttaacgataagcagcatcgttgactatttcattccagggtttgtgtaaagttcgagggcgtttgctctgcagtaagtagaggggacttcttttggcattgcattatggcgacaagggctcaatttgaaaattcttctgaagttggtgtcttttcaaagcttacaaatgcatactgtctggtggccattggtggatcagagaacttttacagcacattcgaatctgagctagctgaggtcattcctgttgtgaagacatcaatagctggaaccagaataattggacgactctgtgttgggaataaaaatggtctgctattaccaaatacgacaactgaccaagagcttcagcacttgaggaatagcttgcctgatcaagttgtggtgcaaagagttgatgaaagattgtctgctcttggcaattgtgttgtctgcaatgatcatgtaggactaattcatactgacttggacagggagacagaagaactgatagcagatgttctaggaatcgaggtttttaggcaaactattgctggaaatattcttgttggcagttatggtgtgctttctaaccgaggggggctggtacatccacacacatccattgaagatctagatgagttatcaacactcctccaagtgccacttgtagctggcactgtcaatcgtggaagtgaagttgtggctgctggaatgattgtaaatgattggactgctttctgcggattggacacaacagcgactgaattgtcagttattgaaagtgttttcaaattgagagaatcacagccgagtgcaatagtcgatgagatgagaaaatcattgattgatagctttgtctaatctcttagagtgtgtaccatttgggtggtgtacaaaaagaatatggtggacatcaggataattttgctaagcagtttgaattaaagagcttttggcataaatctggaaaaaaacagtggatgtgtaataaccttctaagcagctgaattcatnnnngagaagt

SEQ ID NO: 2301 - DNA, 1183 bp, Cucumis sativus
gaaaatagaaaactaaaattacttggaaaacctagaacctctcccgctctctctcccactcccactccctgtactctcccgcctctcgctctagtcattctcctctcgacgacggccgccgcaaacgcaatttcacttctcctattgtttgaggtttcaattgggatctttttgacatagcggttgtgaatttcttcttcatcttccttcttcaaccttttcatggcgaccaggcttatgtttgaaaactcatgtgaaattggagttttctccaagctcactaattcgtactgtctggttgcaattggtggttctgaggatttctatagtacctttgaagctgaattaggtgctgtcattcccgtggttaaaacatctattcatggcactcgcattattggtcgtctatgtgctggaaataaaaatgggcttcttctaccacacaccactactgaccaagaactccagcacttgaggaacagcctacctgaccaagttgttgttcaacgtatacaagagagattgtctgctctggggaatacaattgcttgtaatgatcatgtcgctctcgcacatactgatcttgatcgggaaactgaagatctcattgctgatgttctgggagttgaggtctttaggcagacagtagcaggcaacgacctcgtgggaagctactgtagcttcacaaacaggggtggcttggttcatccacatacatctattgaagatctagatgagctatcaactcttcttcaggtcccattagttgctggaaccgtgaatcgtggaagtgcggtgattgctgctgggttgacagcaaatgactggactgcattttgtggttcagacaccagtgccaccgagttatcggtcattgagagtgttttcaaattgagggaggctcaaccaagttccattgttgaagaaatgaggaagtcactaatagacagttacgtatgaggaggagccgtttcttctactacacctaagatcttgcaagcaattaattgttattactcttctgtctgtatccttctgttttacttaacattttgagtataaaacttgactctgcacttacagtgttttggtcgaaattggggttctccatattttctaatatagatcttttctgtttttgtaatggttaaccgagattctatttgaaatccccttatgtttc

SEQ ID NO: 2302 - DNA, 1055 bp, Eschscholzia californica
gcgtattactcaaagctgacaaatgcatattgtttagttgctattgggggatcagagaacttctatagtacttttgagtctgagttagcggatgttatccctgtggttaaaacctctattggtggcactcggattattggtcgtctttgtgccggaaacaagaatggacttcttgtcccacatactactactgaccaagagcttcaacacttgaggaacagtttacctgatcaagttgttgttcaacgaatcgatgagagactatctgcattgggaaactgcatcgcttgtaatgatcatgttgctctcactcatactgatcttgacagggacactgaagagattatagccgatgtcctcggagtagaagtattcaggcagaccattgctggaaacattctcgtgggaagttactgtaccttctctaaccgaggtggattggtccatccccatacctccattgaagacttggatgaactttctacgcttcttcaagtccctctggtagctggaactgtcaacagaggtagtgaagtcattgctgctggtatgacagtcaacgattggacagcattttgtgggtccgatactactgctacagagctttctgtcattgaaagtgtcttcaagttgagggaagctcaacctagtgccattgttgatgagatgagaaaatccttgatcgatagctatgtctgagtaaaacacttatacaagcttccttcttaagaacaaacgttggaatggcgaaattatggtaatcttatttagttttagagaagaagaaatgaggaaatggaattgaggtcctgcccctgggaagaagaaagatcatcttcactgaactgtagtaatttagcatttttgtgtggaattttgacagctaagtttaactagatgttggattttcttaaggttgttcttttttaggtgtaagcatgtatatgcaccacccactcttggtgtatatgtttgcaagtaacgagaacttttagcatataatatgaatgtttttacagtatgatatatacttaatgacaactacctactaaaaa

SEQ ID NO: 2303 - DNA, 1041 bp, Euonymus alatus
gaatcagagccgagccgcgtgagtccttgcttctctgtcatctttggaatcgttctaatcgggccatcggagttcgtcgacgaaccagctcttattgctccttgtgacttaatttccttctatcatggcgacaagactgcagtttgagaattcatgtgaaattggggtattctccaagctgaccaatgcatactgtctggttgccataggaggatcagaaaacttctatagcacctttgaggcagagttagcagacgtcattcctgtagtcaagacctcaattggaggcactaggataattgggaggatatgcgctgggaataaaaatgggcttcttgttccacatacaactactgatcaagaacttcaacacctgaggaatagtctacctgatcaagttgaagtccggaaaatagaggagaaactatctgccctgggtaattgcatagcttgcaatgaccatgttgctcttacacataccgaactggacaaggaaactgaggagcttgttcaggatgtactcggtgtagaagttttcaggcatacaattgctggtaacattcttgtgggaagcttctgtaccttatccaacagaggtggcttggtccacccccatacttctattgaagatctggatgaactttctacacttcttcaggtcccgttggttgctggaactgttaaccgtggaagtgaagtgataggtgctggaatgacagtaaatgactggacagccttctgcggctcagacactaccgccaccgaattgtctgtcattgagggcgtcttcaagttgagggaagcacaacctagtaccattgttgacgaaatgaggaaatcattagtcgacacttatgtttgagttactatgtactgtgctagtgaaacttgtgtatagactgtagacacgcagtgtttctaattcagcaattctaccagcgtaaagtttgtacttttgttccattttcaagctgagtatttgaaaatgcatataattagtgtgttttgagtgatttgagtgctgtcgaattgatttattaa

SEQ ID NO: 2304 - DNA, 1061 bp, Cucumis melo
gggaactttagagtttatagccaagggaggttgttgttgattcttcaaggttatcgtgtgcaactcatggcgaccaggcttatgttcgagaactcatgtgaaattggggttttctccaagctcactaatgcttactgcttggttgcaattggtggctctgagaatttctacagtgcctttgaaactgaactacgtggtgtcattccggttgttaaagcatctatcggtggcactcgcattattggccgtctatgtgctggaaacaaaaatgggcttcttgtaccacacaccactactgatcaagaacttcagcacttgaggaacagtttgcctgaccaagttgttattcaacgtatacaagagagactgtctgctttgggaaacacgatttcttgtaatgaccacgttgctctcgcacataccgatcttgaccgggaaactgaagacctcatcgctgatgttcttggagtagaggtctttaggcagacagtagcgggcaacgttctcgttggaagctactctagttttacgaatagaggaggcttggttcatccacatacatccgttgaagatttggacgagctatcaacccttcttcaggtcccgttagtcgctggcaccgtgaatcgtggaagtgaagtgattgcggctggattaacagcaaatgactggactgcattttgtggttcggacaccactgccaccgagttatcggtcatcgagaatgttttcaaattgagggaggctcaaccaagctccattgtcgaagaaatgaggaagtcattaattgacagttatgtgtgaggagtttcttcttctacacttgagatttgcaagcaattaattgttattactgtcttttatcttcttctgttatatttaacgactttgagagtgtgaactttgactatccacatcggggttgtatactttggtatcattgtcttggtctcgtattattgttaccattacctaaggtcaatcggtaacgatatctgtaataataacaatacgtatgacatatttataattctcttactataatagtaatagtatttgta

SEQ ID NO: 2305 - DNA, 1035 bp, Momordica charantia
gccgcccccttcttctccctccctccctctgattttctctgccgccgctgccgccgtcgccttcgtggcaagccatttccatacagtgatctgagggcaaggaagttgttgattgatcattgatcattgatcaaagttaccttcaactcatggcaacgaggctgatgtttgagaactcatgtgaagttggggttttctccaaactcactaatgcttactgtttggttgcaattggtggctctgagaacttctacagtgccttcgaatctgaattgggtggtgtcattccggttgttaaagcatccattgatggcactcgcattattggccgcttatgtgctggaaacaaaaatgggcttcttgtaccccacaccactactgatcaagaacttcagcacttgaggaacagtctacccgaccaagttgttgttcaacgcatacaagagagactatctgctttagggaataccattgcttgtaatgatcatgttgctctcgcacatactgatcttgaccgggaaactgaagaactcattgctgatgttctcggagtagaggtctttaggcagacggtggcgggtaacgttcttgtgggaagctactgcagcttcacaaataggggtggcttggttcatccccatacgtctattgaagatttggacgaattatcaacccttcttcaggtccctttagtagccggaactgtcaatcgtggaagtgaagtgattgctgctggcttaacagcaaatgactggattgcattttgtggttcagacactactgcaaccgagttatcggtgatcgagagcgttttcaaattgagggaggctcaaccgagttcgattgttgacgagatgaggaagtcactaattgacagttacgtttgaagttatatattttctgttacagctgtgaactgctttgttgttacttttgcctttttcctttcatcatatttaacaactttgtatgaatgaaattggggtttgtacttgaagcttatttggttgaaaatatatttaacaattaagcttg

SEQ ID NO: 2306 - DNA, 1071 bp, Petunia hybrida
actaacctgttgcagccgccgcaagggagagttcccctgcaaaaagttttgctctttaacttatatccaagctcctaagttctgctttttcagctatcaatggctactaggcttcagtttgaaaattcatgtgaagttggagttttttcaaagctgaccaatgcatactgcttggtcgctattgggggttctgaaaacttctacagcgtgtttgaggatgcgttaccggaaaattttccagtgatcaaaacctccattggaggcacgaggataattggaagactctgtgctggaaacaaaaatggccttctcttgcctcacactactacggatcaagaacttcagcacctgaggaatagtctgccagatggagttgtggttcagcgcattgaagagaggttatctgcccttggaaactgcatagcatgcaatgatcatgttgctcttacacatacagatcttgacaaggaaactgaagagatgattgccgatgttcttggtgtggaagttttcagacaaacaatagcagggaatattcttgttggaagctattgtactttctcaaacttgggaggcttggtacatccgcatacatccattgaggatttggatgagctttcaactctccttcagattcctctggcagcaggaaccgtgaaccgcggtagtgaagtggtagctgctggattgactgtcaatgactgggcagcgttttgtggctcagacactactgcaacagagttgtctgttattgaaaacatattcaagttgagagaggctcaacctggtgctattgttgatgagatgagaaaatcgttgatcgacacttatgtttgagttatcgggttttgcatgtactacagagttttctgtgagagattgagctgctatttttagttttatgtttttaagtttaaaaggttttactttattatgcacagattgatggttaatcttaatcgtgtttcgtatttttcaattgtataatgtagtaaatttatctattttctgtcattaatgagttccatatgaaatggttctgaacttggataaaggaccaatattgctgta

SEQ ID NO: 2307 - DNA, 1324 bp, Picea glauca
gggccattcaaacaataccagaggggatcacaaggagcttttaccaaacgaccccatagattacatgaccctgggccgacgttaatcataactgcctgttacttcgtcctataatttgtactctcgctcctattaacttcgcagtgtgatctgggtttacatctattggcttcggtacagcagattactctaccctgaaattttggagcccggatcaggccgaattttgccaggagtaagtcatttctttggctgttcatcatggctaccagaattcagtttgaaaattccagtgaggtcggtgtcttttcaaaacttacaaatgcatattgcctggtggccattggaggatcagagaacttttacagcacttttgaggctgagctggcagatgtcattcctgtcgtgaagacatctatagcaggcaccaggattgttgggcgtctttgtgctgggaacaagaatggtcttttgcttccaaacacgactactgaccaagaacttcagcacttgaggaatagtttgccggatgaagttgtggtgcaacgagttgaagaacgactatctgcgcttggcaattgtgtggtgtgcaatgaccatgttgctctcattcataccgacctggacagggagacagaagaattaatagcagatgtgctgggagttgaggttttcaggcaaactattgcgggaaatattcttgttgggagttattgtgtcttatcgaataggggtggtctggtccatccacacacttcaatagaagatctagatgaattatcaactcttcttcaagtacctctcgtggcaggcactgtcaatcgtggaagtgaagtaataggtgctggaatgattgtaaatgattggacagctttttgcggcctggacacaactgcaactgaactgtctgttgttgaaagtgttttcaaattgagagaatcacaacctagtgctattgttgatgagatgagaaagtcattgatagatacatttgtctgagtatcaatgccatgccgtatgtctcatcgtttattagtttaaacttactatcggtcctatctaaaatctcaagtgatatcttttgtcattttgttaacttgctctgcaagttcatgctttacagagttgtaacatacatagcattggtacatttattccaagtttcattttgctgtgcaccattgctatatttgagtaaatattgagaatattgaattctgattattatgttgaacgagttctatcactacactcaatggctagcatgtgggtagcagttatgactgttaaatttgtgtatttatctaaaagtgactatatttgt

SEQ ID NO: 2308 - DNA, 1257 bp, Picea glauca
gacttcacattgtgatattggtcttttggttttgggttctgacagtccgttatagcctgaaattttacagcttgaaacagtccgaattctgcgagacagtactgcacagaaaaaaaacatctgtccctcaggaagagcgagtcgtttctttggctgtgcatcatggctacaagaactcagtttgaaaattccagtgaggttggtgtcttttcaaaacttacaaatgcatattgcctggtggccattggaggatcagaaaacttttacagcacatttgaggctgagttggcagatgtcattcctgttgtaaagacatctatagcaggcaccaggatcattgggcggctttgtgctggaaataaaaatggtcttttgctgccgaatactactaccgaccaagaacttcaacacttgaggaatagtttaccggatgaagtcgtggtgcaacgagttgaagaacgactatctgcacttggcaattgtgtggtgtgcaatgatcatgttgctctgattcatactgatctggacagggagacggaagaattgatagccaatgtgctgggagttgaggttttcaggcaaactattgcaggaaatattcttgttgggagttattgcatgttttccaacagaggtggtctggtccacccacatacttcaattgaagatctagatgagttatcaactcttcttcaagtacctcttgtggcaggcactgtcaatcgtggaagtgaagtaataggtgccggaatgattgtaaacgactggacagctttttgtggtttggacacaacagcaactgaattgtctgtaattgaaagtgttttcaaattgagagaatcacaacctagtgctattgtcgatgagatgaaaaagtcattgatagatacctttgtctgaatatcaatggcttctctcatgtctcatctcttactagtttaaattattgctccatctagaattacaagagtatcttatgtctttttggcaacttgctgtgcatgttcacattttataaagttgtaacataccatcggtacatccatttcaagtttttttatctgcaccattgctagagtcgaagtaaatatgtagtaaaagagaattgcaacctagtgttgttgatgagatgagaaaatcattgatatgtacttttttgagtatcagtgtcatctctcatgtctcatctcttattattttaatctcactatcgcttctatctaaaatttcaagcgatatctatctttttggaaaaaa

SEQ ID NO: 2309 - DNA, 1423 bp, Picea glauca
agagacatcgccactgcagtggcacttgtttatctcatgaccatttcgtaatatatatctgcataaatcttgatttgttatctccaacatttccccttggctagtttcaaaccatagattacatgaccctgggtcgacgttaatcataactgcctgttacttcatcttcatcctataatttgtactctcgctcctattaacttcgcagtgtgatctgggtttatatctattggcttcggtacagcagattactctaccctgaaattttggagcccggatcagaccgaattttgccaggagtaagtcatttctttggctgttcatcatggctaccagaattcagtttgaaaattccagcgatgttggtgtcttttcaaaacttacaaatgcatattgcctggtggccattggaggatcagagaacttttacagcacttttgaggctgagctggcagatgtcattcctgtcgtgaagacatctattgcaggcaccaggattgttgggcgtctttgtgctgggaacaagaatggtcttttgcttccaaacacgactactgaccaagaacttcagcacttgaggaatagtttgccggatgaagttgtggtgcaacgaattgaagaacgactatctgcgcttggcaattgtgtggtgtgcaatgaccatgttgctctcattcataccgacctggacagggagacagaagaattaatagcagatgtgctgggagttgaggttttcaggcaaactattgcgggaaatattcttgttgggagttattgtgtcttatcgaataggggtggtctggtccatccacacacttcaatagaagatctagatgaattatcaactcttcttcaagtacctctcgtggcaggcactgtcaatcgtggaagtgaagtaataggtgctggaatgattgtaaatgattggacagctttttgcggcctggacacaactgcaactgaactgtctgttgtcgaaagtgttttcaaattgagagaatcacaacctagtgctattgttgatgagatgagaaagtcattgatagatacatttgtctgagtatcaatgccatgccatatgtctcatcgtttattagtttaaacttactatcggtcctatctaaaatctcaagtgatatcttttgtcattttgttaacttgctctgcaagttcatgctttacagagttgtaacatacatagcattggtacatttattccaagtttcattttgctgtgcaccattgctatatttgagtaaatattgaattctgattattatgttgaacgagttctatcactgcactcaatggctagcatgtgggtagcagttatgactgttaaatttgtgtatttatctaaaagtgactatatttgttggaaacgctggagttgtcattcgatgtataagtaaaaaaaagg

SEQ ID NO: 2310 - DNA, 1415 bp, Picea glauca
tttcactgaaagaaccccaaactcgccactaaaaccacgccctagcacatcgaaccctaacgggccattcaaacaataccagaggggatcacaaggagcttttaccaaacgaccccatagattacatgaccctgggccgacgttaatcataactgcctgttacttcgtcctataatttgtactctcgctcctattaacttcgcagtgtgatctgggtttacatctattggcttcggtacagcagattactctaccctgaaattttggagcccggatcaggccgaattttgccaggagtaagtcatttctttggctattcatcatggctaccagaattcagtttgaaaattccagcgaggtcggtgtcttttcaaaacttacaaatgcatattgcctggtggccattggaggatcagagaacttttacagcacttttgaggctgagctggcagatgtcattcctgtcgtgaagacatctatagcaggcaccaggattgttgggcgtctttgtgctgggaacaagaatggtcttttgcttccaaacacgactactgaccaagaacttcagcacttgaggaatagtttgccggatgaagttgtggtgcaacgagttgaagaacgactatctgcgcttggcaattgtgtggtgtgcaatgaccatgttgctctcattcataccgacctggacagggagacagaagaattaatagcagatgtgctgggagttgaggttttcaggcaaactattgcgggaaatattcttgttgggagttattgtgtcttatcgaataggggtggtctggtccatccacacacttcaatagaagatctagatgaattatcaactcttcttcaagtacctctcgtggcaggcactgtcaatcgtggaagtgaagtaataggtgctggaatgattgtaaatgattggacagctttttgcggcctggacacaactgcaactgaactgtctgttgttgaaagtgttttcaaattgagagaatcacaacctagtgctattgttgatgagatgagaaagtcattgatagatacatttgtctgagtatcaatgccatgccatatgtctcatcgtttattagtttaaatttactatcggtcctatctaaaatctcaagtgatatcttttgtcattttgttaacttgctctgcaagttcatgctttacagagttgtgacatacgtagcattggtacatttattccaagtttcattttgctgtgcaccattgctatatttgagtaaatattgagaatattgaattctgattattatgttgaacgagttctatcactacactcaatggctagcatgtgggtagcagttatgactgttaaatttgtgtatttatctaaaagtgactaaatttgtgtatttatctaaaagcgactctatatttgt

SEQ ID NO: 2311 - DNA, 1246 bp, Zamia vazquezii
  misc_feature (559)..(559): n is a, c, g, or t
  misc_feature (733)..(733): n is a, c, g, or t
ccctgcgctcgtgaggttctggttcggcaacctacccctctccgcattgagaaactgccacattttctgtgttggataacgcagattgtgttcatagtcaacgctgtgtttatgttgaaggccattttgcgctagacggttaaggtctgcagtgccgaagcgctcgagaggaggtttttggaaaaaagaaccccgatccgttggctgttctaattttcaagatattttgggtgactcaaaaccttcactattcagccagtgagaggggtattctggcttttgcatcatggctacaaaaactcagtttgaaaattccagtgatgtgggggtcttctcaaaactcactaatgcatactgcctggtggccattgggggttcggagaacttttacagcacatttgaggcagagctggcagatgtcatcccagtggtgaaaacatccattgcaggaactagagttattggacggatctgtgcagggaacaaaaatggtcttctgctgccacacaccacaactgaccaagagcttcaacacttgaggaatagcttacctgatcangtggtggtgcaacgggttgatgaacgattatctgcacttggcaattgtgtgggatgcaatgatcatgttgctcttattcatactgaccttgacaaggagacagaagaactgatagcagatgttctcggagttgaggtctttaggcaaactattgctggaaatattcttgttggnagctactgtgttttctccaacaggggtggtctggttcatcctcatacatccattgaagacctggatgagttatcaactcttctccaagtacctctcgtcgctggcagtgtcaaccgagggagtgaagttgtgggtgccggactggttgcaaatgattggacagctttctgtggtttggacacaacagcaactgaattgtcagttattgaaagtgttttcaaattgagagaatcacaacctagtgctattgttgatgagatgagaaagtcactaatagatagttatgtataaatattcatgccatctctttcattttggtggacatcaacctccatggcattgtttcctgttctaagcttcatgcaagattctgggactatttgacacctgtgcaaggtcctgtttgatgaaattgtaccttagctttagtactctctttctatgctttccaattgaacaccgttgctatgtgtgagagaatatatgaaaatttgaacatcaaattactcagaa

SEQ ID NO: 2312 - DNA, 1023 bp, Prunus persica
  misc_feature (807)..(807): n is a, c, g, or t
  misc_feature (824)..(824): n is a, c, g, or t
  misc_feature (836)..(836): n is a, c, g, or t
  misc_feature (843)..(843): n is a, c, g, or t
  misc_feature (845)..(845): n is a, c, g, or t
  misc_feature (848)..(848): n is a, c, g, or t
  misc_feature (853)..(853): n is a, c, g, or t
  misc_feature (867)..(867): n is a, c, g, or t
tgccctacttatacacataaaatcccctaattttcctcctccctacctccaaaaccctagctcataacaaactcatacctcaggcgttccttgaatccatggctaccagattgcaattcgagaactcgtgcgaggttggggtgttctcgaagctgacgaatgcctactgtttggtttccatcggaggctctgagaatttctacagcacattcgaggccgagttggcagatgtcatccctgtcgttaaaacctccattggcggcactcgcatcattggccgcctctgtgctggaaacaaaaacgggcttcttttgcctcacacgaccacagaccaagaactccagcacttgaggaacagtttacctgatcatgttgttgttcagcgcattgaagagagactatctgctcttggaaactgtattgcttgcaatgatcatgttgctcttacacacacggatcttgacagagaaactgaggagatgatcgcagatgtacttggcgtggaagtttttaggcaaacgattgctggtaatatccttgtgggcagttactgtgccttcaccaacagaggtggcatggttcatccccacacatctgttgaagacttggacgagctttcaactcttctacaggttcctctggttgctggaacagtcaatcgtggcagtgaagtgatagctgcaggcatgacagtgaatgactggacagcattctgtgggtccgacaccactgccacagaactctcagttattgaaagtgttttcaagttgagggaagctcaacctaggccattgtggatgaaatgangaaatcattgattgacngctatgtctgancaaaatntntgngctanttccatgaataggngctgttttcttccttgttaattgttttaaaacaaaatatctttttaaattcttaatcataagaattctggtgttgccaagttgtataattatggtgccaagctgtacaatatgttataacaaacgtgttttgccttttttcttcccaaaaaaaaaa

SEQ ID NO: 2313 - DNA, 1254 bp, Quercus alba
atcttctatattattattagaaagaaaataaaacaaaaacatttgctaaggtctgaaagtgaaaagcaagatagatattttaagctaatccgtctgatcgaaaaccctaaaacacaaaacagagaaaaagagagagcagccacgacacgataccgatacacaaaaacagaaaagtgtagtaggtcttggagttgaagagctacatattttgtgaataacaacaacaaaagttagtgtttttatttattatttttgggctttccctcaaacaatcaatcatggccaacagaattcaatttgagaactcatgtgatgtgggtgtattttcaaagctcaccaatgcttactgtttggttgccattggcggttctgaaagcttctacagcgcatttgaggctgagttagccgatgttatccctgttgttaagacctccattgctggcactcgcattatcggacgcctttgtgctggcaacaaaaatgggcttctattgcctcacaacaccaccgaccaggaacttcagcacttgagaaacagtcttccggatcaagtagttgttcaacgcatagatgaaagactttctgctctggggaattgtatagcatgcaatgatcatgttgctcttactcacactgatcttgataaggaaactgaggagatgatagcagatgttcttggagtcgaagtttttaggcagacaattgctggtaatatccttgtgggcagttattgtgccttctcaaacaaaggttcatccccatacatccgttgaagacatgaatgaacttgcaacacttcttcaggttcctgtgtctgctgggactgtgaaccgtggtagtgaggtgataggtgctggcttgacagtgaatgattggacagcattttgtggttcagataccacagcaacagaactcaatgttattgaaactgcattccaattgaagccagcccagcctagtgccattgtggatgagatgaggaaatcattgatcgacagctatgtctgagtcttgcatctcactcagcctccagccaaaggattgattacaatatagttgtatgaagttgaaacacttttgtttattttgacttatttccttttgtcagttatttatttttgactctgccaatgttatgatgtttcaatcaagaagcattaatttggaagtctagcagttttgttgtttttgacattggaattctggtagtggttataacgatatgaattgagtccattaagtgtctgtttgaga

SEQ ID NO: 2314 - DNA, 1375 bp, Pinus pinaster
acttctaccaaacgatcgactcgtcactggctgttgctcgattatatgattagtcctctcttaccgattaacatttcagtgtgatatacatctattggcttgggtacggaagtctactttactctgaaatttcgatccccggatcaagtgcgattacgtctattggcttgggagccgaaggctacactactctgaaatttcgaaccccggatcaggccgaatttgccaggacgaacatcactttaagcttgcagcaatacgcactgctatctacttacggctgtaagctcaaagctataatactctgtgaactttacggagattaaatacttttgttctgcggcaggagtaaatcatctctttggctgtgcatcatggctaccagaactcagtttgaaaattccagtgagattggtgtttttcaaaacttactaatggatattgcctggtggccattggaggatcagagaacttttacagcacatttgaggcagagctggcagatgttattcctgttgtgaagacatctataggaggcaccaggattgttggccgtctttgtgctgggaacaaaatggtcttttgctgccaaatacaactaccgaccaagagcttcaacacttgaggaatagtttgcctgatgaagttgtggtgcaacgtgttgaagaacgactatctgcgcttggcaattgtgtggtgtgcaatgatcatgttgctctcattcataccgacctggacagggagacagaagaattaatagcagacgttctgggagttgaagttttcaggcaaactattgcgggaaatattcttgttgggagttatagcgttttctccaataggggtggtctggtccatccacacacttcaatagaagatctggatgaattatcaactcttcttcaagtgcctcttgtggcaggcactgtcaatcgtggaagtgaagtaataggcgctggaatgattgtaaatgattggacagctttttgtggtctggacacaactgcaactgaattgtctgttatcgaaagtgttttcaagttgagagaatcacaacctagtgctatcgttgatgagatgagaaagtcattgatagatacttttgtctgagtatcaatggcatgtgttatgtctcatcgcttgttagttaaacttactatcaggcgtgtctaaatttcaatggataatcttgtcattttgcgaaattgctgtgaaagttcatgctttacacagttgtgagacaacattgttacaactagcaattgcccaaaaggtgcacagacttaacaattgcccaaaaggtgcaaagacatgtaaaataggatggttaaaattgacaaaaaactatactttgattttgatttctgtaattaag

SEQ ID NO: 2315 - DNA, 1140 bp, Cephalotaxus harringtonia
gcgatcgaagtgattgaagcgctgaagttgccgctcctgctcaaatcttcccgctgctacaacgtccacacgccggcagataaattctgttaaagcttccactcctacacaaccgacggctgcaaaagcgatctcctcgctttctccctgcaactcctgctttctttgtacagccaaccaaattatcttcttcagggtttgtgcataaggttgaaggcacttattctgcacaaagaagaagggtcatggcgacaagaactcaatttgaaaattcttcagaagtcggtgtcttttcaaagcttacaaatgcatattgcctggtggccattggcggatcggagaatttttacagcacatttgagtctgagctagcaggtatcattcccgttgtaaagacatcaatagctggaaccagaattattggacgactttgtgctgggaataaaaatggtcttctattgccaaataccacaactgatcaagagcttcagcacttgaggaatagtctgccggatcaagttgtggtgcaaagggttgatgaaagtttgtctgcacttggcaattgtgtggtctgtaatgatcatgtatctctaattcatactgacttggacagggagacagaagagctgatagcagatgttctaggcgtcgaggtttttaggcagactatagctggaaatactcttgttggtagttatggtgtgttttctaacagaggtggactggttcatccacacacatccattgaagatctagatgagttatcgacactcctccaggtacctcttgtggcaggcactgtcaatcgtggaagtgaagttgtggctgctgggatgattgtaaatgattggaccgctttctgcggactggacacaacagcaaccgaattgtcagtcattgaaagtgtgttcaaattgagagaatcacagcctagtgctatagttgatgagatgagaaagtcattgatagatagctttgtctaaataatgtcatctcgtattgtgtctgcagctttctcagtattgtttcctattgtgactttctagcaaggttttgacttttttgtattgtgctgtacaagattgtgctcgagaaagttgtaacaaagaagtagaactaatttccccactatatgatttt

SEQ ID NO: 2316 - DNA, 982 bp, Castanea mollissima
aaaaaaaaaccctaaaacacaaaacaaaacagagaaaagagagagagtgagagagcagccacgacacgatacgaggaggtggtcttggagtagaaaagctacatattttgtgaataacaacaacaacaaaagttagtgtttttttttatttttgggctttccctcaaacaaacaatcaatcatggccaacagaattcaatttgagaactcatgtgatgtgggtgtattttcaaagctcaccaatgcttactgtttggttgccattggcggttctgaaagcttctacagtgcatttgaggctgagttagccgatgttatccctgttgttaagacctccattgctggcactcgcattatcggacgcctttgtgctggcaacaaaaatgggcttctattgcctcacaacaccaccgaccaagaacttcagcacttgagaaacagtcttccggatcaagtagttgttcaacgcatagatgaaagactttctgctctggggaattgcatagcatgcaatgatcatgttgctctcactcacactgatcttgatagggaaactgaggagatgatagcagatgttcttggagtcgaagtttttaggcagacaattgctggtaatattcttgtgggcagttattgtgccttctcaaacaaaggtgctctggttcatccccatacatctgttgaagacatgaatgaacttgcaacacttcttcaggttcctgtgtctgctgggagtgtgaaccgtggtagtgaggtgataggtgctggcttgacagtgaatgattggacagcattttgtggttcagataccacagcaacagaactcaatgttattgaaactgctttccaattgaagccagcccagcctagcgccattgtggatgagatgaggaaatcattgatcgacagctatgtctgagtcttgcatctcactcagccttcagccaaggattgattacaatatagttgtacgaagttgaaa

SEQ ID NO: 2317 - DNA, 1390 bp, Cycas rumphii
tggatccaaagcaagcttggaatgtaaccgtactgccctataaatttcttttcggttacaccctgcaaattgcgtttaggccagctcggctctaagcttattttcacgccgattggcgggtagatcgttagttccgctgtatccaaaggggctcagaaggaggctcttgaacgaagtcgactccatatcttttattggtaactgtagttctaaagatcttcgtgggggttgaaaacctttactattcagcaagcgaaaggggtttttccgcctctgcatcatggctacaagaactcagtttgagaatagcagtgaggtgggcgtattttccaaacttacaaatgcatattgcctggtggccattggaggatctgagaacttttacagcacatttgaggcagagctggcagacgtcattccagttgtgaagacatctattgcagggaccagagtaattggacgtatctgtgctgggaacaaaaatggtcttctgttgccaaacaccacaactgaccaagagcttcaacatttgaggaatagtttacccgatcaagtggtggtgcaacgagttgaagaacgattatctgcacttggcaattgtgtggtgtgcaatgatcatgttgctcttattcatactgaccttgatagggagacagaagagatgatagcagatgttctgggagttgaggtctttaggcaaaccattgctggaaatattcttgttggtagctactgtatttttaccaacaggggtggtttggttcatcctcacacatccattgaagatctggatgagttatcgactcttctccaagtacctcttgtggcaggcactgtcaaccgtggaagcgaagttgtgggtgctggaatggtggtaaatgattggacagctttctgtggtctggacacaacagcaactgaattgtcagttattgaaagtgttttcaaattgagagaatcacaacccagtgctattgttgatgagatgagaaagtcactgatagatacttttgtctaattttcgtgccatctcttttattttgttgggaattagcctccatgctatttcttcctgttctaaggttcaagcaaggtttcataactatttgatacttactgtgcaatttcgttgggaatcagcctccatcgtatttcttcctgttctaaggttcaagcaaggttttatgactcttgatacttgctgtgtgcaatgccttgtttgccacatttgtaacttagcactggtactttcctccccagtttcccaattaagcaccattgctatatgttgagcaagtatgaaagtttgaacatcaaattcttggtaacgttgctgtaattattctatcaacgatcagtatgcagctgggatttattggatagtttaaag

SEQ ID NO: 2318 - DNA, 1236 bp, Pseudotsuga menziesii
aaagagaacctgattttgctttcgtcaaacgctgccggattcctccatcggatcagatatcgctacggaagccctaatcacaatcgcatctgcacaagagctagcggactaattcttcgggcagaaatccactcgactggacgtgagctcgcgcggctatctactcaggacaggactttagggagatttttgttctgcagcaggagtacgtcatttatttggctgtgcatcatggctaccagaactcagtttgaaaattccagtgaggtgggtgtcttttcaaaacttacaaatgcatattgcctggtggccattggaggatcagagaacttttacagcacatttgaggctgagctggcagatgtcattcctgttgtaaagacatctatagcagacgccaggattgttgggcggctttgtgccgggaacaagaatggtcttttgcttccaaacacgactaccgatcaagaactacagcacttgaggaatagtttgccggatgaagttgtggtgcaacgagttgaagaacgactatctgcacttggcaattgtgtggtgtgcaatgatcatgttgctctcattcataccgatatcgacagggagacagaagaattgatagcagatgtgctgggagttgaagttttcaggcaaactattgctggaaatattcttgttgggagttattgtgcgttttctaacaggggtggtttggtacatccacacacgtcaatagaagatctagatgaattatcaactcttcttcaagtacctcttgtggcgggcactgtcaatcgtggaagtgaagtaataggtgctggaatgattgttaatgattggacagctttttgtgggctggacacaactgcaactgaattgtctgttatcgaaagtgttttcaaattgagagaatcacaacctagtgctattgttgatgagatgagaaagtcattgatagatacatttgtctaagtatcaatctcatgccttatgtctcattattgcgtattgctttaaactcactaccaatcctatataaaatttcaagatcttgtcatgttcttaacttgctttgcaaagttgaaacatagcatcggtacagttaaatttactaccgatcctatctaaagtttcaagttcttgtcatgttcttaacttgctttgcaaagttgtaacacagcatcgatacatttattccaagtttcattttgttgtgcaccattgctatacttatctaaa

SEQ ID NO: 2319 - DNA, 1514 bp, Picea glauca
attcaaatattaaacggtcaaccttttgcagcaaggaaaatctataccaccaaatcttgggatacgttatattatcctgaaagatttgatgcacttattgaaaatgattaaatcggttttcgtggattgaagttactaatatccacagtgtagaattcatctctaaatggccgactgtggtgccattcgggttttagtgggttaccgtaatcaacatgcacagtgtaaagttcgtaataataaacatcttggaaacttggagcagattgacttcacattgtgatattggtcttttggttttgggttctgacagtccgttatagcctgaaattttacagcttgaaacagtccgaattctgcgagacagtacttcacagaaaaaaaacatctgtccctcaggaagagcgagtcgtttctttggcttgtgcatcatggctacaagaactcagtttgaaaattccagtgaggttggtgtcttttcaaaacttacaaatgcatattgcctggtggccattggaggatcagaaaacttttacagcacatttgaggctgagttggcagatgtcattcctgttgtaaagacatctatagcaggcaccaggatcattgggcggctttgtgctggaaataaaaatggtcttttgctgccgaatactactagcgaccaagaacttcaacacttgaggaatagtttaccggatgaagtcgtggtgcaacgagttgaagaacgactatctgcacttggcaattgtgtggtgtgcaatgatcatgttgctctgattcatactgatctggacagggagacggaagaattgatagccaatgtgctgggagttgaggttttcaggcaaactattgcaggaaatattcttgttgggagttattgcatgttttccaacagaggtggtctggtccacccacatacttcaattgaagatctagatgagttatcaactcttcttcaagtacctcttgtggcaggcactgtcaatcgtggaagtgaagtaataggtgccggaatgattgtaaacgactggacagctttttgtggtttggacacaacagcaactgaattgtctgtaattgaaagtgttttcaaattgagagaatcacaacctagtgctattgtcgatgagatgaaaaagtcattgatagatacctttgtctgaatatcaatggcttctctcatgtctcatctcttattagtttaaattattgctccatctagaattacaagagtatcttatgtctttttggcaacttgttgtgcatgttcacattttataaagttctaacataccatcggtacatccatttcaagtttttttatctgcaccattgctagagtcagagtaaatatgtagtaaaagagaattgcaacctagtgttgttgatgagatgagaaaatcattgatatgtacttttttgagtatcagtgtcatctctcatgtctcatctcttattattttaatctcactatcgcttctatctaaaatttcaagacgatatctgtc

SEQ ID NO: 2320 - DNA, 1087 bp, Fagopyrum esculentum
agacttgtttgagtttcgatttctttatttaccttggcaatcgtcgttttatcctcatggcgacgacaaggcttcaatttgagaacaactgtgaaattggcgttttctctaagctgactaatacctattgtttggttgcaattggcggatctgagagcttctacagcacgttcgaggcagacttgacagaacacattcctgttgtgaaggcgtccattggtggaactcgaataatcggacgattatgtgctggaaacagaaaagggcttcttttgcctcacaccactaccgatcaagagcttcagcacttaaggaacagtctaccagatgaagtagttgtgcagcgcattgaggaaaaactatctgctcttggaaattgcatagcctgcaatgattatgttgcacttgcccacaccgatcttgacagggaaacagaagagatgattgcagatgttcttggtgtggaagtgtttagacaaactattgctggcaacattcttgtaggcagctactgtgctctctccaacaagggaggcctagtgcatccccacacatctgtggaagacttggatgaattgtcaacacttcttcaggtccccttggtggcgggaactgtaaaccgtggtagtgaggtcatagcagctggcttgaccgtcaacgactggactgcattctgtgggtctgacactacagccacagaaatatctgtcatcgagagcgtcttcaagtttgggggagacaatccacctgccattgtcgatgagatgaggaaatcattgatcgatagttatgtctaactgcttatcaaaatctacaacaatgcttttatttacacctgttttttttccggcaatcatcactcttattcggactacttgttttcaacgttaaatgaagtattcttagtatcaacagaatttgtaaatgtttggtctataaggttcgtcaaacaggacatccttatggagtttacacatgttatgctgatcagtaatgttgactaaagagtaaggtcatgtgcggcaaagctaaccttactctgtagatttttgtggagttttacaattattacaaaacttggaattta

SEQ ID NO: 2321 - DNA, 1137 bp, Flaveria ramosissima
tacacgggtatatatataccccaatttccaacagtcaattactcgtgattcctactattaagccctaattcctctcacccatctcctttatctgaatctatctcaattgttccagatttttcgcgcttcgtcgtgttcacagatatatctgctgtaggaggttggttgaatcccctaaactgaagatttgtttataggttgtgtttgaaggtttctggcgtctagaaccattttgcatccatttggttgtcatttcaccatggctacaaggctacgatttgaaaactcatgtgaagttggtgtattcacaaagctgaccaatgcttactgcttggtagcaactgaaggctctgaaaacttctacagcgtttttgagtctgagttggctgatgttattcctgttgttaaaacttccattggtggtacaaggataattggaaggctttgcattggaataaaaaaggccttcttttgcctcacactactactgaccaagaacttcaacacttgaggaacagcctgcctgatgcagttgttgtaaaacgtattaacgagaggttatctgctcttggtaattgcatggcatgcaatgatcatgttgctcttacacatactgatcttgacaaggaaacagaggaaatgatagctgatgttcttggtgtggaagtttttaggcagacaattgcaggcaatgttcttgtgggaagttattgtgcattttcaaatagaggtgggttggttcatccccacacatcagttgaagatttggatgagctgtcaaccctcctgcaggtccctttggtcgcaggcacggttaaccgtggtagtgaagtcattgcgggtgggttagccgttaatgactggactgcattttgtgggtcagacactactgccacagaactttcggtgattgagaatgttttcaagttgagagaagctcaatccaatgctattgctgacgacacaaggaagtcgttagtttccacttatgtttaaatcaaaatcaaaacttactactatgttactttttttgtgttgtatgttgttgaaaggttcaagttgtcaatctctcctccatctgtatacacatctacgtatgcgtttaactttgtattaaatttgaagctaatatttaag

SEQ ID NO: 2322 - DNA, 1281 bp, Pinus taeda
acaacttttcatgccaaaccctctctatcaattcaaacaatacccgagggtaaccacacgggtgcttataccaaacgatcgactcgccactggctgttgctcgattatattgattagtcctctcttccctactaacatttcagtgtgatatacatctattggcttgggtacagaagactactttactctgaaatttcgatcccggatcaagtgcgattacatctattggcttgggtgccaaagactgcacgactctgaaatttcgaaccccggatcgggccgaatttgctaaatcatctctttggctgtgcatcatggctaccagaactcagtttgaaaattccagtgagattggtgtcttttcaaaacttactaatggatattgcctggtggccattggaggatcagagaacttttacagcacatttgaggcagagctggcagatgttattcctgttgtgaagacatctataggaggcaccaggattgttggccgtctttgtgctgggaacaaaaatggtcttttgctgccaaacacaactaccgaccaagagcttcaacacttgaggaatagtttgcctgatggagttgtggtgcaacgtgttgaagaacgactatctgcgcttggcaattgtgtggtgtgcaatgatcatgttgctctcattcataccgacctggacagggagacagaagaattaatagcagacgttctgggagttgaggttttcaggcaaactattgcgggaaatattcttgttgggagttatagcgctttttccaataggggtggtctggtccatccacacacgtcaatagaagatctggatgaattatcaactcttcttcaagtgcctcttgtggcaggcactgtcaatcgtggaagtgaagtaataggcgaaatgattggacagctttttgtggtctggacacaactgcaactgaattgtctgttatcgaaagtgttttcaagttgagagaatcacaacctagcgctatcgttgatgagatgagaaagtcattgatagatacttttgtttgagtatcaatggcatgtcttatgtctcatcgcttgttagttaaacttactatcagtcctgtctaaaatttcaattgacaatcttgtcattttgcgaaattgctgtgaaagttcatgctttacaaagttgtgagacaacattgttacaattggaaaaactataaggtgcaaagacatgtaaataggatggttaaattggaaaactatactttgattttgatttccgtaattaagctgatatattt

SEQ ID NO: 2323 - DNA, 1154 bp, Cucumis sativus
ataattaatcagccaattcctgtcttgactttgctttctcctccgtgtcatcaacctcacgatctttatcttcgattatctgtcagcaacgacgttccagctccgatttggggttgcaagggactttgagtttatagtgaagagggaggttgttgttgttgattcttcaaggttatcttgtgcaactcatggcgatcaggcttatgtttgagaactcatgtgacattggggttttctccaagctcactaatgcttactgcttggttgcaattggtggctctgagaatttctacagtacctttgaaactgaaatacgtggtgtcattccggttgttaaagcatctattggtgggactcgcattattggccgtctatgtgctggaaacaaaaatgggcttcttgtaccacacaccactacggatcaagaacttcagcacttgaggaacagtttgcctgaccaagttgttgttcaacgtatacaagagagactgtctgctttgggaaacacgattgcttgtaatgatcacgttgctctcgcacattctgatcttgatcgggaaactgaagagctcatcgctgatgttcttggagtagaggtctttaggcagacagtagcaggcaacgttctcgtgggaagctactctagttttacgaataggggaggcttggttcatccacatacatccgttgaagatttggacgagctatcaacccttcttcaggtcccgttagtcgctggaaccgtgaatcgtggaagtgaagtgattgcggctggattaacagcaaatgactggactgcattttgtggttcggacaccactgccaccgagttatcggtcatcgagaatgttttcaaattgagggaggctcaaccaagctccattgtcgaagaaatgaggaagtcgttgattgacagtcatgtgtgaggagtttcttcttctacacttgagatttgcaagcaattaattgttattactcttatctttatcttcttctgctatatttaatgacattgtgagtgaaattggagttgtatatatactttggtatcatcgtcttggtcttgtattattgttaccattaccgaaagtcgatcagtaacgatatctgtaataataacaatacttatgatatatttatcattctcttgctat

SEQ ID NO: 2324 - DNA, 1083 bp, Pinus taeda
gactattgaaagggtttttgagactcgaatcattttttttataacgcgggtttaactatagcatcggttgattcctgctcggagaagcggaagccttcgccaatatacatctttttgagaacaagccgatgccgttgtcgccatgaagctcgtcagtttaaatcatttctttgcctgtgcatcatggctaccagaactcagtttgaaaattccagtgaggttggcgtcttttcaaaacttactaatggatattgcctggtggccattggaggatcagaaaacttttacagcacatttgaggcagaactggcagatgctattcctgttgtgaagacatctattggaggcaccaggattgttgggcgtctttgtgctgggaacaaaaatggtcttttgctcccaaacacaactaccgaccaagaacttcagcacttgaggaatagtctgccggatgaagttgtggtgcaacgagttgaagaacgactatctgcgcttggcaattgtgtggtgtgcaatgatcatgttgctctcattcatactgacctggacagggagacagaagaattaatagcagacgttctgggagttgaggttttcaggcaaactattgctggaaatattcttgttgggagttatagtgttttttctaatagaggtggcctggtccatccacacacttcaatagaagatctggatgaattatcaactcttcttcaagtgcctcttgtggcaggcactgtcaatcgtggaagtgaagtaataggcgaaatgattggacagccttttgtggtctggacacaactgcaactgaattgtctgttatcgaaagtgttttcaagttgagagaatcacagcctagtgctattgtcgatgagatgagaaaatcattgatagatacttttgtctgagtatctaagtttcacttggttgtgtaccatttctatacttgagtgaatgttgaattcttattattatgttgaacgagttctggaactaaactccatggctaacatgtgggtagctgttatgtctgttaaaccttgagaatattgagttattatgttgaacaagttctgtaactac

SEQ ID NO: 2325 - DNA, 1113 bp, Centaurea maculosa
  misc_feature (29)..(29): n is a, c, g, or t
  misc_feature (52)..(52): n is a, c, g, or t
  misc_feature (60)..(60): n is a, c, g, or t
  misc_feature (82)..(83): n is a, c, g, or t
  misc_feature (90)..(90): n is a, c, g, or t
  misc_feature (95)..(95): n is a, c, g, or t
  misc_feature (98)..(98): n is a, c, g, or t
  misc_feature (144)..(144): n is a, c, g, or t
  misc_feature (152)..(152): n is a, c, g, or t
  misc_feature (174)..(174): n is a, c, g, or t
  misc_feature (177)..(177): n is a, c, g, or t
  misc_feature (184)..(184): n is a, c, g, or t
  misc_feature (187)..(187): n is a, c, g, or t
  misc_feature (226)..(226): n is a, c, g, or t
  misc_feature (260)..(260): n is a, c, g, or t
  misc_feature (278)..(278): n is a, c, g, or t
  misc_feature (325)..(325): n is a, c, g, or t
  misc_feature (337)..(337): n is a, c, g, or t
  misc_feature (355)..(355): n is a, c, g, or t
  misc_feature (364)..(364): n is a, c, g, or t
  misc_feature (442)..(442): n is a, c, g, or t
  misc_feature (457)..(457): n is a, c, g, or t
  misc_feature (538)..(538): n is a, c, g, or t
  misc_feature (541)..(541): n is a, c, g, or t
  misc_feature (571)..(571): n is a, c, g, or t
  misc_feature (577)..(577): n is a, c, g, or t
  misc_feature (655)..(655): n is a, c, g, or t
  misc_feature (673)..(673): n is a, c, g, or t
  misc_feature (685)..(685): n is a, c, g, or t
  misc_feature (694)..(694): n is a, c, g, or t
  misc_feature (733)..(733): n is a, c, g, or t
  misc_feature (736)..(737): n is a, c, g, or t
ggcggggacactgagattttagatattgnattgaaatccctaaattcggttngccctttnaaacccctaaattcgattcaanngatacgntttcngtntgaattcattgcaatttctcaaggtttttcgatcttcgtcgtattntcaggctntttgctcctgaagccactttcnatncattcanttntcattcaccatggccacaaggctacggtttgaaaattcntgtgaaattggggtgttcacaaagctgaccaatngttactgcttggtagctnatgaaggctctgaaagtttctacagcattttcgagtctgagttggcngatgttattccngtggttaaaacctctatnggtggcacnaggataattggaaggctttgcatcggaaataagaaaggcctgctcttgcctcatactactaccgaccaagagcttcancacttgaggaacagnttgcctgatgaagttgttgttcaacggattaatgagaagttatctgctcttggtaattgcatggcatgcaatgatcatgtngcncttacccataccgatcttgacaaggaaacngaaganatgatagcggatgttcttggtgtagaagtttttaggcagacaattgcaggcaatgttcttgtgggcagctactgtgcnttttcaaatagaggtggnttggtccacccncacacatcngttgaagacttggatgagctctcgaccctcctccaggtnccnntggtggcaggcaccgtgaaccgtggtagcgaggtcatagccggtggcttgatcgtaaacgactggaccgctttctgtgggtcagacactactgccacagaactgtcggtgatcgagaatgttttcaagctaagagataaccaacctaatgatattgccaatgagatgaggaagtcgctaatcgacgcccatgtttgaattccctgtatgatgttgctatacacgcctctttctttttttatataaattcggcttttatgttgctagaccttttactttttggtactcgattctaatttgagatgataagccttgaatgtaaatcaccataggggtgttaacggggcccaaaaaggataatgtattgcagtttcgtt

SEQ ID NO: 2326 - DNA, 1118 bp, Cephalotaxus harringtonia
gtttgtacggccacccaaattatcctttccagggtttgtgcttaaggttgaaggcactaattctgcacaaagaagaagggtttttgtgtttagctttgcatcatggcgacaagaactcaatttgaaaattcttctgaagtaggtgtcttttcaaagcttacaaatgcatattgcctggtggccattggcggatcggagaacttttacagcacatttgagtctgagctagcaggtatcattcctgttgtaaagacatcaatagctggaaccagaattattggacgactttgtgctgggaataaagatggtctgttattaccaaataccacaactgatcaagagcttcagcacttgaggaatagtctgccggatcaagttgtggtgcaaagagttgatgaatctttgtctgcacttggcaattgtgtggtctgtaatgatcatgtagctctaattcatactgacttggacagggagacagaagagctgatagcagatgttctaggagttgaggcttttaggcagactatagccggaaatactcttgttggtagttatggtgtgttttctaacagaggtggactggttcatccacacacatccattgaagatctagatgagttatcgacactcctccaagtacctcttgtggcaggctctgtcaatcgtggaagtgaagttgtggctgctgggatgattgtaaatgattggactgctttctgtggactggacacaacagcaaccgaattgtcagttattgaaagtgtgttcaaattgagagaatcacagcctagtgctatagttgatgagatgagaaagtcattgatagatagctttgtctaaataatgtcatctcatattgtgtctgcagctttctcagtattgtttcctattgtgactttctagcaaggtcttgacttttttgtattgtgccgtacaagattgtgctgtagaaagttgtaacatagaagtagaacttatttccccttccccactatatgatttttattgtcccacgaattttattatggaacactgttatggttctctctacgattaatcagggaggtaacaatattagctgttttacttgcagttaatttttcaaattttgtggaaat

SEQ ID NO: 2327 - DNA, 1285 bp, Cirsium arvense
taaattcgattcaattgatacgatttccgtttgaattcattgcaatttctcaaggtttttcgatcttcgtcgtattatcaggctctttgctcctgaagccactttccatccattcaattctcattcaccatggccacaaggctacggtttgaaaattcatgtgaaattggggtgttcacaaagctgaccaatggttactgcttggtagctaatgaaggctctgaaagtttctacagcattttcgagtctgagttggctgatgttattcctgtggttaaaacgtctattggtgggacaagaataattggaaggctttgcatcggaaataagaaaggcctgctcttgcctcatactactaccgaccaagagcttcaacacttgaggaacagtttgcctgatgaagttgttgttcaacggattaatgagaagttatctgctcttggtaattgcatggcatgcaatgatcatgtcgcccttacccataccgatcttgacaaggaaaccgaagatatgatagcggatgttcttggtgtagaagtttttaggcagacaattgcaggcaatgttcttgtgggcagctactgtgcattttcaaatagaggtggattggtccacccccacacatccgttgaagacttggatgagctctcgaccctcctccaggttccattggtggcaggcaccgtgaaccgtggtagcgaggtcatagccggtggcttgatcgtaaacgactggaccgcgttctgtgggtcagacactactgccacagaactgtcggtgatcgagaatgttttcaagctaagagataaccaacctaatgatattgccaatgagatgaggaagtcgttaatcgacacccatgtttgaattccctgtatgatgttgctatacacgtctctttcttttttatatatattcggcttttatgttgctagaccttttactttttggttactcgattctaatttgagatgataagccttgaatgtaaatcaccatagggtgttaacgggccgaaaaggataatgtattgcagtttcgttttggttttgacaagtttagtgttgtacattatgttcgatttcggtttggtacttaaaaacagatatccaaattgaatggtttgggttcctgtgagtgtgaatgtcgtgtgggtctatgtcttctaaatctaacatttctggcagcaatatcattaggttgggtttctttactagacaacattctggatcagttggggggcgtttggttcgcggaatggatttcaattaaattggaattcgtt

SEQ ID NO: 2328 - DNA, 1191 bp, Cynara scolymus
  misc_feature (70)..(70): n is a, c, g, or t
  misc_feature (153)..(153): n is a, c, g, or t
  misc_feature (1092)..(1092): n is a, c, g, or t
  misc_feature (1122)..(1122): n is a, c, g, or t
  misc_feature (1151)..(1151): n is a, c, g, or t
caagacgaatcgcctctttttaacctctaattccattcgaccgataggtttcctgtttcacttatagcanttgatcaagatttttccatcttcgtcgtttttacggggtccttgctcctgaagccattttccatccatcaacttctcattaancatggccacaaggctacggtttgaaaattcatgtgaaattggggtgttcacaaagctgaccaatggttactgcctggtagctgatgaaggctctgaaagtttctacagcatttttgagtccgagttggctgatgttattcctgttgttaaaacctctattggtggtacgaggattattggaaggctttgcattggaaataagaaaggtcttctcttgcctcatactactaccgaccaagagcttcaacacttgaagaacagcctgcctgatgaagttgttgtccaacggattgatgagaagttatctgctcttggtaattgcatggcatgcaatgatcatgttgctcttactcataccgatcttgacaaggaaaccgaagatatgatagcggatgttcttggtgtagaagtttttaggcagacaattgcaggcaatgttcttgtgggcagctactgtgcattttcaaatagaggtgggttggtccacccccacacatctattgaagacttggatgaactctcaaccctcctccaggtcccattggtggcaggcaccgtcaaccgtggtagcgaagtcatagccggtggcttaatcgtaaacgactggactgcattttgtgggtcagacactacagcgacagaactatcggtgatcgagaatgttttcaagttaagggaaacccaacctactgatattgccaatgagatgaggaagtcgttaattgacacccatgcttgaatccgacgcttgcctgtatgatgttagacacgtcttttttatatattccgcttttatgttgctatatgtttaaggttctgtttttttggtactaatgagacggtaagtgttgaatgtaaatcaccgtaagggtgttaaaagagaccgtcgaattgaaattgaatagcaaaccgaggcagaaaagaggttaattgtgtatngtagtttggtatcggttttgataagtttancgttctacagtatgttcaattccagtatnatgtttaaaaacatatatctaaattgaatagttggttcct

SEQ ID NO: 2329 - DNA, 1168 bp, Pinus pinaster
tagcatcggttgattcctgcttggagaagcggaagccttgccaatacacatttttttgaaaacaagcggatcccaatctcgccgtgaagctcgtcagttaggactttacggagattaaatacttttgttgtgcaggagtaaatcatttctttgctgtgcatcatggctaccagaactcagtttgaaaattccagtgaggttggcgtcttttcaaaacttactaatggatattgcctggtggccattggaggatcagaaaacttttacagtacatttgaggcagaactggcagatgttattcctgttgtgaagacatctataggaggcaccaggattgttgggcgtctttgtgctgggaacaaaaaaggtcttttgctcccaaacacaactaccgaccaagaacttcagcacttgaggaatagtttgccggatgaagttgtggcgcaacgagttgaagaacgactgtctgcgcttggcaattgtgtggtgtgcaatgatcatgttgctctcattcataccgacctggacagggagacagaagaattaatagcagacgttctgggagttgaggttttcaggcaaactattgctggaaatattcttgttgggagttatagtgttttttctaatagaggtggcctggtccatccacacacttcaatagaagatctggatgaattatcaactcttcttcaagtgcctcttgcggcaggcactgtcaatcgtggaagtgaagtaataggtgctggaatgattgtaaatgattggacagctttttgtggtctggacacaactgcaactgaattgtctgttatcgaaagtgttttcaagttgagagaatcacagcctagtgctattgtcgatgagatgagaaagtcattgatagatacttttgtctgagtatcaatgccatttctcatgtctcatcgctttttagttgagcttactatctgtaactaaactccatggctaacatgtgggtagcagttatgtctgttaaaccttgagaatattgagttattatgttgaacgatatgttgaacgagttctgtaactacactccatggctaacatgtgtgtagcagttatgtcttttaaatctgtatttatctaagagtgacttacgtttgttgtaaacgcttgggaatattgtaaatgtatgtgattg

SEQ ID NO: 2330 - DNA, 747 bp, Cajanus cajan
gtaggacttcaatttgaaaataattgtgaagttggaggcttcagtaaacttactaatgcctactgtttggtccccattggaggttctgagaacttctacagtgtatttgaagctgcattagcagatgttatccctgtggtcaagacatccattgctggtattcgtactcttggttatcaatgtgctggaaacaagaatgggcttcttgtgccccataccaccacagaccaagaacttcaacatttgaggaatagtctacctgatcaagttgttgttcagagaatagaagaaagattatgtgctctgggaaattgtatagcatgtaatgatcatgtggcccttgcacacactgatcttgatgcggagactgaggagattattgcagatgttcttggagtagaagttttcaggcaaaccattgctggtaatattcttgttggtagctactgtgccttctctaatagaggtggtttggtccaccctcatacttccatagaagacttggatgaactttctacacttcttcaagttcctttagtggctgggactgtgaacaggggtagtgaagtaatagcttcaggaatgtctgttaatgattggatagcattttgtggttcagacaccacagcgacagagctatctgtgattgagagtgttttcaaactcagagaagcacaacctagtgccattgtagatgagatgaggaaatccctcattgatatctatgtttgagttgttgtgactagt

SEQ ID NO: 2331 - DNA, 992 bp, Plantago ovata
gccctaacttttcaattaccctcctcctttcctttctcttcagactgtttgatttccttgtcatcaataaatattaaataatcgcagcagcagctgctgacattgtttttcttcttccagacgaacaaacagctcataccatggcaactcggttgcactacgagaacaacagcgagattggcgttttctccaagctcactaacgcttactgcttggtcgctattggcggttctgaaaacttttacagtaccttcgagagtgagttggctgatgttattcctgtcgttaagacctccattgctggtacaagaatcgttgggcgcttatgtgctgggaacaagaatggcttgcttttgccccacactactaccgatcaagaactacaacacttgaggaacagtctgccagattcagttgttcagcgtatagaggagagattatctgctttaggaaactgcattgcttgcaatgatcatgttgctcttacgcatattgatcttgacaaggaaactgaagagatagttgctgatgtcctcggggttgaagttttcaggcagagcattgccagtaatgtacttgttggcagtttttgtgcattttccaacagaggtggcctggtccatcctcatacatccatagaggatttagatgaactttcaactctccttcaggtcccactggtggctgggactgtgaaccgtggtagtgaagtgatagcagcgggcttgacagtcaatgactggactgcgttctgtggggcggacaccactgctactgagttatccgttgtggagaatgttttcaagttgagagaagctagaccgaatgttcttgttgatgagatgagaaaatcattgatcgacaccattgtttgactttttgttgcgttgatacactcaaaaacttttagtttcagggaaatattgttacaatggtcccttgctcaatattgttttggggatgacagtttaaatgagtatgggatttctaac

SEQ ID NO: 2332 - DNA, 1214 bp, Sequoia sempervirens
cacacttctagtttctgcaatttgatagatttgtcggcgttttgcctcttgtcattccgtaaatataaacctagacgcctatatttcggagcatcgttgactacttcgtttgcattccatacagattttcgcattctcctctctcagctttacttcgtttgctcggctccgctttgttcagatagaagcgggcgcgtacatttacaaaccactatctgcagggtttgtggtagaggtcgagggcgtttgctctgcagtaaggagaggggacttcttttggctttgcatcatggctacaaggactcaatttgaaaattcttctgaagttggtgtctttgcaaagcttacgaatgcatactgtctggtggctattggtggatcagagaacttttacagcacatttgagtccgagctagctgaggtcattcctgttgtaaagacatcaatagctggaaccagaataattggacgactctgtgctgggaataaaaatggtctgctattaccaaatacaacaactgatcaagaacttcagcacttgaggaatagcttacctgatcaagttgtggtgcaaagagttgacgaaagattgtctgctcttggaaattgtgttgtctgcaatgatcatgtaggcctaattcatactgacttggacagggagacagaagaaatgatagcagatgttctaggaatcgaggtttttaggcaaactattgctggaaatattcttgttggcagttatggtgtgctttctaaccgaggggggctggtacatccacacacatccattgaagatctagatgagttatcaacactcctccaagtaccacttgtagcaggcactgtcaatcgtggaagtgaagttgtgggtgctggaatgattgtaaatgattggactgctttctgcgggttggacacaacagcaactgaattgtcagttattgaaagtgttttcaaattgagagaatcgcaacctagtgctatagtcgatgagatgagaaagtcattgatagatagctttgtctaaatctctcatagtgtgtaccatttaggtggcctataaaaaaacatggtgcacatcatgataaccttgctaagcggcttgaattaatatgttttggcataaatccgaaaaaaaacagtggatgtcataataaccttgctaagcagctcgaattattatatttttgcctaaattccaatataaatataaa

SEQ ID NO: 2333 - DNA, 844 bp, Citrullus lanatus
catattctttgcttttcttctttagggcttatgtttgagaactcatgtgaaattggggttttctccaagctcactaatgcttactgcctggttgcaattggtggctctgagaatttctacagtacgttcgaaactgaattaggtggtgtcattccggtcgttaaaacatctattgatggcactcgcattattggccgtctatgtgctggaaacaaaaatgggcttcttgtaccacacaccactactgaccaagaacttcagcacttgaggaacagcctacctgaccaagttgttgttcaacgtatacaagagagattgtctgctctggggaataccattgcttgtaatgatcatgttgctctcacacatactgatcttgatcgggaaactgaagagctcattgctgatgttcttggagtggaggtctttaggcagacagtagcgggcaacgtccttgtgggaagctactgtagcttcacgaataggggtggcttggttcatccacatacgtctgttgaagatctggatgagctatcaacccttcttcaggtccctttagttgctggaaccgtgaatcgtggaagtgaagtgattgctgctggattgacagcaaatgattggaccgcgttttgtggttcagacaccacggccaccgagttatcggtcatcgagagcgttttcaaattgagggaggctcaaccaagttccattgttgaagaaatgaggaagtcgctaatagatagttacgtatgaggagtcacttctactatactatacttaagatcttgcaagcaattgattgttattactcgtgtcattttccttctattacatcaacattgtg

SEQ ID NO: 2334 - DNA, 710 bp, Ambrosia trifida
tggccactaagacttcagtttgtagaattcatgcgaaattgggtgttctcaaagctgactaatgcttactgtttggttagcaataggtggttctgaaaattttactagtacatttgaggccgagctagctgatgttattcctgtggttaagacctccattggtggcacacgtataattggccgactttgcattggtacaaaataggccactttacctcataccactaccgaccaagaacttcaacacttgaggaacagtctgccagatgcagttgtggttcagcgaattgatgagagactatctgcccttggaaattgcatagcatgcaatgaccatgttgcccttacccataccgatcttgacagagaaaccgaggaaatgatagctgatgttctcggtgttgaagttttcagacagacaattgctggaaatattcttgtgggcagctactgtgcattttcaaatagaggtggcatggtgcatcctcatacctctattgaagacctggacgagctatcaaccctgcttcaggtacctttggtagctggaacagtgaaccgtggtagtgaggtaatagcggcgggcctaacggttaatgactggaccgcattttgcgggtcagataccaccgcaacagaattgtctgtgattgagagtgttttcaagctgagagaagcccaaccagtgccattgtggatgagatgaggaa

SEQ ID NO: 2335 - DNA, 1076 bp, Helianthus annuus
ctataactataaaatatttacacatatgccccaacttcccaaaatcaattattcattcttgatcttgattcgcacttttaaaaccctaattcgattcacacagctcctgtggtttaaattcatcacaatcgttccaagatctttcactcttcgtcgtgttcacaggttacttgcatccagagccatattccatccgtctactagtcagtttaatatggctacaaggctacggtttgaaaactcatgtgaaattggcgtattcaccaagctgaccaattcttactgcttggtagcaaacgaaggctctgatagcttctacagcgtttttgagtccgagttagctgatactattcctgtcgttaaaacttccattggcggtacaaggataatcggaaggctttgcattggaaataagaaaggtcttctcttgcctcatactactaccgaccaagagcttcaacacttgaagaacagcctgcctgatgcagttgttgttcaacggattaacgagaggttatctgctcttggtaattgcatggcatgcaatgatcatgttgctcttacgcataccgatcttgacaaggaaaccgaggaaatgatagctgatgttctcggtgtggaagtttttagacaaacaattgcagggaatgttcttgtggggagttattgtgcattttcaaacagaggtgggttggttcatccccacacatcagttgaagacttggaagagctctcgactctcttgcaggtccctttggttgcgggcacggttaaccgtggtagtgaagtgatcgcgggtgggttaaccgtgaatgactggactgcgttttgtgggtcagacactacggccacagaactctcggtcattgagaatgttttcaagttgagagaagctcaatctagtgctattgctgacgagacaaggaagtcgttagtttctacgtatgtttgaatcgaaacgagaacgaacattgttactttcttttcgagttgtatgttgttgaaagtacacgttgtctcccttttatatgttctaacttttttttgtgcaattcagttcatgttgtctatcgcta

SEQ ID NO: 2336 - DNA, 859 bp, Ambrosia trifida
gatatcttgactggttgtggttgaaggttctttggattaacttggctttttaccatggctacaaggctccggtttgaaaactcatgtgaaatcggtgtattcaccaagctgaccaattcttactgcttggtagctaatgaaggctctgatagcttctacagcgtttttgagtccgagttagctgatactattcctgttgttaaaacttccattggtggtacaaggataatcggaaggctttgcattggaaataagaaaggccttctcttgcctcatactactactgatcaagaacttcaacacttgaagaacagcctgcctgatgcagttgttgttcaaaggattaacgagaggctatcggctcttggtaattgcatggcatgtaatgatcatgttgctcttacacataccgatcttgacaaggaaacagaggaaatgatagctgatgttcttggcgtggaagtttttagacagacaattgcaggaaatgttcttgtgggtagttattgtgcattttcaaacagaggtgggttagttcatccgcacacatcagtcgaagacttggaagagctgtcaactctcctgcaagtccctttggttgcaggcacggttaaccgtggtagtgaagtgattgcaggtgggttaaccgtcaatgactggactgcgttttgcgggtcagacactacagccacagaactctcagtgattgagaatgttttcaagttgagagaagctcaatctagtgctgttgctgacgagacaaggaagtcgttagtttccacatatgtttgaatcgaaatgaaaacttacattgtcacctttttcacgcgttgtatgttgtttaaagttcatgttgtct

SEQ ID NO: 2337 - DNA, 857 bp, Ambrosia trifida
aatcagctcctgtgcttcaaatccattgtcaattcttctaagatctttcacagatatcttgactggttgtggttgaaggttctttggattaacttggctttttaccatggctacaaggctccggtttgaaaactcatgtgaaatcggtgtattcaccaagctgaccaattcttactgcttggtagcaaatgaaggctctgatagcttctacagcgttttcgagactgagttagctgatactattcctgttgttaaaacttccattggtggtacaaggataatcggaaggctttgcattggaaataagaaaggccttctcttgcctcataccactactgatcaagaacttcaacacttgaagaacagcctgcctgatgcagttgttgttcaacggattaacgagaggctatcggctcttggtaattgcatggcatgtaatgatcatgtggctcttacacataccgatcttgacaaggaaacagaggaaatgatagctgatgttcttggtgtggaagtttttagacagacaattgcaggcaatgttcttgtggggagttattgtgcattttcaaacagaggtgggttagttcatccgcacacatcagtcgaagacttggaagagctgtcaactctcctgcaagtccccttggttgcaggcacggttaaccgtggtagtgaagtgattgcgggtgggttaactgtcaatgactggactgcgttttgcgggtcagacactacagccacagaactctcagttattgagaatgttttcaagttgagagaagctcaatctagtgctgttgctgacgagacaaggaagtcgttagtttccacatatgtttgaatcgaaatgaaaa

SEQ ID NO: 2338 - DNA, 1180 bp, Cichorium intybus
gggggcggttcagaacgaagtcaacaacggggtaccaaaaggccaaaacaaaaatctcgagaactattaaatcatatcacccaaaatatcccgttttgattcatacttttcaaagccctaatttgatcccgcaactcctgcttactttctacatttgaatttatcgcgattgcttcagatttctcgatcttcgtcgtattcacagacttcttgctcctgaaggaatttcccatacatctccttctcatttaccatggccacaaggctacggttcgaaaactcatgtgaaattggggtgttcacaaagcttacaaatgcttactgcttggtagcaaatgaaggatcagaaagtttctacagcatctttgagtctgaactggccgatgtcattcccgttgttagaaccaccattggcggtacaagaatagttggaagactttgcatcggaaacaagaaaggccttctcttaccccatactaccaccgaccaagagctcgaacacatgaggaacagtctgcctgacacagttgttgttcaacgaatcaatgaaaagttatctgctcttggcaattgcatggcatgtaatgatcatgtcgctcttacccataccgatcttgacaaggaaacagaggaaatgatagctgatgtacttggtgtggaagtttttaggcagacaattgcagggaatacacttgtgggcagttattgtgcgttttcaaataaaggtggtctggtgcaccctcacacatcggttgaagatcttgatgagctgtcaactcttcttcaggttcctttggttgcagggacggttaaccgcggcagtgaagtgattgccggtgggttaaccgttaatgactggaccgcattttgcggttcagacactactgcaaccgagttgtcagtgattgagaatgtttttaagttgagggaagctcgacctgaggctattgctaatgagatgaagaaatcgttgattgatacatatgtttgaatgatttcgaactcgaacgcttgttattctggtttttgatttgtattatgtcgtctttatcttttttcttgtatgcggtcgtgatgttgccatatgttcacgacttttgtttttggtgttaaattgtaacgagacagtgaaccttccaatggaaatcacaataccgtaatttggattaggaaatccttg

SEQ ID NO: 2339 - DNA, 1245 bp, Gnetum gnemon
ggagtgttgatttttcggagataagcaaaacttgttctttggtgcgctaggtttcagcgccgccctatcgcacaggttctccttatttatatcgcagagcgtaacaggattgttcctgaaaatatcttggtgcgttaacctgactccctttcctcatggcgacaagaactcaatttgagaactgtaatgaagttggtgtgttttcaaagctaactaataagtattgtctggtggcaatcggggggtctgaaaacttctacagcacatttgaggctgagctgtcggatgtcattcctgttgtaaagacatccatagcggacactaggatcattggacggatctgtgttgggaataaaaatgggcttctactgccaaatactgccacagaccaagaacttcagcatttgaggaatagcttacctgatcaagttgttgtccaacgtattgaggagaggttgtctgctcttggcaatgttgttgcatgcaatgaccacgttgcacttatccatactgatcttgacagggaatcggaagaattgatagcagatgttctgggagttgaggtttttaggcaaactattgcaggcaacattttagttggaagctactgtgtattctccaataggggtggcctggtccatcctcacacttcaatcgaagatctggatgaattatcaactcttcttcaggtacctttagttgcaggaaccgttaatcgtggtagtgatgtgctagctgctggaatggtagcaaatgactggacagcattctgtggtttggacacaacagcaactgaattgtctgttattgaaagtgtctttaaattaagagattcgcagcctagtgcaattgctgatgaaatgagaaaatcactcattgatacgtttgtctaagcgatggatagtgtagtatgtttttctttacctacagaatttaggatttcctagatttgcaagtttgtattcctgaagttttcttttttagaagccagccataaatggcattgttattcttcccttacttgtgtgtgacttgagtcgctagaaggcatcaatggctgacaattattttcttcccttaaatgtgagtgacttgagtcgctagaaggcatcaatggctgacaattatttatatacatcatgtgtcagtttatgatacaaaccaaaaactctcagaacttgtcagtgtatggcagattttctgtattctgttcgcagtattagaccctggattaattgtaatttt

SEQ ID NO: 2340 - DNA, 1310 bp, Lactuca sativa
tgtggatataattctctcaatgatcgaggcatcaacataaacataaccttgcggttcaagtagatttttggcttggtcatcaagttcctgaatcaaagtcaacagcggtgtacccaaaacaaaaatctttctaaaaatatatatcacccaaaaaatccctttgattcatacttttcatttttcaaagccctaatttgattcacccaactcctgctttactttctgactttctgtatctgaattaatcgcactcgctcaaggttcttccttcttcgtcgtattcacaggatacttgctttgaagccattttccatacatctccttctcatttaccatggccacaaggctaaggttcgaaaactcatgtgaaattggggtattcacaaagctcacaaatgcatactgtttggtagcaaatgaaggctctgaaagtttctatagcatctttgagtctgaattagctgatgtcattcctgttgttaaaacatccattggtggcacaagaatagttggaaggctttgcataggaaataaaaaaggccttctcttgcctcataccactaccgatgaagagcttcaacacttgaggaacagcctacctgatgcagttgttgttaaacggattaatgagaaattatccgctcttggtaactgcatggcgtgtaatgaccatgttgcccttacccatactgatcttgacaaggaaacagaggatatgatagcggatgttcttggtgtggaagtgtttaggcagacaattgcaggaaatgtacttgtggggagttattgtgtgttttcaaatagaggtggtattgtgcaccctcacacatctgttgaagatttggatgagctgtcaacgctccttcaggtccctttggttgcagggacggttaaccgtggtagtgaagtgatagccggtgggttaaccgttaatgactggaccgcgttttgtggttcagacactactgcaaccgaattgtccgtgattgagaatgtctttaagttgagggaagctcgacctcaggctattgctaatgagatgaagaaatcattgattgatacgtatgtttgaatcgattcaaatgcttgttaatgttatgttatgttatgttactttatttttttttgggcttaaaatgatgttgacattttcatgttgttttgtcttttttcttgtatttggtttttgtgcttaagatgatgtcgaaaggtaaatctcgtaaaccctaaactggaatcttgagtgaaatatgaaattcatcaaatactcttgggactggctttgaattcatgaatcgttatgagtaatt

SEQ ID NO: 2341 - DNA, 1222 bp, Orobanche aegyptiaca
aaaagaaggaaataactcttcgtgtgccctaactgcactgtgcgaacccgaccctaccgtccgccactgccaccgtcacagccgcgcgcctgccctaactgcgacatattgtctcgttgcgtctgtttcaacctgttcctttcaccatggcaacaagattacagtttgagaatagttgtgagatcggggtgttctccaagctcaccaatgcatattgtcttgttgcaattgggggttctgaaaacttctacagcacatttgaagctgatttggcggattatattccggtgattaaagcctccattgctggcactagaatcattggtcgcctctgtgctggaaacaaaaatgggttacttttgcctcacaatactactgatcaagagcttcaacatttgaggaacagtctaccagattcagtagttgttcagagaatcgaagaaaagttgtctgctctagggaactgtgttgcgtgtaatgatcatgttgctcttacacatcctgatcttgacaaggaaacggaggagttgattgctgatgttcttggggttgaagttttcagacatgctgtggctggtaatatacttgtcggaagctactgttcgttttccaacataggtggcttggtccatcctcatacgtcagtagaggatttaaatgaactggctaccctccttcaggtccctttggtgcctgggaccgttaatcgtggtagtgaagtcataggtgctggtctggtggtcaacgattggacggctttctgtgggtctgataccactgctactgaattatctgttgtggagagtattttcaagttgagagacgctaagccaagtgctattatcaatgagatgaggaaatcattgatcgacacttatgtttgagggtttttcccaggactttctatgtgtagattgaagctgtgaatctcttggaggaagcttgtgggtttttattctgaactaatttccgcgaaaatactgccctttgatttgtattagttattttccgtacttagtatgtggtttgttggtaatgaattgtgagtttggacctgggttatgtgttctataaaattattgaaaatgaaagtgcgattattttgcaagtatgcacatgtatgcagcttttacttgttataaaatggtgtttaatttcagtccgcaaacagtagattgaatgtgcatatggttcagcttgaaatgccaaatgatcttgtgct

SEQ ID NO: 2342 - DNA, 1071 bp, Pteridium aquilinum
atcaaggtttggaagcggacagcaaccttgaaggtctagccttggtgtcccacttcagcttgcgctctacgcaaattttgaaagatttagtcagtaagtcgaagagcgcctgttagggttcctgtcttctgtgtggcgttttcaagcaagcttctccttactgcctgccttgggcgcatatcgtggtgttctgtcattccaccatggcgacaaggattcaatttgagaataatagcgaaattggagttttctcaaagctcaccaacgcatattgcctaaccgccattggaggttcagagaatttttacagtactttcgaatctgaacttgccgataccatcccagtggtcaaggcctccattgctggaacaagggttattggccgaatgtgcgctggtaacagaaatgggctgcttttaccaaactctaccacagatcaagagttgcagcatttgaggaattctttgccagatagtgtcgtagtacaacgtattgatgagcgactgtcggcactgggcaactgcatttcctgcaatgactatgttgcgttgatccatacagatctagatagagaaactgaagagttgttagctgatgtactaaatgtggaggttttcagacaaaccattgcgggtaacatattggttgggagttactgcactttctccaacagagggggtctggttcatcctcatacatctgtcgaagatttggacgaattgtcatctttgctgcaagtgcctttggtagctggtactgtgaacagaggaagtgaggtcattggtgcagggctggttgttaatgactggacagctttctgtggatttgatactactgcaacggagctatctgtaattgaaagtgtattcaagctcagagaagcccagcccagtgcaattgtgaaggaaatgcgagcatcattgattgatactctggcatgatgtgttgaatggaataaatgtgcttctagacggttgcttctccgttgtatagactatttttgttgtcttgtatgtcggtttttttattcttatttcattcatgggaaagtccatgcttggttctttagat

SEQ ID NO: 2343 - DNA, 1080 bp, Ambrosia trifida
tattaaatatacacctcctcatttcccaaaacaataattgaatcttgattcatacttttaaaaccctaactccattcaatcagctcctgtagtttaaactcatcgcaactcttcaagatctttcactattctcttgttcacagatatcttgactggttctgtttgaaggttctttggattaacttgtctttttatcatggctacaaggctacggtttgaaaactcatgtgaaatcggtgtattcaccaagctgaccaattcttactgcttggtagcaaatgaaggctctgatagcttctacagcgtttttgagtccgagttagctgatactattcctgttgttaaaacttccattggtggtacaaggataatcggaaggctttgcattggaaataagaaaggccttctcttgcctcatactactactgatcaagaacttcaacacttgaagaacagtctgcctgatgcagttgttgttcaacggattaacgagaggctatcggctcttggtaattgcatggcatgtaatgatcatgttgctcttacgcatactgatcttgacaaggaaacagaggaaatgatagctgatgttcttggtgtagaagtttttagacagacaattgcagggaatgttcttgtggggagttactgtgcattttcaaacagaggtgggttagttcatccgcacacatcagtcgaagacttggaagagctgtcaaccctcctgcaggtccctttggttgcaggcacggttaaccgtggtagtgaagtgattgctggtgggttaaccgtcaatgactggacagcgttttgcgggtcagacactacagccacagaactctcagtgattgagaatgttttcaagttgagagaagctcaatctagtactgttgctgacgagacaaggaagtcgttagtttccacatatgtttgaatcgaaatgaaacttacattgtcaccttttcacgcgttgtatgttgtttaaagttcatgttgtctccctctatctgttcaacttttttcttcaattcagttttcatgttgtctgtctccttgtaatactctaatatcactcgtctt

SEQ ID NO: 2344 - DNA, 887 bp, Gossypium hirsutum
aaaattcccgacccacgctcatttcgattcacacatacatcctccgccgccaaccgagccatttgtcttccacttgttatatccctctcttgccttccgaaaagagcagcaaaatcaaataaggttgatttaaacccagcttctttatcgcagagcttcttcctttctgttcttatctttttgatcaagtctctgcttgataatggcaactaggcttcaatttgaaaattcatgtgacgttggtgtcttttccaagctgaccaatgcctactgcttggttgcaattggagggtcagaaaacttctatagtacttttgagtcagagctggcagatgtcattccagttgttaagacctctattgctggcaccagaataataggacgtctatgtgctggaaataagaatgggttacttgtaccccacaacacgaccgatcaagaacttcaacacttgcggaatagtctaccggatcaagtcgttgttcggcgcatagaggagaaactatctgctcttggcaactgtatagcttgcaatgaccatgttgctctgacacacactgatctagacaaggaaaccgaggagataatcgctgatgttctcggcgtagaagttttcaggcagacaattgctggtaatattcttgtagggagctactgtgccttttctaacagaggtggcttggtccatcctcatacatccattgaagacttggatgaactttcaacgcttcttcaggttccattggtagctggcactatcaaccgtgggagcgaagtgatagccgctgggatgaccgtaaatgactggacggccttttgcgggtcagacaccactgcaacggagctttccgtgatagagagcgtgttcaagttgagagaagcgcacc

SEQ ID NO: 2345 - DNA, 1069 bp, Cajanus cajan
acgatattacttctcacctaaccttctcttcctccgcccgccatgaccttccacaagatcaccgtcgccaaccccatcgtcgagatggacggttacttcggttaaagatttctggaatagtggaatctttgtcatggcaactagacttcagtttgagaattgttgtgaagttggagtgttttcaaaacttaccaatgcatattgtttggttgctattggaggttctgaaaacttttacagctcatttgaagctgagttagcagatgttatcccagtgatcaagacctccattagtggcattcgtacagttggtcgtctttgtgttggaaacaagaatgggcttctcttgccccataccaccacagaccaagagcttcaacatttgagaaacagtctacctgatcaagttcttgttcagcgtattgatgaaagattaactgctttgggaaattgtatagcatgtaatgaccatgtggccttgacacacattgatcttgacaaggaaactgaggatatgattgcagatgttcttaaagtagaagttttcaggcagactattgcctctaatatcattgtaggaagttactgtacattttccaacagaggtggtttggttcaccctcatacatccattgaagaattggaggaactttctacacttcttgatgttcctttggtcgctgggactgtcaatcgtggcagtgaattactagctgctggcatgacagtaaatgattggatagcattttgtggttcagacactacagctacagagctctctgtgattgagagtatcttcaagctgagagaagtccaacccggtgtcactatgcatgagatgaggaaatcactctttgatagctttctctaattttttttatagaattataattaaaaattcattttgaagtaagatgattttgtttgaacttgaaaaaacataggctagcctatacatgtgttcttaatttttttagctttagttaatcttttatcatctaaaaaattaaatttagttgttttaaaagtgtacacgtggactctaattttttttaaaattgctttaatt

SEQ ID NO: 2346 - DNA, 967 bp, Arnica chamissonis
tttgctatttgactttatcccaattattcaagatttttcgatcttcgtcgtgctcacaggttccttgcatccagaaccattttccatccatctacttgtcatttcaccatggctacaaggatacgatttgaaaattcatgtgaaattggtgtattcacaaagctgaccaatgcgtactgcctggtagcaactgaaggctctgaaagcttctacagtgtttttgagtctgagttggctgatgttattcccgttgttagaacttccattggcggtacaaggataattggaagactttgcattggaaataaaaaaggccttctcttgcctcatactactactgacgaagaacttcaacacttgaggaacagcctgcctgatacggttgttattgaacgtattaacgagaagttatctgctcttggtaattgtatggcatgcaatgatcatgttgctcttacacatactgatcttgataaggaaacagaggaaatgatagctgatgttcttggtgtggaagtttttaggtcagacaattgcagggaatgttcttgtgggtagttattgtgcattttcaaatagaggtgggttggttcatccccacacatcagttgaagacttggatgagctatcaaccctcctgcaggtccctatggttgcaggcacggttaaccgtggcagtgaagtgattgcaggtgggttaaccgttaacgactggactgcattttgtgggtcagacactactgccacagaactctcagtgattgaaaatgttttcaagctgagagaagctcagtctaatgctattgctgacgaaacaaggaagtcgttcgttgccacgtacgtttaaaatcaaaacaaaaacttgctatatgttacttttcatttgctttgtatgttgttgaaagttcttgttgtctctctctatatgttcaacgtttgtgttcaattcagttttcatgttatctcc

SEQ ID NO: 2347 - DNA, 976 bp, Ambrosia trifida
ttcaaatccattgtcaattcttctaagatctttcacggatatcttgactggctgtggttgaaggttctttggattaacttggctttttaccatggctacaaggctccggtttgaaaactcatgtgaaatcggtgtattcaccaagctgaccaattcttactgcttggtagctaatgaaggctctgatagcttctacagcgttttcgagactgagttagctgatactattcctgttgttaaaacttccattggtggtacaaggataatcggaaggctttgcattggaaataagaaaggccttctcttgcctcataccactactgatcaagaacttcaacacttgaagaacagcctgcctgatgcagttgttgttcaacggattaacgagaggctatcggctcttggtaattgcatggcatgtaatgatcatgttgctcttacgcataccgatcttgacaaggaaacagaggaaatgatagctgatgttcttggcgtggaagtttttagacagacaattgcagggaatgttcttgtggggagttactgtgcattttcaaacagaggtgggttagttcatccgcacacatcagtcgaagacttggaagagctgtcaaccctcctgcaggtccctttggttgccggcacggttaaccgtggtagtgaagtgatcgcaggtgggttaaccgtcaatgactggactgcgttttgtgggtcagacactatggccacagaactctcagtgattgagaatgttttcaagttgagagaagctcaatctagtactgtcgctgacgagacaaggaagtcgttagtttccacatatgtttgaatcgaaatgaaaacttacattgtcaccttttttacgcgttgtatgttgtttaaagttcatgttgtctgcctttatatgttcaactttttgttcaattcagttttcatgttgtatgtctccttgtaatactctaatatcactcgtctt

SEQ ID NO: 2348 - DNA, 1226 bp, Cirsium arvense
caacacacaagtggggtagtgggataccctagacgaatcccctctttttaaacccctaattcccaataaaccaataggtcttcctgtttgaatttctcgcaattgatcaaaggtttttcgatcttcttcgtatttacgggctcattgcttctgaagccattttccatccatcaacttctcattaaacatggccacaaggctacggtttgaaaattcatgtgaaattggggtgttcacaaagctgaccaatggttactgcctagtagctaatgaaggctctgaaagtttctacagcatttttgagtccgagttggctgacattattcctgtggttaaaacttctattggtggtacaaggataattggaaggctttgcattggaaataagaaaggcctgctcttgcctcatactacgaccgaccaagagcttcaacacttgaggaacagcctgcctgatgaagttgttgttcaacggattaatgagaagttatctgctcttggtaattgcatggcatgcaatgatcatgtcgctcttacccatacagatcttgataaggaaaccgaagatatgatagcggatgttcttggtgtagaagtatttaggcagacaattgctggcaatgttcttgtgggcagctattgtgcattttcaaatagaggtggattggttcaccctcacacatccgtcgaagatttggatgagctctcaaccctcctccaggtcccattggccgctggcaccgtgaaccgcggtagtgaagtcatagccggtggcttaatcgtaaacgattggacggctttttgtggttcagacactactgcaacagaactctcggtgatcgagaatgttttcaagttaagagatgcccaatcgaatgatattgccaatgagatgaggtcgttaatcgacacacatggttgaaccccgacgattatctgtatgatgttgctatacacgtatctttttatatattccgtttttttatgttgctatatgttaaacttttgttttttggtaatagattcaaatgagatggtaagctttgaatgtaaatcaccataggggtgttaaaaaagactttcgagttgaaatgaaaaacaagaaccagaaaaaagggtaaatacgtgtattgtagtttggtttcggttttgtataagtttagtgttatacataatgttcgtatctcggtttggtattaaaaaagtaaaaaagtaacgaactagcg

SEQ ID NO: 2349 - DNA, 1075 bp, Taraxacum officinale
tcggcggggatcttttcatttttcaagccctaaattgattcacacaactcctgtttaccttctgtatctgaatttatcgcgatcgctcaagagccttccctcttcgtcgtattcacaggcatcttcctcctgaaaagccattttccaaacatctccttctcattcaccatggccacaaggctaaggtttgaaaactcatgtgaaattggggtattcacaaagctcaccaacgcttactgcttggtagcaacagaaggctctgaaagtttctacagcatctttgagtctgaattagccgatgttatacctgttgttagaacaaccatagctggcacacgaatagttggaagactttgcatcggaaacaagaaaggccttctcttgcctcacactaccaccgacgaagagcttgaacacttggtgaacagcctgccggattcagttgtagtaaaaaggattaacgagaagttatccgcacttggtaactgcatggcgtgtaatgaccatgttgcccttacacataccgatctagacaaggaaacagaggaaatgatagcggatgtattgggtgtggaagtatttaggcagacgattgcgggaaacgtactagtggggagttattgtgcgtttacaaatagaggtggtctggtgcaccctcacacatctgttgaggatctggatgagctgtcgacactcttacaggtgcctttggttgcggggacggttaaccgggggagtgaggtgatagcgggtgggttaaccgtgaatgactggaccgcgttttgtggttcggatacgactgcaacagaactttcggttattgagaatgtttttaagttgagggaagctagacccgaggctattgctgatgagatgaagaaatccttgattgatacttatgtttgaaatgatttcggtaaaatgatatgttcaaagtttcatgttgtttgtcttcttttttttttattgtattcagttttcgtgttactatatgcttgacttgtttttttttggtataagatgtaatgacacggcgagtccatgaatggatacctttaagaagcttttgttttat

SEQ ID NO: 2350 - DNA, 1038 bp, Flaveria ramosissima
aacagcaattactcgtaattcctactttttaagccctaaattcccttcacccagatcctgttatctgaatctatcgcaattgttcaaatttttttgccctttgtcacgtcatcttcacaggtttctggcatctagaaccattttacatccatttggttgtcatttcaccatggctacaaggctacggtttgaaaactcatgtgaagttggtgtattcacaaagctgaccaatgcttactgcttggtagcaactgaaggctctgaaaacttctacagcgtttttgagtctgagttgactgatgttattcctgttgttaaaacttccattggtggtacaaggataattggaaggctttgcattggaaataaaaaaggccttctcttgcctcacactactactgaccaagaacttcaacacttgaggaacagcttgcctgatgcagttgttataaaacgtattaacgagaggttatctgctcttggtaattgcatggcatgcaatgatcatgttgcccttacacatactgatcttgacaaggaaacagaggaaatgatagctgatgttcttggtgtggaagtttttaggcagacaattgcaggcaatgttcttgtgggaagttattgtgcattttcaaatagaggtgggttggttcatccccacacatcagttgaagacttggatgagctgtcaaccctcctgcaggtccctttggtcgcaggcacggttaaccgtggtagtgaagtcattgcaggtgggttagccgttaatgactggactgcattttgtgggtcagacactactgccacagaactctcagtgattgagaatgttttcaagttgagagaagctcaatccaatgctatctctgatgagacaaggaagtcggtagttccgtcgttatgtttaaattactaaaatactaaaacttaatagttgttactttttcgttgtttgtagttagttgttaaagttactatggttcttcttctctcctatactacatttgtcatattgtttcggtttcctgtggggtggtg

SEQ ID NO: 2351 - DNA, 1404 bp, Ceratodon purpureus
agagagcgttaaaccctaaacctaaactcagcacagcagaggaggagccatttccaaggccctcactgttggcattcctccgcaactcttgtgcttcctgctgctgctcttgctgttggagaggcttcacctccacagtcccttcctccgcttcgcttctccacatcgttgctgcatcgcacgcaagctcgtcttccaccatggcgaccagggctcagtttgagaatagtaatgaaattggagttttctcgaagctcacaaacgcgtactgcctggtggcgattggtggttctgagaacttctacagcacattcgaatcagagttagcagatgttattcctgtagtgaaggtttctattgctggtactcgagtaataggccgcatgtgcgtcggtaacaagaatggtctgctccttccacaagcaaccactgatcaagagcttctgcacataaggaattgcttaccagacagcgtggtggttcaaagagtagatgagcgtctttctgcgcttggcaactgtattgcatgtaacgattatgtgtcgctcattcacacggatctggacagggaaacagaagaacttattgccgatgttctgggagtcgaagtattcaggcaaactattgcaggcaacatccttgtagggagttacagtcaattcactaaccgtggtggattggtgcacccacatacctcaatagaagatctggatgagttgtcatcactgctacaagttccacttgttgccggtaccgtaaacagaggaagtgaagttattggtgccggattggtggttaatgattggactgctttctgcggactggacaccacagctacagagctttccgtgatcgagagtgtgttcaaactgcgtgatgcccagcctagtaacatcgtcaatgaaatgcgggcttctcttatcgacactatgtcatagatcaacattagtcggctacctccctgcacctccgcactctgtcgcttggtgcttgtactgcgtacctcttctctgtcactaccttctatcagattttcttggacgctacgttgatctcccaagggcatttgtgattaacctacaagaatcgcattcataagctaccttggaaggtgacgtttatcctggacgagtgtacaacctgcacctgcttcctcccaagttttgtggagtatgtatctttactatatagatttactactgcacatgctttcttgggcatctacttcacagtccaacacacgtctgtgagataggcagttttgcgtgatatttgactaagttttgagtgacatatgatatcatactctacagtctctttatgatcgtgcttctccagcattctcagtttccgtacttgtacacagtctgttcaatattggcagaagaactttgataaggacaa

SEQ ID NO: 2352 - DNA, 796 bp, Olea europaea
tcgggggtatttctagacaaattagtttgaatccataatctattttacaccacaaacgtttcatccttcgacccaatcaatctcgatggcaactagattgcaatttgagaacaactgtgaagttggtgtttttttccaagttgaccaatgcatattgtttggtcgcaattggggttctcaaagcttttacagcacctttgaggctgaattggcggatgttattccggtggtcaaaacctcgattggtggcactagaattataggacgcctatgtgctggaaataagaatgggctactcttgcctcacaccaccaccgatcaagaactgcaacacttgaggaacagtctgccagattccgttgttgttcagcgcattgaggagcgattatctgctctggggaactgcattgcatgcaatgatcacgttgctcttacacaccctgatctggacaaggaaactgaggagatgattgcagatgttcttggggtagaagttttcagacagacagttgctggtaatatacttgtgggtagttactgtgcattttctaacagaggtggcttggtccatcctcatacatctatagaggacttggatgaattgtcgacccttcttcaggttcctttggtggctgggaccgtgaatcgtggaagtgaagtgatagccgctggcttgacggtcaatgactggacagcattttgcggatcagacacaactgcaacggaattatcagtaattgagagcgtcttcaagttgagagaagctcaacccagtgctctcgtcgatgagatgaag

SEQ ID NO: 2353 - DNA, 1126 bp, Physcomitrella patens
aacccgaattcatcatctctgtgcgattgatgtgtatcggctccgacattgaacttctgtatttcgaagacccttttccgaagctgtgtcgctttcagatttcgacagtgaaactcgaagttagatctttggataccccagaatggctactagggttcagtttgagaatagcaatgaaatcggagttttttcaaagctaacaaatgcctactgcttggtagcaattggtggctctgaaaacttctacagcacatttgaagcagaattaggtgatgttattcccgttgtgaaggcctctattgctggtacccgagtaataggtcgtatgtgtgttggtaataagaatggtctcctccttccacaagcaaccactgatcaagagctactgcatataaggaattgcttaccagacagcgtggtcgttcaaagagtggatgaacgtctctcagcgcttggaaattgtatcgcttgtaatgactatgtgtcgcttattcacactgatctggatagggaaacggaagaacttgtagcagatgtcctgggagttgaagtattcaggcaaaccattgctggcaatattcttgttgggagctattgtcaattcactaatcgtggtggattggtacacccacacacatcgatagaggatttggatgagttgtcatcgttattacaagtgccactcgtggctggtactgtaaacagaggaagtgaagtcattggtgctggtttggtggttaatgactggactgctttctgtggattggacacaacagctacagaactctctgttatagagagtgtgttcaaactccgtgacgctcaacccagtaatattgtcaatgaaatgagggcttcccttatcgacaccatgtcatagaaatagacaaatcctctcttcacttctcattattgtactactttttctttactgttaaacttcgtcatttcggaccatattttcctcagtaccatacatctcgaggacctgtaatccattgtgatacttatctggatcgtgttcgagtgtttttcaaagcttttatccattcattaggaatgtatgattcagacctactttcttgtaagttctgtggagcatattattacgagacctagtccccac

SEQ ID NO: 2354 - DNA, 820 bp, Cichorium intybus
gacacatcttctccttaagcaaatttccaactactacttttctgatggccacaagacttcagtttgagaattcatgtgaaatcggggtgttctcaaaactcacaaatgcttactgcttggtagcaattggaggctctgaaaacttctacagcacatttgaatcagagttagcagatgtcattcccgaggttaagacctccattggtgggacaagaataattggaaggctatgcattggtaacaaaaacggccttcttatacctcatactactacagaccaagagcttcaacacctgaagaacagactccctgatgccgatgttgttcaacgcattgacgagagactatctgccctcagaaatagcatcgcgtgcaatgaccatgttgcccttacccataccgatctcgacagggaaacggaagaaatgatagcggatgttcttggaatcgaagttttccggcaaacaatcgccggaaatattcacgtgagcagttactgtgcgatttccaatagaagtggcctggttcatccgcatacatcgattgaagacttggatgagctgtcaactctgcttcaagtcccgatggtagcaaggacggttaaccgcggaagtgaagtgataacagcggggttaaccgagaatgactggaacgcgttatgagggtcggacacgacggctacagaattgtctgtgatcgagagcgtgtttaagctcagagaagctcagcccagtgccactgttgatgagatcgacgagtcattgctcgacacatatgtctgagtcataatcagaactatactcgctttaatacactctat

SEQ ID NO: 2355 - DNA, 1074 bp, Physcomitrella patens
atactctgattctgctcgcaaccaagcaaataatccccctttgaattcgctccctaacttggcgagtctgcgtaggcgagctgtcgaaattcgttttacagtgttgcgtaagtggttgcgtaagggcagctgagagtgagattcgcagcctggttgtcggctgttagttcaagatggctaccagggcccagtttgagaacagtaatgaaattggagtattttcaaagctcaccaatgcttactgcctcgttgcgattgggggttccgagaacttttacagcacatttgaggcagagttacaagatgttattcctgtggtgaaggcttctatcgcgggtacccgagtgattggccgtatgtgtgttggtaacaagaatggccttcttcttcctcaagcaactactgatcaagagcttttgcacataaggaattgtttaccagacaaagttgtggttcaaagagtagacgagcgcctttcggcccttggcaattgtatcgcatgtaacgattatgtgtcgctcattcataccgacctcgatagggaaaccgaagaacttgtagctgacgttttgggagttgaggtattcaggcaaactatagcaggaaacatccttgtaggaagctacagtcaattcactaatcgtggcggattggtgcatcctcatacctcaattgaagatttggacgaattgtcatcactattacaagttccacttgtagctggtactgtgaatagaggaagcgaagtcattggagccgggttggtagtaaatgactggactgctttttgtggactggacacaacagccactgaactatcggtgatagagagtgtgtttaaactccgtgatgctcagcccagtaacatcgtcaacgaaatgcgggcctctctcattgataccatgtcatgaggtcgccttcctctttattttttatcacgtgtactgcatactttttctgtgtcactttcgaatcagaatttcttgtgccctgcatatatccaagggaaaaggacgcccacttgctctgagattcttgttatattgtttacacttacaactttcgcttatgccg

SEQ ID NO: 2356 - DNA, 837 bp, Raphanus sativus
ggagtgttaaaaaggcaaacccttttcttcatcataaacctttaactccatttgttccctcttcctccgccgtttcatccctctcccaagtttacgttagcaaagtttctacctttatccactccatggccacccgtcttcagtttgagaacaactgtgaagttggtgtcttttcgaaactcactaatgcctattgcttagttgctattggaggctctgagaacttttacagtgcatttgagtcggagttagctgatgttatccctattgttaagacctctattggaggaacacgaatcattggccgtctatgcgctggaaacaagaatgggcttcttgtgcctcatacaactactgaccaagagcttcaacacttgaggaacagtctacctgatcaagttgtggtccagcgaatcgaggagcgtctctctgctcttggaaattgcattgcctgcaatgaccatgttgctcttgctcacaccgatcttgacaaggaaactgaggagataatagctgatgttcttggtgttgaagttttccgtcagacaattgcaggcaacattcttgtgggcagctactgtgccttgtccaacagaggtggcattgttcatcctcacacttctgtggaagacttggacgagctctcgacactacttcaagtcccactcgttgcacgaaccgtgaaccgtggtagtgaagttataggtgcgggaatgaccgtcaatgattggacttctttctgcggttcggacacaaccgcaacagagctgtctgttatagacagcatcttcagctaaggagcccacctagctctattgtcgacgagatgaggaagtc

SEQ ID NO: 2357 - DNA, 894 bp, Antirrhinum majus
gatatttttccagccgcgaaaacaaagctatctccaatcaaccatggctacaaggctgcagtacgagacaatagcgagattggggttttctccaagctcaccaacgcttattgtttggtggcaattggaggttccgaaaacttttacagcatattcgagagcgagttggctgatgttattccggtggttaagacctcaattgcaggcactagaatcatcggccgcctttgtgctggaaataaaaatggattgcttttgccgcacaatactactgatcaagaactgcaacatttaaggaacagtctaccagattccgttgttgttcagcgcattgaggagagattatctgctctagggaactgtattgcatgcaatgatcatgtggctctcacgcatcctgatcttgacaaggaaactgaggaattgattgctgatgtccttggggtagaagtttttagacagacaattgctggcaatattcttgtgggcagtttctgtacattttccaacagaggtggcttggtccatcctcacacatctattgaggatttggatgagctctcgacactccttcaagtcccattggtggccgggactgtgaatcgtggtagcgaagtgatagcagctggcttgacggtgaatgactggacagggttctgtgggtcagacacgactgctaccgagttgtcggttattgagagtgttttcaagttgagagaagctcaacccagtgcccttgttgatgagatgagaaagtcattgattgatacctatgtttaagttctacaactttaaaactttaacttgtatgcgtggatgataaatttcatgttggaattgagctttccatgttgtttgaagttattcagttttatggaaaattgccgtgctagt

SEQ ID NO: 2358 - DNA, 830 bp, Pennisetum glaucum
ggctgagcttgcagattccattcctgtggtcaagacctctataggtggcaccagaataatcggtcgtctctgtgttggaaacaagaatggacttctattgccgcataccaccactgaccaagagcttcagcatctgaggaactgcttgcctgatcaagtcgtggtacagcgtattgatgagaggttatcagcccttggcaattgcatagcctgcaatgatcatgttgcccttacgcaccctgaccttgacaaggagacggaggagcttattgcagatgtgcttggggttgaggtattcaggcagaccattgctggaaatatccttgtggggagctactgtgcgttctctaacaggggtggcttggttcatcctcacacatccattgaagaccttgatgagctctccactctcctgcaagtcccgctcgtcgctggaactgtgaacagaggcagtgaggtcattgctgcaggcatgactgtgaacgactggactgccttctgtggctcagacacgacggccactgagctctcggtcattgagagtgtcttcaagctgagagaaggtcagcccaccgcaattgttgatgacatgaggaagtctctgatcgacagttatgtgtaactgaggccctgcagatgtgggtctcaagtactacctgtgccaaggtgcaccgtgagctatacttttgtatcagtagtagaaccaaaacgtatccttggcttctgaatcgtagacctgatgttttactatgctccattaaggccatggtatactagtaagaagataacactaaagctcttcgttatgttatatgatgatgttacgtgca

SEQ ID NO: 2359 - DNA, 820 bp, Selaginella moellendorffii
cctcgctgccttggcggtgaagcaagcgtgcctgagcgagaacaacgccaaaacaatggcgacgagggcgcagtttgagaacagcagtgacattggcgtcttctccaagctcactaatgcctactgcctggtagcgattggaggatcagagaatttctacagcaccttcgaggcggagctagccgaccacattcccgtagtaaaggtgtccatctctgggacaagagtgattggaaggatgtgtgtcggaaacaaaaacggcttgctactcccaaactcgacgaccgatcaagagcttcttcacattcggaactctcttcccgaccgtgttgtggttcaaagggtggatgaaaggttgtctgctttgggaaactgcattgcaacgaatgactacgtttctctcgttcacacggacttggacaaggaaaccgaagaactcgtggccgatgtgcttggagttgaagttttcaggcagaccatcgctgggaacgtcttggttggaagctacggcgtcttctcaaacagaggtggactggtgcatcctcacacatcgatcgaagatctggacgagctatcgtcgctgttgcaagtcccgctggttgcaggcactgtcaaccgcgggagcgacgtgatcggcgctgggctgatcgtgaacgactggacagccttttgcggcctcgacaccaccaccaccgagctctcggttgtggagagcgttttcaagctccgagagtctcaacccagtgccattgtcaacgagatgagagcttcgctcatcgatacgcttgcctgagaactgaaaaaaaaaaaaaggaaacta

SEQ ID NO: 2360 - DNA, 776 bp, Populus trichocarpa
gtgcgctgcgtaatgggtgaatttgtgcaggacttcagtttgagaataattgtgaagttggtgtgttttctaaggtgaccaatgcgtactgcctagttgctattgactgcaattgtatggtgttttgcggcacttttgaggcagagttagctgatgtcattcctgttgttcagacctcaattgctggcactcagataattggacggctatgtgctggtaacaagaatgggcatcttgtgcctcataccaccactgatcaagaactccaacacttgagaaacagtctacctgatcaaatagttgttcaacggattgaggggaaaatatctgccctggggaattgcatagcatgcaatgatcatgttgcccttgcgcacactgacctttacagggaaaccgaggagataatagctgatgttctaggggttgaagtttttcggcagacaatagctggtaacattcttgtggggagctactgtgccatctccaacagaggtggtttggtccatcctcgtacatccattgtagacctggttgagctttctacccttctccaggtccctttagttgctggtactgtaaaccgcggcagcgaagtgatagccgctggaatgacagtaaatgactggacatccttttgtgggtcggacactacatactgaactatctgtcattgaaagtgtcttcaagttgagagaatcccaacctagcgccattgttgatgagatgaggaaatcattaattgacagttatgttcgacttgacattagccattc

SEQ ID NO: 2361 - DNA, 940 bp, Parthenium argentatum
cagcttctgtggtttaaactcatcgaaattcttcaacatctttcactcttcatcatcttcacagatttcttgactggttgtgtttgaaggttccttggatctacttgtctttttaacatggctacaaggctacggtttgaaaactcatgtgaaattggtgtattcaccaagctgaccaactcttactgcctggtagcaaatgaaggctctgatagcttatacagtgtttttgagtccgagttagctgatactattcctgttgttaaaacttccattggtggtacaaggataatcggaaggctttgcattggaaataagaaaggccttctcctgcctcatactactacagacgaagagcttcaacacttgaagaacagcctgcctgatacagttgttgttcaacggattaacgagaggttatctgctcttggtaattgcatggcatgcaatgatcatgttgctcttacacataccgatcttgacaaggaaacagaggaaatgatagcagatgttcttggtgtagaagtatttagacagacaattgcagggaatgttcttgtggggagttattgtgcattttcaaataaaggtgggttggttcatccgcacacatcagtcgaagacttggaagagctgtcaactctcctgcaggtccctttggttgcaggcacagttaaccgtggtagtgaagtgattgccggtgggttaaccgttaatgactgaactgcattttgcgggtcacacactacagccacagaactctcagttattgagaatgttttcaagttaacagaagctcagtctagtgctgttgccgatgagacaacgaagtacttagtttccacatatgtttaaatcgaaacttaaacttatgttccttgtttttcactttgtatgttgttgaaagttaagctgtctctatatgttcaacttgtgtgat

SEQ ID NO: 2362 - DNA, 1035 bp, Guizotia abyssinica
aaaatcaaattattggtaaatctctctctgtacttttaaagccctaattccgttcattcagcttctgttaattgatttcatcgcgattgttcgataattctcgctcatcgtcgtcttcaaaggttctttgcatctagaaccatttcacatcaatctgcttgtcattttcccatggctacaaggctacggtttgaaaactcatgtgaaattggtgtattcacaaagctgaccaatgcttactgcttggtagcagatgaaggctctgaaagcttctacagcgtttttgagtctgagttggctgatgttattcctgttgttaaaactgccattggtggtacaaggatcattggaagactctgcattgaaaataaaaaaggccttctcttgcctcatactactactgacgcagaacttgaacacttgaggaacagcctgcctgatgctgttgttgtaaaacgtattaacgagagattatctgctcttggtaattgcatggcatgcaatgatcatgttgctcttacacataccgatcttgataaggaaacagaagaaatgatagctgatgttcttggtgtggaagtttttaggcagacaattgcagggaatgttcttgtggggagttattgtgcattttcaaatagaggtgggttgggtcatccccacacatcagttgaagacttggaagagttatcaaccctcctgcaggtccctttggttgcaggcacagttaaccgtggtagtgaagtgattgctggcgggttaactgttaatgactgggctgcattttgtgggtcagccccccctcccacagaactctccgtgatcccccatgtttttaagttgagagaagctcaatctaatgccatcgcggatgaggcaaggaagtcgttagttgccacttacgtttaaatcgctatgaaaaacgtactatgttctgctttgtatgttgttaaaattttgtgttctctctctatatgttcaacttttgtgttcaatacattttcatgatgtatatcactattcatatatgtttca

SEQ ID NO: 2363 - DNA, 1026 bp, Fraxinus spp
cgaaaacctgtctcaaacctaatccttcccagaaaccctaagcctttgaatcgtttatcgcttacgctattgtatcgattcagacaaattagtttgaatccataatctactttacatcacagacctttcatccttcgatccaatcaatctcgatggcaactagattgcaatttgagaacaactgcgaagtgggtgttttttccaagttgaccaatgcatattgcttggtcgcaatcggggggttctgagagcttttacagcacctttgaggctgaattggcagatgttattccggtgatcaaaacctccattggcggaactagaattataggacgcctttgtgctggaaataagaatggactactcttgcctcacactaccaccgatcaagaactccaacacttgaggaacagtctgccagattccgttgttgttcagcgcattgacgagcgattatctgctcttgggaactgtattgcatgcaatgatcacgttgctcttacacaccctgatcttgacaaggatactgaggagatgattgcagatgttcttggggtagaagttttcagacagacggttgctggtaatatacttgtgggtagcaactgtgcattttctaacagaggtggcttggtccatcctcatacatccatagaggacttggatgaattgtcgacccttcttcaggttcctttggtggctgggactgttaatcgtggtagtgaagttatagctgctggtttgactgtcaacgactggacagcattctgtggatcagacacaactgcaacagaattatctgtaattgagagcgtcttcaagttgagagaagctcaacccagcgcacttgtcgatgagatgagaaaatcattgattgacacctatgtttgagtttcgtttcaagttaaatgtgtggatgactatactgcacttttaccatggttttaattagttttcagacttatggaagagagattttgatctgtattatgacatgcaagttaatatttcatgcatctgttgttt

SEQ ID NO: 2364 - DNA, 826 bp, Selaginella moellendorffii
ctgccttggcggtgaagcaagcgtgcctgagcgagaacaacgccaaaaccatggcgacgagggcgcagtttgagaacagcagtgacattggcgtcttctccaagctcactaatgcctactgcctggtagcgattggaggatcagagaatttctacagcaccttcgagtcggagctagccgaccacattcccgtagtaaaggtgtccatctctgggacaagagtgattggaaggatgtgtgtcggaaacaaaaacggcttgctactcccaaactcgacgactgatcaagagcttcttcacattcggaactctcttcccgaccgtgttgtggttcaaagggtggaggaaaggttgtctgctttgggaaactgcattgcaacgaatgactacgtttctctcgttcacacggacttggacaaggaaaccgaagagctcgtggccgatgtgcttggagttgaagttttcaggcagaccatcgccgggaacgtcttggttggaagctacggcgtcttctcaaacagaggtggactggtgcatcctcacacatcgatcgaagatctggacgagctatcgtcgctgttgcaagtcccgctggttgcaggcactgtcaaccgcgggagcgacgtgatcggcgctgggctgatcgtgaacgactggacagccttttgcggcctcgacaccaccaccaccgagctctcggttgtggagagcgttttcaagctccgagagtctcaacccagtgccattgtcaacgagatgagagcttcgctcatcgatacgcttgcctgagaacttaaaaaaataaaataaacaaagctttggttttc

SEQ ID NO: 2365 - DNA, 2809 bp, Brachypodium distachyon
cgcttttggtcctgctgtgccgcaggtctcaagttcgagaactcgtgcgaggttggcgtcttctcgaggctcaccaacgcctactgcctcgtcgccgccggcggcgctgagaatttcgtcagtgtgtttgaagccgagctcgctggcgtcatcccggtggtcagggcgtccatcggcggcaccaggatcgtcgggagactctgcgtcggcaacaaaaacgggcttcttctgccacataccaccaccgaccaagagctccagcacctgaagaacagcctgcctgatcaggtggtcgtccagcgcatcgacgaacgcctctctgccctgggcaactgcattgcttgcaatgaccatgttgctctcacaaacccagatctcaccaaggaaaccgaggagctcatctcagacgttcttggagtggaggtgttcaggcagacgatcgctgggaacatactggtggggagtttctgcaccttttccaacaaagggggacttgttcacccgcggacgtcggtggaagacctggacgagctgtcgacgctgctacaggtgcccctcgtggccggcaccgtgaaccgggggagcgaggtcatcgcgagcggcatggcggtcaacgactgggcggcgttctgcggctcggacaccacggcgaccgagctctcagttgtggagagcgtcttcaggctgagagacggacgacccggcgctcttggcgccgacgtcaggaagtccttggttgagagctgctttgtttagtcttcttgccagcatgacttctcccttgctgtatcttcactattacgactgctgctgcatcagaagatatgtgttcccgtccattaatcctgtcaggatgatacgaacgaagatcgtctactttgcagacctggaattttcccagtcaagtttagctcaaggacaagactcgttctgatgccaaatgctgattgcagagttcacatttaatgtcaagtagtattacgtgctttacaaacctggaaaaccttcccaaatcaagttgaaaggatgactcgttctaactagcaattgttacttgcagagttcatttatttctccagagttattagtacaaggcaaatattgcttttacaaatagacagcttaagtacagttttgtaggagaacgaacttcagatttggtcaagattccaacacaattcaatctggatcgaaattaaggaatatgtacaggcaaagaaagtgagcaaaggtagtcctgattgctatcaggtcaaagaaatagagataaacttaaggagtaactgaatattctagggaagcagcttcagtatatctattcctgacgcgaagttcagtaatgcatgagaatacaaaatgcaaacactagtagttcgttccatgactaagacattattatcgcatcacatactttggcagaaaaccataagaaacatcatatcgcatggtgacaaagtatgggcctaaagcatcccagatcctattcaagtatgtcagatatcgacttcttcttgttgaatggatcggttgcggcaagtaaagatgcgatgacactgttggggaaaatgttatcagccttcatcctctctctaaatccataaacaggggcctttgcatgcaaatacgcatgaagcagcagctggtactgtctgatcctcccattataacccatctgccgcaacttgctgaacaccttctctgaattgtggacatctcctatttttgaataactatcaagcaacattagatatgagctgtactgaggcttcattttgtttttcactgataacttgtgcagtaaggattcagctttttcaacttctccagcatctacatagagcttcacaagcgaatccaatgttgagatccctaatctgcaaccatcctcctccatccgctttgctagctccttgcccttgtccataaggttttgattggcatacaccctcatcatggcattgtagtatttggaagagagtgttttccatgtcttgaacatattcccaaacacttcctcagccttctcaacatctccaagcctaccaaaagcctcaatagctgataagcactcatctagacgagtattagactggcacaccttccaaatcctctccacatcatccttttttccaagaaatgcatataaaggcattaccatcttgcaagcattacggttttctttcatatcaccctccatcgactccaaaattgcttcagctttctcacggtgaccaccaaatatgtagtgctttgcaattgtggcttgaagcagaagatctggcgtgataccttctgcttccattgactgaacaactttttccatgccttcaatatctcttgatgcgcctttagtgtctacaagaagcttataagtgaagagggatggcttcacatcctccttctccatcattgtgagaacatcgctaatcttcttcttgtccacccttttgtacagtagcaggagctgattgatagcaaatactgtaactgggaacccaagatccttcatcttattgaagacttcctctgctttttttacatttacttcagccacacaattagctagaagagtcctgtatactatctcacccctaagagatgcaggaatattatcaataaacttttcagctttgtaaatcccatggactttagccatcaaatcaagacgtgaagcataatcacgttctacaagttcaattagtttggattcttcaagccattccaggagctgcgtaaaaataatgaacagattatcttccaagtcatacaacaaacatgctggggtaaagcgactatcatgaaagagcaa

SEQ ID NO: 2366 - DNA, 811 bp, Cleome gynandra
ttggaggctcggaaaacttctacagtgctttcgaggcggagttggcagatgttatccccattgttaagacctcaattggcgggacacgaattattgggcgtctttgtgcgggaaataaaaatggacttctcgtacctcataccactaccgaccaagagcttcaacatttgcggaacagtctccctgatcaagttgtagtccagcgaattgaggaacgcctatctgctcttggaaattgcatagcctgcaatgatcatgtcgcacttgctcacactgatcttgacagggagaccgaggagattatagctgatgttcttggggtagaagttttccgacagacaattgcaggaaatattctcgttgggagctactgtgccttctccaatagaggcggattggttcatcctcacacctcagttggagatttggacgagctctcgacccttcttcaggttcctctggttgcaggaacggttaaccgtggtagtgaagtgatagctgcgggtatgacagtgaacgactggactgcattctgcggttcggacacaacggctacagaactctctgtcattgacagcatcttcaaactgagggaggctcagccgagctctatcgtggacgaaatgcggaaatctttgatcgacacttatgtctgagttttgcatctcgtgcttgttctgggaacactctgtggtcaggtgatacaacgatacgtatagtgtttttatgccaaagggttttcatacattttgttatgttatagctgcgaccagattaacatatctatgcttatgttgcaagaattcccatg

SEQ ID NO: 2367 - DNA, 901 bp, Petunia hybrida
acgcggggcagtttcagccgccgagtgagagttcaaagtccaataatatcttccaagctcctagcagtcctgtttctttcagctggcaatggctattaggcttcaatttgagaattcatgtgaagttggagttttttcaaagctgaccaattcatactgcttggtggctattgggggttctgagaacttctacagcgtgtttgaggatgcattaccggaaaattttccagtgatcagaacctccattggaggaacgaggataattggaagactctgtactggaaacaaaaatgggcttctcttgcctcacactactacagatcaagaacttcagcacttgaggaacagtctgccggatggagttgtggttcagcgcattgaagagcggttatctgcccttggaaactgcatagcatgcaatgatcatgttgctcttgcacatacagatcttgacaaggaaactgaagacatgattgctgatgttcttggtgtggaggttttcaggcaagcaatagcagggaatattcttgttggaagctattgtactttatccaacttgggaggcttggtacatcctaatacatctattgaagacaaggatgagcttgcagatctccttcagatttctctggcagcaggaaccgtgaaccgcggtagtgaagtaatagctgctggattgactgtcaatgactgggcggcgttttgcggctcagacactactgcaacagagttgtctgttattgaagacgtatttaagttgagagataatctaccccgtcccgatgagtggaggaaatctttgatcgacacttacgtttgagttctttggtttacattgtgtgtactacaagttgtgtgaaagactgagctactatttatattttatgtatctttggttaaa

SEQ ID NO: 2368 - DNA, 894 bp, Carthamus tinctorius
cggggggggttttaaacaaaaaaaaaagaagaaaaggtttcattccgccgcctccccgcaagcaaaatcaaccctagcgctgctggtcatcgccggaagctgctcgccggccaactcccgtcggcctctgcttgccagcttctcgtcgccgtcgctactccacgtcagatacttttttctctttgtaagcaaatatacacctgctgcatttctccacaatggccacaagacttcagtttgagaattcatgtgaaatcggagtgttctcaaagctaacaaatgcttattgcttggtagcaattggagggtctgaaaacttttacagtacatttgagtctgaattagcagatgttattcctgtggttaagacctccattggtggtacaagaataattggaaggctttgcattggtaacaaaaatgggcttcttctgcctcatactactaccgaccaagagcttcaacatttgaggaacagtctgcccgatgcagttgttgttcaacgtattgatgagagactatctgcccttggaaattgcatagcgtgcaatgaccatgttgcccttacccataccgatcttgatagggaaactgaagaaatgatagccgatgttcttggtgtcgaagttttcaggcaaacaattgctggtaacattcttgtcggcagctactgtgcattttcaaatagaggtggtctggttcacccacatacctctattgaagatttggatgaattgtcaaccctccttcaagtacctttagtggcgggcacggtgaatcgtggtagtgaagtaatagctgccggcataacggtcaatgattggactgctttttgtggtcagacactactgcaactgagttatctgtgatcgagagtgttttcaagttgcgaga

SEQ ID NO: 2369 - DNA, 1081 bp, Centaurea maculosa
aatccctaaattcggttcgccctttttaaatccctaaattcgattcaaccgatacgttttctgtctgaattcattgcaatttctgaaggtttttcgatcttcgtcgtattttcaggctctttgctcctgaagccactttccattcattcacttatcattcaccatggccacaaggctacggtttgaaaattcatgtgaaattggggtgttcacaaagctgaccaatagttactgcttggtagctgatgaaggctctgaaagtttctacagcattttcgagtctgagttggctgatgttattcctgtggttaaaacctctatcggtggcactaggataattggaaggctttgcatcggaaataagaaaggcctgctcttgcctcatactactaccgaccaagagcttcagcacttgaggaacagcttgcctgatgaagttgttgttcaacggattaatgagaagttatctgctcttggtaattgcatggcatgcaatgatcatgtcgcccttacccataccgatcttgacaaggaaaccgaagatatgatagcggatgttcttggtgtagaagtttttaggcagacaattgcaggcaatgttcttgtgggcagctactgtgcattttcaaatagaggtggattggtccacccccacacatccgttgaagacttggatgagctctcgaccctcctccaggttccattggtggcaggcaccgtgaaccgtggtagcgaggtcatagccggaggcttgatcgtaaacgactggaccgcattctgtgggtcagacactactgccacagaactgtcggtgatcgagaatgttttctaagctacgagataaccaacctaatgatattgccaatgagatgaggaagtcgctaatcgacacccatgtttgaattccctgtatgatgttgctatacacgcctctttctttttttatataaattcggcttttatgttgctagaccttttactttttggtactcgattctaatttgagatgataagccttgaatgtaaatcaccataggggtgttaacggggcccaaaaaggataatgtattgcagtttcgtt

SEQ ID NO: 2370 - DNA, 943 bp, Ambrosia trifida
tgttctcaaagctgactaatgcttactgtttggtagcaattggtggttctgaaaatttttacagtacatttgaggccgaactagcggatgttattcctgtggttaagacctccattggtggcacacgtataattggccgactttgcattggtaacaaaaatgggctacttttacctcataccactaccgaccaagaacttcaacacttgaggaacagtctgccagatgcagttgtggttcagcgaattgatgagagactatctgcccttggaaattgcatagcatgcaatgaccatgttgcccttacccataccgatcttgacagagaaaccgaggaaatgatagctgatgttctcggtgttgaagttttcagacagacaattgctggaaatattcttgtgggcagctactgtgcattttcaaatagaggtggcatggtgcatcctcatacctctattgaagacctggatgagctatcaaccctgcttcaggttcctttggtagcaggaacggtgaaccgtggaagtgaagtaatagcggcaggcctaacggttaatgactggaccgcattttgcgggtcagatactactgcaacagaattgtccgtgattgagagtgttttctaagctgagagaagcccagcccagtgccattgtggatgagatgaggaagtctttgatcgacacttacgtttgataagtttttaagtttctttttgctactgtttttatgtgataaattgttttaagctgctggaagttttgggtattgttaaaacgaatgcttttagattgttctattacaaaaaaattgtattaatggtcaacaatcatttaaacattagtcaaaggatcttttcaggaactgaatgggaaaaacttcccacaatagtaactctaaatacgcgatgaaaacgcaagcgtatgtattgtataaaaaagaa

SEQ ID NO: 2371 - DNA, 1161 bp, Allium cepa
ttcagaaaatttctacagtgcatttgaagctgaacttgctgatgttatccctgtggtcaagacatcaatatcaggcactagaattattggtaggctgtgtgtagggaacaaaaatggacttctcttaccacataacacaactgaccaagaacttcaacatttaaggaattgcttgcccgattctgtggttgttcagcgtattgatgagcgtctttctgctctgggcaactgtgtcgcctgtaatgatcatgttgcccttacccacaccgatctggacaggaatacagaggagcttattgcagatgttcttggagtagaagtatttaggcagacaattgcagggaacgttcttgttggcagctactgtacatttacaaacaggggtggtctggttcatccacagacctcaatagaagatcttgatgagctttccacacttctccaagttcctcttgttgcaggaacagtaaacaggggcagtgaagtaattgcagctggtatgaccgtcaatgactggactgctttctgtggatccgacactacagccactgagctctccgttattgaaagcgtattcaagttgagagaggcccaaccttcttccattgtagacgagatgaggaaatctcttatcgacagctatgtgtgatggattattacaatctcacctactacattaccatgaaattgtttatctttgcagtaatttttgtttaccattatttatgattgtttaatgttgaatcttagatggtaaaatgtagtttgcattttggttttgagttgaagttggagaaatttttgtttagaggtattccatgttatacgagtttcaacataaatatgttaagtaagagcaactccaatactccaacgttctggttatcaaattcagaagctctctaacacagcaaaatagggctaatatcatggtagatgttcagtttggatttagaattctgaactgggcgtgagcactttattaatatgcgtttgcgaacgcttgttaaataatcattcaacgtttggatacttaaattggtgtttgagtttagatacttgatttgtgtgcttattttaaaaaatgcgtgtactcgatgttttgttgtttaaatttaaacatctcactttatatgaaacgacaatttcttgaacctttgt

SEQ ID NO: 2372 - DNA, 2380 bp, Sorghum bicolor
gcccgccgcagccgcgcggcgcgtgcgccatccgaaacagccgcgcccacctccactcgaattcaaaatcaaaaaagaaataaacccggcagccataaatcccccacgcgatcccctcccgtcccaatccccactccccaccccacgcatctccatttcaaaaccgcgcaggaccttcgcgtctcttcctccctccgctcccccgctctgctccgctccgctcctctccgctccaaaaccctaggcggcgcccgcccggagcccggatcccgcgtcccgctcccccggcgcctccgcccgtcgcctgctcccccgatggaccccgcggggccgcgcgtgggcacggatcccaccggatcgggagccgcgccgccgcgcgaggaattggacgggagaggaagaggaggagcgtgcagcggcgccgcagcggtggaggggagcgcgtcgcggctggcgggcgctggattaggagatccgagggctggaattctggaatctttggttcaagctgaagcatatttgcacacatataccatggatgttcctcagttgactgctgaaggtgccacacaatgtggagatagagtgtctttattgccccagactggggcacttcagtcagtaactccttgtctgaccttgggccgcgattccaatgcaacatcaatggagaagttgcatggtaatgagtccttgccatttggtaaggagaacatcagaaaagatctccaacctaaacctgatccagaacatgttgataataggatgagtgttgcacgtcttgggttggaccttaacacagcagatagttctgatgcagcagagcttaaccctttcttcccttacaagaagctggggcagttgaaagtcagtggtccatcagaatgtggcagcactactggtgctacagaagaaagcgagtcgcacagaaagtggagagaaatgaagcagaatggctttctttcttcgtctcatggaaatgcaatggtgcctaggccacgtggtcgaccccccaaaaggaaaagggatgatgaattcaaaaagagcacttctacacagcatggccaggctaataagtctatgaaggttgctgctcctagtggcctattatctgggctaaaccctggaatcattaaccatgtgagaaatagcaagcaggtgtactccataataaaggctatggtacactctgagaggcttcagaatgagaaccagcctgcctttactagtcaaacaggtgaaagagggagagatgttagtgagagaattcaggatcagaaatatggtagtggtttcatgaagtgccattcgttgatgaaagataataatgtggtgtttcaccaaacactgcctaccacattgcatttccttccacaggatggtgatagtctcaaactgcaactctcatcagcagtcactatgtcttcagataggacctgcagtacgtcggctgatgatccagcatctaatcatgattacatgactgtactgtcagtaaaagcggccagtgttgcttctcagtggttggaattactgcaccaggacatcaggggacgccttgctgctttaaaacgcagcaggaagagagtcagaaatgctcttcgcacggaactgccatacctaatgtcgacagaatttccatctaatcaagagaatgaatcatcgattgcaaatacttctgaggctggatgtactgaaaaagcagtttcagaagcgcatgtggcacgatggaggtctctgtttgtccagatggacagaacacttcaggaggaagggaaacaactggagaaccggttgaagcaagtgcaagaaatgcaattgaattgtgataaaggcctcaaacacatgacctgtgaagctcctctgctaggacccatggctgaactatggaagctgaacaacccagataattctgagagtgagtgggcggtgcaagccgctgctgcatcaatctactcgacctgcaacatggtcatgagagcggagaacaacgtgccttgcttctgatctcacacttatagtttagtttcttgctttgctgatttttacctcaaaattaggtttcctttcttacctttagcctttgtgaattgtgatcccttgtccattacagtagtggcgagtgatgtaacaagaaacttgtgatgtatgttgtcccccagcctacaatttcacaggcacgtgaaataacacattcttttcatggagttcagaatcttcagatcctaccgttttggttcggttgtcaaatgttgaactggcacggtcgatgttctgattggatgattacatgagtattttctttctttccaccttttcggatagggtctttcggttggctttcctgtgaataagaatagttgggcgccgtgaatccccg

SEQ ID NO: 2373 - DNA, 2254 bp, Zea mays
gtccgatccatctcgatttgaaaaccgcgcaggagcttcgcgtctcttcctccctcactaccgctccgctccgctccaaaaccctagacggcgcccgcagcccggagccccggatccgcgtcccgctcccccggcgtctctgcccgctgtcgccggctccccgatggacctcgcggggccgcgcggggccacggatcccgccggatcgagggccgcgccgccgcacgaggaattggacgggagaggaggaggggcgtgcagcggcgcggcagcagtggaggggagcgcgtggcggctggcggtcgctggactgggagatccaagggccggagttctggaatctttgggtcaacctgaagcacatttgcacacatgtaccatggatgttcctcagttgactgctgaaggtgccacacaacttggagatagagtgtctttattacaccagacagggacacttcagtcagaaactccttgtctgaccttaggccgtgattctaatgcagtatcaatggagaagctgcatgctagcgattgcttgccctgtggtaaagagaatgtcgggacaggactacaacctaaatctgatccagaacgtgctgataataggatgagtgttgcacgtcttgggttggaccttaacacagtagatagtcctgatgtagcagagcctaaccctttcttcccttacaagaaattggggcagtcaaaagtcagcgatccatcggaatgtggcagcactactggtgctatagaagaaagcgagtcacacagaaagtggagagaaatgaagcagaatggctttctttcttcatttcatgggaatgcggtggtgcctaggccacgtggtcgaccccccaaaaggaaaagggatgatgaattcaaaaagagcagttccacacagcatgtacaggctaacaagtctgtgaaggttgctgctcctagtggtctattatctgggctaaaccctggaatcattaaccatgtgagaaatagcaagcaagtttactccataataaaggctatggtacactctgagaggcttgagaatgagaaccactctagtcaaacaggtgaaagagggagagaagttaatgagagaattcaggatcagaaatatggtggtggtttcatgaagtgccatttgttgataaatgataataatgcggtgtttcaccaaacactgcctaacacatcgcagttccttgcacaggatggtgatagtcttaaactgcaactcccatccgcagtcactatgtcttcagataggaccttcagtacgtcagctgatgatcctgcatctaatcatgattacatgactgtactgtcagtaaaagcggctagtgttgcttctcaatggttggaattactgcatcaggacataaggggacgtcttgctgctttaaagcgcagcaggaagagagtcagaaatgctcttcacacggaactgccatacctaaccgcgacagaattttcatctaatcaagagaacgaatcatccattgcaaatacttctgagattggatgtactgacaaagcggtttcagaagctcatgtggcacgatggaggtctctgtttgttcagatggacaaaacacttcaggaggaagggaaacagctggagaacaagttgaagcaagtgcaagaaatgcaattgaattgtgataaaggcctcaaacacatgacctgtgaagctcctctgctaggacctatggctgaactatggaagctgaagaacccaaatatttccgagagcgagtgggcggtgcaagccgctgccgcatcgatctactcgacctgcaacatggtcatgagaacggagaacgtgccttgcttttgataccacacttgtactttagttttttgctttgggcgtgttcggctggctacaagccgacactgttgcagctgtttggattgctgcagctgcaatccatagagagaaaaatactgtagaagccgcagccgcagccggattgcagccgcagcaagccgcagcgaacaagcttacctcaaaccaggtcttctttcttacctttaccctatgtgaatcgtgatcccttgtccattacagtagtggcgactggcgagtgatgtaacaagaacaaacttgtgatgtatgttatcccgagcctacaatttcacaggcacatgaaacagcacattctttttcatggagttgaggatattcatatcctaccgttttggttcggtgagatggtcgaaatagagattgccaccttgttaaattttt

SEQ ID NO: 2374 - DNA, 1913 bp, Setaria italica
gctgccggctccccgatggaccccgcggccgcggatcccgccggatcgggcgcgccgccgcccaaggaattcgacgggagcggagcgcccggcggcggggctgcggaggggagcgcgccgcggccggtggtggctgggttgggagatctgagggcaggaattccggaatcttcgggtcaatctgaagcatgtttgcatccatgtaacaaggatattcctcaattcactgctgatggtgccaaacaatgtggagatagagtgtctttattgcctctggctggggcacttcagacagaagctccttgtctgaccttgggtcgtgattccaatgcagcatcagtggagaagctgcatggtagtgatcctttgtcatgtggtaaagagaacattgggacagatctccagtctaagcctgatgcagaacatggtgagaataggatgagttctgcacatcttggattggacctaaacacagtagatagttctgatgcagctgagcttaatcccttcttcccctacaagaagctggggcagtcaaaagtcagcgatccatcggaatgtggcagtactactggtgctacagaagagagcgagtcgcacagaaagtggagagaaatgaaacagaatggctttctttcttcatctcatggaaaggcagtggtgcctaggccacgtggtcgaccccccaaaaggaaaagggatgatgaattcaagaagaacacttccacacaacatggccaggctaacaagtttgtgaaggttgctgctcctagtggcctattatctgggctaaaccctggaatcattaaccatgtgagaaatagcaagcaagtttactccataataaaggctatggtacactctgagaggcttgagaatgagaatcagcctgcttgtactagtcgaacaagtgaaagagggaaagaagttagtgagagaattcaggatcataactatgggggtggtttcatgaagtgccatttcatgatgaaagataataatgcgatgtttcaccaaacactgcctaccacatcacagttccttccacaggatggtgatagtcttaaactgcaactctcatcagcggccgctgcgtcttcagataggacctgcagtacatcagctgatgatcttgcatctaatcatgattacatgactttattgtcagtaaaagcggccagtgttgcttctcagtggttggagctacttcatcaggacataagggggcgccttgctgctttgaagcgcagcaggaagagagtcagaaatgctcttcacacggaactaccttacctaatttcaacagagttttcatctaatcaagagaatgaatcatctattgcgaatacttctgagtctggatgtactgacaaagcagtttcagaagcacatgcggcgcggtggaaatctctctttgttcagatggacagagcacttcaggaggaggggaaacacctggagaaccggttgaagcaagtgcaagaaatgcaattgaactgtgacaaaggcctcaaacacatgaccagtgatgctccactgctcgggcctatggctgaattatggaagctgaagaacccggatacttctgagagtgaatgggcggtgcaagctgctgccgcgtcgatctactcgacgtgcaacatggtcatgagaactgaaaacgtgccttgcttctgatcttgcatctgtaatttagtttctttctttgctgatctttacctcaaaattaggttccctttctttagccttgtgatgttcattacagtagtggtgagtgctggcatgatgtaacgtgaaaaaaaaaaacttgtgatgtatgttgttaccaacttacaatttcacaggcccgtgaaataacaaattctttcttacgaagttcagaatcttcagatgctaccattccggtttggttg

SEQ ID NO: 2375 - DNA, 2253 bp, Sorghum bicolor
cacacgacacgatcatctcatacagtagagtacgaagcacgggcgggcacgccgttttccggttccacccctggaaaaccgcgggatttagcgtgcaccacccgggcccttttacccctcgaccccagccagccagccaacaagacccccccttggctcgcctcgattccacccacccacaccccacacctccctccgcctccgagcaccaccaaaccctagatctcgcaccggcggcagccagccatgtcgaagccctggggaggcgtcggcgcgtgggcgctggacgccgagcgcgccgaggaggaggagcgcgagcaggccctgtccttcccggcgcccgagccgcccgcggccgcgggcggcgccgccagcttcccgagcctccgcgaggcggccgccgcgggcgccgggggcaagtcgaagaagaacaagaacaagggaaccacgctgtcgctctccgagttcaccacctacggcgccgccgccgcccagcgccgcgcggcgcccgtcgagcccaggggcctgacccacgaggagatgatgatgctgcccacggggccccgggagcgctcggccgaggagctggaccgctcccgcggcttccgctcctacggcggcggcggcggcggcttcggcggccccggcggaggggagcgccgcggcggcttcgacgacgagggccgccgcgggccgggaagaagctcggatcttgacatgccctcccgcgccgacgaggctgacgactggggcgccactaagaagttcaccccggctcccgccgattcgggccgccgcgataggttcggcgggccttcccctctcggccgtgctgatgacattgacgactggtcgcgcgacaagaagccgctcccgtcgcgctaccccagcctcggttctggtggaggtggcttccgtgactcgccgggcttccgtgactcatcagctgcttctgatgctgaccgttgggtccgtggagccacccctatgccacacaacggccaggggtcgggggagaggccgcgcatcgtcctcaatcctcctcctaaacgtgacccggcggcagctgcctccaccccacctgctgaggtggcccgcaaccgcccaagcccgtttggggctgcaaggccccgggaggatgtgctggcagagaagggggtggactggaggaaggttgagaatgagattgagcagaagaccagccggcctaccagctcacactccagcaggccgaatagcgctcattcctcccgccctggaagccctgggtcgcaggtgtcggctgttgggagtgaaggagcaccgagggcacggccaaaggttaacccatttggtgatgccaagccaagagaattggtgttgcaggagaaagggaaagattggaggaagattgatcttgagctcgagcatcgtgctataaataggccagagtctgatgaagaaaaaaatttgaaagaagaaatcaaccttctgaaagtggatcttaaagaaattgagggaaagatgagtaatggttctgaccagacatcggtagatgcaaaagatttgtctgagaagatatctcagttggaaagccagcttgagcagctttcaagggagttggatgacaagattcgatttgggcaaaggccacgttctggtgcaggcagggttacaacacatgcaccaactagtttaggggaggaaccacaggctacagtggtggacagaccgcgttctcgcggtggtatggaaccacccccaaggcaggaagaaagatggggatttcaaggaagcagagaaaggggctcttttggtggaagcagaaattcggacaggccaatggcaagacagagatggtgaaattgggacaacaagcatctcatagggactcttctggttccagtcccttttttgtttgaaaagatgggcaaaataagtctgttttctatttgtcgtgtttgtttggtctagaagattgttgaggatggagataactccacatgaagttattggttgtcaagtctgtatgccgtaggatgttttacatttccctttttgccatcttccatgttaaaacaatatccggcacctccgatactaactgttattcatgcttactgaattccagttcagcttttgtcgaagtcgtttatttgtgcattgtaatggaagccttgaatttgcacgtctacgaatgccatgtcatctttctgctcgttttctaaccagtgtctgtatgttgaggcaaggagctgtgattcccagttgttt

SEQ ID NO: 2376 - DNA, 2212 bp, Zea mays
cagccaacaagacccccctgcctcgcctcgattccacccacacccacatcctcacctccctccgcctccgagtgccaccaaaccctagatctcgcaccggcggcagccatgtccaagccatggggtggcgtcggcgcgtgggcgctggatgccgagcgcgccgaggaggaggagcgcgagcaggtcctggccttcccggcgcccgagccacccgcggccgcgggcggcgccgccagcttcccgagcctccgcgaggcggcctctgctggcggcaagggcaaatcgaagaagaagaacaagggcaccacgctgtccctgtccgagttcaccaccttcggcgcggccgcggcccagcggcgcgcggcgcccgtcgagcccaagggcctgacccacgaggagatgatgctgctgcccacgggcccccgggaacgctcggccgaggagctggaccgctctcgcgggttccgctcctacggcggcggcggcggcggcggcttcggcgcaggcgctggaggggagcgccgcggcgggttcgacgacgagggccgccgcgggccgggcagaagctccgatcttgacatgacatcccgagcggacgaggctgacgactggggcgccactaagaagttcaccccggctcccgccgactccggccgccgcgataggttcggtgggccttcccctctcggccgcgctgatgatattgacgactggtcacgcgacaagaagccgctcccgtcgcgctaccccagccttggttctgcaggtggcttccgtgactcgccgggcttccgcgactcatcagcttcttctgacgctgaccgttgggtccgtggagccacccctatgccacacaacggccagggggcgggggagaggccacgcatcgtccttaatccacctaaacgtgacccgtcaactgcctctaccccacctgctgaggtggctcgcaaccggccaagcccttttggggctgcaaggccccgggaggatgtgctggctgagaagggggtggattggaagaagtttgagaatgagattgaccagaagaccagccgccctaccagttcgcactccagcaggccgaatagtgctcattcctcccgccctggcagccctgggtcacaggtttcggccgttgggagcgaaggagcaccaagggcacggccaaaggttaacccatttggtgatgccaagccaagagaagtggtgttgcaggagaaagggaaagactggaggaagattgatgttgagctggagcatcgtgctataaataggccggagtctgatgaagaaagaaatttgaaagaagaaatcaacctcctgaaggtggatcttaaagaaatcgagggaaagatgagtaatggttctgagcagacatcggtagatgcaaaagatttgtctgagaagatatctatgttggaaagccagcttgagcagctttcaagggagttggatgacaagattcgatttgggcaaaggccacgttctggtgcaggcagggttacaacacttgcacccactagtttaggggaggaaccacaggctacagtggtggacagaccacgttctcgtggtggtatggaaccacccccaaggcaggaagaaagatggggatttcaaggaagccgagaaaggggctcgtttggtggaagcagaaattcagacaggccaatggcaagacagagatggtgaagttgggacaacaagcatctcttagggacacttctggatcgcagtcccttttttgttctgaaaggatgggcaaaaataagtcgttttctgtttgtcgtgtttgtttggtcttagaagattgttgagggtggagataactccacatgaagctattggttgtcaagtctgtatgccgtaggatgctttacatttccctttttgccgtcttccatgtcaaaacaatatctggcaacctccgatactaactgttattcatgggtcactgaattccggatcagcttttgtcataggtcgtttatttcagcattgagtaatggaaaccttgaatttgcacttttactactgccatgccttcattctgtccgttttttttaactagtgtctgtatgttgaggcaacgagctgtgactcccagtcgtctgtattagtttcagactgcgggaatgctttatcacgggtttatatgtgggagattggctggtggctgataagttacccacatgtagagcaaggggcg

SEQ ID NO: 2377 - DNA, 2093 bp, Setaria italica
cagcagcagcgccttccttcctctcctcgatttcgcacccacctccctccctccgcctccgagcaccaccaaaccctagatctcgccaccggcggcagccatgtccaagccctggggcggcgtcggcgcgtgggcgctggacgccgagcgcgccgaggaggaggagcgcgagcaggccgcggccctcccggcccccgagccgcccgcgcccgccggcggcgccgccagcttccccagcctccgcgaggcggccgccgcgaccggcggcggcaagtccaagaagaagaacaagggcaccacgctctcgctctccgagttcaccacctacggcgccgcggcggcccaccgcagggccgcccccgtcgagccccgggggctcaccccggaggagatgatgatgctgcccacggggccccgggagcgctccgccgaggagctcgaccgctcccgcgggttccgctcctacggcggcggcgggggcttcgggggaggggagcgccgcggcgggttcgacgacgagggccgccgtggcccgggcaggagctcggatctcgacatgccctcccgcgccgacgaggtcgacgactggggggccggtaagaagttcaccccggcggccgccgactctggccgccgcgataggttcggcgggccctcccccctcggccgcgcggatgacattgacgactggtcgcgcgacaagaagccgctcccgtcgcgctaccccagcctcggttcgggtggtggcggtggattccgcagctcgccgggtttccgcgactcaccgggcttccgtgactcagcggcttcctcagattccgaccgttgggtccgtggagccacccctctgccacacaacggcgaggggatgggggagaggccgcgcatcgttctcaatgctccgaaacgtgatccttcggctaccactacgccacctgctgaggtggcacgcaaccggccaagcccatttggggctgcaaggcccagggaggatgtgctggccgagaagggggtggattggaggaagatcgagagtgagattgagcagaagaccagccggcctaccagctcgcactccagcaggccaaatagcgcgcattcctcccgccctgggagccctggttcgcaggtttcagcagttggaagtgagggagcacccagggcacggccaaaggttaacccattcggcgatgccaagccaagggaactggttctgcaggagaaagggaaagattggaggaagattgaccttgagctggagcatcgtgctgtaaataggccagagtcagatgaagaaagaaatttgaaagaggaaatcaaccttatgaaggtggatctgaaagaaattgagggaaagataagtgatgattctgaccaagcctcagtagatgcaaaaaatttggctgagaagataacccagttggaaagtcaacttgagcagcttacaagggagttggatgacaagattcgatttgggcaaagaccgcgttctggtgcaggcagggttacagcacttccacctagtccagcagaggaaccacaagctacagttgtggacagaccgcattctcgtggtggtatggaaccacatgcaaggccagaagaaagatggggatttcaaggaagcagagaaaggggatcttttgatggaagcagaagttcagataggccaatgaccaggcagaggtggtgaaattgggactccgagcatctgttaattgttagggaaacttcaggttcccagtaccttttttgtcttgaaaaggatgggcaaaataagtcattttgtgttcgtcttgttgtttggtctagaagattggagaggatggagataactccacatgaagttattgattgtcacctctgtaagctgtaggatgttttccatttccctttttgcagtcttccatgtcaaaacaagacttggcaacttgcggtactaactgtatcatggttactgaattcaagttcagcttttgtcgcaaggcgtttatttgggaatggtggaatggagaccttgaatttgatgttttgtgtcaatgcatgtgttagatatcttcgtgcgtttggttttatcagtatctgtgtatata

SEQ ID NO: 2378 - DNA, 1630 bp, Setaria italica
cccacctccctccctccgcctccgagcaccaccaaaccctagatctcgccaccggcggcagccatgtccaagccctggggcggcgtcggcgcgtgggcgctggacgccgagcgcgccgaggaggaggagcgcgagcaggccgcggccctcccggcccccgagccgcccgcgcccgccggcggcgccgccagcttccccagcctccgcgaggcggccgccgcgaccggcggcggcaagtccaagaagaagaacaagggcaccacgctctcgctctccgagttcaccacctacggcgccgcggcggcccaccgcagggccgcccccgtcgagccccgggggctcaccccggaggagatgatgatgctgcccacggggccccgggagcgctccgccgaggagctcgaccgctcccgcgggttccgctcctacggcggcggcgggggcttcgggggaggggagcgccgcggcgggttcgacgacgagggccgccgtggcccgggcaggagctcggatctcgacatgccctcccgcgccgacgaggtcgacgactggggggccggtaagaagttcaccccggcggccgccgactctggccgccgcgataggttcggcgggccctcccccctcggccgcgcggatgacattgacgactggtcgcgcgacaagaagccgctcccgtcgcgctaccccagcctcggttcgggtggtggcggtggattccgcagctcgccgggtttccgcgactcaccgggcttccgtgactcagcggcttcctcagattccgaccgttgggtccgtggagccacccctctgccacacaacggcgaggggatgggggagaggccgcgcatcgttctcaatgctccgaaacgtgatccttcggctaccactacgccacctgctgaggtggcacgcaaccggccaagcccatttggggctgcaaggcccagggaggatgtgctggccgagaagggggtggattggaggaagatcgagagtgagattgagcagaagaccagccggcctaccagctcgcactccagcaggccaaatagcgcgcattcctcccgccctgggagccctggttcgcaggtttcagcagttggaagtgagggagcacccagggcacggccaaaggttaacccattcggcgatgccaagccaagggaactggttctgcaggagaaagggaaagattggaggaagattgaccttgagctggagcatcgtgcttacttttcaggccagagtcagatgaagaaagaaatttgaaagaggaaatcaaccttatgaaggtggatctgaaagaaattgagggaaagataagtgatgattctgaccaagcctcagtagatgcaaaaaatttggctgagaagataacccagttggaaagtcaacttgagcagcttacaagggagttggatgacaagattcgatttgggcaaagaccgcgttctggtgcaggcagggttacagcacttccacctagtccagcagaggaaccacaagctacagttgtggacagaccgcattctcgtggtggtatggaaccacatgcaaggccagaagaaagatggggatttcaaggaagcagagaaaggggatcttttgatggaagcagaagttcaga

SEQ ID NO: 2379 - DNA, 4548 bp, Panicum virgatum
ggggtcaggacaagttgctccctcctctaaccaccggccaattcgggcgtgtttggttgccacgctacatctgctgctacacaagcaccattttttttggcggcagtaaaaacaaaagaaaaccaaacaagcacgcgattgattgacatgactaggattaatcatcacgttcgcgtggcagccacatctttaatcttatttaattaatctaatctgctgctgatcgctggcccaccgggattcacggttaccggagatggaaagggcatcgaccgctgcggggaagaagaccccccggatgacgctacaaggctttccactctcggagccctgaccgcccgccgcgccgcccactcgtccccagctgcggcggcgggtccgagcactctagccccgcgcgtcctcctgtttccgccgctccaactccccgcgggctcctcgccggcgtccgctccccgcggtcagtcacccagccgcgcatcgctgttgctgctgctcctttcctgttcccctttgcagcagggcagggcagggcagcgtggaggagaggagatattatcgctgccgccgccgccgccgccgccgccgccgccgctgtcccactcgcgcgccacgaagcctcggcctcggcctcggatcggaggcgtgcttatccgcggcggaatccaatcccctcccttgcgtccttctccccagcaaaggccacccgcccgcttttggcgaattaccccccgctgccgcgcccatgattcccggcgattcatccgcccatttgctcctgctcccctcgccgcagctgcagtgcggccgcagctgctagttcggtagcggggggaaggggggcttttgattggggggcggcggcgatgtcgtcgtcgcggtccaacaaccgggggacgtgctcccggagcagctcggcgcggtccaagcacagcgcgcgggtggtggcgcagacgcccgtggacgcgcagctgcacgccgagttcgagggctcccagcgccacttcgactactcctcctcggtgagcgcggccaaccgcccgtccgccagcaccagcaccgtctccgcctacctccagaacttgcagcggggccgcttcatccagcccttcggctgcctgctcgccgtccacccggacaccttcgcgctgctcgcctacagcgagaacgcgcccgagatgctcgacctcacgccgcacgcggtccccaccatcgaccagcgggacgcgctcgccctcggcaccgacgtgcgcacgctcttccgcacgcagagctccgtcgcgctgcacaaggccgccatcttcggggaggtcaacctgctcaaccccatcctcgtgcacgccaggacgtcggggaagcccttctacgccattatgcaccgcatcgacgtcggcctcgtcatcgatctcgagccggtcaaccccgccgacgtgccagtcaccgccgcgggagcgctcaagtcctacaagctcgccgccaaggctatctccaggctgcagtcgctgcccagcgggaacctctcgctgctgtgcaatgtgcttgtccgtgaggtgagcgagctcacgggctatgacagggtcatggcgtacaagttccatgaggatgagcatggtgaggttatcgctgagagcaggagatctgatctagaaccatatcttggcgtgcactacccagccactgacatcccgcaggcgtccaggtttctgtttatgaagaacaaggtgcggatgatatgcgattgctctgccactccagttaagatcattcaggatgatagcctagcacagcctctcagcctatgtggttccacgcttcgggctccccatggttgccatgcgcaatacatggcaaacatgggctctgttgcgtcacttgtgttgtcagtaactataaacgaggatgatgaggaggatggggatactgggagtgaccagcagcccaaaggaaggaagctgtgggggctggtggtttgccatcacacgagtccgaggttcgttccttacccactaaggtacgcttgcgagtttctcttgcaactgtttggcatacagctcaacaaggaggtagaattggctgctcaggcaaaggagaggcacatcctccgaacgcaaacccttctgtgtgatatgcttctgcgagaagctcctgttgcgatatttacccagtcgcctaatgtaatggatctagtaaagtgtgatggaactgcactgtactaccaaaaccagctttgggtgctcggatcaacaccctcggaggcagagataaggagcattgtcacgtggcttcaggagaaccatgatggttcaactgggctgagtaccgacagcttagtggaagcgggttatcctggtgctgctgcacttcgtgaagttgtgtgtggcatggcagccataaagatctcttccaaagattttatcttctggttccgagcccacacagcaaaggagatcaagtggggtggacgtaagcataaaacgaccgatggagatgagaatggtcggaagatgcatccacgatcttcattcaaggccttcttggaggtggttaaatggagaagtgttccctgggaggatgttgaaatggacgcgatccattctttgcagttaatattacgcggctccctgcaagatgaagatgccaacaaaaacaatgtaaggtccattgtaaaagctccatctgaggatacaaagaagatacaggggctacttgagctaagaacagttacaaacgagatggtccgcttaattgagacggcaactgcccctatctttgctgttgacatttacggtaacataaatgggtggaataataaagtcgcagaactcactggattacctgttatggaagccatagggaggcccctcgtagatcttgtcatgtctgattctgttgaagtggttaaacagattttggactcagctttaccaggaatcgaagagcaaaatctggagatcaagcttaaaacattcaatcaacaggaatgcaatggccctataattttgatggtcaactcctgctgcagtcgggacctttcagacaaagttgttggagtttgctttgtagctcaggatttgactgggcagaagatgataatggataagtatactagaatacaaggagactatgttgccatagtgaagaaccccagtgagcttatccctcccatatttatgatcaatgatcttggttcctgcttagagtggaatgaagccatgcagaagattactggtatgaaaagggaagatgcaatagacaagttgttaattggggagattttcacccttcatgagtatggctgtagggtgaaagatcatgctactctaacaaaacttagcatactgatgaacacagtgatttctggtcaggatcctgggaaactcctttttggtttcttcgatacatatggcaagtatgtggaatccctgctcacagctaagaagaggacaaatgctgagggcaagatcactggtgctctttgctttctgcatgtggccagcccagagcttcagcatgctctccaggttcagaaaatgtctgaacaagctgctacaaaaagctttaaggaattaacctacattcgccaagaattaaggaacccactcaatggcatgcaatttacgcataatttattggaacattctgagttgacagaggaacagaggcaacttgttgcatctaatgttctctgtcaggatcagctgaaaaagattttacacgatactgatcttgaaagcattgaacagtgctatatggacatgaacatggtagaattcaaacttgaggaagctctgaatacggtcctaatgcaaggcatgtctctgggcaaggaaaaacggatttctgttgaacgtgattggcctgtggaagtatcatgcatgtacctctatggagacaatttaaggcttcagcaggtcctagcagactatctgacatgcactcttcaatttacccaaccagccgaagggcctattgtgctccaagtcattcccaagaaggaaaatattgggtctggcatgcagattgctcatttagagttcaggatcgtccatccagcaccgggcgtcccagaggccctgatacaggagatgttccggcacagcccagaggtgtctagggagggccttggcctgtacatatgccagaagctggtgaagatgatgagcggcacagtacagtacctccgggaagccgacagctcgtcgttcatcgtcctggtagaattcccggttgcccaactcagcagcaaacggtccaagccttcaacaagtaaattctgacgccgttgcacctggaattgtaaactgcagtcccttcaatgagcgcttggctgtttaaattagtcaaattcaggtagtttgaagtctgtatctggcacgatctgtgtaatgcgggtagatttggtcgtttggggagttggctaggtgtggcctaagcgtaattttaaccgacaactgtatgtctatattgagttgtgagaatgaataaaagcttcacctgtgttcttttcttctgaacgagcttcgctgtgctttcactgggagaatattt

SEQ ID NO: 2380 - DNA, 4265 bp, Brachypodium distachyon
gccggacgtcgtcgtacggctttcccctctcggttaaggacgcttcaattcgcttccccccgccgccgcaaacgccacgccccacgccgcttaaattaagcctgcacgcttctcccccttccccagtatccgaatcccttcggcctccgtccacggcgagcggcgccgccgcgctccggagggccggggagagctggctgtgggttaatttcgcatcgctgttgcttgcttcgtctaccgtttggagcagggaagagtgggggtggggatattatcgctggatgccccacccggcaggccggcactccacaccccgtgctgtgcttatccgcggcggaatccaatccccccatctccctctcctctccgaaaagtcgtccgccgcttttcgcctattacccccgccttgccggccatgattcccgctgattcctccgcccatttgctcctccgcctcgccgagccttactcgccgctgttgctggtcgtcgtcgttgttgttgcgctgtagaaaagggagcggtgaggagcgacgagggggtggggatgtcgtcgtcgcggtccaacaaccgggcgacgtgctcgcgggggagctcggcgcggtccaagcacagcgagcgtgtggtggcgcagacgccggtggacgcgcggctgcacgccgagttcgagggctcgcagcgccgcttcgactactcgtcgtcggtgagcgcggccaaccggtctggggccagcaccagcacggccgtctccgcctacctccagaatatgcagcgcggccgctacatccagcccttcggctgcctgctcgccgcccacccggagaccttcgcgctgctcgcctacagcgagaacgccgccgagatgctcgacctcacgccgcacgccgtgcccaccatcgaccagcgcgacgcgctcaccgtcggcgtcgacgtgcgcacgctcttccgctcccagagcgccgtcgcgctgcacaaggccgccgtcttcggggaggtcaacctgctcaaccccattctcgtccacgccaggacctccgggaagcccttctacgccatcctgcaccgcatcgacgtcggcctcgtcatcgacctcgagccggtcaaccccgctgacgtgcccgttacagccgccggcgcactgaaatcgtacaaactcgcggccaaggccatctccaggctgcagtccctgcccagtgggaacctctccctgctctgcgacgtgttggtccgcgaggtaagcgagctcacaggatacgacagggtgatggcatacaagttccatgaggatgagcatggtgaggtcattgcggagtgcaggaggtctgatttggagccttatcttggcctgcactacccggcaactgacatcccgcaagcgtccaggtttctgttcatgaagaacaaagtgcggatgatatgtgattgtgctgctgttcctgtgaagctcattcaggatgacaacctatcgcagcctatcagcctctgtggctcgaccatgagggcaccccatggttgccatgcccagtacatggcgaacatgggctctgttgcatcgctagtgatgtcgatcactataaatgaagatgaagaggaagatggagacaccgggagtgaccaacagccaaaaggcaggaagctgtgggggctggtggtttgccatcactcgagcccgaggttcgtccctttcccgctcaggtatgcttgcgaatttctcttgcaagtatttggcatacagctcaacaaggaggtggaattggcttctcaggcaaaggagaggcacatcctccgcacacagacccttctctgtgatatgctccttcgggatgctcctattggaatatttacccagtcgcctaatgtaatggatctagttaagtgcgatggtgcagcattgtgttaccgaaaccagattatggtgctgggctcaacgccctccgaaggagagataaagaacatcgttgcatggctgcaggagtaccatgatggctctactggactaagtactgacagcttagtggaagcaggctatcctggtgcgtctgcacttggtgagattgtgtgtggcatggcagctataaagatctcttcaaaaggttttattctctggttccgatcccatacggcgaaggagatcaagtggggtggagctaagcatgaaccaggcgatgcagatgacaatggcaggaagatgcatccgcgatcttcgttcagggccttcttggaggtagttaaatggaggagtgttccttgggaggatgttgaaatggatgcaatccattctctccagctaatactgcgtggctccttgcaagatgaagatgctaacaacaacaacaacgtaatgtccattgttgaagctccatctgatgatatgaagaagatacaggggctacttgaactgagaattgtgacaaatgagatggtccgcctaattgagacggcaactgcgcctatattggctgtcgacatcgttggtaatataaatggatggaataataaagccgcagaaatcactggattacccactacggaagccatagggatgcctctggtacaggtcgttcatggtgattctgttgaagtggttacacagattttaaattcagctttacaaggagtagaagagcaaaatttggaaatcaaacttaaaacattccatcacctggaaagtaatggccctgtaatcttgatggttaatgcctgttgtagtcgtgacctctcagagaaagttgttggggtttgctttgtagcacaagatttgacagggcagaagatgattctggataagtatactcggatacaaggcgactatgttgcaatagtaaagaaccccaatgagctcatcccccctatatttatgatcaatgatcttggttcttgcttagagtggaatgaagctatgcaaaggattactggtataaagagggaagacgcaatagacaagttgctgattggggaggttttcacccttcatgactatggatgtagggtaaaagatcatgctactctaaccaaacttagcatactgatgaacacagtgatatctggtcaagatcccgagaagcttccttttggtttcttcgacgcagatggcaagtgcatggaatcactgctgacagcaaataagagaacagatgctgagggtaagatcaccggtgctctttgctttttgcatgtggccagtccagagcttcagcatgctcttcaggtgcagaaaatgtctgaacaagctgctacacacagctttaaggaattgacatatattcgtcaagaattaaagaacccactcaatggcatgcaatttacccgtaatttattagaaccgtccgagttgacggaggagcagaggcaacttcttgcatcaaatgtcctctgtcaagaacagttaaaaaagattttacatgacaatgatctagaaggcattgaacagtgctacatggagatgaacacggtagaattcaatcttgaggaagctctgaatacggtcctaatgcaaggcatgtctctgagcaaggaaaaacagatttctcttgatcgtgattggcctgtggaagtatcatctatgtacctctatggggataatttaaggcttcagcaagtcctagcagacttcttggcatgcacacttcaatttacgcagccagctgaaggacctattgtactccaggtcattcccaggaaggaaagtattgggtctggcatgcagatcgctcatctagagttcaggcttaaccacccagtgccaggcgtcccagagacgctaatacaagagatgttccgccacggtccaggggtatcgcgggaaggccttggtctgcacataagtcagaagcttgtgaagacgatgagcggcacagtacagtacctccgagaagcagagatttcgtcctttatcgttctggtggagttcccggttgcgcagctcaatagcaagaggcccaggccttcgacaagtaagagtaacttctgaatcctgctgatgccctctccccctcggagatgtaaactagggctattgcttggagcgccatgctgacgttgttagaagagcaggctccgagggagctcagctgatgtatcaaaatgtgtagttgggaacctggattgatcacactgttgttgtttggggggtagctagcttagctgttaggtgttagtgtaatttaaccggctgtatgaatggattgatgaaaataaaatttccacttgtgtttttcgatgattcccaggcggctgcaactcagacgcttaatttgctttaagatt

SEQ ID NO: 2381 - DNA, 4087 bp, Secale cereale
agctggcggtcggttaactgcgcatcgctgttgcttgcttcttctaccgtttggcttggcgccgcgcagggaggagtgtggggataacatcgctgtcccactcgcacccgggcgctgcccctccctgttcccttctcactgcgtgtggtgtgcttatccgcggcgggcgaatccaatcccccactcccccccgtccttctccagaaaagtcgcggctttcccccgccccccgcctcgcccggctctcatgattcccgccgattcatcctccgcccatttgcccctccgcgtcggagaatcccccgcgccactgccgctgccgctggccgtcgtgcggtaggggcgggagtgaggagcgtggagcagcgagggggggcggtggtggtggctggcggcgagatgtcgtcgtcgcggtccaacaaccggccggcgtgctcgcgggggagctcggcgcggtccaagcacagcgagcgggtggtggcgcagacgcccgtggacgcgcgcctgcacgccgagttcgagggctcgcagcgccacttcgactactcctcctctgtcagcgcgctcaaccgctccggggccagcaccagctccgccgtctccgcctacctccagaacatgcagcggggccgctacatccagcccttcggctgcctgctcgccatccacccggagtccttcgcgctgctcgcctacagcgagaacgccgccgagatgctcgacctcacgccgcacgccgtgcccaccatcgaccagcgcgacgcgctcgccgtcggcgccgacgtgcgcacgctcttccgctcccagagcgccgtcgcgctgcacaaggccgccgtcttcggggaggtcaatctgctcaacccaatccttgtccacgccaggacctccgggaagcccttctacgccatcttgcaccgcatcgacgtcggcctcgtcatcgacctcgagccggtcaaccccgccgacgtgcccgtcaccgcagcaggcgcgctcaagtcgtacaagctcgcggccaaggccatctccaggctgcagtccctgcccagtgggaacctctccctgctctgcgatgtgctggtccgggaggtaagcgagctcactggctatgacagggtgatggcatacaagttccatgaggatgagcatggtgaggtcattgccgagtgcaggaggtcggatttggagccgtatcttggcctgcactacccggcaactgacatcccacaagcatccaggtttctgtttatgaagaacaaagtgcggatgatatgtgattgtgctgccagtcctgtgaagctcattcaggatgacaacctgtcacagcctatcagcctctgtggctcgaccatgagggcaccccatggttgccatgcccagtacatggccaacatgggctccatcgcgtcgctagtgatgtcgatcactataaacgaggacgaggatgaggatggagacactgggagtgaccagcagcccaaaggcaggaagctgtgggggctggtggtttgccatcacacgagcccgaggttcgtcccttttccgctcaggtatgcttgcgaattcctcttgcaagtgttcggcatacagctcaacaaggaggtggaacttgcttctcaggcaaaggagaggcacatcctccgcacgcagacccttctctgtgatatgctcctccgggatgctcctgttgggatatttacccagtctcccaatgtaatggatctggtgaagtgcgatggtgcagcattgtgttaccaaaaccagattatggtgctgggatcaacaccctctgaaggagagataaagaagattgtcgcatggcttctggagtgccatgatggctctactggactaagtacggacagcttattggaagcaggctatcctggtgcgtctgcgctcggtgaggttgtctgtggcatggcagctataaagatctcttcaaaaggttttatcttctggttccgatcacacacggcaaaggagatcaagtggggtggagctaagcatgaaccaggtgatgcagatgacaatggcaggaggatgcatccgcgttcttcgttcagggccttcttggaggtagttaaatggaggagtgttccttgggaggatgttgaaatggacgcaatccattctctccagctaatattgcgtggctccctgcaagatgaagatgctaacgacaacaatgcaaggacaattgttgaagctccatctgatgacatcaagaagatacaggggctacttgaattgagaattgtgacaaatgaaatggtgcgcctaattgagacagcaactgctcctatattggctgtcgacatcgttggtaacataaacggatggaataataaagttgcagaaattactggattacccaccacggaagccatagggatgcttctggtagatctcgtggagggtgattctgttgaagtggttaagcaaatgttgaactcagctctgcaaggaaccgaagagcaaaatttggaaatcaagcttaaaacattccatcaacaggaaagtaagggccctgtagtcttgatggttaacgcctgttgtagtcgtgacctttcagacaaagttgttggggtttgtttcgtagcacaagatttgacagggcacaagatgataatggataagtatacccggatacaaggcgactatgttgcaatagtaaagaaccccaatgagctcataccccctatatttatgattaatgatcttggttcttgcttagaatggaatgaagctatgcaaaagattactggtataaagagggaagatgcaatagataagctgctgatcggggaggttttcactcttcatgattatggatgtagggtaaaggatcaagctactataaccaaacttagcatactgatgaacacagtgatctccggtcaagaacctgagaagcttgcttttggtttcttcaacacagatggcaagtacatggattcactgctgacagcaaacaaaaggacagatgccgagggaaagatcaccggcgctctttgctttttgcatgtggccagcccggagcttcagcatgctcttcaggtgcagaaaatgtctgaacaagctgctacacacagcttcaaggaattgacatatattcgtcaagaattaaagaacccactcaatggcatgcaatttacccgtaagttgttggaaccgtctgacttgacagaggagcagaggcaactttttgcatcaaatgtcctctgtcaagaacagttgaaaaagattttacatgacaatgatctagaaggcatcgaacagtgctacatggagatgaacacagtggaattcaaccttgaagaagctttgaatacggtcctaatgcaaggcatgtctctgagcaaggaaaaacaaatttctcttgatcgtgattggccagtagaagtatcatcaatgtacctatatggggataacttaaggcttcagcaagtcctagcagactacttggcatgcgcacttcaatttactcagccagctgaagggcctattgtactccaggtcattcccaagaaggaacacattggttctggcatgcagattgctcatctagaattcagacttgtccacccagcgccaggcgtcccagaggcgctgatacaggagatgttccgccacggcccaggggtatcccgagaaggcctcggcctgcacataagccagaagctggtgaagacgatgagcggcacggtacagtacctccgggaagcggagagctcgtcgttcatcgttctggtggagttcccggtggcgcagctcaacagcaagaggtccaagccttcgacgagcaagagcaacttctgaatccaaccagggccattggttgggttgccagaagagcttagctgatgtatcatatgtgtagctgggaacatggattgtttcccatgttgttgatggttgaggtggagcttagcttagcttagctgttgttaggtttttagtgtaattttaacacggcaactctacgagtgagcgagcgatgaataaaattaaaatctgcgcttgtgttttttgatcaattctcaggtggttgcaaattcagacgtttcagtctggtttgaagaaaatt

SEQ ID NO: 2382 - DNA, 3792 bp, Triticum aestivum
gccgattcctcctccgcccatttgcccctccgcgtcgcagaatcccccgcgccaccgctgctgctgccgctcaccgtcgtgcggtagggggaggggcaggagcgaggagcctagctcgggggcggtggtgaccggcggcgagatgtcgtcgtcgcggtccaacaaccggccggcgtgctcgcgggggagctcggcgcgctccaagcacagcgagcgggtggtggcgcagacgcccgtggacgcgcgcctgcacgccgagttcgagggctcgcaccgccacttcgactactcctcctcggtcagcgcgctcaaccgctccggggccagcaccagctccgccgtctccgcctacctccagaacatgcagcggggccgctacatccagcccttcggctgcctgctcgcgatccacccggagtccttcgcgctgctcgcctacagcgagaacgccgccgagatgctcgacctcacgccgcacgccgtgcccaccatcgaccagcgcgacgcgctcgccgtcggcgccgacgtgcgcacgctctttcgctcccagagcgccgtcgccctgcacaaggccgccgtcttcggggaggtcaacctgctcaacccaatcctcgtccacgccaggacctccggcaagcccttctacgccatcttgcaccgcatcgacgtcggcctcgtcatcgacctcgagccggtcaaccccgccgacgtgcccgtcaccgccgcaggcgcgctcaagtcgtacaagctcgccgccaaggccatctccaggctgcagtccctgcccagtggcaacctctccctgctctgcgatgtgctggtccgggaggtaagcgagctcactggctatgacagggtgatggcatacaagttccacgaggacgagcatggtgaggtcattgccgagtgcaggaggtcggatttggagccgtatcttggcctgcactacccggcaactgacatcccacaagcatccaggtttctgtttatgaagaacaaagtgcggatgatatgtgattgtgctgcaagtcctgtgaagctcattcaggatgacaacctgtcacagcctatcagcctctgtggctcgaccatgagggcaccccatggttgccatgcccagtacatggccaacatgggctccatcgcgtcgctggtgatgtcgatcactataaacgaggacgacgatgaggatggagacactggcagtgaccagcagccgaaaggcaggaagctgtgggggctggtggtttgccatcacacgagcccgaggttcgtccccttcccgctcaggtatgcttgcgaattcctcttgcaagtgttcggcatacagctcaacaaggaggtggaacttgcttctcaggcaaaggagaggcacatcctccgcacgcagacccttctctgtgatatgctcctccgggatgctcctgttgggatatttacccagtctcccaatgtaatggatctggtgaagtgcgatggtgcagcattgtgttaccaaaaccagattatggtgctgggatcaacaccctctgaaggagagataaagaagattgtcgcgtggctgctggagtgccatgatggctctactgggctaagtacggacagcttattggaagcaggatatcctggtgcgtctgcgctcggtgaggttgtctgtggcatggcagctataaagatctcttccaaaggttttatcttctggttccggtcgcacacggcaaaggagatcaagtggggtggagctaagcatgaaccaggtgatgcagatgacaatggcaggaggatgcatccacgttcttcgttcagggccttcttggaggtagttaaatggaggagtgttccttgggaggatgttgaaatggacgcaatccattctctccagctaatattgcgtggctccctgcaagatgaagatgctaacgacaacaatgcaaggtcaattgttgaagctccatctgatgacatcaagaagatacaggggctacttgaactgaaaattgtgacaaatgagatggtgcgcctaattgagacagcaactgctcctatattggctgtcgacatcgttggtaacataaacggatggaataataaagttgcagaaattactggattacccaccacggaagccatagggatgcttctggtagatctcgtggagggtgattctgttgaagtggttaagcaaatgttgaactcagctctgcaaggaaccgaagagcagaatttggaaatcaagcttaaaacaatgcatcaacaggaaagtaagggtcctgtagtcttgatggttaacgcctgttgtagtcgtgacctttcagacaaagttgttggggtatgtttcgtagcacaagatttgacagggcacaagatggttatggataagtatacccggatacagggtgactatgttgcaatagtaaagaaccccaatgagctcataccccctatatttatgatcaatgatcttggttcttgcttagaatggaatgaagctatgcaaaagattactggtataaagagggaagatgcaatagataagttgctaatcggggagcttttcactcttcatgattatggatgcagggtaaaagatcaagttactctaaccaaacttagcatactgatgaacacggtgatctctggtcaagaacccgagaagcttgcttttggtttcttcaacacagatggcaagtacatggaatcactgctgacagcaaacaagaggacagatgctgagggtaagatcaccggcgctctttgctttttgcatgtggccagccccgagcttcagcatgctcttcaggtgcagaaaatgtctgaacaagctgctacacacagctttaaggaattgacatatattcgtcaagaattaaagaacccactcaatggcatgcaatttacccgtaagttgttggaaccgtctgacttgacagaggagcagaggcaactttttgcatcaaatgttctctgccaagaacagttgaaaaagattttacatgacaatgatctagaaggcattgaacagtgctacatggagatgaacacggtggaattcaaccttgaagaagctctgaatacggtcctaatgcaaggcatgtctctgagcaaggaaaaacaaatttctcttgatcgtgattggcctgtagaagtatcatcaatgtacttatatggggataacttaaggcttcagcaagtcctagcagactacttggcatgcacgcttcaatttactcggccagctgaagggcctattgtactccaggtcattcccaagaaggaacacattggttctggcatgcagattgctcatctagaattcagacttgtccacccagcaccgggcgtcccagaggcactgatacaggagatgttccggcacggcccaggggtatcccgagaaggcctcggcctgcacataagccagaagctggtgaagacgatgagcggcacggtacagtacctccgagaagcggagagctcgtcgttcatcgttctggtagagttcccggtggcgcagctcaatagcaagaggtccaggccttcgacgagcaagagtaacttctgaatcccggcgacggtgccctcgagatgtgaaccagggccattgattgggttgctggaagagcaagccctttgggagagcttagctgatgtatcatatgtgtagctgggaacatggattgttcccatgttgatggttgaggaggagcttagctagcttagctgctgttaggttttagtgtaattttaacacggcaactctacgagtgatcgatgaataaaattaaatatgtg

SEQ ID NO: 2383 - DNA, 3815 bp, Hordeum vulgare
ggtgattcccgccgattccacctccgcccatttgcccctccgcgtcgcagaatcccccgcgccaccgccgctggccgtcgcgcggtagggccgtaggagcgaggagcgcagagcagcgagggggtggcggcgggatgtcgtcgtcgcggtccaacagccggtcggcctgctcgcgggggagctcggcgcggtccaggcacagcgagcgggtggtggcgcagacgcccgtggacgcgcagctgcacgccgagttcgagagctcgcaccgccacttcgactactcctcctcggtaagcgcgctcaaccgctccggcgccagcaccagctccgccgtctccgcctttctccagaacatgcagcggggccgctacatccagcccttcggctgcctgctcgccatccacccggagtccttcgcgctgctcgcctacagcgagaacgccgccgagatgctcgacctcacgccgcacgccgtgcccaccatcgaccagcgcgacgcgctcgccgtcggcgccgacgtgcgcacgctcttccgctcccagagcgccgtcgcgctgcacaaggccgccgtcttcggggaggtcaacctgctcaacccaatcctcgtccacgccaggacctccgggaagcccttctacgccatcttgcaccgcatcgacgttggcctcgtcatcgatctcgagccggtcaaccccgcggacgtgcccgtcaccgccgccggcgcgctcaagtcgtacaagctcgccgccaaggccatctccaggctgcagtccctgcccagtggcaacctctccctgctctgcgatgtgctggtccgggaggtaagcgagctcaccggctatgacagggtgatggcatacaagttccatgaggatgagcatggtgaggtcattgccgagtgcaggaggtctgatttggagccgtatcttggcctgcactacccggcaactgacatcccacaagcatccaggtttctgttcatgaagaataaagtgcggatgatatgtgattgtgctgcttcacctgtgaagctcattcaggatggcaacctgtcacagcctatcagcctctgtggctcaaccatgagggcaccccatggctgccatgcccagtacatggccaacatgggctccatcgcgtcgctagtgatgtcggtcactgtaaacgaggatgacgatgaggatggagacactgggagtgaccagcagcccaaaggcaggaagctctgggggctggtggtttgccatcacacgagcccgaggttcgtccctttcccgctcaggtatgcttgcgaattcctcttgcaagtgttcggcatacagctcaacaaggaggtggaacttgcttctcaggcaaaggagaggcacatcctccgcacgcagacccttctctgtgatatgctcctccgggatgctcctgttgggatatttacccagtcgccaaatgtaatggatctagtgaagtgcgatggtgcggcattgtgttaccaaaaccagattatggtgctgggatcagcaccctctgaaggagagataaagaagattgccgcgtggctgctggagtgccatgatggctctactggactaagtacggacagcttactggaagcaggctatccgggcgcgtctgctctgggtgaggttgtctgtggcatggcagcaataaagatctcttcaaaaggttttatcttctggttccgatcgcacacggcaaaggagatcaagtggagtggagctaagcatgaaccaggtgatgcagatgacaatggcaggaggatgcatccacgttcttcgttcagggcctttttggaggtagttaaatggagaagtgttccttgggaggatgttgagatggacgcaatccattctctccagttaatattgcgtggctccctgcaagatgaagatgctaacgacaacaatgtaaggtcaattgttgaagctccatccgatgacgtcaggaagatacaggggctacttgaattaagaattgtgacaaacgagatggtgcgcctaattgagacagcaactgctcctatattggctgtcgacatcgttggtagcataaatggatggaatggcaaagttgcagaaattaccggattacccaccacggaagccatagggatgcttctggtagatctcgtggagggtgattctgttgaagtgattaagcaaatgttgaactcagctatgcaaggaaccgaagagcaaaattttgaaatcaagcttaaaacattccatcaacaggaaagtaatggccctgtagtcttgatggttaacgcctgttgtagtcgtgacctttcagacaaagttgttggggtttgtttcgtagcacaagatttgacagggcacaagatggttatggataagtatacgcagatacagggcgactatgttgcaatagtaaagaaccccaatgagctcataccccctatatttatgatcaatgatcttggttcttgcttagaatggaatgaagctatgcaaaagattactggtataaagagggaagatgcaatagataagttgctgatcggggaggttttcactcttcatgattatggatgtagggtaaaggatcaagctactataaccaaacttagcatactgatgaacacagtgatctccggtcaagaacccgagaagcttgcttttggtttcttcagcacagatggcaagtacatggaatcactgctgacagcaaacaagaggacagatgctgagggtaagatcaccggcgctctttgctttttgcatgtgcccagcccggagcttcagcatgctcttcaggtgcagaaaatgtctgaacaagctgctgcacgcagctttaaggaattgacatatattcgtcaagaattgaagaacccactcaatggcatgcaatttacccgtaagttgttggaaccgtctgacttgacagaggagcagaggcaactttttgcatcaaatgttctctgtcaagaacagttgaaaaagattttacatgacaatgatctagaaggcatcgaacagtgctacatggagatgaacactgtggaattcaaccttgaagaagctttgaatacggtcctaatgcaaggcatgtctctgagcaaggaaaaacaaatttctcttgatcgtgattggccagtagaagtatcatcaatgtacctatatggggataacttaaggcttcagcaagtcctagcagactacttggcatgcacacttcaatttactcggccagctgaagggcctattgtactccaggtcattcccaagaaggaacacattggttctggcatgcagattgctcatctagaattcagagttgtccacccagcgccaggcgtcccggaggcgctgatacaggagatgttccgccacggcccaggggtatcccgagaaggcctcggcctgcacataagccagaagctcgtgaagacgatgagcggcacggtacagtacctccgggaagcagagagctcctcgttcatcgttctggtggagttcccggtggcacagctcaacagcaagaggtcgaagccttcgacgagcaagtggtcgaagccttcgacgagcaagagcaacttctgaatccaaccagggtcattggttgggttgctagaagagcttagctgatgtatgtatcatatgtgtagctgggaacatggattgttcccatgttgatggttgaggaggagcttagctagctgagctgttaggtttttagtgtaattttaatacgcaactcttcgagtgagtgagcgatgaataagattaaaatgtgcgcttgtgttttttgatcgattctcaggtggttgcagattcata

SEQ ID NO: 2384 - DNA, 4334 bp, Setaria italica
gcgtcgactgttgcggggaagaagacccccggatgacgccacatcgctttccactctcggagccctgacaacccactcgtcttcaactgcggcggccgcgcatcctccaatttccgacgctcccaatcccccgatccgtccgcgtgctcctcgccgaccgccgccgccgcgccggcgtcctctccccgcggttagtgagtcagccgcgcgcgcatcgctgttgctgttgcttccctcggttccctttcgtgttcccctttggagcagggcaggagagaagatattatcgctgctgctgctgctgcttgcccgctcgctgtcccactcgcgcgcgcctcgcctcggccccggaggcgtagtattccccatcctcccccgtgcttatccgcggcggaatccaatcccctaccccacgtccttctgcccagcaaagggcgccaccgcttttggcgtattccacggctgccgcgcgcatgattcccgcggattcctctgcccatttgctcctgttcccctcgcagctgcagcgccgccgcggctagtccggtagcggggaaggaggaggaggaaggggggattgggttggggggcggcggagatgtcgtcatcgcggtccaacaaccgggggacatgctcccggagcagctcggcgcggtccaagcacagcgcgcgggtggtggcgcagacgcccgtggacgcgcagctgcacgccgagttcgagggctcccagcgccacttcgactactcctcgtcggtgggcgccgccaaccgccctttggccagcaccagcaccgtctccgcctacctccagaccatgcagcggggccgctacatccagcccttcggctgcctgctcgccgtccacccggacaccttcgcgctgctcgcctacagcgagaacgcgcccgagatgctcgacctcacgccgcacgccgtccccaccatcgaccagcgggacgcgctcgccgtcggcgccgacgtgcgcacgctcttccgctcccaaagctccgtcgcgctgcacaaggccgccaccttcggggaggtcaacctgctcaaccccatcctcgtgcacgccaggacgttggggaagcccttctacgccattatgcaccgcatcgacgtcggcctcgtcatcgatctcgagccggtcaaccccgccgacgtcccggtcaccgctgcgggcgcgctcaagtcgtacaagctcgccgccaaggctatctccaggctgcagtcgctgcccagcgggaacctctcgctgctctgcgatgtccttgtccgtgaggtgagcgagctcacgggctacgacagggtcatggcgtacaagttccatgaggatgagcacggcgaggttatcgccgagtgcaggagatctgatctggagccgtatcttggcctgcactacccagccactgacatcccacaggcgtccaggtttctctttatgaagaacaaagtgcggatgatatgcgattactctgctgttccagtgaagatcattcaggatgatagcctagcacagcctctcagcctatgtggttccacgctccgggctccccatggttgccatgcgcaatacatggcaaacatgggctctgttgcgtcgcttgtgatgtcagtaactataaacgaagatgaggaggatgaggatactgggagtgaccagcagcccaaaggcaggaagctgtgggggctggtggtctgccatcacacgagcccgaggttcgttcctttcccgctaaggtatgcttgcgagtttctcttgcaagtgttcggcatacagctcaacaaggaggtagaactggctgctcaggcaaaggagaggcacatcctccgaacgcaaacccttctgtgtgacatgctcttgcgggatgcccctgttgggatatttacccagtcgcctaatgtgatggatctagtaaagtgtgatggagctgcactgtactaccaaaaccagctttgggcgctcggatcggttccctccgaggcagagataaagagcattgtcgcatggctgcaggagaaccatgatggttcaactgggctgagtactgacagcttagtggaagcgggttatcctggtgctgctgcacttcgtgaggttgtgtgtggcatggcagccataaagatctcttccaaagatttcatcttctggttccgagcccacacagcaaaggagatcaagtggggtggagctaagcatgaagcagtggatgcagatgagaacggcaggaagatgcatccacgatcttcgttcaaggccttcttggaggtggttaaatggagaagtgttccctgggaggatgttgaaatggacgctatccattctttgcagttaatattacgtggctccctgcaagatgaagatgccaacagaaacaatgtaaggaccattgtaaaagctccatctgaggatacgaagaagatacaggggctacttgaactaaggacagttactgatgagatggtccgcttaattgagacagcaactgcccctatcttggctgttgatattgccggtaacataaatggatggaacaataaagccgcagaactaactggattacctgttatggaagccatagggaggcctctggtagatcttgtcatgtctgattctgttgaagtggttaaacagattttggactcagctttacaaggaattgaggagcaaaatctggaaatcaggcttaaaacattcaatcaacaggaatgcaatggccctgtaattttgatggtcaactcctgctgcagtcgggacctttcagagaaagttgttggagtttgctttgtagcacaagatttgactgggcagaagatgattatggataaatatactaggatacaaggagactatgttgccatagtgaagaaccccagcgagctcatccctcccatatttatgatcaatgatcttggttcctgcttagagtggaatgaagctatgcagaagattaccggtatgaagagggaagatgccattgacaagttgttaattggggaggttttcacccttcatgattatggctgtagggtgaaagatcatgctactctaacgaaacttagcatactgatgaacacagtgatttcgggtcaggatcccgggaaactcccttttggtttcttcaacacagatggcaagtatgtggaatcccttctcacagcaaataagaggacaaatgctgagggcaagatcaccggtgctctttgcttcctgcatgtggccagcccagagcttcagcatgctctccaggtgcagaaaatgtctgagcaagcggctacaaacagctttaaggaattgacctacattcgccaagaattaaggaacccactcaatggcatgcaatttacacatagtttattggaaccttccgagttgacagaggaacagaggcggcttgttgcatctaatgttctctgtcaggatcagctgaaaaagattttgcatgacactgatcttgaaagcattgaacagtgctatatggagatgaacacagtagaattcaaacttgaggaagctctgaatacagtcctcatgcaaggcatgtctctgggcaaggaaaaacggatttctattgaacgtgattggcctgtggaagtatcatgcatgcacctctatggagacaatttaaggcttcagcaggttctagcagactacctggcatgcactcttcaattcacccaaccagcgaaggacctattgtactccaagtcattcccaagaaggaaaatattgggtctggcatgcagattgctcatttagagttcaggattgtccatccagcaccgggtgtcccagaggccctaatacaagaaatgttccggcacaacccagagatgtctagggagggcctcggcctgtacataagccagaagctagtgaagacgatgagcggcacagtacagtacctccgggaagccgacagctcatcgttcattgtcctggtagagttcccggtcgcccagctcagcagcaagcggtccaagccttcaacaagtagattctgacgctcttgcacccagaactgtaaacagcattccctccactgagagctcggctgtgttaaatagtcaaatgtagcaagtttgaagcatcgttggtcgtctttgtatctggcacggtctttgtaatgcggatagatttggtcgtttcaggagttggctaggtgtagtgtaactttaaccgagaactggatgcgtatgttgagttgtgagaatgaataaaagctccacatttattcttcttttcttctgaacgagctttactgtgttgtcagtgagagtatatctcacaaaccatgttctgctggtgaatgcgggaattagcccgaaggaaa

SEQ ID NO: 2385 - DNA, 3056 bp, Panicum virgatum
cggcccagtccaccagaaaggaaccgttcgaagcgcacggactccacccgcacccttttaaacacggctctgagccggccgtttcgagtccgtcgtcgtgtagctctcatccatcgtgatggactagatccttccttgcacaccactaacccccaaccaccgccacctaatcgcccatccgcgccctgcttcccctgcgctgcaagggcggtctcgtcccagatccgcccgttcgcgcgcggatcgatccttccaccgcctctctccggtccggcgggtggttttctcggagattcccactggttgtggcggtcgatttgtgtctgctcgcgttgcgtgtggatctggtttgggacggaggagagaagcgtggaggtgctcgtgtgaggagggacgccgttagagcggctcgatctgttcgtcggttctagatctggaagggcttaatctgtctcagttagggcacctgcacctgcacctcgacccatggcgacgcttgtcatctcggagcagcgcggccaccagctccaccattcctctggtcgccggaagaaggcatcatcagcatcgccccatttctcctcgccacaacctgtgcgcggctttcaagccgataactgccgcgccttccactccagcatcaccatcggcatcctgccgtcccctcccgcgccaggggtggcacggactcgctcctcccctgagcctaagacgccgaagcagcaggtgcaccatgggaaaaagcgcagcagagcaatatccatcagcccttcaacatcccctccctcgcgccctgaactctgggctggcccggggttctccaactcaccaccacccagctccctgccgatacccaagttctccctccaccagaagcgcagtatctcacttgagtttccacctgctgaccggtcagatgatgaagtgctgcctgtgcatgccaagtctgtgccttcatcgccaactgcaggctcaggtgttagcttctttagtgataatgatgctgccattgcaacggagaatctgaggaggatccttcacttgaaaattgaggatcactgaatcgggaggggttggcagttctgtgtacataggttaactacaactaaccctggtagtctgtatagcgtagctgaggataaccaccgtgcacctgacctgacggtggttttcatctacagtgtaggtggttagcaagcacagctagaaggttaggcagtatgaaactgcagtgatggtgtggtggtggtggagatgcatgaggtcactgcagtttatgaagtcaccttttcagctgaccttgtagacaccttttagtatccaatgttccttttaggtgttggttttttagacattagataagtcatttgcatctgtagttcatgtcagtagtgctagcctacatacccttgctcctgtagttcatgtcaggcaggacaagtaggttatggttcaagttttagataactttagcttacatcatgtcatatgtgtagtcatctgtaggatggctgcatctcatgaaacttgcattctgtctcaaagttgcatcctcctgactggctcatctcccttcataacatctccttgtgttctgcaaagctcgcaaggatctcccctctctagcacttctgttttttggaatgaagatgctgagagaagttgttatgaagtcccaactcaatgttctttctccatgtgtctcctaactctcagtttgtttcctcagttctttgcatcccttgcatgtcaaattgcattccctgccatccaatatcaatttcatatccttgctctcagagttgcacctagtggtggctttgccttcgtttaggcatctttggtatttccttgcccttgttcctggagcatgcccaggttatgctctccttcatatattcccataaaggacttaatatgctggagatctgcaagtgctcaaacagtcaaacctgtataaggtttgcttgtccaatgcacttcatggtacccatacttggagtccagaatttatgaagtgtcttatcacttagttatctgttttctttttttccagtattgtgctagactgttgttttgtgtaatatttgattgggtagttgtttgtggtattgttttaatgttgttactcgaatttgctgtcagtgtttttccatgtcgatgctgtggtatttcttttacttcttaactaaactttgttatactgtcatggtatttttggtcctgtttctgtaacgtgcctgaagttttataatatggcctagtgtgaaggtggatccatcctgtctttctttcgtcgttgcaactcaagattttctggtggtctagatcattgagtcgtaatggtgtctttttgaggatttatgagcactgggaattgggatgctcggtgactggtgcttcagctggctgttgctggtggctggtgttgatttgttgtgagagaaaagtactattggctggttggtggtgttggctggtgctgatttggtgtgagaaaattactgctggctggttggctgacaagtcagctgaacagagtattttgtgttgggaagacgattgattctgatcgtacaatttgtgaaaatgttgatgatttttttgctgctgctatattgtgcggtctctcttcgatgtttggtcgtttggagcttctcaagaccttttagttgcatatatacacaattacggttaaattgctctggagagaacagatatctatgtcagcatagttgactttgttaggcttcacctgtggagctagtaatccatggctctatgtttctgttattcagttctggctattatggttggcggctctgtgatccattttccatacatgccaacatgtttgattccacgagcaatcctactgtgcgtatgcatgaccattggacgctcatcatccgattccagtttatgcgtgtcccatgattggacgctcatcctcctgtgcaacttgggctttcaggctgtttccagcagcgctcgcatcgcatccccaatgcgggaaaagcgcactaccagggtactatagcacgctctacacattc

SEQ ID NO: 2386 - DNA, 2155 bp, Panicum virgatum
cgtgtagctctcatccatcgtgatagactagatccttccttgcacaccactaaccccaaccaccgccacctaatcgcccatccgcgccctgcttcccctgcgctgcaagggcggtctcgtcccagatccgcccgatcgcgcgcggatcgatccttccaccgcctctctccggtccggcgggtggttttctcggagattcccactggttgtggcggtcgatttgtgtctgctcgcgttgcgtgtggatctggtttgggacggaggagagaagcgtggaggtgctcgtgtgaggagggacgccgttagagcggctcgatctgttcgtcggttctagatctggaagggcttaatctgtctcagttagggcacctgcacctgcacctcgacccatggcgacgctcgtcatctcggagcagcgcggccaccagctccaccattcctctggtcgccggaagaaggcatcatcagcatcgccccatttctcctcgccacaacctgtgcgcggctttcaagccgataactgccgcgccttccactccagcatcaccatcggcatcctgccgtcccctcccgcgccaggggtggcacggactcgctcctcccctgagcctaagacgccgaagcagcagtgcaccatgggaaaaagcgcagcagagcaatatccatcagcccttcaacatcccctccctcgcgccctgaactctgggctggcccggggttctccaactcaccaccacccagctccctgccgatacccaagttctccctccaccagaagcgcagtatctcacttgagtttccacctgctgaccggtcagatgatgaagtgctgcctgtgcatgccaagtctgtgccttcatcgccaactgcaggctcaggtgttagcttctttagtgataatgatgctgccattgcaacggagaatctgaggaggatccttcacttgaaaattgaggatcactgaatcgggaggggttggcagttctgtgtacataggttaactacaactaaccctggtagtctgtatagcgtagctgaggataaccaccgtgcacctgacctgacggtggttttcatcaacagtgtaggtggttagcaagcacagctagaaggttaggcagtatgaatctgcagtgatggtgtggtggtggtggagatgcatgaggtcactgcagtttatgaagtcaccttttcagctgaccttgtagacaccttttagtatccaatgttccttttaggtgttggttttttagacattagataagtcatttgcatctgtagttcatgtcagtagtgctagcctacatacccttgctcctgtagttcatgtcaggcaggacaagtaggttatggttcaagttttagataactttagcttacatcatgtcatatgtgtagtcatctgtaggatggctgcatctcatgaaacttgcattctgtctcaaagttgcatcctcctgactggctcatctcccttcataacatctccttgtgttctgcaaagctcgcaaggatctcccctctctagcacttctgttttttggaatgaagatgctgagagaagttgttatgaagtcccaactcaatgttctttctccatgtgtctcctaactctcagtttgtttcctcagttctttgcatcccttgcatgtcaaattgcattccctgccatccaatatcaatttcatatccttgctctcagagttgcacctagtggtggctttgccttcgtttaggcatctttggtatttccttgcccttgttcctggagcatgcccaggttatgctctccttcatatattcccataaaggacttaatatgctggagatctgcaagtgctcaaacagtcaaacctgtataaggtttgcttgtccaatgcacttcatggtacccatacttggagtccagaatttatgaagtgtcttatcacttagttatctgttttctttttttccagtattgtgctagactgttgttttgtgtaatatttgattgggtagttgtttgtggtattgttttaatgttgttactcgaatatgctgtcagtgtttttccatgtcgatgctgtggtatttcttttacttcttaactaaactttgttatactgtcaatggtatttttggtcctgtttctgtaacgtgcctgaagttttat

SEQ ID NO: 2387 - DNA, 1212 bp, Oryza sativa
cacccagccaggtattcaggtccaacctgcttccgtgacacaagtcgaaacctaacgcgacgcacggttcgccccgcgccgcagcgctgctcacgcgcatacgcattccccctctcctctcctttataaatcccccgcgcgccggcggccggccggtgaccaccaaccactctaccacaaccattacgctatccgccacgagcaagcgagcgagagcgaggcaaagcaagaaggcgacctcaccaaataatcccccaccaccacaagaagcaggggcgcgccatggcgagagccgctaccgtggcggcggcgtcgtccgcgctgctgctggcgctgctcctggcgctggcgtggggagccgcggcgggggcgggggaggtgccgctcggctgggagctcggggtcggcgtcggcggcggcagcggcgacgacgacggcttcgggttctccggggcggcggctgacggcgccgcggtggtgaggcgggtcctgcaggggcggggctacatcagctacggcgcgctgcggcgcgacacgacgccctgctccgtccgcggcgcctcctactacaactgccgccccggcggccaggccaacccctactcccgcggctgctccgccatcacccgctgccgcggctgaccggcctccaccaccaccaacccgctgttcgaactggattcaaagttcgttcgttgctcctctccgtctactcgctagttcgtcttcttcatttttttctccccttccttactctttttttttctccgccctgttttaaccgtgaaagaagaagcacaattggtctggatcggtgcccaggaatcgaatcgagtgaataagatttgtgtcactccagtcctgtatgtggattctaataatattaataatcaagttgtgtataaactggtggatagatttatcgttcaaggatgagtgctgctactgatgacaacccggtgagcaaattcgctcaattgcagcaatcgcccttctccaaacacgggtttccttaacattaaaatgttatcaaatggaatggattaagagaagcagaggttggctaagccaaccaaattgtttactaaatccacaccagctggcctgattagtcggaatggtcagcagctgatggcgccgttgggacttcaggaatcagaacctgcttttctgcatacccaacccacaaaacggttagccaccgacactgcg

SEQ ID NO: 2388 - DNA, 2150 bp, Brachypodium distachyon
cgtcggtggcggcgtcgcaatcatcctgcacgcgcccctcattccacgctacaccaccgcaccaacccgagaaagaacaacactaggcaccagcatccggcagcacactctccgtcccgagaaggcaaagcaaagctaacctcgctgcagttcccactcttcgccacgactcgattcgattcgtcggcacctcccttcttctcgaagcttctagtgccctgccgtctcgcttccgcaccaacccagtccaagcctacctcgctgccgagagtggccgccgccgccgctgcttggtggttactgcaagtgctagtgtcggtcggtgggatgcccgccgggacggtggacgcggcgccgcgccgccagtaaaagcggcggaggcttgtctctcgccgggcgcaaacccggttttaaccgccgctgacatcgcccgccgacgccaattccggccccgcaccgcgccatggacgccgcctctcgccccgcggtcgtcatcgacaacggcaccggatacacgaagatgggattcgccgggaacgtggagccctgcttcatcacccccaccgtcgtcgccgtcaacgactcattctccaaccaggcgagggccaccactaaggggaactggatggcgcagcacaacgccggtgtcatggccgatctcgacttcttcataggggacgaggctttagctcggtcccgttctagcagcacatacagcctcagctaccccattcgcggcggccaggttgagaattgggataccatggagaagttctggcagcagtgcattttcaattacctccggtgtgatccagaagatcactatttcctactgacagagagcccgctgactcctcctgaaactcgggagtacactggggagatcatgtttgagacgttcaatgtgcccggtctgtacatagcggttcaacctgtccttgccctcgctgcaggatacacaacaacaaagtgtgaaatgacaggtgttgtagttgatgtgggtgatggagctacccacattgttcctgttgctgatgggtatgtcattgggagcagtatcagatctattccacttacaggcaaggatgttacccagtttattcagcaacttatgaaggaaagaggtgaacacattccaccagaagaatcttttgacgtggcaaggagggcgaaggaaatgtactgctatacctgttcggacattgtgaaggaatttaataagcatgacagagagccctccaagtacataaaacacttgactggcaccaaaccaaaaactggtgctccatacacctgtgacattggatacgagcgcttcctgggccctgagattttcttccatcctgagatttacaataatgacttcaccacccctttgcaagatgttattgacaaatgcatccaatcatccccaatcgacacaaggagggctctttataagaatattgtcttgtctgggggatcgactatgtttaaagatttccacagaagattacagcgggacctaaaaaagattgtggatgcacgggtccgtacatctaatgctcgacttggtggagatacaaaggcccaacccgtagaagtcaatgtggttagtcatccaattcaaagatatgcagtttggtttggtgggtctgtgcttgcttctacagctgaattctatgaggcttgtcacacaaaagcagagtatgaagagtacggtgcaagcatctgccgatcaaatccagtcttcaaagggatgtactgaacctgccgatgaaaaaaagaagaagaaaaactggcgctgggcatcagaaatagcatccccatgcaatcagcctgggcctagcagcagcaggctggcagcatggtaaaactgacattgtggaggcagaggctgccaaggagcctgcctcgctgtacgcgcttgtacaaaaccggcgtgcacatagatagatcacatcgccttgatacatcttttgaattcatctgtacttctagcctagcgataagaacactccgcgagtgacctggagtctagcgggtagcgagctgtgaacggcatgctgttgtataatctgactgaattggaatatcgctgtaacagtaacttttcgtactcctacaatttgtggggtttatctggtattgttccatgcacctttcccgtg

SEQ ID NO: 2389 - DNA, 1881 bp, Triticum aestivum
cgccgctgcgacggtggccgccgcccgcaaccgtttcctcccaccgccgactttcctctcgccagtcgcaacctggtgctgccgccgctgacatcgtctgcctccgcccccgcaccacgatggaccccacctcacgccccgccgtcgtcatcgacaacggcaccggctacaccaagatggggttcgccgggaacgtggagccctgcttcatcacccccaccgccgtcgccgtcaacgaatccttctccgaccagacgagggccaccgccaaggggaactggctggcgcagcacagcgcgggcgtcatggccgatctcgacttcttaataggggaggaggctttagcccggtcccgttccagcagcacatacagcttgagctaccccattcgcaacggccaggttgacaactgggacaccatggagaagttctggcagcaatgcattttcaattacctcaggtgtgacccagaagatcactatttcctgctgaccgagagcccactgactcctccagaaacccgggagtacactggggagatcatgtttgagacgttcaatgtgcctggtctgtacatagcggttcaacccgtccttgccctagccgcaggatacacaacaaccaagtgtgaaatgacaggtgttgtggttgatgtgggtgacggagctacccacattgttcctgttgctgatgggtatgtcattgggaacagtatcagttctatcccacttacaggcaaggatgttacccagtttattcagcaacttatgaaggaaagaggtgaacacattccacccgaagaatcttttgatgtagcaaggagggcgaaggaaatgtactgctatacatgttcggacattgtgaaggaatttaataagcatgacagggagccctcaaagtacataaaacgcttgactggcatcaaaccaaaaacgggtgctccgtacacctgtgacattggatacgagcgcttcctgggccctgagatattcttccaccccgagatttacaacaatgacttcaccactcctttgcaagatgttatagacaagtgcatccaatcatccccaattgacacaaggagggctctttataagaatattgtcttgtctgggggttcaactatgtttaaggatttccacagaagattacagcgggacctgaaaaagattgtggatgtacgggtccgtgcatctaatgctcgacttggtggagatgcgaaggctcaacccgtggaagtaaacgtggttagccatccaattcaaagatatgcggtttggtttggcggatcggtgcttgcttctacagcagaattctacgaggcttgccacacaaaagcagagtatgaagagtacggtgcaagcatctgccgatcaaatcctgttttcaaagggatgtattgaaattttcgtatgaagactaggaggcatcacagatagcatctccatgcaatcagcctgagcctagctagcagtagcaggctggcagcatggtaaatggtaaaactgacaccggaggcaagctctctgtagcgtttgtttgtacacaaccagcgtgcacatagagataaacaaaacatttcgttaattcatcttctgtatactacatatgtagaatggggccggttagtgcagcaaacaggagaacttgtgaccggatggcgctggcggcacctgagcggcacatgcttagctgttgtatatctgtagtaccactcagtgtggccgtaaacggaacagttttttgtgggtgagctggtatggctcctcgtattttcccgtgaagtcgttgccaccgattttctggatagtggaagatttcagttgacatcgtgatcatgatgcatttattattatctactctatctataaaagaaagatg

SEQ ID NO: 2390 - DNA, 2137 bp, Setaria italica
acacgcacgcaccacccgagaggcccagacgacgcagcgttgtcaacacgcacgccaggacaaatccagccagcgctcaccgaagcagaaaggccgcgacccaaagcaaagcagagctcgagctccgctctccagtcttcccaccgcccgccaaccccgagatatacctcccttcttcccgaagcttcgtcccccagagacagacgacattactggctctgcctcggcgcgggtgccggtggttgccagtggcggtgggtgggtggcccggtggtggcgctgggatgctcgccgcgacggcgaccgccgcccgcctcctccgcctgccgctggtcgtagcggcccaccgcgcgcccgactcgacccggccccgccccgattgccgccgccgccgccactgacggacgaccgccccgcttggcgcccgccatggacgccttgtcccgccccgccgtcgtcatcgacaacggcaccgggtacacgaagatggggttcgcggggaacgtggagccctgcttcatcacccccaccgtcgtcgccgtcaacgactccttctccgcctccgcgcagccggcgccgaggggcgcccccgccaaggggaactggctcgctcagcacagcgccggcgtcatggccgacctcgacttctacatcggggaggaggcgctggcgcggtcccgcgccagcagcacgtacagcctcagctaccccatccgcaatggccaggtggagaattgggatactatggagaggttctggcaacagtgcatcttcaattacctgcggtgtgatccggaagatcattactttcttttaactgagagccctctgactgctcctgagactcgggagtacactggggagatcatgttcgagacgttcaatgtgcccggtctctacattgcagtccaaccggtccttgcgctagctgctgggtacactaccaccaagtgtgaaatgacaggtgttgtagttgatgtgggtgatggagctacccacattgttcctgttgctgatggttatgtcattggaagcagtatcagatctattccgctcacaggcaaggatgttacccagtttatccagcaactcatgaaggaaaggggtgagaacattccacctgaagaatcttttgatgtagcaaggaggcttaaagaaatgtactgctatacttcttcagacattgtgaaggaattcaataagcacgacagagagccctcaaagtacattaaacattggactggcatcaaaccaaaaactggagcaaaatacacatgcgacattggatatgaacgattcctggggcctgagatattcttcaacccggagatttacaacaatgacttcaccactcctttacaagttgttattgacaagtgcattcaatcatccccaatcgacacaaggagagctctgtacaagaatattgtcttgtctggaggatcaactatgtttaaggatttccataggagattacaacgggacctgaaaaagatagtggatgcacgggtccgtgcatctaacactcggcttattagtggggatccaaaggcccaacctatagaagtgaatgtggtcagtcatcctattcagagatatgcagtatggtttggcggttctgtgcttgcttctactgcagaattctacgaggcttgccacacaaaagcagaatacgaagagtatggtgcgagcatctgccgaacaaatcctgttttcaaaggaatgtattgaacagagccccagtgcattaaaccggagagcaaatccccaagctggacatcacaaaagtgtaactccccagtccccatgcaatcgaccggtgcctgcacatcccctgcaaaaatggggagactgacgggttgaggaggcctgacgagagatcctgtagaagcctttgccgcacgagttgtacaaaccaaccaaaagtgcgcatagatagacccatacatcatctatatatttctgttagatgccggcaacggctttgtcaccagcatggtcgcgcccaatctgcctgctgctgtactatataatctttgctaacttgcggcgcgttgtaatttgtagcgccaacattgttcttcctggtgatgcagctttgcgccttgtagatctacatgttgtttcgtttacaatg

SEQ ID NO: 2391 - DNA, 2166 bp, Sorghum bicolor
catcctgcacgccaccagcgtaccccaacccgaggacgaacacgccgcgcccgcactcgaacacgcacgccacgagacgcaacgcaacgcagcgttgtcactgtcacgccaggacaaatccagcgctccccgaagcagaaagaccgcgacccaaagcaagctcgagctccgctccgctccagtctccaccgccccgccaacccccgagagatacctcccttcctctccaagctttcgtctccagaccagacgacgtcgccggctcttccctcggcgctggtgctggtggttggaccagtggcggtgggtgggtggccgggtggctgggtggtgctgttgctgggatgcccgccgcgacggcgaccgccgccagcctccgcctgccgctgccaaaggcggcccgccactcgccccgctcgagccggcgccaccccgattgccgccgccgccgctgacgagcgaccgcacgctcggcgcccgccatggacgccttgtcccgccccgctgtcgtcatcgacaacggcaccgggtacacgaagatggggttcgcggggaacgtggagccctgcttcatcacccccaccgtcgtcgccgtcaatgattccttctcctcctccggccagcccgcggcgaggggcgcccccgccagggggaactggctcgctcagcacagcgccggcgtcatggctgacctcgacttctacatcggcgaggaggcgctggcccgatcccgcgccagcacctcgcacagcttgagctatcccatccgcaacggccaggtggagaattgggatactatggagaggttctggcaacagtgcatcttcaattacctccggtgcgacccagaagatcattattttcttctaactgagagccctctgactgcccctgagacccgggagtatactggggagatcatgttcgagacgttcaatgtgcccggcctctatattgctgtccaacctgtccttgcgctcgctgctgggtacactaccaccaagtgtgaaatgacaggtgttgtagttgatgtgggtgatggggctacacacattgttccagttgctgatggatatgtcattgggagcagcatcagatctattccaattacaggcaaggatgttacccagtttgttcatcaacttctaaaggaaagaggtgagaacattccaccagaagaatcttttgatgtagcaaggaggattaaagaaatgtactgctatacttcttcagacattgtgaaggaatttaataaacatgacagggagccatcaaagtacgttaaacactggacgggcatcaaaccaaaaactggtgcgaaatacacatgtgacattggatatgaacgattcctggggcctgagatcttcttcaacccagagatatataacaatgacttcaccactcctttgcaagttgttattgacaagtgcatccaatcatccccaatcgacacaaggagggctctttataagaatattgtcttgtctggaggctcaactatgtttaaagatttccataggaggttacagcgggacctaaaaaagatagtggacgcacgagtccgtgcatctaatagtcggcttattagtggagatactaaggcccagcctatagaagtgaacgtggtcagtcatcctattcagagatatgcggtatggtttggcggctctgtgcttgcttcaactgccgaattctacgaggcttgtcacacaaaagcagagtacgaagagtacggtgcgagcatctgccgatcgaaccctgtgttcaaagggatgtactgaatcagcccatcatataatcccattctcaatggtatgtattaaaccgggagcgattccctgaggttgactgtcgtgaatggcatccactccagcgtaaatggggagaaggagaactgacagtggagacggactgtccagagggatcctggagaagcatagccgtacgagctgtacaaacgaaaagtgcaaatagataggttcatgtttcatcatacaatttagatgctggtaggcctgacaggatgggtttgccacctctgctgaattgggtggcattgtaatttttagcgtcaacattgttgcttctggcgatgcggcattgctccatgtatacatgttgattcggcaacaattttttttctctcggtgacttcgtactagg

SEQ ID NO: 2392 - DNA, 2035 bp, Zea mays
aggacaaatccagcgctccccaaagcagaaagaccgcgacccaaagcaagctcaagccgctccgctcctccagtctccagtctccaccgcccgccaaccccgagatatacctcccttcctctcgaagcttcgtctgcagacgaagtcgccggctcttccctcggcgctggtgccggtgggttgcctgtggcggtgggtgggtggccgggtggtggtgttgctgggatgcccgccgcgacggcgaccgcagcccgcctccgcgtgccgctgccaaaagccgcccaccactcgccctgctcgagccggcgccaccccgactgccgccgccgctgacgagacgagcggccacacgcttggcgcgcgccatggatgccttgtcccgccctgctgtcgtcatcgacaacggcaccgggtacacgaagatggggttcgcggggaacgtggagccctgcttcatcacccccactgtcgtcgccgtcaacgattccttctccggctccgcccagccggcggtgaggggcacccccgccagggggaactggctcgctcagcacagcgccggcgtcatggctgacctcgacttctacatcggcgacgaagcgctggcccgatcccgcgccagcagctcgcatagtttgagctatcccatccgcaacggccaggtggagaattgggataccatggagaggttctggcaacagtgcatcttcaattacctccggtgcgacccagaagatcattattttcttctaactgagagccctctgactgcccccgagacccgggagtacaccggagagatcatgttcgagacgttcaatgtgcctggcctctatattgcagtccaacctgtccttgcgctggctgctgggtacactacaaccaagtgtgaaatgacaggtgttgtagttgatgtgggtgatggggctacccatatcgttccggttgctgatggttatgtcattgggagcagtatcagatctattccaattacaggcaaggatgttacccagtttattcatcaacttctaaaggaaagaggtgagaacattccagcagaagaatcttttgatgtagcaagaaggattaaagaaatgtactgctatacttcttcggacattgtgaaggaattcaataaacatgacaaggagccatcaaagtacattaaacactggacgggcaccaaaccgaagactggtgcaaaatacacatgtgacattggatatgagcgattcctagggcctgagatcttcttcaacccagagatatataacaacgacttcaccactcctttgcaagttgttattgacaagtgcatccaatcatctccaatcgacacaaggagggctctttataagaatattgtcctgtctggaggctcgactatgttcaaagatttccataggaggttacagcgggacctaaagaagatagtggatgcacgggtccgtgcatctaatagccggcttattagtggggatgctaaggcccagcctatagaagtgaacgtggtcagtcatccgatccagagatatgcggtatggtttggtggctctgtgcttgcttcaaccgccgaattctacgaggcttgccacacaaaggcagagtacgaggagtacggtgccagcatctgccgaacgaatcctgtcttcaaagggatgtactgactcagagcggttccctgtggctgacgtcgtggatgatatccactcaaagcttaaatggggagaagtgacagtggtcgtggagacaggactgtcgagagggatcctgatcgtggggaagcatagccgtacgagctgtacaaaagagaagcgcaaatagataggtttatgtttcaccatacaatttagatgctggtaggcctgacaggatgggtttgccacccctgctgaattgggtggcattgtaatttgtagcgtcaacacttctggcggtgcgagattgctccttgtatacatgttgattcggcagcgatgttttctctctctcggtggcttagtagttggtactggtctttgggcggttaccggca

SEQ ID NO: 2393 - DNA, 2867 bp, Panicum virgatum
acgcgacgcgcgccaggacaaatccaggcagaaaggccgcggcccaaagcaaagccaaagcggaggcgctcgagctcccaccccgctccgctcgctctccagtctccagtctccaccgcccgccaaccccgagatatacctcccttcctcccgaagcttcgtcttcgtctcgtccccccggagacagacggacgagcgttgctgcccccgcgcgggtgccggtggttgccagtggcggtgggtggtgtggtgctgccgctgggatgcccgccgcgacggcgaccgctgccgcccgcctgccgctgctcgaagcggcccgccgctcgcccgactcggcccggccccgcctcgattgccgccgctgacggacggacggacggacgacggccccgccccgctcggcgccggccatggacgccctgtcccgccccgccgtcgtcatcgacaacggcaccgggtacacgaagatggggttcgcggggaacgtggagccctgcttcatcaaccccaccgccgtcgccgtcaacgactccttcgccgcctccgcgcagccggcgcccaggggcggccccgccaaggggaactggctcgcgcagcacagcgccggggtcatggccgacctcgacttctacatcggggaggaggcgctggcgcggtcccgcgccagcagcacctacagcctcagctaccccatccgtaatggccaggtggagaattgggatactatggagaggttctggcaacagtgcatcttcaattacctgcggtgcgatccggaagaccattactttcttctaaccgagagccctctgactgctcctgagacccgggagtacaccggagagatcatgttcgagacgttcaatgtgcctggcctctatattgcagtgcaaccggtccttgcgctcgctgctgggtacactaccaccaagtgtgaaatgacaggtgttgtagttgatgtgggtgatggagctacccacattgttcctgttgcggatggttatgtcattgggagcagtatcagatctattccgcttacaggcaaggatgttacccagtttgtccagcaacttatgaaggaaagaggtgagaatattccaccagaagaatcttttgatgtagcgaggagggttaaagaaatgtactgctatacttcttcagacattgtgaaggaattcaataagtatgacagagagccctcgaagtacattaaacgctggactggcatcaaaccgaaaactggtgcaaaatacacatgcgacattggatatgagcgattcttggggcctgagatattcttcaacccagagatatacaacagtgactttaccactcctttacaagttgttattgacaggtgcatccaatcatccccaatagacacaagaagggctctatataagaatattgtcttgtctggaggatcgactatgtttaaggattttcatcggagattacaacgggacctaaaaaagatagtggatgcacgggtccgtgcatctaatactcggcttattagtggagatccgaaggcccaacctatagaagtgaatgtggtcagtcatcctattcaaagatatgcagtatggtttggcggttctgttcttgcttctaccgcagaattctacgaggcttgccacacaaaagcagaatatgaagagtacggcgcaagcatctgccgaacaaatcctgttttcaaagggatgtattgaatagaacccggatgcattaaacaggagggaaaatcgtcaagctggacatcacaaattgtcaccccacatgcaatcaacaatcgcctgcacgtctcctgcaacaatgaggagactgacagtcgaggcggcctgacgagagatccagtagaagccttgcagtcgctgcacgagttgtacaaaccaaagtgctcatagatagacccacattgcatctatatatctcttcattgctctgttagatgccggtagcctggcaacggctttgtactaatgcactatataatctttgctaacttgtggtgcgttgtaatttgtagcgtcaacgctgttgtttctagggatgggcgttgctactacatgttgattcatttacgatgttctttcccggtgatatggtgttgggttactccttggccgtcaatcgtcccatgtgttaatgccgccacgccctgccgcggggaacagcatggcagtgccgaggcctcaaacaagctggggttgcaaacctgtgtgcttgcgaatggatggctcgtttgcacggccgtcagcgccagcctccacggggcacggttctgaccaagccgtgccgtggagcaggcggcaccggcacaacgtgctcattttcctgttagccaattctgcaactcaggctgtaatcagtaagtaatcacctctttcttaactaggcctagcactaatatatgatcgaacagcacagaacatggacactgatttagtgacacggccaccgagttgggtgacagagcgattgcagattaggtaagcttcaatccagcaccaatagccaaaggagttaagataaaccaaacaaaagcctccctaatatttacaacctaccatgtctaagcttaccactgctctgaatgaggagcaaccagaatgtggctggaactggagtgggctcagctgaggtcaattggaacatgcatggggacgctcactctctccacgccctcaaggagcttcacgccgagttggcctctggcccctcccccaaacgcgcacagctcgccggactccatcaccgcaaatgtgtgcgggtgccccatctccgagttcagccagtaggaggcgttcgtcgggcagacctgcgcgaccttcttgttcagcgccttgagcgactctacgatgctc

SEQ ID NO: 2394 - DNA, 2086 bp, Zea mays
catcctgcacgccaccagcgtaccaacccgaagacgaacacgcgcacacgccgcactcgaacacacactcgacgcaatgcaacgcagcgcagcgttgtcacaatgtcacgccaggacaaatccagcgctccctgaagcagagaaagaccgcgaccaaaagcaagttcgatctccgctcctccagtctccaccgcccgccaaccccgagatatacctcccttcctctcgaagcttcgtctccagagtccagacgacgtcgccggctcttcactcggcgctggtgctggtggttgccagtggcggtggctgggtggccgggtggcggtgttgctgggatgcccgccgcgacggcgaccgccgcccgcctccgactgccgctgccaaaagcagcccaccgctcgccctgctcgagccggcgcctctccaattgccaccgccactgacgagcgaccacacgcttggcgcccgccatggacgccttgtcccgccccgctgttgtcatcgacaacggcaccgggtacacgaagatggggttcgcggggaacgtggagccctgcttcatcacccccactgtcgtcgccgtcaacgattccttttccggttcaggccagccggcggcgaggggcgcccctgccagggggaactggctcgctcagcacagtgccggcgtcatggctgacctcgacttctacatcggccaggaggcgctggcccgatcccgcgccagcagctcgcacagcttgagctatcccatccgcaacggccaggtggaaaattgggattctatggagaggttttggcaacagtgcatcttcaattacctccggtgcgacccagaagatcattattttcttctaactgagagccctctgactgcccctgagatccgggagtataccggggagatcatgttcgagacgttcaatgtgcccggcctctatattgctgtccaacctgtccttgctctagctgctgggtacactacaaccaagtgtgaaatgacaggtgttgtagttgatgtgggtgatggggctacccacatcgttccagttgctgatggttatgtcattgggagcagtatcagatctattccaattacaggcaaggatgttacccaatttattcatcaacttctaaaggaaagaggtgagaacattccaccagaagaatcttttgatgtagcaaggaggatcaaagaaatgtactgttatacttcttcagacgttgtgaaggaattcaataaacatgacagggaaccatcaaagtatgttaaacactggacgggcatcaaaccaaaaactggtgcgaaatacacatgtgacattggatacgagcggttcctggggcctgagatcttcttcaacccagagatgtataacaatgacttcaccactcccttgcaagttgttatcgacaggtgcatccaatcatccccaattgacacaaggagggctctttataagaatattgtcttgtctggaggctcgactatgtttaaagatttccataggaggttacagcgggacctcaaaaagatagtggatgcacgggtccgtgcatctaatagtcggcttcttagtggagatgctaaggcccagcctatagaagtgaatgtggtcagtcatcctattcagagatatgcggtatggtttggtggatctgtgcttgcttcaactgccgaattctacgaggcttgccgcacaaaagcagagtatgaagagtacggtgcgagcatctgccgatcgaaccctgttttcaaagggatgtactgactcagcctatcatagtcctgttctcaagggtatatatgtatttaaaccgagatctgttccctgtggctgacgtcgtgaatggcgtccactcaagcgtaaatggggagatctgacagcggaaacggactgccaagagggatcctggagaatcctagccgtaggagctgtacaaaagtaaagtgcaaatataggttcattttttatcatacaatttagatgctggtaggcctgacgggatgggtttgccacctctgctgaactgggtggcattgtaatttgtagcgtcaacattggtgcttgtatacatgtaggga

SEQ ID NO: 2395 - DNA, 1998 bp, Elaeis guineensis
ctcaggatcgccgtttggtaactcggcggggcctcacgccgcggtggggatcccctcccatcccaaacccccacgacacggatggaatccctcccttcctttcgttgagccgccgctgtcgcttgcgatccacgcctcttctactgtcttcttcttctctctcgccgacgccccacccctccgccgcccgtggccaataccatgagcggatgccctaggcggcgctacctctcggatctcgtcggcagatcctccgtttcctcgctctcgaatggacgctgcttctcggcctgccgttgtcatcgacaacggaaccgggtacaccaaaatgggatttgctggcaatgttgagccatgcttcatcatccctacagtagttgctgtcaatgagtcttttttgaatcaagcaaggagttcaagtaagggaaattggctagcacagcacagtgcaggtgtaatggctgatcttgatttttttattggagaggaggctttatcacggtctcgctctagcagcacatacaatcttagctaccctatacatcatggtcaggtagagaactgggataccatggaaagattttggcaacagtgcatttttaattacttgcgttgtgatccagaagatcattattttctcttgactgagagcccactcaccgctcctgaaaatcgtgaatacacaggggaaatcatgtttgagacatttaatgtccctgggctgtatatcgcagtccagcctgtccttgcccttgctgctggatatactacttccaagtgtgaaatgacaggggttgtagttgatgtgggagatggagctacgcatgttgtgccagttgcagatggttatgtgattgggagtagcatcaaatctattcctattgcgggcaaggatgttactcaatttattcagcaacttttgagggaaaggggagagcatataccaccagaagactcttttgaagtagctcggaaggtgaaagagatgtattgttacacttgttctgacattgtcaaggaattcaataagcatgataaggagcctgccaagtacatcaagcattggactggtgttaaaccaaggaccagagctccatattcctgcgatataggatatgagcgctttcttggtcctgagattttcttccatcctgagatatacggtagtgattttaccactcctttacctgctgtgattgacaagtgcattcagtcatccccaattgacacaaggagggctctgtataagaatatagtgctatctggaggatcaaccatgttcaaggacttccatagaagattgcagcgagatctaaaaaagatagtggatacgcgaatcgttacatctgctgcccgctttggtggagatgttaagtctcagcccattgaagttaatgtagtcagccatcctatccagagatttgctgtttggtttggaggttcagtgcttgcatctacacctgaattttatggggcttgccatacaaaagcagaatatgaggaatatggtgcaaatatatgtcgaacaaatcctgtcttcaaaggaatgtattgaaatggaaaatgaataatggccagtgaatgtaaggttcatctcctccatgtgaagctacagcctactacgttactctccttggaagcccccatctgtacagctgagaagaccatgaagagggaaccttcatacgagttgtacaatacatgtatcagcagaaggccttaggtttcgttctgtccattgattctgtattaatttcatggaaatttttatatatttgataaagcaaagaaaaagggaggttcccacttgtactccaggtacgatgcttaatcgagttactcattatatagcatatatgctgagcgagcacctgagctagatgacccctgtagtgtatggcatggttaatgcaacaacatttctgcactaaaattactcgcttgtatatctaacccctcaaggtgaactgtggactcttgatttcacattcttgcaag

SEQ ID NO: 2396 - DNA, 2019 bp, Elaeis guineensis
gtgcgggcctcacgccgaccccccaccacacggatggaattagaatccctccgccctcgttaagccgccgcggtcgcttccgatccacgccctccgccctcgttaagccgccgctgtcgcttccgatccactcctttctctgctgctctttctttctcccccgtctctctcttcccctcttagcgagattgtggttctcgccgacgcggccagagcgcccgcccccattgcttccgccgcacgcggccactaccatgagcggatgccctaggcggcgccacctctcggatctcgtcggcagatccacccccgcctcgctctccgatggacgctgtttctcggcccgccgttgtcatcgacaacggaaccgggtacacaaaaatgggatttgctggcaatgttgagccatgcttcatcatccctactgtagttgcggtcaatgagtctttcttaaacccatcaaggagttctagtaagggaaattggctagcacagcacagtgcaggtgtaatggctgatcttgatttttttattggagaggaggctttatcacggtctcgctctagcagcacatataatcttagttatcctatacatcatggtcaggtagaaaattgggatacaatggaacgattttggcaacagtgtatttttaattacttgcgttgtgatcctgaagatcattattttctattgaccgagagcccactgactgctcctgaaaatcgtgaatacacaggagaaatcatgtttgagacatttaacgtccctgggctgtatattgcagtccagcctgtccttgcccttgctgctggatatactacttccaagtgtgaaatgacaggggttgtagttgatgtgggagatggagctacacatgttgtaccagttgcagatggttatgtgattgggagtagcatcaaatccattcctattgcgggcaaggatgttactcaatttattcagcagcttttgaaagaaaggggagagcatataccaccagaagactcttttgaagtagctcggaaggtgaaagaaatgtattgctacacttgttcagacatagtcaaggaattcaataagcatgataaggagccttctaagtacatcaagcgttggactggtgttaaaccaaagacaggagcaccatattcctgtgatataggatatgagcgctttcttgggcctgagcttttcttccatcctgagatatacagtagtgattttaccactcctttacctgctgtaattgataagtgcatccagtcatccccaatagacacaaggagggccttgtataagaatatagtgttatctggaggatcaaccatgttcaaggacttccatagaagattgcagcgagatgtaaaaaggatagtggatacacgaattgttgcatccgatgctcgatttggtggagatgttaagtctcagcccattgaagttaatgtagtcagccatcctatccagagattcgccgtttggtttggaggttcagtacttgcatccacacctgaattttatgaggcttgccatacaaaagcagagtatgaagaatatggggcaagcatatgtcgaacaaatccggtcttcagaggaatgtattgaaatagaagaaggttcatctcttctctgtgaagccacggcaaacaacattactctcctccgaagctcccaggtgcatccccatctgtacagctgagaagagcatggacggagggccttcatattagctgtacaatattatacatgttgtatcagtagaaagcctcaggtttagtgctgtcaattgattgtgtattgatttcacggaagtatttatatatttgaaaatgaagatgaagataaagacaaggggaagttcccacttgtatccaggtacaatactttgaactactagatgctgagcaagaaccccgagctggacggcttttttagcgcacggcatggctaattcaacaccatttttctagtatatctcttgcaagtaaatactaaacaaaccagctgaactttagt

SEQ ID NO: 2397 - DNA, 2227 bp, Amborella trichopoda
tttattttgcagagatcgcttactttgaagagagagagagagagagagagagagttcgtatttctagagagagagagttcgtctttctagagagagagagcttggtgaggaaaggcaaagggatgcaattctcgatggtgtttagagaaagagacggtgtttgctgttgcttggagttcacaacacgattaaacgaggctaaatagctgctatgtacttatagggtttcgcgttttgattaagtactgggatctggtgatcagatccagggcttaatctttttgcttctctctttactttttaatggatgccacttctcggcccgctgttgtcatcgacaatggaacagggtacaccaagatgggttttgcaggcaatgttgagccatgctttattatcccaacagtggtggcagtgaatgaatctttcctgaatcagtcaagggtgtcaagtaaaggaagttggttagcacagcacagtgcaggtgtcatggcagacctggatttctttattggagatgaggctctatcccgatctcgcacaagtagcacttacaatcttagctaccccatccaccatgggcaggtggagaattgggatactatggagagattttggcagcaatgcatattcaattacttgcgatgtgacccggaggatcactatttccttttaacagagagccctctaactgctcctgagaatcgtgaatacacaggagaaattatgtttgaaaccttcaatgtccctgggctttatatagcagtgcaacctgtccttgcccttgctgctggatacactacttccaagtgtgaaatgacaggagtggtggtggatgttggggatggggctacgcatgtagtaccggtggcagatggttatgtgatagggagcagcatcaaatctatcccaattgctgggaaggatgttactctcttcattcagcaactcttgcgggaaagaggagaacatattccaccagaagattccttggaagttgcacggaagattaaagagatgtactgttatacttgttctgacattgtcaaggagtttggcaagcatgacagagaaccatcaaagtacattaagcattggactggaatcaaagcaaagactggagcaccatactcatgcgacattggctatgaacgttttttgggtcctgaggtattttttagccctgagatctatagcagtgatttcatcacccctttaccctctgttatagacaagtgcatccaatcatctcccattgatacaaggcgggctttatacaagaacatagtattatctggagggtctacgatgtttaaagacttccatagaaggttgcagcgagatataaagaagattgttgatgctcgcgttgcggcatctgatgctcgacttggtggagacacaaaatctcagccaattgaagtcaacgttgttagccatcccatccagcgatttgcagtttggtttgggggttcggtgcttgcatcaacaccagaattttatgcggcttgccatacaaaagcagagtacgaggagtatggtgcgagtgtttgccgaacaaatcccgtattcaaaggcatgtactaacgtagaaacaggtcaaaagtgtaggtcaagttcttcatcaatctagcgggagaaaatccagttgtaaaatgaagatacaccaattcctttacatttcaaggttccaaccttggagtgtttcaggggcccttgctggtggttatagcaggtagcatgagctccattactggaaaaccggaccctgagagctgtacaatagatgtgatagttaggtgagctatgaattttggtactcccattacattcctattcttttttagaaataaatctcatcagatttccagccatcataaaagtagatgttgtatgttttgtgatacctgtatgtagaagagcagtctttgactggcttgtacagcctaggctggatgtcattttaactttcagcttagttgggtatggcgtttctgcaatatttgatccatatatattggcagtggaaatattgtttggggtcagaggaaatcaatccccagttgggtacctttcattgtcacataaatttctattgcactcaatagtgtcacaatataaagagccatttttctattggtttatccatttctttatttcttgttataaatttgatgtggttgtatagctccaactttctcatttttataccatttgtttttcgttt

SEQ ID NO: 2398 - DNA, 1313 bp, Musa acuminata
gctcccggttccccgatggacgctgcttcccggcccgcggtggtcatcgacaacggcaccgggtataccaagatgggatatgctggcaatgttgaaccttgcttcatcatacctactgtagttgctgtcaacgagtctttttcaaatcaatcaaggagctctgctaagggaaattggctagcacagcataatgcaagtgtaatggccgatcttgattttttaattggggaagaagctttaatgcgttctcggtttagtacggcatacaatcttagttacccaattcggaatggtcaggtggagaattgggatgcaatggaaagattttggcaacaatgtatcttcaattacttgcgctgtgacccagaagatcattattttcttctaactgagagcccacttactgcccctgagaaccgtgaatatactggagaaatcatgtttgagacatttaatgttcctggattgtatatagctgttcaacctgtccttgcccttgctgctggatacactacttcaaagtgtgaaatgacaggggttgttgttgatgttggagatggtgctactcatgtagttccagttgctgatggttatgtgataggaagtagcatcaaatcaattcctattgcaggcaaggatgttactcaatttattcagcagcttatgaaggaaagaggagaacatgtaccacctgaagactctttggaagtagcaagaaaggtcaaagaaatgtattgctacacatgctcagacattgtaaaggagttcaataaacatgacaggttgcctggcaagtacactaagcaatggactggagttaaaccaaagactggggcatcatatacctgtgacattggatatgagcgctttcttggtcctgagatctttttccatcctgagatttatggtagtgattttattactcctttacctgttgtcattgacaaatgcattcagtcatcaccaattgacaccaggagagctttgtataagaatatagtactatctggaggatcaactatgtttaaggacttccacaggagattgcaacgagatttaaagaagattgtggatgcaaggattgtggcatctgctgctcgacttgatggagatgtaaaatcacaacctattcaagttaatgtcgtcagtcatcctatccagagatttgcagtttggtttggaggttctatactggcctctactcctgaattttatagggcttgccacacaaaagcagagtatgatgagtatggagcaagcatatgcagaaccaatcctgtcttcaaaggcatgcattgaaatgcaaagacaaa

SEQ ID NO: 2399 - DNA, 1752 bp, Amorphophallus konjac
ttgcccggtttcccgaatggacgcgacttctcgccctgcagtggtcatcgacaacgggaccgggtataccaagatgggatttgctggaaatgttgagccatgcttcattatcccaactgttgtagccgtcaatgaatcttttctaaatcagtctagggtctccaacaagggaaattggctagtgcagcacaatgctggtgtgatggctgatcttgattttttcattggtgatgaagctctttcacgatctcgctccagcagcacgtacaatctcacctatcctattcatcacggtcaggtggaaaattgggatgctatggagaggttctggcagcaatgtatatttaattacttgcgttgtgatcctgaggaccattattttctcttgacagagagtcctttaactgctcctgaacatcgggagtatactggggaaatcatgtttgagacatttaatgttcctggactctatatagcagtccagcctgtcttggcccttgctgctgggtacacaacttcaaagtgtgaaatgacaggggttgtcattgatgttggagatggagctacacatgtcgtgccggttgcagatggttatgttattgggagcagcatgaagtctattcccatatcagggaaggatgtttccttatttattcagcaacttttgcgggaaaggggagagcatatacctccagaggattcttttgaagtagctcgaaaagtgaaagaaatgtattgctacacatgttcagatatcgtcaaggaatacaacaagcatgaccgggaaccttccaagtatgttaaacagtggagtggaattaaacccaaaactggagcaccatactcctgtgatattggctatgaaagattccttggccctgagatcttctttaatccagagatttacagtagtgaattcaccactcctctgccaattgttgttgacaaatgcattcaatcagcaccaattgatacaaggagggctctctataagaatattgtcttgtctggagggtcaaccatgttcaaggacttccatagaagattgcagcgggatctaaagaagatagtggatgctcgtctcctggcatctgatgcccgacatggtggagaaataaagtcccaacctgttgaagtcaatgtaatgagccatccaattcaaaggtttgcggtttggttgggggctctgtacttgcatcaacacccgagttctatgaggcttgtcatacaaaagcagagtacgaggaatacggagcaagtatttgccgcacgaatcctgttttcaaagggatgtattaagatggtggaagtgtacgatgcctgcattacgatggatttcttctgcctacagcccccctaacgttttcgtcagccggtaatctccacggaattccagcacccttgtacgtaatcatggtttgaagtggcacatacccggatctgtataatattatttcatgggagatctataagcagagataggaagacgttgcttcatggaaaataaggggcttggtggttgttgctagaggtgtattcttgaaatggttccttttttatcctttctggcagcaggaggaaagctgtcacttgtatacctagttgtaacatctcagaaggaaaacattgattagcaggaagtgtctaagctgaatggcttttagtattcagcttagtgtggagtggggataacattctttgtagcaaatggtcgattcataaccttaatgctttgatttctttgtaccgtcg

SEQ ID NO: 2400 - DNA, 2043 bp, Solanum phureja
gattgctaagaaacgaatcgaaaacacccaatagacagtgagaccaaagctataattgagtatagagtataatagtgatcaactgtttgatgaatattcctaagtactctctttactgctacttcaattcttgtcacctttctcattgaaatggatggattatatctttcacccacctccattatcatcttctttttagtattgcatttgtcgccacccctttctttgtttcaacaaccatgataatggaccctgctacctctcgccctgctctagtcattgataatggaactgggtatactaaattgggttttgctggaaatgttgaaccaagttttattttaccgacggtggttgctgttaatgagtcgtttctgaatcagactcgagctacgactaagaacagcaactggctagcgcagcatagtgcaggggttatggcggatctggatttttttattggggaagaggcattgactagatctaaatctagtaatacttataatcttagttatcctattaaacatggtcaagttgataattgggatgctatggagcgtttttggcagcaatgtatatttaattatcttcgttgtgaccctgaggatcactattttttattgactgaaagccccatgactgcaccagaaagtcgagaatataccggtgagattatgtttgagactttcaatataccggggctttatattgctgtgcagccggtgcttgctttggcggctgggtatacaacatctaagtgtgagatgactggagttgtagtggatattggagatggtgctactcatgttgtacctgttgctgacggttatgttatcgggagcagcattaagtcaatccctattgctggaagagacgttacactcttcattcaacagctcatgagggaaaggggggagcatgttccaccggaggattccttcgaagtagcccggaaagtgaaggaaatgtattgttacacttgttcagacattgtcaaggagtttaataagcatgacaaagagccagggaagtacataaaacattggagaggtacaaaaccaaagacaggagcaccttattcatgtgatgttggctatgagcgatttcttggtcccgaggttctcttcaatcccgaaatatataacagtgattttacaactcctttacctgatgtgatagacaaatgtattcagtctgcacctatagacacaagaagagctttatataagaatattgttttatctggaggatccaccatgttcaaagacttccatagaagattgcaacgagatatcaagaagattgtggatgctcgtgttcttgcatcagatgctcggttaggtggaaatgtaaaagcacaaccagttgaagtgaatgtggtcagccatcctattcagagatatgcagtttggtttggaggatctgtacttgcttctactcctgaattttttgcagcttgccatacaaaggctgaatatgaggaatatggagctagcatatgtcgcacaaaccctgtatttaagggaatgtactaactacaatcagtgaaggcatttctcatcgtcatgttctcctcccaataccctgatccttgccctacttctcaacttcggtttgcaatcctacatccatgaggactgtgtatgttaacaggttattggaggcagtacattgtagatttcattcattgaactgtgagaaaacaagattcttgtattctttccataggaagcacatctgtcccttggtagggccggttggcacttcaatggcagataagtttcaccgaacaattgaacattacctgagctgaatgtcattttctgagtgttcggttgagtcagagggctacaagtatacttagtttcaaggaaaaataataagctgtcatacgatttggggtttgattaggaggattattctttttctcttttttcgctttaattgaaactttgaatgttatatagctacacttgtacattattctcactgttggggaaacctttttattctttttccagaataatgtatcatagattttgc

SEQ ID NO: 2401 - DNA, 2435 bp, Eucalyptus grandis
ctcgagctcgagcgctcgatttcttcctgctctccataattcatcgctttttcgccgtcctgcaaaagaaaattttcaggttgctcagtccccttttttagcccgtttccttgtcgcggtcgcgggtcgccgtcgccgtcgccgtcggcgtcgtccttctccttcgaattttgattgcttcccaagttaagcatcgattctctctctcgctatttctctctctcttggtggtgaacaaccaacgatgcacgactcttccacttcacctactgcccctcctacttctcccgcctgacgcggtccccagcctctcccaccaatcccccgaccgacgagggccggccgccccggaagcctccgtttttgaattggcctgttgcaatcccagtcgtcccccgcgacggcggcaaggacgacgacggcggcggcgtcggcgctcctctaaggcgcatcgcctgaacatgatcccttgcctcccgcgctctctcgccggatctcagtcgcaggtccatctccatctccatctccgtcgccacagccacagccaccgccgccgccgccccttcctccccgccgcgcgctctccatggaccccgccgcctcccgccccgccgtcgtgatcgataacgggaccgggtacacgaagatggggttcgccggcaacgtggagccctgcttcatagtccccacggtggtcgcggtgaacgagtcgttccagaaccaggcgcggggctcttccaagagcagcaattggctggcgcagcacagcgccggggtcatggccgatctcgacttctacattggggaggaggcgcacgcccgatcccgatccagcagcgtctacaacctcacctacccgatcaagcacgggcaggtcgagaattgggacgccatggagcggttctggcagcactgcatcttcaattacctgcggtgcgatcccgaggaccactacttcctgctgacggagagcccgctcacggctccggagagccgggagtacacgggcgagatcatgttcgagactttcaatatccccgggctttacatcgcggtgcagccggtgcttgctcttgctgctgggtacaccacttccaagtgcgagatgacaggagttgtagtggatgttggagatggtgctactcatgttgtaccagtggctgatggttatgttattgggagcagcattaagtctatacccatttcaggaaaagacgttactctctttattcaacagctcatgcgggaaagaggggaacatgtaccaccggaggattcttttgaagtagcgaggaaagtgaaggaaacttattgttatacctgttctgacatcgtcaaggaatataataagcatgacaaggaaccagcaaagtatattaagcagtggaaaggtgttaaaccaaagacaggagctccatacacttgtgacataggatatgaacgatttcttggacctgaggttttctttagtccagagatctacagctctgacttttcttcccctttgcctgttgtcattgacaaatgcattcaatctgcaccgatagacacgaggagggcgttatacaagaatattgtgttgtctgggggatcaaccatgtttaaggatttccacagaaggttacagcgggatttgaaaaagattgtggatgcccgcgttcttgcttctgatgctcgacttggtggggaagtaaaagcacagccagtagaagttaatgttgttagccatcctattcaaaaatttgctgtttggtttgggggttctgtacttgggtcaaccccagaattttttgaggcttgccatacaaaagcagagtacgaagagtatggggcaagcatttgccgcacaaatccagttttcaaggggatgtattgatacatgatgaggagcttgacttggttggcatgcctggtggacggtacccagaaatgcctgaccatttgcaaccgtggcacctccatttacctctgagactgacgctgccatgtgctcgaacattctctcgccattgcgtccagagatggtgtacaatacatgcctgtttactgctctgtcttactttcaaggaatgtacttctggaactcaattctttcattaaggatataggagattaggatggctctgattttgccgccaagagggcttaccatgccggatccgaccgatagttctcattcagcagtcacatacagagaagaagcttaattgcattcttaggttgcaggttagatgaatagggggatagcgatagaaggttttgttttcggttttaccatttcgttgttcgattactttagatgacgtagattttgaggttggaactcgattctttctggacagagtttgatcataagataatgtgaattaattcgcaacgtctgatattgtatgtccgcagtgattgctgaaagttgtgaattttcaacgcattgc

SEQ ID NO: 2402 - DNA, 2030 bp, Solanum lycopersicum
gattgctaagaaacgaatcgaaaacacccaatagacagtgagaccaaagctataatttagtatagagtataataatgatcaactgtttgatgaatattcccaagtactctctttactgctacttcaattcttgtcacctttctcattgaaatggatggattatatcttttacccacctccattatcatcctctttttagtattacatttgtcgccacccctttctttgtttcaacaaccatgataatggaccctgctacctctcgtcctgctctagtcatcgataatggaacagggtatactaaattgggttttgctggaaatgttgaaccaagttttattttaccgacagtggttgctgttaatgagtcatttgtgaatcagactcgagctacgactaagaatagcaactggctagcacaacatagtgctggggttatggcggatctggatttctttgttggggaagaggcagtgactagatctaaatctagtaatacttataatcttagttatcctattaaacatggtcaggttgataattgggatgctatggagcgtttttggcagcagtgtatatttaattaccttcgttgtgaccctgaagatcactattttttgttgactgaaagccctatgactgcaccggaaagtcgagaatatacaggggagattatgtttgagactttcaatataccagggctttatattgcggtgcagccggtgcttgctttggcagctgggtacacaacatctaagtgtgagatgactggagttgtagtggatattggagatggtgctactcatgttgtacctgttgctgacggttatgttatcgggagcagcattaagtcaatccccattgcaggaagagacgttacactcttcattcaacagctcatgagggaaaggggggagcatgttccaccggaggattccttcgaagtagcccggaaagtgaaggaaatgtattgttacacttgttcagacattgtcaaggaatttaataagcatgacaaagagccagggaagtacataaaacattggagaggtacaaaaccaaagacaggagcaccttattcatgtgatgttggctatgagcgatttcttggtcccgaggttttcttcaatcccgaaatatataacagtgattttacaactcctttacctgatgtgatagacaactgtattcagtctgcacctatagacaccagaagagctttatataagaatattgtattatctggaggatccaccatgttcaaagacttccatagaagattgcaacgagatatcaagaagattgtggatgctcgtgttcttgcgtcagatgctcggttaggtggaaatgtaaaagcacaaccagttgaagtgaatgtggtcagccatcctattcagagatatgcagtttggtttggaggatcagtacttgcttctactcctgaattttttgctgcttgccatacaaaggctgaatatgaggaatacggagctagcatatgtcgcacaaaccctgtatttaagggaatgtactgatactaactacaatcagtgaaggcatttcttatcgtcatattctcctcccaataccctgatccttgccctacttctcagcttcgatttgcaatcctacatctatgaggactgtgtatattaacaggttattggaggcaatgcattgtagatttcattcatcaactgttagaaaacaagattcttgtattctttccataggaagcacatctctccccttggcaaggctggttggcacttcaatggcagataagtttcacgaacaattgaacatacctcattttctgagtattcggttgagtctgagggctacaagtatacttagtttcatgaaaaaaataataagctgtcataagattttggggtttgattagaggatcatttatattctttttttcgctttaattgaaactctgaatgttatatagctacacttgtatattattctcttaattctttttccagaataatgtatatcatagattttgcatttggttc

SEQ ID NO: 2403 - DNA, 2604 bp, Zostera marina
attccgtcgtgttaacagatctcttctcgtctcaagacggccgtgacaaaaacctcattctacctagatcgcacaccgcgccctctttcactgccagaatcaggtcttctcgttggatcttccgaatcaaattcggggaaacctcagatcgactgatgaccgcaagccctgaacgcttatcacaggatctccaaggaagatccaaattcaacgctttcttctcgatttctaatggacgctacttctcgtcctgctgtcgtcattgacaatggcactggttactccaagatgggatttgctggtaatgttgaaccatgcttcatgactccaacggttgttgctgtcaatgaatcctttttaaatcaatcaaagagctcctctagtaaagcaaattggttagcacagcatagtgcaggtgtgatggctgaccttgattttttatcggagacgaggctctgtcacgctctcgctcaagcagcacatacaacctcagttatcccattagtcatggtcaggtggaaaattgggatgcaatggaaagattttggcaacaatgtatatacaattacttgcgttgcgatcctgaagatcattattttcttctgactgagagtcctctaactgcccctgaaagtcgtgaatacacaggagaaataatgtttgagacattcaatgtccctggactttacatagcagtgcaaccagtacttgcacttgctgctggatatacaacgtctaagtgtgaaatgacaggtgttgttgttgatgttggagatggagctacacatatagtaccagtggctgatggatatgtaattggaagcagcattaaatctatacctatctcagggaaagatgttacttcttttgttcagcagcttttaaaggaaagaggagagaatatcccaccagaagactctttttgaggtagctcgtaaggtgaaggaaacttattgttatacttgttcagatatcgttaaggaatataataaacatgacaaggaaccttccaaattcattaagcaatggactggtataaaaccaaggacaggagcaccatacacatgtgatattggttatgagcgttttcttggtcctgagatttttttcaatcctgagatatacactaccgattttaccactcctttgcctgttttaattgataaatgtattcagtcagcaccgatcgacacaaggagggctctctacaagaatattgtattatctggaggatcgaccttgtttaaagacttccatagaaggttgcagcgagatgtaaagaagatagtagatgctcgactagctgcatctgaagctcgacacggaggagatgtaaaatcacaacctattgaggtcaatgtggtcagtcatcctatccaaaggtttgccgtttggtttggagggtcagttttggcatcaacacctgaattctatccggcttgccatacaaaagaagaatacgaggaatgtggtgcaagtatatgccgaacaaatccagtctttaaaggaatgtactaatcaccagagcaacgcaacaaatctacttctgatcgattttaaaatcaatgttgtaaatgagctattacccaaccaggaatgtgtatctattgaagaggcagcaaccaacagataaaaaaaagatgaatctcaaaaataagtctagcttttattttgctgaaatactatatttcaccagcttgctgataaaattacaatggtagtagttgttgataaagttcttaatagttttgtacaagttgatcatacctttttactttttagttattcagctaatcagatcaaacctgagaaaatttcatgtataataaataatacattcaatgttgaaacagcctagttacaatgtgttattaaaaaaagcctggttacaatgtgccaccaaactgatcaacttcgttatatcataaatttcaaataatcagaaatacagaagaaatggtagtgagtacaagctatggagcccggtcaaatggttttgtgtcgttgtaacatgtatcccacacagcttccattgcatcctttgaagatgcttctgtgcaataagggctttcagacatagacatcagtactcgtcttctaacacaatcttgttcatgacctcttagttttgtgtatccacgcagcaactcgcgtttgaaaaagcaatcaccacttagatgagcagcacgaatctcagcacatgccaaatgtgcacaattagtccaaagcaaatttttcacccgacaatcatcgtatgcatgaattagctcgtggataataacttggttgatctcatcttgatagatcatgtgattactgcatacacgaatcccatgtccgcgttggtaagtaccactggtcttccgtttgcaaatcatggcttggaaaaaactatccttcgcagaacacccagccttctcgagcttctccctcaaaaatttcaccatcggcagcttgaaactcttctgtattgccttctggcattgttccaccgtcattccatttccaccctcaaatgcacttccggaattggcggtggcgtcctccattcttctctccgtctcgccaccactgactgaggtctgagaattgtgaaccgtcccc

SEQ ID NO: 2404 - DNA, 2237 bp, Gossypium hirsutum
cgttgtctttctttctattgtttgattgctaagaaaagtatcaatcaagagaaagaacaaagaagaaggaatttggagtctttgattgataaactcgatgagaattcagttttgaaatggttagtcttacttgagtttgggatatcgcctaaccaacaactcttgtttcaagaagctataccgttgaaacgtcacttgcttttggttggggatccaagtttgctgttggtatcgactcagtactgccatcggggggagcttgcttctccttatttgcgcttcttcaagcgcgcttcatgaccatgatctcttgccccctactctcttttggatctcgctcgcagatccacgacaacacccaaccaattgccagcttccgttttgattctcgatggacccaacttctcgccccgctgtcgtcattgacaacggtactggatatactaagatgggatttgcgggtaatgtagaaccgtgttttattcagccaacagtagtagctgttaacgagtcgttcctaaatcaatctagaacttcttccaagtcaaattggtcagctcagtattcagctggggtaatggcggatcttgattttttcattggagatgaagcactgacgaaatcaagatcgagtaatgcttataaccttacatatcctattagaaatggtcaagtttataactgggatgctatggaacggtattggcagcaatgtatattcaattatttacggtgtgatcctgaggatcattactttttgttgactgagagtcctcttactgctcctgagaatcgagaatatacaggtgaaattatgtttgagacgtttaatgttccggggctttatattgctgtgaattccgtgcttgctttagcagctgggtacactacgtctaagtgtgagatgacaggagtggtggtggatgttggagatggggccacacatattgtacctgttgctgatggttatgttattgggagcagcattaaatcaataccgatagctggaaaagatgttacactcttcatacaacagctcatgcgggaaagaggagagaaaattccaccggaggactcatttgaagcagctcgaaaagtgaaggaaatgtactgctatacatgttctgatgtggtcaaggagttcaacaagcatgacaaagaacctggaaaatatatcaaacattggagaggcattagaccgaagactggagcaccatactcctgtgatattggttatgaacggtttttaggccctgaggttttctttagtcctgagatctacagcagtgattttactactcccttaccagttgtaatagataagtgcattcagtcagcaccaattgacaccagaagagctttgtataagaatatagttttatctggtggatccaccatgttcaaagacttccacagaaggttgcagcgggatctgaaaaagattgttgatgctcgagtacttgcgtctgatactcggcttggtggggaagtaaaagcacatcctgtggaagttaatgtagttagtcatcctatccaaagatttgcggtatggtttggaggttctgtacttgcatcaacgcctgaattttttgcggcatgtcacacaaaagcagaatatgaggaatatggagccagcatttgccgtacaaatcctgtttttaagggtatgtattgaggaaaatatctgtttgtcagctgattattgaaaaaagcattatctgataatgctcaagtgcgtaacttgctatttccactgtcatcttgcacatcaagttaattccctcattccggctttgcttggtgcttgtgtgtatttgctgtaagaggtggtataaaacatggtaaccagtctcaattgcagtggttaagaaagagaagttcattctttaatttggagttaaaaagggtcctcacagtcgcctcggaatatcagatataaatctgaggagctgaattccatttacaatgtttagcttacttagggatgtgatagagattttacaaagtttaggtacattttctgttataaagcaaaattggagtagtaattttgatctaagaaatttattttctgacattcttgtaattgatattagtccttcgtttggtataataatattaatcgagatgttagcaaatatggtttgtgtactgtgggaagcagtcaatgtgcagactaggtacaataatgatgttttcatccttttctgaatatgggatttatatccttaccattt

SEQ ID NO: 2405 - DNA, 2350 bp, Gossypium raimondii
cgacaatgttacccactcagtcaaaattgacgaagccgtacctctccgagcataaaacaaggaaggaataaaaaagaaactaaaagaaaagaaagaaaggttggtgcgttgtctttctttctattgtttgattgctaagaaaagtatcaatcaagagaaagaacaaagaagagggaatttggagtttttgattgataaactcgatgagaattcagttttgaaatggctagtcttacttgagtttgggatatcgcctaaccaacaactcttgtttcaataagctataccgttgaaacgtcacttgcttttggttggggatccaagtttgctgttggtatcgactcggtactgccatcggggggagcttgcttctccttatttgcgcttcttcaagcgcgcttcatgaccatgatctcttgccccctactctcttttggatctcgctcgcagatccacgacaacacccaaccaattgccagcttccgttttgattctcgatggacccaacttctcgccccgctgtcgtcattgacaacggtactggatatactaagatgggatttgcgggtaatgtagaaccgtgttttattcagccaacagtagtagctgttaacgagtcgttcctaaatcaatctagaacttcttccaagtcaaattggtcagctcagtattcagctggggtaatggcggatcttgattttttcattggagatgaagcactgacgaaatcaagatcgagtaatgcttataaccttacatatcctattagaaatggtcaagtttataactgggatgctatggaacggtattggcagcaatgtatattcaattatttacggtgtgatcctgaggatcattactttttgttgactgagagtcctcttactgctcctgagaatcgagaatatacaggtgaaattatgtttgagacgtttaatgttccggggctttatattgctgtgaattccgtgcttgctttagcagctgggtacactacgtctaagtgtgagatgacaggagtggtggtggatgttggagatggggccacacatattgtacctgttgctgatggttatgttattgggagcagcattaaatcaataccgatagctggaaaagatgttacactcttcatacaacagctcatgcgggaaagaggagagaaaattccaccggaggactcatttgaagcagctcgaaaagtgaaggaaatgtactgctatacatgttctgatgtggtcaaggagttcaacaagcatgacaaagaacctggaaaatatatcaaacattggagaggcattagaccgaagactggagcaccatactcctgtgatattggttatgaacggtttttaggccctgaggttttctttagtcctgagatctacagcagtgattttactactcccttaccagttgtaatagataagtgcattcagtcagcaccaattgacaccagaagagctttgtataagaatatagttttatctggtggatccaccatgttcaaagacttccacagaaggttgcagcgggatctgaaaaagattgttgatgctcgagtacttgcgtctgatactcggcttggtggggaagtaaaagcacatcctgtggaagttaatgtagttagtcatcctatccaaagatttgcggtatggtttggaggttctgtacttgcatcaacgcctgaattttttgcggcatgtcacacaaaagcagaatatgaggaatatggagccagcatttgccgtacaaatcctgtttttaagggtatgtattgaggaaaatatctgtttgtcagctgattattgaaaaaagcattatctgataatgctcaagtgcgtaacttgctatttccactgtcatcttgcacatcaagttaattccctcattccggctttgcttggtgcttgtgtgtatttgctgtaagaggtggtataaaacatggtaaccagtctcaattgcagtggttaagaaagagaagttcattctttaatttggagttaaaaagggtcctcacagtcgcctcggaatatcagatataaatctgaggagctgaattccatttacaatgtttagcttacttagggatgtgatagagattttacaaagtttaggtacattttctgttataaagcaaaattggagtagtaattttgatctaagaaatttattttctgacattcttgtaattgatattagtccttcgtttggtataataatattaatcgagatgttagcaaatatggtatatgtgtactgtgcgaagcagtcaatgtgcagactaggtacaataatgatgttttcatccttttctgaatatgggatttatatccttaccattttccaa

SEQ ID NO: 2406 - DNA, 1936 bp, Phalaenopsis aphrodite
gaaataattccaaattaacaaaaggaaaaaagtaaacccatactatcaataaataccgacaatcgggatctgctgtggccgtaggagctgcgccaatggaggccagaacgtcgcagcgaatggaatcgaatctagctcggtgagctgccgctcttccttgtgttccacgcctattccctgtctgccatctccaccctccggtccaactctccaactccaccagaccgcgcgcttgcgcgttcgcccgccactgatcgcttcctcactacgatgtgcggatgtcctagaagaaggacttttcgggatctcgcagggatccacatctctcttcttttacaatggacgccgcttctcgacccgctgtggtcatcgacaacggaaccgggtacaccaaaatggggttttctggaaatgttgagccctgctttatcatccctactgtagtagcggttaatgaatcctttctaaatcagtcgaggagttctaataagtccaattggctagcacaatacaatgcaggagtgatggctgaccttgatttcttcattggagaggaggctttatctcggtcacgatcaagcagtacttacaatctaagttatccgattcatgagggtcaggtggagaattgggatacaatggaaagattttggcaacaatgtatttttaattacctgcggtgtgaccctgaggatcattattttcttctcactgaaagtccacttacagctcccgaaaatcgtgaatatatgggagaaatcatgttcgagacatttaatgtccccggactgtatatagcagtccagcctgttctagcccttgctgctggatacaccacttcaaagtgtgagatgacaggggttgtagttgatgttggagatggggctactcatgttgttccagtggctgaaggttatgtgattggaaatagcatcaaatccattcccatttctggcaaggatgttactttgtttattcagaggcttatgaaggaaaggggagagaatttacctcctgaagactcttttgaagttgctcggaaggttaaggaaatgtatagctacacttgctcagatattgttaaggagtttaacaagtatgacaaggaaccgaacaagtatatcaagcaatggacgggtataaagccaaagactggagcaccatactcttgtgatattggatatgagcgctttcttggtcctgagattttcttcaatcctgagatatacagcagtgaatttgccactccattaccagaagtaattgacaaatgtatacagtcatcgcctattgacacaagacgggctctctataagaatatagtgttatcaggggggtctaccatgtctaaggattttcatagaaggctccagagggatttgaagaagattgttgatgcccgtattgcagcatctgaagcaagacttggaggagaagtaaagtctcatcctattgaagttaatgtggtcagtcaccctatacagagatttgcagtttggtttggtggttctgtgctggcatctacaccagaattttatggggcatgccacacaaaagcagaatacgaggaacatggtgcaagcatttgccgaacaaaccctatatttaaaggaatgtactgaaatgccaagagatttttccaatttggccaacgcattactcacgtaagcttccacactacagaaaacaatatatactactgctctcctgcagtcctcccccccataattgtagactatatgattattcaaatgagttgtatgatagatgctgtatagtttgtaagccttgcatttttcaagccatccattgatttttaattttgcattctttcctgtgaagcaacttccattactgttaccaggaagcagttttcatattattgaggaattattttgtccaggtgagcttttcgaattgttctctttcattcagg

SEQ ID NO: 2407 - DNA, 1842 bp, Lippia dulcis
cggggggaggaagagaaaggaaagagccccactcctgaaatcatcatcattaatcctcagttccactggctgtcgttgattttgactgtcgatgatgaatttaatgacttaatgatgaaatggatggaataaaatccttgcccgctaccgtttctttcgtcctcggtgttgtttatgacccattgttgatcggtcaggctcactcccgccggacgccgctgtttgcatttcaacgaacatgatcaccttttttattaaaacccttcaaatatctcggccagctgtggattatcttagttctgaattatggaccccgccgcctctcgcccggctgtagtcatcgataatggcactgggtatacaaagatgggttttgctggaaatgtagaaccgtgttttatctccctacagtagtagcaacgaatgagtcatttgttggtcagccgcgaataagttctacgaagagcagcaattggttggcgcagcataatgcaggggtgatggctgatctggattttagtattggagaagaggcattatctagatctaaatctagtagcacttatagcttgagctatcctatcaaacatggccaggtggaaaattgggatgctatgaagaggttctggcagcagtgatttttgattatctgcgctgcgatccagaagatcattattttctgttgaccgagagtccattgaccccaccagagagtcgggaatatacaggcgaaataatgtttgagacttttaatgttccaggcctttatattgctgtgcagcctgtgcttgcattggctgctgggtacacaacatccaagtgtgagatgacaggtgtcgtcgtggatgttggggatggagctactcatgtcgtgcctgttgctgatggttatgttattggtagcagcattaagtcaattccaatttcaggggaagacgtcactctgtttgtgcagcagctcatgcgagaaagaggagagaatattccacccgaggattcttttgacgtagcccggaaggtcaaggaaacgtactgctatacttgttctgacattgttaaggagttcaataagcacgacaaagagccagcaaagtacattaagcagtggagaggtactaagccaaagacaggggctccatatacttgtgatataggctatgaacggttccttggccctgaggtcttcttcaatcctgaaatttataatagtgatttttccactcctttacctgatgtgatagacaaatgtattcagtcggcaccaatagatacaaggagagccttgtacaagaatgttgttttatctggcggatcaaccatgttcaaagacttctctagaaggttgcagcgagatttgaagaagattgttgatgctcgagttcttgcctcagatgctcgattaggcggagaattaaaggctcaacctgtggaagtaaatgttgtcagccatcctgtccagagatatgcagtttggtttggaggatcagttcttgcatccactcctgaatttttcccggcatgtcatacaaaagcagagtatgaggaatgtggagcaagcatatgccgtacaaatccagtatttaaagggatgtattgatttgaatcttttgaagcaatctaatagattggaatgagaagtgacgatttctatcaccaacaatctgtggtattcaaattttcttacaggtgagatagctggaggggatgtaccatactttttccagtccataatgtgaaaacacaactagggttcttgtattctttgactaggaagcagttgttatttggagagccactcctcctgctgttgctgcacatttgagctcagtttaggcctgatat

SEQ ID NO: 2408 - DNA, 2399 bp, Ricinus communis
agacacagtcggtcccacgtaagtaatttgaaaatcggacggtggaagacggtaccattgagagtcaaatctgactgatatcattaaatttaaaaaggaatcgtaccaaacaaagagacgaggaagagaagggagtcctttttgtttgctttgcgtttagcctcaattgccaagaaaagtatccaaatcgacgaacaacacagaaatcgattgatttatattttataggtatagaagaagacgaagacgaagacgaagaagaagaagaacagagtgttaagttttcggtgctatgaccttgaatttgatgatgaggagaccttgttttatgtcttattgttgttgaaatgggtagatttttgttatacgtattcaccaacttgaagctaccattaccgttgagtggctgctttcacttgcgatccaagtcttctttcattgctaattcacctccttttttgcgcttctctaagcgctcttctctaccatgaccttctcctttatacccactttctgctttgtcctccacaagcgtttcctcttccattcccatggaccccaccaatcgtcctgccgtcgtcatcgacaacggcactgggtatactaaaatgggtttcgcgggaaacgtagaaccttgttttattttaccaacagttgtagctgtaaacgaatcatttctaaatcaatctagaacaacttcaaaagcgaattggttatcacagcataacgctggtgttatggccgatctagatttctttattggagaagaggcgattactaaatcaagatctagtaatacttataaccttagttatccaattaaacacggccaggttgataattgggatgctatggaaaggtactggcagcaatgtatatttaattatttgaggtgtgatccagaggatcattattttcttttgactgagagcccacttactgcaccggagactcgtgaatacaccggtgagattatgtttgagacgtttaatgttcctgggctttatattgcggtcaactccgtgcttgctttagctgctgggtacacaacatccaagtgtgagatgacaggggttgtggtggatgttggagatggggcaactcatgttgtaccagttgctgatggttatgtcattgggagcagcattaaatcaatccctatagctggaaaagatgttactctctttatccagcagctcatgcgggaaagaggagagaatatcccgctggaagattcatttgatgtagctcgaaaagttaaggaaatgcactgctacacttgttctgacattgttaaggagttcaacaagcatgacaaagaacccggcaagtacattaagcattggagaggtattaaacccaaaacaggggcaccatactcttgtgatattggctatgaacgatttctaggccctgaggtcttttttaatcctgagatttatagcagcgacttcaccactcctttacctgctttgatagacaagtgcattcagtctgcaccaattgatacaaggagggctttgtacaagaatattgtgttgtctggaggttcaaccatgttcaaggactttggcagaaggttgcaacgggatttgaagaagattgtagatgcgcgggttcttgcatctgaagctagattaaatggcgaaattaaatcacaaccagtggaagtaaatgtagtcagccatcctattcaaagatttgctgtttggttcggtggttcagtacttgcatcaacacctgaattttttgcggcttgccatacaaaagcagaatatgaggaatatggagcaagtatttgccgcacaaatcctgttttcaagggaatgtattagatcaaatttggattcagcaggcattctcagatggaaatgttcttggagtgacatcactttccacttccagcatgtgccccaatttgctttcctcattacatcattgtgcggtcatccatattcactggctgtgagaggcattgtaaaatatggacgcttgatccaaactgcaacagggaaaatgcattccttgtattgattctttcattggttagctgcggtcccttaaaatctataggatggaagttaatcacattacttgtaggccctgctaggaactgtcatttaggtaaaacacagacgagctgatttttatagccttcagctcagttagatcatgacaatgatttttcccccttttatttcctctttgttcctgaatgtttataataccaaatatattcattcgtttgtataagttggataaacggtactactaattagaattagagattttgttttatttgaatttactctgccctttatgggttaaggattattgtatatcatatcaatctgcaggattagaaattacattcatttgttgtgaaacaggatcaaaga

SEQ ID NO: 2409 - DNA, 2402 bp, Ricinus communis
agacacagtcggtcccacgtaagtaatttgaaaatcggacggtggaagacggtaccattgagagtcaaatctgactgatatcattaaatttaaaaaggaatcgtaccaaacaaagagacgaggaagagaagggagtcctttttgtttgctttgcgtttagcctcaattgccaagaaaagtatccaaatcgacgaacaacacagaaatcgattgatttatattttataggtatagaagaagacgaagacgaagacgaagaagaagaagaacagagtgttaagttttcggtgctatgaccttgaatttgatgatgaggagaccttgttttatgtcttattgttgttgaaatgggtagatttttgttatacgtattcaccaacttgaagctaccattaccgttgagtggctgctttcacttgcgatccaagtcttctttcattgctaattcacctccttttttgcgcttctctaagcgctcttctctaccatgaccttctcctttatacccactttctgctttgtcctccacaagcgtttcctcttccattcccatggaccccaccaatcgtcctgccgtcgtcatcgacaacggcactgggtatactaaaatgggtttcgcgggaaacgtagaaccttgttttattttaccaacagttgtagctgtaaacgaatcatttctaaatcaatctagaacaacttcaaaagcgaattggttatcacagcataacgctggtgttatggccgatctagatttctttattggagaagaggcgattactaaatcaagatctagtaatacttataaccttagttatccaattaaacacggccaggttgataattgggatgctatggaaaggtactggcagcaatgtatatttaattatttgaggtgtgatccagaggatcattattttcttttgactgagagcccacttactgcaccggagactcgtgaatacaccggtgagattatgtttgagacgtttaatgttcctgggctttatattgcggtcaactccgtgcttgctttagctgctgggtacacaacatccaagtgtgagatgacaggggttgtggtggatgttggagatggggcaactcatgttgtaccagttgctgatggttatgtcattgggagcagcattaaatcaatccctatagctggaaaagatgttactctctttatccagcagctcatgcgggaaagaggagagaatatcccgctggaagattcatttgatgtagctcgaaaagttaaggaaatgcactgctacacttgttctgacattgttaaggagttcaacaagcatgacaaagaacccggcaagtacattaagcattggagaggtattaaacccaaaacaggggcaccatactcttgtgatattggctatgaacgatttctaggccctgaggtcttttttaatcctgagatttatagcagcgacttcaccactcctttacctgctttgatagacaagtgcattcagtctgcaccaattgatacaaggagggctttgtacaagaatattgtgttgtctggaggttcaaccatgttcaaggactttggcagaaggttgcaacgggatttgaagaagattgtagatgcgcgggttcttgcatctgaagctagattaaatggcgaaattaaatcacaaccagtggaagtaaatgtagtcagccatcctattcaaagatttgctgtttggttcggtggttcagtacttgcatcaacacctgaattttttgcggcttgccatacaaaagcagaatatgaggaatatggagcaagtatttgccgcacaaatcctgttttcaagggaatgtattagatcaaatttggattcagcaggcattctcagatggaaatgttcttggagtgacatcactttccacttccagcatgtgccccaatttgctttcctcattacatcattgtgcggtcatccatattcactggctgtgagaggcattgtaaaatatggacgcttgatccaaactgcaacagggaaaatgcattccttgtattgattctttcattggttagctgcggtcccttaaaatctataggatggaagttaatcacattacttgtaggccctgctaggaactgtcatttaggtaaaacacagacgagctgatttttatagccttcagctcagttagatcatgacaatgatttttcccccttttatttcctctttgttcctgaatgtttataataccaaatatattcattcgtttgtataagttggataaacggtactactaattagaattagagattttgttttatttgaatttactctgccctttatgggttaaggattattgtatatcatatcaatctgcaggattagaaattacattcatttgttgtgaaacaggatcaaagatcc

SEQ ID NO: 2410 - DNA, 1939 bp, Cucumis sativus
atagtgattgagttttgtttgattgcgaagaaaagcatcacaaattcctaacacaaacaaagatgatcatcttcatcatcaacttccttccactttctccattccctaattccccttaatcacattacaattctaaaaacatggcttcttttttcctccattattacaacccatcaagcttccgttcgttgagtcgctcctttcgcttgcgatccaagtctacaactgctccttcaacctcaaccatctcctcctcttctcttcttctatcgcgcctttgatggccatgatcctctctcttcaaccttattccggatctcagttgcaggtccactcccatatccagaatctcgatatcaccttcaacatcgacaaccacaatcgtcttcatattcccgtatggaccccgctgcttctcgtcccgctgtagtaatcgataatggaaccggatatactaaaatggggtttgccggtaatgtagagccgtgtttcatcgttcctagtgtagttgcagttaatgaatcgttcctaaaccaatccagaaactcgtcgaaagctaactggcttgcgcagcataatgctggtgtaatggcagatcttgatttctttattggagatgaggcgcttgcgaagtcgagatctagtagtacttataatcttagttatccgattcgaaatggtcaggtttataattgggatgccatggagcggttctggcagcagtgtatattcaattatttacggtgtgatccggaggatcattattttcttttgaccgagagccctcttacggcgcctgagagtcgagagtatacgggtgaaataatgttcgagacattcaatgttccggggctttatattgctgtcaattccgtccttgctcttgctgctggttataccacatctaagtgtgagatgacaggagttgtagtggacgttggagatggggctactcatgttgtgcctgttgcagatggctatgttattggaagtagcattaagtcagttcccattgctggcaaagacgtgactctctttgtccaacagctcatgaaggaaagaggggaaaatgtaccacctgaggactcttttgaagtggcccgaaaagtgaaggaaatgtattgctatacctgttctgacattgtcaaggagttcaataagcatgataaggagccaggcaagtatctaaagcactggaagggtattaaacccaagactggcgcaccatattcttgtgatattggctatgaacgatttcttggcccggaggtgttcttcaatcctgaaatttacagcagcgagtttaccacccctttgcctgctgtaatagacaggtgtattcaatctgctccaattgataccagaagagcgttgtacaagaatatagtactatctggaggttcaacaatgttcaaggacttccataggaggttacaaagagacttgaagaaaatcgtggatgctcgaatccttgcttctgaagctagattaggaggagaaataaaatcgcatccggtggaagtcaatgttgttagccatcccatccagagatttgccgtctggtttggaggctccgttcttgcatcaactcccgagttttttgcggcttgtcatacaaaagcggaatatgaggagtacggtgcaagcatatgccgcacgaatcctgttttcaaaggaatgtattgatgcaaagatcctcgagagctttttgacgtttgggtgggtagtatagtccctgacttatgttggatcagatgctttgccgtttccccttgagcgtgcacctcggttggatgctattcttgcagcctttcctttggcaggtgtacatgggtgatgtaaaatatgatcattttgtgtaaaatttgtacgaaatgtggtttcattacttcaattctttcattgggggccaggtttttctaaagtttagcaattggtc

SEQ ID NO: 2411 - DNA, 2123 bp, Citrullus lanatus
agtgattgagttttgtttgattgcgaagaaaagcatcgcaaattcctacacacagatgatgaccatgaagtttgttccaatatctccattccctaattccccttagacagattacaaatgaaaatggctgttgcttttatcaattacaagctatcaagctgttcgttgagtcgctcctttcgcttgcgatccaagtctgcgactgctccttcaacctcaatctcctcctcctcctcttcttcttctcttcttccatcgcgcttatccgagcgcctttgatgaccatgatcctctgtcttcgtccttattccggatctcagttgcaggtccactgccataaccacaatctcgatatcaccctcaacaacaacgaccatcctcatattctcccttttcccgcatggaccccgctgcttctcgccccgctgtagtaatcgacaatggaaccggatatactaaaatggggtttgccggcaatgtagagccatgttttattgttcctagtgtagttgcagttaacgaatcgtttttaaaccaatcgaaaaattcgtcgaaagcaaattggcttgcgcagcataatgctggtgtaatggcagatcttgatttcttcattggagatgaggcgcttgcgaagtcgagatctagtagtacttataatcttagctatccaattcgaaatggtcaggtttacaattgggacgccatggagcggttctggcagcagtgtatattcaattatttgcggtgtgatccggaggatcattattttcttttgactgagagcccccttacggcgcctgagagtcgagagtatacgggtgaaataatgttcgagacattcaatgttccagggctttatattgctgtcaattccgtgcttgctcttgctgctggttatactacatctaagtgtgagatgacaggggttgtcgtggacgttggagatggggctacccatgttgtgcctgttgcagatggctacgttattggaagcagcattaagtcagttcctattgctggcaaagacgtgactctctttgtccagcagctcatgaaggaaagaggagaaaatgtaccacccgaggactcttttgaagtggcccgaaaagtgaaggaaatgtattgctatacttgttctgatattgtcaaggagttcaataagcacgataaggagcctggcaagtatataaaacattggaagggtattaaacccaagactggcgcaccatactcctgtgatattggctatgaaagatttcttggtccggaggtgttcttcaatcctgaaatttatagcagcgagtttaccacccctttgcccgctataatagacaggtgtattcagtccgctccaattgataccagaagagcgttgtacaagaatatagtactatcgggaggttcaacaatgttcaaggacttccataggaggttacaaagagacttgaagaagatcgtggatgcccggatccttgcttctgaagctagattaggaggagaaataaaatcgcatccagtggaggtcaatgttgttagccatcccatccagagatatgccgtctggtttggaggctctgttcttgcatcaactcccgagttttttgcggcttgtcatacaaaagcagaatatgaagagtacggtgcaagcatatgccgcacaaatcctgttttcaaaggaatgtactgatgcaaacatccttgagctttggccattggggtagtatagtcccagcttatgttggatcggatgctttgccgtttccccttaacgtgcacctcggttgggttcggttggatgctttgctgcagcctttcgtaggtgtacatgggtggtgtaaaatatgatcattttctgtataatttgtacgaaatgtggttcattacttcaattctttcattgggggccaggttttcttaaattagcaattggtccaaatttagcttttctgatgtagatgggcgttgaggaatcctatagaatcagcatttcagtgaattttagatgagctgaattgcttgttttttggcgttcagcttgggtgaaggtttcaaaaagaagtttattttcttgtctcttatcatatcatcaattacatttgaaatgcttaataacccacattcct

SEQ ID NO: 2412 - DNA, 1710 bp, Nicotiana benthamiana
gctgaattgtttgactgctaataaaagaatccaaatcttaaagaaaaacacagtgaaaaagctactagaagtagtacaattgagaaagactataatgctgagcaactgtttgatgaatgttcctcctaacctcctcctttacttctacttcaattcttgtctccttatttgtcattgagaaaatggatggattgtatctttcacccacctccattatcctcgccagaatcttctgctgttgctattcccttcttttagtattccatttgacgtcctcttttcatcaacccccttctctgtttcaacgaccatgatcttcccccttaaaactctcattggatctcaaccccagatccactgtcgctatccattcagctttttctctttcagtttctcttcttcatggaccctgctacctctcgccctgctgtagtcatcgacaacggaaccgggtacactaaattgggttttgctggaaatgtggagccaagtttcattgtaccaacagtggttgcggttaacgagtcatttttgaaccagactcgagccactactaagagtagcaattggctatcccaacacagtgcaagtgttatggcggatttggatttctttattggggaagaggcattggctagatctaaatctagtagtaatacttataatcttacctatcctattaaaaaaggtcaggttaataactgggatgtgatggagcgtttctggcaacagtgtatatttgattaccttcgttgtgatccggaggatcactattttatattaactgagagccccatgactgcacctgaaagtcgagaatatactggtgagatcatgtttgagactttcaatgtaccagggctttatattgctgtgcaaccggtgcttgctttggctgctggttacactacatctaagtgtgaaatgactggagtcatagtggatattggagatggtgctactcatgtcgtacctgttgctgaaggttatgttattgggagtagcattaagtcaatccccattgctgggaaagatgttacactcttcattcaacagctcatgagggaaaggggggagcatgttccacctgaggattcctttgaagtagcccggaaagtcaaggaaatgtattgttacacttgctcagacattgtcaaggagtttaataagcatgacaaagagccagggaagtacataaagcattggagaggtactaaaccaaagacaggagcaccttattcatgtgacgttggctatgaacgatttcttggtcccgaggttttcttcaatcccgagatgtataacagtgattttaccactcctttacctgatgtgatagacaaatgtattcagtctgcgcctatagacacaagaagagctttatataagaatattgttttatctggaggatccacgatgttcaaagacttccatagaagattgcaacgagatctcaagaagattgtggatgctcgcgttctggcatcagatgctcggttaggtggaaatgtaaaagcacaaccagttgaagtgaatgtggtcagccatcctattcagagatatgcagtttggtttggagggtctgtacttgcttcaactcctgaattttttgcagcttgccatacaaaggctgaatatcaggaatatggggctagcatatgtcgcacaaatcctgtatttaagggaatgtattgatactgaaatgattcg

SEQ ID NO: 2413 - DNA, 1748 bp, Tabernaemontana elegans
gccgcagatccaccaccgtcagagctctaattcttgtacctcttgcgcttctctctatcatggaccctgccacttctcgccccgccgtcgtcatcgacaacggcaccgggtatactaaaatgggttttgctggaaatgtagagccgtgctttatagtgccaaccgtggtggctgcgaacgagtcgtttgtgaaccagccgcggtcggccaacaacgaagagcaataattggttggcgcagtacagtgcgggggttatggcggatctggatttttgtataggagaagaggcattgtctagatctaaatcaaatagtacctataaccttagctatccgattaagcacggccaagttgacaattgggacgcaatggaaaggttttggcagcagtgtatatttaattacctaagatgcgatccggaagaccattactttttgttgacggagagtccgctaactgcacctgagagccgggagtataccggtgagattatgtttgagacgtttaatgttccggggctttacattgcagtgcagccagtgcttgccttggctgcagggtacacaacatccaagtgtgagatgacaggggttgtagtggatgttggagatggggctactcatgttgtacctgttgcagatggttatgtgattggaagcagcattaaatcaattcccgtttcagggagagatgttactgtcttcattcagcagctcatgcgggaaagaggagagcatgttcctcccgaggactcctttgaagtagctcgaaaggtgaaggaaatgtattgctatactagttcagatatcgtcaaggagttcaataaacatgacaaagagccagcaaagtacattaaacgttggagaggcaccaagccaaagacagggcaccttactcatgtgacatcggatatgaaagatttcttggtcctgaggtcttctttaatccagagatttacaacagtgattttacaacccctttaccggttgtaatcgacaaatgcatccagtctgcaccaattgacacaagaagggccctgtacaagaatattgttttgtctggaggatcaaccatgttcaaagacttccacagaaggttacagcgtgatataaagaagattgttgatgctcgtgttcttgcatcagatgaccgcgtacaaggagatgtgaaagcacaaccagtggaagtgaatgtagtcagccatccaatccagagatatgctgtttggtttggtggctctgtacttgcatccacccctgaattttttacggcttgccatacaaaggccgagtatgaggaatgcggcgcaagcatatgccgcacgaatcctgtcttcaaggggatgtattgaggtcaagcctttgaagaaaagatgatcatttttctggtggtctactttgacctaaaggctcttgattccctctcctggttgaggccaagctttggaagtttacgtctccaagtgccttctgtgtaccatgatgaggcatgtgcagtgtacaatagattctcagtctcagcattgtaacaacaaattgaggttcctgtattctttcagtaggaagcaactgtttttttggggccagttgaagctgccatgtctgttattggttggtctggctggaaattctgtatcaaattggtgtccgaaattagttggacgggaagtctgctgaatatcatcttcaagtgcagttagcttaagtctataggactaggaagtatatttaaatttttgttttggttg

SEQ ID NO: 2414 - DNA, 2130 bp, Manihot esculenta
gggagtcatcgtttccttgttgggttggtgctttgtgttaagctccgacaaggaagaaaagaatccaaatcggaaacacaacacgcactcaaaatagattcatatacagattagataagaagagagtggtaatgatgatgctcaagctgatgaagagaacaaattttttgtgctcttgttgagatgggtagatttttattattgttattattattcaccagctgtaagtttccattaccattgagtttctggtttcactcgggatccaactctactctcatcaccatcaccaattcaccttcccttttgcgcttctctaagcgcccctcccgaccatgagcctcgcccttaaaccctctattggatctccttcgcagatccttcgtcaattcccccaccacagttttatcttcattttcttcttcaattcccatggaccccacctctcgaccttctgtcgtcatcgacaatggcaccgggtatactaaaatgggttttgcgggaaatgtagagccgtgttttattttaccaactgtagtagctgtaaacgattcttttctcaatccatctagaacttcaaaagctaattggcttgcgcagcatagcgcaggggttatggccgatctagacttctttattggagaagaggcctttgctaaatcgagatcgagtagtacctatagtcttagctatccaatcaaacatggtcaggttgacaattgggatgccatggaaaggtactggcagcagtgtgtattcaattatttgcgatgtgatccagaggatcattactttcttttgaccgagagcccgcttactgcaccggagaatcgcgaatgtaccggtgagattatgtttgagacgtttaatgttcctggtctttatattgcggtcaattcggtgcttgctctagcagctgggtacacaacatccaagtgtgagatgacaggggtcgtggtggatgttggagatggggctactcatattgttcctgttgctgatggttatgttattgggagcagcattaggtcagttcctattgctggaaaagatgtgactctctttatccagcagctcatgcgggaaagaggagagaatgtgccaccagaagattcatttgatgtagctcgaaaagttaaggaaatgtattgttatacaagttctgatattgttaaggaatataacaagcatgataaagaaccagccaagtatattaagcattggaggggtattaaacccaaaacaggggcaccatactcctgtgatattggctatgaacgatttcttggccctgaggttttctttaatccagagatttacagtagtgacttcaccactcctctaccagttgtaatagacaagtgtattcagtctgcacccatcgacacaaggagggctttgtataagaatatagtgttgtctgggggatcgaccatgttcaaggactttggtagaaggttgcaacgggatctgaagaagattgtagatgcacgggttcttgcatctgaagctagattgaaggatgaagtaaagacacaaccggtggaagttaatgttgttagtcatcccatccagagatttgctgtatggtttggaggttcagttcttgcatcgacacctgaattttttgcggcttgccacacaaaggcagaatacgaggaatatggagcaagcatatgccgcacaaatcctgttttcaagggaatgtattaatgcagatggttcagcagtaaattttcagatgccactgccaatgcttctcggaatggcaccattttttatttccatcagatggctcgattcacttcccttgttatatctctgtatggtgttgttcatcctattaatgggaggtgagaggtggtgtaaagtatggatggttgatcaaaattgcaacagagaagatgggtttcttgtattgattctttcattggttacctctttaggatgtcagttatttatgttgctagataggccctgcttaggaaactcttaggtaagcatagtcgagctgaaattttagtcttaagcttagttagattatgataaccatatacttttttctgtcttccatttgttttgtgaatggttatgaccccatatatattcattcgtttgcatgagttggat

SEQ ID NO: 2415 - DNA, 2127 bp, Cucumis melo
taaagcatcgcaaattcctaaacacaaacaagatgatcatcttcatcatcaacttccttccagtttctccattccctaattccccttaatcacattacaattctaaaacatggcttcttttttcctccattattacaacccatcaagcttccgttcgttgagtcgctccttccgcttgcgatccaagtctaccactgctccgtcaacctcaaccatcttctcttcttcttcttcttcttcttctcttcttctatcgcgcctttgatggccatgatcctctctcttcaaccttattccggatctcagttgcaggtccactcccatatccagaatctcgatatcaccttcaacatcgacaacgacaatcgtcttcatattcccgcatggaccccgctgcttctcgtcccgctgtagtaatcgataatggaaccggatatactaaaatggggtttgccggtaatgtagagccgtgttttatcgttcctagtgtagttgcagttaatgaatcgttcttaaaccaatcgagaaactcgtcgaaagctaactggcttgcgcagcataatgctggtgtaatggcagatcctgatttctttattggagatgaggcgcttgctaagtcgagatctagtagtacttataatcttagttatccgattcgaaatggtcaggtttataattgggatgccatggagcggttctggcagcagtgtatattcaattatttacggtgtgatccggaggatcattattttcttttgactgagagccctcttacggcgcctgagagtcgagagtatacgggtgaaataatgttcgagacattcaatgttccggggctttatattgctgtcaattccgtgcttgctcttgctgctggttatactacatctaagtgtgagatgacaggagttgtagtggacgttggagatggggctactcatgttgtgcctgttgcagatggctatgttattggaagcagcattaagtcagttcccattgctggcaaagacgtgactctctttgtccaacagctcatgaaggaaagaggagaaaatgtaccacctgaggactcttttgaagtggcccgaaaagtgaaggaaatgtattgctatacctgttctgacattgtcaaggagttcaataagcatgataaggagccaggcaagtatctaaagcactggaagggtattaaacccaagactggcgcaccatattcttgtgatattggctatgaacgatttcttggcccggaggtgttcttcaatcctgaaatttatagcagcgagtttaccacccctttgcctgctgtaatagacaggtgtattcaatctgctccaattgataccagaagagcgttgtacaagaatatagtactatctggaggttcaacaatgttcaaggacttccataggaggttacaaagagacttgaagaaaatcgtggacgctcgaatccttgcttctgaagctagattaggaggagaaataaaatcgcatccagtggaagtcaatgttgtaagccatcccatccagagatttgccgtctggtttggaggctccgttcttgcatcaactcccgagttttttgcggcttgtcatacaaaagcggaatatgaggagtacggtgcaagcatatgccgcacgaatcctgttttcaaaggaatgtactgatgcaaagatccttgagctttttgacctttgggtgggtagtatagtccctgacttatgttggatcagatgctttgccgtttccccttgagcgtgcacctcggttcgattgctattcttgcagcctttggtagaggagaggggtgtacatgggtgatgtaaaatatgatcattttgtgtaaaatttgtacgaaatgtggtttcattacttcaattctttcattgggggccaggtttttctaaaatttagcaattggtccaaaatttagcctttctttcttcctcatgtagatgggcgttgataaatcctatagaaaaattcagcatttcagtgaattttattagatgagctgaattgcatgttttttggcgttcagcttaggtgaaggtctcaaaaagaaagtttattttcttatttgttctctttatcatctattacatttgaaatgcttaataaccc

SEQ ID NO: 2416 - DNA, 1705 bp, Ambrosia trifida
tcgcttcatttataaaacccttcatcggatctcagttgcagtatcctttttcactccaacaatattattatttttattgcttttcttgttttctcactttattgtcatggatccttccacttctcgtcctgctgtagtaatcgacaatggcactgggtatactaaaatgggttttgcgggtaatgtggagccgtgttttattactccaactgtagtggcagttaacgaatcgtttataacgcagccgactcgaagctctagtaagggaagtagtagttggatggctcagcatagtgctggggtgatggctgatcttgatttctttattggggaagaggcgttgtcgaaatcgagaagtagtagtacgtataatttaagctacccgattaaacacgggcaggtggagaattgggatgcgatggaacggttttggcagcagtgtatatttaattatctgcggtgtgatccggaggatcattactttttgttgactgaaagtccgttgactccgccggaaagtagagagtataccggtgagattatgtttgagacgtttaatgttcccgggctttatattgctgtgcaaccggtactcgctttggctgctgggtacacaacatctaagtgtgagatgacaggtgtcgtagtagatgttggagatgggtccactcatgttgtacctgttgcagaaggttatgttattggtagcagtattaagtcactaccaatttctggaaaagatgttactctctttgttcaacaactcatgcgtgaaagaggggagcacgttcctcctgaagattcacttgaagtagctcgaaagataaaggagatgtattgctacacaagttctgacattgttaaggagttcaataagcatgataaggaaccatccaaatacattaaacaatggcgaggaatcaaaccaaagaccggggcaccatattcatgtgacgttggctatgaacggtttcttggtcccgagatattttttaatcctgagatatacaatagcgactttacaacccctttacctgttgtaatagacaagtgtattcagtctgcaccaattgacacaagaagggctttatataagaatatagtgttgtctggaggatcaaccatgtttaaagatttccagagaaggctgcaaagggatacaaagaagattgtcgatgcacgagttcttgcatctagcatgaggcataatggtgaagtaaaagcacaaccagttgaagtcaatgtggtcagccatcctatccagagatatgctgcgtggtttggaggctcggttcttgcatccacaccagaattttttacggcttgccatacaaaagcagaatatgaggaatacggcgcaagcatatgcagaacaaatcctgttttcaagggaatgtattgatccgggatctctttttctcttcatggttctgtgtacattttgcagattaggtgtacactagatgttaagtttcttgtaaggaaaaaaaagaataattttcttgtattctttgattaagaagcaaataggttttgttttataggatacccctagtaaagtgttttgtttctttaaggtttactttgtaaggtgacacaagtttgatcggataaaggtgtcgtcaaattgtttcaacacttccagattgcctttcttttttcttattttatgcagtgctgtgaatctattccctcaaaaaaagaa

SEQ ID NO: 2417 - DNA, 1398 bp, Nicotiana benthamiana
tacgaccatgatcatcccctttaaacccttctttggatctcaactgcagatccatcacagcacattcaagttttcgttttccttcttgaattcattatggacccttctacctctcgcccagctgtagtcattgacaatggaactgggtatacaaaaatgggttttgctggaaatgttgaaccatctttcatactgcctacagttgtcgctgttaacgaatcatttatcaatcagcctcgagctttaactaagagcagcaacttagctcagtacagtgcaggagttatggctgatcttgatttctttattggagaagaggcagtgagtagatctaaatccagtagcacttacaatcttagctatcctattaaacatggacaagttgataactgggatgcaatggagcggttctggcagcagtgcatattcaattatctgcgctgtgaccctgaggatcactattttctgttgactgaaagccctatgactgcaccagagaaccgagaatataccggtgaaattatgtttgagactttcaatgttcctggactttatatagctgtgcagccggttcttgctctggcagctgggtacacagcatctaagtgtgagatgactggagtcgtagtggatgttggagatggtgctacccatgttgtacctgttgctgaaggttatgttattgggagtagcattaagtcaatccccgttgctgggaaagatgttactcttttcattcagcagctcatgaaggaaaggggagagcatgttccagcagaggactcttttgaagtagcacgaagagtgaaggaaatgtattgctatacttgttctgacattgtgaaggagttcaataagcacgataaagagccagggaagtacatcaagcaatggagaggtacaaaaccaaagacaggagcaccatattcatgtgatgttggctatgagcgatttcttggtcctgaggttttcttcaatcctgagatctataatagtgattttacaacccctttacctgatgtgattgacaaatgtattcagtctgcaccaattgacacaagaagagctttatataagaatattgttctatccggaggatcaaccatgttcaaagacttccatagaagattgcagcgagatctcaagaagattgtggatgaccgtgttcatgcatcagatgctcggttaggtggaaatgtcaaagcacaaccagttgaagtgaatgttgtcagcaatcctatccagagatatgcagtttggtttggaggttctgtactagcttcaactccggaattttttgcggcttgccatacaaaggcagaatacgaggaatatggagctagcatatgccgcacaaaccctgtatttaagggaatgtattgatattgaattgatccc

SEQ ID NO: 2418 - DNA, 2421 bp, Cajanus cajan
caacagagagagagagagaaagaaagggtcgttgttgttcattttgtttgattgggaaggaaagcatctttgggaaacgaacagaagagaatgaaatgatgaacatgtaaatgggacctgcacttccacttccacttccacttccacctccaccctctctcttctcttgagattatacttcaaatgggtttaccaatcaccaaccattcccctttgttttttatctcctttcacttccagtcaaagtctgcgtcaacatcatcacctacacctattactccttcttcctcctccttattgtgctcttcacgaccatgatcctctgcttcacactcactcttggatctcagttgcagatccaccttcaccgtttaccatcacttccagcttttcgctctttctcatggacccgtctacttctcgtccagctgtagtcatcgataatggctccgggtatacgaagatggggtttgctggtaatgttgagccatgttttattgttccgacagtggttgcacttaatgagtcgtttctgaatcaatctaggagctcttctaaaggcaattgggttgcccagcacaatgctggggttatggcggatcttgatttcttcattggggatgacgcactttccaagtctcgatctagcagtacttacaatctcagctacccgattcggcatggtcaggttgagaattgggatgccatggagcgcttctggcagcagtgcatattcaactatttgaggtgtgatccggaggatcactattttctcttgactgagagtccgttgaccgcgcctgagagtcgcgagtatactggggaaatcatgtttgagacttttaacgtgcctggactttacattgctgtgaattctgtgcttgcccttgccgctggatacacaacgtctaagtgtgagatgacaggagttgtagtggatgttggagatggggctactcatgttgtacctgttgcagatggttatgttattggtagtagcatcaaatcgattcctattgctggaaaggatgttaccctttttgttcagcagcttatgcgggaaagaggagagaatgtaccaccagaagactcttttgaagtggcgcggaaagtgaaggaaatgtattgctacacctgctctgacattgtgaaggaatttaataagcatgataaagagccagccaagtatatcaagcattggagaggtattaaaccaaagacaggggcaccatattcctgtgatattggttatgagcgatttcttggcccagagattttctttaatcctgagatatatggcagcagcaactttaccacccctttgccagttgtaatagacaagtgcattcagtctgcaccaattgacacaaggagatcattatataagaatatagtgttgtccggaggttcaaccatgttcaaggattttcatagaaggttgcaacgtgatcttaaaaaaatagtggatgcccgcgtcctttcatctgaagcacgcataaatggggagataaaatcgcagccagtggaggtaaatgtagtcagtcatccaatccagagatttgcagtttggtttggaggatcagtacttgcatcaacacctgaattttttacggcttgtcatacaaaggcagaatacgaggaatatggagcaagcatttgccgcacaaatcctgttttcaaggggatgtattgaagcaacgacgaattagttgaccatggttgctgttagttacttgataaaacaattgaatgaaagccttgttattttggtgctcaattcccctcccaatctttcttcccaccagaagtgagtgtaaaatatgtatattcagtgaaaatatgcatttgtttttattccagtagtctccctaggcagtcagtttcacatggttaatacagttgccagaaggtccagatggtacttaatggttagatagaaattgatctttgacagagttggcagctgaattgcaatttttggtgttcagcttagagtatgattaagtcttgcaatttttctcattcattgctcggactgataaattccattgagggcttgattgatgaacatgataacgaaaatagtacaggataaactgtcatacccgctcttaatttattgtttgatgagccaataagataagacaattctatcatcctaccttattctattcactcatcaaaatttttattaaaatggtgaatgttgggctagaaatgctgggctcactcttggttcccattctctccacccttttattcatatcccaaggcgttttatttgcattctcacatttttgattgtttataacgacctaacatattttttaggtgagattggattaagttagttaatttaattgtgagttattaatttttcagtccagttcattcttttacaggttgtgggccaaatagact

SEQ ID NO: 2419 - DNA, 1801 bp, Valeriana officinalis
tttgtttatacacttgataatattcagttcctcactgacatgaaatggatggagtaatttataccttcttcttcttcttctccatcaaccgacaactaccgttcaccggcctttttctcttgcaatcgaccttctcttcatcactacgatgatcacttcttataaacccctttttggatctcaatcgcagatccactccaactctctttcttactactctgtctctgtctctaatggatgccgcctcaacccgccccgccgtagttattgacaatggcaccgggtatactaaaattggatttgcaggaaacgtggagccatgttttacgcttcccacagtagtcgctttaaacgaatcctttgtgagccaggctcgaaactcggtaaaaggaagtaattggctacaacaacacagcgcgggggtcatggcggatctcgatttctttattggtgacgaagctgtggctagatctcgatctagtagtacgtacagccttagccatcctattgagcaaggccaggttcataattgggattccatggaacgcttttggcagcaatgcatatacaattatttgcggtgtgatccggaggatcactattttttgttgactgaaagtcctcttactcccccggaaagtcgcgagtacaccggagagatcatgttcgagactttcaatgttcctggtctttatattgccgtacagccagtcctagctctcgcagcaggttacaccacttctaagtgcgagatgacaggggtagtagtcgatgttggggatggggctactcatgttgtgcctgttgcagacggttatgttattgggagcagcattaaatccattcctatttctggcaaagatgtcactctcttcatccaacaacttatgcgggaaagaggagagcatgttccaccagaagattcccttgaagtggcacgcaaaattaaggagatgtattgctacacttgctcggacatcgtcaaggagtttaataagcacgatagagaaccggcaaaatatgttaagcaatggaaaggtactaaactcaagactggagcaccttactcttgtgatattggctatgaacgatttctgggccccgaggttttcttcaatcctgagatatatagtacagactttgcgacccctttacctgccgtaatagacaagtgtattcaatcggcaccaattgacacaagaagggctctctataagaatgtagtgttatccggaggatcaactatgttcaaagatttccaccggaggctgcaacgagatttaaagaagatagttgattctagggttttagtttctgatgctaggcttggcggtgaacttaaagcacaaccggtggaagtcaatgtagtcagccatccaatccaaagatacgctgtttggtttggaggctctgtacttgcttcaacacctgaattttttgcggcttgccatacaaaagccgagtacgaggaatacggtgccagcatatgccggacgaaccctgttttcaagggaatgtattgaaaaggttatatatgtcagcggaacgctatacagtgtataattttgcaggttagcaagcaggtcgtgagaaggtggtgtaaattagcatgctcttccgtcttatattctgtaagtagctagaacagagagttgtttggattattaagttatagttttgattgttgtgttatacttgtaccaccatatacatttttaaagtgtaaagtttgtttgcgccacataccgttgtcaactgtgatcttatggaataccaaaatagacattcaatttttcgaaaa

SEQ ID NO: 2420 - DNA, 2086 bp, Musa acuminata
ggagtaacacatcgagagggccggaatgcttcaggccgaaggcatctatggccaatatatacttggcgtcgccatcgagagctcgctcgcccgctacgtgtcggaagagggcgacggtggattcgcgttgagccgctcggatccacgccatcgctttccttcgcctcctcgttctcggcccgggatccccggtagcgccgcacctgacggcgccaataccatgagtggttgcccccggcgttcccgctccttggatctcgccgacagacccgccccgaagcatccagatggacgctgcctctcggcccgtggtggtcatcgacaacggctccgggtacacaaaaatgggatttgctggcaatgttgaaccttccttcatcatccctactgtggttgctgtcaatgagtctttttcaaatcaatcaaagagtatcagtaaaggaaattgggttgcacagcacagtgcaagtgtaatggctgatcttgatttttcaattggagaagaagctctattgtattctcgctctagtactacatatggtcttagttaccctattcatcatggtcaggtggagaattgggatgcaatggaaagattttggcaacaatgcatcttcaattatttacgttgtgacccagaagatcactattttcttctgaccgagagtccacttactgctcctgagagtcgtgaatatacaggggaaatcatgtttgagacattcaatattcctggattgtatatagcggttcaacctgtcctagcccttgctgctggttacacaacttcaaagtgtcaaatgacgggagttgtggttgacgttggagatggtgctacacatgttgtcccagttgcagatggttatgtaataggcagtagtatccgatcgatacctattgcgggcaaggatgctacccagtttattcagcaacttatgaaggaaaggggagagcatataccaccagaagattcttttgaagtagcaaggaagatcaaagaaacatattgctacacttgttcagacattgtcaaggagttcaataagcatgacaaggagcatagtaaatatacaaagcaatggattggtaccaaaccaaagacccgagcacgatactcttgtgatgttggatatgaacggtttcttggtcctgagatcttcttccatcctgagatttacaatgataattttaccactcctttacctgctattgtggacaagtgcattcagttatcaccaattgataccagaagggctttatataagaatatagtgttatctgggggatcaacaatgtttaaggatttccatagaagattgcaacgagatttaaaaaggatagtggatgcacggatggtaacatccaacgcccaactcatcgatgatgtaaaatctcaacccattgaagtcaatgtggtcagtcatccttttcagagatacgcagtttggtttggaggttctgtgcttgcatcgacgcctgaattttatgaggcttgccacacaaaggcagagtacgaggaatacggagccagcatctgcagaacaaatcctgtcttcaagggtatgtactgacatcaaaagactgcataccatatctttgtatgcatctacaactcactccccgctctatacatttgtgatgtgatgagaaggggctttttctgtgttgtataataaatgcaatagatgacggtatgcctttttccattacattgttgtcccagaaatatataagattggaggcagcagtgatgctgaattgacttgtcttttcttttataagctgaatgccctgtctctgtatttgcttaggttttccagaacattttcctataaactttttggatgagagatgctctctctctctctccccccccccccccccccccctgaattgacttgtattttcttttataagctgaatgcccagtctctgtatttgcttaggttttctataacattttcctataggatgagagattctctctctctctctttccattacattgttgtccgagaaatatataagatttgaggcagcagtgatgctgaattgacttttcctttcttttataagctgaatgccc

SEQ ID NO: 2421 - DNA, 2137 bp, Phaseolus vulgaris
aagctactaattactgccgtcaaattaattacaattaatactaatagaaagagacagaatctagagagagaaagagagagggaagagttgttgtttgattgccaaggaaagcatgtttgggaaatcaacagaatggtgatgatgatgatgatgaagtaactgggacctgcatctgcacttccaccttcacacttcagttttcacttcaaatgggtttatccacaataaccaaccattcctatttctcttttctcttttttcacttcggatcaaagtctgcgtcaacgtcatctttactctcacctatactaccttccttttcatccttattcacctcttcacgaccatgatcctctgcctcacattcactctcggatccaccttcagctttcaatatcaccgccactttttcgctctctctcatggacccctctacttctcgaccagctgtagtaatcgataatggctccgggtatacgaagatggggtttgctggtaatgttgaaccatcctttattgttccgactgttgttgcagttaatgagtcgtttctgactcaatccaggggttcttctaaaggcaattgggcggcccagcacaatgctggggttttggcagatcttgatttcttcattggggatgaggcactttccaagtctcgatctagcagcacttacaatctcagctacccgattcggcatggtcaggttgagaattgggatgccatggagcgcttctggcagcagtgcatattcaactacttgaggtgtgatccggaggatcactatttcctcttgaccgagagtccattgaccgcacctgagagtcgcgagtatactggggaaatcatgtttgagacttttaacgtgcctggactttacattgctgtgaattctgtgcttgctcttgcagctgggtacacaacatctaagtgtgagatgacaggagttgtagtggatgttggagatggggcaactcatgttgtacctgtggcagatggctacgttattggtagcagcatcaaatcgattcctattgctggaaaggatgttactctttttgttcagcagcttatgcgggaaagaggagagaaggtaccaccggaagactcttttgaagtggcatggaaagtaaaggaaatgtattgctacacctgctctgacattgtgaaggaattcaataagcacgacaaagaaccaggcaagtacatcaagcactggagaggcattaaaccaaagacaggggcaccatattcatgtgatattggctatgaacgatttcttggtcctgagatttttttcagtcctgagatatatggcagtgactttacgactcctttgccagttgtaatagacaagtgtattcagtctgcaccaattgacacaaggagatccttatataagaatatagtgttgtctggaggttcaaccatgttcaaggattttcataggaggttgcaacgtgatcttaaaaaaatagtggatgctcgtgtccttttatctgaagcacgcttaaacggggagataaaatcacagccagtggaggtaaatgtactcagccatccaatccagagatttgcagtttggtttggaggatcagtacttgcatcaacacctgaattttttacggcttgtcatacgaaggcagaatatgaggagtatggagcaagcatttgccgtacaaatcccgttttcaaggggatgtattaaagcaacatggaattagttgatcatggatgcagttacttgataaacagttgaatggatatcctgttattttgatccctcaattccacctcctggtctttcttcccacccgtattcgtggtgtggcaggagtgagtgtaaaatatatatagtcattgaaaatatgcatttgttttttattccagcagtcttcctaggcagtcagtttcacatggttaatacagcaggtcaagatgttaatggctacatagaaagtgatatttgatcaaatttacaaaattctcttcttttagttctttatcattcttgtattctaagtaaaacaccccccattatctcaaacattctgaatgttctctattttgtattttggatgcacattttacacactattttagtaattagtaaaacaaattctcttaactatctta

SEQ ID NO: 2422 - DNA, 1626 bp, Beta vulgaris
cttattaatggatgcttcttcctctcgccctgctgttgtcatcgacaatggcaccgggtatactaaaatgggtttttctgggaatgtggagccttgctttatagtcccaacagcggtcgcagtgaacgattctttcgtaaaccaaccaagaacttcgactaagagtagtaattggttgactcaacataatgctggtgttatggctgatttagattttttcattggagatgaagcattagcaagatctaggtctagtagtacatatagtttgaactatcccatcacgaatgggcaagttgagaattgggatgctatggaaagattttggcaacaatgtatttttaattatttacgttgtgatccagaagatcatcactttttgttaactgaaagtcctctcacaccccctgagagtcgagaatatacaggtgaaattatgtttgagactttcaatgtacctgggctttacatcgcagtgcagcctgtgctagctttagctgcaggttacaatacatcaaagtgcgagatgacaggggttgtagtagatattggagatgggggtacgcatgttgtacctgttgcagagggttatgttatcgggagcagtatcaagtcaattcccatttctggaacagatgtttccctgttcgtccaacagctcatgcgggaacgaggagagaatgtgccacctgaagattcctttgaagttgctcgacaagtgaaggagatgtattgctacacttcttcagatattgtcaaggagttcaacaaacatgacaaagagccctctaagtatgtcaagcaatggaaaggaataaaaccaaagactggggctccgtacacctgtgacattggctacgaacgcttccttggtcctgaggttttctttaatccagagatctacaacaccgattttaccactcctttaccggctgttattgacaagtgcatccaatctgcaccaatagacaccagacgagcactttacaagaatattgtgttgtctggtggctcaactatgttcaaagatttccatcgaaggttgcaaagggatctgaagaagattgttgatgcccgagcccttgcatctgaggtccggcttggtggatcaatgaagtcacaaccagtggaagtcaatgtagtaagccatcccatccagagatatgcagtatggttcgggggatctgtacttgcttcaactcccgagttttatggagcctgccacaccaaagcggagtatgaagaatatggagcaagtatatgtcgtacaaatccagttttcaagggcatgtactgatgtgatcgactggacgatttacttcttgcactgtatctattggcaattttggctttgtgttgctcagaatccatctgcgcgtttatgcattttcaagcaacttataaagtggaagtggtgtaaaatagaaatttactttgtaagaaagcttcaatttttcttctgtagtaattcttttgttaggaagctttagattgcagctctacgcttgccattggatgctttcgttagaattcttgttacacttgcaacaatcatatgatagtcaattggttatacatttaggttagaataagttgctcctcaagattttatagtgatcatagttt

SEQ ID NO: 2423 - DNA, 2189 bp, Quercus alba
cagagagagaaagaaagagtcttgagaagagaaagaaagatgtcagtcgtcagtgggtgtgttgtttgattgcgaagaaaagcatcatcgaagaaacgccaaaacatacacgcatagacacaaacacacaaaaatattttgaaaattcagggggctcaaaaacagtgatgagcaagtttatgcgactaatattattcagctttcacgctcgtcgttgttgttgctgttgttattattgttgagaaatgaaatgggtggagcgacaatcaccaactcttgtgtgttgagtcgctgctttcgcttgcgatccaagcctaagtctcaatcaccatcaccttcttcttcttcttcttcttcctcctcaaagtgctcttcttgaccatgatcctctgccctaaactctctcttggatctcagtcgcagatccattttcaacaccaacgcttcctttcctctccttctcatggaccccgctacgtctcgccccgctgtagttatcgacaacggcaccgggtatactaagatggggttcgccggtaatgttgaaccatgttttattgttcctacagtagttgcagtaaacgagtcgtttttgaaccaatctcgaagctcctcaaaagccagttggctagcgcaacacagtgctggtgtgatggccgatcttgacttcttcatcggtgatgaggcagttgcgagatctcgatctagtactacttacaatctcagctacccaattcagcacggccaggtggaaaattgggacgcaatggagcggttctggcagcagtgtatattcaactatttgcggtgtgatccggaggaccattactttttattgaccgagagtccacttactgcaccggagagtcgcgagtatactggtgaaattatgtttgagacattcaatgttcctgggctttatataggggtgaattccgtgctcgctcttgcggccgggtatactacatctaagtgtgagatgacaggggttgtagtggatgttggagatggggctactcatgttgtacctgttgcagatggttatgtcattgggagtagcattaagtcagttcctattgctgggaaagatgtaactcttttcgtccagcagcttatgcgggaaagaggagagcatgtgccccctgaagactcatttgaagtggctcggaaagtgaaggaaacttattgctacacttgttctgacattgtcaaggaattcaataagcatgacaaagaaccagcaaaatatgttaagcagtggagaggtattaaaccaaagactggcgcaccatactcctgtgatatcggctatgaacgttttcttggccctgaggttttctttaatcctgaaatatatagcagcgagttttcaacccccctaccagctgtaatcgacaagtgtattcagtctgcaccaattgacacaagaagagcattgtataagaatatagtactgtctggaggctcaaccatgtttaaggacttccataggaggttgcaacgagacttaaagaagattgtggatgccagggttcttgcatcagaagctcgacttggtggggaaataagatcacaaccagtagaagttaatgtagtcagccatcccatccagagatttgcagtttggtttggaggctctgtacttgcatcaacacctgaattttttgcggcttgccatacaaaagcagagtatgaggagtatggtgcgagcatatgccgaactaatcctgttttcaagggcatgtattgatgcaaaaaaccattttggctgatcattgttttgtgattaagatgctcaatggaatgcctcgccatttccaccttccttatgcacctcaattcacttcaccctatcttcctcggcatttaattttcttgagttggtgggaggggatgtaaaatatgtttagattcatttttgtaagaatatgtgggtttcctgtatccattctttcattagggggtagcagttctgctctcagcagccaaaagggaatggccattgtcattggggcaaacgttaacccagctgaaatgcaattctaatgttcagcttagatagagttggtaaaatatatttttttttcaaacaagaaaaaaattaagaacgagtagtccaccaagtacattcttaggtaggaagtaaaattcatttcgattgagttattgtaatatgagaactaatttga

SEQ ID NO: 2424 - DNA, 2228 bp, Populus trichocarpa
aagagagagagagagagaggaagtcctcggtgtcgttgtagctgtgttgttcagtgaaaagcttggattggatttgccaagaaaagcatccaagacgccaaggaaagtgaggagatacacaggaccttctctcgttaataaaaataataattgaaggatgaagaaattgacgtggagagatcatcttacgctgttgagctcattaccttcttgttgttgaaatggatacatttttattcaccaaattacagttgagcggctgctttcacttggaaatcaagtctaccagctcaccatcgtcgtcttcttcttcctctttttcgcgcttctctctcgaccatgaccttctctcttaaaccctctcttgaatctcccttgttgatccctctccaccttcacccctattccttctctatctcccatggaccccacatctcgtcctgccgtcgtcatcgactacggtaccgggtatactaagatgggttttgcgggaaatgtagagccgtgttttattttaccaacagcagtagcagtaaacgagtcgtttctaaatcaatctcgaacttcttcttcgaaagcgaattggcaagcgcagcacagtgcaggggttatggcggatctagatttttttataggagaggaggcgcttgccaaatcgagatctagtaatacttatagtcttagctatccaatcaaacatggtcaagttgataactgggacgccatggaaaggtactggcagcagtgtatatttaattatttgcgttgcgatccagaggatcattactttttattgactgaaagcccgcttactgcaccggagagtcgtgagtataccggtgagattatgttcgagacctttaatgttcctgggctttatattgccgtcaattctgtgcttgctcttgcagctggttacacgacatccaagtgtgagatgacaggggttgttgtggatgttggagatggtgctgctcatgttgtgcctgttgcagatggttatgttattgggagcagcatcaagtcaatccctattgctggcaaagatgttactctatttatccagcagctcatgcgggaaagaggagagaatgtacccccagaagattcatttgaagtagctcggaaagtgaaggaaacacattgctatacttgttccgatattgtcaaggagttcaacaagcatgacaaagaaccagcaaagtatattaagcactggagaggtattaaaccaaaaacaggggcaccatattcctgtgacattggatatgagcgatttcttggccctgaggtattctttaatcctgagatttatagcagtgactttaccactcctttaccagctgtgatagacaagtgtattcagtctgcaccaattgacacaaggagggctttgtataagaatatagtgttgtctggaggatcaaccatgttcaaggactttggtagaagattgcaaagggatttgaagaagattgtggatacacgtgttctcacatctgaagctagacttggcgggaaaataaaatcacaaccagtggaagtgaatgtagtcagtcatcctatccagagatttgcggtttggtttggtggttcagtactagcatcaacgcctgagttttttgcggcttgccatacaaaagcagaatatgaagaatatggagcaagcatatgccgtacaaatcctgttttcaagggcatgtattgatgcaaaaaccgtttaccaggcattattccatgaagtgcctcatcacttcgccctcatgttcacttccccttcgtcccaaatttacttggtctgcatgtatattcacggatcgcgggaggtggtgtaaaatatggacgcccagtctgaattgttagaaaagaagatggttccttgtatcgattctttcatttgttagctgcagcctcctctttagatgtcaataggaagcaattaattgtgttattcgtaggcgcccgctctgctgttgcttgatatgaccagataggaaatgtccttagggaaacatcattttgagctgaatttgtagtcttcggctctttagaatataataaatattttttcccttgtctgtgacaaaatgtattcattcgtttgcatgaactgcataaatggaagttgtaatttgaatcaggaatatgtccacctgaatttcccctatcctatttagattactgtactgacattatccgttatataatgaagtccagtgtttaagcta

SEQ ID NO: 2425 - DNA, 2240 bp, Populus trichocarpa
aagagagagagagagagaggaagtcctcggtgtcgttgtagctgtgttgttcagtgaaaagcttggattggatttgccaagaaaagcatccaagacgccaaggaaagtgaggagatacacaggaccttctctcgttaataaaaataataattgaaggatgaagaaattgacgtggagagatcatcttacgctgttgagctcattaccttcttgttgttgaaatggatacatttttattcaccaaattacagttgagcggctgctttcacttggaaatcaagtctaccagctcaccatcgtcgtcttcttcttcctctttttcgcgcttctctctcgaccatgaccttctctcttaaaccctctcttgaatctcccttgttaatccctctccaccttcacccctattccttctctatctcccatggaccccacatctcgtcctgccgtcgtcatcgactacggtaccgggtatactaagatgggttttgcgggaaatgtagagccgtgttttattttaccaacagcagtagcagtaaacgagtcgtttctaaatcaatctcgaacttcttcttcgaaagcgaattggcaagcgcagcacagtgcaggggttatggcggatctagatttttttataggagaggaggcgcttgccaaatcgagatctagtaatacttatagtcttagctatccaatcaaacatggtcaagttgataactgggacgccatggaaaggtactggcagcagtgtatatttaattatttgcgttgcgatccagaggatcattactttttattgactgaaagcccgcttactgcaccggagagtcgtgagtataccggtgagattatgttcgagacctttaatgttcctgggctttatattgccgtcaattctgtgcttgctcttgcagctggttacacgacatccaagtgtgagatgacaggggttgttgtggatgttggagatggtgctgctcatgttgtgcctgttgcagatggttatgttattgggagcagcatcaagtcaatccctattgctggcaaagatgttactctatttatccagcagctcatgcgggaaagaggagagaatgtacccccagaagattcatttgaagtagctcggaaagtgaaggaaacacattgctatacttgttccgatattgtcaaggagttcaacaagcatgacaaagaaccagcaaagtatattaagcactggagaggtattaaaccaaaaacaggggcaccatattcctgtgacattggatatgagcgatttcttggccctgaggtattctttaatcctgagatttatagcagtgactttaccactcctttaccagctgtgatagacaagtgtattcagtctgcaccaattgacacaaggagggctttgtataagaatatagtgttgtctggaggatcaaccatgttcaaggactttggtagaagattgcaaagggatttgaagaagattgtggatacacgtgttctcacatctgaagctagacttggcgggaaaataaaatcacaaccagtggaagtgaatgtagtcagtcatcctatccagagatttgcggtttggtttggtggttcagtactagcatcaacgcctgagttttttgcggcttgccatacaaaagcagaatatgaagaatatggagcaagcatatgccgcacaaatcctgttttcaagggcatgtattgatgcaaaaaccgtttaccaggcattattccatgaagtgcctcatcacttccccctcatgttcacttccccttcgtcccaaattttacttggtctgcatgtatattcacggatcgcgggaggtggtgtaaaatatggacgcccagtctgaattgttagaaaagaagatggttccttgtatcgattctttcatttgttagctgcagcctcctctttagatgtcaataggaagcaattaattgtgttattcgtaggcgcccgctctgctgttgcttgatatgaccagataggaaatgtccttagggaaacatcattttgagctgaatttgtagtcttcggctctttagaatataataaatattttttccctttgtctgtgacaaaatgtattcattcgtttgcatgaactgcataaatggaagttgtaatttgaatcaggaatatgtccacctgaatttcccctatcctatttagattactgtactgacattatccgttatataatgaagtccagtgtttaagctatttgaacttt

SEQ ID NO: 2426 - DNA, 2255 bp, Populus trichocarpa
gagagaaagtgcttgttgttgttgttgtgttggcgaatgagaaggttggattggattgccaagaaaagcatccaagacagcaagaaaagagacgagagacacaagaccatctctcgacaataataattaataaaaggatgaagaaattgatgaggagaaatcatcttacctcgttgagttcattaccttcttgttgttgaaatggagacaacctttttgttcaccaaattaccattgagtggctgcgttcacttgggattcaagtcaccgtcttcttcctttttttcgcgcttctctctcgaccatgaccttctctcttaaaccctcttttgaatcccccttgctgatccctctctaccttcaccactattcattctctatctctcatggacgcttcctctcgtcctgccgtcgtcattgacaacggctcagggtatactaagatgggatttgcgggaaatgtagagccgtgttttattttaccatcagtagtagcagtaaacgaatcgtttttaaatcaatcgcgaacttcttcttcgaaagcaaattggctagcgcagcatagtgcaggggttatggccgatctagatttctttataggagacgaggcgcttgccaaatcgagatctagtaatacttataatcttagctatccaatcaaacatggtcaagttgctaactgggatgccatggaaaggtactggcagcagtgtatttttaattatttgcgttgcgatccagaggatcattactttttattgactgaaagcccgcttactgcaccggagagtcgtgagtataccggtgagattatgttcgagacctttaatgttcctgggctttatattgccgtcaattctgtgctcgctcttgcagctggttacacaacatccaagtgtgagatgacaggggttgttgtggatgctggagatggagctacttatgttgtacctgtcgcagatggttatgttattgggagcagcattaagtcaatccctattgctggcaaagatgttactctatttatccagcagctcatgcgggaaagaggagagaatgtacccccggaagattcatttgaagtagctcggaaagcgaaggaaatgcattgctatacttgttccgatattgtcaaggagttcaacaagcatgacaaggaaccggcaaagtatatcaagcaatggagaggtattaaaccaaaaacaggagcaccatattcctgtgacattggatatgaacgatttcttggtcctgaggtattctttaatcctgagatttatagcagtgactttaccactcctttaccagctgtgatagataagtgtattcagtctgcaccaattgacacaaggagggctttgtataagaatatagtgttatctggaggatcaaccatgttcaaagactttggtagaagattgcaacgggatttgaagaagattgtggatacacgtgttcttgcatctgaagctagacttggtgggggagtaaaatcacaaccagtggaagtgaatgtagtcagccatcctatccagagatttgcagtctggttcggcggttcagtgttagcatcaacacctgagttttttgctgcctgccatacaaaagcagaatatgaggaatacggagcaagcatttgccgcacaaatcctgttttcaagggaatgtattgatgcaaaatcccagttgggcagattgtttaccaagcacttccatggcattgttccatggagtgcctcatcatttccatctatatcacttgccatggttcacttccctcggcccaaatttacctggtcttcatgtatattcacggattgctggaggtggtgtaaaatatggacgcccagtcttaatttttagaaaagaagatgattccttgtatcgattctttcattggttagctgcagcctcctctttagatgtctcaataggatgccaattaattgtgttattcgtaggtgcccccccccccccctggtgcttgatgaccatttaggaaatatcctgtagttaaacatcattttgagccgaatttttagtcttcggctccttagaatacgataaagatttttttttctttccctttttacatttgcctgtgaccaaaatgtattcattcgtttgcatgaactgcataaatggaagtactaatttgaaacagggaaatgttgacctgaatttccacttatcctctctgtgttacagaattcctgtaccgacattttctgttatataataaatattcattgtat

SEQ ID NO: 2427 - DNA, 2419 bp, Populus trichocarpa
gagagaaagtgcttgttgttgttgttgtgttggcgaatgagaaggttggattggattgccaagaaaagcatccaagacagcaagaaaagagacgagagacacaagaccatctctcgacaataataattaataaaaggatgaagaaattgatgaggagaaatcatcttacctcgttgagttcattaccttcttgttgttgaaatggagacaacctttttgttcaccaaattaccattgagtggctgcgttcacttgggattcaagtcaccgtcttcttcctttttttcgcgcttctctctcgaccatgaccttctctcttaaaccctcttttgaatcccccttgctgatccctctctaccttcaccactattcattctctatctctcatggacgcttcctctcgtcctgccgtcgtcattgacaacggctcagggtatactaagatgggatttgcgggaaatgtagagccgtgttttattttaccatcagtagtagcagtaaacgaatcgtttttaaatcaatcgcgaacttcttcttcgaaagcaaattggctagcgcagcatagtgcaggggttatggccgatctagatttctttataggagacgaggcgcttgccaaatcgagatctagtaatacttataatcttagctatccaatcaaacatggtcaagttgctaactgggatgccatggaaaggtactggcagcagtgtatttttaattatttgcgttgcgatccagaggatcattactttttattgactgaaagcccgcttactgcaccggagagtcgtgagtataccggtgagattatgttcgagacctttaatgttcctgggctttatattgccgtcaattctgtgctcgctcttgcagctggttacacaacatccaagtgtgagatgacaggggttgttgtggatgctggagatggagctacttatgttgtacctgtcgcagatggttatgttattgggagcagcattaagtcaatccctattgctggcaaagatgttactctatttatccagcagctcatgcgggaaagaggagagaatgtacccccggaagattcatttgaagtagctcggaaagcgaaggaaatgcattgctatacttgttccgatattgtcaaggagttcaacaagcatgacaaggaaccggcaaagtatatcaagcaatggagaggtattaaaccaaaaacaggagcaccatattcctgtgacattggatatgaacgatttcttggtcctgaggtattctttaatcctgagatttatagcagtgactttaccactcctttaccagctgtgatagataagtgtattcagtctgcaccaattgacacaaggagggctttgtataagaatatagtgttatctggaggatcaaccatgttcaaagactttggtagaagattgcaacgggatttgaagaagattgtggatacacgtgttcttgcatctgaagctagacttggtgggggagtaaaatcacaaccagtggaagtgaatgtagtcagccatcctatccagagatttgcagtctggttcggcggttcagtgttagcatcaacacctgagttttttgctgcctgccatacaaaagcagaatatgaggaatacggagcaagcatttgccgcacaaatcctgttttcaagggaatgtattgatgcaaaatcccagttgggcagattgtttaccaagcacttccatggcattgttccatggagtgcctcatcatttccatctatatcacttgccatggttcacttccctcggcccaaatttacttggtcttcatgtatattcacggattgctggaggtggtgtaaaatatggacgcccagtcttaatttttagaaaagaagatgattccttgtatcgattctttcattggttagctgcagcctcctctttagatgtctcaataggatgccaattaattgtgttattcgtaggtgccccccctggtgcttgatgaccatttaggaaatatcctgtagttaaacatcattttgagccgaatttttagtcttcggctccttagaatacgataaagatttttttttctttcccttttttcatttgcctgtgaccaaaatgtattcattcgtttgcatgaactgcataaatggaagtactaatttgaatcagggaaatgttgacctgaatttccacttatcctctctgtgttacagaattcctgtaccgacattatctgttatataataaatattcattgtataaactatgacttcttcatgctcttgtaaattcgggacctgatagagatgtgtgctgtgttttcagtttcttgcacgcacttttgtatttggctaattgattttctggtgggagatttttttcatgatgcagattcaacagactcataatcttgaggtaatttcaagtatag

SEQ ID NO: 2428 - DNA, 1828 bp, Ambrosia trifida
aaataataataacatcaatggtatgaacctacacccattaatattcgtataccgtttgttgtaattgtccgcttttgcttgcattccacgtcttctttcccaatcgatttcccccaacgaccatgatcgcttcctttattaaacccttcatcggatctcaattgcagatcctttttcactccaacaatattattattattgctttccttgttttcttactttattgtcatggatccttccacttctcgtcctgctgtagtaatcgacaacggcactgggtatactaaaatgggttttgcgggtaatgtggaaccgtgttttattactccaactgtagtggcggttaacgaatcgtttataacgcagcctactcgaagctctagtaaaggaagtagtagttggatggctcagcatagtgctggggtgatggctgatcttgatttctttattggggaagaggcgttgtcgaaatcgagaggtagtagtacgtataatttaagctacccgattaaacatgggcaggtggagaattgggatgcgatggaacggttttggcagcagtgtatatttaattatctgcggtgtgatccggaggatcattactttttgttgactgaaagtccgttaactccgccggaaagtagagagtatactggtgagattatgtttgagacgtttaatgttcccgggctttatattgctgtgcaaccggtactcgctttggctgctgggtacacaacatctaagtgtgagatgacaggtgtcgtagtagatgttggagatgggtccactcatgttgtacctgttgcagaaggttatgttattggtagcagcattaagtcactaccaatttctggaaaagatgttactctctttgttcaacaactcatgcgtgaaagaggggaacacattcctcctgaagattcacttgaagtagctcgaaagataaaggagacgtattgctacacaagttctgacattgttaaggagttcaataagcatgataaggaaccatccaaatacattaaacaatggcgaggaattaaaccaaagaccggggcaccatattcatgtgatgttggctatgaacggtttcttggtcccgagatattttttaatcctgagatatacaatagcgactttacaactcctttacctgttgtaatagacaaatgtattcagtctgcaccaattgacacaagaagggctctgtataagaatatagtgttgtctggaggatcaaccatgtttaaagatttccagagaaggctgcaaagggatacaaagaagattgtcgatgcacgagttcttgcatctagcatgagaaataacggtgaagtaaaagcacatccagttgaagtcaatgtagtcagccatcctatccagagatatgctgcgtggtttggaggctcggttcttgcatccacaccagaattttttacggcttgccatacaaaagcagaatatgaggaatacggcgcaagcatatgcagaacaaatcctgttttcaagggaatgtattgatccgggatctctttttctctttatggttcgtgtacattttgcagattaggtgtacactagatgttaagtttcttcttgtaaggaaaaaaaaggaataattttcttgtattctttgattaagaagcaaataggttttgttttataggatacccctagtaaagtgttttgtttctttaaggtttactttgtaaggtgacacaagtttgagcggataaaggtgtcgtcaaattgtttcaacacttgcagattgcctttcttttttcttattttatgcactgctgtgaattctttttccaaaaaagaa

SEQ ID NO: 2429 - DNA, 1962 bp, Musa acuminata
cagacttgactcgcttcgtccgggacctgtcggaagccgaaaggggcgggcgatgatggatttccgttgagccgccgctgtcgcttcggatccacgctgctcccctcctcctcttccgcattatcgcatcgagatctacatcagcgccgccgccgacggcgccactaccatgagcggttgcccatcgcggtgccacgcctcggatctcgccggcagatccgccctcaaatatccaaatggacgctacctctcgcccagcggtggtcatcgacaatggcaccgggtatacaaaaatgggatttgctggcaatgttgaaccttccttcatcatcccaaccatagttgctgtcaatgaatctttttcgaatcaaccaaagagttctagtaagggaaattggctcacacagcatactgcaggtgtagtggcggaccttgactttttaattggagaagaagccttaacatgttctcgctctagtaatatgtacagtcttagttaccccatccatcatggtcaggtggaaaattgggatacaatggaaagattttggcaacaatgtatctttgattatttacgttgtgaccctgaagatcactattttcttctaactgagagcccccttactgctcctgaaacccgtgaatatacaggagaaatcatgtttgagacctttaatattcctggattgtatatagcagtccaaccagttctagcccttgctgctggttacactacttcaaagtgtgaaatgacaggtgttgtagttgatgttggagatggtgctacacatgttgttccggttgcagatggttatgtgataggcagtagtatcagttcaatacctatagcgggcaagaatgttacccagttcattcagcagcttatgaaggagaggggtgagcatataccaccagaagattcttttgaagtggcaaggaagattaaagaagcatattgctacacgtgttcggacattgtaaaggaattcaataggcatgacaaagagcctggtaaatatacaaagcaatgggttggtactaaaccaaagactggggtgcgatactcttgtgatattggatatgagcgttttcttggtcctgagattttcttccatcctgagatatacaatagtgattttaccactcctttacctgccgttgttgacaaatgcattcaattatcaccaattgacaccagaagggctctatataaggcaagtaatatagtgttatctgggggatcaaccatgtttaaggacttccatagaagactgcaacgagatttgaaaaggatagtggatgcacggattgttacatctgaagcccaattcaaagatgtaaaagctcaacccattgaagttaatgttgtcagccatcctattcagagatatgcagtttggtttggaggttctgtgcttgcatcaacttctgaattttatggggcttgccacacaaaagcagaatacgaggaatatggagctagcatatgccgaacgaatcctgtcttcaaaggaatgtactgaaatcgaaggattgaatgccagcataaacaaagttcataatcttttatgaagccacaaacgggcaaaaatcattcccaatctgtacatttgagaggcaaccagaggggattttcaagttgtatattagatgtgtcattgcctcaggtatgaattaccatagcagtgatctctgaataccctgtttgtgttttttgtttgggttattcagcacatattcctgtaaacttctatgggattattcagaacaaagatgaatcacaccaactctctctaagatgtcatatactctgtccaagcaaatgaactgccatggttgtgttaatatttcaacagcaccaaactatttacttttagagaaataacaaacttgagcagaagcatgcttctttgatgttatcggtgcaaatgccattggttcataattgctttaaggaacagg

SEQ ID NO: 2430 - DNA, 1879 bp, Mimulus guttatus
aagcttttccttgtttgattgctgagaagagaataagaatcaagaaaacaaccccaccctggaatcatcgtcgtctatacttagtttcagtttgggtgatgacgaagttgacgactcaacggtgaaatgggtggaatcaaacccttcaccaccaccgttgattggtcagcctcaccttccccggaacgccgtcgtatgaatttcaacgaacatgatcgccgtttttcttaaaaccctcgaaaaatctcagctgcggatttatcttcttctttcttactcatggaccctaccacttctcgccccgccgtagtaatcgataacggcactgggtatacgaagatgggttttgctggaaatgtcgaaccttgttttatagtccccactgtagtagcagtaaacgaatcatttgtcaaccagccgcgatcaagttcttcgaaaggcagcaattggttgtcccagcatagtgcgggggtgatggcggatctggatttttatataggagaagaggcattggctagatctaaatctagtagcacatataacttgagctatccaattaaacatggccaggtcgataattgggatgcaatggagcgattctggcagcagtgcatatttaattacctgcgctgtgatccggaggatcattactttttgttgactgagagtccattgaccccacctgagagccgagagtataccggcgagataatgtttgagacgtttaatgttccagggctttatattggtgtgcagcctgttcttgctttggctgctgggtacacaacatccaagtgtgagatgacaggagttgttgtggacgtgggggatggagctactcatgtcgtgcccgttgccgagggttatgttatcgggagcagcattaagtcaattccaattgcaggagaagatgtcactctcttcatccagcagctcatgcgagaaagaggagagcttgttccacctgaggactcctttgaagtagcccggaaagtgaaggaaatgtattgctacacatgctctgacattgtaaaggagttcaataagcatgacaaagagccttcaaagtatgttaagcagtggagaggtactaagccaaagacaggagcaccgtattcttgtgatataggctacgaacggttccttggccccgaggtcttcttcaaccctgaaatatatagtaccgattttagtacccctttacctgatgtgatcgacaaatgtattcaatcggcaccaatagatacaagaagagcgttgtacaagaatgttgtcttatctggaggatcaaccatgttcaaagacttccatagaaggttacaacgggatgtaaaaaagattgttgatgctcgagttcttgcttcagagactcggcttggaggagaagtaaaatcccaacccgtggaagtaaatgtagtcagccatccaatccagagatatgctgtttggttcggcggctcggtgcttgcatccactcccgagttttttacggcatgccatacaaaagccgagtacgaggaatgtggagcaagtatatgccgcacaaacccggttttcaaagggatgtattgatttgaaggacaatcgaactaataagaaaaaaaagaaagtatttttttcacaacggcgagcattgaaagcggtgatttttctcatgtattcattacaggttcgggtcacaatgtaatgtacattttcagacaatagtgtaacaaatggaggtgttcttgtattctttcactaggaagtaacaattcttttttgaggaaaaaaaatgtctggaaaaggtaatctcagtttatagatttttagtatttgtttggatttgatgcaactacaacaaaattaccataccttcttataatgttgatttgttcct

SEQ ID NO: 2431 - DNA, 2061 bp, Mimulus guttatus
aagcttttccttgtttgattgctgagaagagaataagaatcaagaaaacaaccccaccctggaatcatcgtcgtctatacttagtttcagtttgggtgatgacgaagttgacgactcaacggtgaaatgggtggaatcaaacccttcaccaccaccgttgattggtcagcctcaccttccccggaacgccgtcgtatgaatttcaacgaacatgatcgccgtttttcttaaaaccctcgaaaaatctcagctgcggatttatcttcttctttcttactcatggaccctaccacttctcgccccgccgtagtaatcgataacggcactgggtatacgaagatgggttttgctggaaatgtcgaaccttgttttatagtccccactgtagtagcagtaaacgaatcatttgtcaaccagccgcgatcaagttcttcgaaaggcagcaattggttgtcccagcatagtgcgggggtgatggcggatctggatttttatataggagaagaggcattggctagatctaaatctagtagcacatataacttgagctatccaattaaacatggccaggtcgataattgggatgcaatggagcgattctggcagcagtgcatatttaattacctgcgctgtgatccggaggatcattactttttgttgactgagagtccattgaccccacctgagagccgagagtataccggcgagataatgtttgagacgtttaatgttccagggctttatattggtgtgcagcctgttcttgctttggctgctgggtacacaacatccaagtgtgagatgacaggagttgttgtggacgtgggggatggagctactcatgtcgtgcccgttgccgagggttatgttatcgggagcagcattaagtcaattccaattgcaggagaagatgtcactctcttcatccagcagctcatgcgagaaagaggagagcttgttccacctgaggactcctttgaagtagcccggaaagtgaaggaaatgtattgctacacatgctctgacattgtaaaggagttcaataagcatgacaaagagccttcaaagtatgttaagcagtggagaggtactaagccaaagacaggagcaccgtattcttgtgatataggctacgaacggttccttggccccgaggtcttcttcaaccctgaaatatatagtaccgattttagtacccctttacctgatgtgatcgacaaatgtattcaatcggcaccaatagatacaagaagagcgttgtacaagaatgttgtcttatctggaggatcaaccatgttcaaagacttccatagaaggttacaacgggatgtaaaaaagattgttgatgctcgagttcttgcttcagagactcggcttggaggagaagtaaaatcccaacccgtggaagtaaatgtagtcagccatccaatccagagatatgctgtttggttcggcggctcggtgcttgcatccactcccgagttttttacggcatgccatacaaaagccgagtacgaggaatgtggagcaagtatatgccgcacaaacccggttttcaaagggatgtattgatttgaaggacaatcgaactaataagaaaaaaaagaaagtatttttttcacaacggcgagcattgaaagcggtgatttttctcatgtattcattacaggttcgggtcacaatgtaatgtacattttcagacaatagtgtaacaaatggaggtgttcttgtattctttcactaggaagtaacaattcttttttgaggaaaaaaaatgtctggaaaaggtaatctcagtttatagatttttagtatttgtttggatttgatgcaactacaacaaaattaccataccttcttataatgttgatttgttcctattcttttttttttctctagaatttcttttttatttttcgaacgccattcgcaattcttaattttcttaattagagtttttggttgaattccgttattggaggctaatttttgtttaatcaatagtagaataatggatgttcgtttgatgaaattgcgtttgtgttatttatagaaatatag

SEQ ID NO: 2432 - DNA, 1611 bp, Ambrosia trifida
tgatcgcttcctttataaaacccttcatcggatctcaactgcagatcctttttcactccaacaatattattatttttattgctttccttgttttcttactttattgtcatggatccttccacttctcgtcctgctgtagtaatcgacaacggcactgggtatactaaaatgggttttgcgggtaatgtggaaccgtgttttattactccaactgtagtggcagttaacgaatcgtttataacgcagcctactcgaagctctagtaagggaagtagtagttggatggctcagcatagtgctggggtgatggctgatcttgatttctttattggggaagaggcgttgtcgaaatcgagaagtagtagtacgtataatttaagctacccgattaaacatgggcaggtggagaattgggatgcgatggaacggttttggcagcagtgtatatttaattatctgcggtgtgatccggaggatcattactttttgttgactgaaagtccattgactccgccggaaagtagagagtataccggtgagattatgtttgtagacgtttaatgttcccgggctttatattgctgtgcaaccggtacttgctttggctgctgggtacacaacatctaagtgtgagatgacaggtgtcgtagtagatgttggagatgggtccactcatgttgtacctgttgcagaaggttatgttattggtagcagcattaagtcactaccaatttctggaaaagatgttactctctttgttcaacagctcatgcgagaaagaggggaacacattcctcctgaagattcacttgaagtagctcgaaagataaaggagacgtattgctacacaagttctgacattgtaaaggagttcaataagcatgataaggaaccatccaaatacattaaacaatggcgaggaattaaaccaaagaccggggcaccatattcatgtgatgttggctatgaacggtttcttggtcccgagatattttttaatcctgagatatacaatagcgactttacaacccctttacctgttgtaatagacaagtgtattcagtctgcaccaattgacacaagaagggctttatataagaatatagtgttgtctggaggatcaaccatgtttaaagatttccagagaaggctgcaaagggatacaaagaagattgtcgatgcacgagttcttgcatctagcatgaggcataatggtgaagtaaaagcacaaccagttgaagtcaatgtagtcagccatcctatccagagatatgctgcgtggtttggaggctcggttcttgcatccacaccagaattttttacggcttgccatacaaaagcagaatatgaggaatacggcgcaagcatatgcagaacaaatcctgttttccagggaatgtattgatccgggatctcttttcttcttcatggttcgtgtacattttgcagattaggtgtacactagatgttaagtttcttcttgtaaaggaaaaaaaggaataattttcttgtattctttgattaagaagcaaataggttttgttttataggatacccccagtaaagtgttttgtttctttaaggtttactttgtaaggtgacaaaaaagaa

SEQ ID NO: 2433 - DNA, 1730 bp, Phaseolus vulgaris
ttttcgctctctctcatggacccctctacttctcgaccagctgtagtaatcgataatggctccgggtatacgaagatggggtttgctggtaatgttgaaccatcctttattgttccgactgttgttgcagttaatgagtcgtttctgactcaatccaggggttcttctaaaggcaattgggcggcccagcacaatgctggggttttggcagatcttgatttcttcattggggatgaggcactttccaagtctcgatctagcagcacttacaatctcagctacccgattcggcatggtcaggttgagaattgggatgccatggagcgcttctggcagcagtgcatattcaactacttgaggtgtgatccggaggatcactatttcctcttgaccgagagtccattgaccgcacctgagagtcgcgagtatactggggaaatcatgtttgagacttttaacgtgcctggactttacattgctgtgaattctgtgcttgctcttgcagctgggtacacaacatctaagtgtgagatgacaggagttgtagtggatgttggagatggggcaactcatgttgtacctgtggcagatggctacgttattggtagcagcatcaaatcgattcctattgctggaaaggatgttactctttttgttcagcagcttatgcgggaaagaggagagaaggtaccaccggaagactcttttgaagtggcatggaaagtaaaggaaatgtattgctacacctgctctgacattgtgaaggaattcaataagcacgacaaagaaccaggcaagtacatcaagcactggagaggcattaaaccaaagacaggggcaccatattcatgtgatattggctatgaacgatttcttggtcctgagatttttttcagtcctgagatatatggcagtgactttacgactcctttgccagttgtaatagacaagtgtattcagtctgcaccaattgacacaaggagatccttatataagaatatagtgttgtctggaggttcaaccatgttcaaggattttcataggaggttgcaacgtgatcttaaaaaaatagtggatgctcgtgtccttttatctgaagcacgcttaaacggggagataaaatcacagccagtggaggtaaatgtactcagccatccaatccagagatttgcagtttggtttggaggatcagtacttgcatcaacacctgaattttttacggcttgtcatacgaaggcagaatatgaggagtatggagcaagcatttgccgtacaaatcccgttttcaaggggatgttttaaagcaacatggaattagttgatcatggatgcagttacttgataaacagttgaatggatatcctgttattttgatccctcaattccacctcctggtctttcttcccacccgtattcgtggtgtggcaggagtgagtgtaaaatatatatagtcattgaaaatatgcatttgttttttattccagcagtcttcctaggcagtcagtttcacatggttaatacagcaggtcaagatgttaatggctacatagaaagtgatatttgatcaaatttacaaaattctcttcttttagttctttatcattcttgtattctaagtaaaacaccccccattatctcaaacattctgaatgttctctattttgtattttggatgcacattttacacactattttagtaattagtaaaacaaattctcttaactatctta

SEQ ID NO: 2434 - DNA, 2369 bp, Glycine max
caaacaagttaaatattcgtgttgggtggcggtgcttgagatcaagcatcctccatttgttcgtaccaacacggcaacaacgacaattgtttgtagttgccgtcatgccctgcacactaatttattattattattaaaaattaagattaataataaaccaaagagaaagaaacagacagaactagagaagagaagagtcattgtttggttgccaaggaaagcatcttcgggaaacgaacagaatgatgatcgactaaatgggacctgcacttccacttccattcgctgtgttcaaatgggtttagcaacaacaatcaccaaccattctcatttgtcttttactatcttctttcacttcggatcaaagtctgcatcaccatcatctttaccctcacctacaccactttcttcttcctcctccttattgcgcttctcacggcgctcttcacgaccatgaacctctgcctcacactcactctcactctcggatctcactcgcagatccaccttcagctttcaccatcactactacttattcgctttttctcatggacccatcttcttctcgtccagctgtagttatcgacaatggctccgggtatacgaagatggggtttgctggtaatgttgagccgtgttttattgctccgacagttgttgctgttaatgagtcgtttctgaatcaatcgaggggctcttctaaaggcagttgggtggcccagcacaatgctggggttatggcagatcttgatttcttcatcggggatgaggcactttccaagtctcggtctagcagcacttacaatctcagctacccgattcggcatggccaggttgagaattgggatgccatggagcgcttctggcagcagtgcattttcaattatttgaggtgtgatccggaggatcactatttcctcttgaccgagagcccattgaccgcgcccgagagtcgcgagtatactggggagatcatgtttgagacttttaatgtgcctggactttacattgctgtcaattccgtgcttgctcttgcagctggatacacgacgtccaagtgtgagatgacaggagttgtagtggatgttggagatggagctactcacgttgtgcctgttgcagacggctatgttattgggagtagcatcaaatcgattcctattgccggaaaagatattactctttttgttcagcagcttatgcgggaaagaggagaaaatgtaccaccggaagactcttttgaagtggctcggaaagtgaaggaaatgtattgctacacctgctctgacattgtgaaggaatttaataagcatgacaaagaaccaggcaagtacatcaagcattggagaggtattaaaccaaagacgggggcaccatattcatgtgatattggctatgagcgatttcttggccctgagattttctttaatcctgagatatatagtagtgactttactacccctttgccagttgtaatagacaaatgcattcagtctgcgccaattgacacaaggagatcactatacaagaatatcgtgttgtctggaggttcaacaatgttcaaggattttcacaggaggttgcaacgtgatcttaagaaaatagtggacgcccgtgccctttcatctgaagcacgcataaatggggagataaaatcacagccagtggaggtaaatgtactcagccatccaatccaaagatttgcagtttggtttggaggatcagtacttgcatcaacacctgaattttttacggcttgtcatacaaaggcagaatatgaggagtatggagctagcatttgccgtacaaatccggtattcaaggggatgtattaaagcaacgacgagttagttgatagtggatacagttacttgataaacagttgaatgaatatccggttattttgatcctcaattcccctcctggtctttcttctcacccgtattcgtggtggcaggagtgagtgtaaaatatgtatatttagtgaaaatatgcatttgtttttattccaccagttgccagcaggtgcagatagtgcttaatggttagatagaaattgatctttgacttgcaatttttggtgttgagcttagagattgatgaagttctgtattttttgtcattcagtgttgggactgacaattccattaaggacagtttcggagcatgagaagggaaataagatgagatatactatcatatccaatcttaattcatggtttggtgagataataagatatgataaattaatcctattattgtatcatattctatttaccgggcaaaattttatcctatggtcaaggttagaattcaatatgatatgattaagaaatatttttcttactcacccttctctcccatctcat

SEQ ID NO: 2435 - DNA, 1723 bp, Euphorbia peplus
atggaccctacctctcgtcccgccgtcgttatcgacaacggcaccgggtatactaaaatggggtttgctggtaatgtagagccgtgttttattttacccactgtagtagctgtaaacgagtcgtttataaaccaatcaagaacttcttccaagtccaatttgttagctcagcatagcgctggggttatggccgatttggacttctttatcggggaagaagccgcttctaaatcgagatctagtaatacttataatcttaactatcctattcaacaaggtcaggttgataattgggatgccatggaaaggtattggcagcaatgtattttcaattatttgcgttgcgatcccgaggatcattactttcttttgactgagagcccccttactgcacccgagagtcgagagtatacgggggagattatgttcgagacgtttaacgtgcctgggctttatattgcggttaattccgtgcttgctcttgcagctgggtataccacatccaagtgtgagatgacaggggttgtggtggatgttggagatggggctactcatattgtaccagttgctgatggttatgttatcgggagcagcattaagtcaattcctattgctggcaaagatgttaccctctttatccaggagctcatgcgggaacgaggagaaaatgtaccaccagaagattcatttgacgtcgctcgaaaggtgaaagaaatgtattgttacacctgttctgacattgttaaggagtacaacaagcatgacaaagaaccagccaagtatattaagcattggagaggaattaaaccaaaaacaggggcaccatattcttgtgacattggctatgagcgatttcttgggcccgaggttttctttagtcctgagatttatagcaatgactccatctctcctttaccagaggtaatagacaagtgcattcagtctgcaccaattgatacaaggagggcattgtataagaatatagtgttgtctgggggatcaaccatgttcaaggattttgggagaaggttgcaacgagatctgaagaagattgtggatgcccgggttctggcatctgaagctagaatggaaggagaaataaaagcacgtccagtggaggtaaatgttgtcagtcatcccatccagagatttgctgtttggtttggaggttcagtacttgcgtcaacacctgaattttttgcagcttgtcatacaaaagaagaatacgaggaatatggagcaagcatatgccgaacgaatcctgttttcaaagggatgtattaatctacatcaatggcataaatgattcagcagacatttttgagatagcaatgacatcattttccatttccttcacatgcctcagttctgctcctgcataccatcttaacgcgagttcatccatattcaagggttgtctgaggtggtgtaaaatatcgacagtcgatcggaactgtgacagatacggtggttaccttgtattgattctttcattggttacttgcaaaggttcataggatggcagtttaattatgttacttataggctctggtaggaaggaactctcaattaggtagaccataggttgagctgaatttttagccttcggctcatttagattatcttaataattacttttcccttctcatcctttttgtttgtgtatgattataataccaaatagattcattggataaacaaaactaatttaaataaaacattt

SEQ ID NO: 2436 - DNA, 1723 bp, Amsonia hubrichtii
gcagatccaccaccgtcagagctctaattcttgctactcttgtacttctgtatctcatggaccctgccacttctcgccccgccgtcgtcatcgacaacggcaccgggtatactaaaatgggttttgctggaaatgtagagccgtgctttatagtgccaacagtggtggcagtaaacgagtcgtttgtgaaccagccacggtcagccacgacgaagagcaacaattggttgacgcagtacagtgctggggtgatggcggatctggacttttgtataggagaagaggcactatctagatctaaatcaaatagtacttataatcttacttatcctattaagcacggccaagttgacaattgggacgcaatggagaggttttggcagcagtgtatattcaattacctacgatgtgatccggaagaccattactttttgttaactgagagtccgctaactgcacctgagagccgggagtataccggtgagattatgtttgagacgtttaatgttccggggctttacattgcggtgcagccggtgcttgctttggctgcagggtacacaacatccaagtgtgagatgacaggggttgtagtggatgttggagatggggctactcatgttgtacctgttgcagaaggttatgtgattggaagcagcattaaatcaattcccatttcagggagagatgttactctcttcattcagcagctcatgcgggaaagaggagagcatgttcctcctgaggattcccttgaagtagctcgaaaagtcaaggaaatgtattgctacactagttcagatatcgttaaggagttcaataaacatgacaaagagccagcaaagtacattaaacactggagaggcacaaagccgaagacaggggcaccttactcatgtgatgtcggatatgaacgatttcttgggcctgaggtcttctttaatcctgagatttacaatagtgatttcacaacccctttaccagttgtaattgacaaatgcatccagtctgcgccaattgacacgagaagggctttgtataagaatattgttttatctggtggatcaaccatgttcaaagacttccacagaaggttgcagcgggatataaagaaaattgttgatgctcgtattgttgcatcagatgttcgtgtacaaggagatgtgaaagctcacccagtggaagtcaatgtagtcagtcatccaatccagagatatgctgtttggtttggtggctctgtacttgcatccacccctgaattttttacagcatgccatacaaaggccgaatatgaggaatgtggggcaagcatatgccgcacgaatcctgttttcaaggggatgtattgatgtcaagcctgtgaagagaagatgatcattttctggtggtctatttcgacctaaaggctcttgactccctctcctgtgaaaggtcaagctttctctggaattttacatcaccaaagtgccttccatgtaccctcttgatgggaaatgttgtgggaggcagtgtacaatagattctcagtctcagcattgtaacaaattgagattcttgtattctttcagtaggaagcaactgtctttttggtggagctgaaggtgcccatttctattagtctggctggaaatctgcatcagatttgtgtcctgaattagttggataggaactctgctgcatatcatcttggagtgcagctagctgaggtctttagaattacaag

SEQ ID NO: 2437 - DNA, 1931 bp, Fagus grandifolia
aaatagcaaaaagtaaaaaagactcagagagagagagagaggtctcagtcgtcagtgggtttgtgttgtttgattgcgaagaaaagtatcgaattcgaagaaaacgcacacactaacacacatttttcaggcacaaacaatgatgatgaagttgatgaaactagaccgattcagcttttacactcgtcgttgttgttgttgaatatgggtggagcaatcaccaactcctgtgcgttgagtcgctgctttcgcttgcgatccaagtctgcatcgtcatcaccgtcatcgtcacgtattttgtcttcttgttactcttattcatccttgcgcttctcaaagcgctcttcttgaccatgatcctctgccctaaactctctctcggatctcagctgcagatccacctccaacacaagcatcttgttttttccttttctcattctcattctcatggaccccgctacgtctcgccccgctgtagttatcgacaacggcacagggtatactaaaatggggttcgccggtaatgttgagccatgctatattgttcctacagttgtagctgtaaacgagtcgtttttgaaccaatcacgaagctcctcaaaagctaattggctagcgcagcacagtgctggcgtgatggctgatcttgatttcttcattggggatgaggcgcttgcgagatctcgatctagtagtacttacaatctcagttatccgattcagcatggtcaggtggacaattgggacgcaatggagcggttctggcagcagtgtatttttaactatttgcggtgtgatccagaggatcattatttttgttgactgagagtccgcttactgcgccggagagtcgcgagtatactggtgaaattatgtttgagacattcaatgttcctgggctttatattgcggtgaattcggtgcttgctcttgcggccgggtatacgacatctaagtgtgagatgacaggggttgtagtggatgttggagatggggctactcatgttgtacctgttgcagatggttacgtcattgggagtagcattaagtcaattcctatttctgggaaagatgtaactctttttgtccagcagcttatgcgggaaagaggagagcatgtgcctcctgaagactcgtttgaagtggctcggaaagtgaaggaaacatattgctacacttgttctgacattgtcaaggagtacaataagcatgacaaagaaccagcaaagtatattaagcaatggagaggtattaaaccaaagacaggggcaccatactcttgtgatatcggctatgaacggtttcttggccctgaggttttctttaatcctgagatttatagcagcgagttgagcaaccctctaccagctgtaatcgacaagtgtattcagtctgcaccaattgacacaagaagagctttgtataagaatatagtgttgtctggtggctcaaccatgttcaaggactttcatagaaggttgcaacgagacctgaagaagattgtggatgccagggtttttgcatcagaagctcgacttggtggggaagtaaaatcacatccagtagaagtcaatgtagtcagccatcccatccagagatttgcagtttggtttggaggctctgtacttgcatcaacacctgaattttttgcggcttgccatacaaaagcagaatatgaggagtatggtgcgagcatatgccgaactaatcctgttttcaagggaatgtattgatgacaaaaaaccatattggctgatcattgttttctgattaagatgcttaatggaatgccttgcctattttcacctcccatatgcacctcaattcacttcatcctatcttcctcagcattcatgttttcttgagttggcgggaggtgatgtaaaatatgtttagattcatttttgtaagaatgtgggtttcctgtatcc

SEQ ID NO: 2438 - DNA, 1870 bp, Arachis hypogaea
gtttttccccattccctgtcaacgaaagcgtatatcaattttcaacgttgatcctctccctccctcacaatcttggatctcgctcgcagatccaccctaactgtcatcttcctcaccacttatggaccctgttgcttctcgtcctgctgtagttattgataatggctccgggtatacgaagatgggttttgccggcaacgttgagccgtgctttattgttccaacggtggttgcacttaacgagtcgttcctcaatcaatcaaggacctcttctaaggccaattggatcgcccagcacaatgctggggtcatggcggatcttgatttcttcattggggatgaggcccttgctaagtctcgatctagcagcacgtatagtctaagctacccgattcagcatggccaggttgaaaattgggactccatggagaggttctggcagcagtgcatatttaactacctgaggtgtgatccggaggatcactattttcttttgactgagagtcctttgactgcgcccgagagtcgcgaatataccggtgaaatcatgtttgagacctttaacgtacctggattatacattgccgtaaattcggttttagctcttgcagctggctacacaacatctaagtgtgagatgacaggagttgtggtggatgttggagatggggctacacatgttgtacctgttgcagacggctatgtcattgggagtagcatcaaatcagttcctattgctggaaaggatgttacactttttgtccagcagcttatgcgggaaagaggagagaatataccaccagaagactcttttgaagtggctcggaaagtgaaggaaatgtattgctacacatgctccgacattgttaaggaattcaataaacatgacaaagaaccatcaaagtatataaggcaatggagaggtatcaaaccaaagacgggggctccatattcatgtgacattggctatgaacggtttcttggccccgaggttttctttaatcctgagatatatagcagtgacttttccactcctttgccagttgtaatagacaagtgcattcagtctgccccgattgacacaagaagagcattatacaagaatatagtgttatctggaggatcaaccatgttcaaagattttcacaggaggttgcaacgcgatctgaagaaaatagtggatgctcgtgtacatgcatctgatgcacgtctaaatggggagattaaatcacaaccagtggaagtcaatgtagtcagccattctgtccagagatttgcagtctggtttggaggctcggtgcttgcatcaacccctgaatttttgcggcttgtcatacaaaagcagaatatgaggaatatggagcaagcatttgtcggacaaatcctgttttcaaagggatgtactgaagtaaagacaaattagctgatcatgcaaatggagtttcttgattaaaagcttgaatgaatgcctctgcttatattgatccgcaattcacctcctgtgctttcttcccacctttgtccttcaaggtggcagaagttggtgtagaatatgtatattcagtgagaaaatatatttccactttttcttcctgctgttctctctttggagttactttcatcagatgtgtgatatggttgccagtaggtctagatgttacttaatgcttttatagaaaccaatcttcaccaaatagctggctcagctgaattgcaatttttggtgttcagcttagagtttgatgaagatctgtattttttcatttgttgcttggactgatcattccgctgagcactttactaggtaggaagcttaattcattgggatggaattgtaatacaaataagcactattgcaggttagaatcgg

SEQ ID NO: 2439 - DNA, 2323 bp, Citrus sinensis
aaaagaacgtctctatgtggaggcagctatcgcggtgcatagtttttaattgatagctaagaaaagtatcgtagtcgagatcacaattcgcacatacggcaaaagggaaaacagagagggagaaaaaaaagaaagaaaaaaagaaagaggaaaatgaaaagacagtgatagcaatgatgaagaagttgatgagcgaggcttatcatttccattatcgatgttgttgttgaaatgggtgttggattttgtaccaacttacaaagctgccgtgcgttgagtcgctcctttcacttgcgattcaagtctttcgtatatcaccatcaccaacactttcttcacgatcatgttccattgccttaacccttctctcggatctcagttgcggatccctcgttaccaccaccaccacgattctcacctcctttctctttacaatggaccccacttctcgtcctgccgtcgtcatcgacaacggcaccgggtatactaagatgggttttgcgggtaatgtagagccgtgttttattcttccgactgtagtagctgtaaacgagtcgtttttaaatcaatcaagatcttcgtcaaaggccaattggcttgcacagtacaacgcaggcgtaatggccgaccttgacttctttattggagatgaagcagtcacaaaatcgcgatctagtagtacctataaccttagttatcctattaggcatggtcaggttgataattgggatgctatggagaggtattggcagcagtgtatatttaattacttgcgttgtgatccagaggatcactactttctgttgaccgagagcccgctcactgctcctgagagtagagagtatactggtgagatcatgtttgagacttttaatgttcctggcctttatattgctgtgaattcggtgcttgcacttgcagctgggtacacaacatctaagtgtgagatgacaggagttgttgtggatgttggagatggggctacttatgtagtaccagtcgcagagggctatgtcattgggagcagcattaagtcgattcctattgctggaaaagatgtcactctcttcattcagcagctcatgcgggaaagaggtgagaatgtaccacctgaagactcgtttgaagtagctcggaaggtgaaggaaatgtattgctatacatgttcagatattgtcaaggagtacaacaagcatgacaaagaaccatcaaaatatttgaagcaatggaggggcatcaaaccgaagacaggggcaccatattcatgtgatataggttatgaacgatttcttggccctgaggtgttctttaatcctgagatatatagcagcgattttaccactcctttaccggctgtaatagacaaatgtatccagtctgcaccaattgacacaagaagggctttgtataagaatatagttttatctggaggttcaactatgttcaaggacttccatagaaggttgcaacgggatctgaagaagattgtggatgcccgggttcttgcatctgatgctcgacttggtggggaagtaaaagcacaacctgtggaagttaatgttgtcagccatgctattcagagatatgcagtgtggtttggtggttctgtactagcttcgacgcctgaattttttgcggcttgccatacaaaagcagagtatgaagaatatggagcaagcatatgtcgttcaaatcccgttttcaagggaatgtattaattcaaaggccaatttcagctgattgtttaggagactgaaagcatttccttatgtggttacatgagttgcctcaaacctatgctgatgtcactcctcacatctttgctgggtgttaacatgtactcatggtaaaaagtgttcagtttagatgctgctcagttgagagaaaaagaaaaatggatttcctgtgttgattctttgataaggggtagaccgggttttcttcattgaatggtaggaaggggtaagccctgctggcactttcggaacacaagagaattatcaaattggtaaaccgggactgagctgaaactgcatatgaagtattcagcttagaaggatggataaattttttatttttacccctttttttccttttggttgggagagattatttcaccaagtacgttttgaggtaggaagtttaggtgatattgtttggagtaatggaagaagtagtactttgagttagaaatttgtttatgtgaattccctcggtttaaattctttttgaggtacatgttctgtacattaatcattcaggaaagaggaaacttgtataatgatgattatttttagaaatcgcaattgctgtggattacata

SEQ ID NO: 2440 - DNA, 1555 bp, Euphorbia esula
  misc_feature (764)..(764): n is a, c, g, or t
gcatttttttttgtcctcttctggatctcatttgcaggtccttctgtttctttaccagagttttatcttcctcttctcctccgatggaccctacctctcgacctgccgtcgtcatcgacaacggcaccgggtatactaaaatggggttcgctggtaatgtagagccgtgttttattttaccgactgtagtagctgttaacgagtcgtttataaaccaatcaagaacttcttcgaaggcgaatttgttagctcagcatagcgctggggtaatggccgatttggacttctttattggagaagaagcggcttctaaatcgagatccagtaatacttataatcttaactatccaattaaacaaggtcaggtcgataactgggatgccatggaaaggtattggcagcaatgcattttcaattatttgcgttgcgatccagaggatcattacttccttttgaccgagagccctcttactgcaccggagagccgagagtataccggcgagattatgtttgagacttttaatgtgcctgggctttatattgctgtcaattcggtgcttgctctagcagctgggtataccacatccaagtgtgagatgacaggggttgtggtggatgttggagacggggctactcatattgtaccggttgctgatggttatgttatcgggagcagcattaagtcaattcctattgctggcaaagatgttactctctttatccaggagctcatgcgggaaagaggagaaaatgtacccccggangattcatttgacgtggctcgaaatgtgaaggaaatgtattgttacacttgttctgacattgttaaggagtacaacaagcatgacaaagaaccagccaagtatattaagcattggagaggaattaaacccaaaaccggggcaccatattcttgtgacattggctatgagcgatttcttgggcccgaggttttctttagtcctgagatttatagcaatgactccatctctcctttaccagaggtaatagacaagtgcattcagtctgcaccaattgatacaaggagggcattgtataagaatatagtgttgtctgggggatcaaccatgttcaaggattttgggagaaggttgcaacgagatctaaagaagattgtggatgcccgggttctggcatctgaagctagaatggatggagaaataaaagcacggccggtggaggtaaatgttgtgagtcatcccatccagagatttgctgtttggtttggaggctcagtacttgcgtcaacacctgaattttttgcagcttgtcatacaaaagaagaatacgaggaatatggagcaagcatatgccggacaaatcctgttttcaaagggatgtattaatccaaaatcaatggcaagatgattcaaaagaggcatttttgagatagcaatgactccatttttcatttttcttcatgtgcctcaattcctctccttcatcccatcatcttaatgaggttttcattagtattcaaggggttgtttgaggtggtgtaaatatgacagatacggtggttaccttgtattga

SEQ ID NO: 2441 - DNA, 1619 bp, Zostera marina
ttccgtcgtgttaacagatctcttctcgtctcaagacggccgtgacaaaaacctcattctacctagatcgcacaccgcgccctctttcactgccagaatcaggtcttctcgttggatcttccgaatcaaattcggggaaacctcagatcgactgatgaccgcaagccctgaacgcttatcacaggatctccaaggaagatccaaattcaacgctttcttctcgatttctaatggacgctacttctcgtcctgctgtcgtcattgacaatggcactggttactccaagatgggatttgctggtaatgttgaaccatgcttcatgactccaacggttgttgctgtcaatgaatcctttttaaatcaatcaaagagctcctctagtaaagcaaattggttagcacagcatagtgcaggtgtgatggctgaccttgattttttatcggagacgaggctctgtcacgctctcgctcaagcagcacatacaacctcagttatcccattagtcatggtcaggtggaaaattgggatgcaatggaaagattttggcaacaatgtatatacaattacttgcgttgcgatcctgaagatcattattttcttctgactgagagtcctctaactgcccctgaaagtcgtgaatacacaggagaaataatgtttgagacattcaatgtccctggactttacatagcagtgcaaccagtacttgcacttgctgctggatatacaacgtctaagtgtgaaatgacaggtgttgttgttgatgttggagatggagctacacatatagtaccagtggctgatggatatgtaattggaagcagcattaaatctatacctatctcagggaaagatgttacttcttttgttcagcagctttaaaggaagaggagagaatatccaccagaagactctttgaggtagctcgtaaggtgaaggaaacttattgttatacttgttcagatatcgttaaggaatataataaacatgacaaggaaccttccaaattcattaagcaatggactggtataaaaccaaggacaggagcaccatacacatgtgatattggttatgagcgttttcttggtcctgagattttcaatcctgagatatacactaccgattttaccactcctttgcctgttttaattgataaatgtattcagtcagcaccgatcgacacaaggagggctctctacaagaatattgtattatctggaggatcgaccttgtttaaagacttccatagaaggttgcagcgagatgtaaagaagatagtagatgctcgactagctgcatctgaagctcgacacggaggagatgtaaaatcacaacctattgaggtcaatgtggtcagtcatcctatccaaaggtttgccgtttggtttggagggtcagttttggcatcaacacctgaattctatccggcttgccatacaaaagaagaatacgaggaatgtggtgcaagtatatgccgaacaaatccagtctttaaaggaatgtactaatcaccagagcaacgcaacaaatctacttctgatcgattttaaaatcaatgttgtaaatgagctattacccaaccaggaatgtgtatctattgaagaggcagcaaccaaca

SEQ ID NO: 2442 - DNA, 2138 bp, Malus domestica
ggtcgacgttgtttgattgccaataaaagcatcgaatcggagaaaatttgccgaagctgcaacgatgatgatgcagtcgacgagagctgccgccattgaaatcttcagcttctgcgtccgtcactgaaatgggtggggcaccaatcgcaatcaccaactgccgcgagctaccgagctgttcgttgagccgccgctttcgcttccgatccaagtctgcgtcgccatcatcagcaccaccaccagcttccacttcgtgcttttctttcccgcgctcttcaaaactatgatcatttgcctcgcaccctcctctattggatctcagctgcagatccacctccgtaataatcaaagccaataccagtttcaagctctctcatggacccggcctctcgcccagctgtagtcatcgacaatggaagtgggtatactaagatgggtttcgctggaaatgtcgagccgtgttacattgttccgactgtagttgccttaaatgaatcgtttttgaacccgtccagaacctcctccaaggctggctgggtagcgcagcacaatgctggcgtgatggctgatcttgatttctttataggggatgaggcgctggaaagatctcgatctagtacgacttacaatctgagctatcccattcgacagggccaggtcgagaattgggattcaatggagcggttctggcagcaatgtatatttaactacttgcgttgtgatcctgaagaccattattttcttttaactgagagtccgcttactgccccggagagccgggagtatacgggcgaaatcatgttcgaaactttcaatgttcctggcctttacattgccgtgaattcagtacttgctcttgcagctggttacactacctctaagtgtgagatgacaggggttgtagtggatgttggagatggggcaactcacattgtacctgttgcagaaggttatgttattgggagcagcatcaagtcggttcctattgccgggaaagatgtcactctattcgtccagcagcttatgcgggaaagaggcgagaatgtgccacaagaagactcttttgacgtagctcgcagagtgaaggaaatgtattgctatactagttctgacatagtcaaggagtttaataagcacgacaaagaaccctccaagtatattaagcaatggagaggcattaagccaaagacaggggcgccctactcttgtgacattggctatgaacgatttctgggtccagaggttttcttcaatcctgagatttatagcacagacttcaccactcccttaccagttgtaattgacaagtgtattcagtctgctccaattgacaccaggaggtctttgtataagaatatagtgttgtctggaggttcaaccatgttcaaggacttccataggaggttgcaacgggatataaagaagattgttgatgcccggcttcttgcatctgaagctcgagttggcggtgaagtaaaatcacagccagtggaagtgaatgtagttagtcatcccatccagagatttgcagtttggtttggaggctctgtacttgcatccacacctgaattctttgcggcttgccatacaaaagaagagtacgaggaatacggcgcaagcatatgcagaacaaatcctgttttcaaggggatgtattgatgcaaatatcgattttggctggatcacttgctggcaattcctgataaaaatggtattccccatcaattccacctcctacacgctgagtaattttacttcctgaatctgcctggtcagatctgtacgcatgtgctgctaggggcagtgtaaaatatagtttatcagttgttaattttgtaagagaaatttcattaggaggcaataggtgtcctaaaagcagataggaaaatagtctgcagtgttttttagtccgagtggcccctgaaaggatcagacgagaatcgtgatgcgggtagacatgaacctgcctgaaatatggagttttgaggttcagcttagatagatagagtttgcttaagattgttacactgtagtacatttccggtaggtagttcgattctttcggtggattggattggattggattgttgtagcacaataatttctaatttgagttcaagtatatttctatttcaaga

SEQ ID NO: 2443 - DNA, 2157 bp, Papaver somniferum
aatatctcctgaatttctagagacagagtgagaaaaacaagagaagtcgtcagatttcaatggtgatgaattctaaaagaatccattatcaactatattcatgaagaagttgatgagtagagttgaaatggatgaattcatatctgaaactaagaatgagttgttgagttatagttttcgctttgaatttaagttaaattcgttatcgataccaagaatatgatcctaaccctagaacccatatcggatctcacctgtggatccactcaattttactttcaatggatgccgctgcatctcgtcctgctgtagttattgataatggaactggctattctaaaatgggttttgctggtaatgtagaaccgtgttttataataccaactgttgtcgctgtaaatgagtcgtttcttaatcaaccaagaggttcagttaagggaagtaattggttagcacaacatagtgctggtgtgatggcagatcttgatttttatataggggaagaagctgtatcaaggtcgagatcgagtagtagttataacttaagtcatccaattcaacatggtcaggttgagaattgggatgcaatggaaagattttggcaacaatgtatattcaattacttaagatgtgacccggaagatcattactttctacttacagaaagtccacttactccacctgaaaaccgcgaatatactggagaaatcatgtttgaaacgtttaatgttccgggtctttatattgctgttcaaccagttcttgctctcgccgcgggttacaccacttccaagtgtgaaatgacaggagttgtagtggatgttggagatggtgctacacatattgtgcctgttgcagagggttatgttatcgggagcagcattaaatctatacctatcgctggaagggatgttacccaatttatccagcagctcatgcgggaaagaggggagcttataccacccgaagacgcatttgaagtagctcggaaggttaaagagaactattgctacacttgttcagatatagtcaaggaatataacaagcacgacaaagaaccatcgaagtacatcaagcaatggagagggattaaacctaggacaggagcaccattctcttttgatgttggctatgaacgctttctcggccctgagattttcttcaatcctgaaatatatagtagcgactttacaactccattaccatccgtgatagacaagtgcattcagtctgcgccaattgacacacgaagagcactgtacaagaatattgttctatctggaggatctaccatgttcaaggattttcatagaagaatacaaagagatgtaaagaagattgtagatgctcggctccatgtgtctgatacaaggcttggtggagaaattaaatcacaaccagtggaagtcaatgtagtcagccatcccattcagaggtttgcagtttggtttggaggctctgttctggcatcaacacctgagttctatgcagcttgccacacaaaagcagagtacgaggagtatggagcaagtatctgtcggacgaatcctgttttcaagggaatgtattaggtataaaaggtgtctagtttctctgaggccactaatctacttcgggtatcaattgatgcatatctaacatgtactctcaatcatctaacatagaaccatggttagttaaaattttagttgttccagttatacaagtgcattcaggaacacctaactattaagtgctcctgttgtaattagattgttaaaagataaacatctgggtacccttagttttcgaccttccacatccacaatcttagtgaatttgattgatgtttagtttctttaaatttacaatttgattttaaatgtaattgtatatttaattttgtcgatcttttatgcattgttgtctggatatctttctttcttgggtctgttgggaacttgttaagtttgggcaagtttgaaaacgaggtcgttctttttatggatgaaacaaattgctgggaagaaatggtgtcatatttgttattttatttacaacattaccttgttagcatctgtggttgtgaaggcgcaattgtaatgataatggagagtaactttggatgatataatgttatcttcatcttcttgggaaggacttctcactgcaggaaca

SEQ ID NO: 2444 - DNA, 1940 bp, Glycine max
catgttttggaaccgaacagaatgatgatgatcgagttaatgggacctgcacctttcagttgagatggatgtagcaatcaccaaccatttcaatttgtctatttccttctttcacttgggagcaaagcctctgtcaccatcacttacaccttcttcttccttgttccgcttttcacgaccatgatcctctgcttcacgcttactctcggatctcagtcgcagatccaccttcaacgttcaccaccttttcaatctttctcatggatccctctacttctcgtccagctgtagtcatcgataatggctccggttatactaagatggggtttgctggtaatgttgagccatgttttaatgttccgacagtggttgcaattaacgagtcctttcttaatcaatcgaggaattcctctaaaggcaattgggttgcccagcacaatgctggcgtaatggcagatcttgatttcttcattggggatgaggccctctccaaatctcgatctagcagcacttataatctcagctacccaattcagcatggccaggttgagaattgggatgccatggagcgcttctggcagcagtgcatattcaactatttgaggtgtgatccagaggatcactattttctcttgacggagagtccattgacttcgccagagagtcgcgagtatactggggaaatcatgtttgagacgtttaacgtacctggactttacattggtgtgaattctgtgcttgctcttgcagctggttacacaacatctaagtgcgagatgactggagttgtagtggatgttggagatggggctgctcatgttgtacctgttgcagacggctatgttattggcagtagcatcaaatcgattcccatttctggaaaggatattactctttttgtgcagcagcttatgcgggaaagaggagagaatgtaccaccagaagactcttttgaagtggcacggaaagtgaaggaaatgtattgctacacctgctctgacattgtgaaggaatttaataagcatgacaaagagccagccaagtatatcaagcactggagaggtattaaaccaaagacgggggcaccatattcctgtgatattggctatgaacgatttcttggccctgagattttctttaatcctgagatatatggcagtgactttaccacccctttgccagttgtaatagacaagtgcattcagtctgcgccaattgacacaaggagatcattatacaagaatgtagtgttgtctggaggttcaaccatgttcaaggattttcacaggaggttgcaacgtgatctaaaaaaaatagtggatgctcgtgtccttttatctgaagcgcgcttgaatggggagataaaatcgcagccagtggaggtaaatgtactcagcaatccaatccagagatatgcagtttggtttggaggatcagtgcttgcgtcaacacctgatttttttacggcttgtcatacaaaggcagaatatgaggagtatggagcaagcatttgccggacaaatcctgttttcaagggaatgtattaaatcaacaacaaattagttgattatcgatgcagttatatgataagactgttgaatgaaacagctggttatcgttatcctcaattcacttcctgggctttcttcccacctatattcagggtggcagaagtgagtgtaaaatatgtgtattaagtgaaaatatgcgtttgtttttattccattcctaggtagtcagtttcacagggttaatacagctgtcagcagatccagacgatacttaatggttagatagaatttgatctttgacaaagctggttgagctgaattgcaaattttggggttcagcttagagtttgatgaagttctgcattttttgtcattcattgatgggactgataataccatgaagcacttttctaggtagtaagttaaatt

SEQ ID NO: 2445 - DNA, 2215 bp, Glycine max
attgtgattataccaaaatagtcatctacctgagaagaaaacaagagagtctaggagagagagaaggaaggtagttgtttaaagcatgttttggaaccgaacagaatgatgatgatcgagttaatgggacctgcacctttcagttgagatggatgtagcaatcaccaaccatttcaatttgtctatttccttctttcacttgggagcaaagcctctgtcaccatcacttacaccttcttcttccttgttccgcttttcacgaccatgatcctctgcttcacgcttactctcggatctcagtcgcagatccaccttcaacgttcaccaccttttcaatctttctcatggatccctctacttctcgtccagctgtagtcatcgataatggctccggttatactaagatggggtttgctggtaatgttgagccatgttttaatgttccgacagtggttgcaattaacgagtcctttcttaatcaatcgaggaattcctctaaaggcaattgggttgcccagcacaatgctggcgtaatggcagatcttgatttcttcattggggatgaggccctctccaaatctcgatctagcagcacttataatctcagctacccaattcagcatggccaggttgagaattgggatgccatggagcgcttctggcagcagtgcatattcaactatttgaggtgtgatccagaggatcactattttctcttgacggagagtccattgacttcgccagagagtcgcgagtatactggggaaatcatgtttgagacgtttaacgtacctggactttacattggtgtgaattctgtgcttgctcttgcagctggttacacaacatctaagtgcgagatgactggagttgtagtggatgttggagatggggctgctcatgttgtacctgttgcagacggctatgttattggcagtagcatcaaatcgattcccatttctggaaaggatattactctttttgtgcagcagcttatgcgggaaagaggagagaatgtaccaccagaagactcttttgaagtggcacggaaagtgaaggaaatgtattgctacacctgctctgacattgtgaaggaatttaataagcatgacaaagagccagccaagtatatcaagcactggagaggtattaaaccaaagacgggggcaccatattcctgtgatattggctatgaacgatttcttggccctgagattttctttaatcctgagatatatggcagtgactttaccacccctttgccagttgtaatagacaagtgcattcagtctgcgccaattgacacaaggagatcattatacaagaatgtagtgttgtctggaggttcaaccatgttcaaggattttcacaggaggttgcaacgtgatctaaaaaaaatagtggatgctcgtgtccttttatctgaagcgcgcttgaatggggagataaaatcgcagccagtggaggtaaatgtactcagcaatccaatccagagatatgcagtttggtttggaggatcagtgcttgcgtcaacacctgatttttttacggcttgtcatacaaaggcagaatatgaggagtatggagcaagcatttgccggacaaatcctgttttcaagggaatgtattaaatcaacaacaaattagttgattatcgatgcagttatatgataagactgttgaatgaaacagctggttatcgttatcctcaattcacttcctgggctttcttcccacctatattcagggtggcagaagtgagtgtaaaatatgtgtattaagtgaaaatatgcgtttgtttttattccattcctaggtagtcagtttcacagggttaatacagctgtcagcagatccagacgatacttaatggttagatagaatttgatctttgacaaagctggttgagctgaattgcaaattttggggttcagcttagagtttgatgaagttctgcattttttgtcattcattgatgggactgataataccatgaagcacttttctaggtagtaagttaaattcattttgattgaattgtaataagcaccagtgcaggttagatttatgtttacgctaaatcgtgattcatatatttttgcacttttgggtacataatgtacaattgtattttgtttactgatgatcaaagccagaaataatttttttgccacattggaatttgaaatcattctcccaacattttttatgtaat

SEQ ID NO: 2446 - DNA, 1417 bp, Nicotiana tabacum
atggacccttctacctctcgcccagctgtagtcattgacaatggaaccgggtatacaaaaatgggttttgctggaaatgttgaaccatctttcatactgcctacagttgtcgctgttaacgaatcatttatcaatcagcctcgagctttgactaagagcagcaacttagctcagtacagtgcaggagttatggctgatcttgatttctttattggggaagaggcattgagtagatctaaatctagtagcacttacaatcttagctatcctattaaacatggacaggttgataactgggatgcaatggagcggttctggcagcagtgtgtattcaattatctgcgctgtgaccctgaggatcactattttctgttgactgaaagccctatgactgcaccagagaaccgagaatatactggtgaaattatgtttgagactttcaatgttccgggactttatatagctgtgcagccggttcttgctctggcagctgggtacacagcatctaagtgtgagatgactggagtcgtagtggatgttggagatggtgctacccatgttgtacctgttgctgaaggttatgttattgggagtagcattaagtcaatccctgttgctgggaaagatgttactcttttcattcaacagctcatgaaggaaaggggagagcatgttccagcagaggattccttagaagtagcacgaaaagtgaaggaaatgtattgctatacttgttctgacattgtgaaggagtctaataagcatgataaagagccagggaagtacatcaagcaatggagaggtacaaaaccaaagacaggagcaccatattcatgtgatgttggctatgagcgatttcttggtcctgaggttttcttcaatcctgagatctataatagtgattttacgacccctttacctgatgtgattgacaaatgtatccagtctgcaccaattgacacaagaagagctttatataagaatattgttctatccggaggatcaaccatgttcaaagacttccatagaagattgcagcgagatctcaagaagattgtggatgaccgtgttcctgcatcagatgctcggttaggtggaaatgtcaaagcacaaccagttgaagtgaatgttgtcagcaatcctatccagagatatgcagtttggtttggaggttctgtactagcttcaactccggaattttttgcggcttgccatacaaagacagaatacgaggaatatggagctagcatatgccgcacaaaccctgtattcaagggaatgtattgatattgatccaatcccaactgatgattgttaaaggcacttattctcagatgttcacattcgacagcttgatcttccatcccttgtgttcagctccaagttgaaatctaacacctgcgggcatctttcagtt

SEQ ID NO: 2447 - DNA, 2046 bp, Trigonella foenum-graecum
tatgggtagtagtgatagagctatcaccgacaaccactattttatgttcactcgttcctttcacttgggatcaaagtctttgtcgtcatcatcttcttcttcttcttcttcacgaccatgatcctctgtctaaacctacctattggatctgaattatactcttacagatccacttcaaattttcatcattttttttatatttctcatggacccagctgcttctcgtcctgctgtagtcatcgacaatggctccgggtatacgaagatggggtttgcgggtaacgtggaaccttgttttattgttccaacagtggttgcaattaacgagtcgtttttgaatcaatcgaggagttcttctaaaggaaattggattgcacagcataatgcaggggttatggctgatcttgatttctttattggagatgacgcgctttctaagtctcgatctagtagcacttataatctcacctacccgattaagcatggtcaggtggaaaattgggatgcaatggagcgtttttggcagcagtgtatattcaattatttgaggtgtgatcctgaggatcattattttcttttgactgagagtccgttgacagcgcctgagagtcgtgagtatactggggaaattatgtttgagacttttaatgtgcctggactttacattgccgtgaattctgtgcttgctctggctgctggctacacaacttctaagtgtgagatgacaggagtcgtagttgatatcggagatggggctacacatgttgtaccagttgcggatggttatgttattggaagtagcatcaaatcagttcctattgctggaaaggatgttactcttttcatccagcagctaatgcgggaaagaggagagaatataccaccagaagactcgttcgaagtggctcggaaagtgaaggaaatgcattgctacacctgctctgacatagttaaggaatataataagcatgacaaagaaccagccaagtatatcaagcaatggagaggcgttaaaccaaagactggggctccatattcctgtgatattggctatgaacgctttcttggccctgaggttttctttaatcccgagatatatagcagtgactttaccactcctttgccagttgtaatagacaagtgcattcagtctgcgccaattgacacaaggagatcattatataagaatatagtgttgtcaggaggatcaacaatgttcaaggattttcacaggagattacaacgtgatataaagaaaatagtggatgctcgtgtccttgcagctgaagcgcgcttaaatggggagataaaatcacatccagtggaggtcaatgtactcagtcatcctatccaaagatttgcagtttggtttggtgggtcagtgcttgcatcaacacctgaattttttacggcttgtcatacaaaagcagaatacgaagaatatggagcaagcatttgccgcacaaatcctgttttcaaggggatgtattaaaaagatgaattagctgatcacagatgccgtctcttctcttgatataaaaaaagaaattaaggtctggttatttcgattctcgtttcatctcacggtctttcttccaatctttattaagggtagcggaagtgtaaaatatgtatattcagtgaaacaaatgtttttctagctttaaatcctgcagttctccctaggaagccaatttcatgtcatcttgtggttaatatggttgccagcaggtccagatggtacttattggtagatagaatttgatttttgacaaaatgttggctgagctgaatggcaatttttagtgttcagcttagagtttggtaatgttctgcattttttcatttgttgttgggactggtataacattaagtacttttctaggcaggagattaaattcgttgggattgaattgtaatactaataagccctagtgcaagttttgtgtttatgttaatcacataatttttgcatttttaggtatgtaatgcacacttcagaactagtattaatgatttgagatatatagtactctgctgtagttt

SEQ ID NO: 2448 - DNA, 2051 bp, Phaseolus vulgaris
tcttccttattgcgctcttcacgaccatgatcctctgcctcacactcactctcactctcggatctccctcgcagatcccctttcaacgctcaccatcaccaccaccgtttctctctttctcatggatctctctccttcgcgtccagctgtagtcatcgataatggctccgggtatactaagatggggtttgctggtaatgtcgagccatgttttattcttccgacagtggttgcagttaatgagtcgtttttgaatcaatcgaggaacctttctaaaggcaattggttagcccagcacaatgccggtgtaatggcggatcttgatttctttattggggatgaggcactttccaagtctcgatctagcagcacttataacctcagctacccaattcagcatggtcaggttgagaattgggatgccatggagcgctactggcagcagtgcatattcaattatttgaggtgtgatccggaggatcactattttctcttgaccgagagtccattgacttcgcctgagagtcgtgagtatactggggaaatcatgtttgagacttttaacgtacctggactttacattggtgtgaattctgtgcttgcccttgcagctggttataccacatctaagtgtgagatgacaggagttgtagtggatgttggagacggcgctgctcatgttgtacctgttgcagatggctatgttattggtagcagcatcaaatcaattcctatttctggaaaggatgttactctttttgtgcagaagctcatgcgggaaagaggagagaatgttccacccgaagactcttttgaagtggcacgaaaagtgaaggaaatgtattgctacacctgctctgacatagtgaaggaatttaataagcacgacaaagaaccagccaagtatataaagcattggagaggcattaaaccgaaaacaggggcaccatattcctgtgatattggctatgaacgatttcttggccccgagattttctttaatcctgagatatatggtagtgactttaccacccctttgccagttgtaatagacaagtgcattcagtctgcaccaattgacacgaggagatcactctataagaatattgtgttgtctggaggttcaaccatgttcaaagattttcacaagaggttgcaacgtgatctaaaaaaaattgtggatactcgtgtcattttatctgaagcacgcttaaatggggagataagatcgcagccagtggaggtaaatgtagtcagccatccaattcagagatttgcagtttggtttggaggatcagtgcttgcgtcaactcctgaattttttacggcttgtcatacaaaggcagaatatgaggagcatggagcaagcatttgccgtacaaatcctgttttcaagggaatgtattaatgcagcgatagttgccgaaggacgcagttatttgattagacagttgaatgaatgcctggttgttttgatccccaattcaccttctgatctttcttcccacctatattcaaggtggtggtggaagtgagtgtaaaatatgtatattaagcgaacacatgcatttgttttcattccagcactctctctaggcagtcagtttcactcggttattacagttgccagaaggtccaggcggtactttaatggctagatagaaactgatctttgacaatactggctcagctgaatttgcaacttttggcgttcagcttagagtctgatgaagttctgcattttttgtcattctttgttgggactaaatattgcatcaagtacttttctaggtcacaagtcaaattcgtttttattgaattgtaataagcaccagtgcaggttagatttgtgtttaccataatcatatatttttgcatttttggggtacatattgtacaatttgtattttgtttactgatgatcaaagctagaaataattcttttgtcacgttaactgttcctgattcctgatgtacttcaggtaatgtgaaactattctccctgcattttaatatagtaaggctcaaataatgttttaggtactcgtaaa

SEQ ID NO: 2449 - DNA, 2124 bp, Fragaria vesca
agaaaaccaaaaaaaaccaaacaaacgcagattcagaaacaacaatgatgaagaagtccatgagagctgccactgatttaacccgtcgtatttgaaatgggaatcccaaccaccaccaactggtgcagcaactctgctctcttgagtcgcttccgatccaagtctgcgtcaccatccccaccaacaccaccaccacctccctcttcgctctctttatcatcacctctgctgcgctctccaataccatgatcctctccctcgctccctctcttggatctcagctgcagatccatacccaccaaacccaatcccaatggaccctgcttctcgccccgcagtagtcatcgacaatggcaccggctatactaagatggggtttgccggcaacgtcgagccgtgttacattgtgcccacagtagttgcagtcaacgattcgtttgtgaaccaatcgagaagcacctcctccaaggccagctggatagcgcagcacaatgccggcgtgatggccgatcttgatttcttcataggggatgaggctatcgagaaatcgagatccagctcgacttataatttgaagtatccgattagtcatgggcaggtggagaactgggactcgatggagcggttctggcagcagtgtatatttaattacttgcgttgtgaccctgaagatcattactttcttttgactgagagcccgcttactgccccggagagccgggagtatacgggggagattatgtttgagactttcaatgttcctggcctttacattgctgtgaactcggttcttgctcttgcagctggctacactacctctaagtgtgagatgacaggtgttgtagtagatgttggagatggggccagtcatgttgttcctgttgccgaaggttatgttattgggagcagcatcaagtctgttccaattgcagggagagatgtcactctttttgtccaacaacttatgcgggaaagaggagagaatgtgccaccagaagactcctttgatgtagctagaaaagtgaaggaaatgtattgctatactagttctgacatcgtcaaggagttcaacaagcatgataaagaaccatccaagtatattaagcaatggaaaggcattaaaccaaagacaggagcaccgtacacttgtgatattggctatgaacgatttcttggaccagaggtattttttaatcctgagatttacagcagcgatttcaccactccattaccagttgtaattgacaaatgtattcagtctgctccaattgacaccaggaggtctttgtataagaatattgtgttgtctggaggttcaacgatgttcaaggacttccatagaaggctgcaaagagatataaagaagattgtggatgcccggcttcatgcatctgaagctcgagtcggtggagaactgaaatcacatccagtggaagtaaacgtggtaagccatcccatccagagatatgcagtttggtttggaggctccgtacttgcatccacacctgaattctttggggcttgccatacaaaagcagagtatgaggaatacggtgcaagcatctgtagaacaaatcctgttttcaagggtatgtactgatgcacatatactggatcatgtgctggcatttcctgatcaaaattggaatgctcagtatctgacctcatggtatttgcttggtctcatccaaacaattgtgcttccaagaggtggtgtaaaatatagtttctcatcttaacgttgtaagagatgtggggttttctttttgtaatgaatgttttgttagagggcaataggtctcttagaagccaaataggaaatagcgtattgatgattacatgtccaagtggcccggaggatcagagtgagaatcgcgagttgggtagacatgaacctggctgaattgcagttttggttttcagcttagatagttgcttaagataattagcctattcctgtttcttttttcttcagttatgatatacacatttcagatagttcaattcttttgggttgcatttgttgtagtacacagcactttctaatttgagttagacaaatttttgttacagattgtgcataaacaaccttatattgttaaatgtatgttcatttttttacct

SEQ ID NO: 2450 - DNA, 1820 bp, Flaveria ramosissima
tcggatccaacttacatcaacctctaattcagcctaccgatcttcatacgatcacacacccacgtacaccaaagaactagaaatcaaggggcttgatttgatccacacatcgtcaagaaaggtgcgattgggaaaagatagtgggttagtggatttacatcgtaatgatggcgaattactgtttctcccaatgaaatcaaatggatggagctacacccattaacgacatcaatcatcgtcggtactgtttgttgaattgccgcttttgcttacgttcgacgttctcgttatcgatcggtttcccccatcgatcatgatcacttcctccttaaaaccccacatcggatctcaattgcagatccacttttacttcaagaacatcgttggttttcttctttccgcactctctcatcatggatccttctacatctcgtcctgctgtagtaattgacaatggcaccgggtatactaaaatgggctttgcgggcaacgtggagccctgttttatcgctccaactgtggttgcaatcaacgaatcgtttataactcagcccacgcgtagctctagtaagggaagtagcagttggctcgcacaacacagtgctggtgtgatggctgatcttgacttctttattggggaagaggctttatccaaatcaagaactagtagtacttacaatctaagctacccaatcaaacacgggcaggtggaaaattgggatgcgatggagcggttttggcagcagtgtatatttaattacctgcggtgtgatccagaggatcattactttttattgactgaaagcccacttactccaccagaaagtcgagagtatactggtgagattatgttcgagacatttaatgttccagggctttatattgcagtgcaaccggtacttgctttggctgctgggtacacaacatctaagtgtgagatgacaggtgttgtggtagatgttggagatgggtccactcatgttgtacctgttgcagaaggttatgttattggtagcagcattaagtcaataccgatttctggaaaagatgttactctcttcgttcaacaactcatgcgcgaaagaggggagcccattcctcccgaagattcatttgaagtagctcgcaagattaaggagacttattgctacacaagttctgacattgtgaaggagtacaataagcatgataaggaaccatccaagtacatcaaacaatggcgaggtattaaaccaaagaccggggcaccatattcatgtgatgttggctatgaaaggtttcttggtcccgagatattttttaatcctgagatatacaatagtgactttacaacccctttacccgctgtaatagacaagtgtattcagtctgcaccaattgacacaagaagggctttatataagaatatagtgttgtccggaggatcaaccatgtttaaagatttccagagaaggctgcaaagggatacgaagaagattgtcgatgcacgggttcatgcatctagcatgaggcataatggtgaagtaaaagcacagccagttgaagtcaacgtagtcagccatcctatccagagatatgctgcgtggtttggaggctcggttcttgcatccacaccagaattttttacggcttgccatacaaaagcagagtatgaggaatacggggcaagcatatgcagaacaaatcctgttttcaagggaatgtattgatccaggatatgtttttttcttcattgttttgtgtactattttgcagtattagatgtacactagattgtttcatttcttagtaaaagaaaaaaaaactaaatttttattagt

SEQ ID NO: 2451 - DNA, 1539 bp, Mimulus guttatus
ctaatggaatcctccacttctcgtcctgctgtagtcatcgacaatggcactgggtacacgaaactgggttttgccggaaacgtagagccctgttttacagttccgacagtagttgcagtaaacgagtcgttcgtcaaccaggcccggcccggttcaacaaagggcagcaattggctggtgcagcatagcgcaggggtgatggccgatctcgattaccacataggcgaagaggcggtcgccagatctaaatccagcaccacttacagtttgagttatcccatgaaacacggtcaggttgataattgggattcgatggagaggttctggcagcagtgtatatttaactatctacgctgcgatccagaagatcactacttcctgttgaccgagagctcgttgactgcgccggagagtcgcgagtacaccggagagatcatgttcgagacctttaatgttccgggactttatatagctgtgcagcctgttcttgcattggctgctggatataccacatccaagtgtgaaatgacaggagttgtagtggacatcggagacggggctactcatgttgtccctgttgcagatggttatgttatcgggagcagcattaagtcgattccgattgcagggaaagacgtcactcggttcatccaacacctcatgaaagaaagaggagagcatgttccacccgacgactccttcgaggttgcgcgtaaagtgaaggaaatgtattgctacacttgttccgatattgtcaaggagttcaataagcacgacaaagagccagcaaaatacgttaagcagtggagaggtactaagccgaaaaccggggctccttattcttgtgatataggctatgaacggttccttggccccgagatattcttcaaccctgaaatttacagtgacgattttacgacgcctctgcctgatgtgattgacaaatgtattcagtccgctccaatagatacacgaagatcgttgtataagaatatcgtattatccggagggtcaaccatgttcaaagacttccacagaaggctgcaaagggatgtgaaaaagattgtcgatgctcgagttcttgcctctaatactaagcttggtggagaattaaaggcacaacctgttgaagtaaatgtcgtaagccatcctatccagaaatgtgcagtttggtttggaggctctgtacttgcatccacccccgagtttttcacagcttgtcatacgaaagcagagtacgaggaatatggagcgagcatatgccgcacgaacccagtttttaaaggaatgtattaattagtcgatcgatcaaattgttagttatacggaggcagtttctttccaggcgtaaaaaaacggagattcttatattctttcagacattcggtagagttcagctcaggttttcgacaatgctaagggcggctgtttcgcatgttcagtaatcgtaaggtctgtttttatctctctaattgatcaaataatttgatttatcataatgttttatatttgtagtatattcaacgagtttatagcctt

SEQ ID NO: 2452 - DNA, 1750 bp, Mimulus guttatus
ggaacgaaaagcttaatcagccgatgttttctttctccgacgttgttgtttgtagctgcaactactcgccgttgacacgtcggactcgttccgatcaccacgcgccgccgtcaaccatgatcgccgtttttctcagcacatttcaagaatctcagacccgggtttttctcttctagctaatggaatcctccacttctcgtcctgctgtagtcatcgacaatggcactgggtacacgaaactgggttttgccggaaacgtagagccctgttttacagttccgacagtagttgcagtaaacgagtcgttcgtcaaccaggcccggcccggttcaacaaagggcagcaattggctggtgcagcatagcgcaggggtgatggccgatctcgattaccacataggcgaagaggcggtcgccagatctaaatccagcaccacttacagtttgagttatcccatgaaacacggtcaggttgataattgggattcgatggagaggttctggcagcagtgtatatttaactatctacgctgcgatccagaagatcactacttcctgttgaccgagagctcgttgactgcgccggagagtcgcgagtacaccggagagatcatgttcgagacctttaatgttccgggactttatatagctgtgcagcctgttcttgcattggctgctggatataccacatccaagtgtgaaatgacaggagttgtagtggacatcggagacggggctactcatgttgtccctgttgcagatggttatgttatcgggagcagcattaagtcgattccgattgcagggaaagacgtcactcggttcatccaacacctcatgaaagaaagaggagagcatgttccacccgacgactccttcgaggttgcgcgtaaagtgaaggaaatgtattgctacacttgttccgatattgtcaaggagttcaataagcacgacaaagagccagcaaaatacgttaagcagtggagaggtactaagccgaaaaccggggctccttattcttgtgatataggctatgaacggttccttggccccgagatattcttcaaccctgaaatttacagtgacgattttacgacgcctctgcctgatgtgattgacaaatgtattcagtccgctccaatagatacacgaagatcgttgtataagaatatcgtattatccggagggtcaaccatgttcaaagacttccacagaaggctgcaaagggatgtgaaaaagattgtcgatgctcgagttcttgcctctaatactaagcttggtggagaattaaaggcacaacctgttgaagtaaatgtcgtaagccatcctatccagaaatgtgcagtttggtttggaggctctgtacttgcatccacccccgagtttttcacagcttgtcatacgaaagcagagtacgaggaatatggagcgagcatatgccgcacgaacccagtttttaaaggaatgtattaattagtcgatcgatcaaattgttagttatacggaggcagtttctttccaggcgtaaaaaaacggagattcttatattctttcagacattcggtagagttcagctcaggttttcgacaatgctaagggcggctgtttcgcatgttcagtaatcgtaaggtctgtttttatctctctaattgatcaaataatttgatttatcataatgttttatatttgtagtatattcaacgagtttatagcctttgcagttgaaatagtctttgaaatttaaaaacaaa

SEQ ID NO: 2453 - DNA, 2441 bp, Prunus mume
ccgacggaccatttcgctatatatattccgcgggtcccataatgactcccgccagagccaaaatctgaccgttgccaggtgtccaaatctaacggtaagaaaccgacgccatatcaaaagaaacccaaacgacaaaaggtaactagccaaaaagagaagggagatagataaaagagaaagcaaggggggtcacagtcggtgcgccgttgtttgattgccaataaaagcatcgaatcggagaaaaacgcagagaaacagagcaatgatgatgcagttgatgagagctggcgttgaattcagtttccatggtcgtcgttgaaatgggtggagcatcaatcacagtcaccaactgctgcaagctaccaagctgtgcgttgagtcgctgctttcacttccgatccaagtctgcgtcgccatcaacaacgtcaacaacaccagcttcctcttcgggttatctgttcttccgctctacaaagcgctcttcacgaccatgatcatttcccttacgccttctattggatctcagctgcagatccacctccgccattcaaatcaaatccaagcccgttttcaatctttttctcatggacccggctgctcgccccgctgtagttatcgacaatggcagtgggtatactaagatggggttcgcgggtaatgtcgagccgtgttacattgttccgactgtagttgccttaaacgaatcgtttctgaacccggccagaacctcctccaaggctggttggctagcgcagcacaatgctggcgtaatggctgatcttgatttctttataggggatgaggccctggaaaggtctcgatctagtacaacttacaatctaagctatcccgttcgccagggtcaggtcgagaattgggattcaatggagcgattttggcagcaatgcatattcaactatttgcgttgtgatcctgaagaccactattttcttttaactgagagtccgcttactgcccctgagagtcgcgagtatacgggcgaaattatgttcgagactttcaatgttcctggcctttacattgccgtgaattcggtacttgctcttgcagctggttacacaacgtctaagtgtgagatgacaggggttgtggtagatgttggagatggagcaactcatgttgtacctgttgcagaaggttatgttattgggagcagcatcaagtcagttcctattgctgggaaagatgtaactctcttcgtccagcagcttatgcgggaaagaggagagaatgtgccaccagaagactcctttgacgtagctcgcaaagtgaaggaaatgtattgctatactagttctgacattgtcaaggagttcaataagcacgataaagaaccatccaagtatattaagcaatggagaggcattaaaccaaagacaggtgcaccttactcttgtgacattggctatgaacgatttcttggtccagaggttttctttaatcctgagatttatagcaatgacttcaccactcccttaccagctgtaattgacaagtgtattcaatccgcgccaattgacactaggaggtctttgtataagaatatagtgttgtctggaggttcaaccatgttcaaggacttccacaggaggttgcaacgggatataaagaagattgtcgatgcccggcttcttgcatctgaagctcgagttggtggggaattaaaatcacagccagtggaagtaaatgtcgttagtcatcccatccagagatttgcagtttggtttggaggctctgtacttgcatccacacctgaattctatgcggcttgccatacaaaagaagagtatgaggaatatggtgcgagcatatgcagaacaaatcctgttttcaagggtatgtattgatgaaaacatcaattttggccggatcacttgccggcaattcctgataaaaaaaaatgtctcttacatgctcagtaatgcatttcctgatattttcctggtgtctagaggcggtttgtaatataattactcagttaatcttaattttgtaagggatgtggggtttttttgtaatgataatttcatttaggggggcaataggtctcttagaaaccaataggaaatagtctctgcggtgttgcatgtccaagtggcaagtggaaagtggccctgaaggatcagatgagatgagatgagaatcgtgatttgggcaagaagacatgaacctggctgaattgcagttttggtgttcagcttagaatagagtttgctcaagattattattagcctttcattttttttccctcgactgataattacaccgtagtacacttcaggtaggcctattcttttgaattggattgttgtagtacaataatttctaatttgacttttttaaatttcaagaaatttgtcacaaattgtgtttataaattcattttgtttaatacaattattagtttaaatcgctaatct

SEQ ID NO: 2454 - DNA, 2102 bp, Prunus persica
ggtgcgccgttgtttgattgccaataaaagcatcgaatcggagaaaaacgcagagaaacagagcaatgatgatgcagttgatgagagctggcgttgaattcagtttccatggtcgtcgttgaaatgggtggagcatcaatcacagtcaccaactgctgcaagctaccaagctgtgcgttgagtcgctgctttcgcttccgatccaagtctgtgtcgccatcaacaacgtcaacagcaccagcttcctcttcgggttatctgttcttgcgctctacaaagcgctcttcacgaccatgatcatttcccttacgccctctattggatctcagctgcagatccacctccgccattcaaatcaaatccaagcccgttttcaatctttttctcatggacccggctgctcgccccgctgtagttatcgacaatggcagtgggtatactaagatggggttcgcgggtaatgtagagccgtgttacattgttccgactgtagttgccttaaacgaatcgtttctgaacccggccagaacctcctccaaggctggttggctagcgcagcacaatgctggcgtaatggctgatcttgatttctttataggggatgaggccctggaaagatctcgatctagtacaacttacaatctaagctatcccgttcgccagggtcaggtcgagaattgggattcaatggagcggttttggcagcaatgcatattcaactatttgcgttgtgatcctgaagaccactattttcttttaactgagagtccgcttactgccccggagagtcgtgagtatactggcgaaattatgtttgagactttcaatgttcctggcctttacattgccgtgaattcggtacttgctcttgcagctggttacacaacgtctaagtgtgagatgacaggggttgtggtagatgttggagatggagcaactcatgttgtacctgttgcagaaggttatgttattgggagcagcatcaagtcagttcctattgccgggaaagatgtaactctctttgtccagcagcttatgcgggaaagaggagagaatgtgccaccagaagactcctttgacgtagctcgcaaagtgaaggaaatgtattgctatactagttctgacattgtcaaggagttcaataagcacgataaagaaccatccaagtatattaagcaatggagaggcattaaaccaaagacaggcgcaccttactcttgtgacattggctatgaacgatttcttggtccagaggttttctttaatcctgagatttatagcaatgacttcaccactcccttaccagctgtaattgacaagtgtattcagtccgcgccaattgacactaggaggtctttgtataagaatatagtgttgtccggaggttcaaccatgttcaaggacttccacaggaggttgcaacgggatataaagaagattgtcgatgcccggcttcttgcatctgaagctcgagttggtggggaattaaaatcacagccagtggaagtaaatgttgttagtcatcccatccagagatttgcagtttggtttggaggctctgtacttgcatccacacctgaattctatgcggcttgccatacaaaagaagagtatgaggaatatggtgcgagcatatgcagaacaaatcctgttttcaagggtatgtattgatgaaaacatcaattttggctggatcacttgccggcaattcctgataaaaaatatgtctcttacgtgctcagtaatgcatttcctgatattttcctggtttcatctgtatgtatgtgctgctagaggcggtttgtaatataattactcagttaatcttaattttgtaagggatgtggggttttttttgtaatgataatttcatttagggggcaataggtctcttagaaaccaataggaaatagcctctgcggtgttgcatgtccaagtggcaagtggcaagtggccctgaaggatcagatgagatgagatgagaatcgtgatttgggcaagaagacatgaacctggctgaattgcagttttggtgttcagcttagaatagagtttgctcaagattattattagcctttcattttttttttccctcgactgat

SEQ ID NO: 2455 - DNA, 3415 bp, Cicer arietinum
atttctattaaaaaacattggacacgtttccaatttaaccttgtaaaaaaatgtttccaatttaagccaggtaacaggagggaaaagacttagcacaattttcctgtttggtgggtctaaaactaaacagtgctctactcaggtgaagctagaaatcacacggtctattataaaagcatccccacccatcggtaccatacacaacacaagccaaaccccaaaaaaaaaatgatataaaaaataaaacaaggaaaacaataataagaaaggaaagaagaaggaagagacagaagagaaagagaagggtccaattgtttgtttgggaaagaaaacatcttttaggaaaaggaaaacaaaacacacttgattctcaagttgttaattaatgggacctctctaactataattcttctaccttgtattgtattttgagtttatgtttatcattatcatagttgaattgaaaacaaatgggtagtgataatagagctatcaccaaccactcttcacatcttcctaattttacgttcactccctcttttcacttgcgatcaaagtctgagtcaccatcatcatcaccatcttcttcatccttatcgatctcttcattaccatgatcctctgccccacttttcctattggatctgaatcgtactctcgcagatccacctccaatcttcaccacttttacgctctttctcatggaccctgctgcttctcgtcctgctgtagtaatcgacaatggctccgggtatacgaagatggggtttgctggtaatgttgaaccctgttttattgttccaacagtggttgcaattaacgagtcgtttctgaatcaatcgaggagttcttctaagggaaattgggttgcacaacataatgcaggagttatggctgatcttgatttctttattggagatgatgcactttcaaagtctcgatctagcagcacttataatctcacttacccgattcggcatggtcaggttgataactgggatgccatggagcgattttggcagcagtgtatattcaattatttgaggtgtgatcccgaggatcattattttctcttgactgagagtccgttgacagcccccgagagtcgtgagtatactggcgaaatcatgtttgagacttttaatgtgcctggactttacattgctgtgaattctgtgcttgctctggctgctggttacacaacgtctaagtgtgagatgacaggagttgtagttgatattggagacggggctacacatgttgtaccagttgcggatggttatgttattggaagtagcatcaaatcggttcctattgctggaaaggatgttactctttttgtccagcagctaatgcgggaaagaggggagaatgtacccccagaagactcttttgaagtggctcggaaagtgaaagaaatgcattgctacacctgctctgacatagtgaaggaatataataagcatgacaaagaaccagccaagtatatcaagcaatggcgaggtgttaaaccaaagactggggctccatattcttgtgatattggctatgaacgctttcttggccccgaggttttctttaatcctgaaatatatagcagcgacttttccactcctttgccagttgtaatagacaagtgcattcagtctgcaccaattgacacaaggagatcactatataagaatatagtgctgtcaggaggatcaacaatgttcaaggattttcacaggagattgcaacgtgatctaaagaaaatcgtggatgctcgtgtccttgcagctgaagcgcgcctaaatggggagataaaatcacatccagtggaagtcaatgtagtcagccatcctatccaaaaatttgccgtttggtttggaggatcagtgcttgcatcaacacctgaattttttacggcttgtcatacaaaggcagaatatgaagaatatggagcaagcatttgccgcacaaatcctgttttcaaggggatgtattaaagaaaagatgaattagctagctgatcatggatgctgtctcttctcttgatatatataaaaaaagaattaatgtctgattattttgatcctcagttcacctcaaggtctttcttccgatctggattcagggtggcgaagcgagtgtaaaatatgtatattcagtgaaaaatgcatttccacttttaattccagcacttcttcctaggtagtcaatttcatgtcatcatgtggctaatatggtcgctggtaggtctagatggtgtacttaatggtagatagaatttgatttttgacaaaatgttggcagggccgaatagcaatttgcagtcttcaccttagagttcagtaatgttctgcattttttcatttgttgggagtgacataccattaagtacttctctactcaggagattaaattcgttggaatcgaattgtaatactaataaggctgtccaggttttgtttttatactagtcaattatttgcgtttttatactgcatacttccgtactattcatgatttgagattgctgtaatttgaaatcatttctccaacatatttatttaataatcaataactaattaactataactatctgttctctgtggtggcaaatccacattagggaagtgattgaaggttttgctattatcaccgtcaaaatattcctgtcttaatcaaatagcttttgtcccagttccttttctttttagctcgacttgtggagctgcaattgaaaatgagacagattgtgtcaaggcattattatttttttggtatgttacgccttccatttattgtcagagataattctatttgagtccatttattatcagagataattctatttgaggtactggtcaccaaggtaatcaaaaccaaattaaattggcgggttcaatagattggaccagaaaccggacctcttactggtccaatcgactatgaaaaccgtccggaaaaccggcgatttggctggtttaacaggttggaccgcattttgtctttcttgtagaaaaaattggaaaatggcgtcggattcaaccagctcttcgtccacctctaatcttaagcgccagaagttgaacttgacacagaaatgctgaagaaaagaagaggtgcagatctaaaaaaaagaaaagaaaccatgaaatagaaagaactaaagaagaagaagagaaggaggagtcttttgtttgtcagatgaatttacactgtgattgtgagaaggagtcgataccgcttgacattactaggacattgaaatgtgcaaaaatcaaatattggaagcaggacttgtttaaagggtgatagttgaaaaaaaatcaaactttgtacggtgtgtaaatttgttgaaaagtgggaaagcatgataatgctagaaaatcaaaatacccattttaaagtaaccgtctgttattattaa

SEQ ID NO: 2456 - DNA, 2273 bp, Solanum phureja
gtacaaaattgaagaagagcagaatctcacactagacgatgaattcgaaactgtttgtttgccttattcaataaattcgaaactgtttgtttgccttattcaatgaaatggaaatggatgaattgaacccttctaccatcggtacttccgtcgtcatcacctttttcctaccttatacgtcgtcgttttcatcccctttcttcctcctacgaccatgattataccctttaaacctctctttggatctcaaccgcagatcctctctttcttcttcaatccttatggacccttctacctctcgccctgctgtagtctttgacaatggaaccgggtatacaaaaattggttttgctggaaatgtggagccatgtttcatactacctacagttgttgcagctaacgaatcatttgttaatcagcctcgagctttgactaagaacagcaactggttagcccagcacagtgcaggggttatggcggatcttgatttctttattggggatgaggctttgaccagatctaaatctagtagcaattacaatcttacctatcctattgaacatggacaagttgataactgggattcaatggagcggttctggcagcagtgtatattcaattacctgcgttgtgaccctgaggatcactattttctattgactgaaagccctatgactgcaccagagaaccgagaatatactggtgaaattatgtttgagactttcaatgttccgggactttatatagctgtgcagccggttcttgctttggcagctgggtacacagcatccaagtgtgagatgactggagtcgtagtggatattggagatggtgctacccatgttgtacctgttgctgagggttatgttattgggagcagcattaagtcaattcccgtttctgggaaagatgttactctctttgttcaacagcttatgaaggaaaggggagaacatgttccagcagaagattcctttgaaatagcacgaaaagtgaaggaaatgcattgctacacttgttctgacattgtgaaggagttcaataagcatgataaagagccagggaagtacatcaagcactggagaggtacaaaaccaaagacaggagcaccttattcatgtgatgttggctatgagcgatttcttggtcctgaggttttcttcagtcctgagatttataatagcgattttacgaaccctttacctgaggtgattgacaaatgtattcagtctgcaccaatagacacaagaagagctttatataagaatattgttttatctggagggtcaaccatgttcaaagatttccatagaagattgcagcgagatctcaaaaagatagtggatgaccgcattcttgcatcagatgctcggttaggtggaaatgtcaaagcacaaccagttgaagtgaatgtggtcagcaatcctatccagagatatgcagtttggtttggaggttctgtactggcttcaactcctgaattttttgcggcttgccatacaaaggcagaatacgaggaatatggagctagcatatgccggacaaatcccgtattcaagggaatgtattgatattgaaccaattcaaactgatgattgcaaaggcatttattgtcaagatgtgctcatcctaacaacccaatccatccgtccttggtgtcagcttcaagctgaaatcctacatccgcaggtgccttcagttatgtcaaccgatcggaggcagtgtaggatggacctgtaacgaatggggttcttgtacttttctccattagcagcgcatgaattctagccttgccggaaaagtaggctttcatcttccatttttcagatggctgatcagttagatgacatttactgagctgaatgttattttctgtgtgttcagttcagtctagggatttatcagtttattttagtaagagggcaggataataagcttcaaacaaattcaggtaggttttcttttaattgttattgaatgactattagtgctctatgtcaaagattcatgtagaaacttgttttctctgtagacacattctgaacattgaagctatacctgtatatttggttcaccactgaaccttcattctttttctaggaatagtattgtcatttgtctccaagttattttgtctggtgcaatttaatctgcatttgtgcttttgtaagctgtttgttgtgatttctcttagcttttgggtgtcttgatgacaataattttagtttgggtttccgtgagcagctaaaagaaaattgcttggttagttgtta

SEQ ID NO: 2457 - DNA, 2006 bp, Glycine max
tttctttctttcacttgggattaaagcctctctcaccgtcatcatatttaccttcttccttgttccgcttttcacgaccatgatcctctgcttcacgctcactctcggatctcagtcgcagatccaccttcaacgctcaccaccctttcattctttctcatggatccctctacttctcgtccagctgtagtcatcgataatggctccgggtatactaagatggggtttgctggtaatgttgagccatgttttattgttcccacagtggttgcaattaacgagtcttttcttaatcaatcgaggaactcctctaaaggcaattgggttgcccagcataatgctggcgtaatggcagatcttgatttcttcattggggatgaggcactttccaagtctcgatctagcagcacttataatctcaactacccaattcagcatggccaggttgagaattgggacgccatggagcgcttctggcagcagtgcatattcaactatttgaggtgtgatccggaggatcactattttctcttgactgagagtccgttgacttcgcctgagagtcgcgagtatactggggaaatcatgtttgagacttttaacgtacctgggctttacattggtgtgaattctgtgcttgctcttgcagctggttacacaacatctaagtgcgagatgacaggagttgtagtcgatgttggagatggggctgctcatgttgtacccgttgcggacggctatgttattggtagtagcatcaaatcaattcctatttctggaaaggatattactctttttgtacagcagcttatgcgggaaagaggagagaatgtaccactagaggactcttttgaagtggcacggaaagtgaaggaaatgtattgctacacctgctctgacattgtgaaggaatttaataagcatgacaaagaaccagccaagtatatcaagcattggagaggcattaaaccaaggacaggggcaccatattcctgtgatattggctatgaacgatttctaggccctgagattttctttaatcccgagatatatggcagtgactttaccacccctttgccagttgtaatagacaagtgtattcagtctgcgccaattgacacaaggagatcattatacaagaatgtagtgttgtctggaggttcaaccatgttcaaggattttcacaggaggttgcaacgtgatctaaaaaaaatagtggatgctcgtgtacttttatctgaatcacgcttgaatggggagataaaatcgcagccagtggaggtaaatgtactcagcaatccaatccagagatttgcagtttggtttggaggatcagtgcttgcatcaacacctgaattttttacggcttgtcatacaaaggcagaatatgaggagtatggagcaagcatttgccggacaaatcctgttttcaagggaatgtattaaatcaacgacaaattagttgattatcgatgcagttatttgataagactgttgaatgaatgtctggctggttatcgttatccttaattcacttcttggtctttcttcccacctaaattcagagggcggcggaagtgagtgtaaaatatgtatattaagtgaaaatatgcattttgtttttatccgggcaatctccctaggcagtcagtttcacacggttaatacagttgccagcaggtccagacggtacttaatggttagatagaaaattgatctttgacaaagctggctgaactgaattgcaacttctggtattcagcttaagtgttcgatgaagttctacattatttgtcattcattgatgggactgataattccatgaagtacttttctaggtatatagtaagttaaattcattttgattgaattgtaataagcaccagtgaaggttagatttgcgtttacgtcatatagtttggcatttttgggaacataatgtacaatagtattttgtttactgatgatcagagccagaaatatttttgttgccacgtgaactattt

SEQ ID NO: 2458 - DNA, 2255 bp, Glycine max
aaagaaaacatattcttgccttgtagagagagagagagagagagagagagagaagggaagtagttgtttaaagcatgttttggaaacgaacagaaggatgatcgggttaatgggacctgcagctttcagttgagatggatgtagcaatcaccaaccattcccatttgtttatttctttctttcacttgggattaaagcctctctcaccgtcatcatatttaccttcttccttgttccgcttttcacgaccatgatcctctgcttcacgctcactctcggatctcagtcgcagatccaccttcaacgctcaccaccctttcattctttctcatggatccctctacttctcgtccagctgtagtcatcgataatggctccgggtatactaagatggggtttgctggtaatgttgagccatgttttattgttcccacagtggttgcaattaacgagtcttttcttaatcaatcgaggaactcctctaaaggcaattgggttgcccagcataatgctggcgtaatggcagatcttgatttcttcattggggatgaggcactttccaagtctcgatctagcagcacttataatctcaactacccaattcagcatggccaggttgagaattgggacgccatggagcgcttctggcagcagtgcatattcaactatttgaggtgtgatccggaggatcactattttctcttgactgagagtccgttgacttcgcctgagagtcgcgagtatactggggaaatcatgtttgagacttttaacgtacctgggctttacattggtgtgaattctgtgcttgctcttgcagctggttacacaacatctaagtgcgagatgacaggagttgtagtcgatgttggagatggggctgctcatgttgtacccgttgcggacggctatgttattggtagtagcatcaaatcaattcctatttctggaaaggatattactctttttgtacagcagcttatgcgggaaagaggagagaatgtaccactagaggactcttttgaagtggcacggaaagtgaaggaaatgtattgctacacctgctctgacattgtgaaggaatttaataagcatgacaaagaaccagccaagtatatcaagcattggagaggcattaaaccaaggacaggggcaccatattcctgtgatattggctatgaacgatttctaggccctgagattttctttaatcccgagatatatggcagtgactttaccacccctttgccagttgtaatagacaagtgtattcagtctgcgccaattgacacaaggagatcattatacaagaatgtagtgttgtctggaggttcaaccatgttcaaggattttcacaggaggttgcaacgtgatctaaaaaaaatagtggatgctcgtgtacttttatctgaatcacgcttgaatggggagataaaatcgcagccagtggaggtaaatgtactcagcaatccaatccagagatttgcagtttggtttggaggatcagtgcttgcatcaacacctgaattttttacggcttgtcatacaaaggcagaatatgaggagtatggagcaagcatttgccggacaaatcctgttttcaagggaatgtattaaatcaacgacaaattagttgattatcgatgcagttatttgataagactgttgaatgaatgtctggctggttatcgttatccttaattcacttcttggtctttcttcccacctaaattcagagggcggcggaagtgagtgtaaaatatgtatattaagtgaaaatatgcattttgtttttatccgggcaatctccctaggcagtcagtttcacacggttaatacagttgccagcaggtccagacggtacttaatggttagatagaaaattgatctttgacaaagctggctgaactgaattgcaacttctggtattcagcttaagtgttcgatgaagttctacattatttgtcattcattgatgggactgataattccatgaagtacttttctaggtatatagtaagttaaattcattttgattgaattgtaataagcaccagtgaaggttagatttgcgtttacgtcatatagtttggcatttttgggaacataatgtacaatagtattttgtttactgatgatcagagccagaaatatttttgttgccacgtgaactatttagtgatttgtgatgtacttcaggtaatttgaaatcattcaaccaacatttttaatataataaattaataataagctat

SEQ ID NO: 2459 - DNA, 2538 bp, Solanum lycopersicum
tcgcttatttccccttttctcatctcgcttgcctctctcatcgctttttcgatcttgctcagctctctcctcttaatgtgtattaattttgatacaaatctatttgtacttatatattttctccaaaatccataaaaaatgcactctcatctctctctcaaatttagctcgcctcttttctcctctaacatttcgttgttagtcgtaattaagcaaagtataattataaattcctaataaaggctgtcgtttacttattctgaaatttctgtgtcaaataatgatttgatatttgagaaatcggaccctaacattgttgttaaaagttgttaattacaatagccacctggcacggatgtaaaaccgaatgaacaatcgagaaatactaggaaatattttgtcttgattgctaagaaaggaatcccaaattgaagaagaggaggatgaattcgaaactgtttgtttgccttattcaatgaaatggaaatggatgaattgaatttgaacccttcaacgaacgctacttccgtcgtcctcacctttctcctaccttatacgtcgtcgttttcatctcctttcttcctcctacgaccatgattataccctttaaacctctctttggatctcaaccgcagatcctctctttcttcttcaatccttatggacccttctacctctcgccctgctgtagtcattgacaatggaaccgggtatacaaaaattggttttgctggaaatgtggagccatgtttcatactacctacagttgttgcagctaacgaatcatttgttaatcagcctcgagctttaactaagaacagcaactggttagcccagcacagtgcaggggttatggccgatctcgatttctttattggggatgaggctttgaccagatctaaatctagtagcaattacaatcttacctatcctattcaacatggacaagttgataactgggattcaatggagcgcttctggcagcagtgtatattcaattacctgcgttgtgatcctgaggatcactattttctcttgactgaaagccctatgactgcaccagagaacagagaatatactggtgaaattatgtttgagactttcaatgttccgggactttatatagctgtccagccggttcttgctttggcagctggctacacagcatccaagtgtgagatgactggagttgtagtggatattggagatggtgctacccatgttgtgcctgttgctgagggttatgttattgggagcagcattaagtcaattcctgtttctgggaaagatgtcaccctcttcgttcaacaacttatgaaggaaaggggagaacatgttcccgcagaagattcctttgaaatagcacgaaaagtgaaggaaatgcattgctacacttgttctgacattgtgaaggagttcaataagcatgataaagagccaggaaagtacatcaagcactggagaggtacaaaaccaaagacaggagcaccttattcatgtgatgttggctatgagcgatttcttggtcctgaggtcttcttcagtcctgagatttataatagtgattttacgagccctttacctgaggtgattgacaaatgtattcagtctgcaccaatagacacaagaagagctttatataagaatattgttttatctggaggttcaaccatgttcaaagatttccatagaagattgcagcgagatctcaagaagatagtggatgaccgcattcttgcatcagatgctcggttaggtggaaatgtcaaagcacaaccagttgaagtgaatgtggtcagcaatcctatccagagatgtgcagtttggtttggaggttctgtactggcttcaactcctgaattttttgcggcttgccatacgaaggcagaatacgaggaatatggagctagcatatgccggacaaatcccgtatttaagggaatgtattgatactgaaccgatccaaactgatgattgtaaaagcatttattgtcaagatgtgcacatcctaacaacccaatccatccgtccttggtgtcagcttcaagctgaaatcctacatccgcaggtggcttcagttatgtcagccgatcagaggcagtgtaggatggacctgtaacgaagggggttcttgtacttttctccattagcagcgcatgacttctggccttgttggaaaagtaggctttcatcttccattttgcagatggctgatcagttagaggacattttctgagctgaatgttatgttctgcatgttcagctcagtttagggatttaccagtttattttagtaagagggcaggataataagtttcaaacgaattcaggtaggtttcttctaattgttatcgaatgactattattgctctatgtcaaagattcatgtagaagcttcttttctctgtagacgcactctcaatgttgaagctatacctgtatatttggttcactactggaccttcattccttttctaggagtagtactgtctccaagttattttgtctggtgcaatttaatctgcatttgcgctttct

SEQ ID NO: 2460 - DNA, 1572 bp, Cirsium arvense
caaatggatggagtgataatactcattagcaatctcaatcatcatcatcatcagttgttggattgccgctttcgcttgcaatcgacgtccacttttcttcttccaatcggtttcccccaacgaccatgatcacttcctcccttaaaccccaactcggatctcacttgcagatccacctttgctccaataattgctctaacaacaacaacttaatctctcgcaatggatccttctacatctcgtcctgctgtagtaatcgacaacggcaccgggtatactaaaatgggttttgcgggtaatgtagaaccatgttttattgctccgacagtagttgcagttaacgaatcgttcataacccagccgaaccgtagttctaacaagggaagtagcagttggatggcgcaacatagtgcgggtgtaatggccgatcttgatttctttattggggaagaagccttgtccaaatcaagaactagtagtacttacaatctaacgtacccgataaaacacgggcaggtggaaaattgggatgcgatggaacggttttggcagcagtgtatatttaattatctacgttgcgatccggaggatcattactttttgttgacggagagtccgctgactccaccggaaagccgagagtataccggtgagattatgtttgagacgttcaatgttccggggctttatattgcagtgcagccggtgcttgctcttgctgcagggtacacgacatctaagtgtgagatgacaggtgttgtggtagatgtcggagatggagctactcatgtcgtacccgttgcagaaggttatgttattgggagcagcattaagtcaataccgatatcggggagagatgttaccctcttcgtccaacagctcatgcgtgaaagaggggaacatgttcctcctgaagattcatttgaaatagctcggaaggttaaggagacttattgctacacatgtgcagacattgtcaaggagtacaataagcatgacaaagaaccatccaagtacattaaacaatggagaggtattaaaccgaagaccggggcaccgtatgcatgtgatgttggctatgaacgatttttaggtcccgagattttcttcaatccagagatatacaataaagatttcacgacccctttacccgctgtaatagacaagtgtattcagtctgcgccaattgacacaagaagggctctatataagaatatagtgttgtctggaggatcaaccatgtttaaagacttccaacgaaggctgcaacgggatacgaagaagattgtcgatgctcgtgttcttgcatctaatttgaaatatactagtaccagtaatgaagtaaaatcacaaccggttgaagtcaacgtagtcagccatccgatccagagatacgccgtatggtttggaggctctgtactcgcatcgacaccagaatttttcacggcttgccatacgaaagcagaatatgaggaatacggcgcaagcatatgccgaacaaatcctgttttcaaaggaatgtattgagtcgggtttgtgttcgtattcgtgtacattttgcaggttagcttt

SEQ ID NO: 2461 - DNA, 2367 bp, Gossypium hirsutum
gaaaagtatagatgaagagagaaaaaggaaaagagggaatttgttgataaaatgatgagaaatatttttatggaagggaagggaggtttgcaatgggtaatgttattggattatctttcgatatcgccaaccactgctattcgataccattgaaacgtcactgctttcagttgggatccaagtttgttgttgttgatatcgagtcaataccatcctcctcggcaacagtggagttcgcttctccttatctgcgcttcttcaagcgcacttcatgaccatgatcctttgtcctcaattttctcttgggtctcgctcgcagatccaccgccaccgccaccgccactacaaccaaaaccgatttcctaccttccgtttctcttctcgatggatcccacttctcgccccgctgtcgtcatcgacaacggcactggatatactaagatgggatttgcgggtaatgtagagccgtgttttattcaacaaacagtagtagcagttaacgaatctcttctaaatcaatctagagcttcttccaaatctaattggttagctcagtattcagctggggtaatggcagatcttgatttcttcattggagatgaagcactcacgcgatcacgatcaagtaataactataacattacccatcccattaagcatggtcaagtggataattgggatgctatggaacgatattggcaacaatgtatttttaattatttacggtgtgatcccgaggatcattacttcttgctgactgagagtccacttactgctcctgagaatcgagaatatatgggtgaaatcatgtttgagacgtttaatgttccagggctttatattgctgtgaattctgtccttgctttagctgctgggtacacgacatctaagtgtgagatgacaggggtggtagtggatgttggagatggggctacgcatattgttcctgttgcagatggttatgttattgggagcagcattaaatcaataccaatagcaggaaaagatgttactctctttatacaacaactgatgcgggaaaggggagagaaagttccacccgaggactcatttgaagtagctcggaaagtgaaggagagatattgctatacttgttctgatattgtcaaggagttcaacaagcatgataaagaaccttcaaagtacatcaaacaatggagaggtattagaccgaaaacagggacaccatactcctgtgatattggttatgaacgatttttgggcccagaggttttgtttaatcccgagatccataacagtaattttacaactcctttgccggctgtaatagataagtgcattcagtcagctccaattgacacaagaagggctttgtataagaatatagtgttatctggtggatcaaccatgttcaaagacttccacagaaggttgcagcgggatctgaaaaagattgtagatgcccgagttcttgcttctgatgctcggtatggtggggaagtaaaagcacaacctgtggaagttaatgtagtcagtcatcctatccaaggatttgcagtgtggtttggaggttctgtacttgcatcaacacctgaattttatgcggcatctcatacaaaagcagaatatgaggaacacggagcaagcatttgccgcacaaatcctgtgtttaaggggatgtattgaggcaaatatccttttcaggtgattaatgaaaaaatattctctgatgatgctcaaggtggtgacttgctatttcaattgccatcaagctcatcagtttatttcagttattcctgctttttgcttggtgctcatgtgtattggttgtaagaggtcggttgatgtagagcatattaggtagccagtcttaatagcaatgggaaaaaaatttaaattattacattcattctttaattaggagtaaagggtcctaatggcagcactatagaatgcagtcagatttgttacccgcaagcactgcctacgcttgttgatcggatggatatcaaatagttggaaaaaaatgtgagccgaattgcagatttagtttcagcttacataggacgtgatagggatttaaaaatatatatctatgaagcagggtggttggttgtgtttggtgggagcagcagcaaacccggtcgtgttaggtgggagcagcagcaaacccggtggtgttagcaaacccggtggtgtttaagtgtcatttctttcaccagtgcattttctgttagcaaacaagatgggaatactttgtgttagaaattcagttttcttattattgacattttgtaatttggtgttgatcttttgtgtaatatataaagttggctaatattcaaatatggtttgcttgtaattaaggtacattttacaaccatt

SEQ ID NO: 2462 - DNA, 2940 bp, Gossypium raimondii
taataggtaaaacgttacctgtaacaaccttcctcgcaattcgaaaagaagtttgatctcatcagtcccaattgagtcgtagctcccaggataaaatcaaaatgaaagtgaaaatattaccgagctctagtaaaaattttactaagccaaagcttaagaggaaaataaagaaaggaaagtggttgttgctttgtctttttatgatttcatttgattactaggaaaagtatagatgaagagagaaataggaaaagagggagtttgttgataaaatgatgagaaatatttttatggaagggaagggaggtttgcaatgggtagtgttattggattatctttcgatatcgccaaccactgctattcgataccattgaaacgtcactgctttcagttgggatccaagtttgttgttgttgatatccagtcaataccatcctcctcggcaacagtggagttcgcttctccttatctgcgcttcttcaagcgcacttcatgaccatgatcctttgtcctcaattttctcttgggtctcgctcgcagatccaccgccaccgccactacaaccaaaaccgatttcctaccttccgtttctcttctcgatggatcccacttctcgccccgctgtcgtcatcgacaacggcactggatttactaagatgggatttgcgggtaatgtagagccgtgttttattcaaccaacagtagtagcagttaacgaatctcttctaaatcaatctagagcttcttccaaatctaattggttagctcagtattcagctggggtaatggcagatcttgatttcttcattggagatgaagcactcacgcgatcacgatcaagtaataactataacattacccatcccattaagcatggtcaagtggataattgggatgctatggaacgatattggcaacaatgtatttttaattatttacggtgtgatcccgaggatcattacttcttgctgactgagagtccacttactgctcctgagaatcgagaatatatgggtgaaatcatgtttgagacgtttaatgttccagggctttatattgctgtgaattctgtccttgctttagctgctgggtacactacatctaagtgtgagatgacaggggtggtagtggatgttggagatggggctacgcatattgtacctgttgcagatggttatgttattgggagcagcattaagtcaataccaatagcaggaaaagatgttactctctttatacaacaactgatgcgggaaagaggagagaaagttccacccgaggactcatttgaagtagctcggaaagtgaaggagagatattgctatacttgttctgatattgtcaaggagttcaacaagcatgataaagaaccttcaaagtacatcaaacaatggagaggtattagaccgaagacagggacaccatactcctgcgatattggttatgaacgatttttgggcccagaggttttgtttaatcccgagatccataacagtaattttacaactcctttgccggctgtaatagataagtgcattcagtcagcaccaattgacacaagaagggctttgtataagaatatagtgttatctggtggatcaaccatgttcaaagacttccacagaaggttgcagcgggatctgaaaaagattgtagatgcccgagttcttgcttctgatgctcggtatggtggggaagtaaaagcacaacctgtggaagttaatgtagtcagtcatcctatccaaggatttgcagtgtggtttggaggttctgtacttgcatcaacacctgaattttatgcggcatctcatacaaaagcagaatatgaggaacacggagcaagcatttgccgcacaaatcctgtgtttaaggggatgtattgaggcaaatttccttttcaggtgattaatgaaaaaataattctctgatgatgctcaaggtggtgacttgctatttcaattgccatcaagctcatcagtttatttcagttattcctgctttttgcttggtgctcatgtgtattggttgtaagaggtcggttgatgtagaacatattaggtagccagtcttaatagcaatggtaaaaaaattaaaattattacattcattctttaattaggagtaaagggtcctaatggcagcactatagaatgcagtcagatttgttaccggcaagcactgcctacacttgctgatcggatggatatcaaatagttggaaaaaaatgtgagcggaattgcagatttagtttcagcttacataggatgtgatagggatttaaaaaatatatctatggagcagggtggttggttgtgttttggtgggagcagcaacaaacccggtggtgtttaagtgtcatttctttcaccagtgcattttctgttagcaaacaagataggaatactttgtgttagaaattcagttttcttattattgacattttgtaatttggtgttgatcttttgtgtaacatataaagttggctgatattcaaatatggtttgcttgtaattaaggtacattttacaacaattatggtgttctttatatgggatttatttttcttttatcatttctctaggggtgtgcttggacacttggttggggaaaagtggaaataaaattaatttttccagattggaaatgataagaggagggaaaatgagagatgtgtatattagttcaaaattatgtattttttaattgttttcttttcttttctttcatattgaagtctaccaagcaatggatagaaaaaaaatatgaaaaagagtatttatgttttccttctttctagtttttaatccctccaattttcttttcactatacctagcaaagcttaagagtgtgattggttgagtttaagaatacgagtgaatggaaaagtgaaaagaaaataaattaaatatgcttggtaggaaagaaaaatgagaggaaag

SEQ ID NO: 2463 - DNA, 1633 bp, Centaurea maculosa
tttaccaatgaaatcaaatggatggagtgatgataataataacactcattagcaatctcaatcatcatcagctgttgttggattgccgctttcgcttgcaatcgacgtccacttttcttcttccaatcggtttcccccaacgaccatgatcacttcctcccttaaaccccaactcggatctcacttgcagatccacctttgctccaataattgctctaacaacaacaacaacttaatctctcgcaatggatccttctacatctcgtcctgctgtagtaatcgacaatggcaccgggtatactaaaatgggttttgcgggtaacgtggaaccatgttttattgctccgacagtagttgcagttaacgaatcgttcataacccagccgaaccgtagctctaacaagggaagtagcagttggatggcgcaacatagtgcgggtgtaatggctgatcttgatttctttattggggaagaagccttgtcgaaatcaagaactagtagtacttacaatctaacgtacccgataaaacatgggcaggtggaaaattgggatgcgatggaacggttttggcagcagtgtatatttaattatctacgttgtgatccggaggatcattactttttgttgacggagagtccgctgactccaccggaaagccgagagtataccggtgagattatgtttgagacgttcaatgttccggggctttatattgcagtgcagccggtacttgctcttgctgcagggtacacgacatctaagtgtgagatgacaggtgttgtggtagatgtcggagatggagccactcatgtcgtacccgttgcagaaggttatgttattgggagcagcattaagtcaataccgatatcggggagagatgttaccctcttcgtccaacagctcatgcgtgaaagaggggaacatgttccccctgaagattcatttgaaatagctcggaaggttaaggagacttattgctacacatgtgcagacattgtcaaggagtacaataagcatgacaaagaaccatccaagtacattaaacaatggagaggtattaaaccgaagaccggggcaccgtatgcatgtgatgttggctatgaacgatttttaggtcccgagattttcttcaatccagagatatacaataaagatttcacgacccctttacccgctgtaatagacaagtgtattcagtctgcgccaattgacacaagaagggctctatataagaatatagtgttgtctggaggatcaaccatgtttaaagacttccaacgaaggctgcaacgggatacgaagaagattgttgatgctcgtgttcttgcatctaatatgaaatatactagtaccagtaatgaagtaaaatcgcaaccggttgaagtcaacgtagtcagccatccgatccagagatacgccgtatggtttggaggctctgtactcgcatcgacaccagaatttttcacggcttgccatacgaaagcagagtatgaggaatacggggcaagcatatgccgaacaaatcctgttttcaaaggaatgtattgagtcgggtttgttttcgtgtacattttgcaggttagctttgttaaagaagaggtgtacactagatgttgatgatggatgttttt

SEQ ID NO: 2464 - DNA, 1914 bp, Malus domestica
ctttctctcatggacccggcctctcgcccagctgtagtaatcgacaatggaagtgggtatactaaaatgggtttcgcgggaaatgtcgagccatgttacactgttccgactgtagttgcattaaacgaatcgtttttgaacccgtccagaacctcctccaagtccggctggatagcgcagcacaacgctggcgtgatggctgatcttgatttctttattggggatgaggcgctggaaagatctcgatcaagtacaacttacaatctaagctatcccgttcgacagggccaagtcgagaattgggattcaatggagcggttctggcagcaaagtatatttaactacttgcgttgtgatcctgaagaccattattttcttttaaccgagagtccgcttactgccccggagagccgggagtataccggtgaaatcatgttcgaaactttcaatgttcctggcctttacattgccgtgaattcggtacttgctcttgcagctggttacactacctccaagtgtgagatgacaggggttgtagtagacgttggagatggggcaactcatattgttcctgttgcagaaggttatgttattgggagcagcatcaagtcagttcctattgccgggaaagatgtcactctcttcgtccagcagcttatgcgggaaagaggagagaatgtgccaccagacgactcctttgatgtagctcgcagagtgaaggaaatgtattgctatactagttctgatattgtcaaggagtttaataagcacgataaagaaccatccaagtatattaagcaatggagaggcatcaaaccaaaaacaggggcgccctactcttgtgacattggctatgaacgatttcttggcccagaggttttcttcaatcctgagatttatagcaccgacttcaccactcccttacccgttgtaattgacaagtgtattcagtctgctccaattgacactaggaggtctttgtataagaatatagtgttgtctggaggttcaaccatgttcaaggacttccataggaggttgcaacgggatataaagaagattgtggatgcccggcttcttgcatctgaagctcgagttggtggagaagtaaaatcacatccagtggaagtgaatgtagttagccatcccatccagagatttgcagtttggtttggcggctcagtacttgcatccacacctgaattctttgcagcttgccatacaaaagaagagtatgaggaatacggtgcaagcatatgcagaacaaatcctgttttcaaggggatgtattgattcagatatcgattttggctggatcacttgctggcaattcctgattcaaattggaattccctgtcaattccacctccgacatgctcagtaattttacttactggattttcacggtatcatctctatgcatgtgctgctagaggcggtgtaaaatatagttactcagttaaatttgtaagagaaatggggttttctttttgtagtgattatttctttaggtggcaataggtctcccagaagcagatcggaaatagcctttgcagttttcgcatgtccaagggccctggaggatcagatatgaatcgtgaatcggctcaggtgcagttttgatgttcagctaagatggagtttgcttaagatcattagccgttgaagttttttctcgagcgatataacagcgtagtgcatttcgggtaggcagttcgattcttttggaatggatttgtggtagcacaataatttctaattttagctgaatatatttcgatcacaagacagatgttacagattgtgtataatttccttttgttcaacgatgttcacgttgaagaaatatatgtgtattaaactccaagcaacctctactacggtaacttctgaaaggcatttcgttttttcttt

SEQ ID NO: 2465 - DNA, 2060 bp, Manihot esculenta
gaataggcaagaaaagaatacaagccaaagagattcacagacacagattagattagaaaacgggagagagtggtaatgatgatgctcaagttgatgaaaggaacaaaatttatatggtctttttgagatgggtaaattattattgttattattcttcaccaactccaagctaccattgtcgttgagtcgctgctttcacttgggatccaagtctcctttcatcgccatcaccaattcgccttcctttttgcgcttctcgaagcgcacttcccgaccatgaacctctcccttaaaccctttattggatctccctcgcagatccttcttcattttttccacctgcgtttcatctccctcatccctctttctcatggacccgaccactcgccctgctgttgtcatggacaatggcaccgggtatactaaaatgggttttgctggaaatgtagagccttgttttattttacctactgtagtagctctaaacgattcgtttcttaatcaatccagaacttcaaaagcgaattggcttgcgcagcacagcgcgggtgttatggccgatctagattttttcattggagaagaggcgtttgccaagtacagatcgagtagtatttataatcttcgctatcctattgaacatggccaagttgacaattgggacgctatggaaaggtactggcagcaatgcatattcaattatttacgatgcgatccagaggatcattactttcttttgaccgagagcccgcttactgcaccggagagtcgcgaatacaccggtgagattatgttcgagacatttaacgtccctgggctttatattgcggttaattcggtgctggctctagcggctgggtacacaacatctaagtgtgagatgacaggggttgtggtggatgttggagatggggctagtcacgttgtacctgttgctgatggttatgttattgggagcagcattaagtccattcctattgctggaaaagacgtcacactctttatccaacagctgatgcgggaaagaggagagaatgtaccaccagaagattcatttgatgtagctcgacgggtgaaggaaatgcattgctacacatgttcagacattgtgaaggagtacaacaagcatgacaaagaaccagccaagtatattaagcaatggagaggtattaaacccaaaacaggggcaccatactcctgtgacattggctatgaacgatttcttggccctgaggtattctttaatccagagatttatagcagtgacttcaccactcctttatcagctgtaatagacaagtgcattcagtctgcaccaattgatacaaggagggctttgtacaagaatatagtgttatctgggggatcaaccatgttcaaggactttggtaaaaggttgcaaagggatctgaagaagattgtggatgcaagggctcttgcttttgaagctaaactggatgctggagtaaaatcacaaccagtggaagttaatgtagtcagtcatcccatccagagatttgctgtttggtttggaggttcagttctcgcatcaacacctgaatttttttctgcttgccacacaaaagcagaatacgaggaatatggagcaagcatatgccgcagcaatcctgttttcaagggaatgtattaatgcaaagttctgatttgccagatgattcgatgggcattcagatgccaatgttccttgcaaagacattattttgcactcccataaatagcctcagttcgcttccctgttacatctctgtatggtgttcatccatattaatgggtagtaagaggcagtgtaaagtattgattctcaatctacaagctaacagagaagatgggtttcttgtactgattctttcattggttctccctcaaagtctatagggtggaggtcaattatgttgctagaaactgtcatttagtacacacagttgagctgaaattttagtcttcagttcagttagattatgataatctccatttttccttttccttattgttttgtgaatgattataacaccataatataaatttcattcgtttgtatg

SEQ ID NO: 2466 - DNA, 2544 bp, Gossypium hirsutum
aagaggaatatattacaacccaatttgatggttccaccaccaaacattaatttggttggttgtaatgtctatggcggcctgcattgaatccattcctattctgggaagaggctgcatagccattcctttccctcaccgctgaataggcattgaataggatttttttcctttttaatttttgccctcacctttacccttctccttcaacccgatagcccttctcaccagctataatccctcattctttcttcttttcttttactcactcgatgcatgaagagagaaaaagaaaaatagggaatttgatgataaaatgatgagaaatatttttatggaagggaagggaggtttgaaatgggtagtattattggattttctttcgatatcgccaaccactgctattcgataccgttgaaacgtcactgctttcagttgggatccaagtttgttgttgttgctatccagtcaataccatcctcctcggcaacagtggagttcgcttctccttatctgcgcttcttcaagcgcacttcatgaccatgatcctttgtcctcaattttctcttgggtctcgctcgcagatccaccgccaccgccactacaaccaaaaccgatttcctaccttccgtttgtcttctcgatggatcccacttctcgccccgctgtcgtcatcgacaacggcactggatttactaagatgggatttgcgggtaatgtagagccgtgttttattcaaccaacagtagtagcagttaacgaatctcttctaaatcaatctagagcttcttccaaatctaattggttagctcagtattcagctggggtaatggcagatcttgatttcttcattggagatgaagcactcacgcgatcacgatcaagtaataactataacattacccatcccattaagcatggtcaagtggataattgggatgctatggaacgatattggcaacaatgtatttttaattatttacggtgtgatcccgaggatcattacttcttgctgactgagagtccacttactgctcctgagaatcgagaatatatgggtgaaatcatgtttgagacgtttaatgttccagggctttatattgctgtgaattctgtccttgctttagctgctgggtacactacatctaagtgtgagatgacaggggtggtagtggatgttggagatggggctacgcatattgtacctgttgcagatggttatgttattgggagcagcattaagtcaataccaatagcaggaaaagatgttactctctttatacaacaactgatgcgggaaagaggagagaaagttccacccgaggactcatttgaagtagctcggaaagtgaaggagagatattgctatacttgttctgatattgtcaaggagttcaacaagcatgataaagaaccttcaaagtacatcaaacaatggagaggtattagaccgaagacagggacaccatactcctgcgatattggttatgaacgatttttgggcccagaggttttgtttaatcccgagatccataacagtaattttacgactcctttgccggctgtaatagataagtgcattcagtcagcaccaattgacacaagaagggctttgtataagaatatagtgttatctggtggatcaaccatgttcaaagacttccacagaaggttgcagcgggatctgaaaaagattgtagatgcccgagttcttgcttctgattctcggtatggtggggaagtaaaagcacaacctgtggaagttaatgtagtcagtcatcctatccaaggatttgcagtgtggtttggaggttctgtacttgcatcaacacctgaattttatgcggcatctcatacaaaagcagaatatgaggaacacggagcaagcatttgccgcacaaatcctgtgtttaaggggatgtattgaggcaaatttccttttcaggtgattaatgaaaaaataattctctgatgatgctcaaggtggtgacttgctatttcaattgccatcaagctcatcagtttatttcagttattcctgctttttgcttggtgctcatgtgtattggttgtaagaggtcggttgatgtagaacatattaggtagccagtcttaatagcaattgtaaaaaaattaaaattattacattcattctttaattaggagtaaagggtcctaatggcagcactatagaatgcagtcagatttgttaccggcaagcactgcctacacttgctggtcggatggatatcaaatagttggaaaaaaatgtgagctgaattgcagatttagtttcagcttacataggatgtgatagggatttaaaaaaatatatctatggagcagggtggttggttttgttttggtgggagcagcaacaaacccggtggtgtttaagtgtcatttctttcaccagtgcattttctgttagcaaacaaggtaggaatactttgtgttagaaattcagttttcttattattgacattttgtaatttggtgttgatcttttgtgtaatatataaagttggctgatattcaaatatggtt

SEQ ID NO: 2467 - DNA, 2116 bp, Lactuca sativa
cttacgggttaacctaaccggaccaggtgaagctgcaaggggcacttgggagatcttagtagtggagccgtgccaaacacttctcctatcgaacctcaaaatccgactgccattcttcacaatcacacgaccacgagagacgcagataggagagaaagggacaggatttgattgtttttttcgccaagaaaggtgttgaattgggggaaaaggtgggggatagtggatttgtatggtaataatggtgaatttgatggaacaactgattccgacaggattattttctcttttccaatgaaatcaaatggatggagctacacccattgacaagatcaatcatcttcgctgctggttgttgaattgccgctttcgcttacattcgacgtccacgtttttaatcgattccccccaacgaccatgatcacttcctcccttaaaccccacatcggatctcaaccgcagatccacttttgctctaataacatcgctgtttctctctgctgctcactctcttttcatggatccttccacatcacgtcctgctgtagttatcgacaacggcaccgggtatactaaaatgggttttgcgggtaacgtggagccctgttttattgctccaacagtagttgcagttaacgaatccttcataactcagcccaatcgttcctctaccaaaggaagtagcagttggctgacacagcacagcgctggtgtaatggctgatcttgatttctttattggggaagaagccatatccaaatcaagaagcagcagtacttatagtctaacctacccaatcaaacacgggcaggtggaaaattgggatgccatggaacggttttggcagcaatgtatatttaactacttacgttgtgatccagaagaccattactttttattaacagagagtccattgactccacctgaaagtcgagagtacacgggtgagattatgtttgaaacattcaatgttccagggctttatattgcagttcaaccagtacttgctcttgctgctggatacacatcatctaagtgtgagatgacaggtgttgtagtagatgttggagatggtgccactcatgttgtacccgttgcagaaggttatgttattggaagcagcattaagtcattaccaatttcaggaaaagatgttactctctttgtccaacaactcatgcgtgaaagaggagagcatgtcccccctgaagattcacttgaagtagctcgaaagatcaaggaaacttattgctacacatgtgcagacattgtcaaggagtacaataaacatgacaaagaaccatccaagtatgttaaacaatggagaggtattaaaccaaagactggagcaccttactcatgtgatgttggatatgaacgatttcttggtcccgagattttctttaatccagagatatacgataaagacttcacaacccctttacctgctgtaatagacaggtgtattcaatctgcaccaattgacacaagaagagctttatataagaatatcgtgttgtctggaggatccaccatgtttaaagacttccaaagaaggctgcaacgggatacaaagaagattgtggatgcacgtgttcttgcatctagtgctagacatggtagtgaagtaaaggcacaaccggttgaagtgaatgttgtgagccatcccatccagagatatgcagtatggtttggaggctctgtacttgcatcaacacctgaattttttacggcatgtcatacaaaagcagaatatgaggaatatggggcgagcatatgtcgaacaaatcctgtgttcaagggaatgtattgaatcatgaatcctttgatttctagaagctcttcttcccttggtgtacattttgcagcttagcttttgttaaacaagaggtgtacactagatgttttgattttcttgtaagaaaaaaaaagagagaagattgtattctttgatttagaagcaaataggttttgttttaatgctgatatttatttctataaggtgacacaacttttgagcacataaaggtgtcatcaatttgtttcaacgttatacagaacttgtgtttcttgttttgtgttttttgcagttttaagaatctttttctgatgcgtt

SEQ ID NO: 2468 - DNA, 1640 bp, Cephalotaxus harringtonia
agatctgatcaggtcgtgagttcgaatctgaccacatggacgcaacatcacgccctgcagttgttattgacaatggcaccggctacacaaagatgggtttcgctggaaatgtggaaccgtgcttcatcatccctactgttgtggcagtgaatgaatcgtttttaagtcaatctagaggctctggaaagggaagctggttagcacagcacaatgctggtgtcatggcagatcttgatttctttattggtgatgaggctttgtccagatctcattctagcaatacatacaatctcagttatcctatacggcatggtcaggtagaaaattgggatactatggagagattttggcagcaatgtatattcaattatttacgatgtgatcctgaggaccactatttcctcctaaccgagagtcctcttactgctccagaaaaccgtgaatatacaggagaaataatgtttgaaacatttaatgttccaggtctgtatatagctgtgcaagctgttcttgctctggctgccgggtatacaacttctaagtgtgaaatgactggagtggttgtggatgctggagatggggctacacatgttgtacctgtagcggatgggtatgtgattggaagcagcatcaagtcaattcctattgctggaaaagacctaactttgtttgttcaacaactcatgcgggaaaggggtgaaaatataccgccagaagattccttggaagtggcacgtaaagtgaaaggaacgtactgctacacctgttctgatattgtcaaggaatttggtaagcatgaccgagaaccttcaaaatacataaaacagtggactggtaagaaacctaagacaggggcaccatattcctgtgatgtcggttatgagcgttttatggctcctgaggtcttctttcatcctgagatctacagtagtgattacactacacctttgcctgttgtagtggataggtgtatccaatcatcgccaattgacaccagacgtgctttgtacaagaatatagtattatcaggagggtccactatgttcaaggacttccaaagaagattgcagcgtgatatcaaaaaattgtggattctcgaattgctgcatcagatgctcggcttggtggtgaatcaaaatcacaagcagtggaagtgaatgttgtcagtcatccaatccagcggtttgcagtttggtttggaggttctgtccttggatctacaccggagttttatacggcttgccattcaaaggcagaatacgaggaatatgggccaagcatttgtcgtacaaaccctgtatttaagggaatgtattaaatgtggagtataatttgcatccacaatttttttattaacattgagggaaaaaatattcagattacttgtttgtcatgtacataaattttttttttggtgtccacatggatttttctaagcagttttttgctgtattttctgtacattctgctcgtaaatgaattatctcctcccaatagactgatgaatgaaacatttttgtcatcagttaatgtggatatgtctcgtgtaatagctttctccctctcgtctgcgggcaatttttgtaacagaggatagtctgtaactctattccattttgttttccaaaagaacaaatcta

SEQ ID NO: 2469 - DNA, 2165 bp, Pinus taeda
ggatgctgaaaggcgaataaagtgaaagtgaaagtaaatgaagtaaattgaattaaaactcagtgtttgtgctgacagcagcggggttcgaacttcaaacggatggatgcgcaggaggagagtaattagaagaaagcggagtcagagatcggagcagatccgaggccaaagctctccacatggatgctacatctcgccccgctgttgttattgacaatggcaccgggtatacaaagatgggttttgctggcaatgtagaaccatgcttcattatccctacagttgtggcagtgaatgaatcattcttaagtcaatctagaggctctggaaaggggaattggttagcacagcatgatgcagctgtcaaggcagatcttgatttctttattggtgaagaggctttgtctcgttctcattctagcaacacatacaatcttagttatcctatacgccatggtcaggtagaaaactgggattccatggagagatattggcagcaatgtatattcaattatttgcgctgcgatcctgaggatcattatttcctcttaactgagagtcctcttactgctccagaaaaccgtgaatatactggagaaataatgtttgaaacatttaatgttccaggactttatatagctgtacaggctgtccttgctattgctgctgggtacacaacctctaagtgtgaaatgactggagtagttgtggatgctggagatgggattacacacattgtacctgtagcagatggatatgtcattggaagtgccattaaatcaatccctattgctggaagagacctcactttatttgttcaacaacttatgcgggaaaggggtgaaaatataccgcctgaagattcatttgaagtggcacggagaataaaagaagcttactgctacacctgtgctgatattgttaaggaatttggtaagcatgatcgagacccagaaaaatatataaaacaatggtctggtacgaaacctaagacgggagcacgatattcttgtgatgttggttatgagcggtttctggctccagaggtcttctttaatcctgaaatctactccagtgattatacaacccccttgcctgttgtggtggacaagtgcatccagtcatcgccaattgacaccaggcgagctttgtacaagaatattgtattatcgggagggtcaactatgtttaaggatttccctagaaggttgcaacgtgatattaaaaaaattgtagatgctcgaattggtgcatcagatgctcgacttggtggtgaagtaaaatcacaggcagtagacgtcaatgtagttggccatccaatccagcggtttgcagtttggtttggaggctctgtacttgcctctacaccagagttttatacggcttgccatacaaaagcagaatatgaggaatacggcccaagcatttgtcgtacaaatcctgtgttcaagggaatgtattaaagcttatgagtataatatggtgtaatgaattttctttgacacgggaagtattcaattttattttcttgtttccgtgtacataattgttgttttccttctcaattagtgttagcatttttcgcagtatgtgctgtacatttgtttaagttggtagcaagaaaggaagaatggtcggaataaatcagttttagctgtattcgaggttttttctgtcaatagtatggaggtgaattatagtctccatccattggaccgacaaataaaattctcatgtcatcagacaacgccaatctgtgtctgatgtagtagttttcccccagttctctggaagggtggaatttgtaatatataggataaagccattctgaacctctattccgttctagtttataaaggaaaaaatgtagactagttaatttggatcaccgttaagtgttgtggaagagggttggtggtttactgctttcgggtggaacaatgaggaatcatgtctttagcatgtgaatatcatccccttctacaattagttgatggttatagcagattacaaaaagcagcatgcttgcctatttgcatgttataaatgcagtgattggatatagcggaatacaaaaggcagcatggtatatgttccataccattgcacgttgatgggattgataatttgactgtaacatccaataataacaaatttattgtgct

SEQ ID NO: 2470 - DNA, 1737 bp, Eutrema halophilum
agttttagtgaaatttgatttgtttaaaaaactaatattggttatcgattcggtttggttcagataaaccgaagtaattttatcaagtgcatttgttttctatctgaaaaagtctccgcacgattcgaccgacgccggcgactttccgtatgatctgaagttctgaacgaagggttcgctgaatttcacagaatctctcattgtttatcagaagccttctttcgttaaacactgttttggatctcatcaatagcagacgcttcaccttcaccgtctggcgaggcgtctttgattcagatatcgccggcgtagtttctgctatggatccgacttctcgacccgctgttgtaatcgacaatggaactgggtatacaaaaatgggatttgcgggtaatgtagagccatgttttatccttccaacagtagttgcggttaacgagtcgtttttgaatcaatccaagagctctttaaaaggaaactggacagtccagcacaatgccggagttgcggcggatctggatttctttatcggagacgaagctcttacgaaatcacggtctagtagtacctataatcttcattatccaatcgagcatggtcaagttgaggattgggatgctatggaaagatattggcagcagtgtatcttcaactatttgagatgtgatcctgaggatcattactttcttctcaccgaaagccctcttactcctcctgagagtcgagaatacacaggggagattttgttcgagactttcaatgttcctgggctttacattgctgttaattctgtgcttgcacttgcagctgggtacacaacatcaaagtgtgagatgacaggggttgtagtagatgttggagatggggcaactcatgtggtacccgttgcagaaggttatgttattgggagctgtatcaagtcgattccgattgctggcaaagatgtcaccctctttatccagcaactcatgcgggaaagaggtgagaatataccaccagaagattcatttgatgtagcccgtaaagtgaaggaaatgtactgctacacttgctcagacatcgtaaaggagtttaataagcacgacaaagaaccaggaaagtttattaaacaatggaaaggtgttaagccaaagactggtgcaccatacacttgtgacgtgggatatgaacgattccttggacctgaggtcttttttaatccagagatatacagcaatgacttcacaaccgctttaccagctgtaatagacaaatgtatccagtctgcaccaattgatacacgaagagctttatataagaatatagtgttgtccggaggttcgactatgttcaaagatttcggaagaaggttacaaagagatctcaagaagatagttgatgctcgtgttcttgctaataacgctcgtacgggtggtgagatcacgtctcaaccggtggaggttaatgtcgtgagccaccctgtccagaggtttgcagtttggtttggaggctctgtgctttcatcaactcctgagtttttcgcgagttgcagaacgaaagaggagtatgaggaatgtggagcaagcatatgccgtacaaatccagtcttcaagggaatgtattgaagctaaactgaagcggtttcataaataatcctccagccagaaccgtgctcacgttatactataataaacattataatgtaataaacatgggcctagagccggaaaaatgctcatataattcctctactatatg

SEQ ID NO: 2471 - DNA, 1935 bp, Lactuca sativa
actcgttatacaattatagcatatatcagcataatagagccgtgacgaatacttttggttatttgggatccaacgttgcgtggcgataccaaaaccaaacggcccaatttcatactcaactctgattgccatatttggtgtttacaatctcgaaacattacacacgagattgaagaacacatacatagagaaagaatcactgacaggtttctgttgtttcatcataaaggaaagtatcttgatcggagaaaacgacactgggtctgtattcaattgcaatgatggtgaaatttgtgaaacaactttcacattcatcataaatttcaatgcaatcaaatggatgctttcaaacccattaagaacatcgatcatctccagtattgtttgccgactagttgctttgggttgaaatcgacgccgacagttttaatccatcgtctcaaacgaccatgatcagttcttcccttaaaccccactttggatctcagttgcaggtccattaccactccacgaacatcattatttctctctacttttggctcgcatcatggatccttcaacctctcgtcctgctgtagtcatcgacaatggcaccgggtatacgaaaatgggatttgctggtaatgtggagcctttctttaacgttccaacagtagttgctcttaacgactcatttgtaagccaaccttcccgaagctcaatcaagggaagcagcagctggctaaatcaacacagtgcaggagtgatggctgatcttgattttcacataggagaagaagccatgtcaaagtcaagatctagtggcatctacaatctaactcacccaatcaaacatggacaggtggaaaattgggatgcaatggagcgattttggcaacaatgtatatacaattacttgcgttgtgatccagaggatcattactttttgttgactgaaagcccattgactgcacccgagactcgagaatacactggtgagattatgtttgagacattcaatgttccagggctttatattgcagttcagcctgttcttgctcttgctgctggatacaccacaaagaagtgtgagatgacaggtgttgtggtggatgttggagatggagctacacatgttgttcctgttgcagaaggttatgttattgggagcagtattaagtcaatacctatatcaggaaaagatgttacttacttcatccaacaactcatgagggaaagaggagagcacattccacctgaagattcacttgaagtagcaaggaaagttaaagaaacattttgctacacttgttcagacattgtcaaggagtttaataagcatgacaaagagccagccaaatacattaaacaatggaaaggcattaaaccaaagacaggggcaccatactcatgtgatattggctatgaacgattccttggtcctgaggtcttcttcaatccagagatatacaatagaggctttacaactcctttacctgttgtaatagacaagtgtattcagtctgcaccaattgacacaagacgcgccctctataagaatattgtattgtctggaggatcaaccatgtttaaagatttccacagaaggttacaaagggaggtaaagaagattgtgggtgcacgtgttcatgcatcagaagcgaaatttagtaatgaagtgaaagcacaaccggttgaagttaatgtagtgagccatcctatccagaaacatgcggtatggtttggaggctctgtacttgcatcaacacaggaatttttcatggcttgtcatacaaaagcagaatatgaagaatatggggcaagcatatgcagaacaaatcctgttttcaagggaatgtattgattgatacaagaatctgttatagtggttgtgtacatttctagaggcttgaattcatgtatgaaaaaagtgaattttggatttttttttttttt

SEQ ID NO: 2472 - DNA, 2060 bp, Pinus pinaster
aattgaaactcagtgtttgtgctgacagcagcggggttcgaacttcaaacggatggatgcgcaggaggagagtaattagaagaaagcggagtcagagatcggagcagatccgaggccaaagctctccacatggatgctacatctcgccccgctgttgttattgacaatggcaccgggtatacaaagatgggttttgctggcaatgtagaaccatgcttcattatccctacagttgtggcagtgaacgaatcattcgtaagtcaatctagaggctctggaaaggggaattggttagcacagcatgatgcagctgtcaaggcagatcttgatttctatattggtgaagaggctttgtctcgttctcattctagcaacacatacaatcttagttatcctatacgccatggtcaggtagaaaactgggattccatggagagatattggcaacaatgtatattcaattatttgcgctgcgatcctgaggatcattatttcctcttaactgagagtcctcttactgctccagaaaaccgtgaatatactggagaaataatgtttgaaacatttaatgttccaggactttatatagctgtacaggctgtccttgctattgctgctgggtacacaacctctaagtgtgaaatgactggagtagttgtggatgctggagatgggattacacacattgtacctgtagcagatggatatgtcattggaagtgccattaaatcaatccctattgctggaagagacctcactttatttgttcaacaacttatgcgggaaaggggtgaaaatataccgcctgaagattcattggaagtggcacggagaataaaagaagcttactgctacacctgtgctgatattgttaaggaatttggtaagcatgatcgagacccagaaaaatatataaaacaatggtctggtacgaaacctaagacgggagcacgatattcttgtgatgttggttatgagcggtttctggctccagaggtcttctttaatcctgaaatctactccagtgattatacaacccccttgcctgttgtggtggacaagtgcatccagtcatcgccaattgacaccaggcgagctttgtacaagaatattgtattatcgggagggtcaactatgtttaaggatttccctagaaggttgcaacgtgatattaaaaaaattgtagatgctcgaattggtgcatcagatgctcgacttggtggtgaagtaaaatcacaggcagtagacgtcaatgtagttggtcatccaatccagcggtttgcagtttggtttggaggctctgtacttgcctctacaccagagttttatacggcttgccatacaaaagcagaatatgaggaatacggtccaagcatttgtcgtacaaatcctgtgttcaagggaatgtattaaagcttacgagtataatatggtgtaatgaattttctttgacacgggaagtcttcaattttattttcttgtttccgtgtacataattgttgttttcctcctcacttaattagtgttagcattttttgcagtatgtgctgtacatttgtttaagttggtatcaagaaaggaataatggtcagaataaatcagtcttagctgtattcgaggttttttatgtcaatagtatggaggtgaattatagtctccatccattggaccgacaaataaaattctcatgtcatcagacaacgccaatctgtgtctgatgtagtagttttccccggttagggtggatttgtaatatataggataaagccattctgaacctctatttcgttctagtttataaaggaaaaaatgtagactagttaatttggatcaccgttaaatgttgtggaagagggttggtggcttactgctttcgggtggaacaatgaggaatcatgtctttagtgtgtgaatatcatccccttctacaattagttgtcaatacagtgattggttatagcagattacaaaagcagcatgcttgcctatttgcatgttataaatgcagtgattggatatagcagaatacaaaaggcagcgtggtatatgtgcataccatt

SEQ ID NO: 2473 - DNA, 2110 bp, Cajanus cajan
agagaaagagaaagagaaagagggaagggtacgatgtttgggaaaggaagagaatgatgatcatgttaatgggacctgcatttttcacttgaattcaaatggctgttgcaatcaccaacccttcccatttctcttttcacttgggaccaaactatctgttagtgtcgccatcatattattatttaccttcttcttcccccttgttgcgctcttcacgaccatgatcctctgcctcacactcactctccgattcggatctcactcgcggatccactttccacgttcaccatctttttgcactttctcatggatccctctatgtctcgtccagctgtagtcatcgataatggctccgggtatacgaagatggggtttgctggtaatgttgagccatgttttatattaccgacagttgttgcagttaatgagtcgtttctgaatcaatctaggagcacttccaaaggcaattgggtgacccagcacaatgctggggttatcgcggatcttgatttcttcatcggggatgaggcgcttgctaagtatcgaactagcagcacatacaatctcaactatccgattcagcagggccagattgagaattgggatgccatggagcgattttggcagcagtgcatattcaactatttgaggtgtgatccagaggatcactattttctcttgactgagagtccattgaccgcgcctgagagtcgtgagtatactggggaaatcatgtttgagacttttaacgtccctggactttacattgctgtgaattctgtgcttgctcttgcagctggctacacaacctctaagtgcgagatgacaggagttgtagtggatattggagatggggctgcccatgttgtacccgttgcagatggctatgtaattggtagtagcatcaaatcgattcctatttctggaaaggatgctactctttttgtgcagcagcttatgcgggaaagaggagagaatataccaccagaagactcttttgaagtggcacggaaagtgaaggaaatgcattgctacacctgctctgacattgtgaaggagtttaataagcatgacaaagaaccagccaagtatgtcaaacagtggaaaggcattaaaccaaagacaggagcaccatattcgtgtgatattggctatgaacgatttcttggccctgagattttctttaatcctgagatatacagcagcgactttaccacccctttgccagttataatagacaagtgcattcagtctgcaccaattgacacaagaagatcattatacaagaatatagtgttgtctggaggttcaaccatgttcaaggattttcacaggaggatgcagcgtgatataagaaaaatagtggatgctcgtgtcctttcatctgaagcgcgcttaaatggggagataaaatcgcagccagtggaggtaaatgtagtcagccatcccatccagagatttgcagtttggtttggaggatcagtgcttgcatcaacacctgaattttttgcgtcttgtcatacaaaggaagaatatgacgagtatggagcaagcatttgccgtacaaatcctgttttcaaggggatgtattaaaacaacgacaaattagttgatcatggatgcagtgatttgataagacgattgaatgaatgtctggttattttgatcctcaattcacctcgaagtctttcttctcacctgtattcagagtggcaggcaggaatgtaagatatgtatattaagtgaaaataagcatgttgtttttattccagcggtcttcataggaacttggtttcacacggttaatacagttgccagcagctccagatggtacttaatggatagatagaaatatactttttgtcatttagagtttgatgaagttttgcattttttgtcattcattgttgggactgataattccataaatttctaggtaggaagttgaattcatttttgattgaattgtaataagcaccagtgcaggttagatttttggtttacgtgaatcatatatttttgcatttttgggtacataatgtacaacttgtattctgtttactgatgatcaaagccagaaataattattgtcacgttaactgttcgtgat

SEQ ID NO: 2474 - DNA, 1915 bp, Arabidopsis thaliana
atcggaaaaatctcacacgataaagtaccagtcgacgacggcgactttctctatgatctgaccgtttcgctgaatctcacgtgaatctctgattttccgggaaaatcaattttctctcattgtctctctccctacattgtttctcatagcctacgagaaattacgtggtagcttgtcggaaactcaacttccgttgacggaaggcgcgagaaagaagcaagcttaggttcgatcggaaaattctagggttctctagtgtttaaacggtagagataatcgatctctaatcggatactgttttggatctccattcacaccctctggtgagctgattttgctttagagatcgccggcttagtttctctaatggatccgacttctcgacccgctattgtcatcgacaatggaactgggtatactaaaatgggatttgcgggtaatgtagagccatgttttatcttaccaacagtagttgcagtaaacgagtcgtttttgaatcaatccaagagttcttctaaggcaacttggcaaactcagcacaacgctggagttgctgcggatctcgatttctatattggagatgaagctcttgcgaaatcgcggtctagtagtactcataatcttcattatccaattgagcatggtcaagttgaggattgggatgctatggagagatattggcagcagtgtatatttaactatttgagatgtgatcctgaggatcattattttcttcttactgaaagtcctcttactcctcctgaaagtcgagaatatactggagaaattttgtttgagacttttaatgttcctgggctttacattgctgttaattcagttcttgcacttgctgctggctacacaacatcaaagtgtgagatgacaggggttgtagtagatgttggagatggggcaactcatgttgtacctgttgcagaaggttatgtcatcgggagctgtatcaaatcgattccaattgctggcaaagatgtcaccctctttatccagcaactcatgcgggaaagaggtgagaatataccaccagaagattcattcgatgtagcccgtaaagtgaaggaaatgtactgctacacttgttctgacatcgtaaaggagtttaataaacatgacaaagaaccagcaaagtatattaaacaatggaaaggtgtaaagccaaagactggtgcaccatacacttgcgacgtgggatatgaacgattccttggacccgaggtgttctttaatccagagatatacagcaatgacttcacaactactttaccagctgtgatagacaaatgtattcagtctgcaccaattgacacacgaagagctttatataagaatatagtgttgtccggaggttcaactatgttcaaagatttcggaagaaggttacaaagggacctcaagaagattgttgatgctcgtgttcttgctaataacgctcgtactggtggtgaaattacgtctcaaccggtggaggttaatgtcgtgagccatcctgtccagaggtttgcagtttggtttggaggctctgtgctttcatcaactcctgagtttttcgcgagttgcagaacgaaagaggagtatgaggaatatggagcaagcatatgccgcacgaatccggtgttcaagggaatgtattgaagctgcttcataaataattcaccagcagattctgtgaatgtttgtctgctttactccatttctattactgactttagggttcttgagtacacacagtgtaagctaggcttgatgtagaagtcatattattattcagacaaattaaagaaaaaaagtatgtagaagtttgatttttttttcatattattttctgttaactcaagcattaaattccacagaaaagttccggattatcaatcgtctaattgtcaagttatcatttttt

SEQ ID NO: 2475 - DNA, 1599 bp, Centaurea maculosa
  misc_feature (3)..(3): n is a, c, g, or t
  misc_feature (6)..(6): n is a, c, g, or t
  misc_feature (11)..(11): n is a, c, g, or t
  misc_feature (13)..(16): n is a, c, g, or t
  misc_feature (24)..(25): n is a, c, g, or t
  misc_feature (28)..(28): n is a, c, g, or t
  misc_feature (32)..(33): n is a, c, g, or t
  misc_feature (35)..(35): n is a, c, g, or t
  misc_feature (37)..(37): n is a, c, g, or t
  misc_feature (39)..(39): n is a, c, g, or t
  misc_feature (44)..(44): n is a, c, g, or t
  misc_feature (59)..(61): n is a, c, g, or t
  misc_feature (73)..(73): n is a, c, g, or t
  misc_feature (122)..(122): n is a, c, g, or t
  misc_feature (160)..(160): n is a, c, g, or t
  misc_feature (162)..(162): n is a, c, g, or t
  misc_feature (192)..(192): n is a, c, g, or t
  misc_feature (220)..(220): n is a, c, g, or t
  misc_feature (237)..(237): n is a, c, g, or t
  misc_feature (243)..(243): n is a, c, g, or t
  misc_feature (271)..(271): n is a, c, g, or t
  misc_feature (289)..(289): n is a, c, g, or t
  misc_feature (297)..(297): n is a, c, g, or t
  misc_feature (329)..(329): n is a, c, g, or t
  misc_feature (824)..(824): n is a, c, g, or t
  misc_feature (833)..(833): n is a, c, g, or t
  misc_feature (935)..(935): n is a, c, g, or t
  misc_feature (1149)..(1149): n is a, c, g, or t
atngantcatngnnnntttgattnnacnactnntntntnttttntttaccaatgaaatnnnatggatggagtnataatactcattagcaatctcaatcatcatcatcagttgttggattgcngctttcgcttgcaatcgacgtccacttttcttccaatngntttcccccaacgaccatgatcacttcctcncttaaaccccaactcggatctcacttgnagatccacctttgctcnaataantgctctaacaacaacaacttaatctctngcaatggatccttctacntctcgtcntgctgtagtaatcgacaatggcaccgggtatnctaaaatgggttttgcgggtaacgtggaaccatgttttattgctccgacagtagttgcagttaacgaatcgttcataacccagccgaaccgtagctctaacaagggaagtagcagttggatggcgcaacatagtgcgggtgtaatggctgatcttgatttctttattggggaagaagccttgtcgaaatcaagaactagtagtacttacaatctaacgtacccaataaaacacgggcaggtggaaaattgggatgcgatggaacggttttggcagcagtgtatatttaattatttacgttgtgatccggaggatcattactttttgttgacggagagtccgctgactccaccggaaagccgagagtataccggtgagattatgtttgagacgttcaatgttccggggctttatattgcagtgcagccggtacttgctcttgctgcagggtacacgacatctaagtgtgagatgacaggtgttgtggtagatgtcngagatgganccactcatgtcgtacccgttgcagaaggttatgttattgggagcagcattaagtcaataccgatatcggggagagatgttaccctcttcgtccaacagctcntgcgtgaaagaggggaacatgttccccctgaagattcatttgaaatagctcggaaggttaaggagacttattgctacacatgtgcagacattgtcaaggagtacaataagcatgacaaagaaccatccaagtacattaaacaatggagaggtattaaaccaaagaccggggcaccgtatgcatgtgatgttggctatgaacgatttttaggtcncgagattttcttcaatccagagatatacaataaagatttcacgacccctttacccgctgtaatagacaagtgtattcagtctgcgccaattgacacaagaagggctctatataagaatatagtgttgtctggaggatcaaccatgtttaaagacttccaacgaaggctgcaacgggatacgaagaagattgtcgatgctcgcgttcttgcatctaatatgaaatatactagtaccagtaatgaagtaaaatcgcaaccggttgaagtcaacgtagtcagccatccgatccagagatatgccgtatggtttggaggctctgtactcgcatcaacaccagaatttttcacggcttaccatacgaaagcagagtatgaggaatacggggcaagcatatgccgaacaaatcctgttttcaagggaatgtattaagtcgggttcgtgttcgtatt

SEQ ID NO: 2476 - DNA, 1985 bp, Picea glauca
tcgggggaaaacgagtgaattaaattgaattgaaattcagtctgtgctgacagcagcggggttcgatcttcgaacggatggatgcgcaggaggagagtaattagaagagagtggcgtgagagatcggagcagatctaaggctgaagctctccacatggacgctacatctcgccccgctgttgttattgacaatggcaccggatacacaaagatgggttttgctggcaatgtagaaccatgcttcattatccctacagttgtggcagtgaatgaatcattcgtaagtcaatctagaggctctggaaagggaagctggttagcacagcatgatgcagctgtcaaggcagatcttgatttctttattggtgaagaggctttgtctcgttctcattctagcaacacatacaatcttagttatcctatacgccatggtcaggtagaaaactgggataccatggagagatattggcaacaatgtatattcaattatttgcgctgtgatcccgaggatcactatttcctcttaactgagagtcctcttactgctccagaaaaccgtgaatatactggagaaataatgtttgaaacatttaatgttccaggactttatatagctgtacaggctgtccttgctattgctgctgggtacacaacttctaagtgtgaaatgactggagtagttgtggatgctggagatgggattacacacattgtacctgtagcagatggctatgtcattggaagcgccattaaatcaatccctattgctggaagagacctcactttgtttgttcaacaacttatgcgggaaaggggtgaaaatataccgcctgaggattcattggaagtggcacggagaataaaagaagcttattgctacacctgtgctgatattgttaaggaatttggtaagcatgatcgagaccctgaaaaatatataaaacaatggactggtacgaaacctaagacaggagcacgatattcttgtgatgttggttatgagcgatttctggctccagaggtcttctttaatcctgaaatctactccagtgattacaccacccccctgcctgttgtggtggacaagtgcatccagtcatcgccaattgacaccaggcgagctttgtacaagaatattgtattatcgggagggtcaactatgtttaaggatttccccagaagattgcagcgtgatattaaaaaaattgtagatgctcgaattggtgcatcagatgctcgacttggtggtgaagtaaaatcacaggcagtagacgtcaatgtagttggccatccaatccagcggtttgcagtttggtttggaggttctgtacttgcctctacgccagagttttatacggcttgccatacaaaggaagaatatgaggaatacggcccaagcatttgtcgtacgaatcctgtgttcaagggaatgtattaaagatgatgagtataatctggtgcaatgaattttctatgacataggggaaagtcttcaattttattttcttgtttccgtgtacataatcgtggttttcctcctgtccactttgattagtgttagcatttttcgcagtatctgctgtacatttgcttaagttggttgcaagaaaggaataatggtcggaataaatcagtttttaactgtgttagaagtttttcctgtcaatagtatggaggtgaatgtatagtctccatccattggaccgatgaataaaattcttgtcatcagacaatgccaatctgtgtctgatgtagtaatttcccccctgttctctagaggggtggaatttgtaacatataggataatgccaatctgaacctctatttcgttctagtttaaaaaggcaaaatatagactagttaatttggataagctttaaatgttgtggaagagcaagaaggctatgctaatatattggattcttggacatggggttggtggtgtactggtttcaggtggtacaatgaggattcatgtatttagt

SEQ ID NO: 2477 - DNA, 1836 bp, Arabidopsis lyrata
atcggaaaaatctcccacgatgaagtacaaatcgacgacggcgactttgtctatgatctgagttcgttgaatttcacgggaatctctaattttccgggaaaatcaattctgttttctctccccttacattgtttctcatagcctacgagtgagaaattacgcggtagcttgtcggaaactcaacttccgttgacggaaggtgcgagaaataagcaagcttaggttcgatcggagggttttctagtgttttaagggtagagataatcgatctttgattggatactgttttggatctccagtcgcagatccttcaccctctggtgatctgcttttgctttagagatcgccggcgtagtttctctaatggatccgacttctcgacccgctgttgtcatcgacaatggaaccgggtatactaaaatgggatttgcgggtaatgtagagccatgttttattctaccaacagtagttgcagttaacgagtcgtttttgaatcaatccaagagttcttctaaggcaacttggcaaactcaacacaacgctggagttgctgcggatctcgatttctatatcggagatgaagcccttgcgaaatcgcggtctagtagtactcataatcttcattatccaattgagcatggtcaagttgaggattgggatgctatggaaagatattggcagcagtgtatatttaactatttgagatgtgatccagaggatcactattttcttcttactgaaagtcctcttactcctccggaaagtcgagaatatactggagaaattttgtttgagactttcaatgttcccgggctttacattgctgttaattcagttcttgcacttgctgctgggtacacaacatcaaagtgtgagatgacaggggttgtagtagatgttggagatggggcaactcatgttgtacctgttgcagaaggttatgttattgggagctgtatcaaatcgatcccaattgctggcaaagatgtcaccctctttatccagcaactcatgcgggaaagaggtgagaatataccaccagaagattcattcgatgtagcccgtaaagtgaaggaaatgtactgctacacttgttctgacatcgtaaaggagtttaataaacacgacaaagaaccagcaaagtatattaaacaatggaaaggtgtaaagccaaagacaggtgcaccatacacttgcgacgtgggatatgaacgattccttggacccgaggtattctttaatccagagatatacagcaatgacttcacaactactttaccagctgtgatagacaaatgtattcagtctgcaccaattgacacacgaagagctttatataagaatatagtgttgtccggaggttcaactatgttcaaagatttcggaagaaggttacaaagagatctcaagaagattgttgatgctcgtgttcttgcaaataacgttcgtactggtggtgaaattacgtctcaaccggtggaggttaatgtcgtgagccatccagtccagcggtttgcagtttggtttggaggctcagtcctttcatcaactcctgagtttttcgcgagttgcagaacgaaagaggagtatgaggaatatggagcaggcatatgccgcacaaatccggtgttcaagggaatgtattgaagctgcttcataagtaattcatcagcagatcctgtgaatgtttgttagggttcttgagtacacacagtgtaagctaggtttgatgtagaaggcatattattttcagacaaaaattttttttttttttgctctgttaacttactcaaagttccggattatcaattgtctaattgtgaagttttcattttt

SEQ ID NO: 2478 - DNA, 1745 bp, Eutrema parvulum
gaggcagcttgccggaaactcaaacttccgttgacggggggcgcgacaaaaagaagcaagcgtagattctcttttgatccttgattgtgcaggactgatcgaaattctacggtttacgggttctttgattggacactgtttcggatctcagttcgcagatcattccccttcaccgtctttgattttatgtaatggatccgacttctcgacctgctgttgtcatcgacaatggaaccgggtacactaaaatgggatttgcgggtaatgtagaaccatgttttattcttccaacagtagttgcagctaacgagtcgtttctgagccaacccaagagttctttgaagggaacttgggcagcacagcacaacgctggagttgcggcggatatggatttctttatcggagatgaagctcttacgaaatcacggtctagtagtacctataaccttcattatccgatcgagcatggtcaagttgaggattgggatgctatggaaagatattggcagcagtgtgtattcaactatctgagatgtgatccagaggatcattactttcttctcactgaaagccctcttactcctcctgaaagtcgagaatacactggagagattttgtttgagactttcaatgttcccgggctttacattgctgttaattcagtgcttgcacttgcagctgggtacacaacatcaaagtgtgagatgacaggggttgtagtagatgttggagatggggcgactcatgttgtacctgttgcagaaggttatgttattggaagctgtatcaagtcaattccaattgctggcaaagatgtcaccctctttatccagcaactcatgcgggaaagaggtgagaatataccaccagaagattcattcgatgtagctcgtaaagtgaaggaaatgtactgctacacttgttcagacatcgtaaaggaatttaataaacacgacaaagaaccaggaaagtttattaaacaatggaaaggtgttaagccaaagactggtgcaccctacacatgtgacgtgggatatgaacgattccttggacccgaggttttctttaatccagagatatacagcaatgacttcacaacttctttaccagctgtaatagacaaatgtattcagtctgcaccaattgacacacgaagagctttatataagaatatagtgttgtccggaggttcaactatgttcaaagatttcggaagaaggttacaaagggatctcaaaaagattgttgatgctcgtgtgcttgctaataacgcacgtaccggtggtgaaatcacgtctcaacctgtggaggttaatgtcgtgagccaccctgtccagagatttgcagtttggtttggaggctccgtgctttcatcaactcctgagtttttcgcgagttgcagaacgaaagaggagtatgaggaatgtggagcaagcatatgccgaactaatccggtgttcaaagggatgtattgaaacaaattgaagctgcttcataagtaattcaccagcatcgtcttagatcatgtgaatgtttgtctgaaacactccaattcagttacttgtaactcaagctatttggctgtagagttcatgagttcacgatcagtccgtcagtgtaagctatgcttgatgtagaaaaactcgtattattttcagacaaaaaaaagaaaaaaaagtagtatgtagaagtcaggtttgttttttcttctgtgaaacataccacacgcatcaaattccataaaa

SEQ ID NO: 2479 - DNA, 1963 bp, Pseudotsuga menziesii
gaacttcgaacggatggatgcgcaggagcttgattagaagagagcggagtgaaagatcagagcagatccgaggccgaagctctcctcatggacgctacatctcgccctgctgttgttatcgataatggcaccggatacacaaagatgggttttgctggcaatgtagaaccatgctttattatccctacagttgtggcagtgaatgaatcatttgtaagtcaatctagaggctctggaaagggaagctggttagcacagcatgatgcagctgttaaggcagatcttgatttctttagttggggaagaggctttgtctcgttctcattctagcaatgcatacaatcttagttatcctatacgccatggtcaggtagaaaactgggataccatggagagatattggcaacaatgtatattcaattatttgcgttgtgatccggaggatcactatttcctcttaactgaaagtcctcttactgctccagaaaaccgtgaatatactggagaaataatgtttgaaacatttaacgttccaggactttatatagctgtacaggctgtccttgctattgctgctgggtacacaacttctaagtgtgaaatgactggagtagttgtggatgctggagatgggattacacatattgtacctgtagcagatggctatgtcattggaagtgccatcaaatcaatccctattgctggaagggacctcactttatttgttcaacaacttatgcgggaaaggggtgaaaatataccgcctgaagattcattggaagtggcacggagaataaaagaagcttattgctacacctgtgctgatattgttaaggaatttggtaagcatgatcgagaccctgaaaaatatataaaacaatggactggtacaaaacccaagacaggagcacgatattcttgtgatgttggctatgagcggtttctggctccagaggtcttctttaatcctgagatctactctagtgattacaccacacccttgcctgttgtggtggacaagtgcatccaatcagccccaattgacaccaggcgagctttgtacaagaatattgtattatcgggagggtcaactatgtttaaggatttccctagaagattgcagcgtgatattaaaaaaattgtagatgctcgaattggtgcatcagatgctcgacttggtggtgaagtaaaatcacaggcagtagaagtcaacgtagttggccatccaatccagcggtttgcggtttggtttggaggctctgtacttgcctctacaccagagttttatacggcttgccatacaaaggcagaatacgaagaatacggcccaagcatttgtcgtacgaatcctgtgttcaagggaatgtattaaaagatgatgagtatagtctggtgcaatgaattttctatgacacgggaaagtcttcaattttattttcttgtttccgtgtaaataatcgttgttttcctcctgttcactttgattattgttagcatttttcgcagtatctgctgtatatttgctcgagttggtagcaagaaaggaataatggtcggaataaatcagtttttagctgtgttcgaagtttttactgttaatgatatggaggtgaatgtatagtcgccctccattggaccgattaataaaattctttggtaatcagacaacgccaatctgtctgatgtagtagttttccctccgttctccaggggtggaatttgtaacataaaggataatggcaatctgaaccttttatttctttctagtttaaaaaagcaaatttctaggttagttaattcgatcagcattaaatgttgtggaagaacaatagggctatggaaatatattggattggggtttgccaatcgtgttatccagatggtacaacgaggaatcgtgtttttagtctgtgaaatgtcatcccttctacaattagttgtcaatgcagtgattgaaaatagc

SEQ ID NO: 2480 - DNA, 2454 bp, Theobroma cacao
tcaaatttgacgaagccgtacctccaagcttaaaagaagaaaggcagaaaaaaaacggagtaaaaaaaaaaaaaaaagggaaaggaaggttgtcgtgttgcctttctttctatagtttgattgcaaagaaaagtatcgagagagagagggaatacgattttgatgataaaatgatgatgaaattgatgagaatttttcgtcggttggagttttgaaatgggtttcattattggattgctgagtttggatatcgccaacgacagctattatttcaagaagctactaccgttgaaacgtcgctgctttcggttgggatccaagtttcttgttggggtcgagtcaataccgtcgggggagttcgcttctccttatttgcgcttcttcaagcgcgcttcatgaccatgatcccttccccacaaatctctcttggatctcgctcgcagatccacccccaccgccaccatcacaacaacaagaacaactccctcgcctttgtttttcttcccgatggatcccacttctcgccctgctgtcgtcatcgacaacggcaccgggtacggtttgtcttccattatcgtaactgaaatagttgttgctcacaatctgtatactaagatgggatttgcgggtaatgtagagccgtgttttattcaaccaacagtagtagcagtaaacgagtcgtttctaaatcaatcaagaagttcttcaaaagcaaattggttagctcagtattcagctggggtaatggcagatcttgatttcttcattggagatgaagcactcgcgagatcgcgagctagtaatacttataatcttacctatcctattaggcatggtcaagttgataattgggatgctatggaacgttattggcagcaatgtattttcaattatttacggtgtgatcctgaggatcattactttttgttgactgagagtccgcttactgctcccgagagtcgagagtatactggtgaaattatgtttgagacgtttaatgttccggggctttacattgctgtgaattctgtgcttgctttagcagctgggtacactacatctaagtgtgagatgacaggggtggtagtggatgttggagatggggctacacatgttgtacctgttgcagacggttatgttattggaagcagcattaaatcaataccaattgctggaaaagatgtaactctcttcatacagcagctaatgcgggaaagaggagagaaaattccaccagaggactcatttgaagcagctcggaaagtgaaggagatgtactgctatacttgttctgatattgtcaaggagttcaacaagcatgacaaagaacctgcaaagtacatcaaacaatggagaggtattagaccgaagacaggggcaccatactcctgtgatattggttatgaacgatttttaggcccagaggttttctttagtcctgagatctatagcagtgattttaccactcctttaccagctgtaatagataagtgcattcagtcagcaccaattgacacaagaagagctttgtataagaatatagttttatctggtggatcaaccatgttcaaagacttccacagaaggttgcagcgggatctgaaaaagattgtggatgcccgagttcttgcatctgatgctcggcttggtggggaagtaaaagcacaacctgtggaagttaatgttgtcagtcatcctatccaaagatttgcagtttggtttggaggttctgtacttgcctcaacacctgaattttttgcagcatgtcatacaaaagcagaatatgaggaatacggagcgagcatttgccgcacaaatccttgggtgacttggtatttccacttccatcatgaacatcagttctcatctcttgttccatctgtgctaggaggcaagggtcgtcctcacagcagcccggagaatgcagtcaaatttgttgccagcaggctctgccaacacttaatggaacagatggaatatcaaatagttggaaaaaaatctgctgagctgaattgcatttttagtgttcagcttacttaggatgtgataggggttttacataatttttttttttctcattttggggtgggccagagtagggtggttggttgtgttttggtggcaacggtaaacccggtggtgattcagagtctttgttccaccagtacattctctgttagaaagcaagattggagttctaattgagttagaaatttgtttttgtgatattctgtaattggtattaatcttttgtgtaatattgatcaagatggcaaaatttcacatatggtttcagcacattatgcaacaattatgatgttctttttgtatgggatatattctttccttaattgatttttcaagttactgacattttggcatgctaaacatgaaccttgttttgagagagaggtggtggctgcattcaattgaaattaaaggtgctaaatcttc

SEQ ID NO: 2481 - DNA, 1849 bp, Brassica rapa
gtctgaaagaatctctcacacggtaaagtacaaaccgacgacggcgactttccctatgatctgagtttctgaaccaatggtcttccctcaatttcacgggaatctctgattgttttccgggaaaattaaattatatcttctctctcccctacattgtttaccggagacagagctacgtggcacctcgccggaatctcaaacttccattgtcggagaagaagaagaagaagcaagtttggagattgatccttcgttttgcaaaacagatcgaaactcttaacgtttctactgttactcgttcttcaactggactctgtttcgggcgtaatggatccgacttctcgacccgctgttgtcatcgacaatggaaccgggtatacaaagatgggctttgcgggtaacgtagaaccatgtttcattctcccgacagtagttgcatctaacgagtctttcttaagccagcccaagagttctttaaagggctcttgggcagctcagcacaatgctggagtcgcggcggatatggacttctttataggagacgaggctctcacgaagtcacggtctagtagtacttacaatcttcgttatccgatcgagcatggtcaagttgaggattgggatgctatggaaaggtattggcagcagtgtgtgtttaactatctgaggtgtgatccagaggatcattactttcttctcaccgagagccctctcactcctcctgagagccgagagtacactggggagattctgttcgagacttttaatgttcctgggctttacattgctgttaactcggtgcttgcacttgcagctgggtacactacatcaaagtgtgagatgacaggggttgtagttgatgttggagatggggcgactcgtgttgtgcctgttgcggaaggttatgttattgggagctgtatcaaaacaattccgattgctggcaaagatgtctccctctttatccagcaactcatgcgtgaaagaggtgagaatataccaccggaagattcattcgatgttgcacgtaaagtgaaggaaatgtactgctacacttgttcagacattgttaaggagtttaacaaacacgacaaagaaccaggaaagtatattaaacaatggaaaggtgttaagccaaagactggtgcaccatacacttgtgacgttggatacgaacgattccttggacctgaggtcttctttaatccagagatatacagcaatgactttacaacttctttaccgactgttatagacaaatgtatccagtctgcaccaattgacacacggagagctttatataagaacatagtattgtccggaggctcaactatgttcaaagatttcggaagaaggttacaaagggatctcaaaaagattgttgatgctcgtgttcttgctaacaacgcacgtaccggtggtgaaatcacgtctcaaccagtggaggttaatgtggtgagccaccctgtccaaaagtttgctgtttggtttggaggctctgtgctttcatcaactcctgagttttttgcgagttgcagaacgaaagaggagtatgaggaatgtggagcaagcatatgtcgtactaatccggtgttcaaagggatgtattaaaagtttaaaacaaatagaagctggttctttaaataattcaccagcatatgtgaatgtttgtctgaatgaaacactccattttagatacttgtaactaagctatttggctctttaggtttcattgagtttctcaatcagtgtaagctaggctttatgtagtagaagaattcatattgttctcagacaaagcaaaaaaaaaaaacaaaacaaaaattgtctgtagaaaagaaacaaaaaa

SEQ ID NO: 2482 - DNA, 1678 bp, Brassica napus
ggactgtcggaaagaatctctcacacgctaaaggacaaaccgacgacggcgactttccctatgatctgagtttctgaaccaatggtcttccctgaatttcacgggaatctctgatcgttttccgggaaaattaattatatcttctctctcccctacattgtttaccagagctagagctgctacgtggcagctcgccggaatctcaaacttccattgtcggagaagaagcaagtttggaggttgatccttcgttttacaaaacagatcgaactctttaacgtttctactgctactcgttcttcagctagactctgtttcggatctctgtttcgggcgtaatggatccgacttctcgacccgctgttgtcatcgacaatggaaccgggtatacaaagatgggctttacgggtaatgtagaaccatgtttcattctcccaacggtagttgcatcgaacgagtctttcttgagccagcccaagagttctttaaagggctcttgggcagctcagcacaacgctggagttgctgctgatatggacttctttatcggagacgaagctctcacgaagtcacggtccagtagtacttacaatcttcgttatccgatcgagcatggtcaagttgaggattgggatgctatggaaaggtattggcagcagtgtgtgttcaactatctgaggtgtgatccagaggatcactactttcttctcaccgaaagccctctcactcctcctgagagccgagagtacactggggagattctgttcgagacttttaatgttcctgggctttacattgctgttaactcggtgctggcacttgcagctgggtacacaacatcaaagtgtgagatgacaggggttgtagttgatgttggagatggggcgactcgtgttgtgcctgttgcggaaggttatgttattgggagctgtattagaacaattccaattgcgggcaaagatgtctccctctttatccagcaactcatgcgtgaaagaggtgagaatataccaccagaagattcattcgatgttgcccgtaaagtgaaggaaatgtactgctacacttgctcagacattgttaaggagtttaacaaacacgacaaagaaccaggaaagtatattaaacaatggaaaggtgttaagccaaagactggtgcaccatacacttgtgacgttggatacgaacgattccttggacctgaggtcttctttaatccagagatatacagcaatgattttacaacttctttaccggctgtaatagacaaatgtatccagtctgcaccaattgacacacgacgagctttatataagaacatagtattgtccggaggctcaactatgttcaaagatttcggaagaaggttacaaagggatctcaaaaagattgttgatgcccgtgttcttgctaataacgcacgtaccggtggtgaaatcacgtctcaaccagtggaggttaatgtggtgagccaccctgtccaaaagtttgctgtttggtttggaggctctgtgctttcatcaactcctgagtttttcgcgagctgcagaacgaaagaggagtatgaggaatgtggagcaagcatatgccgtactaatccggtgttcaaagggatgtattaaaaacaaatagaagctggttcattaaataattcaccagcatatgtgaatgtttgtct

SEQ ID NO: 2483 - DNA, 1532 bp, Brassica napus
atcgaaactcttaacgtttctactgttactcgttcttcaactggactctgtttcgggcgtaatggatccgacttctcgacccgctgttgtcatcgacaatggaaccgggtatacaaagatgggctttgcgggtaacgtagaaccatgtttcattctcccaacggtagttgcatctaacgagtctttcttaagccagcccaagagttctttaaagggctcttgggcagctcagcacaacgctggagttgcggcggacatggacttctttataggagacgaggctctcacgaagtcacggtctagtagtacttacaatcttcgttaccccatcgagcatggtcaagtcgaggattgggatgctatggaaaggtattggcagcagtgtgtgtttaactatctgaggtgtgatcctgaggatcattactttcttctcaccgagagtcctctcactcctcctgagagccgagagtacactggggagattctgttcgagacttttaatgttcctgggctttacattgctgttaactcggtgcttgcacttgcagctgggtacactacatcaaagtgtgagatgacaggggttgtagttgatgttggagatggggcgactcgtgttgtgcctgttgcggaaggttatgttattgggagctgtatcaaaacaattccgattgctggcaaagatgtctccctctttatccagcaactcatgcgtgaaagaggtgagaatataccaccggaagattcattcgatgttgcacgtaaagtgaaggaaatgtactgctacacttgttcagacatcgttaaggagtttaacaaacacgacaaagaaccaggaaagtatattaaacaatggaaaggtgttaagccaaagactggtgcaccatacacttgtgacgttggctacgaacgtttccttggacctgaggtcttctttaatccagagatatacagcaatgactttacaacttctttaccgactgttatagacaaatgtatccagtctgcaccaattgacacacggagagctttatataagaacatagtattgtccggaggctcaactatgttcaaagatttcggaagaaggttacaaagggatctcaaaaagattgttgatgctcgtgttcttgctaacaacgcacgtaccggtggtgaaatcacgtctcaaccagtggaggttaatgtggtgagccaccctgtccaaaagtttgctgtttggtttggaggctctgtgctttcatcaactcctgagttttttgcgagttgcagaacgaaagaggagtatgaggaatgtggagcaagcatatgtcgtactaatccggtgttcaaagggatgtattaaaagtttaaaacaaatagaagctggttctttaaataattcaccagcatatgtgaatgtttgtctgaatgaaacactccattttagatacttgtaactaagctatttggctctttaggtttcattgagtttctcaatcagtgtaagctaggctttatgtagtagaagaattcatattgttctcagacaa

SEQ ID NO: 2484 - DNA, 1620 bp, Brassica napus
cggagggcgcgagaaagcaagcctagaggtttctcttttgtatccttgatcgtgcaaggcagatagagatttgagggattacgagtatcaattatcgttcttacgttggacagtttcggatctcacctcgcagatcctccaccgtctccggcgtaatggatccgacttctcgacccgccgttgtcatcgacaacggaaccgggtacacgaaaatgggtttcgcgggtaatgtggaaccgtgtttcattcttccaacggtagttgcagccaacgagtctttcttgagccaacccaagagttctttaaaggggtcttgggcggcacagcacaacgctggagttgcggctgatatggacttctttatcggagacgaagctcttgcgaagtctcggtctagtagcacttataatcttcgttacccgatcgagcatggtcaagttgaggattgggatgctatggaaaggtattggcagcagtgtgtgttcaattacttgagatgtgatcctgaggatcattactttcttctcactgaaagccctcttactcctcctgagagtcgagagtacactggagagattttgtttgagacttttaatgttcctgggctttacattgctgttaactcggtgcttgcacttgctgctgggtacactacatcaaagtgtgagatgacaggggttgtggtggatgttggagatggggcgactcgtgttgtgccggttgcagaaggttatgttattgcgagctgtatcaagtcaataccaattgctggcaaagatgtcaccctctttatccagcaactcatgcgggaaagaggtgagaatataccaccagaagattcattcgatgtagcccgtaaagtgaaggaaatgtactgctacacttgttcagatatcgtaaaggagtataataaacacgacaaagaaccaggaaagtacattaagcaatggaaaggtgttaagccaaagactggtgcaccatacacttgtgatgtgggatatgaacgattccttggacctgaggtcttctttaatccagagatatacagcaatgactttataacttctttaccggctgtaatagacaagtgtatccagtctgcaccaattgacacacgaagagctttgtataagaatatagtattgtccggaggttcaactatgttcaaagatttcggaagaaggttacaaagggatctcaagaagattgttgatgctcgtgttcttgctaataacgcacgtactggtggtgaaatcacgtctcaacctgtcgaggttaatgttgtgagccaccctgtccagaagtttgcagtttggtttggaggctccgtgctttcatcaacccctgagtttttcgcgagttgcagaacgaaagaggagtatgaggaatgtggagcaagcatatgccgaactaatccggtgttcaaggggatgtattgaaatcaattgaagctgcgtcagcatcatcttagatcatgttaatgtttgtttgaaacactattttagttacttgcaactcaagatatttgtctttgtctttagggttcatgagttcacagtcgagtgaaagctagggttgattattttcagacaaaataaaagaataaagtatgtagaggcc

SEQ ID NO: 2485 - DNA, 1723 bp, Medicago truncatula
gcaccaggtcatccacaatggctccgggtatacaaaaatgggctttgctggtaatgttgaaccttgttttattgttccgagtgtggttgctgattaacgagtcgtttttgaatcaatcgagaagttcttctaaaggaaattggattgcacaacataatgctggggttatggctgatcttgatttctttattggagatgacgcgctttctaagtctcgatctagtagtacttataatcttacctacccgattaagcatggtcaagttgaaaattgggatgccatggagcggttctggcagcactgtatattcaattatttgaggtgtgatcctgaggatcattattttcttttgaccgacagtccgttgacggcacctgaaagtcgtgagtataccggggaaattatgtttgagacttttaatgtgcctggactttacattgctgtgaattctgtgctcgctctcgctgctggctacactacgtctaagtgtgagatgacaggagtcgtagttgatattggagatggggctacacatgttgtcccagttgcggatggttacgttattggaagtagcattaaatcagttcctattgctggaaaggatgttactcttttcgtccagcagctaatgcgggaaagaggagagaatataccaccagaagactcattcgaagtggctcggaaagtgaaggaaatgcattgctacacctgctctgacatagttaaggaatataataagcatgacaaagaaccagccaagtatatcaagcaatggagaggcgttaaaccaaagactggggctccatattcttgtgatattggctatgaacgctttcttggccctgaggttttctttaatcctgagatatatagcagcgacttcaccactcctttgccagttgtaatagacaagtgcattcagtctgcgccaattgacacaaggagatcattatataagaatatagtgttgtcaggaggatcaacaatgttcaaggattttcacaggagattacaacgtgatataaagaaaatagtggatgctcgtgtccttgcagccgaagcgcgcctaaatggagagataaaatcacatccagtggaggtcaatgtactcagccatcctatccaaagatttgcggtttggtttggtggatcagtgcttgcatcaacacctgaattttttacggcttgtcatacaaaggcagaatacgaagaatatggagcaagcatttgccgcacaaatcctgtttttaaggggatgtattaaagcaaagatgaattagctgatcacggatgcagtctcttctcttgatataaaaaaagaaattatggtctggttattttgatcctcgtttcatctcacggtctctcttccaatcttccagggtagcagaagtgtaaaatatgtatattcagtgaaaaaatgtttttccagttttaattcttgcagttcttcctaggaagccaatttcaagtcatcatgtggttaatatggttgccagcaggtccagatggtacctattggtagatagaatttgatttttgacaaaatgttggctgagctgaatggcaatttttagtgttcagcttagagtttggtaatgttctgtattttttcatttgttgttgggactgatataacattaagtacttttctaggcaggagattaaattcgttgggattgaattgtaataataataagcactagtgcaagttttgtgttt

SEQ ID NO: 2486 - DNA, 1732 bp, Brassica rapa
cattgtcttaaccacgtggcaccttgtcggaaactcaacttctgttgacggagggcgcgagaataagaagcaagccagaggtttctcttttgatccttgatcgtgcaaggcagatcgagatttgagggattacgagtatcaattatcgttcttccgttggacactgtttcggatctcagctcgcagatcctccaccgtctccggcgtaatggatccgacttctcgacccgccgttgtcatcgacaacggaactgggtacacgaaaatgggtttcgcgggtaatgtggaaccgtgtttcattctcccatcggtagtcgcagccaacgagtctttcttgagccaacccaagagttctttaaagggaacttgggcggcacagcacaacgctggagttgcggctgatatggacttctttatcggagacgaagctcttgcgaagtctcggtctagtagcacttataatcttcgttacccgatcgagcatggtcaagttgaggattgggatgctatggaaaggtattggcagcagtgtgtgttcaattacttgagatgtgatcctgaggatcattactttcttctcactgaaagccctcttactcctcctgagagtcgagagtacactggagagattttgttcgagacttttaatgttcctgggctttacattgctgttaactcggtgcttgcacttgcagctgggtatacaacatcaaagtgtgagatgacaggggttgtggtggatgttggagatggggcgactcgtgttgtgcctgttgcagaaggttatgttattgcgagctgtatcaagtcaataccaattgctggcaaagatgtcaccctctttatccagcaactcatgcgggaaagaggtgagaatataccaccagaagattcattcgatgtagcccgtaaagtgaaggaaatgtactgctacacttgttcagatatcgtaaaggagtataataaacacgacaaagaaccaggaaagtacattaagcaatggaaaggtgttaagccaaagactggtgcaccatacacttgtgatgtgggatatgaacgattccttggacctgaggtcttctttaatccagagatatacagcaatgactttataacttctttaccggctgtaatagacaagtgtatccagtctgcaccaattgacacacgaagagctttgtataagaatatagtattgtccggaggttcaactatgttcaaagatttcggaagaaggttacaaagggatctcaagaagattgttgatgctcgtgttcttgctaataacgcacgtactggtggtgaaatcacgtctcaacctgtcgaggttaatgtcgtgagccaccctgtccagaagtttgcagtttggtttggaggctccgtgctttcatcaacccctgagtttttcgcgagttgcagaacgaaagaggagtatgaggaatgtggagcaagcatatgccgaactaatccggtgttcaaggggatgtattgaaatcaattgaagctgcgtcagcatcatcttagatcatgttaatgtttgtttgaaacactattttagttacttgcaactcaagatatttgtctttgtctttagggttcatgagttcacagtcgagtgaaagctagggttgattattttcagacaaaataaaagaataaagtatgtagaggtcggctttgtttcttctttgaaacgtaccacacgcatcaaatcccattaaagtgaatgcac

SEQ ID NO: 2487 - DNA, 730 bp, Saccharum officinarum
cagcagcagactgatctacactactggagtagagcttagtagctcaagagcagaacgcattatcaccaatgaggccgctccttgtgcttgctctgatttttgtgattgccggtgtggcgcatggcgcgggggagtgcgggagagcctccgctgacagggtggcgctaaggctggcgccatgcgtctcggccgccgacgacccgcagtcgacgccgaccagcagctgctgctcggccgtgcacgccatcgggcagagccccagctgcctgtgcgccgtcatgctgtccggcaccgccagggctgccgggatcaagccggaggtcgccattaccatccccaagcgctgcaacatggccgatcgccccgtcggctacaagtgcggagattacacgctgccctgacgacatccgtcagcgagaccgtgcgagtgattatgacaagctgatgaacgcgccatgcaaggcgttgtgttggaaaaatcgaatccgctagaataaataagtacacgtggacgacgggcttttgctgtatcactactggactttgcttgtgttgtatgtcaaaaataataaatatgttccgtttctctaatataagaaaaatatgtattgttggtccacaaaaaatattaactaaaatcttacgttatatgttatcagtcactttcattaaaaaaggggcgccttcttaaagaatcacaattattttcgcgtgttggcgaaggaataga

SEQ ID NO: 2488 - DNA, 656 bp, Zea mays
agaagcaccagccttgtaggagaggccagcagcagcatccttaccagcacacagtggagctagctagctagtagagaggtcaatcaccaatggcgaggcagctcgttgtgcttgctctgcttttcgtgatcgccggtgtggcgcatggcgcgggggagtgcgggagagcctccgccgacagggtggcgctaaggatggcgccatgcatctcggctgccgacgacccgcagtccacgccgaccagcagctgctgctccgctgtgcacaccatcgggcagagccccagctgcctgtgcgccgtcatgctgtccggcaccgccagggctgccgggatcaagccggaggtcgccattaccatccccaagcgctgcaacatggccgaccgccccgtcggctacaagtgcggagattacacgctgccctagctgatgaagacgtcgtcaacgagaccgtgcgagtgaacctgcatgaacgaatgccattatgccatgcaactatgttgcgttgcgttgttggaataataatcgaatccgctagaataaatatgtacgtgcacgacggcctcttgcttgtatcactggactttgcttgtgtgttatacgtcaaatatgttccgtttctctcatataagaaaattatgcaatgcttgttattaa

SEQ ID NO: 2489 - DNA, 1254 bp, Panicum virgatum
agaacaggcgcgcgcgtccacaaatgtgtttcagatcagccagtgatttaattatgtgccgacataccttgtggcccgttgccatcattagttcgccgctcaagtttccactccattgagaagcgcttgatccggcggccggttgatggcctgatccacgtacagtgctgtccaatgcagaaggccactagccgaccggttttgcagccaaaccaagtaagcttcacaattcaaagtggagacaccactccactccgctagtgctggcacgatgcaatcagtgacttgcaggtgctcactccatttagtcctgaacggtcatggccatagaatgtacctcctcatcagtactagtatataagaagcaccagccatgttggagagggcggcagcagcagcagagttagcataaccaaactgaatttgcactagtggttatttgttaactcgatagaaatcatcatcatcatcatcatcatcaatgaggccgctcgttgtgcttggcctggtcctcgtgctcgcagcaggggtcgcgctggacggcgtcgacggcgccggggagtgcgggagggcctccgctgaccgagtggcgctgcggctggcgccgtgcgtctcggcggccgacgacccgcagtcgacgccgacgagcagctgctgctcggccgtgcacaccatcgggcagagccccagctgcctctgcgccgtcatgctgtccggcaccgccagggccgccgggatcaagccggaggtcgccattaccatccccaagcgctgcaacatggccgatcgccccgtcggctacaagtgcggagactacacgctgccctgacgacctcgtgagtgaggccaccgcgctggtaattaataaagagatggacgccaaggaaaggctttgtgttggaataatcgagtctgcgcgaaccatgaacgtggacgaggggctctagccctatcacactggactgtgcttgtatcgtaattgtgttccacttcgtctaaaattaataagaatgaatgtgttgcttatcaagcccattacaggccatagccgggggaaaatggtgttatgttgaagaggcccatgaaacccaaaaatatttcttgtccatttcagttgctttaatgttgtgtacagttactgcgtgcatagtcgtgaggcctcatatagcgtgaaacacacatagacacttatatacacgcacgtatacttacctctatgaatacacgcacataatcttacctatcactaccaga

SEQ ID NO: 2490 - DNA, 654 bp, Setaria italica
gcagcagcagcacaaagtgtaatcaaactgagttgcactatgaggccgctcgttgtgctcggtctggtccttgtggtcgccggggtagcgctggagggcgccgccgccgccggggagtgcgggagggcctccgctgacagagtggcgctgcggctggcgccgtgcatctcggcggccgacgacccgcagtcgacgccgacgagcagctgctgctcggccgtgcacaccatcgggcagagccccagctgcctctgcgccgtcatgctgtcccgcaccgccagtgccgccgggatcaagccggaggtcgccattaccatcccaaagcgctgcaacatggccgatcgccccgtcggctacaagtgcggagactacacgctgccctgacgacctcatgactgatgccgcgctagtgatcaacgagatggatgccacggaaggctttgtgtgttggaataattgagtccgcgcgaaccattaacgtggacgaggggctgtagctcccaatcacactgaagtgtgcatgtcgtgtatgttgttgtcaaaataatctattacttcgtatacgggcttaaaatgaggacctgacgacattgcaaatttacggtcgaccgttaataagcaaaagtggcgctcgatctcggaccgcatttttcc

SEQ ID NO: 2491 - DNA, 982 bp, Panicum virgatum
acagtgctgtccaatgcagaaggccactagccgaccggtttaatttgcagccaactcaagcacccttcacaattcaaagtggagacaccactcccccgctagtgctggcacgatgcaatcagtggctcccaggtgctcactccatttagtcctcaacggccatagaatgtacatgtaccgcctcatcagtactagtatataagaagcaccagccatgttggagagggcagcagcagcatctagctagcataatcaaactgagtttgcattagtggttaactcgagagaaaatcatcaacaatgacaatgaggccgctcgttgtgctcggtctggtccttgtggtcgcagcaggggtggcgctggacggcgccgacggcgccggggagtgcgggagggcctccgccgaccgggtggcgctgcggctggcgccgtgcatctcggcggccgacgacccgcagtcgacgccgacgagcagctgctgctcggccgtgcacgccatcgggcagagccccagctgcctctgcgccgtcatgctgtccggcaccgccagggccgccgggatcaagccggaggtcgccattaccatcccgaagcgctgcaacatggccgatcgccccgtcggctacaagtgcgagactacacgctgccctgacgacctcgtgagagaggccgccgcgctggtgattatgaaagagatggacgccaaggaaggctttgtgttggaataatcgagtccgcgcgaaccatgaacgtggacgaggggctccagccctatcacactgtgactgtgtgtgcttctcgtactagtactgtgtgttcaacttcgtctaaaattaataagaatggacgtgttgcttgtcaagaccattattggcccattaataaaaatggtgttgggttgaagaggcccatgaaacccaaaaatatttcttgtttatttcagttgcttcaataatattgtgtgcaattactgcgtgcaaa

SEQ ID NO: 2492 - DNA, 1996 bp, Pennisetum glaucum
aagaactacctgcaggaccagctgctggggttcgcgctcgtgccgctcccggaggtcgtctccgccgacggcggcacgctcgccagggagttcccgctcaccaccagcgacctgttccagacgccctcggggttcctgcagctcgagctttcctacatcggggtcgtgccggaggtcgtgcccatctcgccgacgcccaagccggcgctggccgacccggaggaggagccggagagtaacgccggcgccggcgccgggaacgggaaggagtacgagaagatcgagttccccgacctgaatctcgtcgaggaaaaccagatcatggtgtccgagtacaccgggctgccgtgcgcggccgtggaggcgcagagctccgagagcctgctgacttcggatcacgaggacggcgccacgaccatgagtcacgaagccggcgtgcgcctcgtggagagcttctcgacggaccacagcaccgctgacgctgactcggtgggcggcttccggagcgacgacacgccggtcagcagcgtgtccaccacggagtcccccggcgccgcggcggtgccggccactcctcagtccaactccagctcggaaccgtccgggaacgcccactcgtcggccgaggctaaggagaaggcggcgcccgaggccactgacgcggaggtcgactcgtcccgcaccgtccaggagagccccgcggcgaactcgcccggcgccgcgtcggaggccgcggtggacaagccggtgatcaccgtcaacatcgagcaggaggtgaaggtcgacgggaaccagatcatggacatgtacatgaagagcatgcagcagttcacggactcgctggccaagatgaagctccccgccttggatttggacaacggcagcagcgagaagagcagccctgccaccgccgcctccgaggtagactccagtggcgccgtctcgagcgcggcgaagaagccggcggccggcggccagcaggagaagccgtctcccaaggtgttctacggcagccgggccttcttctgatctccaccggaagcactggccgcacccaacaacgaagcaaggagatggcatttgcagtcgtctcagctgaaaatcttactagcgcagaggaataacaccaccttctcatgctctcttgttctaggtttgtcagatcgggaattagttgctctgccttaatgtatcagtcagtacttgatgaaaaatggtttggtttctctgtttttgtaattttcttgggccacctcttacgccgtttcatgaaaacaccctcaagttttgaaggattgctaagagggtgtcaatattacaacaccctaagtttatcaaaaataaattattacacaaccactactccgataatttattgaagccctctcaaactttacataactacatttatttaagcccgtacatatgaagtattaaatttatttttaattttacaacatacacgacgacatgcacagtacagtgtgatagggcctagtgcccttcgtccacgttaatggttcgcgcggactcgattattccaaacacaagatttccgtggcatccattcatctcgttgatcaccagcgaggtcgtcagggcagcgtgtattctccgcacttgtagccgacggggcgatcggccatgttgcagcgcttggggatggtgatggcgacctccggtttgatcccggcggccctggcggtgccggacagcatgacggcgcataggcagctggggctctgcccgatggtgtgcacggccgagcagcagctgctcgtcggcgtcgactgcgggtcgtcggccgccgagatgcacggcgccagccgcagcgccaccctgtcggcggaggccctcccgcactccccggcggccgcggcgccctccagcgcgacaccggcggcgaccacgaggaccagaccgagcacgacgagcggcctcattgtgtgcaactcagttttgatcacacttcgtgctgctgctgctagcttcttct

SEQ ID NO: 2493 - DNA, 694 bp, Cynodon dactylon
ccgggggtgtaccaaccgaattaccgaatcgcactttatagtggttaaagcaagagaagaagccgtcaatgaggtcgctcgtcgtgcttgctctgttcgccctgcttgccgggatcgcgctggaggttgcggacggcgccggcgagtgcggcagggcctctgcggacagggtggcgctgcgcctggcgccgtgcatctcggctgctgacgacccgcagtcaacgccgaccagcagctgctgcgccgcggtgcacacaatcgggcagagccccagctgcctctgtgccgttatgctgtccggcaccgccagggctggcgggatcaaaccggaagctgccattaccatccccaagcgttgcaacatggcggatcgccccatcggctacaaatgcggagagtacaccctgccctgatgatgatctcgtgagaaaaaggctgtgccaatgcacagtaatcaacgacaaaaggaatgttatgcgctttctgttggaataacaagtcccgcgcgtgcaagtgatgcttccactcacatgtgggcctccactcacatatatggaatgtctaagtatgcttgtggtgtatgtgaaaaatgtgtctcctttaatctaagacaagaataacagtgtgttgttttgtgaaggataaagttcacttagcgtctccgaactataaaaccgtttgtttgatggaaaaa

SEQ ID NO: 2494 - DNA, 592 bp, Eragrostis curvula
ttgcactagtagttgaagcaagatcaaagatgaggtcgttcgtggtggttgctctggtccttgcgatcgccggtgtcgccctgcgtggcgcggacgccgccggcgagtgcggcagggcctccgccgacaggatggcgctgcggctggcgccgtgcatctcggccgccgacgacccgcagtcgacgccgagcagcagctgctgctcggcggtgcacaccatcgggcagagccccagctgcctgtgcgccgtgatgctgtccggcaccgccaaggccgccgggatcaagccggaggtcgccattaccatcccccagcgctgcaacgtggcggaccgccccgtcggctacaaatgcggagattacacgctgccttgacgacctcgctcgtgagtaagcgatgtgccggggaataaccaaatgaagaatgccatggacggctttgtgttggaataataagcgagtcccgcgcgtgcaacagaagatgcgggtctctagccgcatcagtggaccgtgtctatgtgcttctggtgtgtgtgaaaaaaaaaagtgttgttgtgtctaagaaccataaataaacttgtgtttggtttatg

SEQ ID NO: 2495 - DNA, 846 bp, Oryza sativa
tttatcggtttttgatttatcaacggattccatgaaatttgcgaattttgacccggtatcaggatcgtgaaccctggacactagtatataacaagcaccacacccttgtatacgagtaagcacagcagcaaaactaaactgatcatacacacaaattaagttgtgatcatccgagcaaaagcaaagcaagagaacggtagctagctagttgacacaatgagggcgggcaggttggtgatcctcgtggcggtggcggtggtggtggtggtcgccggcggcggggcggcggagggcgccggcgagtgcgggagggcgtccgccgaccgggtggcgctgcggctggcgccgtgcgtgtcggcggcggacgacccgcagtcggcgccgtcgagcagctgctgctcggcggtgcacaccatcgggcagagccccagctgcctgtgcgccgtgatgctgtccaacacggccagggtcgccgggatcaagccggaggtcgccatcaccatccccaagcgctgcaacatggccgaccgccccgtcggctacaagtgcggagattacacgctgccttgacccttgaggccttgagggggactgtggcacttatcgatatcaagacgtacggatgccgtgggagcttaggctttgtgtcggaataagcgagagtccttcatgttcggggctctgccacttatatggactatgcacgtggtggttgtgaaaatatgtatcctgtgtttcgtctgagtaaactgttaaatataataagaatatacaaaagcttgcttgacaaattaatccgggacgtaaataaattgaccatgcaattaagtgcgtgcgtatatacac

SEQ ID NO: 2496 - DNA, 2678 bp, Hordeum vulgare
gacaaaatcattattaaaacaacgctacgaagaacgcctctaaaccatcacgctacgcccgttacgaactatgcaaaactcaatctttttaatacctattctattctcagcagctcttagtttgagctgcgatggattaactgaagtttgtgcttcggtctcttgtccttcagcacctactttcacagtcaattcctattcttattcaccaagcgacttcaaccttatcagttttggatcaatcaccattaatcacggagatgtcgaaggaagagttgcagttagaaataacttcaacgctcctagtcaaggagtttccatcggttattctcttcctagtacttcttctccttcatactctcttgttgctggaggagacgttaactgggttaatggagagatttatccttctggtgccggtctttacgtcggaggagccttcactggtgctgctactttgagagaaaaagttgctcctggaggaggatgcggaacaactgctggatgcctcaatggtcaattcgatgctctctcccaatacgccacaagcctttctaatgctcttgctggattatctgcaactgcttctgccgccctcaattatcaacaattagtcatcaactgtactggatcagctaatctttatattgttgctattggagctagcgtcttcagcggagtcaacgattttaccacaaccggatgtgatgccaacgctgttttcttgttcaacatcatgggatcagacaaagtcactttcaaaggaaatactttctcttctcacctcgccgtttacaaccttcccatggctacatcggtcgagattgatacttttgtcttcggagacattctcgctcctgctggaactttgggaatgagcgtatctgcaggaaccgtcaccggacttgttatcgctaatgatgtttctgaactcatccaagtcaacattcctatgtgccctaaccaaaacaccacttcgactggagtttcaactgggtctgataacaccacttctggatctgccacttctaccggcactggatctgacaacaacaccacttcaactgaatctgctagctctacgtccactaatggagttccttctgcttcatctacctcaacttcaggagttcccccttcttcttccactggatctagtaccaccggaaacggaaacggaaacgccatctgtaccttcttggatgatcaagctgcttgccccaacatcaataacgctttgaacggagacttcacctttgttttcggacgatatgacgttattgtcttcggtgatttagctgcctcttctggagatatcgaaggaagaacttttgcttccggaaatgtcgatttttccaacggaatgttctcccttggattaagagccgccacttctaacagtgactactccctcattgccggaggactcaactttgcaagcggatctatcagccgaggaagagctttcgtcgctggatcttctagcgtcgctaactacctccaacgatacatcgatggaccttgcaacgacggttcatgcctagattccatcagaactcaaggacaaagctgctacaacagcctctccgacacctttgccggacgatctaacgctgctatttctttgagcgaatcccgagcctctcttacttgcaattcaagctctgactctgtctactacatcaacgttgacagctctcacatcagcgctgcatcttggggatcttcatctaactgcaacagcggagctatctacgttttcaacattgaaggatctgacgacttcactatctctggagcagctttccccaccgataatgttgtatacaacgtccgaggatcaagaactgttactatcgcaacttctgtccacggaaacattttggctcctcaagctaacatcgttatgaactccggacttattgttggaaaacttgttgctgctagagccactgttgttcaagtcaacattattcccgaatgcgtcgacaacggaaacagtggatctaactctgatgttgaggcagcagcagcgagcgatccgcactagtcactgcaagaaccaccacaggtgagtgatccatcggcggagcaagggaagaagcacacagggagagatggcaatgaggccgctcgtcgtcctggccctggcggtggcgctggccggcgtggcgctgggtgagggggccggcgagtgcgggaggtcgtcccccgaccggatggccctgcgcatggccccgtgcatctcggcggcggacgagccggactcggcgccctccagcagctgctgctcggcggtgcacaccatcggcaagagccccagctgcctgtgcgccgtcatgctgtccggcaccgccaagatggccgggatcaagcccgaggtcgccatcaccatccccaagcgctgcaacatggccgaccgccccgtcggctacaagtgcggagattacacgctgccttgagtggcccagctctggtgccgatgaagatgaatgctgtggaaggcgtacgtcgtcgtgtgggaataagcgagtggtgcatgtaccacttaagttggggcactagtgactccatggaggtgccacatcatgtgatgtgtgcttgtggaaatatgtttctgtaagcgtgtaaaatgtttcgtctgtgttaacgtgaacaaacgtctccgtgtgatctct

SEQ ID NO: 2497 - DNA, 957 bp, Zea mays
agggtttcactcttccgtatataatcctgcccacaacgccgtctcctaaaccttagccgcgcggacgcccaccagcagctgcccccttgctgtcgccgcctctccgcgcgaccgatctaccgccgccgccaccatgtcgctgatcgccggcgaggacttccaacatattctgcgtctgctgaacaccaacgtggatgggaagcagaagatcatgttcgccatgacctccataaagggtgttgggcgccgcttctccaacatcgtctgcaagaaggccgacatcgacatgaacaagagggccggtgagctgacgcctgaagagctggagcgcctgatgacggtcgtggcgaaccctaggcagttcaaggtgccggactggttcctcaacaggaagaaggattacaaggacggaaggttctcacaggtcgtctccaacgccctcgacatgaagctcagggacgacctcgagaggctcaagaagatcaggaaccaccgtggtctgcgtcactactggggcctccgtgtccgtggccagcacaccaagaccactggcaggcgtggaaaaactgttggtgtctccaagaagcgataagctacatatctatcgacaaatctcagatgtactagtgttggttcatgttcaaactgtcttgatgaagggtttctgttgggacagtttcctgaaattatgttttgccctaggataatcttgcagttatggaaccttattatattgtatcctgcaatttgtttttttgcaacttataagagtaattttatttgatgagtcttatgctgatagtctctctatgctgttggtattgttaaggctatctttagcggagcttatatatggacgtgcaaaacacttttttttgttatgtagactctattgtttatagagtagagtttgaaatattgagtgagataaggattgaggttgggattgttggagat

SEQ ID NO: 2498 - DNA, 924 bp, Cenchrus ciliaris
  misc_feature (37)..(37): n is a, c, g, or t
  misc_feature (85)..(85): n is a, c, g, or t
  misc_feature (94)..(94): n is a, c, g, or t
  misc_feature (164)..(164): n is a, c, g, or t
  misc_feature (191)..(191): n is a, c, g, or t
  misc_feature (254)..(254): n is a, c, g, or t
  misc_feature (392)..(392): n is a, c, g, or t
  misc_feature (616)..(616): n is a, c, g, or t
  misc_feature (654)..(654): n is a, c, g, or t
cccgagaggagaatccctacccccgcgcagccgcagncccctcgccgccgccgccgcttcctcgaactccggcgcgtgcccgagntccgccagncgctgccgccatgtcgctgatcgcgggggaggacttccagcacatcctgcgtctgctcaacaccaacgtngatggcaagcagaagatcatgttcgcnctcacctccatcaagggtgtcggccgccgcttctccaacatcgtctgcaagaaggccgacatngacatgaacaagcgggctggtgagctgaccccagaggagcttgagcgcctcatgaccgtggttgccaacccccgccagttcaaggtccctgactggttcctcaacaggaagaaggactacaaggatggtaggttctcncaggttgtttccaacgcccttgacatgaagctaagggatgaccttgagaggcttaagaagatcaggaaccaccgtggtctgcgtcactactggggcctgcgtgtccgcggacagcacaccaagaccaccggaaggcgtggaaagactgttggtgtgtcaaagaagagataaaccgcttgtcatcatattggcctagcttgtgtcttgagtatccgaacctttgnactgtgttttactggaggatgtttatccctaggatatntaatgagctattttggttcatgaaatacttgtagcgactcttttggtggctgtgttccaagcgcggcttgaattcagtgttctgtgaaacggtaaagttttgcctatttggaaaatgatgtgctttctcttcgtgtggtctaccattgttgacgttctgttgtcttgttccaagcttccaattttgttgaggatatcaattttttctcttgatcaaagtttatgtttgtaaaaccttttgtgatatgaacctgtcaaacaggcatttgta

SEQ ID NO: 2499 - DNA, 1438 bp, Zea mays
agggtttcactcttcatatataaaccagtccacaactccccccctaaaacttagccgcgtggacgcacaccagcacctgccctcctcgccgtcgccgcctccctccgcgcgaccgatctaccctccgccgccaccatgtcgctgatcgccggggaggacttccagcatatcctgcgtttgctgaacaccaacgtggatgggaagcagaagatcatgttcgccatgacctcaatcaagggtgtcgggcgccgcttctccaacatcgtctgcaagaaggccgacatcgacatgaacaagagggccggcgagctgacgcctgatgagctggagcgcctgatgacggtcgtggccaaccctaggcagttcaaggtgccggactggttcctcaacaggaagaaggattacaaggacggcaggttctcgcaggtcgtctccaacgcccttgatatgaagctcagggacgaccttgagaggctcaagaagatcaggaaccaccgtggtctgcgtcactactggggcctccgcgtccgtggccagcacaccaagactactggcaggcgtggaaagaccgttggtgtctccaagaagcgatgagctctatatcaccctgagaaatcttggccgcactaccgtgtcggtttgtgtccaaacagtcctgatgaagggtttctgtttaggcagtttcctgaaatggtgttttgctttaggacaatctcgcggttattgaaccttaatatatcgtgtccctgggatgtgtttttttgacactttataagtaatttcatttggatgagacttaattctggtttgactcgttacattgttaactcgactccgagaggagtgccttcccagtgcagttcattcacattgcctgttgtggaggataaggttcattttcatcgtttcacgtttgcggtattttgcgttaaattacacctgtgttgtacaagtttggttcagtgaagctgctgatttatttgctttgctcggtgttgtgaaacctcctcgcattaacctatagtattgcaacgccataacctatagtattgattgatttacactatgggcaaagctgtatgaaacatcctcgcgtctgactacaggaaaggcagtatggaacatgcagttgtgcttgcggattttgatcatgaaaacttggacctctctgcacgccagtagctcaagcatgcaggaatgcaattcatcgacaagttttcgattttcacccgtgtctttaaccgaaaccagcgttagacgcgagcatgcctctgatttccactcctcgctgtccatgggctgctttgaaatttgtatgctgtaaattataaatcttctccatgtgagaagctgaaatatgtatgcagtaaattcaaaatcaatcaaacagttgtgtagtcggtgcggatgttggagtccggccgattgcccgttggtg

SEQ ID NO: 2500 - DNA, 752 bp, Pennisetum glaucum
acatggcgcagccgcagcctctcgccgccgccgcttcctctaactccggcgcgtgcccgagatccgccagccgctgccgccatgtcgctgatcgcgggggaggacttccagcacatcctgcgtctgctcaacaccaacgttgatggcaagcagaagatcatgttcgcgctcacctccatcaagggtgtcggccgccgcttctccaacatcgtctgcaagaaggccgacatcgacatgaacaagcgggctggtgagctgaccccagaggagcttgagcgcctcatgactgtcgttgccaacccccgccagttcaaggtccccgactggttccttaacaggaagaaggactacaaggatggtagattctcccaggtcgtttccaacgcccttgacatgaagctcagggatgaccttgagaggctcaagaagatcaggaaccaccgtggtctgcgtcactactggggcctgcgtgtccgcggacagcacaccaagaccaccggaaggcgtggaaagactgttggtgtgtcgaagaagagataaaccccttgtcataattggcctagcttgtgtcttgagtatccgatccattgcactctgttttactggaggatgtttatcccttaggatatctgatgagctatttgggttcctaaaatacttgtagtgactcttttgttggtggctgtgttccaagtgcggattgaattcagtgttctttgaaaccgcaaagttttgtctgttgaaaaaattct

SEQ ID NO: 2501 - DNA, 856 bp, Pennisetum glaucum
ccgagaggtgaaacccttccccgtgcagccgcaccccctcgccgccgccgcttcctcgaactccggcgcgcccccgagctgcgccagccgctgccgccatgtcgctgatcgcgggggaggacttccagcacatcctgcgtctgctcaacaccaacgtggatggcaagcagaagatcatgttcgcgctcacctcaatcaagggtgtcggccgccgcttctccaacatcgtctgcaagaaggccgacattgacatgaacaagcgggctggtgagctgaccccagaggagcttgagcgcctcatgactgtggttgccaacccccgccagttcaaggttcctgactggttcctcaacaggaagaaggactacaaggatggtaggttctcccaggttgtttccaacgcccttgacatgaagctcagggatgaccttgagaggctcaagaagatcaggaaccaccgtgggctgcgtcactactggggtctgcgtgtccgtggacagcacaccaagactaccggaaggcgtggaaagactgtcggtgtgtcgaagaagagataaatcccatgccgtggcgcactttattgtcctagcttgcgtctcaagtgtccaaagctttgtggtgtgctctactgatgtttatccctaggatagatgacgagctgttttggttcatgaaatacttgtagtgactcttttggtgcctgtgttcctatcgtgtattgaattcaatgttatgtgaaacggtaaagttttgcctatttttagaaaatgctgtgctttctctttgtagtggtctgttaggctaccattattgacaatctgtttcgtcttgttaaaaacttcaaattctgctgagg

SEQ ID NO: 2502 - DNA, 464 bp, Triticum aestivum
ccatgtcgctgatcgccggtgaggacttccagcatatcctgcgtctgctgaacactaacgtggatgggaagcagaagatcatgttcgccatgacctccatcaagggtgtggggcgccgcttctccaacatcgtctgcaagaaggccgacatcgacatgaacaagagggccggcgagctgactcctgatgagctggagcgcctgatgacggtcgtggccaaccctaggcagttcaaggtgccggactggttcctcaacaggaagaaggattacaaggacggcaggttctcgcaggtcgtctccaacgcccttgacatgaagctcagggacgaccttgagaggctcaagaagatcaggaaccaccgtggtctgcgtcactactggggcctccgtgtccgtggccagcacactaagactactggcaggcgtggaaagactgttggtgtctccaagaagcgataagct

SEQ ID NO: 2503 - DNA, 838 bp, Setaria italica
ctgaaaccctacccagcgcagccgcagcccctcgccgccgccgcttcctcgaactccggcgcgtgcccgagctccgccagccgctgccgccatgtcgctgatcgcgggggaggacttccagcacatcctgcgtctgctcaacaccaacgtggatggcaagcagaagatcatgttcgcgctcacctccatcaagggtgttggccgccgcttctccaacatcgtctgcaagaaggccgacatcgacatgaacaagcgggctggtgagctgaccccagatgaacttgagcgcctcatgactgtggttgccaacccccgccagttcaaggtccccgactggttcctcaacaggaagaaggactacaaggatggtaggttctcccaggtcgtttccaatgcccttgacatgaagctcagggatgaccttgagaggctgaagaagatcaggaaccaccgtggtctgcgtcactactggggcctgcgtgtccgtggacagcacaccaagaccaccggaaggcgtggaaagactgttggtgtgtcgaagaagagataaactccttgtcatcatattggcctagcttatgtcttgagtatccaaaacctttgcactgtgttttactggaggatgtttatccctaggatatctgatgagctatttgggttcctgaaatacttgtagcgactcttttggtggctgtgttccaagcgcggattgaattcagtgttctttgaaaccgtaaagttttgcctgtttggaaaattctatgcccttttgtgtcgtttgatctgttaggctacaaaggttgactacgtgctgtttcaacctgagttccaaacttac

SEQ ID NO: 2504 - DNA, 1401 bp, Eragrostis curvula
  misc_feature (28)..(28): n is a, c, g, or t
  misc_feature (31)..(31): n is a, c, g, or t
  misc_feature (34)..(35): n is a, c, g, or t
  misc_feature (42)..(42): n is a, c, g, or t
  misc_feature (47)..(48): n is a, c, g, or t
  misc_feature (58)..(58): n is a, c, g, or t
  misc_feature (540)..(540): n is a, c, g, or t
  misc_feature (592)..(592): n is a, c, g, or t
  misc_feature (595)..(596): n is a, c, g, or t
  misc_feature (603)..(603): n is a, c, g, or t
  misc_feature (613)..(614): n is a, c, g, or t
  misc_feature (643)..(643): n is a, c, g, or t
  misc_feature (649)..(649): n is a, c, g, or t
  misc_feature (654)..(654): n is a, c, g, or t
  misc_feature (665)..(665): n is a, c, g, or t
  misc_feature (668)..(668): n is a, c, g, or t
  misc_feature (671)..(672): n is a, c, g, or t
  misc_feature (687)..(687): n is a, c, g, or t
  misc_feature (704)..(704): n is a, c, g, or t
  misc_feature (717)..(717): n is a, c, g, or t
  misc_feature (728)..(728): n is a, c, g, or t
  misc_feature (739)..(739): n is a, c, g, or t
  misc_feature (754)..(754): n is a, c, g, or t
  misc_feature (763)..(763): n is a, c, g, or t
  misc_feature (768)..(768): n is a, c, g, or t
  misc_feature (960)..(961): n is a, c, g, or t
  misc_feature (969)..(969): n is a, c, g, or t
aaagaacacaagacgccagggcctaggnggnggnnctctacncttcnnccctcgccgncgctgccgcgttcgcctgcgagcgaccgatctgccgccgctgccgccatgtctctcgtcgccggtgaggacttccagcacatcctgcgtctgctgaacaccaacgtcgatgggaagcagaagatcatgttcgccatgacctccatcaagggtattggccgccgcttctcgaacatcgtctgcaagaaggccgacatcgacatgaacaagagggccggtgagctgacgccggaggagctggagcggctgatgaccgttgtggccaacccgcgccagttcaaggtgccggactggttcctcaacaggaagaaggactacaaggacggcaggttctcgcaggtcgtctccaacgccctcgacatgaagctcagggacgaccttgagaggctcaagaagatcaggaaccaccgtggtctccgtcactactggggcctccgtgtccgtggccagcacaccaagactactggcaggaggggaaagacngttggtgtgtccaagaagcgataagctatatatctactccacaaaccttggnccnnctactgnattggttcanntccaaacagtcttgatgaagcgttcctgntagacngtttnctcaaatgatnttntgnnctaggataatctctngcagttatggaaccttnctatattgtatcntgcatgtgttntggatctttgnagagtatttattttnatgagactnttgcngataaaaaaaaaaaaaaaaaaaaaaaaaaaaagtactctgcgtaaaaaccagggtttaacccctattgaattcccggcccccgtggggtcacccatatggaaaacctccccccccgtgggaaagcaacctggagaattcaaaaggggcaaaaaaaaagcttggccaatccgggcaaatttttttttaaaaanngggggttnttgtttattcccgggccccccgggggggggggggggagggagcggtgcggccccttctcccccttaaaaaagttaaattaattatgtgtcccactttttataaaaaaaaaaaaaaaagaataatataatcaaacaatattactacgaaaaaaaaaagagaaatttcaaatgaacatttggaacaacaaaattagagggtaaacatacagaataggatacgagaagtgaaatgtatctatcagcattgttacagtggaataataaaagccagatcggatacattaaagtctcagacaacatattataggaaacatgtagatagtacaacagactaataataacctactaatatcgtacaaatgacctaaatcattgaatctaaatcagaaccttatgtgtgcaggaactgacgccacactggatgctgaatct

SEQ ID NO: 2505 - DNA, 1018 bp, Oryza sativa
gcctccgaagccctagctcctcccgccgccgccgccgccgccgccgccgcctctccactcgagagacccagccgccgccgccgccgccgccgccatgtcgctgatcgccggggaggacttccagcacatcctgcgtctgctgaacaccaacgtcgatgggaagcagaagatcatgttcgcgctcacctccatcaagggtgtcggccgcaggttctccaacatcgcctgcaagaaggccgacatcgacatgaacaagagggccggtgagcttacgccggaggagctggagcggctgatgaccgtggtggcgaacccgcggcagttcaaggtgcccgactggttcctcaacaggaagaaggactacaaggacgggaggttctcccaggttgtctccaacgcgctcgacatgaagctcagggatgatcttgagaggctcaagaagatcaggaaccaccgtggtctgaggcactactggggcctccgtgtgcgtgggcagcacaccaagacaaccggaaggaggggtaagactgtcggtgtgtccaagaagcgataagcctaagaaccacccgagacttgatgaagcgtttcgttgggtgatgttttgccctaggataatattttgcagctatggaaccttgtcgtaatgtatcttgaagagtgtctttgggaactaagagtaatttacttttcttgaaactattgcagtattgactccttgtttattgcttttctccactttcttctacccacttaaaactattgcagtatcgactccttgtttattgctattctccactggcttctgccttaattttggatgttgcatgcgctgtgtatctggttcatgtgatgtaccatggcagcttgatgcattgggattactttgtgctgctattctcattagagaacgcattagtctgatatggtagtttgatctgatgtagtggttaatgataaacttagggttaatgttatggatggtaataactggtaaataaattgtgagattttcttctat

SEQ ID NO: 2506 - DNA, 930 bp, Oryza sativa
aacaagcccaagtaaaagcccattcaatctacaccctagatctcaatccccatcactcacagccgtccgatccactccacccgcaactatataacagctccgcctcctccgcgaaccggaaaaccctaaccctcgcagccgcatcgcgccaccgcctcctcctccccctccccctccggcgagagagcccgcgccgttgccgccgccgccgccgccgccatgtcgctgatcgcgggggaggatttccagcacatcctgcgtctgctgaacacgaacgtggatgggaagcagaagatcatgttcgcgctcacctccatcaagggtgtcggccgccgcttctccaacatcgcctgcaagaaggccgacatcgacatgaacaagcgggctggtgaactcactcctgaggagcttgagcgcctcatgactgtggtggcaaaccctcgccagttcaaggtccctgactggtttctgaacaggaagaaggactacaaggatgggaggttctcccaggttgtttctaacgccctggacatgaagctcagggatgaccttgagaggctgaagaagatcaggaaccaccgtggtctccgtcactactggggtctccgtgtccgcggtcagcacaccaagactactggcaggaggggaaagactgtcggtgtctccaagaagagataaattccatgcccatcggctcagcaaattcattttgcttgtcttatgagcgtttcaatgatgtcagtcttgataggcagttttgttggatgatgcttttgtctaagaagatagatcgtgcgttgcaggaatctcaaaacttttatatattgtaacttggttgtttggtaccgcaaattctgaagcctaatttttttactggatgtgtttctggtggatgttatgttttcatatttcattgcttgcgacggttga

SEQ ID NO: 2507 - DNA, 1023 bp, Saccharum officinarum
tgccgcgccgtacttgccgggacgacccacgcgtccggcgcggacgcccaccagcacctggccccctcgccgtcgccgcctcgccccgcgcgaccgatccaccgccgcggccaccatgtcgctgatcgccggtgaggacttccagcatatcctgcgtctgctgaacaccaacgtggatgggaagcagaagatcatgttcgccatgacctccatcaagggtatcgggcgccgcttctccaacatcgtctgcaagaaggccgacatcgacatgaacaagagggccggcgagctgacctctgaagagctggagcgcctgatgacggtcgtggccaaccccaggcagttcaaggtgccggactggttcctcaacaggaagaaggactacaaggacggcaggttctcacaggtcgtctccaatgccctcgacatgaagctcagggacgacctcgagaggctcaagaagatcaggaaccaccgtggtctgcgtcactactggggcctccgtgtccgtggccagcacactaagactactggcaggcgtggaaagactgtcggtgtctccaagaagcgataagctagcagcggcttatggcaacggcagcagctttttagctgcagcgaacgagccttaccttccaacaaatcttatgaagggtttctgttttgacagtttcctgaaatgatgttttgccctaggataatcttgcagttatggaaccttaatatattgtatcctgcaatgtgtttttttccccaacttctaagagtaattttattttgatggggacttgtgctgattgactcctttaaaaaaaaaaaaaaaaaggacgggccgctctttaaagatcccaagccttactttcgcgtgcctttgcgacgtccatagctctttttaatatggtaacctaaattcaatttcacttggcccgtcgtttttaccaacgtctgacttgggaaaaaccacctgcggtacccccaacttaaattgccttgtcagcaacaatcccccttttcggccgagct

SEQ ID NO: 2508 - DNA, 750 bp, Panicum virgatum
gagccgcgcggacgctctccaccacccgagccttcccgctgtcgccgcctcgctccgcgcgaccgatctgccgccatgtcgctgatcgcgggtgaggacttccagcacatcctgcgtctgctgaacaccaacgtggatgggaagcagaagatcatgttcgcgatgacctccatcaagggtatcggccgccgcttctccaacatcgtctgcaagaaggccgacatcgacatgaacaagagggccggcgagctgacgcctgacgagctggagaggctgatgacggtggtggcgaaccccaggcagttcaaggtgccggactggttcctcaacaggaagaaggactacaaggacggcaggttctcgcaggtcgtctccaacgccctcgacatgaagctcagggacgacctcgagagactcaagaagatcaggaaccaccgtggtctgcgtcactactggggcctccgtgtccgtggccagcataccaagactactggcaggcgtggaaagaccgttggtgtctctaagaagcgataagctatatatctaccaatcttggccttattactgtgttggttcgtgtccaaacagtcttgatgaagcttttctgtttagacagttccctgaaatgatgttttgccctaggaaaatcatgcagttatggaaccttaatatattgtatcgtacaatgtgttttttgcaacctctaagagtaatttgattttgatgagacagttgtggattgactcttta

SEQ ID NO: 2509 - DNA, 795 bp, Panicum virgatum
agaaccctaccccgcgcagccgccgcccgtcgccgccgccgccgccgcttcgtcgaactccggcgcgtgcccgagcctcgccagtcgctgccgccatgtcgctgatcgcgggggaggacttccagcacatcctgcgtctgctcaacaccaacgtggatggcaagcagaagatcatgttcgcgctcacctccatcaagggtgtcggccgccgcttctccaacatcgtctgcaagaaggccgatatcgacatgaacaagcgggctggtgaactgaccccagatgagcttgagcgcctcatgactgtggttgccaacccccgccagttcaaggtccctgactggttcctcaacaggaagaaggattacaaggatggtaggttctcccaggtcgtttctaacgctctcgacatgaagctcagggatgaccttgagaggctgaagaagatcaggaaccaccgtggtctgcgtcactactggggccttcgtgtccgtggccagcacaccaagaccaccggaaggcgtggaaagactgttggtgtgtcgaagaagagataagccccatgtcgatgcgccttgtattggcttggcctagtttgtgtcgagtacgcggacctttgtgctgtgttttgctggaggatatgtttatctctaggatagatggtgagctgtttgggttcatgaatacttgtagcgactcctttggtgcctatgttcgaagcacggattgaatttcagtgttctgtgaaaaacaatgaagttttgcctgtttggaaaaagcatcctatgtcctttcgtg

SEQ ID NO: 2510 - DNA, 790 bp, Panicum virgatum
gtcgaactccggcgcgtgcccgagccccgccagccgctgccgccatgtcgctgatcgcgggggaggacttccagcacatcctgcgtctgctcaacaccaacgtggatggcaagcagaagatcatgttcgcgctcacctccatcaagggtgtcggccgccgcttctccaacatcgtctgcaagaaggccgacatcgacatgaacaagcgggctggtgagctcacgccagatgagcttgagcgcctcatgactgtggttgccaacccccgccagttcaaggtgcctgactggttccttaacaggaagaaggactacaaggatggtaggttctcccaggttgtttctaacgccctcgacatgaagctcagggatgaccttgagaggctgaagaagatcaggaaccaccgtggtctgcgtcactactggggccttcgtgtccgtggccagcacaccaagaccaccggaaggcgtggaaagactgttggtgtgtcgaagaagagataagccccatgtccaagcgccctgtattggcccatagcttgtgtcttgagtatgcaaacctttgtgccatgttttgctggatatgtttatctctaggatagatgttgagctgtttgggttcatgaatacttgtagcggctccattggtgcctgtgttcgaagcgcggattgaatttcagtgttctgtgaaaaaacgatgaagtcttgcctgtttggaaaagcatcctatgtcctttcgtgtcatggggtctgttgggccacagtgtttgatgagcagctgtttcgacttt

SEQ ID NO: 2511 - DNA, 1030 bp, Panicum virgatum
acaaaagagcccgttaaacccacgggatccactccggtcggccccactccgcatccatcctggccgtcgatccgccgcccctagggttacttccacccgctcacactcccaactataaagcgctccccgctgcgccgccgccgcctccgagaggagaaaccctaccccgcgcagccgcagcccgccgccgccgccgccgccgcctcgtcgaactccggcgcgtgcccgagccccgccagccgctgccgccatgtcgctgatcgcgggggaggacttccagcacatcctgcgtctgctcaacaccaacgtggatggcaagcagaagatcatgttcgcgctcacctccatcaagggtgtcggccgccgcttctccaacatcgtctgcaagaaggccgacatcgacatgaacaagcgggctggtgagctcacgccagatgagcttgagcgcctcatgactgtggttgccaacccccgccagttcaaggtgcctgactggttccttaacaggaagaaggactacaaggatggtaggttctcccaggttgtttctaacgccctcgacatgaagctcagggatgaccttgagaggctgaagaagatcaggaaccaccgtggtctgcgtcactactggggccttcgtgtccgtggccagcacaccaagaccaccggaaggcgtggaaagactgttggtgtgtcgaagaagagataagccccatgtccaagcgccctgtattggcccatagcttgtgtcttgagtatgcaaacctttgtgccatgttttgctggatatgtttatctctaggatagatgttgagctgtttgggttcatgaatacttgtagcggctccattggtgcctgtgttcgaagcgcggattgaatttcagtgttctgtgaaaaaacgatgaagtcttgcctgtttggaaaagcatcctatgtcctttcgtgtcatggggtctgttgggccacagtgtttgatgagcagctgtttcgactttcgacctacatgcgttctgcatttaatttggggct

SEQ ID NO: 2512 - DNA, 959 bp, Setaria italica
gctcccactcccaactataaagctctccccgctacgacgccgccgcccccgagaggagaaaccctaccccgcgccgccgcaccccctcgccgccgccgcttcctcgaattccggcgcgtgcccgagctccgccagccgctgccgccatgtcgctgatcgcgggggaggacttccagcacatcctgcgtctgctcaacaccaacgtggatggcaagcagaagatcatgttcgcgctcacctccatcaagggtgtcggccgccgcttctccaacatcgtctgcaagaaggccgacattgacatgaacaagcgggctggtgagctgtccccagatgagcttgagcgcctcatgaccgtggttgccaacccccgccagttcaaggtccctgactggttcctcaacaggaagaaggactacaaggatggtaggttctcccaggtagtttccaacgcccttgacatgaagctcagggatgaccttgagaggctgaaaaagatcaggaaccaccgtgggctgcgtcactactggggcctgcgtgtccgtggacagcacaccaagaccaccggaaggcgtggaaagactgtcggtgtgtcgaagaagagataaaccccatgtcgtggcacgccgtattgtcctagcttgtgtcttaagtatccaaacctttgtgctgtgttctactcgaggatgtttatccctaggatagatgatgagctgtttgggttcatgaaatacttgtagcaactcttttggcgcccgtgttccaagcgtggattgaattcagtgttatgttctgtttcgtcttgttccaaacttccaattttgtgaggattctgaagctggtgatggttttgtggttggaaaacgtaagagctcgatcaaagtttgtgtttgtaatacctttagtgatgtaaaccgctcaaacaagcacttgtaacacctgtctctaagtcagagtatata

SEQ ID NO: 2513 - DNA, 1025 bp, Sorghum bicolor
gatccgcggccattagggttgcttccacccccatcaccctcccaactataaagctcgcctcgcgacgccgccgccgccgccagcgagaggagaaaccctaccccgcgcagccgcagccgcagcccgtcgccgccccgaactccggcgcgtgcccgagctccaccagccgctgccgccatgtcgctgatcgcgggggaggacttccagcacatcctgcgtctgcttaacaccaacgtggatggcaagcagaagatcatgttcgccatgacctccatcaagggtgttggccgccgcttctccaacatcgtatgcaagaaggccgacatcgacatgaacaagcgggctggtgagctgtcatcagatgagcttgagcgcctcatgactgtagttgccaaccctcgccagtttaaggtccctgactggttcctcaacaggaagaaggattacaaggatggtaggttctctcaggttgtttccaatgcccttgacatgaagctcagggatgaccttgagaggctgaagaagatcaggaaccaccgtggtctgcgtcactactggggcctgcgtgttcgtggccagcacaccaagaccaccgggaggcgtggaaagactgtcggtgtgtcaaagaagagataagctccttgaggcatattggtcttatcttgagtttcttttgtatgcagacatttgtgctttgatatgccacaggatgtttattatctgtaggatagatgagagttccgctttacaagacttctatatattgtagcaatcttttgctgcctgtgttccaagagggttgaattgaatgttctgtgaaacgggtaaaagttttatatgcttgtttttgctgtgtttcctcggaggtcattttgctagtgaaagctgacaagagccgatttgttctacgaaattttgatatatctgttttgtatccgtgtgttcccgattcgattccgatattcagtagtttctggacctggtaaaaattttgatagttcaaagttgtctagtgcggccccgtg

SEQ ID NO: 2514 - DNA, 941 bp, Saccharum officinarum
ctaccctgcgcagccgcagcccgtcgccgcctccaactccggcgcgcgcccgagctccaccagccgctgccgccatgtcgctgatcgcgggggaggacttccagcacatcctgcgtctgctcaacaccaacgtggatggcaagcagaagatcatgttcgccatgacctccatcaagggtgtcggccgccgcttctccaacatcgtctgcaagaaggccgacatcgatatgaacaagcgggctggtgagctctccgcggatgagcttgagcgcctcatgactgtggttgccaacccccgccagtttaaggtccctgactggttcctcaacaggaagaaggattacaaggatggtaggttctctcaggttgtttccaatgcccttgacatgaagctccgggatgaccttgagaggctgaagaagatcaggaaccaccgtggtctgcgtcactactggggcctccgtgtccgtggccagcacaccaagaccaccgggagacgtggaaagaccgtcggtgtgtcaaagaagagataaacttcttgaggcatattggcattgtcttgagtatgcagacatttgtgctttgttatgctgcaggatgtttattatctgtaggatagatgagcagttccgctttacgagacttctatatattgtagcaatcttttgctgcctgtgttccaagttggttgaattgaatgttctgtgaaacgggtaaagttttatatgcttgacagtactttgtttgcgctgtgtttccccttggagggcattttgctcgtgaaagctgacgaagaaccgatttgttctatgaaaaaataaatatatataatatatccatcctcaacatttatctataaaaaaaaccttctcattattctacctctcatcgggcggccgctctaaaggatcccatgtttccgtaccccatgtatggccacg

SEQ ID NO: 2515 - DNA, 610 bp, Saccharum officinarum
ctaccccgcgcagccgcagcctgtcgccgcctccaactccggcgcgcgcccgagctccaccagccgctgccgccatgtcgctgatcgcgggggaggacttccagcacatcctgcgtctgctcaacaccaacgtggatggcaagcagaagatcatgttcgccatgacctccatcaagggtgtcggccgccgcttctccaacatcgtctgcaagaaggccgacatcgacatgaacaagcgggctggtgagctatccgcggatgagcttgagcgcctcatgactgtggttgccaacccccgccagtttaaggtccctgactggttcctcaacaggaagaaggattacaaggatggtaggttctctcaggttgtttccaatgcccttgacatgaagctcagggatgaccttgagaggctgaagaagatcaggaaccaccgtggtctgcgtcactactggggcctgcgtgtccgtggccagcacaccaagaccaccgggaggcgtggaaagactgttggtgtgtcaaagaagagataaactccttgaggcatattggccaatcttgaatgtcttgagtatgcagacatttgtgctttggtatgccgcaggatgtt

SEQ ID NO: 2516 - DNA, 815 bp, Panicum virgatum
cttcccgccgtcgccgcctcgctccgcgcgaccgatctgccgccgccaccatgtcgctgatcgccggtgaggacttccagcacatcctgcgtctgctgaacaccaacgtggatgggaagcagaagatcatgttcgcgctcacctccatcaagggtgtcggccgccgcttctccaacatcgtctgcaagaaggccgacattgacatgaacaagagggctggcgagctgtcgcctgacgagctggagaggctgatgacggtggtggcgaaccccaggcagttcaaggtgccggactggttcctcaacaggaagaaggactacaaggacggcaggttctcgcaggtcgtctccaacgccctcgacatgaagctcagggacgacctcgagagactcaagaagatcaggaaccaccgtggtctgcgtcactactggggcctccgtgtccgcggccagcacaccaagactactggcaggcgtggaaagaccgttggtgtctccaagaagcgataagctatatctaccaatcttggccttattactgtgttggttcatgtccaaacagtcttgataaagagtttctgtttagacagtacctgaaatgatgttttgccctaggataatcatgcagttatggaaccttaatatattgtatcgtacaatttgttttttgcaacttctaagagcaatttgattttgatgagacagttgcggattgactctttacatttattattgtgatcagagtgatcttttcttactgtttgtcgtgcctacatgatgcaaatggttgcaataccaatgttatttccattctgt

SEQ ID NO: 2517 - DNA, 862 bp, Panicum virgatum
aaaaccttagccgcgcggacgcccaccaccacctgcgacttcccgccgtcgccgcctcgctccgcgcgaccgatctgccgccgccaccatgtcgctgatcgccggtgaggacttccagcacatcctgcgtctgctgaacaccaacgtggatgggaagcagaagatcatgttcgcgctcacctccatcaagggtgtcggccgccgcttctccaacatcgtctgcaagaaggccgacattgacatgaacaagagggctggcgagctgtcgcctgacgagctggagaggctgatgacggtggtggcgaaccccaggcagttcaaggtgccggactggttcctcaacaggaagaaggactacaaggacggcaggttctcgcaggtcgtctccaacgccctcgacatgaagctcagggacgacctcgagagactcaagaagatcaggaaccaccgtggtctgcgtcactactggggcctccgtgtccgtggccagcataccaagactactggcaggcgtggaaagaccgttggtgtctctaagaagcgataagctatatctaccaatcttggccttattactgtgttggttcatgtccaaacagtcttgataaagagtttctgtttagacagtacctgaaatgatgttttgccctaggataatcatgcagttatggaaccttaatatattgtatcgtacaatttgttttttgcaacttctaagagcaatttgattttgatgagacagttgcggattgactctttacatttattattgtaatctgagtgatcttttcttactgtttgtcgtgcctacatgatgcaaatggttgcgataccaatgttatttccattctgtaagttacac

SEQ ID NO: 2518 - DNA, 962 bp, Brachypodium distachyon
gcaaaaccttagtcgcgcgaactcccacccctgcctcctgcccccctgcgagagccgccgccgccgcagccgccgaccgcagccatgtctctgatcgcgggtgaggagttccagcacatcctgcgtctgctcaacaccaacgtcgatgggaagcagaagatcatgttcgcgctgacctccatcaagggtgtgggccgccgcttctccaacatcgtctgcaagaaggccgacatcgacatgaacaagagggctggagagctcacgccggaggagttggaccggctgatgcatgtggtggccaacccgcgccagttcaaggtccccgactggttccttaacaggaagaaggactacaaggacggcaggttctcccaggtcgtctccaacgccctcgacatgaagctcagggacgacctcgagaggctcaagaagatcaggaaccatcgtggtctgcgtcactactggggtgttcgtgttcgtggacagcacaccaagactactggcaggagaggaaagactgttggtgtctccaagaagcgataagctttatgttgacctcgcatatcttgtccctacatctgtgttggtcatttggagagtcttaatgaagtgtccccgtttagactataaccttggatgatgttttgccctagatactattttgcagttctgcaacttcaatatattgtatcctgaattcctttttgaactccaagagtactttcgttcccatgatcctgttgtggatcgtctcctttcaatgtttgatgcagatgcatggcttagagcttataagtgttttgcccgtttctgtgcgcaatcatttcagtcaatgcatctcaatgctgtctgctgtgatgtcccagctctttgccaaggtttggaaatgcttttgatcttaacgggcacctttcatgttctttctgttgatcgtatttattccactctggcatttggtatta

SEQ ID NO: 2519 - DNA, 691 bp, Oryza sativa
ctgtcgtttccccgggggtacttccagcacatcctgcgtctgctgaacaccaacgtcgatgggaagcagaagatcatgttcgcgctcacctccatcaagggtgtcggccgcaggttctccaacatcgcctgcaagaaggccgacatcgacatgaacaagagggccggtgagcttacgccggaggagctggagcggctgatgaccgtggtggcgaacccgcgccagttcaaggtgcccgactggttcctcaacaggaagaaggactacaaggacgggaggttctcccaggttgtctccaacgcgctcgacatgaagctcagggatgatcttgagaggctcaagaagatcaggaaccaccgtggtctgaggcactactggggcctccgtgtgcgtgggcagcacaccaagacaaccggaaggaggggtaagactgtcggtgtgtccaagaagcgataagcctaagaaccacccgagacttgatgaagcgtttcgttgggtgatgttttgccctaggataatattttgcagctatggaaccttgtcgtaatgtatcttgaagagtgtctttgggaactaagagtaatttacttttcttgaaactattgcagtattgactccttgtttattgcttttctccactttcttctacccacttaaaactattgcagtatcgactccttgtttattgcta

SEQ ID NO: 2520 - DNA, 677 bp, Oryza sativa
gatgaatgggggaggatttccagcacatcctgcgtctgctgaacaccaacgtggatgggaagcagaagatcatgttcgcgctcacctccatcaagggtatcggccgccgcttctccaacattgcctgcaagaaggccgacatcgacatgaacaagcgggctggtgaactcactcctgaggagcttgagcgcctcatgactgtggtggcaaaccctcgccagttcaaggtccctgactggtttctgaacaggaagaaggactacaaggatgggaggttctcccaggttgtttctaacgccctggacatgaagctcagggatgaccttgagaggctgaagaagatcaggaaccaccgtggtctccgtcactactggggtctccgtgtccgtggtcagcacaccaagactactggcaggaggggaaagactgtcggtgtctccaagaagagataaattccatgtacatcagcacagcaaatatgcattttgcttatcttatgagcgtttcaatgatgtcggtcttgataggcagttttgttggatgatgcttttgtctaagaagatagatcgtgcttggaggattctcaacttgttatatattgtaacttgcttgtttgtaccgcaaattctgaagcctaattttttactggatgtgtttctggtggagttatgttttca

SEQ ID NO: 2521 - DNA, 773 bp, Panicum virgatum
gggtggggttggtcttttgcagtcgctgatcgcgggggaggacttccagcacatcctgcgtctgctcaacaccaacgtggatggcaagcagaagatcatgttcgcgctcacctccatcaagggtgtcggccgccgcttctccaacatcgtctgcaagaaggccgacatcgacatgaacaagcgggctggtgaactgaccccagatgagcttgagcgcctcatgactgtggttgccaacccccgccagttcaaggtccctgactggttcctcaacaggaagaaggattacaaggatggtaggttctcccaggtcgtttctaacgctctcgacatgaagctcagggatgaccttgagaggctgaagaagatcaggaaccaccgtggtctgcgtcactactggggccttcgtgtccgtggccagcacaccaagaccaccggaaggcgtggaaagactgttggtgtgtcgaagaagagataagccccatgttgatgcgccttgtattggcttggcctagtttgtgtcgagtacgcggacctttgtgctgtgttttgctggaggatatgtttatctctaggatagatggtgagctgtttgggttcatgaatacttgtagcgactcctttggtgcctatgttcgaagcacggattgaatttcagtgttctgtgaaaaacaatgaagttttgcctgtttggaaaaagcatcctatgtcctttcgtgggtcttttcggcaacagggttcatgagcagctgtttcgatctgtgttccaacct

SEQ ID NO: 2522 - DNA, 1051 bp, Brachypodium distachyon
aattatttagccgctttccctcagcgccgcctgcaaaaccctagccccgcatctgcagacgcccatcaccgcccctcgccgccgccccctcctcctccagcgagagcagtgcccaccgacgccatggcgctgatcgcgggggaggagttccagcacatcctgcgtctgctcaacaccaacgtcgatggcaagcagaagatcatgttcgcgctcacctccatcaagggtatcggccgccgctactccaacatcgtctgcaagaaggccgacatcgacatgaacaagcgggctggtgagcttactactgaagagcttgaccgcctcatggttgtggtgtctaaccctcgccagttcaaggttcctgattggttcctcaacaggaagaaggattacaaggatggcaggttctcccaggttgtctccaatgcccttgacatgaagctcagggatgaccttgagaggctgaagaagatcaggaaccaccgtggtctgcgtcactattggggcgtccgtgtccgtggccagcacaccaagaccactggcaggcggggaaagactgtcggtgtctcgaagaagagataaactctacgcctatcaggctgcttattttcagcgtctgttgatgtgaaaccttggtgccctcgtagttggacagttttgtttttggggaattatgtctgcatgtctctagtgataggtcatggtctgtgtttgctctcttgcgtgtgttctttgtggattcagttctgtttttgttggatggcaattatattaattagattttgtgattggagataatgttttaggtatttgtttcgagtattgatgtcttttaggctgtgtttggtagctcagtattttaggagttttgtgtgaatatcacagtttctaaaattactctggtttcaaatacttttgaggtgtttggctacaacaaaaaactgtagttttaatactgtagtatagctaaaactatggtattttcgctgtataaaataaagagccttggacctctctatatcttaccaagcatgttggaaaaacagatcct

SEQ ID NO: 2523 - DNA, 945 bp, Hordeum vulgare
aaaaccttagacgcgcaaacgccaatctccctcctaccccgagcgccccagccgccgccgccgccgtcgccgtcgtccccgccgactgccgccatgtcgctgatcgcgggtgaggagttccagcacatcctgcgtgtgctcaacaccaacgtcgatggtaagcagaagatcatgttcgcgctgacctccatcaagggtgtgggccgccgcttctccaacatcgcctgcaagaaggccgacatcgacatgaacaagagggccggagagctctcctcggaggagatggaccggctgatgacggttgtggccaacccgcgccagttcaaggtgccggactggttccttaacaggaagaaggactacaaggacggcaggttcacccaggtggtctccaacgccgtcgacatgaagctcagggacgaccttgagaggctcaagaagatcaggaaccaccgtggtcttcgtcactactggggcgtgcgtgtccgtggtcagcacaccaagactaccggcaggagaggaaagactgttggtgtctccaagaagcgataagcttctcaatgatcccgcatagctttgctaccattactgtgttggtccatttccagaatctgaaggagtgttcctgtttagacgattaccttggatgatgttttgccctagataatgtttttcggttctggaacctttaatatattgtatcttgaattcctcgttttgaactcctaaagagtttgtttgccatgggctttcgagtcatttcaatgtttggcaagagcatgtctatcagtgatactcctgaagggctttctagtcatttcaatgtttgccatgggctttttgtgcgtttcaggtttgttgactaattgaaggtttgggcattatcagttgtttgcattgtcgttcgttggctaattgagtcctgaaaaacttcctagttttgac

SEQ ID NO: 2524 - DNA, 846 bp, Pseudoroegneria spicata
ccgttgctgtcaaacgccaacctcctccccctcctgcccccgagcgccccagccgccgccgtcgccgccgccgactgccgccatgtcgctgatcgcgggtgaggagttccagcacatcctgcgtgtgctcaacaccaacgtcgatggtaagcagaagatcatgttcgcgctgacctccatcaagggtgtgggccgccgcttctccaacatcgtctgcaagaaggcggacatcgacatgaacaagagggctggagagctttcctcggaggagatggatcgtctgatggcggtggtggccaacccgcgccagttcaaggtgccggactggttcctgaacaggaagaaggactacaaggacggcaggttctcccaggtcgtctccaacaacgtcgacatgaagctcagggatgaccttgagaggctcaagaagatcaggaaccatcgtggtctgcgtcactactggggcgtgcgtgtccgtggtcagcacaccaagactaccggcaggagaggaaagactgttggtgtctccaagaagcgataagctgcttcgcaacgacccctcatagctttgctactactgtgttggtccatttccagaatctgaaggagtgttcttgtttagacgatttccttggatgatgttttgccctagataatgttttgcggttctggaacctttaatatattgtatcttgaattcctcgttgaactcccaagagtttgttttgccatgggcttcgagtcatttgaatggttggcaagagcaattctattctatgcattcctgtgcattacaggtttgttggctaattgaatcctggtaagtttttgggtgtgcccattcta

SEQ ID NO: 2525 - DNA, 848 bp, Secale cereale
taattcgtccccgtcccccctccaaaacctgaaccccagacgctctaacgccgccaacctccttcccctcgcgccgccgccgccgccgacgacgccgactgcagccatgtcgctgatcgcgggcgaggagttccagcacatcctgcgtgtgctcaacaccaacgtcgacggcaagcagaagatcatgttcgcgctcacctccatcaagggcgtgggccgccgcttctccaacatcgtctgcaagaaggccgacatcgacatgaacaagagggccggagagctttccgcggaggagatggaccgtctgatggcggtggttcacaacccgcgccagttcaaggtgcccgactggttcctcaacaggaagaaggactacaaggatggcaggttctcccaggtcgtctccaacgccgttgacatgaagctcagggatgaccttgagcggctcaagaagatcaggaaccatcgtggtctgcgtcactactggggcgtgcgtgtccgtggtcagcacaccaagactaccggcaggagaggaaagactgttggtgtctccaagaagcgataagctgctttgcaaagatgccgcatagctttgccactactgtgttggtccatttccagaatcttaatgagtgttaccttggatgatgttttgcccttgttttgccatgggctcgagtcatttgaatggttggcaacatcatgtctgttctaagcatatgtgtgcattacaggtttgttggctaattgaatcctggtatatttttgggcgtgccattctagttgtgggtgtaatttgtggcattgtgtacctggacatttttttgataaagaataacctgacatat

SEQ ID NO: 2526 - DNA, 726 bp, Secale cereale
cgccgccgtcgccgccgactgcagccatgtcgctgatcgcgggtgaggagttccagcacatcctgcgtgtgctcaacaccaacgtcgatggtaagcagaagatcatgttcgcgctgacctccatcaagggtgtgggccgccgcttctccaacatcgtctgcaagaaggccgacatcgacatgaacaagagggctggagagctgtccgcggaggagatggaccgtctgatggcggtggtgcacaacccgcgccagttcaaggtgccggactggttccttaacaggaagaaggactacaaagacgggaggttctcccaggtcgtctccaacgcggtcgacatgaagctcagggatgaccttgagaggctcaagaagatcaggaaccatcgtggtctccgtcactactggggcgtccgtgtccgtggtcagcacaccaagactaccggcaggagaggaaagactgttggtgtctccaagaagcgataagctttgcaaccatactgcatagctttgctactactgtgttggtccattttcagaatctcaaggagtgttcttgtttagacgattaccttggatgatgttttgccctagataatgttttgctggaacctttaatatattgtatcttgaattccttgttgaactcctaagagtttgtttgccatgggcttcaagtcatttcattggttggcaagagcatgttcgtgcattacagatttgttgg

SEQ ID NO: 2527 - DNA, 846 bp, Secale cereale
gccgccgccgccgccgacgacgccgactgcagccatgtcgctgatcgcgggcgaggagttccagcacatcctgcgtgtgctcaacaccaacgtcgacggcaagcagaagatcatgttcgcgctcacctccatcaagggcgtgggccgccgcttctccaacatcgtctgcaagaaggccgacatcgacatgaacaagagggccggagagctttccgcggaggagatggaccgtctgatggcggtggtgcacaacccgcgccagttcaaggtgcccgactggttcctcaacaggaagaaggactacaaggacggcaggttctcccaggtcgtctccaacgccgttgacatgaagctcagggatgaccttgagcggctcaagaagatcaggaaccatcgtggtctgcgtcactactggggcgtgcgtgtccgtggtcagcacaccaagactaccggcaggagaggaaagactgttggtgtctccaagaagcgataagctacttacaaagatgccgcctagctttgctactactgtgttggtccatttccagaatgttaaggagtgttcatatttagacgattaccttggatgatgttttgccctagataatgttttggttctggaaccattaatatattgtatcttgaattccttgttgaactcgtacaagagtttgttttgccacgtgcttttggcaacatcatgtctgttctaagcatatctgtgcattacaggtttgttggctaattgaatcctggtatatttttgggcgtgctattctagttggtggtgtaatttgtggcattgtttacctggtactatttttgtattaaagtaataaccttacg

SEQ ID NO: 2528 - DNA, 809 bp, Secale cereale
gtcgccgccgactgcagccatgtcgctgatcgcgggtgaggagttccagcacatcctgcgtgtgctcaacaccaacgtcgatggtaagcagaagatcatgttcgcgctgacctccatcaagggtgtgggccgccgcttctccaacatcgtctgcaagaaggccgacatcgacatgaacaagagggctggagagctgtccgcggaggagatggaccgtctgatggcggtggtgcacaacccgcgccagttcaaggtgccggactggttccttaacaggaagaaggactacaaagacgggaggttctcccaggtcgtctccaacgctgtcgacatgaagctcagggatgaccttgagaggctcaagaagatcaggaaccatcgtggtctccgtcactactggggcgtgcgtgtccgtggtcagcacaccaagactaccggcaggagaggaaagactgttggtgtctccaagaagcgataagctttgcaaccatcctgcatagctttgctactactgtgttggtccattttcagaatatggagggttcttgtttagacgattaccttggatgatgttttgccctagataatgttttgctggaacctttaatatattgtatcttgaattccttgttgaactcctaagagtttgtttgccatgggcttcaagtcatttcaatggttggcaagagcttgtctattctatgcatttccgtgcattacagatttgttggctaattgaatccttgtatttttttggttgtgcccattgtattgctgtgaatgatcgatgacttctagtttgtggtgtg

SEQ ID NO: 2529 - DNA, 932 bp, Secale cereale
ggggagacgcgaacgcacctcctcccctcctgcccccgagcgccccagccgccgccgccgtcgccgtcgccgccgactgcagccatgtcgctgatcgcgggtgaggagttccagcacatcctgcgtgtgctcaacaccaacgtcgatggtaagcagaagatcatgttcgcgctgacctccatcaagggtgtgggccgccgcttctccaacatcgtctgcaagaaggccgacatcgacatgaacaagagggctggagagctgtccgcggaggagatggaccgtctgatggcggtggtgcacaacccgcgccagttcaaggtcccggactggttccttaacaggaagaaggactacaaagacgggaggttctcccaggtcgtctccaacgctgtcgacatgaagctcagggatgaccttgagaggctcaagaagatcaggaaccatcgtggtcttcgtcactactggggcgtgcgtgtccgtggtcagcacaccaagactaccggcaggagaggaaagactgttggtgtctccaagaagcgataagctttgcaaccatactgcatagctttgctactactgtgttggtccattttcagaatctcaaggagtgttcttgtttagacgattaccttggatgatgttttgccctagataatgttttgctggaacctttaatatattgtatcttgaattccttgttgaactcctaagagtttgtttgccatgggcttcaagtcatttcaatggttggcaagagcatgttcgtgcattacagatttgttggctaattgaatccttgtatttttttggttgtgcccattgtattgctgtgaatgatcgatgacttctagtttgtagttctgagtctaagttgaagttgtcggtagtttagggaaaaggtaaaaaaaactagaagactgaccgaaggaccg

SEQ ID NO: 2530 - DNA, 951 bp, Secale cereale
tcgccgtcgccgccgactgcagccatgtcgctgatcgcgggtgaggagttccagcacatcctgcgtgtgctcaacaccaacgtcgatggtaagcagaagatcatgttcgcgctgacctccatcaagggtgtgggccgccgcttctccaacatcgtctgcaagaaggccgacatcgacatgaacaagagggctggagagctgtccgcggaggagatggaccgtctgatggcggtggtgcacaacccgcgccagttcaaggtgccggactggttccttaacaggaagaaggactacaaagatgggaggttctcccaggtcgtctccaacgccgtcgacatgaagctcagggatgaccttgagaggctcaagaagatcaggaaccatcgtggtctccgtcactactggggcgtgcgtgtccgtggtcagcacaccaagactaccggcaggagaggaaagactgttggtgtctccaagaagcgataagctttgcaaccatcctgcgccgaggtgtctatgtgttggtccattttcagaatatgaaggagtgttcttgtttagacgattaccttggatgatgttttgccctagataatgttttgctggaacctttaatatattgtatcttgaattccttcttgaactcctaagagtttgtttgccatgggcttcaagtcatttcaatggttggcaagagcttgtctattctatgcatttccgtgcattacagatttgttggctaattgaatcctctttatttttttttttggtgttgcccattgtattgctgtgaatgatcgatgacttctagtttgagttaaaaaagtaaaaaaaaaaaaaaaaaaaaaaaaaaaaaaagaaaaaaaaaaaaaaaaaaaaaataaaaaaaaaaaaaaaactaaaaataaagaactaagaacaaagacaacaagaacgggaagtaaggagagtaga

SEQ ID NO: 2531 - DNA, 1166 bp, Triticum aestivum
gaacgcacctcctcccctcctgcccccgagcaccgcagccgccgccgccgccgccgccgccgccgactgcagccatgtcgctgatcgcgggtgaggagttccagcacatcctgcgtgtgctcaacaccaacgtcgacggtaagcagaagatcatgttcgcgctgacctccatcaagggtgtgggccgccgcttctccaacatcgtctgcaagaaggccgacatcgacatgaacaagagggccggagagctttccgcggaggagatggaccgcctgatggcggtggtgcacaacccgcgccagttcaaggtgccggactggttcctcaacaggaagaaggactacaaggacggcaggttctcccaggtcgtgtccaacgccgtggacatgaagctcagggatgaccttgagaggctcaagaagatcaggaaccatcgtggtctgcgtcactactggggcgtgcgtgtccgtggtcagcacaccaagactaccggcaggagaggaaagactgttggtgtctccaagaagcgataagctgcttcacaaagatcccgcatagctttgctactactgtgttggtccatttccagaatcttaaggagtgttcttgtttagacgattaccttggatgatgttttgccctagataatgttttggttctggaacctttaatatattgtatcttgaattccttgttgaactcttcagagtttgttttgccatgggctttagtcatttgaatggttggcaagattatgtatgttctagcatttctgtgaattacaggtttgttggctaattgaatcttggtatattttttggtgtgcatgatcgagttttgtaagttgttggcaactgggtaatactccctccattcctgaatgtaagatattttggcagttcaatctgctgtcaaaatgtctaagaggtatatcataggtcgtcctatttgggtattgttgtttatcagttgcatgaaagttaagacctttatttttgacctcgactcttgctttgcatctaccaatagaacctagaatgagagatactggtaaatgcaaaagactatactgatactctcattgaacatataaaccctgaagaacttgtagtcacaaccttgcctttatgtcgccgccacctccgctcctgctgttgccgcatccc

SEQ ID NO: 2532 - DNA, 675 bp, Eragrostis curvula
  misc_feature (309)..(309): n is a, c, g, or t
  misc_feature (547)..(547): n is a, c, g, or t
  misc_feature (573)..(573): n is a, c, g, or t
  misc_feature (603)..(603): n is a, c, g, or t
  misc_feature (608)..(608): n is a, c, g, or t
  misc_feature (610)..(610): n is a, c, g, or t
  misc_feature (615)..(615): n is a, c, g, or t
  misc_feature (631)..(632): n is a, c, g, or t
  misc_feature (636)..(636): n is a, c, g, or t
  misc_feature (644)..(644): n is a, c, g, or t
  misc_feature (649)..(650): n is a, c, g, or t
  misc_feature (652)..(655): n is a, c, g, or t
  misc_feature (657)..(657): n is a, c, g, or t
  misc_feature (662)..(662): n is a, c, g, or t
  misc_feature (667)..(667): n is a, c, g, or t
  misc_feature (674)..(674): n is a, c, g, or t
aagggacaagtcggccgccaaccgccgcttcctcctcctcctcctccggcgcgcgccccgcaccacctgccgccgccgccatgtcgcttgtcgcgggtggggacttccagcacatcctgcgtctgctgaataccaacgtggatggcaagcagaagatcatgttcgccatgacctccatcaagggtatcgggcgccgcttctccaacatcgtctgcaagaaggccgacatcgacatgaacaagcgggctggtgagctgaccccagaggacttgagcgctcatgacgtggttgcaaccccgtcagttcaangttccggattggttcctgaacaggaagaaggactacaaggatggtaggttctcccaggttgtctccaacgccctggacatgaagctcagggatgaccttgagaggctcaagaagatcaggaaccaccgtggtcttcgtcactactggggcctccgtgtccgtggccagcacaccaagaccaccggcaggcgtggaaagactgttggtgtctcgaagaagagataaaccctgtctcaangcacagctctggtggcttatcttcanagtgtctttatcaacgccagacttcgtgtnatatntngctgnaggatgcttgtcatanngtanatgctganttgtnncnnnntntgaancctgnatatatnt

SEQ ID NO: 2533 - DNA, 697 bp, Secale cereale
ccccagacgctctaacgccgccaacctccttcccctcgcgccgccgccgccgccgacgacgccgactgcagccatgtcgctgatcgcgggcgaggagttccagcacatcctgcgtgtgctcaacaccaacgtcgacggcaagcagaagatcatgttcgcgctcacctccatcaagggcgtgggccgccgcttctccaacatcgtctgcaagaaggccgacatcgacatgaacaagagggccggagagctttccgcggaggagatggaccgtctgatggcggtggttcacaacccgcgccagttcaaggtcgcccgactggttcctcaacaggaagaaggactacaaggacggcaggttctcccaggtcgtctccaacgccgttgacatgaagctcagggatgaccttgagcggctcaagaagatcaggaaccatcgtggtctgcgtcactactggggcgtgcgtgtccgtggtcagcacaccaagactaccggcaggagaggaaagactgttggtgtctccaagaagcgataagctacttacaaagatgccgcctagctttgctactactgtgttggtccatttccagaatgttaaggagtgttcatatttagacgattaccttggatgatgttttgccctagataatgttttggttctggaaccattaatatattgtatcttgaattccttgttga

SEQ ID NO: 2534 - DNA, 930 bp, Secale cereale
gaaccccagacgctctaacgccgccaacctccttcccctcgcgccgccgccgccgccgacgacgccgactgcagccatgtcgctgatcgcgggtgaggagttccagcacatcctgcgtgtgctcaacaccaacgtcgacggcaagcagaagatcatgttcgcgctcacctccatcaagggcgtgggccgccgcttctccaacatcgtctgcaagaaggccgacatcgacatgaacaagagggccggagagctttccgcggaggagatggaccgtctgatggcggtggttcacaacccgcgccagttcaaggtgcccgactggttcctcaacaggaagaaggactacaaggacggcaggttctcccaggtcgtctccaacgccgttgacatgaagctcgagggatgaccttgagcggctcaagaagatcaggaaccatcgtggtctgcgtcactacgtgggctgcgtgtccgtggtcagcacaccaagactaccggcaggagaggaaagactgttggtgtctccaagaagcgataagctttgcaaccatcctgcatagctttgctactactgtgttggtccattttcagaatatggagggttcttgtttagacgattaccttggatgatgttttgccctagataatgttttgctggaacctttaatatattgtatcttgaattccttgttgaactcctaagagtttgtttgccatgggcttcaagtcatttcaatggttggcaagagcttgtctattctatgcatttccgtgcattacagatttgttggctaattgaatccttgtatttttttggttgtgcccattgtattgctgtgaatgatcgatgacttctagtttgtggtgtgatttgtttgcttacttaagttggagtctgagcaagttgaattgtggatttggaaaaaggaaacg

SEQ ID NO: 2535 - DNA, 472 bp, Secale cereale
actgcagccatgtcgctgatcgcgggtgaggagttccagcacatcctgcgtgtgctcaacaccaacgtcgatggtaagcagaagatcatgttcgcgctgacctccatcgaagggtgtgggccgccgcttctccaacatcgtctgcaagaaggccgacatcgacatgaacaagagggctggagagctttccgcggaggagatggaccgtctgatggcggtggtgcacaacccgcgccagttcaaggtgccggactggttcctcaacaggaagaaggactacaaggacgggaggttctcccaggtcgtctccaacgccgttgacatgaagctcagggatgaccttgagaggctcaagaagatcaggaaccatcgtggtctgcgtcactactggggcgtgcgtgtccgtggtcagcacaccaagactaccggcaggagaggaaagactgttggtgtctccaagaagcgataagct

SEQ ID NO: 2536 - DNA, 549 bp, Secale cereale
gaaccccagacgctctaacgccgccaacctccttcccctcgcgccgccgccgccgccgacgacgccgactgcagccatgtcgctgatcgcgggtgaggagttccagcacatcctgcgtgtgctcaacaccaacgtcgacggcaagcagaagatcatgttcgcgctcacctccatcaagggctgggccgccgcttctccaacatcgtctgcaagaaggccgacatcgacatgaacaagagggccggagagctttccgcggaggagatggaccgtctgatggcggtggttcacaacccgcgccagttcaaggtgcccgactggttcctcaacaggaagaaggactacaaggatggcaggttctcccaggtcgtctccaacgccgttgacatgaagctcagggatgaccttgagcggctcaagaagatcaggaaccatcgtggtctgcgtcactacgtggggcgtgcgtgtccgtggtcagcacaccaagactaccggcaggagaggaaagactgttggtgtctccaagaagcgataagctgctttgcaaag

SEQ ID NO: 2537 - DNA, 669 bp, Avena sativa
ctgcagccatgtctttgatcgcgggtgaggagttccagcacatcctgcgtgttctgaacaccaacgtcgatggaaagcagaagatcatgttcgcgctgacctccatcaagggtattgggcgtcgcttctccaacatcgcctgcaagaaggccgacatcgacatgaacaagagggctggagagctcaccacagaggagatggaccgtctgatgacggtggtgcagaacccaaggcagttcaaggttccggactggttcctgaacaggaagaaggactacaaggacggcaggttctcccaggtcgtctctaaccaggtcgacatgaagctcagggatgaccttgagcggctcaagaagatccgcaaccatcgtggtctgcgtcactactggggcgtccgtgtccgtggtcagcacaccaagactaccggaaggagaggaaagactgttggtgtctccaagaagcgataagctcaatattcaccccacatagcttgccactcctttgtgttggtccagttcgagagtcttgatgaagtgttcctgtttagactcatgatgttttgccctagatcatattttgcacttgtggaactttaatatattgtatcttgaattcctctgttgaactcctaagagttatttggttcccatgcccctgttgtgggttgac

SEQ ID NO: 2538 - DNA, 961 bp, Elaeis guineensis
tttttgcctctgcttccctccatcgccgccttcccctttcctccttcccaccggcgaagagaagaaacccttgtcgccatgtctctgatcgcgaacgaggatttccagcacatccttcgtgtgcttaacacgaacgtggatggcaaacagaagatcatgtttgcccttacctccatcaagggtatcggccgccgcttcgccaacatcgtctgcaagaaggccgacgtcgacatgaacaagagggctggggagctctcagccgcagagcttgagaacctcatgacagttgtagcaaatccccgtcagttcaagatcccagattggtttctgaacagaaagaaggactataaggacggtagatactcacaggtggtttcaaatgcgctggacatgaagctgagggatgaccttgagcgcctgaagaagatcaggaaccaccgtggtctacgtcactattggggtcttcgagttcgcggtcaacacaccaagactactggaaggaggggaaagactgttggtgtttcaaaaaagcgatgaagcctctctccacacctgtatgcgttgttttttgggatttcaacgtccaagcagatattagaattctattctctatcaaaggctgaactttcgagggttttcaagcagttttttttttagttacaatcttggtaatttctgggacttcgatgtgttttttctgttgtggtgttgtgagctaagtttgctgctcatttttaatgtccaacagtcttggtgagctcataaggttttaattccattttggaagcttgttttgctaagcattggttctggacaagttgacaatgttagccactgagtagcttgtttccagtgaatcatgttatgataggtttggtggaacaaaagttcttatttgatgtgattatgaccatttgcttctggcgcacggagaggaaggaaccatttgggctcaaattgg

SEQ ID NO: 2539 - DNA, 819 bp, Secale cereale
cccctcgcgccgccgccgccgccgccgacgccgactgcagccatgtcgctgatcgcgggcgatgagttccagcacatcctgcgtgtgctcaacaccaacgtcgacggcaagcagaagatcatgttcgcgctgacctccatcaagggcgtgggccgccgcttctccaacatcgtctgcaagaaggccgacatcgacatgaacaagagggccggagagctctccgcggaggagatggaccgtctgatggcggtggtgcacaacccgcgccagttcaaggtgcccgactggttcctcaacaggaagaaggactacaaggacggcaggttctcccaggtcgtctccaacgccgttgacatgaagctcagggatgaccttgagcggctcaagaagatcaggaaccatcgtggtctgcgtcactactggggcgtgcgtgtccgtggtcagcacaccaagactaccggcaggagaggaaagactgttggtgtctccaagaagcgataagctgctttgcaaagatgccgcatagctttgccactactgtgttggtccatttccagaatcttaatgagtgttaccttggatgatgttttgccctagataatgttttggttctggacctttaatattgtagagtttgttttgccatgggctcgagtcatttgaatggttggcaacatcatgtctgttctaagcatatgtgtgcattacaggtttgttggctaattgaatcctggtatatttttgggcgtgccattctagttgtgggtgtaatttgtggcattgtgtacctggacatttttgataaagaataatctgaca

SEQ ID NO: 2540 - DNA, 891 bp, Zea mays
cccatctactataaaggtcaccccgcgacgcggccccctagaggacaaaccctaccccgcgcagccgcagccttttgccgcgtcggacaccggtgcgtgctcgagctccaccagtcgctgccgccatgtcgctgattgcgggggaggactttcagcacatcctgcgtttgcttaacaccaacgtggatggcaagcagaagatcatgtttgccctcacctccatcaagggtgtcggccaccatttctccaacatcgtctgcaaaaaggccaacatcgacatgaacaagcaggctggtgagctatcctagatgagcttgagcgcctcatgactgtggttgccaaccctcgccagtttaaggtccttgactggttcctcaacaagaaggactacaaagatggtaggttctctcaggttgtttccaatgccctcgacatgaagctcagggatgaccttgagaggctcaagaagattgggaaccaccgaggtctccgtcactactagggcctgcgtgtccatggccagcacaccaagactactggaaggcgtggaaagactgttggtgtgtcaaagaagagataaactccttgaggcatattgatgcctatcttgggagtttggtgagtatgtggaaaatttgcgctttgttatgccaataggatgtttattatctgtaggatagatgatatgttctagtttacaaggcttctatgtatattgtagcaatcttttgatgcctgtgttccaagcgagttgtgagttgaatgcttgatagtgcttcctttgtgtcgtgctttgttgggggatattttgcatgaagttttgatacatcatctgttttcgatttttgtttgttcctgcttcgattcagaaattgagtagtttttcaacct

SEQ ID NO: 2541 - DNA, 752 bp, Festuca arundinacea
  misc_feature (64)..(64): n is a, c, g, or t
  misc_feature (254)..(254): n is a, c, g, or t
  misc_feature (275)..(275): n is a, c, g, or t
  misc_feature (636)..(636): n is a, c, g, or t
ggcacgaggcgcgaacgccaacctcctctttctgcccccgtgagccccagccgccgccgcagcngccgccgacgccgactgccgccatgtcgctgatcgcgggtgaggagttccagcacattctccgtctgctgaacaccaacgtcgatggtaagcagaagatcatgttcgcgctgacctccatcaagggtgttgggcgccgcttctccaacatcatctgcaagaaggccgacatcgacatggacaagagggcnggagagctcacaaccgagganatggaccgggtgatgacggtgttgcagaacccgcggcagttcaaggtgccggactggttccttaacagaaagaaggactacaaggacggcaagttctcccaggtcgtctctaaccagcttgacatgaagctcagggatgacctcgagaggctcaagaagatccgtaaccatcgtggtcttcgtcactactggggtgtccgtgtccgtggtcagcacaccaagactaccggcaggagaggaaagactgttggtgtctccaagaagcgataagctttaactgacacacatagattgccactacttctgtgctggtccatttcgggagtcttaatgaggtgttccctgtttagacaattacctnggacgatgttttgccctagatcatattttgcagttctggaactttaatatattgtatcttaaattcctttttgaacacctaaagagtaattttattccgccgcccttgttgtgtgc

SEQ ID NO: 2542 - DNA, 752 bp, Zingiber officinale
  misc_feature (28)..(28): n is a, c, g, or t
  misc_feature (40)..(40): n is a, c, g, or t
  misc_feature (42)..(42): n is a, c, g, or t
  misc_feature (58)..(58): n is a, c, g, or t
  misc_feature (61)..(61): n is a, c, g, or t
  misc_feature (71)..(71): n is a, c, g, or t
  misc_feature (147)..(147): n is a, c, g, or t
  misc_feature (189)..(189): n is a, c, g, or t
  misc_feature (207)..(207): n is a, c, g, or t
  misc_feature (249)..(249): n is a, c, g, or t
  misc_feature (270)..(270): n is a, c, g, or t
  misc_feature (399)..(399): n is a, c, g, or t
  misc_feature (411)..(411): n is a, c, g, or t
  misc_feature (480)..(480): n is a, c, g, or t
  misc_feature (489)..(489): n is a, c, g, or t
  misc_feature (510)..(510): n is a, c, g, or t
  misc_feature (519)..(519): n is a, c, g, or t
  misc_feature (541)..(541): n is a, c, g, or t
  misc_feature (546)..(546): n is a, c, g, or t
  misc_feature (558)..(558): n is a, c, g, or t
  misc_feature (584)..(584): n is a, c, g, or t
  misc_feature (633)..(633): n is a, c, g, or t
  misc_feature (637)..(637): n is a, c, g, or t
  misc_feature (644)..(644): n is a, c, g, or t
  misc_feature (652)..(652): n is a, c, g, or t
  misc_feature (661)..(661): n is a, c, g, or t
  misc_feature (672)..(672): n is a, c, g, or t
  misc_feature (676)..(676): n is a, c, g, or t
  misc_feature (687)..(687): n is a, c, g, or t
  misc_feature (697)..(697): n is a, c, g, or t
  misc_feature (743)..(743): n is a, c, g, or t
gcacgaggattcttcctcccgacgcacntgtgcgagagcngnagaagggcgaggaganagnacctagtcgncgacgtcgccatgtcgctggtcgcgaacgaggatttccagcacattcttcgtgtgctcaacaccaacgtcgatggnaagcagaagatcatgttcgcactcacctccatcaagggtatnggccgccggtttgctaanattgtttgcaaaaaggccgacgtcgacatgaacaaaagagcnggagaactctcagctgctgancttgagaaccttatgactgtggtggccaatccacgccagtttaagatcccagattggtttctgaacaggaagaaggactacaaggatggccgatactcccaggttgtttccaatgccctggacatgaancttagggatganttggagcggctgaagaagataaggaaccatcgaggtcttcgtcactactggggccttcgagttcgcggncagcacacnaagactaccggccgaaggggnaaaactgtnggtgtctccaagaaaagatgancttcnactggtgctctngtcacacttctacatttcaatttcgntttcatgatgtctgctgctttgcagctcaacgtgctatatttatgtttnagantctaccngcatggtngtgtttggntgaatagattnttanaactattttanaacaatcganttgaagtgtaatttgttttccttattaattataaatgtttttattnggataaaaa

SEQ ID NO: 2543 - DNA, 697 bp, Zingiber officinale
  misc_feature (51)..(51): n is a, c, g, or t
  misc_feature (54)..(54): n is a, c, g, or t
gcttgtgcgagcggtgtggcagcagcggcgaggcgagaaaccctagacgtngangtcgccatgtcgctggtcgcgaacgaggatttccagcacattctccgtgtgctcaacaccaatgtcgatgggaagcagaagatcatgttcgccctcacgtctatcaagggtatcggccgccggttcgccaacattgtttgcaaaaaggccgacgtcgatatgaacaaaagagctggtgaactctcggctgctgagcttgagaaccttatgactgttgtggctaacccacgccaattcaagatcccagattggtttctgaacaggaagaaggactacaaagatggccggtactcccaggttgtgtcaaatgctttggacatgaagctaagggatgacttggaacggctgaagaagataagaaaccaccgaggacttcgacactactggggcctccgagttcgtggtcagcacacaaaaactactggaaggagggggaaaactgttggtgtctccaagaagcgatgagcttgaacttgtttttctgtttctgcatgttatagtttccattggatctttttttccatgtcaggtttgcgtggagcttgtgtctgcgttacttgttcgcatcatctttgtttcttttgataattttgggttgtcgaactatgtgagaataatgtttatgttggtaggtgagtttgat

SEQ ID NO: 2544 - DNA, 810 bp, Elaeis guineensis
cttcggcttcgcttgttctcataccccggcccgccttgctttccttctgttcggcctgcgcgcgaggcgagggagaaagggaaaggaaacctgccgtagccgccgtcgccgtctccgccgtcatgtcgctgatagcgaacgaggatttccagcacatccttcgtgttctgaacacgaacgtagatggcaagcaaaagatcatgatcgcccttacctccatcaagggtatcggccgccgattcgccaacatcgtctgcaagaaggccgacgtcgacatgaacaagagggctggtgagctctcagctgctgagcttgagaacctcatgacggttgttgccaaccctcgccagttcaagatcccagattggttcttgaacaggaagaaggactacaaggatggtcggtactcgcaggttgtctccaatgctttggacatgaagctgagagatgatttggagcgactgaagaagataaggaaccaccgcggtttgaggcactactggggtcttcgagtccgtggtcagcacacaaagactactggcagaaggggaaagactgttggtgtgtcaaagaaacgatgagcttagccttctatttctgctttcgatgttctaattttgaaccttgaggtctggtagtgaatttttttttcccattatgcctggatgtgaaactactcatggatatttttggataacagttttgaattttgataactaaaatattatcaatgtgcttgccgtgataatgacaatttggtcaactttgtttggttaaaaaaaaaactaagtagactagtccaacggacga

SEQ ID NO: 2545 - DNA, 671 bp, Phalaenopsis aphrodite
attacactatcacatatataacataaagctcaagtcgaagctaggaattgtccaaaaccctagcggcggctgtctgcgaggagacggtacagagaaacagcagctttgggttgcaagagaaagctagcagccatgtctctcatcgcgaacgaggattttcagcatattcttcgcgttcttaacacgaacgtggatgggaagaaaaagatcatgtttgcgctcacctccatcaagggtattggccgccgatttgccaacattgtttgcaagaaggccgatgtagacatgaacaagagagctggcgagcttacagcagcagaactggagaatttgatgacgattgtagcaaatccccgtcagtttaaaattccggactggtttttgaacaggaagaaagactacaaagatgggagatactctcaggttgtgtctaatgctttggacatgaagctcagagatgatctggagcgtttgaagaaaatcaggaatcatcgtggtctacgtcactactggggtcttcgtgttcgtgggcagcacaccaaaacaaccggcaggagggggaagactgttggtgtttccaagaagcgataagctttatttcatctgctttctatagcacaccaaaacccaagcatgtcttcaatcttcgaacattcaatcacattttgttt

SEQ ID NO: 2546 - DNA, 789 bp, Phalaenopsis aphrodite
ctattctcatttttttgttactatcttggtggtgcagacggcggaggggagcggaaaccctagcatttggaaaatttttgaagcagagaaaaaatgtctctaatcgcgaacgaggatttccagcacatccttcgtgtgctgaacacgaacgtggatggtaagaagaagatcatgtttgctctcacctccatcaagggtatcggtcgccgttttgccaacatcgtctgcaagaaggccgatgtcgacatgaacaagagagctggtgaactgtctgctgctgaacttgagaatctcatgactgtagttgcaaatccacgtcaattcaaaatcccagattggtttttaaatagaaagaaggattacaaggatggtcggtactcacaagtggtttcaaatgcattggacatgaaactgagagatgacctcgaaagattgaagaagattagaaatcatcggggcctgcgtcattattgggggcttcgtgttcgtgggcagcacacgaagactactgggaggagaggaaagactgtcggcgtgtcgaagaagcgttgatcctccacctcattgctgctctgcttctgctgcattgttatgttgtctctccattggagcttgaaactaaaattttgggtgacttgaaaaatctttttgaagtatttacttttcatgtagttttgcatcattatattactattttaaggatatattgattctcttatttgttctctttttattataaagctttctgatcaatattattatagctgtttattgcaagaaatattattt

SEQ ID NO: 2547 - DNA, 762 bp, Ananas comosus
agagagagagagagagagagagaaggggagcagcgaaagggcgagaaccctaaccctagcttcgtcccttccaccatgtctctgatcgcgaacgaggatttccaacacatccttcgtgttcttaacacgaacgtcgatgggaagcagaagatcatgttcgcactcacctccatcaagggtgtcggccggcgcttcaccaacatcgtctgcaagaaggccgacgtcgacatgaacaagagagccggtgagatttcagctatggagcttgagaaccttatgactattgttgcgaatccccgccagttcaagattccggattggttccttaataggaagaaggattataaggatggccggtattctcaagttgtttccaatgctttggacatgaagctgagggatgatctggagaggctgaagaaaattagaaatcaccgtggcttgcgtcattactggggtctccgtgtccgtggacagcacacaaagactaccggtaggaggggaaagactgttggtgtctccaagaagcgatgagcctatcctcctttctctacattacgctgtgttctgatcatattgctttcgaactttgaggtttcattgagatcctgtgtttggttattttatgaattttgtgatggattagctttttgatttgaggcaacggtttaaatagttcatggaaccaacaatgttcttattctgtgtttccagcgtctttgatcagaaagagtttcattacttcctaggtttttgaatgat

SEQ ID NO: 2548 - DNA, 791 bp, Papaver somniferum
cgaggtggttctactcaagatcccttcaacagatctctacataaaaagaaagcaaaacaatgtctttggttgcgaacgaagattttcaacacattcttcgtgtgttgaatacaaatgttgatggaaagcaaaagattatgtttgctatgacttctattaagggtattggtaggagatttgccaatattgtctgcaaaaaagctgacgtggatatgaacaagagggctggtgaactctctgtagcagagttggagaatctgatgacaattgttgcaaatccacgtcaattcaagattccagactggtttttgaacagaaagaaagattacaaggatggaagatactcccaggttgtatctaatgctcttgacatgaagctgagagatgacttggagcgtttgaagaaaattaggaatcatcgtggtttgaggcattactggggtctcagagtccgtggtcagcacaccaagactacaggtcgcaggggtaagactgttggggtctccaagaagcgttgaagactggttgttgttctttttgatccgtacagtgagaagttggtctttctgagacagacttttaatcttgatactagtatagtttaggcttttgaacatcttgtgctattaatgtcttgtgtttttttatcctagttttgagaattaaagcgagtgagtatgaattacagaaatctgaaacaaaatgttttaccttgggatttcttgtatttggctatcttattgaaacattgcagcccagaaagcagggaaattggatttgcattggctggt

SEQ ID NO: 2549 - DNA, 985 bp, Papaver somniferum
gtcttgtaaactaaagaagaaaaccctttcgacgcttttgtgaggtagttctactcaagatcccttcaacagatctctacataaaaagaaaacaaaacaatgtctttggttgcgaacgaagattttcaacacattcttcgtgtgttgaatacaaatgttgatggaaagcaaaagattatgtttgctatgacttctattaagggtattggtaggagatttgccaatattgtctgcaaaaaagctgacgtggatatgaacaagagggctggtgaactctctgtagcagagttggagaatctgatgacaattgttgcaaatccacgtcaattcaaaattccagactggtttttgaacagaaagaaagattacaaggatggaagatactcacaggttgtatctaatgctcttgacatgaagctgagagatgacttggagcgtttgaagaaaattaggaaccatcgtggtttgaggcattactggggtctcagagtccgtggtcagcacaccaagactacaggtcgcaggggtaagactgttggggtctccaagaagcgttgaagactggttgttgttctttttgatccggggagttcgtacggtgagaagttagtctttctgagacagacttttaatcttgatactactatatagtttaggcttttgaacatcttatcctagttttgagaattaaagtgagtgagtatgaattacagaaatctgaaacaaaatgttttaccttgggatttcttgtatttggctatcttattgaaacattgcagcccagaaagcagggaaattcgatttgcattggctggtttatctaaaaatcttagtttcagtatgaccaagttcgaacagcagtgctaatatgtaggttatgattagggtccaaacttattttgttagtatatcctcctttcatactaaagaaggtgaaaactcgcaggtttgtccaatatattcagaatagttatgactgtaaaaa

SEQ ID NO: 2550 - DNA, 667 bp, Papaver somniferum
gttcgaagctcccccagagagaagaagaaagagttccactcgagatcccttcaacaaaatgtctttggttgcaaacgaagattttcaacacattcttcgtgtgttgaatactaacgttgatggaaagcaaaagattatgtttgctatgacctcaatcaagggtattggtaggagatttgccaatattgtctgcaagaaagctgatgttgacatgaacaagagggctggtgaactatctgcagcggagttggagaatttgatgacaattgttgctaacccacgtcaattcaaaattccagactggtttttgaacagaaagaaggattacaaggatggaagatactcacaagttgtatctaatgctcttgacatgaagctcagagatgatttggagcgtttgaagaagatcaggaaccatcgtggtttgaggcattactggggtctcagagtccgtggacagcacaccaagactactggtcgcagaggtaagactgttggtgtctccaagaagcgttgaagactggttgttattcttttgatcggagaagttcttgtggtgagaagtttgtcattgtgctttatagttggaacctagaaggacttaaattatgatactagtatagttttaggattttgaatattttggaattttaatgtcctgcatttt

SEQ ID NO: 2551 - DNA, 699 bp, Papaver somniferum
agatataatgcataatgtgtagtggtaaaactcggaatacccttttttcagaagattttttagaagatcttggaagctcctctgagacaaagagttccactagagatcccttcaagaaaatgtctttggttgcgaacgaagattttcaacacattcttcgtgtgttgaatactaatgtcgatggaaagcaaaagattatgtttgctatgacctctattaagggtattggtaggaggtttgctaatattgtctgcaaaaaagctgatgtggatatgaacaagagggctggtgaactctctgcagcagagttggagaatctgatgacaattgttgcaaatccccgtcaattcaaaattccagactggtttttgaacagaaagaaagattacaaggatggaagatactcccaggttgtatctaatgctcttgacatgaagctgagagacgacttggagcgtttgaagaagattaggaaccatcgtggtttgaggcattactggggtctcagagtccgtggtcagcacaccaagactacaggtcgcaggggtaagactgttggtgtctccaagaagcgttgaagactggttgttattctttttgatctgggaattcgtacggtgagaagttagtctttctggtgtggagttggaacctagaaagactttttatcttgatactagtatagtttaggcttttgaa

SEQ ID NO: 2552 - DNA, 735 bp, Vigna unguiculata
gggagcaacgataggaggggtggcacagaactccgaaaccctattgtacaaatccctaatctacataggtcaagagcttcagcgaagaaaatgtctgtggtggcaaacgaggatttccagcacattctgcgtgtgctgaacacgaacgtagatggtaagcagaaaataatgttcgctcttacctcgatcaaaggtattggcagacgattcgctaacattgtctgcaaaaaagccgatgtcgacatgaacaagagggctggtgaattgactgctgcagagttagataatcttatgactgtggttgccaacccaaggcaattcaaggtcccggattggtttttgaacagaaagaaggactacaaggatgggaaatattctcaggtggtttcaaatgctctggatatgaagttgagggatgatttggagcggttgaagaaaatcagaaatcaccgtggtttgaggcactactggggtcttcgtgttcgaggtcagcataccaagacaactggtcgcaggggtaaaactgttggtgtctctaagaagcgttaagctgttacattttatctattatgaggattcatattgttattgaagcaaattttgagttttgttttgtcgtgtccctataaaaacataaatttctattgcttgtttagtgttatgctttcaatattcttttgtactttacctgtctggtcgtgttgagatatatattatataaggagattgatttta

SEQ ID NO: 2553 - DNA, 675 bp, Ipomoea nil
ggaaccccaaccttcgttcacagttcaggcatacagttcagcggagagcgagagaggggagagaaagccataatcatgagtctggtcgcgaacgaggatttccagcacattttgcgtatcctgaacaccaatgtcgatgggaagcagaagattatgtttgctatgacttccatcaaaggtattggtcgccgcttcgccaatatctgctgcaaaaaagccgatatcgacatgaacaaaagggctggggaacttactgctgctgaaattgataacttgatgaccgttgttgcaaaccctcgccagttcaaggtccctgactggtttttgaacaggcagaaggactataaggatggtaactattcacaggttgtctccaatgcattggatatgaagcttagggatgaccttgaacgcctgaagaaaatcagaaaccaccgtggtctccgacactactgggggctccgtgtacgtggacagcacaccaagacaactgggcgtaggggaaagactgttggtgtctcgaagaagcgttgattttggttgcattcgaatcatggatggttttgttttagaatatatttatatcttttatttgtgatattagtatttagtactagtactttttaaagctaaaagcatgagcttccatgtttttgtcaagcaggcatgatttca

SEQ ID NO: 2554 - DNA, 774 bp, Liriodendron tulipifera
  misc_feature (159)..(159): n is a, c, g, or t
ggcattttcgcagggaggctccagcaaaagctccttcttctcggcgaaaaaatgtctctgatcgcgaacgaagatttccagcacattcttcgtgttctgaacacgaacgtcgatggaaagcagaagatcatgttcgctctgacctccatcaaaggtatngggaggcgtttcgccaacatcgtatgcaaaaaggccgacgtcgacatgaacaagagggctggtgaattatctgcagcagaacttgagaacctcatggtgattgttgccaatccccgacagttcaagattccagactggtttttgaacaggaagaaggattacaaggatgggaggtattctcaggttgtctcaaatgcattggatatgaagttgagagatgatttggaacgactgaagaagatcaggaaccatcgtggtctgaggcactactggggtctccgtgtacgtggtcagcacaccaaaaccacaggccgcagaggaaagactgttggtgtctccaagaagcgttgagtgccttttcttctcttcttttttcaatcaaccatgttagattggcccggtgagttgtattttgagttttagaactgtttagtcagttgccgttccttcgtgtttttattttacagctcagtttgagctgtgttctagtttttgcaatatttggatcgattaactgaatttctatttccctatggacccaagttattagcggattatgatgggtgaaaatctaaagataaaaagaagtattttggaaaaaaaaaaaaaaaaaaa

SEQ ID NO: 2555 - DNA, 772 bp, Liriodendron tulipifera
gtactttcaacaagcagctgcgaggcgtcaacctctccctctctctctcaaacatgtctctgatcgcaaacgaagatttccagcacattcttcgtgtcttaaacacgaatgtcgacgggaaacagaagatcatgtttgctctgacctccatcaaaggtattgggaggcgtttcgccaacatcgtctgcaagaaggccgacgtcgacatgaacaagagggctggtgaattgtctgcagcagaactggagaatctcatggtgattgttgccaaccctcggcaattcaaaatcccagattggtttttgaacaggaagaaggattataaggatgggaggtattctcaggttgtctccaatgcgctggatatgaagctgagagatgacttggagcgactgaagaaaatcaggaaccaccgtggtcttcggcactactggggcctccgtgttcgcggtcagcacaccaagacaactggccgcagaggaaagacagtcggcgtctccaagaagcgctgagttctaatttttatatttttctcaactataagattgctgttagatgctcaggtgagaattctacattgagctttcggtcttgtttatgtggtttttatatcgttcctgtttgcatttgtttgagcgacttattcggcattggctaggaagaattcagtataggatgtggttctttgaattggatattttatttcttttttgtctattgctgccattggaatatgactgataaaatctaatatcaaggagcttttggatgt

SEQ ID NO: 2556 - DNA, 751 bp, Avena sativa
gagctgaagacgatcttcgcgcttcgccgctgccacctcctcctcttccagcgagagctccgcccaacgccatcgtcatgtcgctcatctcgggggaggagttccagcacatcctgcgtctgctcaacaccaacgttgatggcaagcagaagatcatgttcgcgctgacctccatcaagggtatcgggcgccgctactccaacatcgtctgcaagaaggcggacatcgacatgaacaaaagggctggtgagcttactactgaagagcttgaccgtgtcatgaccgtggtacaaaaccctcgcttgttcaaggtccctgattggttcctgaacagaaagaaggattacaaggatggcaggtactctcaggttgtttccaatggtgttgacatgaagctgagggatgacctcgagaggttgaaaaagatcaggaaccaccgtggtctgcgtcactactggggtgtccgagtccgtgggcagcacaccaagaccactggcaggaggggaaagactgtcggtgtctccaagaagagataaaccctatgcccattggtcgcagcatgctggcttatcttcattgtctcttgatgtgaaactctagtgccctcgtcagttgacagttttgttcggggttatgtctgcatgtctatgataaaatcatttcttttctggtttatggcactggcaagcgtaattttctgtgtttgtttgcggatttagttgtgctttctgaatggagatagttttgtgct

SEQ ID NO: 2557 - DNA, 802 bp, Arachis hypogaea
tctgcatcttcaatcgcccaagagtttcagcttcggcgccatcaatccttcactctctcccaactcactctccatccaaaatgtctctggtggcgaacgaggatttccaacacattcttcgtgttcttaacacaaacgtagatgggaagcagaaaattatgtttgctatgacctccatcaaaggtatcggaaggcgatttgctaacatctgttgtaagaaggccgatatcgacatgaacaagagagctggtgaactgagtgctgctgagcttgataatctgatgactgtggttgccaacccaaggcaattcaagatcccagattggttcctcaacaggaagaaggactacaaggatggcaagtactcccaggttgtgtccaacgctctcgacatgaagctcagggatgacttggagagactcaagaaaatcagaaatcaccgtggtttgaggcactactggggtctccgagttcgtggccaacacaccaagaccactggccgtaggggaaagactgttggtgtctcgaagaagcgttaaactgttatattttgggttttggaaattagatattgttgaagaggcagacatatgttttacacaccgatgcccttttttggttatatgctctctcttgacaatttcaattttgttggttatttgttttaagcttccatttagttgaattatgatgatattttaagatttatcagacttccgatccaatagtattaagttgcgttttaacagaaagttggcctaacaaaatactttcaaatgattatcgattagtaacagcagtg

SEQ ID NO: 2558 - DNA, 786 bp, Arachis hypogaea
cgggggctattgcgttgcgcagttggaatagcggaggttttagcaaaggaggcgtcgtgcccagctgcgcggagcagagccacatccaacttccttgaatctcccttcattcaaccatgtctctagtggcaaacgaggatttccagcacattcttcgtgttctgaacacaaacgtagatgggaagcagaagattatgtttgctatgacctccatcaaaggtatcggaaggagattcgccaacatctgttgcaagaaggccgatatcgacatgaacaagagagctggtgaattaagtgctgctgagcttgataatctgatgactgtggttgccaacccaaggcaattcaagatcccagactggttcctcaacaggaagaaggactacaaggatggcaagtactctcaggtcgtgtccaacgccctcgacatgaagctcagggatgacttggagagactcaagaaaatcagaaaccaccgtggtttgaggcactactggggcctccgagttcgcggtcaacacaccaagactactgggcgtaggggaaagaccgttggtgtttccaagaagcgttaaattgttatattttggcttttggaaattagatattgttgaagaggcagacaatgtttttacataccaactttgctttttggttgttaaatgctctcttgaccgttttcagttttgtttgttattttctctaagcttctttttagttgaatgaatgatgactctttttacagacatgagacatccacaatccaatagtattgattacattata

SEQ ID NO: 2559 - DNA, 577 bp, Platanus occidentalis
gtattcgaggtattggctctctgtgattgattccgagtcgccaagctccgcctcacccctccaacaatctctgcaaacaaaatgtctctgatcgcgaacgaagattttcagcacattttacgtgttttgaacaccaatgtcgatggaaaacagaagatcatgtttgccctgacctccattaaaggtatcgggaggcgattcgccaacatcgtctgcaagaaagccgacgtcgacatgaacaagagggctggagagctatctgcccaggagctagagaaccttatggtgatcgtggcgaaccctcgacagttcaaaattccagattggtttttaaacaggaagaaggattacaaggacgggaggtattctcaggtggtgtcgaatgcattggatatgaagttgagagatgatttggaacgattgaagaaaatcaggaatcatcgtggcctgaggcactactggggcctccgagttcgtggtcagcacaccaagaccacaggtcgcagggggaagactgttggtgtgtctaaaaagcgatgatcttctcttattcttttattattgaactattaaattt

SEQ ID NO: 2560 - DNA, 773 bp, Platanus occidentalis
agtatagaggtctgggttctccctgattgtttccgaggttccaagatccgctcctcccatccccaacctctgcaacagaatgtctctgatcgcgaacgaagattttcagcatattttgcgtgttttgaacaccaatgtcgatggaaagcagaagatcatgttcgcactaacctccattaaaggtatcgggaggcgattcgccaacatcgtttgcaagaaggccgacgtcgacatgaacaagagggctggtgaattgtctgctgcggagctggagaatctcatggtgattgttgctaaccctcgacagtttaaaatcccagactggttcttgaataggaaaaaggattataaggacgggaggtattctcaggtggtgtcaaatgcattggatatgaaattgagagatgatttggaacggttgaagaagattaggaatcatcgcggtttgaggcactattggggccttcgtgttcgtgggcagcacaccaagactaccggccgcagggggaagactgttggtgtctctaagaaacgttgatcttttcttcttctcatcatttgagggtctttttcctattaaaactgagacctttttgacatggttctcttaatttgattgtttttaagttgtattacactcttaaattgcaagaattgatcataggatgtggattcattaagcaaatctttgctcatcttttgttttaattatatagaattctggcttgctcatctttctttttaattatattgaattcgggcaacagctttta

SEQ ID NO: 2561 - DNA, 800 bp, Platanus occidentalis
gaggcgcttaggtccgctccaccatccaacaatctctgcaacaaaatgtctctgatcgcgaacgaagattttcagcacattttacgtgttttgaacaccaatgtcgatggaaagcagaagatcatgttcgcccttacctccattaaaggtatcggaaggcgattcgccaacatcgtctgcaagaaggccgacgtcgacatgaacaagagggctggtgaactatctgcggcggagctggagaatctcatggtgattgttgcgaatcctcgacagtttaaaatccctgactggtttttgaataggaagaaggattacaaggacgggaggtattctcaagtggtgtcgaatgcattggatatgaagttgagagatgatttggagcgattgaagaaaattaggaaccatcgtggtctgaggcactactggggcctccgtgttcgtggtcagcacaccaaaactacaggccgccggggaaagactgttggtgtctctaagaagcgatgagctttcatttgaactattagattattaggtgagggagggaacttctgttatcagctttcaactgagacgtttttgacattttcttttcctttctccaaatttgattgtttctgtgctgtatgaattaattgcaagaattaattataggatgtggattccctcaaatttatgttcatcaatctttttaaataccaaatggtttttattatgaaatatggcatatacatctcttcaaatgtgaggattggattgtagtgacatcttatgtgcaaatatatggcttgattttaaatttt

SEQ ID NO: 2562 - DNA, 888 bp, Papaver somniferum
ctgttcgaagttcccccagagagaagaagaaagagttccactcgagatcccttcaacaaaatgtctttggttgcaaacgaagattttcaacacattcttcgtgtgttgaacactaacgttgatggaaagcaaaagattatgtttgctatgacctcaatcaagggtattggtaggagatttgccaatattgtctgcaagaaagctgatgttgacatgagcaagagggctggtgaactatctgcagctgagttggagaatttgatgacaatcgttgctaacccacgtcaattcaaaattccagactggttcttgaacagaaagaaggattacaaggatggaagatactcacaagttgtatctaatgctcttgacatgaagctcagagatgatttggagcgtttgaagaagatcaggaaccatcgtggtttgaggcattactggggtctcagagtccgtggacagcacaccaagactactggtcgcagaggtaagaccgttggtgtctccaagaagcgttgaagactggttgttatggtgagaagttgttatggtgagaagtttgtcattctgctttaaagttggaacctagaaggacttaaattatgatactactagtatagtgtaggattttgaatatcttggaattttaatgtcctgcatttttcttactgaaatctgcgaccacattttgatatgggaacttctttgtatttggcttttttaagtgttaacagttgatatgctgcaccaaaatctggaaatttgatttgttttgattgttctcttttcaagttcagctttagtttctcagttttaaccttgtatcagaaaaaccttcttgcgatgcatgtttagtttcatgactgagtaatgcagtcaatttgattt

SEQ ID NO: 2563 - DNA, 832 bp, Phalaenopsis aphrodite
ctgtctgcgaggagacggtacagagaaacagcagctttgggttgcaagagaaagctagcagccatggcgaggacacaccttttcttacttgcgatcatcgaagctttcttatttagtctttgcttgccagttttttctctttcaaattcgctagttcttattttatctatttaatttcagtctctcatcgcgaacgaggattttcagcatattcttcgcgttcttaacacgaacgtggatgggaagaaaaagatcatgtttgcgctcacctccatcaagggtattggccgccgatttgccaacattgtttgcaagaaggccgatgtagacatgaacaagagagctggcgagcttacagcagcagaactggagaatttgatgacgattgtagcaaatccccgtcagtttaaaattccggactggcttttgaacaggaagaaagactacaaagatgggagatactctcaggttgtgtctaatgctttggacatgaagctcagagatgatctggagcgtttgaagaaaatcaggaatcatcgtggtctacgtcactactggggtcttcgtgttcgtgggcagcacaccaaaacaaccggcaggagggggaagactgttggtgtttccaagaagcgataagctttatttcatctgctttctatagcacaccaaaacccaagcatgtcttcaatcttcgaacattcaatcacattttgtttgtttttcaacttgattatttggatttttgtttttgggtataaaatgtgtgttttaacctagacccactttgattaagtcttcagtactatttctgttgatcttgaattggaattaa

SEQ ID NO: 2564 - DNA, 769 bp, Papaver somniferum
cttgtacttcctttactccctccccgaagagagaacagtaaactatcaactcaattccgctggttaaacaaaaatgtctctagtagcaaatgaagattttcagcacatattgcgtgtgttgaacacaaacgttgatggaaaacaaaagataatgtttgcaatgacatcgatcaaaggtatcggtagacgatttgctaacattgtctgtaagaaagccgatgtcgacatgaacaagagggctggtgaattatctgctgctgagctagagaatctcatgacaattgttgctaatccacgccagttcaaaatcccagactggtttttgaataggaagaaggattacaaggatggaagatattctcaggtggtgtctaatgctttggatatgaaactcagggatgatttagagcgcttgaaaaagatcagaaccatcatggtttgaggcactattggggtcttcgtgtgcgtggtcagcataccaagacaactggtcgccgaggaaagactgttggtgtctccaagaaacgttgagtttgttcttttttttccttttctttttgaactaaaaatccaagggtattgttcttttttgttctggggccgaagatcttttggtaggttcatgctattttgttttggttggcatcaactgaaccttttctaaatagtgccctgtaactgttagtttgtttggatgatggatagtgtcatatctaacgaaacttcattccttttactgaaggctattagttctatctattctatttct

SEQ ID NO: 2565 - DNA, 682 bp, Acacia harpophylla
gagactgaaggagctgcggttattatatcttcgaactgggcactgccgcatacctgaatctcagcttccaagatgtctctggtagcgaacgaggatttccagcacattcttcgtgttctgaacacaaacgtcgatgggaagcagaggattatgttcgctatgacctctatcaaaggtattggcaggcgattcgctaacatttgctgcaagaaggctgatattgacatgaacaagagggccggtgaattgagtgctgctgagttggataatcttatgaccgtggttgcgaaccctaggcagttcaagattccagattggtttttgaataggaagaaggattacaaggatggcaagtattctcaagttgtatcaaatgctttggatatgaagttgagagatgacttggaaaggctgaagaaaatcaggaaccaccgtggtttgaggcactactggggtcttagagttcgtggtcagcacaccaagactactggacgtaggggcaagactgttggtgtctctaagaagcgttgagctcttgcttttagtgatttactacttgttttaaagaaattagatatgtgatcggataatcaagtaatttttggttttggaatgcagttgaattttgtttatgtttgaacgtgagcctgttactactagccatttaatatgaactctttat

SEQ ID NO: 2566 - DNA, 815 bp, Amorphophallus konjac
cggccgggggcactccctcgagccggcgcccgcttcctcctccttccctgtctcctgcccgcgaagcagagcggatcggagatcaaaaccctagccgccgaaatgtctctgatcgcgaacgaggatttccaacacatcctgcgtctgatgaacaccaacgtggatggcaagaggaagatcatgttcgccctcaccgccatcaagggtatcgggcgccgcttcgccaacatcgtctgcaagaaggcggacgtcgacatgaacaagagggctggtgaactctcagctgctgaacttgagaatctgatgacggtcattgcaaacccacgtcagttcaaaatccctgattggtttctgaacagaaagaaggactataaggatggcaggtactctcaagttgtttccaatgccttggacatgaagctgagagatgacctggagcgcctgaagaagatcaggaaccaccgtggtctgaggcactactggggtcttcgtgtccgcgggcagcacaccaagaccactggtcgtcgggggaagactgtcggtgtctccaagaagcgataaatttccgcatggtttttttgttatcgctgtcatcatggtcaaggaccatctcgagctatagggacttgggttttcctgttcatttcttgagctctgatgtcgcagtatttttgttatggagacgttgatcatggagacgacgtaggatttgttatcattttgacttcaataccgaggtttgcttttatggcgcatctatgttcatgtggatttaagctatcgaaagtattaatatagtgtttggatgcattttt

SEQ ID NO: 2567 - DNA, 961 bp, Aristolochia fimbriata
aggtaaaagaaagcaaaaccctcgaaccggcagataaaagggctttaaaaccctaccttgagatacttcgcggcctttttgttttccctgatcaccggcgagaagctccagacccttgtgtctatcggcgagcgtcgcaaagatgtctttggtcgcgaacgaagattttcagcatatattgcgtgttctgaacaccaatgtcgatggcaagcagaagatcatgttcgccttgacttctatcaagggtattggtagacgttttgccaatatcgtctgcaaaaaggctgatgttgatatgaacaaacgagctggcgaattatcggctgcagagctggagaatttgatggttattgttgccaatcctcgccagttcaaaatcccagactggtttttgaacaggaagaaggattacaaggatgggaggtattcacaggtagtatccaatgctctggatatgaagttaagagatgacttggagcggctgaagaagatcagaaatcaccgtggtctgaggcactactggggtctccgtgttcgtggccagcacaccaagacaacaggccgcagaggaaagactgttggtgtgtccaagaagcgttgagcgcttttccatgtggcaacttccttgcgagtgtgtcaaaatttgagtcttctaaggatttcatttacatggtttctttttggtagtaaacttctaagctgggaacagatacaaattagccagggtctgatactattttgtttgaccggatatcctcgttaattacaagttggtttcgatcctattataagaacgagtctttaccaagttgttgggccaaaggtaaaatcgcagcaaccttaacttaaaaagaaggttgatatctgaagttagctctctacatacggaaacctccgttttctctcgcgattaaccatttcaatgctctgatctttgggaaatggtactaatttttttggt

SEQ ID NO: 2568 - DNA, 722 bp, Persea americana
ggatatacttctcttgatcttttgcaaggccgccccagtctccctctccctctccctgagtttcactcgctctcgcaaaaatgtcgttgattgcgaatgaggaatttcagcacattctgcgtgttctgaacaccaatgtggacggtaagcagaagatcatgttcgctctcacctccatcaaaggtatcgggaggcgttttgctaacctcgtctgcaagaaggctgatgtcgatatgaacaagagggctggtgaattatctgcggctgaattggagagtctgatgacgatcgtggcaaatcctcgccagttcaagattccagattggtttttgaacaggaagaaggattacaaggatggcaggtattcacaggtggtctcaaacgcactggatatgaagctgagagatgatttggaacggctgaagaaaatcaggaaccaccgaggtttgaggcactactggggtctccgtgttcgtggacagcacaccaagactacaggtcgcagagggaagactgttggtgtctccaagaagcggtgaaaaacttctgtttgtcttcttcaaaatagctatgttggtcatttggtgagagttctatttcgaattttgagataatttgatatgtttttatggattccaagcttctgttaggatttagtaccctaagtattacagtagtttgaagtaaaatggcaacttttcctttgcttgtactcggaattg

SEQ ID NO: 2569 - DNA, 799 bp, Beta vulgaris
attctcacttgtgcgttttgagcctccaccaccaaagagagagagaacaccgcccctcggaacttcacatcgcatctgcaaaaatgtctttggtggctaatgaagaatttcaacatattttgcgtttgttgaacacaaacgttgatggtaaacagaagatcatgtttgccatgacttcaatcaaaggtattggtcgtcgttacgccaatatttgctgtaagaaggctgacattgatatgaacaaaagggctggtgagcttactgctgcagagctcgacaatttgatgacagttgttgcaaaccctaggcaattcaaaatcccagactggtttcttaacaggcaaaaggattacaaggatggcagatttagtcaggttctttctaaccaacttgacatgaaactcagggatgaccttgagcgtctgaagaagatcagaaaccaccgtggactacgtcactactggggtctgagagttcgtggacaacacaccaagactaccggacgtaggggaaagactgttggtgtctcaaagaagcgttaaggattatggatcttttactacaaattatcatgtcttcttttgttttatgaaaacctagtcttgagaatgatacaagtaatgctgttttggccaattgaggcagttgatgttatttttgtagatcagagcttccaactcttgatactttagttgagagaaggtatgcttgtagactttgcgttagtagtgagtaaaatacttagtcgtttaccatgcggctttatttgaactttgaagtcatgaatttctttgtttaa

SEQ ID NO: 2570 - DNA, 2529 bp, Beta vulgaris
ctgttaatgtcctttagaaacaaaaccaaaaccatgaatcctctttttataagagaaaaacagacataaaacattaaccactcaaaaaacacaaccattcattttctctctcctccatggacgaaatcttcggcccattccacatccctcaacaaagcagacgacacaaactccgctaccatcatcaaaacgacgacgttatcatccctaaccataattttctctctcctcttcaactccagcaagctacttcatcttcatcatcacctttagtggacccactaatggcgtccactaatctttctttatcatcctcaactcacgcgcgcgcgtaccatccttgtccagtgggcccatttacgggctacgcttccattttggcccgatctaggtttcttcggcccgcccaagatcttctcgacgaattctccgccactaatggtgtttctttccagaaacatagtcttaagattctagaagattctggaaccttgttttgtgacgatgatcataatcatgcttcacttcgatctactcatcctaacctcgtatcaatgcttcatgaggtttacaagagatataaactgtactgccaacagatgcaatcagctgtttcatcattcgaatctgtagccggccttggaaatgcagctccatttttatgttttgctgtcaaagccatgtttaagcactttcaatgcttaaagaatgctattcttgatcatattcgtgttacgagtaaagcttttagtaatgtagacactaggagagatcctacttcaggttcctgcgctgaggacaaggctccagcttctaatttttgccacatcctgtttggcgatctcaaagaggatttcctgataaagcagtagctgttctaaggaattggctatttgaacactttctacacccttatcctagtgatacagacaagcaaatgttggcgcagaagactggtctatcaagaagtcaggtatctaactggttcacaaatgcaagagttaggctatggaagccaatggtggaagaaatgcacgcgcttgagagaaaatctcaatgctctaaggcagcagatactcggaaattcatcactttatcaactgatcataatcatcaaacttcactacatcctctactatctgagaaagatttccagatttcatactcacaacataaagatcaggataataataataacagtcaatataagcggagtaggatagaagcttttccagtagccgagcaagggaaggaagaacaacatttcggcatgctttgcaaccgtcttccaagcaaccaagtccttggtgttggaggaagccaaactggagcacatcttaaccattcttccagattgagcaacgatcacgaaaatacaaatgggttatcttgggctaatcatggccaaattgtaccattttggcttgccaaacaatgagattcatggatttattaggattcaatcttggtgcttgatcgaaagtgcattgtggggactattgtatgaacttggtgaagtatctacctgaagtcctgaaattatttgggtttgggattcagagtgcgcaaaaatgtggtgaacgcataggccgtagttcgaggggtaaaagatgtgcatgttacgcattgtaaaatataacccatagtattgcatgttcatcttcctttacgcacgaaaccttgtaatttgcttcttgtactaattgggaagactacttctggcaaaaaaaaaaaaaaaaaactcaagactagttctctccctcgtgccgaattcggcacgagggagaaaatcaacagcttcggagctacatccacgcccatctgcgaaaatgtctttggtggcaaatgaagaatttcagcacattttgcgtttgttaaacacaaatgttgacgggaagcagaagatcatgtttgctatgacttcaatcaagggtattggccgtcgttatgctaatatttgctgcaagaaggctgatattgatatgaacaaaagggctggtgagctcactgctgcagagcttgacaatttgatgacagtcgtagcaaatcctaggcaattcaaagtcccagactggtttcttaacaggcagaaggactacaaggatggcagatacagtcaggttctttctaaccagcttgatatgaaacttagagatgaccttgagcgtctcaagaagatcagaaaccaccgtggtctacgtcactactggggtctgagagttcgtggacaacacaccaagactactggacgtaggggaaagactgttggtgtctcaaagaagcgttaaggatttatgtttgcttctctatggatctattactaaaaatttatctctcggttttgtttttttgatcaaaagctagcatgagtctgagaaaagtaatgctgttttggcaaatttatgcagttaaatgttaattttgtagatctcaatttcaacccttgaggcttttgttatgaggaggtatgcttttagactttgcagtggtagcgaggatgctaatgctttttttaccaatttttttttt

SEQ ID NO: 2571 - DNA, 797 bp, Chelidonium majus
cagtaatttgagctcttggctgttggctctcgctggtaggagtttaggagacgccaagatccaccaaccaacaaaatgtctttggttgcaaacgaagattttcagcacattttgcgtgtgctgaacaccaacgttgatggaaagcaaaagatcatgtttgctttgacctccattaagggtattggaaggagatttgctaacatcgtctgcaagaaggccgatgttgacatgaacaagagggctggtgaattatctgctgctgagctggagaatctcatggtgatcgtcgcaaacccccgacagttcaaaatcccagactggtttttgaacaggaagaaggattacaaggatggaagatactcacaggttgtgtcaaatgctcttgacatgaagctgagagatgatttggagcgattgaagaagatcaggaaccaccgtggtttgaggcactactggggtctcagagttcgtggtcagcacaccaagacaactggtcgtagggggaagactgttggtgtgtctaagaagcgttgagctcttgttctactctttgaatgtcagacagcaattaatgtggtagtgaggtttgtgtttctgttacaggttcgagacctacaaagacttcaatcatgatcttagtttaggattgcagatctcttaattcaaatgtggtgttttttcttacttttgagaacaagtgaatatgattagtgaaatccgaaaaccaaaagtttttgatatttgaattatcctgcagggtgtagtagtatttctttttaattggatttttaagtaat

SEQ ID NO: 2572 - DNA, 715 bp, Chelidonium majus
aaccctagaaaaatgtctctcgttgccaatgaagatttccaacacattcttcgtgttctgaacacgaacgtcgatggaaagcagaaaatcatgtttgccctaacttccatcaagggtatcggtcgccgtttcgccaacatcgtttgcaagaaagctgatgtagacatgaacaagagagctggtgaactgtcggctgctgagcttgagaacctcatggtcattgttgccaatcctcgccagttcaagatcccagactggttcttgaacaggaagaaggattacaaggatggtaggtattctcaagttgtttccaatgcattggacatgaaactgagggacgatcttgaaaggttgaagaagatcaggaaccatcgtggtcttcgacactactggggtcttcgagtccgtggacaacacacaaagactactggtcgcagaggaaagactgttggtgtgtccaagaagcgataagttttgttcttcatttcaatggtatcttctgttggaggtttattcctgctgcaaattttggttgtttatgagttacttttgagtctcaagattgtcatattaggaggggaccttctctttgttttgttactggtttgataagttaatggatgtttagtttctttttctttatattggtttttatatattacaatggatcttacttcatttgctcatgacaacacatttgttaaaaaatgagttt

SEQ ID NO: 2573 - DNA, 696 bp, Curcuma longa
gcagaaggaaggtcggagagcgaactcttaactgacgccatgtctctggtggcgaaagaggatttccagcatattcttcgtgttttgaacaccaacgtcgatggaaagcagaagatcatgttcgcccttacctcgatcaaaggtatcgggcgccgcttcgccaacatcgtatgcaagaaggccgaggtcgacatgaacaaaagggctggcgagctctctgctgctgaacttgagaaccttatgacagtcgttgggaatccacgccaattcaagatccctgattggtttttgaacagaaagaaagattacaaggatggaaggtactctcaagttgtttcaaatgccttggacatgaagctgagggatgaccttgagaggctgaagaagataagaaaccaccgtggacttagacactactggggtcttcgtgtccgaggccagcacacaaagaccactggccggaggggaaaaactgttggtgtctcaaagaagcgatgaggtattaatcatctcatggtactcgagcccatctggtgaactctagctttatattcagtattgatcaagattgccaattacttatttggctctttttttatgacaattttgtttgcttaagcttgaatatttgcctacagaattcgtcctagaccaccaatatgttatatgttttatgatattcggatttcaaagggt

SEQ ID NO: 2574 - DNA, 719 bp, Eschscholzia californica
caattttgtagctgctcagagagctttcaatagagagagagagagagaaagagaaaccctaaaaatgtctctcgttgcgaatgaagatttccaacacattcttcgtgttcttaacacgaatgttgatggaaaacagaaaatcatgtttgccctaacctccattaagggtattgggcgccgtttcgctaacatcgtctgcaaaaaggctgatgtagacatgaacaaaagagctggtgagctttctgcagctgagcttgagaacctcatggtgattgttgcaaatcctcgtcagttcaagatcccagactggtttttgaacaggaagaaggattacaaggatggtaggtattctcaggttgtttccaatgcattggacatgaagctgagggatgatcttgaaaggcttaagaagatcaggaaccaccgtggtctacgtcactactggggtcttcgagtccgtggacaacacaccaagactactggaagaaggggaaagactgttggtgtgtccaagaagcgataagtttggactgtcatttctctatggaatcatatcatggatgtctttttcgttttggaaattttgtttggttatgagttactttgaagcataggactgaaatcaagtctcagattgtttgtttaggaatcttcttgtctttgttttgataacaagcttaatgttgagatgcttttatttacatttctatttatgggtt

SEQ ID NO: 2575 - DNA, 875 bp, Medicago truncatula
aactcaaacatcacacaagaaagcagaagagttcagatcttcgccgccgcctacctccctctccctcccatctccccgcaaaatcaacaaacatgtctttggtagcgaacgaagagtttcaacacattctgcgtgtgttgaataccaacgttgatggaaagcagaagatacagtttgctatgacttcaatcaaaggtattggaagaagatttgctaacatttgttgcaagaaagctgatgttgacatgaacaagagagctggtgagttgactgctgctgaattggagaacattatgactgtggttgccaaccctaggcaattcaaggtccctgattggtttttgaacagaaagaaggattacaaggatggcaagttttctcaagttgtttcaaatcaactggacatgaagttgagggatgatttggagcgcttgaagaagatcaggaatcaccgaggtttgagacattactggggtcttcgtgttcgtggacagcataccaagactactggacgcagaggaaagaccgttggtgtctctaagaagcgttaaagtgtttctgtttttgtttgcagaagagaagttatcagggaaagaaagtttaaatttcgtttagacatgtttgcaatgtttcatgtttgttattttctgttacaaaattttgttgtttccatgacctggtgatgagttacatggttttataagttgccaagatgtttaatagggatgttgaaattatttatgtgctttttagtagtgagtttttggaaggagataattgaagtttatctattatattcagatgcacttaatatttttatagcctaaatgcttgtcatagcatatatttgctacttagggctgtttggacaaaca

SEQ ID NO: 2576 - DNA, 686 bp, Carica papaya
aagaacctcttcttctcttttcccctaaagaaaggagcagcctcttctctcaaaacgccaatctcgcgacactgacaatgtctcttgtggcgaacgaggattttcagcacatattgcgtgtgctgaacacaaatgttgacgggaagcagaagataatgtttgctctgacttcgatcaaaggtgtcggtaggcgatttgctaacatcgtctgcaagaaggctgatgttgacatgaacaagagagctggcgagttaactgctgctgagcttgacaatctcatggttattgtagcaaatccacgtcagttcaaaatcccagattggtttctgaacagacagaaggattacaaggatggaaagttttctcaagttgtctctaatgctctggacatgaagttgagagatgatttggagcgcttgaagaagatcaggaaccaccgcggtctgaggcactactggggtctccgagtccgtggtcagcacactaagacaaccggtagaaggggaaagactgttggtgtctccaagaagcgttgagtccttcattactgttctttagcgaggacatctacatgaattggcagagttaactacattaaaatgctcctttttggctactggaaattgtacttaaattctgatgtgattctcccgatttattttattgtccctttgaaaactttcatg

SEQ ID NO: 2577 - DNA, 873 bp, Glycine max
atataaaagggactcgatcccaaaaccctaggtttcagatccttaatcggccaggaccaaacagcatccgcggcagcgacggtaaccctccaacaacaacacttccgctgcgaaaaatgtctctggtggcgaacgaggatttccagcacattctgcgtgtgctgaacaccaacgtggatgggaagcagaagataatgttcgcaatgacctccatcaagggtattggaaggagattcgccaacatcgcttgcaagaaggctgatgttgacatgaacaaaagggctggtgagttgactgctgctgagttggatagtgtgatgactgtggtggcgaaccctaggcagttcaagatcccagactggtttttgaacagaaagaaggattacaaggatggcaaatactctcaagttgtgtctaatgctcttgatatgaagctcagggatgatcttgagagactcaagaaaatcagaaaccaccgtggtttgaggcattactggggccttcgtgtccgtggtcagcacaccaagactactggccgtaggggaaagactgttggtgtctctaagaagcgttaagctattatgtttggcttggagattagattttgttgagaaggaaagtttgaagtacactagacatgttttgcatcataccaactttgtatccgtcgttaaatggcttgacaatttcaattttgtttgttatttgcatcaagattcagtttagttaaatgatgtgttggttttcttagttgtagagaaccctgaatagtattattgaaatattacgaattcagtttgatcctggaagggaaatctcgccttttccaatactatattagtaaataaattaggagacaaattgaatttggtt

SEQ ID NO: 2578 - DNA, 896 bp, Glycine max
caaaaccctagcgtagtcgcagcacacactatataaaagggactcgatcccaaaaccctaggtttcagatccttaatcggccaggaccaaacagcatccgcggcagcgacggtaaccctccaacaacaacacttccgctgcgaaaaatgtctctggtggcgaacgaggatttccagcacattctgcgtgtgctgaacaccaacgtggatgggaagcagaagataatgttcgcaatgacctccatcaagggtattggaaggagattcgccaacatcgcttgcaagaaggctgatgttgacatgaacaaaagggctggtgagttgactgctgctgagttggatagtgtgatgactgtggtggcgaaccctaggcagttcaagatcccagactggtttttgaacagaaagaaggattacaaggatggcaaatactctcaagttgtgtctaatgctcttgatatgaagctcagggatgatcttgagagactcaagaaaatcagaaaccaccgtggtttgaggcattactggggccttcgtgtccgtggtcagcacaccaagactactggccgtaggggaaagactgttggtgtctctaagaagcgttaagctattatgtttggcttggagattagattttgttgagaaggaaagtttgaagtacactagacatgttttgcatcataccaactttgtatccgtcgttaaatggcttgacaatttcaattttgtttgttatttgcatcaagattcagtttagttaaatgatgtgttggttttcttagttgtagagaaccctgaatagtattattgaaatattacgaattcagtttgatcctggaagggaaatctcgccttttccaatactatattagtaaataaattaggagacaaattgaa

SEQ ID NO: 2579 - DNA, 808 bp, Trigonella foenum-graecum
caaacatcagaaagcttaggtttagatcttcgccgccaacctccctctccctcctctctctcccatctccctgcaaattcaacacaacatgtctttggttgcgaatgaagagtttcaacacattctgcgtgtgttgaacaccaacgttgatggaaagcagaagattcagtttgctatgacttcaatcaaaggtattggaagaagattcgctaacatctgttgcaaaaaggctgatgttgacatgaacaagagagccggtgaattgactgctgctgagttggagaacattatgactgtggttgccaaccctaggcaattcaaggtccctgattggtttttgaacagaaagaaggattacaaggatggtaagttttctcaggttgtgtcaaatcaactggacatgaagttgagggatgatttggagcgcttgaagaaaatcagaaaccatcgtggtttgaggcactactggggtcttcgtgttcgtggacagcatactaagactactggtcgcagaggaaagactgttggtgtctctaagaagcgttgaagtgtttctgtttttgtttccagaagagaaatcaccagggacagaaattttaagttgcatttagacatgtttgctatgatttattgttgttaatttcggttaaaaaatttttttgtttgctggaccttgtgctcagttacatgttggttttgcaagttgcagagacatcaaataggattgttgaaactattttgtgttttttatttatggagttttcgaaaagagataattggagtttatttataatattcaaatgcactt

SEQ ID NO: 2580 - DNA, 738 bp, Trigonella foenum-graecum
cggccgggggatccagggtaaaaccgtcaatctcccaatttagcataatataaatagtcaattctcagaaaccctaattcttcttcaccttcacatcctcaattggccacagcgcacgcacctgttcacagggaaccttcgtcggctaggctaaaatgtctttggttgcgaacgaagaatttcagcacattctgcgtgtgctcaacacaaatgttgatggaaagcagaagatccagttcgcaatgacttccatcaagggtattggaaggcgattcgctaacatctgctgtaagaaagctgatgttgacatgaacaagagggctggtgaattgactgctgcagagttggaaaatattatgacagtggttgcaaaccctcgtcaatttaaggttccagattggtttttgaataggaagaaggattacaaggatggaaaattctctcaagttgtttccaatcaacttgacatgaagttgagggatgatttggagagactcaagaaaatcagaaaccatcgtggtttgaggcactactggggtcttcgtgttcgtggacagcataccaagactactggccgcagaggaaagactgttggtgtctcaaagaagcgttaagctgttatgttttgatttggagattagatgattttgaggaggcatattttaagcttattagacatgtttcctatacaaactttgtatggttgttaaatgctgcgacaatttcaattttgtttgg

SEQ ID NO: 2581 - DNA, 812 bp, Trigonella foenum-graecum
cggccggggctctttagcattctcaagtggtcacagcattacccagccttagcggcaatcatcgctgttcaatcaatcctccgtggttaggctaaaatgtctttggtggcgaacgaagaatttcagcacattctgcgtgtgttgaacacaaatgttgatggaaagcagaagatccagtttgcaatgacttccatcaagggaattggaaggcgattcgctaacatctgctgtaagaaagctgatgttgacatgaacaagagggctggtgaattgactgctgcagagttggaaaatattatgacagtggttgcaaaccctcgtcaattcaaggttccagattggtttttgaataggaagaaggattacaaggatggaaaattctctcaagttgtttccaatcaacttgacatgaagttgagggatgatttggagagactcaagaaaatcagaaaccaccgtggtttgaggcattactggggccttcgtgttcgtggtcagcataccaagactactggccgcaggggaaagactgttggtgtctcaaagaagcgttaagagatgtgatgtcctgttttggagattatatgattttgaggaggcatatttaagcacattagacatgtttcatataccgactttgtattgtttttaattgaatgcattgacaatttaaatttggttggtttgtgcctgattagttgaatggtgttggtatttttatacgtctccttcagcacgtccaatttgttaatgaagtttgtgagtggagacttagttgcgcactgttggttactgaataaaattcagatttt

SEQ ID NO: 2582 - DNA, 874 bp, Tripterygium wilfordii
tgctgctgctgctgagacgtcaatagcgaagagcctccgtcttttctcctaccgtccaaaatgtcgttggtggcgaacgaggattttcagcacatattgcgtgtgctgaacacaaacgttgatgggaagcagaagataatgttcgctctgacctcaatcaaaggtattgggaggcgatttgcaaacattgtctgcaagaaggccgatgtggacatgaacaagagggctggtgaacttactcctgccgagctggacaatctaatggtggttgttgctaatcctcgacaattcaaaatcccggactggtttttgaataggcagaaagattacaaggatgggaaatattctcaggttgtgtccaatgccctggatatgaaattgagagatgatttggaacggttgaagaagatcaggaaccaccgtggtctgaggcactactggggtctccgtgtccgtggtcagcacaccaagaccactggtcgcagagggaagactgttggtgtctcaaagaagcgttgagatattaatcttttactggcaatgctagtcctacattagtggaatgtttttgcatcagacagttttgaaattgtgaactcttcttattacccgtatcgttcaattgcttagatttggctttgtctatgaattatttgcatttcaattgcatgtctggaattcggctgtgtttcttaatgttcttatggcatttacgtactaaacagctagctgctgaacactgatctacttaaatgcatctaggggattgattgtaaggtctcatgaatgagagaccttaagaaaaggtccttttgcactgcttttttattatatttgagcaggtgttctgtcataataagagcaattgattgtc

SEQ ID NO: 2583 - DNA, 825 bp, Secale cereale
agacgcgaacgcaacctcccctgcccccgagacgccccagccgccgccgccgccgtcgccgccgactgcagccatgtcgctgatcgcgggtgaggagttccagcacatcctgcgtgtgctcaacaccaacgtcgatggtaagcagaagatcatgttcgcgctgacctccatcaagggtgtgggccgccgcttctccaacatcgtctgcaagaaggccgacatcgacatgaacaagagggctggagagctgtccgcggaggagatggaccgtctgatggcggtggtgcacaacccgcgccagttcaaggtcgccggactggttccctaagaggaagaaggactacaaaggacgggaggttctcccgaggtcgtctccaacgctgtcgacatgaagctcgagggatgaccttgagaggctacaagaagatcaggaaccatcgtggtcttcgtcactacgtgggggcgtgtcgtggtccgtgggtcagcacaaccaagactaccggcgaggagaggaaagactgttggtgtctccaagaagcgataagctttgcaaccatactgcatagctttgctactactgtgttggtccattttcagaatctcaaggagtgttcttgtttagacgattaccttggatgatgttttgccctagataatgttttgctggaacctttaatatattgtatcttgaattccttgttgaactcctaagagtttgtttgccatgggcttcaagtcatttcaatggttggcaagagcatgttcgtgcattacagatttgttggctaattgaatccttgtatttttttggtcgaaaaaaaaaaa

SEQ ID NO: 2584 - DNA, 530 bp, Olea europaea
tttagtgtttgttttctcctccgaaggccgaagcgaataacccgtcccatacaaaccggcctattttcagtcatgtcgctgatagcaaatgaggatttccagcacattcttcgtgtgcagaacacgaatgtggatggtaaacagaagatcatgtttgccctgacgtcaatcaagggtatcggtcgtcgattcgctaatattgtctgcaagaaagcagatattgacatgaacaagagggctggtgagctttcagctgctgagattgacagcttgatgacaatcgtggccaatcctcgccaattcaaaatccctgactggtttctgaacaggaagaaggattataaggatggaaaattttctcaagtgacttccaatgctctggacatgaaactgagggatgatcttgagcgtttgaagaagattaggaatcaccgtggtctccgtcactactggggtcttagagtgcgtggacaacacaccaagaccactggccgtaggggaaagaccgttggtgtctccaagaagcgatg

SEQ ID NO: 2585 - DNA, 695 bp, Glycine max
agctacaacagcatcgtcggcggcgtaaccctccaacaacaacacttcctcgtcagaaaatgtctctggtggcgaacgaggatttccagcacattctgcgtgtgctgaacaccaacgtggatgggaagcagaagataatgttcgcaatgacctccatcaagggtattggaaggagattcgccaacatcgcttgcaagaaggctgatgttgacatgaacaaaagggctggtgagttgactgctgctgagttggacagtgtgatgactgtggtggcgaaccctaggcagttcaagatcccaaactggtttttgaacagaaagaaggattacaaggatggcaaatactctcaagttgtgtctaatgctcttgatatgaagctcagggatgatctcgagagactcaagaaaatcaggaaccatcgtggtttgagacactactggggtcttcgtgtacgtggccagcataccaagaccactggtcgtaggggtaaaactgttggtgtgtccaagaagcgctgagctctcacttcctttcttttttccccgttttttgaaggagatatatttttgttttgttaaagtcgacaaaattttattgagaacggatttggattttgttgcattcgaacgttgattttgattgggttggttgatcttatttattttacttattaatcctatgtctttttggtccaa

SEQ ID NO: 2586 - DNA, 819 bp, Malus domestica
gtataaaatcattcacaaaggccgcggctgccatttctagggtttctctttgcttcacttacgtcttcacggcacacacaggcgcagaactgctccaaaagcttcaagatccaaaaccctagcaagccatgtctctggtagcgaacgaagagtttcagcacattctgcgtgtgctgaacaccaatgtggacgggaagcagaagattatgtttgccctaacctccatcaaaggtatcggacgtcgtttcgccaacattgtctgcaagaaggctgacgtcgacatgaacaagagggctggtgaactgtctgccgcggagcttgataccctcatgacaattgttgcgaatcctcgccagttcaaaattccagactggtttttaaacaggaagaaagattacaaggacgggaggtactctcaagttgtttccaatgcattggacatgaagctgagggacgacctcgaacgcttgaagaagatcaggaaccaccgtggtctccgtcactactggggtctccgggtgcgtgggcagcacaccaagaccaccggtcgcagaggaaagactgttggtgtctccaagaagcgatagtctgctttcgcattttccgtttcttgagctcgttgctggatgtttacatgttagcttgagaaattttgcttctttagtatatctgagaatgtttttgaatgctgaaatacacgtttttagattgtttcagggatttagtttcttgttttttaacccgaggcatattttcgttaattgtaagtgcactaattttccaaagtgaaggtgttccagcatatttcagtattgctaa

SEQ ID NO: 2587 - DNA, 727 bp, Aquilegia formosa
aggtcgaaaaccctaatttcttcggcacaatcttcatttcgttgcagagaagagaacacagagatctagaagaagaaaccctaatcatgtctctggttgcgaatgaagattttcaacacattcttcgtgttctgaacacgaatgtcgatggaaagaagaagattatgtttgctttaacttctatcaaaggtattggtcgtcgttatgccaatattgtttgcaagaaggctgatgtcgacatgaacaaaagagctggagagctaactgcagctgagcttgagaacttgatggttattgttgccaatcctcgtcagttcaagatccctgattggtttttgaacaggaagaaggattataaggatggtaggtattctcaggttgtgtctaatgctctggacatgaaacttagggatgatttggagcggcttaagaagatcaggaaccatcgtggtcttcgtcattactggggtctacgagtgcgtggacagcacaccaagactactggtcgcaggggaaagactgttggtgtttccaagaagcgttgagtgtgacttacctaccctagatgtctgtctgaggatttcctgtttctgatgcaaattttgttttgtcttggatttgaagtggacaaatttagatgaagaccttgtcttgtagcttttataatatttggaatggttatctttggtacccttgaaactcgttctaatatgaaattactgcacct

SEQ ID NO: 2588 - DNA, 641 bp, Aquilegia formosa
gaataacatagaagccagatcggcggagagattaaaccctaattctcaaccatgtcacttgttgcgaatgaagattttcaacacattcttcgtgttttgaatactaatgttgatggaaagaagaaaatcatgtttgctttaacttcaattaagggtattggtcgtcgtttagccaacatcgtttgcaagaaagctgatgtcgacatgaacaaaagggctggtgaactctcagcagctgagcttgagaaccttatgactattgttgcgaacccacgacaattcaagatccctgattggtttttgaatagaaagaaggattataaggatggaaggtattctcaagttgtttccaatgctttggacatgaagctcagagatgatttagagcgtttgaagaagatcagaaaccatcgtggtcttcgtcattactggggtctgcgtgtgcgtggacaacataccaagaccactggacgcaggggaaagactgttggtgtctccaagaagcgataaattttctgcatcttctgaattcccatttttggtatttgttatcatgatacttttttcaaggccctcttagtttgcactaagaatcaatttagttaatactacaccatggaacaatgttttctttgtagctt

SEQ ID NO: 2589 - DNA, 834 bp, Musa acuminata
gtaaaattccctagggttttactttcctcgtcgtctcccctctataaagcttcctccgccgtattccgccggcgagcgcccttgagaacagcagcgcgaggaataaatccataaccgccgccgccatgtctctggtcgcgaacgaggacttccaacacattcttcgtgtcctcaacaccaacgtagatgggaagcagaagatcatgttcgccctcacctccatcaagggtatcggtcgccggttcgccaacatcgtgtgcaagaaggccgacgtcgacatgaacaaaagggctggagagctctccgctgccgagcttgagaatcttatgactgttgttgctaatccacggcagttcaagattccagattggtttctgaacaggaagaaggactacaaggatggcagatattcccagattgtttcaaattctctggacatgaagcttagagatgatctggagcgcctgaaaaagataaggaaccaccgcggtctccgtcacttttggggtcttcgagtccgtggtcagcacacaaagaccactggcagaaggggaaagacggtcggtgtgtcgaagaagcgatgagcttgaaattatatttctgctactggttatgctagttttgatctggatttacaactttgatgtctgctttgtgatttaatcctgtgataggcaagactagttgatggataattttgcatgtttggaagacttaaggttgaaaaattgtttttgtgagaatttgatttaagatcctcttccttggcatagcatgtgtctgttctttccacaaattttatcctccaaacctgcaaatggtggtgagcttctt

SEQ ID NO: 2590 - DNA, 1070 bp, Musa acuminata
ctccggcgcgagctcgagagagcagtagtagaagaagggcgtggagagagatcgtagccgttggcaccgggccgtcgcgttcgccatgtcgctggtcgcgaacgaggatttccagcacattctccgtgtgctcaacaccaacgtcgatgggaagcagaagatcatgtttgcccttacctccatcaagggtatcggccgccggttcgccaacatcgtgtgcaagaaggccgacgtggacatgaacaaaagggctggagagctctcagctgccgagcttgagaaccttatgactgttgtagccaatccacgccagttcaagatcccggattggtttctgaacaggaagaaagactacaaggatggtcggtattcccagattgtttcaaattctctggacatgaagcttagggatgatctggagcgtctcaagaaaataaggaaccaccggggtcttcgtcacttctggggtcttcgagttcgagggcagcacacaaaaactactggcaggagaggaaagaccgtcggtgtctcgaaaaagcgatgagtgatgaactaagagaccttggatgcctcaaaaaactcggcatccaagggcttagacttctgtttctgccgccgctgtttgtgttagtttcgatttggatttccaacggttgatatctgcattagtgattccattccgtgttacacactaggctggtgtgatggataattttggatgttccttaggctacacatttgtcaatttgctgcattctaatgctatttaagaccaatgttggaagcttttgtgatgggtatctgttttggtatttctttgaaaatatgaattatgatggttagaattgcaggcaggaatctctatactgaattgatcataaagagagcaacttctacaagcctgccttttaaggactaccaagaaacattggattccatggctgcttcaacctgatagtacaatttggtcatgtggacaaattggtgttgtattcgaccgagatgaaatagccagatttagatgcctattgattggaattgtaattgatgcaaatgaaaagaaaacaaac

SEQ ID NO: 2591 - DNA, 957 bp, Musa acuminata
atgaggatcaaattagagcaaagcctgtttaccgtcgtgatttaccggtcccccacgtgcggttccttcttcctcctccaatcgccgccgcatagggagagaagcgagatcagacgaagggcggacagcgaaaccttagccgccgccatgtcgctggtcgcgaacgaggatttccagcacattcttcgtgttctgaacacgaacgtcgatgggaagcagaagatcatgttcgccctcacctctatcaagggtatcggccgccgcttcgccaacatcgtctgcaagaaggccgacgtcgacatgaacaagagggctggtgagatctcggctgccgaactcgagaacttgatgacaattgttgccaatccgcgccagttcaagatcccggattggttcttgaacaggaagaaagactacaaggatggacgatattctcaggttgtttcaaatgccttagacatgaagctgagggatgaccttgagagactgaagaagataaggaaccaccgcggtctccgtcatttctggggtcttcgagttcgtggtcagcacaccaagacaactggcaggaggggaaagactgttggtgtctctaagaagcgatgagcttaacaatcctctttgatgttgtctttcgatcttgaagtcatcacctaagttttattcatcatgttggagaagactaattctttttaatggtttggttatgtttaggtaacaattttgattgtcaatggaaccgtaacattgatgaaagttatttctctcggtcatttttccaatgcctttttctgacaactggatattgtagttttgagtttgctcctcagaattgcatggctttgaaataggaggtcccatggtaaagattattaccaccctttaaaagagtcctcagttctttagatgactctggatccaaatgcactatagaatttgaggtcaatctctgtcatc

SEQ ID NO: 2592 - DNA, 759 bp, Theobroma cacao
tcgcctccgttagttattcgcttcagctcatcagtccccagagcctcttctctcatctccccgaatctcgcaaaaatgtctctggtggccaacgaagattttcagcacattttgcgtgttctgaacaccaacgtcgatggaaagcagaagattatgtttgctttgacctccatcaagggtatcggaaggcgtttcgctaacattgtctgcaagaaggctgatgttgacatgaacaagagggctggtgaattgactgcacaggagctggacaatctcatgaccattgttgcgaaccccaggcagtttaaaatcccagactggtttttgaacaggcagaaggattacaaggatggaaagtactcccaagttgtgtctaatgctcttgacatgaagttgagagatgacttggagcgcttgaagaaaatcaggaaccaccgtggtctgaggcactactggggcctccgtgtccgtggtcagcacaccaagactactggccgcagagggaagactgtcggtgtctctaagaagcgttgagtgcttcatatatattttgaagaaatatatattcaggcagagagtttatttccttgctttaaagcactgtttgcatcatccaaattttggatgtgattttcttgattttgagttgtttttaaacccttgaagacaaaatagtgttttaatcaatcgtttgatttttaactattgctattaagaacactttcattatagatatttagattaaatgttgtttccttg

SEQ ID NO: 2593 - DNA, 796 bp, Cephalotaxus harringtonia
gtcttgttgttagtgttgcagttgtttggagttgccgtaagcttgaggaggctccgagctttaacgaaaatgtctcttattgcgaatgaagactttcaacatattcttcgtgtcctcaacactaatgttgatgggcgacagaagataatgtttgccctaacatccatcaagggaattggtaggcgttttgccaacattgtctgtaaaaaggctgatgttgacatgagcaagagagctggtgagctttctgcccaagagcttgagaatttgatggtgattgtggcaaatccacggcaattcaagatccctgactggtttttgaataggaagaaggatcacaaggatgggcggttctctcaggtggtatccaatgcacttgacatgaaactcagggatgacttggaacgcttgaaaaagatcaggaatcatcgtggtctccgtcattattggggtctgcgagtgcgtggacaacatacaaagaccacaggccgcagggggaaaactgttggtgtctcaaaaaagcgttgagcaagaaaattcctggagaaaaagaattgtgtttgtggcttcatactgttatatttttctcattataggtgctttatgtattgattgtctttgcaacatccctgtttattcaaaaacattaaatatatttgacaaggctgtaaggctttgattttgtactctttgatctcagaatactgctcgtggcttcatactgttaatgcttttcttctataggtgctttatattgtattgattgtctttgcaacaggtgtatttattcttgaaa

SEQ ID NO: 2594 - DNA, 850 bp, Cephalotaxus harringtonia
ctagggtttcgacgagggttttatagttaaagttttgtacaggtgcaagcctctgattttcatatcccgaacgttcggtctccgtgtgagatcctgtcgaactaatttctgcaaaaatgtcgcttattgcaaacgaagactttcagcacattcttcgtgtgctgaacactaacgtagatgggcggcagaagattatgtttgccctgacttccatcaagggtatcggccgccgtttcgcgaacatcgtctgcaagaaggctgatgttgacatgagcaaaagggctggagagctgtcagcacaagaactggaaaatctgatggttatagtagcaaaccctaggcagttcaagattccggactggtttctgaacaggaagaaggatcacaaggacggtcgtttctctcaggtggtttccaatgccctcgacatgaagctcagggatgacttggaacgtctcaagaagatcaggaaccaccgtggtctgagacactactggggccttcgtgtacgtggacagcacacaaagaccaccggtcgtaggggaaagactgttggtgtctcaaagaagcgttgattactttatttttttggtagaagattgtcatgtgtagctggttaattctgtcacagctggaggcttaaatatttctgttgtgggcttttagttgtgacgccgaatacttggtgctgtagttgcttttgatgatttttatatgtatttcagaatataaacatttttgagaactaccataagctgacaattacggtactttttgacctttgtgttaggtgatgcatttgggtatttttaatctgtttgatatcaatatgtatttttgactgaaacct

SEQ ID NO: 2595 - DNA, 688 bp, Cleome spinosa
cttctgtaaatttgcggcgatcatattgctgcttgaagacggcgagagctttctcctcttctcaggcggcgtttcactgcaaatcaagatgtctctggtcgcgaatgaggacttccagcacattctgcgtgtgttgaacactaatgttgatggtaagcagaagattatgtttgcccttacctctatcaagggtattggaaggcggtttgctaacatcgtctgcaagaaggctgatgttgacatgaacaaaagggcaggtgagttatcagcagctgaactagacaacctcatgacaatagtggctaaccctcgtcagttcaagattccggactggttcttgaacaggcagaaggactacaaagacggaaagttctcccaagtggtatccaacgctctggacatgaagctaagagacgaccttgaacgtctcaagaagatcagaaaccaccgtggtttgagacactactggggactccgggtgagagggcaacataccaagaccaccggtcgcagaggaaagactgttggtgtctccaagaagcgttgagccttccttcttgttttgctcttttacggaccggtttcagttttgcgggacatggtttttggtctttgtgagcgaatccttcttcatatgtatctgctttgagacacgcaacggggataggcaaggcacacaggggatagg

SEQ ID NO: 2596 - DNA, 679 bp, Cleome spinosa
cttttttgtagtataatctggagagatcgtgttactgctcgacgagatctttctcttctcaggcagcttctctgtgaatcacgatgtctctggttgcgaacgaggacttccagcacattctgcgtgtgctgaacactaacgttgatggtaagcagaagattatgtttgcccttacctctatcaagggtattgggaggcgatttgctaacattgtctgcaagaaggccgatgttgacatgaacaagagggccggtgagttgtctgcagccgaacttgacaacctcatgacaatcgttgcaaacccccgtcagttcaagatacccgactggttcctgaacaggcaaaaggactacaaggatggcaagttctcccaagttgtctccaacgctctggacatgaaactcagagacgacctggaacgtctcaagaagatcagaaaccaccgtggtctgaggcactactggggtctccgtgtccgagggcagcacaccaagacaaccggtcgtagaggaaagactgtcggtgtttccaagaagcgttgagggagttttttctagttgctaccaatgatatgggcattgcttgatgaagaccggttttagtttgttggttccccgtacaattttgagtcatttatgatcgaatgagaagtctttcttcttcatatggattttgggcc

SEQ ID NO: 2597 - DNA, 919 bp, Gossypium hirsutum
ttggcggcggagaagactcggcattcaggcgagcgcccggtggtgtggtacgtagtgggtttagtacgccccgccaaacaaaaaaacctagaatcgtgaatgtataaaaccctagtttggctccctaggttattctcctcagatcagcagtcccccagagtctattccctcatctacccccaaatatcctcacattatgtctctggtggccaacgaagattttcagcacattttacgtgtgctgaacaccaacgttgatgggaagcagaagattatgtttgcattgacctccatcaagggtatcggaaggcgattcgctaacatcgtttgcaagaaggctgatgtcgacatgaacaagagggctggtgaattgactgcacaggagttggacaatctcatgaccattgttgcaaaccccaggcagtttaaaatccctgactggtttttaaataggcagaaggattacaaggacgggaagtattcccaagtcgtgtctaatgctcttgacatgaagttgagggatgatttggagcgtttgaagaagatcaggaaccaccgtggtctgaggcactactggggccttcgcgtccgtggtcagcacaccaagactactggtcgcagagggaagactgtcggtgtgtctaagaagcgttgaaggcttcatatatattttggaaaaaattatgtagtcttgcagagtgttcatatctttgaatgtaagcactatttgcaggaagacaaattttggatgtgattttttttgttgtttctagacaagtggtaagactagtagtgttgggtctttatcggttgctattaggaatacttgcgttactgaatttaatttggtttgaatgataattgtctttggaatttgtgttggtttgccatatttcagctatagtaaattttcaattaa

SEQ ID NO: 2598 - DNA, 652 bp, Gossypium hirsutum
cccgggggatccgcccagcgtggtcgcggccgaggtcttcaaagctcatctgtcaccccagagccccttctctccgccgaatctcctttttctcccgtaaaaatgtctctggtggccaacgaagattttcagcacattttgcgtgtcctgaacaccaacgttgatggaaagcagaagattatgtttgctttgacctccatcaagggtatcggaaggcgtttcgccaacattgtttgcaagaaagccgatgtagacatgaacaagagggctggtgaactgactgcacaggaattggacaatctcatgacgattgtggcgaacccgaggcagtttaaaatcccagattggtttttgaacaggcagaaggattacaaggatggaaagtattcccaagttgtgtccaatgctctcgacatgaagttgagagatgacttggagcgcttgaagaagatcaggaaccaccgtggtctgaggcactactggggccttcgtgtacgtggtcagcacaccaagactactggtcgccgaggaaagactgttggtgtgtctaagaagcgttgaattcttcataacataatctatagtatgatgaggcagatatttatttctttgcttttaagcgatgtttgcatcaaagacaattttggatttg

SEQ ID NO: 2599 - DNA, 1185 bp, Gossypium hirsutum
ttctgtttattaccatatggttgagttttacataattatggcaggaatagttggaacagttcatccaaggggaaacataaaatacaggtaatcacttcaatctatatatccagaaggcaaatttagaacttggactttctatgtctaaattaactgcaaactacagattgagcttaccggctaagaaccacgaatgcatggcctccgctgtttattcgcttcagctcatcacttcccatagtctctcctcctccctcaccaaatcaaaatgtctctggtggcgaacgaagactttcagcacattttgcgtgtgctgaacaccaacgttgatggaaagcagaagatcatgtttgctttgacctccatcaagggtattggaaggcgtttcgctaacattgtttgcaagaaggctgatgtcgacatgaacaagagggctggtgaattgactgcacaggagctggacaatctcatgaccattgttgcaaaccccaggcagtttaagatccctgactggtttttgaataggcagaaggattacaaggatgggaagtattcccaagttgtgtctaatgctctcgacatgaagttgagagatgacttggagcgattgaagaagatcaggaaccaccgtgggctgaggcactattggggtcttcgtgtccgtggtcagcacaccaagaccactggtcgcagaggaaagactgtaggtgtctctaagaagcgttgaatgtttcatatatgttgtcaggcagagtgtttatttccttggtttataagcatcctttgcagcagtggatgtgacattttgttttgagttggcctaaatatctcagacaagtagtgttttaattaatcaattgttcgtttgatccttgtttgtgctacatgttttgttttttttgccgggcatcataaaatttgaccttaaaattacaaggtcatttgtgggggacttaatctccaagcatatcaagtgtgcttttgcttcaacatttgagcttctttgacaccgccaattttatcttttttggcactttgagcttctcaatgaccagttatttcttcaagatcaatcggttacatccgttcggttaaaatgttaaatatgagtgaaggtcagtattttgtttggttggtggaaaagtagatggatgaaaagaaagaatggatgtaaaatgaatttcg

SEQ ID NO: 2600 - DNA, 923 bp, Gossypium hirsutum
ccctagttaaattggtctccatcggttattcgcctcacctcatcagcttcagtatcgccagagcctcatctctcatcttccccaagtctcctcgccgctctcaaaaatgtctctggtggccaacgaagattttcagcacattttacgtgtattgaacaccaacgttgatggaaagcagaagattatgtttgctttgacttccatcaagggtatcggaaggcgttttgctaacattgtttgcaagaaggccgatgtcgatatgaacaagagggctggtgagttgactgcacaggaactggacaatctcatgaccattgttgccaaccccaggcagtttaaaattccagactggtttctgaataggcaaaaggattacaaggatggaaagtattcccaggttgtttctaatgctctcgacatgaagttgagagatgacttggagcgtttgaagaaaatcaggaaccaccgtgggctgaggcactactggggcctccgtgtccgcggtcagcacaccaagactactggtcgcagagggaagactgttggtgtctctaagaagcgttgagtgcatatacatatatatcctgaggcagaatttatttccttgcttttaggcactgtttgcatgaagacaaattttggatgtgactttcttcttcagttgttttgttttaattaataattttcttctatgaatatggcaatgttagacatgacattagaatacgcaaatttcaggtcaatgaatttcccaacattcattaattaatcatattcaaatggttaattatttttcttcgatggatgtgaaactttatgtaatgatatagttttcagttatttctcgtttggtctaattagagtttttgtaaagcattgtaatttaaggaaagtgttaaataaattttaataaattcttattg

SEQ ID NO: 2601 - DNA, 873 bp, Cucumis sativus
agaatctgattgacaatatataaaatccttctccactccccacttgaagatctcctcctctgcttctttcctgcctttgcgccgccggggattcaaccaactccttgcctctatcttcatccgccatgtcactggtagcaaacgaggattttcagcacatcctgcgtgtgctcaacaccaacgtcgatgggaagcaaaagattatgtttgctcttacttcaattaaaggtattggaagacgtttcgctaacatcgtttgtaagaaggctgatgtcgacatgaacaagagggccggtgaactaactgctgctgagttggataatctcatggtggttgttgccaatccacgacaatttaaaattcccgactggtttttgaataggcagaaagactacaaggatggaaaatattctcaagtagtttcaaatgcattggacatgaagttgagagatgatttggagcggttgaagaagattaggaaccaccgaggtctgaggcactactggggcctccgagtccgtggtcagcacactaagaccactggtcgccgagggaaaactgttggtgtctccaagaagcgttgagcatttgcttgtttctatagtcgagttaagtatgtgtttgggcaaatcaagttctttggcctttttagttgaacattcgagctgttctttccttttggaatttttgtttgagatgtggtatttttgttcaatctttttttctactgactttaattaggctggaaaaggaaggttgatagtgacaaatggtaaagattatgaatccatattgatccttttggtgtgaaaaggtgttaagagtgccagtttaataatagggttgagaaatcatcttattgttgattttcga

SEQ ID NO: 2602 - DNA, 749 bp, Cyamopsis tetragonoloba
cagcttcggcggcaaccgtcatacccgaccacctcttccgcaacaacaatgtctctggtggcgaacgaggatttccagcacattctgcgtgtgctgaacacgaacgtagatgggaagcagaagatcatgttcgctcttacctccattaagggtattggaagaagattcgccaacatctgctgcaaaaaagccgatgttgatatgaataagagagctggtgagttgagtgctgctgagttggataacctgatgactgtggttgccaaccctcgccaattcaagattccagattggtttttgaacaggaagaaggactacaaggatggcaagtactctcaggttgtgtcaaatgccctggatatgaagctgagggatgacttggagagactcaagaagatcagaaaccaccgtggtttgaggcactactggggtcttcgtgtccgtggtcagcacaccaagactactggccgcaggggaaagactgttggtgtctccaagaagcgttaagctgttatgttttggctttgagattagatattattgtcgaagagtacattagacatcttgttttgcatatcgactttttaatgcatgcttgttaaattatctgacaatttcaattttgtttgttacttgcgttatgattccgtttaattgaatggtgttttcttattcttagttatagtgaagtattgatgcacaagtttataagtgagttacgaatatgcttatggttttttaccctcgtg

SEQ ID NO: 2603 - DNA, 857 bp, Euonymus alatus
ctcaattggcatctctgtgccgctttcttgttgctgcgctactcagacgccaagagcgaagagcctcctctgtgtgtttctcctagcgttcaaaatgtcgttggtggcgaatgaggattttcagcacatattgcgtgtgctgaacacaaacgttgatgggaaggataagataatgttcgctctgacctctatcaaaggtattgggaggcgatttgcaaacattgtctgcaagaaggctgatgtggacatgaacaagagggctggtgaattaactcctgctgagctggacagtctaatggtggtggttgctaatcctcgacaattcaaaatcccagactggtttttgaataggcaaaaggattacaaggatgggaaatattctcaggtcgtgtcaaacgctttggatatgaaattgcgagatgatttggaacgattgaagaagatcaggaaccaccgtggtctgaggcactactggggtctccgtgttcgtggtcagcacaccaaaaccaccggtcgcagagggaagactgttggtgtctcgaagaagcgttgagatattattctttttctgggaattctagtcctacgttactggaatgtttttgcatcagacagttgtgaactcttgttactcttctcgttcagtggcttatatttggctttgtcgatgaattatttgaatttctattgcatgtccgaacttccgctggtttttttattgttcttttggtatttatgcactaaatagctatctgctgaatagtgaattagctaaatgcatttggcggattgattgtaaggtctcatgagacatcctggctagctgccctttttttatttgagcaggagttttgact

SEQ ID NO: 2604 - DNA, 836 bp, Euonymus alatus
cggccgggggctcactcggcttctctgtgcggccttgttgttgctgcgctgctcagactccaagagcgaagagcctccgctgtcttttctcagtgttcaaaatgtcgctggtggcgaacgaggattttcagcacatattacgtgtgctgaacacaaacgttgatgggaaggataagataatgttcgctctgacctctatcaaaggtattggtaggcgatttgcaaacattgtctgcaagaaggctgatgtggacatgaataagagggctggtgaattaactcctgctgagctggacaatctgatgggtgttgttgctaatcctcgacaattcaaaatcccagactggtttttgaataggcaaaaggattacaaggatgggaaatattctcaggtcgtgtcaaacgctctggatatgaaattgcgagatgacttagaacgattgaagaagatcaggaaccaccgtggtctgaggcactactggggtctccgtgtccgtggtcagcacaccaagaccacaggtcgcagagggaagactgttggtgtctcaaagaagcgttgaaatattgttatttttatggcaatgctagtcctaaattattgggatcttttttgcatcagacagtcttggaggacctttcttgaactggacggggttttgaaattgtgaactttttatttctcctctttcaattgcttagatttggctttgtgtatgagttatttgcgttttaattcgatgtctggactttggctggtttcttactgttcttttgctatttatgtactataaaaggctagttgctgaacagtaaaatacttaaatgcatttaacgga

SEQ ID NO: 2605 - DNA, 585 bp, Euphorbia peplus
gaagaagaagcatcaggacgaagccgctcgccctctgccctgaaaaatgtcgttggtagcgaacgaagatttccagcacattttgcgtgtgcttaacacaaatgttgacgggaagcagaagatcatgttcgctcttacttccatcaaaggtattggaaggcgtttcgccaacatcgtctgcaagaaagccgatgtcgacatgaacaagagagctggtgaattaactgctgccgagctggacaatctcatggttgtcgttgcgaacccccgacagttcaaaattcccgattggtttttgaatagacagaaggactacaaggatggaaagtattcacaggtggtatcaaatgctcttgacatgaagctgagagatgacttggagcgtttgaagaagatcaggaaccatcgtggtctgaggcattactggggtctccgtgtccgtggtcagcacaccaagactaccggtcgccgagggaaaactgttggtgtctctaagaagcgttaaaaacctctccttttatattttgcaagcaaattttctgttggatgcaatattagattaatggaattagtccttttgagatt

SEQ ID NO: 2606 - DNA, 722 bp, Linum usitatissimum
gagggttttataggctgtttcacttctcactcttcgaagcaaaaggaaagcgcggcgctgcttctgaagagaagagatcgcagccatgtctctcgttgcaaatgaggagtttcagcacattcttcgtgtcctcaacaccaacgttgatggaaagcagaagatcatgtttgccctgacctctatcaagggtattggtcgccgatttgccaacatcgtctgcaagaaggctgatgttgacatgaacaagagagctggtgagctgtcttcggaagagctggacaagctcatgacggtggttgcgaacccacgtcagttcaagatcccagactggttcctcaacagacagaaggattacaaggatgggaagtactcccaggtcgtttctaacgctttggacatgaagctgagggatgatcttgagaggctcaagaagatcaggaatcaccgtggtctccgtcactactggggcttgagagtccgtggacagcacaccaagaccaccggtcgcaggggaaagactgttggtgtgtcaaagaagcgataagctgtttggaatctctgtggaactctttgggcatatgcttttatggtactatgttttacagactatttgttcactacttgtttagggtctttttgccggagtttaattaaagttgatatctgtagctttgataatgtttccagagttgtttgagatgaattttgaatgaatggtttga

SEQ ID NO: 2607 - DNA, 927 bp, Linum usitatissimum
ctggcgctagggttttggtcgtctctgtatcgcatctcctcttcactttcagctcagaaactgaatcgcagtcccagcctaagcagccatgtcgctcgttgccaatgaagaattccagcacattcttcgtgttctcaacaccaatgtcgacggaaagcagaagattatgtttgccctgacctccattaagggtattggtcgccgatttgccaatatcgtctgcaagaaggccgacgttgacatgaacaaaagggctggagaattatcatccgaagagcttgacaagctaatgacagttgttgctaaccctcgccagttcaagatcccagactggttcctgaataggcagaaggactacaaagatggaaagtattcccaagttgtctccaacgcattggacatgaagctgagggatgatctcgaaaggctcaagaagatccgtaaccaccgtggtctgcgtcactactggggtttgagagtccgtggacagcataccaagactactggccgtagaggaaagactgttggtgtgtccaagaagcgataagctgttagtggacattttctccgagctgccgaatttcacgactgttagtaatgttttttgaggtcctgttgtactgaatatttagtgtagttcatcgcatggaagctgattatctgccattttggatgattgttcccagggttgcctatgctctgagatctatgcctttgaagttattactcgctttcgatttcgttgaagtatcaaaatttttgtttgcatttttcaatcgggtgcgctacctatcgtgttattcccatcttgctggtgagtaatcttagaatataattaactttccccggagttgtacttctcaggacgacgatttaaatgaacaagcaaggaatttgttgaactcacaaattaatgcagaaaatgct

SEQ ID NO: 2608 - DNA, 695 bp, Fraxinus spp
gtgggcgattttctctactatagcgaagtagccgatcagggaattattgcaccttctccacagccaattcgcagcagcagccatgtctctgatagcaaatgaggatttccagcatattctgcgtgtgcagaacacgaacgtggacgggaagcagaagatcatgttcgccttgacctccatcaagggtattggccgccgtttcgccaatatagtctgcaagaaagccgacatcgacatgaacaagagggctggtgagctctctgccgcggagattgacagcttgatgactattgtggcaaatcctcgtcaattcaagatccctgactggtttctgaataggaagaaggattacaaggatggaaagttttctcaagtgacttccaatgctttggatatgaagctcagagatgatcttgaacgtttgaagaagatcaggaaccaccgtggtctccgtcattactggggacttcgtgtgcgtggacagcacaccaagaccaccggccgcaggggaaaaactgttggtgtctccaagaagcgatgagcctcgtgtttttatactgttctctttgttgttttgtctgaatatttgctgcagttcttgactaagttcttacagctagtaatttgctctctattttccgttgatttttgatgtgttggatttcaatgactgttatggcaaaatcattagattc

SEQ ID NO: 2609 - DNA, 692 bp, Fraxinus spp
gtgggcgattttctctactatagcgaagtagccgataagggaattatcgcaccttctccacagccaattcgcagcagcagccatgtctctgatagcaaatgaggatttccagcatattctgcgtgtgcagaacacgaacgtggacgggaagcagaagatcatgttcgccttgacctccatcaagggtattggccgccgtttcgccaatatagtctgcaagaaagccgacatcgacatgaacaagagggctggtgagctctctgctgcggagattgacagcttgatgactattgtggcaaatcctcgtcaattcaagatccctgactggtttctgaataggaagaaggattacaaggatggaaagttttctcaagtgacttccaatgctttggatatgaagctcagggatgatcttgaacgtttgaagaagatcaggaaccaccgtggtctccgtcactactggggacttcgtgtgcgtggacagcacaccaagaccaccggccgcaggggaaaaactgttggtgtctccaagaagcgatgagcctcatgtttttatactgttctctttgttgttttgtctgaatttttgctgcagttcttgactaagttcttacagctagtaatttgctctctattttacgttgaattatgatgtggtggatttcaatgactgttatggcaaaatcattaga

SEQ ID NO: 2610 - DNA, 793 bp, Fraxinus spp
gagggtttagtgtttgttttctcctccgaagctaatctgccgtcccattcaaaccggcctattttcagccatgtcgctgatagcaaatgaggatttccagcacattcttcgtgtgcagaacacgaatgtggatggtaagcagaagatcatgtttgccctgacgtcaattaagggtatcggtcgtcgattcgccaatattgtctgcaagaaagctgatattgacatgaacaagagggctggtgagctttcagctgctgagattgacagcttgatgacaatcgtggccaatcctcgccaattcaaaatccccgattggtttctgaacaggaagaaggattacaaggacggaaaattttctcaagtgacttccaatgctctggacatgaaactgagggatgatcttgagcgtttgaagaagattaggaatcaccgtggtctccgtcactactggggtcttagagtgcgtggacaacacaccaagaccactggccgtaggggaaagactgttggtgtctccaagaagcgatgattctcttctcttttttctcactgttcacctcgatacaatgtttggttttaggcatcgcttgaccttatgatcttgcatctatctgataaaatgctttgttgcggatctcttttaaagaactgtctcactttctaattttgggtgttgttaaatgtttaactctcctttttatggcaattttgttggatttgaagtgtttataggacgataaatcagctttttccacctccgttgtggtttgtcatgttgcttccatcgattagg

SEQ ID NO: 2611 - DNA, 1041 bp, Gossypium raimondii
aattgacttctttcggtcaagcggactattaatttaaaaaaaataagaaaaatgaatattttattttgaaaaattaataaaaataagaaaacgcaaatgtcactcacccaaaaaaaacctagaatcgtgaatgtataaaaccctagtttggctcccacggttattctcctcagataagtagtcccccagagtctcttccctcatctacccccaaatctcctcacattatgtctctggtggccaacgaagattttcagcacattttacgtgtgctgaacaccaacgttgatgggaagcagaagattatgtttgcattgacctccatcaagggtatcggaaggcgattcgctaacatcgtttgcaagaaggctgatgtcgacatgaacaagagggctggtgaattgactgcacaggagttggacaatctcatgaccattgttgcaaaccccaggcagtttaaaatccctgactggtttttaaataggcagaaggattacaaggacgggaagtattcccaagtcgtgtctaatgctcttgacatgaagttgagggatgatttggagcgtttgaagaagatcaggaaccaccgtggtctgaggcactactggggccttcgcgtccgtggtcagcacaccaagactactggtcgcagagggaagactgtcggtgtgtctaagaagcgttgaaggcttcatatatattttggaaaaaattatgtagtcttgcagagtgttcatatctttgaatgtaagcactatttgcaggaagacaaattttggatgtgatttttttttgttgtttctagacaagtggtaagactagtagtgttgggtctttatcggttgctattaggaatacttgcgttactgaatttaatttggtttgaatgataattgtctttggaatttgtgttggtttgccatatttcagctatagtaaattttcaattaaactccaaagatgctcccacattgggcttaattgagttggtctagatgtgagaattcaaaattctattctcaaataaagtatcgttttctg

SEQ ID NO: 2612 - DNA, 1029 bp, Gossypium raimondii
gttttagcccaaaaacccaaccctaaaagccctaccgcaatcaatatataatttgttagaagaaaccctagcctctagcttggcctccattggtatacttcaaaagctcatctgtcaccccagagccccttctctccgccgaatctcctttttctcccgtaaaaatgtctctggtggccaacgaagattttcagcacattttgcgtgtcctgaacaccaacgttgatggaaagcagaagattatgtttgctttgacctccatcaagggtatcggaaggcgtttcgccaacattgtttgcaagaaagccgatgtagacatgaacaagagggctggtgaactgactgcacaggaattggacaatctcatgacgattgtggcgaacccgaggcagtttaaaatcccagattggtttttgaacaggcagaaggattacaaggatggaaagtattcccaagttgtgtccaatgctctcgacatgaagttgagagatgacttggagcgcttgaagaagatcaggaaccaccgtggtctgaggcactactggggccttcgtgtacgtggtcagcacaccaagactactggtcgccgaggaaagactgttggtgtgtctaagaagcgttgaattcttcataacataatctatagtatgatgaggcagatatttatttctttgcttttaagcgatgtttgcatcaaagacaaaattttggatttggttttgttgttttagttggttttttaaaccttgcagacaagtagtgtttctcttttaatcgattgtttgatctttttatcaattgacattaaggatacctgctttgatagataaagattacacatgttttcttcacctcaagtccaagtcctgaagaattggtggtgtccatgaccagattgggttattcacatatgggtattaacatcacatggttgttcatgttgggtgctcatatttataaatgattccttttatatgaaaatatattatctttatttaatattaattgaaaataggcatttgttatggt

SEQ ID NO: 2613 - DNA, 1115 bp, Gossypium raimondii
atgaaccaatataaatacgtttgttagaggaatccttaaaaaccctaacttggcctccgctgtttattcgcttcagctcatcacttcccatagtctctcctcctccctcaccaaatcaaaatgtctctggtggcgaacgaagactttcagcacattttgcgtgtgctgaacaccaacgttgatggaaagcagaagattatgtttgctttgacctccatcaagggtattggaaggcgtttcgctaacattgtttgcaagaaggctgatgtcgacatgaacaagagggctggtgaattgactgcacaggagctggacaatctcatgaccattgttgcaaaccccaggcagtttaagatccctgactggtttttgaataggcagaaggattacaaggatgggaagtattcccaagttgtgtctaatgctctcgacatgaagttgagagatgacttggagcgattgaagaagatcaggaaccaccgtgggctgaggcactattggggtcttcgtgtccgtggtcagcacaccaagaccactggtcgcagaggaaagactgtaggtgtctctaagaagcgttgaatgtttcatatatgttgtcaggcagagtgtttatttccttggtttataagcatcctttgcagcagtggatgtgacattttgttttgagttggcctaaatatctcagacaagtagtgttttaattaatcaattgttcgtttgatccttgtttgtgctacatgttttgtttattttgccgggcatcataaaatttgaccttaaaattactaggtcatttgggggggacttaatctccaagcatatcaagtgtgcttttgcttcaacatttgagcttctttgacaccgccaattttatcttttttggcactttgagcttctcaatgaccagttatttcttcaagatcaatcggttacatccgttcggttaaaatgttaaatatgagtgaaggtcagtattttgtttggttgggtggaaaagtagatggatgaaaagaaagaatggatgtaaaatgaatttcgagtatgcctgttataaaggtaatttaaaaataaataaattattgaaatgaattttgattgcttactaagaaagaaaa

SEQ ID NO: 2614 - DNA, 946 bp, Gossypium raimondii
tttgtgcactaaaccctagttaaaattggtctccatcggttattcgcctcacctcatcagcttcagtatcgccagagcctcatctctcatcttccccaagtctcctcgccgctctcaaaaatgtctctggtggccaacgaagattttcagcacattttacgtgtattgaacaccaacgttgatggaaagcagaagattatgtttgctttgacttccatcaagggtatcggaaggcgttttgctaacattgtttgcaagaaggccgatgtcgatatgaacaagagggctggtgagttgactgcacaggaactggacaatctcatgaccattgttgccaaccccaggcagtttaaaattccagactggtttctgaataggcaaaaggattacaaggatggaaagtattcccaggttgtttctaatgctctcgacatgaagttgagagatgacttggagcgtttgaagaaaatcaggaaccaccgtgggctgaggcactactggggcctccgtgtccgcggtcagcacaccaagactactggtcgcagagggaagactgttggtgtctctaagaagcgttgagtgcatatacatatatatcctgaggcagaatttatttccttgcttttaggcactgtttgcatgaagacaaattttggatgtgactttcttcttcagttgttttgttttaattaataattttcttctatgaatatggcaatgttagacatgacattagaatacgcaaatttcaggtcaatgaatttcccaacattcattaattaatcatattcaaatggttaattatttttcttcgatggatgtgaaactttatctaatgatatagttttcagttatttttcagagtagttcgtttggtctaactagagtttttgaaagaattgtaatttaaggaaagtgttaaataaattttaataagttcttattg

SEQ ID NO: 2615 - DNA, 788 bp, Vitis vinifera
cttaaaccttcactgggagtctagggtttcagtctccttcgatttctctgcgctttgaagccgtctgagacgaacagcttcgcagagcttcatctgaaaccctaaccatgtccttggtagcgaacgaggaatttcaacacatacttcgtgtgctcaacacgaacgtcgatgggaaacagaagatcatgtttgctctgacctccatcaaaggtattggccgccgtttcgctaatatcgtctgcaagaaagccgatgtcgacatgaacaagagagctggcgagctctcagctgcagagcttgagaacctcatggtgattgttgccaatcctcgccaattcaagatccccgactggtttcttaacaggaagaaggattacaaggatgggaggtattctcaggttgtttccaatgcgttggacatgaagctgagggatgaccttgagcgactgaagaagatcaggaaccatcgtggtctccgccactactggggtcttcgtgtccgtgggcaacacaccaagacaactggccgcaggggaaagactgttggtgtctccaagaagcgatgatctgttctattccctatttttaacatgcacttttgtccttgggcatttttgattggtgtcagctgtttttctcagtttagtttgttcaacaacatttacatgagcacagtttctctctcgatttgagttgttcttggatgtttttagtagtgattacttctcatatctttcttttaatgatattatgacttcacttattcccatttgaattttcttgaggat

SEQ ID NO: 2616 - DNA, 1040 bp, Vitis vinifera
gcgcaacactcgataacctcactctagggttttgggtttccccttcctcatcctttaaaaccacggctgcatacttccgtagccctttctctcacctttgagccctaatcctaaccctagccatgtctcttgttgcaaacgaggaatttcagcacattcttcgtgtgctcaacaccaacgtcgatgggaagcagaagatcatgtttgccctcacttccatcaagggtattggtcgccgtttcgccaatatcgtctgcaagaaagccgatgtcgacatgaacaaaagagctggtgaactatctgctgctgagctcgagaacctgatggtgattgtggcgaatcctcgtcagtttaagatccctgactggtttctgaacaggaagaaagattacaaagatggtagatattctcaggttgtttctaatgcattggacatgaagctcagggatgatcttgagcgtttgaagaagatcaggaaccaccgtggtcttcgacactactggggtctacgtgtacgcggacaacacaccaagacaactggccgcagagggaaaactgttggtgtctcaaaaaagcgttaaatctccctttcctcctgcgaattttgtttgctttccaatttttctcaagtccatcatgtctctagtatggttgttcaggtgaatgcatatggtattcccgtttcacttatctttcatcagtgttctcctcgattgcttgatagttattcaagagagggttttgatatggtattcgattacattattcgctactgttagtgataaaagaggtctctggatttgaatgttcattcattcacatgttgattttggattattcattcttgcaagcaccttcactcacaattcatataacggattgtctctacttagttggttcttgttggtgtaacctcacgcagggtggcttccatagaaattgtagatgggtcaaaacgcatcccactcggaaggtttgccttacagaatgcttacatgaatgtaaaaattctgcgacttatattaaaaacataatggttt

SEQ ID NO: 2617 - DNA, 772 bp, Vitis vinifera
atttgagcttcttcagacgccgagaatcaaaagtaacatcaatctttgcgtcgacaatgtcgctagtggcgaacgaagaattccagcacatattgcgtgtcctgaacacgaacgtggatgggaaacagaagataatgtttgccctcacgtcaatcaagggtattgggaggcgattcgctaatattgtttgcaagaaggccgatgttgacatgaacaaaagggctggtgaattatctgctgctgagctggagaacctcatggttattgttgctaatcctaggcaattcaaaattcctgactggtttttgaataggaaaaaggattacaaggatggcagatattctcaggtggtttcaaatgcattggatatgaagttgagagatgacttggagcgattgaagaaaatcaggaaccaccgtggtctgaggcactactggggcctccgtgttcgcggccagcacaccaagaccacaggtcgtagaggaaagactgttggtgtctctaagaagcgttgagccttggattgtttttgctttgaacaattatatattatgatgaaacacaagtcctttgcagttaagaagagtcagatttttttatgcaaattttctaatattggttgaatttcaaatccaaaatctgcagtctttctaatcaaccacctaccatggtgagatcttatgtgaaggatttagattatagctacatccgtgggtgagatatcaccaaattagcatgaattgatatttagcatttcaattttctactcttt

SEQ ID NO: 2618 - DNA, 768 bp, Carpinus betulus
agacttcccgtgcagcttcgctttctacctccgaatcctctctctcgcaggctccgtctctgcaagtccaaaatgtctctggtggccaatgaggagttccagcacattctgcgtgtcctcaatacgaacgtggacggaaagcagaagataatgttcgctcttacctccatcaaaggtatcggacgccgctttgccaacatcgtctgcaagaaggctgacgtggacatgaacaagagagcgggtgaactaactgctgctgagctggacaatctcatgactattgttgccaatcctcggcagttcaaaatcccagactggtttttgaataggaagaaggattacaaggacgggaagtactctcaggtggtgtccaatgcattggacatgaagttgagagatgatttggaacggttgaagaagattaggaaccatcgtggtctaaggcactactggggtcttcgtgttcgtggccagcacaccaagaccactggccgcagggggaagaccgttggtgtctctaagaagcgttgagcttttttcttctttgttttaaacaattaaatatatggttgggcaagccaggttttttgttattaacatgtttgattagacattattagattttttgtactgtggttgtggttggatgtttcactatggttgggttttgaaccttgtagccctattagtgttctcatttgctcaattttggtttttctatggttctgtctaatttggttgtcaaagttgtcctgggagtgagaatac

SEQ ID NO: 2619 - DNA, 940 bp, Mesembryanthemum crystallinum
  misc_feature (520)..(520): n is a, c, g, or t
  misc_feature (727)..(727): n is a, c, g, or t
  misc_feature (737)..(737): n is a, c, g, or t
  misc_feature (740)..(741): n is a, c, g, or t
  misc_feature (752)..(752): n is a, c, g, or t
gcacgagcaagagcagctgcctccgactgtagaagacctacagagctgcaacaatgtcgttggtggcgaatgaagagtttcagcacattctgcgtctgttgaacaccaatgtcgatgggaagcagaagatcatgtttgccatgacatcaatcaagggtattggccgccgtttcgccaacatttgctgcaagaaggccgatattgacatgaacaagagggctggtgagcttacaactacagaactcgacaatctgatgactgttgttcaaaaccctaggcagttcaagatcccagactatttcctcaacaggcagaaagactacaaggatggtaggtttagtcaggttctttccaaccagcttgacatgaagcttagagatgaccttgagcgactcaagaagatcagaaaccaccgtggtcttcgtcactactggggtctcagagtacgtgggcagcacaccaagaccactggacgaaggggaaagactgttggtgtgtcaaagaagcgctgaaaacttgnggttgttttctgttttgggtttctgtctccatgtgttgtttttgcctttggactaagcctaggatgtcaagaatatggctatttttgccaaatttgttcaacggatgttagtatttttgtagggccatagcttcaaaatcttgatcgttctgttgagagaatatatggttgcagttttaatcacaggacctgtttttttgttttatnaataattttnttnntttttactttntttggtaacatcctattttttctacttttttaattacttactctctattttcttaataattaaatccttgggggggggcccggccccccattttcccctattttgaggtcttttacccgcgccccctggccggtgttttaaacctgtggacttggaaaaccctggctgtacccaccttattgttcttg

SEQ ID NO: 2620 - DNA, 712 bp, Ipomoea batatas
agcggccctgcagaagagtgagagacggagagggaagaagcaaagccgcagccatgagtttggtagcgaacgaggatttccagcacattctgcgtatcctgaacaccaatgtcgatgggaagcagaagattatgttcgctctcacctccatcaagggtatcggccgccgattcgccaacatctgctgcaaaaaagctgatattgacatgaacaaaagggctggtgaactttcttcagctgagattgacaacttgatgactgttgttgcgaaccctcgccagttcaaggttcctgactggttccttaacaggcagaaggactacaaggatggtggctattctcaggttgtgtccaatgcattggacatgaagctcagggatgatcttgagcgattgaagaaaattaggaatcaccgtggtcttcgtcactactggggtcttcgtgtacgtggacagcacactaagacaactggacgtaggggaaagactgttggtgtctcaaagaagcgttaagattgattacacctgtgatatttcatgttctgttctaaattttgttttcatatacaatgatatgtggtctttagcatgtagtacatgtttcttgagactgagctttttaggggttcaatgaaggcagaccttgtctttctgttttgctacattatcgaatgattcttgtgaacttaatagatccttgagtgtttttggtt

SEQ ID NO: 2621 - DNA, 707 bp, Ipomoea nil
ggccctgcagaagagtgagagtcggagagggaaaaaacaagccgcagccatgagtttggtagcgaacgaggatttccagcacattctgcgtatcctgaacaccaacgtcgatgggaagcagaagattatgttcgctctcacctccatcaagggtatcggccgccgattcgccaacatctgctgcaaaaaagctgatattgacatgaacaaaagggctggtgaactttcttcagctgagattgacaacttgatgactgttgttgcgaaccctcgccagttcaaggttcctgactggttccttaacaggcagaaggactacaaggatggcggctattctcaggttgtgtccaatgcattggacatgaagctcagggatgatcttgagcgattgaagaaaattaggaatcaccgtggtcttcgtcactactggggtcttcgtgtacgtggacagcacactaagacaactggacgtaggggaaagactgttggtgtctcaaagaagcgttaagattgattacacctgtgatttcatgttttgttctaaattttgttttcatatacaatgatgtggtctttagcatgtagtacatgtttcttgagactgagctttttaggggttcaatgaaggcagaccttatgagccttgtctttctgttttgctacattattgaatgattcttgcgaacttaatagatcctcttgagtgt

SEQ ID NO: 2622 - DNA, 788 bp, Glycyrrhiza uralensis
gtttgttcataaaccctagaatttcagatcctctcaatcggccaccaccaacaaacacagccttggcggcaacagtcactctccaacgaatcttcggcggcgaaaatgtctctggtggcgaacgaggagttccagcacattctgcgtgtgctgaacacgaacgtggatgggaagcagaagataatgttcgctatgacatccatcaagggtatcggcaggagattcgccaacatctgttgcaagaaggccgacgtcgacatgaacaagagggctggtgagttgagtgctgctgagctggacaatctgatgacggtggttgcgaaccctcgccaattcaagatccctgattggttcctcaacaggaagaaggactacaaggatggcaaatactctcaggtcgtctctaatgccctcgatatgaagctcagggatgaccttgagagactcaagaaaatcagaaaccaccgtggtttgaggcactactggggccttcgtgttcgtggtcagcataccaagactactggccgcaggggaaagaccgttggtgtctcaaagaagcgttgaagctgttatgcttttggtttggagattagagatgatgttgaagaggcatatttgaagtacattagacatgtttcctatatacctactttgtattggttgttgaatgcgatgacaatttcagttttgtttgtttatttgcgttaagtttttcatttagttgaatgttttgatagagaaccttgaatagttttgatgaaattgcgtattcgcattgtttcctaaaa

SEQ ID NO: 2623 - DNA, 544 bp, Glycyrrhiza uralensis
tgactgcttctctcactctgagctctctcgctttacacttcagagtcgagagagcgagagagagagagtcgatcatgtctctggtagcgaacgaggattttcaacacattcttcgtgttttgaacaccaatgtcgatggcaagcagaagatcatgttcgcccttacctccatcaaaggtattggtcgccgtttcgccaacatcgtttgtaagaaagccgacgttgacatgaacaaaagagctggtgaactaacagctgctgaacttgatcagctgatggtgattgtggcaaatccgcgccaattcaagattcctgactggtttctcaacaggaaaaaggattacaaagatggcaagtactcccaggttgtatccaatgcattggacatgaaactcagggatgatctggagcgtttgaagaagataagaaaccaccgtggtctgaggcactactggggtcttcgagttcgtggacagcacacaaagaccactggacgtaggggcaagactgttggtgtctctaagaagcgttgagttttcattct

SEQ ID NO: 2624 - DNA, 899 bp, Cucumis melo
ttggtaagtcgtccgtttcgttgcagcctcttagccaaggagaagaagcatcaggacgaagacgctcaacctcttctctcaacaatgtcgttggtagcgaacgaagatttccagcacattttgcgtgtgctcaacacaaacgttgatgggaaacagaagatcatgttcgctcttacttccatcaaaggtattggaaggcgtttcgccaacattgtctgcaaaaaagccgacgtcgacatgaacaagagagctggtgaattaactgctgccgagctggacaatctcatggtggttgttgccaacccccgacagttcaaaatccccgattggtttttgaacagacagaaggattacaaggatggaaagtattcacaggttgtgtctaatgctcttgacatgaagctgagagacgacttggagcgtttgaagaagatcaggaaccaccgtggtctgaggcattactggggtcttcgtgtccgtggtcagcacaccaagactactggtcgccgagggaagactgttggtgtctctaagaagcgttaaacaatgtctgtttttattttgcttgacaagcaaattttcagcaaattttctgttggatgcaatatttcagattaatggaattagttgtttgagattcggtttagaactttttggatttggctgtggggttccttaagcctctctctgccggttatatttcacatcgatgattcatttttgctccttataatagagattgaaatcccagttgagttatttgttattctccattatctgcttcgcattgtgtattggtgtttactgttgattaatgttatagccatttgataaggtcactattaataaccgtttacttatatatatatatttggacaattatgctgaagaaaaaaaaa

SEQ ID NO: 2625 - DNA, 801 bp, Cucumis melo
caaaagatctcctctggttctttcctgcagttgcgccgccgggaattcttccaaccccttgcctctatcttcattcgccatgtcactggtagcaaacgaggattttcagcacattctgcgtgtgctcaacactaacgtcgatgggaagcagaagattatgtttgctctcacatcaattaaaggtattggaagacgttttgctaacatcgtttgcaagaaggctgatgtcgacatgaacaagagggctggtgaactaactgctgccgagttggataatctcatggtggttgttgccaatccacgacaatttaaaattcccgactggtttttgaataggcagaaagactacaaggatggaaaatattctcaagtagtttcaaatgcattggacatgaagttgagagatgatttggagcggttgaagaagattaggaaccaccgaggtctaaggcactactggggcctcagagtccgtggtcagcacactaagaccactggtcgacgagggaaaactgtcggtgtctccaagaagcgttgagcatttgcttgtttttatagtcgagtatgtgtttgggcaaatcaagttctttggccttttagttgaacatttgagctgtactttctttttggaacttttgtttgggatgtggtatttttgttttaagtttaactcttttttttatgtctttgattaggctagaaaaggaagtttgatagtggcaaatggtaaagattatgaatccatattgatccttttggtgtgaaaaagtgttgagagattttatttataaagttgttatt

SEQ ID NO: 2626 - DNA, 660 bp, Nuphar advena
gatctctccgttgtcacaatgtctctcattaccaacgaggatttccagcacattcttcgtatcctgaatacgaatgtcgatgggagacagaagatcatgtttgccctcacctccatcaagggtgtcggccgaaggttcgcgaacattgcctgcaagaaagctgatattgacatgaacaagagggccggtgagttgtcttctgctgagctagagcaacttatggtaattgttgcgaacccccggcagttcaagatcccagattggtttctcaacaggaagaaggattacaaggatgggagatattcccaggttgtttcaaattcattggacatgaaattgagggacgatttagagcgtttgaagaagattaggaaccaccgcggtcttcggcactactggggccttcgtgtgcgcgggcagcataccaagacaaccggccgtcgtggtaagactgttggtgtctctaagaaacgatgagaagtctgggtcatccttgtgctttgatagtttgctgtgctgctgcttttggatttctttcatgaacaactcgactaccttcatcagacatgactcgtatcatgtttttgtttcaattttgtgttggcattattacctttaatagctattcttaattaatctagttgaactattttgtgagcc

SEQ ID NO: 2627 - DNA, 662 bp, Avena sativa
caggtgaggagttccagcacatcctgcgtgttctgaacaccaacgccgatggaaagcagaagatcatgttcgcgctgacctccatcaagggtattgggcgtcgcttctccaacatcgtctgcaagaaggccgacatcgacatgaacaagagggctggagagctcactacagaggagatggaacgtctgatgactgtggtgcacaacccacggcagttcaaggttccggactggttcctgaacaggaagaaggactacaaggacggcaggttctcccaggtcgtctccaaccaggtcgacatgaagctcagggatgacctcgagcggctcaagaagatccgcaaccatcgtggtctgcgtcactactggggcgtccgtgtccgtggtcagcacaccaagactaccggaaggagaggaaagactgttggtgtctcgaagaagcgataagctccatattcaccccacatagcttgccactacttctgtgttggtccatttcgagagtcttaatgaagtgtcttgtttagacaattaccccggatgatgttttgccctaggtcatattttgcacttgtggaactttaatatattgtatcttgaattcctcttttgaactcctaagagtaatttggtatccatacccctgttgtgggttgactcctt

SEQ ID NO: 2628 - DNA, 931 bp, Avena sativa
cagctgaagacgatcttcgcgcttggccgctgccagctcctcctccagcgagagctccgcccaacgccgtcgtcatgtcgctcatctcgggggaggagttccagcacatcctgcgtctgctcaacaccaacgttgatggcaagcagaagatcatgttcgcgctcacctccatcaagggtatcgggcgccgctactcgaacatcgtctgcaagaaggccgaccttgacatgaacaagagggctggtgagcttactactgaagagcttgaccgtgtcatgaacgtggtgcaaaaccctcgctcgttcaaggtccctgattggttcctgaacagaaagaaggattacaaggatggcaggtactctcaggttgtttccaatggtgttgacatgaagctgagggatgacctcgagaggttgaaaaagatcaggaaccaccgtggtctgcgtcactactggggtgtccgtgtccgtgggcagcacaccaagaccactggcaggaggggaaagactgtcggtgtctccaagaagagataaacctgatgcccattggtctcggcatgctggcttatcttcattgtcgcttgatgatgtgcaactctggtgccctcgtcggtggacagttttgttggggattatgtttgcatgtctatgataaagtcatggtctgttctggtttatggcactgctaagcgcaattttgctgtcagtcttgtttgtttattaagtgtttactgaatggagatagttttgtgtttggaccatgtttgtggtaagtattttgcatcaatgtcagattgataacttgcatctggttgccctggtcatttgtgtctgcgacccaagctgagtgtaactaactgtaccaagatggctggatctatcagtgctgttgcgctgactctagaatgattccggccgtagagggttggcct

SEQ ID NO: 2629 - DNA, 778 bp, Elaeis guineensis
gccgccgccttgcactctaactccaattccaaccgatcggccgaggagggcttccttctttccctgatcaagtgctcgatctcagaaaccatgtcgctggtggcgaacgaggatttccagcacatattgcgagtcttgaacaccaacgtggatggcaagcagaacgtaatgttcgccctcacgtccatcaagggtattggcaggcgtttcgccaacatcgtctgcaagaaggcagacgtcgatatgaacaaaagggctggtgaactttctgctgaggaactggagaatctaatggtcgttgtggcgaacccaaggcaattcaagatcccagactggttcttgaacaggaagaaggaccacaaggatgggaggtattctcaggtggtctccaatgctcttgacatgaagctgagagacgatttagagcgattgaaaaagatcaggaatcaccgtggcttgcgacattactggggtcttcgtgttcgggggcaacacaccaagacaaccggccgaaggggaaagactgttggtgtctcaaagaagcgttgagtcgttcgattttttttattccagtggctggataattatttattgaagtgaatgccttttggtttgaattcaactagttaaagaacaccatctcatttttgttttttggtgtaggattgcagcatgataaactttatggatgtagacttcttttgttatctttgaatttgtgtactcaaatgttatttggcatatcttagaatatctcttattttacaaaaaaaaaaaa

SEQ ID NO: 2630 - DNA, 669 bp, Olea europaea
ttttttttatcctccgaagccaaagcagccgtcttacacaaaccgaccgaattctcgccatgtctttgatagcaaatgaggattttcagcacatccttcgtgtgcagaacacgaatgtggatggtaagcagaagataatgttcgcacttacgtcaatcaagggtatcggtcgtcgattcgccaatattgtctgcaagaaagctgatattgacatgaacaagagggctggtgagctttcggccgctgagattgacagcttgatgactattgtggccaatcctcgacaattcaaaatccccgactggtttctgaacaggaagaaggattacaaggatggaaaattttctcaagtgacttctaatgctctggacatgaaactgagggatgatcttgagcgtttgaagaagattaggaaccaccgtggtctccgtcactactggggtcttcgagtgcgtggacagcacaccaagaccactggccgtaggggaaagactgttggtgtctccaagaagcgatgattctctttcgcattattctcacgaaaacactgtttggctttaggcttcacttgacctatgatctcgcatctgataaaatgctagctttcggatctcttttaaagaactttcttaagtgtgattttggggtattgttgttaaatgttacttc

SEQ ID NO: 2631 - DNA, 849 bp, Olea europaea
cgcaggggagggtttcgggcttttttatcctccgaagccaaagcagccgtcttacacaaaccgaccgaattctcgccatgtctttgatagcaaatgaggattttcagcacatccttcgtgtgcagaacacgaatgtggatggtaagcagaagataatgttcgcacttacgtcaatcaagggtatcggtcgtcgattcgccaatattgtctgcaagaaagctgatattgacatgaacaagagggctggtgagctttcggccgctgagattgacagcttgatgactattgtggccaatcctcgacaattcaaaatccccgactggtttctgaacaggaagaaggattacaaggatggaaaattttctcaagtgacttctaatgctctggacatgaaactgagggatgatcttgagcgtttgaagaagattaggaaccaccgtggtctccgtcactactggggtcttcgagtgcgtggacagcacaccaagaccactggccgtaggggaaagactgttggtgtctccaagaagcgatgattctctttcgcattattctcacgaaaacactgtttggctttaggcttcacttgacctatgatctcgcatctgataaaatgctagctttcggatctcttttaaagaactttcttaagtgtgattttggggtattgttgttaaatgttactctccttttttagcgattttgttgcattttaagtatttataggccgataaatcagcatgtcacctctattatttgagattccggattcatatcttctgtttttatgttcttaacagcgtcatggttgcatttggtaatatagaaagtcaaatttttatcaaaaaa

SEQ ID NO: 2632 - DNA, 596 bp, Olea europaea
ttgtggcgatttactctactgaagcgaagtagccgatctgggaattgttgcagcttctccacaaccaattcgcaatagtagccatgtctctgatagcaaatgaggatttccagcatattctgcgtgtgcagaacacgaacgtggacgggaagcagaagatcatgttcgccttgacctccatcaagggtattggccgccgattcgcaaatattgtctgcaagaaagccgacatcgacatgaacaagagggccggtgagctctcagctgcggagattgacagcttgatgactattgttgcaaatcctcgtcaattcaagatccccgactggtttctgaataggaagaaggattacaaggatggaaagttttctcaagtgacttccaatgctttggatatgaagcttagggacgatctggaacgtctgaagaagatcaggaaccaccgtggtctgcggcattactggggtcttcgtgtgcgtggacagcacaccaagaccactggccgcaggggaaaaactgttggtgtctccaagaagcgatgagcctcatctttttatactgttctctttgtcgttttgtctgaatttttgctgcgg

SEQ ID NO: 2633 - DNA, 780 bp, Olea europaea
ttgtggcgatttactctactgaagcgaagtagccgatctgggaattgttgcagcttctccacaaccaattcgcaatagtagccatgtctctgatagcaaatgaggatttccagcatattctgcgtgtgcagaacacgaacgtagacgggaagcagaagatcatgttcgccttgacctccatcaagggtattggccgccgattcgcaaatattgtctgcaagaaagccgacatcgacatgaacaagagggccggtgagctctcagctgcggagattgacagcttgatgactattgttgcaaatcctcgtcaattcaagatccccgactggtttctgaataggaagaaggattacaaggatggaaagttttctcaagtgacttccaatgctttggatatgaagcttagggacgatctggaacgtctgaagaagatcaggaaccaccgtggtctgcggcattactggggtcttcgtgtgcgtggacagcacaccaagaccactggccgcaggggaaaaactgttggtgtctccaagaagcgatgagcctcatctttttatactgttctctttgtcgttttgtctgaatttttgctgcggcttaactaagttcttacagttagtattttgctctctattttacgttggtttttgatgtgttggatttcaatgactcttatggcaaaaccattagttacctaattaccttgtaacgatgcgattctggaaaattataaaacaagttgcagtagggcccggttttgatagcctaattgaattcagt

SEQ ID NO: 2634 - DNA, 687 bp, Lippia dulcis
caccagattagggcttgcgaatttaatatcggagtttcgccggctcagagaaccctagtctagagcaatgtcgcttgttgcaagcgaggatttccagcacattctgcgtgtgcagaacacaaatgttgatggaaagcagaagatcatgttcgccatgacctcgattaagggtgtcgggcgccgtttcgccaacattgtctgtaagaaagctgatatcgacatgaacaagagggctggtgagctttctgctgctgagatagatagcttgatggtgatcgtggcaaatcctcgacaattcaagatcccagactggtttctgaataggaagaaggattacaaggacgggaagttctctcaagtgacttccaatgccttggacatgaaactgagggatgaccttgaacgtttgaagaaaatcaggaaccaccgtggtctgcgtcactattggggccttcgtgtgcgtgggcagcacaccaagactactggtcgcaggggaaagactgttggtgtctcaaagaagcgctgagaatcttggttttctgtctttgttttgtatttcttgactttccatcacatatatattgctgagtttggtattgttgaggattttagttttggatactgcttcagtttcagttttgtcgtgtaggacgacgagtcaatagaatttatgatttgatccactaa

SEQ ID NO: 2635 - DNA, 866 bp, Cajanus cajan
atcaaagcagtgagtgagagagaggagccacaacacggagatacagagcgcggaaaccctagaatctctaatccctaatcgggtcaagagcttcggaagcgatctcataaaataatgtctctggtggcaaacgaggattttcagcacattctgcgtgtgctgaacaccaatgtagatgggaagcagaacataatgttcgctcttacctctatcaaaggtattggcaggcgattcgctaacatttgctgcaaaaaagccgatgtcgacatgaacaagagagctggtgaattgactgctgctgagttggataatcttatgactgtggttgccaaccctaggcaattcaagatcccagattggtttttgaataggaagaaggattacaaggatggcaaatattctcaggtggtgtccaatgctctggatatgaagttgagggatgatttggagcgcttgaagaaaatcagaaatcaccgtggtttgaggcactactggggccttcgtgttcgaggccagcacactaagactactggtcgcaggggtaaaactgttggtgtctctaagaagcgttaagctgttatatttttgctttgagaatagatatggttagtgaagcaaattttgaattaagtgagacatggttccataaaacataaatttgtattggttgttaagttttgtgatgttttcaattgtttttttaatttgctttacctggtgttgagatgcatattagcatttgatgcggaccagaaaaatggtgaaataataggatatattgtattcaacttcaattgtgaaaaccaaagtacatcagaaaattaaatcaagcagagtatttaagagagaacatgtatatcagaaaa

SEQ ID NO: 2636 - DNA, 925 bp, Cajanus cajan
acagcaaaaccctagcgcagtcggagcacactatataatatagactcaatcccaaaccctagagtttcagatcctcaatcggccaacaccaacagctccggcggcgaccgtcactctccaacaacccttccgcggcgaaaatgtctctggtggcgaacgaggatttccagcacattctgcgtgtgctgaacactaacgtggatggcaagcagaagataatgttcgctctcacctccatcaagggtattggtcggagattcgccaacatggtttgcaagaaggccgatgttgacatgaacaagagggctggtgagttgagtgctgctgagttggataatttgatgactgtggtggccaaccctaggcaattcaagatcccagattggtttttgaacagaaagaaggattacaaggatggcaagtactctcaggttgtgtctaatgctcttgatatgaagctaagggatgacttggagagactcaagaaaatcagaaaccaccgtggtttgaggcactactggggccttcgtgtccgtggtcagcatactaaaactactggccgcagggggaagactgttggtgtctctaagaagcgttaagatgttatgccttggctcggagttgttagattttgttgaggaggcaaatttgaagtacattagacatgttttgcataccaactttgtatcggttgttagatgctgtgacaatttcaattttgtttgttatttgtgttaagcgtccgtctagttgaatgttggttttttaagtcgttgagaaccttgaatagtattgatgaatcatgaaattacatattcactttaatgattattcctggaaggaaaatgctacattctaaaattcaaattataatattagcattaaattagagacacgtttataacttaaatgaattgttgaattt

SEQ ID NO: 2637 - DNA, 720 bp, Platanus occidentalis
gccctctcaccgtttccttaccctagtttcattccgagagaagacagaggagaggcggcggagcttagctatgtctctcgtagcgaacgaagagttccaacacattcttcgtgttctgaacacgaacgtcgatgggaaacagaagatcatgtttgccctaacttcgatcaaaggtatcggtcgccgtttcgccaacatcgtctgcaagaaggctgatgtcgacatgaacaaaagagctggtgaactatcagctcaggagcttgagaaccttatggtgattgttgcaaatccgcgccaattcaagatccccgactggtttttgaataggaagaaggattataaggatggcaggtattctcaggttgtttccaatgcattggacatgaaactgagggatgaccttgagcgtttgaagaagatcaggaaccaccgtggtctccggcactactggggtcttcgagtgcgtgggcagcacaccaagacgactggccgaagggggaagactgtcggtgtctcgaaaaagcgatgagtttttttatgttatcctatctgggtttctgcaaattttgttcacttttttcttggattatgttgaagagttttatatggtaagggtcttctctttctaataggtttgatgaattcatggacgtttttagctttgttttttctatatggttcgtgataatattatgtgacttgtctagacgatgccctttt

SEQ ID NO: 2638 - DNA, 760 bp, Populus trichocarpa
tcctctgctacaacccgcccgttcccgccccgccccgccccgccccgccccagagccccgctcctctcgaaaacacaaaatgtctttggtggctaacgaggattttcagcacattctacgtgtgctgaacacgaatgtagatggtaaacaaaagataatgtttgctttgacatcaatcaaaggtattggcaggcgtttctctaacattgtctgcaagaaggccgatgttgatatgaacaagagggctggtgaactatctgcagccgagttggataacctcatgactattgttgcaaatcctcgccagttcaaaatcccagactggtttttgaataggcagaaggattacaaagacgggaagtattctcaggtcgtgtcaaatgcattggacatgaagttgagagatgatttggagcgtttgaagaagatcaggaaccaccgtggtctgaggcactactggggtcttcgtgtcagggggcagcacacaaagactactggccgtcgtggaaagactgttggtgtctctaagaagcgttgaacatacttttgctgcattgaacaaattttatatatggtttggcgggatcggtccctttttggtatgattaatgtttgctctagacaagtttagaggcgattttgttagatgacaaatatttttattattgtgaactcccttatctatttgaatcagttgccaaaatcttgttttcactatatgaagaatagtttcacttgacatccatttcagattttatta

SEQ ID NO: 2639 - DNA, 831 bp, Populus trichocarpa
tcctctgctacaacccgcccgttcccgccccgccccgccccgccccgccccagagccccgctcctctcgaaaacacaaaatgtctttggtggctaacgaggattttcagcacattctacgtgtgctgaacacgaatgtagatggtaaacaaaagataatgtttgctttgacatcaatcaaaggtattggcaggcgtttctctaacattgtctgcaagaaggccgatgttgatatgaacaagagggctggtgaactatctgcagccgagttggataacctcatgactattgttgcaaatcctcgccagttcaaaatcccagactggtttttgaataggcagaaggattacaaagacgggaagtattctcaggtcgtgtcaaatgcattggacatgaagttgagagatgatttggagcgtttgaagaagatcaggaaccaccgtggtctgaggcactactggggtcttcgtgtcagggggcagcacacaaagactactggccgtcgtggaaagactgttggtgtctctaagaagcgttgaacatacttttgctgcattgaacaaattttatatatggtttggcgggatcggtccctttttggtatgattaatgtttgctctagacaagtttagaggcgattttgttagatgacaaatatttttattattgtgaactcccttatctatttgaatcagttgccaaaatcttgttttcactatatgaagaatagtttcacttgacatccatttcagattttattatctctgtttcttgtctgcataagctgctcttttacttttgatatttttttgagcgatcttttggatattcc

SEQ ID NO: 2640 - DNA, 944 bp, Papaver somniferum
tcccccagagagaagaagaaagagttccactcgagatcccttcaacaaaatgtctttggttgcaaacgaagattttcaacacattcttcgtgtgttgaacactaacgttgatggaaagcaaaaggttatgtatgccttgacctcaatcaagggtattggtaggagatttgccaatattgtctgcaagaaagctgatgttgacatgaacaagagggctggtgaactatctgcagctgagttggagaatttgatgacaatcgttgctaacccacgtcaattcaaaattccagactggtttttgaacagaaagaaggattacaaggatggaagatactcacaagttgtatctaatgctcttgacatgaagctcagagatgatttggagcgtttgaagaagatcaggaaccatcgtggtttgaggcattactggggtctcagagtccgtggacagcacaccaagactactggtcgcagaggtaagaccgttggtgtctccaagaagcgttgaagactggttgttattcttttggtcggagaagttgttatggtgaactttgtcattctgctttaaaattggaacctggaaggacttaaattatgatactaccagtatagtttaggattttgaatatcttggaattttaatgtcctgcatttttcttactgaaatctgcgaccacattttgatatggaacttctttgtatttggcttttttaagtgttaacagttagatatgctgcaccaaaatctggaaatttgatttgttttgattgttctctttttcaagttcagcattagtttctcagttttaaccttgtatcagaaaaaccttcttccttgctatgcatgtttagtttcatgactgagtaatgcagtcaatttgatttaacttgaaaacttgaacatagttttctgggtttgacaaaaaaaactgagtcggaga

SEQ ID NO: 2641 - DNA, 678 bp, Salvia sclarea
gcggagcagccgtcgaagaacgtaaaataccgcagctgctcgattccaaccctaaaaatgtctcttgtagctaatgaagatttccagcacattctgcgtgtgcagaacacgaacgtggacggaaagcagaagatcatgttcgccatgacctcaatcaagggtattggtcgccgtttcgccaacatcgtctgcaagaaagccgatgttgatatgaataagagggctggtgaactcactgctgctgaacttgatagcttgatggttattgtggcaaacccccgtcagttcaagattcccgactggtttttgaacaggaagaaggattacaaggatggcaagttttcccaggtgacatcaaacgctcttgacatgaagcttagggatgatcttgagcgattaaagaagatcagaaaccaccgtggtctccgtcactactggggccttcgcgtgcgtggacaacacaccaagaccactggtcgtaggggaaagacagtgggtgtctccaagaagcgatgagcgttatcttttctatttatctctttgttatggatacttttgtttcgttttaggctttgcaagcgcctataagagatttacatgaccggctcttgttatctttgttttggattccaatattaattttgatcatggtttttaagactcggtaaaaaaaaaaaa

SEQ ID NO: 2642 - DNA, 755 bp, Glycine max
acaacaaaaccctagcgcagtcgcagcacactatattagagtttcagatcctcaatcagccagctacaacagcatcgtcggcggcgtaaccctccaacaacaacacttcctcgtcagaaaatgtctctggtggcgaacgaggatttccagcacattctgcgtgtgctgaacaccaacgtggatgggaagcagaagataatgttcgcaatgacctccatcaagggtattggaaggagattcgccaacatcgcttgcaagaaggctgatgttgacatgaacaaaagggctggtgagttgactgctgctgagttggacagtgtgatgactgtggtggcgaaccctaggcagttcaagatcccaaactggtttttgaacagaaagaaggattacaaggatggcaaatactctcaagttgtgtctaatgctcttgatatgaagctcagggatgatctcgagagactcaagaaaatcaggaaccatcgtggtttgagacactactggggtcttcgtgtacgtggccagcataccaagaccactggtcgtaggggtaaaactgttggtgtgtccaagaagcgctgagctctcacttcctttcttttttccccgttttttgaaggagatatatttttgttttgttaaagtcgacaaaattttattgagaacggatttggattttgttgcattcgaacgttgattttgattgggttggttgatcttatttattttacttattaatcctatgtctttttggtcca

SEQ ID NO: 2643 - DNA, 961 bp, Glycine max
cgacgtcgttctcagtggcgcacacaacaaaaccctagcgcagtcgcagcacactatattagagtttcagatcctcaatcagccagctacaacagcatcgtcggcggcgtaaccctccaacaacaacacttcctcgtcagaaaatgtctctggtggcgaacgaggatttccagcacattctgcgtgtgctgaacaccaacgtggatgggaagcagaagataatgttcgcaatgacctccatcaagggtattggaaggagattcgccaacatcgcttgcaagaaggctgatgttgacatgaacaaaagggctggtgagttgactgctgctgagttggacagtgtgatgactgtggtggcgaaccctaggcagttcaagatcccaaactggtttttgaacagaaagaaggattacaaggatggcaaatactctcaagttgtgtctaatgctcttgatatgaagctcagggatgatctcgagagactcaagaaaatcaggaaccatcgtggtttgagacactactggggtcttcgtgtacgtggccagcataccaagaccactggtcgtaggggtaaaactgttggtgtgtccaagaagcgctgagctctcacttcctttcttttttccccgttttttgaaggagatatatttttgttttgttaaagtcgacaaaattttattgagaacggatttggattttgttgcattcgaacgttgattttgattgggttggttgatcttatttattttacttattaatcctatgtctttttggtccaatttgtgttggagaccatgttgatttccattaaatatgccctaatctagtaatctcgagcaaggttattgtatgattactacccaaggcctatcttagaagcataatgcttgagtgaaatatttcttatgtgaaaatgtttataagctcaaataatatgcagtttaagattatattaaaaaaa

SEQ ID NO: 2644 - DNA, 876 bp, Glycine max
gaggttttagcctaggaaccgtgttcatctactctgagccgcataacttcccggaatcgtgcatacctacgttcaatatgtcgctggtggcaaacgaggatttccagcacatacttcgtgttttgaacacgaacgtagatgggaagcagaagataatgttcgctcttacctcaatcaaaggtattgggaggcgattttctaacatttgctgcaagaaggctgatgttgacatgaacaaaagagctggtgaactgagtgctgctgagttggatagtgtgatgactgtggttgccaacccccggcaattcaagattccggactggtttttgaacagaaagaaggactacaaggatggcaagtattctcaggtggtgtcaaatgcactggatatgaagttgagggatgacttggagagacttaagaaaatcaggaaccatcgaggtttgagacactactggggtcttcgtgtacgtggccagcataccaagaccactggtcgtaggggtaaaactgttggtgtgtctaagaagcgctgagctttcacttcctttttcttctgtttttttaagaatgagatatattatttttttgttaaagccgacaaaattttattttgagaatggatttggattttgttgcatttgaacgttgattgtgattgggttggttgatcttatttattttacttattaatcctatgtctttttggtccattttgtggtggataccatattgatttccattaaatataatgccctaatctcgagcaaggttaatgtatgacctatcttagtagcataatgcttgagtgaaatatttcttatgtgaacatgtttatcagcacagctaataaagatgatgatgtccttattgaaa

SEQ ID NO: 2645 - DNA, 940 bp, Glycine max
ataagcccggcccatgtttatttctcctacaaatataagaacccttttctgatactttgaggttttagcctaggaaccgtgttcatctactctgagccgcataacttcccggaatcgtgcatacctacgttcaatatgtcgctggtggcaaacgaggatttccagcacatacttcgtgttttgaacacgaacgtagatgggaagcagaagataatgttcgctcttacctcaatcaaaggtattgggaggcgattttctaacatttgctgcaagaaggctgatgttgacatgaacaaaagagctggtgaactgagtgctgctgagttggatagtgtgatgactgtggttgccaacccccggcaattcaagattccggactggtttttgaacagaaagaaggactacaaggatggcaagtattctcaggtggtgtcaaatgcactggatatgaagttgagggatgacttggagagacttaagaaaatcaggaaccatcgaggtttgagacactactggggtcttcgtgtacgtggccagcataccaagaccactggtcgtaggggtaaaactgttggtgtgtctaagaagcgctgagctttcacttcctttttcttctgtttttttaagaatgagatatattatttttttgttaaagccgacaaaattttattttgagaatggatttggattttgttgcatttgaacgttgattgtgattgggttggttgatcttatttattttacttattaatcctatgtctttttggtccattttgtggtggataccatattgatttccattaaatataatgccctaatctcgagcaaggttaatgtatgacctatcttagtagcataatgcttgagtgaaatatttcttatgtgaacatgtttatcagcacagctaataaagatgatgatgtccttattgaaattattt

SEQ ID NO: 2646 - DNA, 793 bp, Glycine max
gaatttcagatcctcaatcggccagcaccaacagcatcggcggcgacagtcactctccgacaacaacacttccgcggcgaaaaatgtctctggtggcgaacgaggatttccagcacattctgcgtgtgctgaacaccaacgtggatgggaagcagaagataatgttcgctatgacctccatcaagggtattggaaggagattcgccaacatcgcttgcaagaaggccgatgttgacatgaacaaaagggctggtgagttgagtgctgcagagttggatagtgtgatgactgtggtggcgaaccctaggcaattcaagatcccggattggtttttgaacaggaagaaggattacaaggatggaaagtactctcaggttgtgtctaatgctcttgatatgaagctcagggatgacttagagagactaaagaagatcagaaaccaccgtggtttgaggcactactggggccttcgtgtccgtggtcagcacaccaagactactggccgcaggggaaagactgttggggtctctaagaagcgttaagctattatgttttggcttggatattagattttgtttaggaggcatgtttgaagtacactacatgttttgcatcataccaactttgtatccgttgttaaatggcttgacaatttcaattttgtttgttatttgcatctgagattccgattagttaaatgatgttggttttcttagttgtagagaaccttgaatagtatttttgaaattacgaattcagtttgatccgggaaggaaaatttcgtcatttcaaa

SEQ ID NO: 2647 - DNA, 956 bp, Glycine max
ccacacaacaaaaccctagctcagtcgcggcacactatataacatcaactcaatcccaaaccctagaatttcagatcctcaatcggccagcaccaacagcatcggcggcgacagtcactctccgacaacaacacttccgcggcgaaaaatgtctctggtggcgaacgaggatttccagcacattctgcgtgtgctgaacaccaacgtggatgggaagcagaagataatgttcgctatgacctccatcaagggtattggaaggagattcgccaacatcgcttgcaagaaggccgatgttgacatgaacaaaagggctggtgagttgagtgctgcagagttggatagtgtgatgactgtggtggcgaaccctaggcaattcaagatcccggattggtttttgaacaggaagaaggattacaaggatggaaagtactctcaggttgtgtctaatgctcttgatatgaagctcagggatgacttagagagactaaagaagatcagaaaccaccgtggtttgaggcactactggggccttcgtgtccgtggtcagcacaccaagactactggccgcaggggaaagactgttggggtctctaagaagcgttaagctattatgttttggcttggatattagattttgtttaggaggcatgtttgaagtacactacatgttttgcatcataccaactttgtatccgttgttaaatggcttgacaatttcaattttgtttgttatttgcatctgagattccgattagttaaatgatgttggttttcttagttgtagagaaccttgaatagtatttttgaaattacgaattcagtttgatccgggaaggaaaatttcgtcatttcaaattcaagtactataattagtaaataaattaggagacattgaattttgctagtggtttcgtacgtagttttcacatatggaaatgttgatgcttgatcac

SEQ ID NO: 2648 - DNA, 588 bp, Euphorbia esula
gaagaagaagcatcaggacgaagccgctcgccctctgccctgaaaaatgtcgttggtagcgaacgaagatttccagcacattttgcgtgtgcttaacacaaatgttgacgggaagcagaagatcatgttcgctcttacttccatcaaaggtattggaaggcgtttcgccaacatcgtctgcaagaaagccgatgtcgacatgaacaagagagctggtgaattaactgctgccgagctggacaatctcatggttgtcgttgcgaacccccgacagttcaaaattcccgattggtttttgaatagacagaaggactacaaggatggaaagtattcacaggtggtatcaaatgctcttgacatgaagctgagagatgacttggagcgtttgaagaagatcaggaaccatcgtggtctgaggcattactggggtctccgtgtccgtggtcagcacaccaagactaccggtcgccgagggaaaactgttggtgtctctaagaagcgttaaaaacctctccttttatattttgcaagcaaattttctgttggatgcaatattagattaatggaattagtccttttgagattggg

SEQ ID NO: 2649 - DNA, 840 bp, Taxus baccata
gacaagtggtatcaacgcagagtacgtcggggatagcaggtctagggttcggacgagggtttaatagttaacgcctttaatcagtgcgatccttctgttttccatacctcgcacttgcatccattcgtgcgatcccgcccctgcaccaacgattttctgcgaaaatgtcgctcatagcgaatgaagattttcagcacattctccgtgtgctgaataccaacgtggatgggcgacagaagattatgtttgctctgacttccatcaagggtatcggccgccgttttgcaaatattgtctgcaagaaggccgatgttgacatgagcaaaagggctggagagctgtcagcacaagaattggaaaatctgatggtaatagtggcaaaccccaggcagttcaagatcccggactggtttctcaacaggaagaaggatcacaaggatggtcgtttctctcaggtggtttccaatgcccttgatatgaagcttagggatgatttggagcgtctcaagaagatcaggaatcaccgtggtctgagacactactggggccttcgtgtacgtggacagcacacaaagaccactggtcgtaggggaaagactgttggtgtctcaaagaagcgttgattacttattttatttggtaaaagattgttatgcttagctggttagttctgtcacaggtggaggcttaaatatctctgttgcaagctttcagcagtgcctcgcaatccttggttttatatttgcttttgatgatttctatatgtatttcagaatatgaacatttttgaggactactataatgagctgacaattacggtacttcttgacctttgtgttt

SEQ ID NO: 2650 - DNA, 606 bp, Thalictrum flavum
accctaatcatgtctctggttgcgaatgaagactttcagcacattcttcgtgttctgaacacgaatgtcgatgggaaaaagaagattatgtttgccttaacttctatcaaaggtattggtcgtcgttacgccaatattgtctgcaagaaggccgatgtcgacatgaacaaaagagctggtgagctaactgcagctgagcttgagaacttgatggtcattgtcgccaatcctcgtcagttcaagatccctgattggtttttgaacaggaaaaaggattataaggatggaaggtattctcaagttgtatccaatgctctggacatgaaactaagggatgatctggagcgtctaaagaagatcagaaaccaccgtggtcttcgtcattattggggtctgcgagtgcgaggacagcacaccaagactactggtcgcaggggaaagactgttggtgtttccaagaagcgttgagtgcgacttacttattctatgtctgagaatttcctttttctgatgcaaattttgtaacaacttggatttggagtggacaaatttagatggacaagtttgatactttttggaattgttgagttattatcggtactctgc

SEQ ID NO: 2651 - DNA, 823 bp, Solanum lycopersicum
acacttctccgtatttagggttttctaagagcttggcatctcttccaaaacaaaagcagcagccgcagtgtaacacagtgaaaccctagccatgtctctggttgcgaacgaagattttcagcacattcttcgtgtgcaaaacacaaatgttgatggaaagcagaagatcatgttcgctatgacctctatcaaaggtatcggtcgccgttttgctaacattgcttgcaaaaaagccgatatcgatatgaacaagagggctggtgaacttactgctgcagagcttgacagcttgatggtagttgtggctaatcctcgccaattcaaaatcccagattggtttttgaacagacagaaggattacaaggatggcaagttttcccaagttacatctaatgcccttgacatgaaacttagggatgacttggaaaggctgaagaagatcaggaatcaccgtggtttgcgtcactactggggcctccgtgttcgcggtcagcacacaaagaccactggtcgcaggggaaagactgttggtgtctccaagaagagataaatcgtctacatgcaaattcctttattatgctttatgcttctctttagaattcggaatctggacacttgcaaaaagtttgttagggtatttttgtattgtttgcatttaaacttccttgtcccgccttttggagatctatagttcctataaatcctccgatggcagtgcaagcatgtgtttacttttgggatcaaagttttgccgattttactttggattaatacatcaaatatgagtacttttttatggagatgcatccttttttcagtttcc

SEQ ID NO: 2652 - DNA, 781 bp, Tripterygium wilfordii
ccttcttgttgctgctgctaagacgccaagagcggagagcctctgtcttctgtcatacagtccaaaaatgtcgttggtggcgaacgaggagtttcagcacatattgcgtgttctgaacacaaacgttgatgggaagcagaagatcatgttcgctctgacctcaatcaaaggtattgggaggagatttgcgaacattgtctgcaagaaagcagatgtggacatgaacaagagggctggtgaattaactcctgctgagctggacaatctaatggtggttgttgctaatcctcgacaattcaaaatcccagattggtttttgaataggcagaaggattacaaggatgggaaatattctcaggtcgtgtcaaacgctctggatatgaaattgagagacgatttggaacgattgaagaaaatcaggaaccaccgtggtctgaggcactattggggtctccgtgtgcgtggtcagcacaccaagaccactggtcgcagagggaagactgttggtgtctcaaagaagcgttgagatattattcttttcctggcaatgctattcctacattacgggaacgttcttgcatcagacagttttggacaaactttcttgacctcgttggagttttaaaaatgtgaaacctttatttcccttctcattaaatcgcttagttttgggtttgtttatgctttgtgtatgaattatttgcgtttcaattgcatgtctggactttgaatatgtttcttactgtccgtttggtatttactgtttttgttaaaggggatt

SEQ ID NO: 2653 - DNA, 914 bp, Tripterygium wilfordii
cctacattctctctcgcaagcaagagacctgcaatcgcacagtcgcaaaacaagctgagaagctatgtcgttggtggcaaacgaggagtttcaacatatacttcgtgtgctgaacacgaacgttgatggaaagcagaagatcatgtttgccctaacctccatcaaagggatcggtcgccgcttcgccaacatcgtgtgcaagaaagctgatgttgacatgaacaagagagctggtgagctaactgctgctgagctggagaacttgatggtggttgtagccaatccgcggcagttcaagatccctgattggttccttaacaggcagaaggattacaaggatggaaaatattctcaagttgtctcaaatgcattggacatgaagcttagggatgatcttgagcgtttgaagaagatcaggaaccaccgtggtcttagacactactggggtcttcgagtgcgtggtcagcacaccaagacaactggccgcagggggaagactgttggtgtctcaaagaagcgttaaattatgcctctttgtattaatttgatgtcctcctcccgcaacaaattttgttttattttaggtttacaagtctagggcagaagggatgcagtaattttgtggtggtagggttgccatcagatatcttgatatcaataccttatgttgactgcttaatctttcttttcaagattttgttataatgttctgcattgcattagctgattactatttcatcgagtgtgcacgccgttttatgaacgaatataagtttctcatcaccattttgcacgatcaaatgttagtttttgcttcgtgtttaatggtagggagtactaccgtatccattattgctggcatcaaatgtaaatgttggatcatttttatttttctagtttatttacatgaattg

SEQ ID NO: 2654 - DNA, 726 bp, Valeriana officinalis
tcttcttctctccaaaaatcgtaagcggctgctgaagaacttgtgtaactacttcgatccaagcactccagccatgtctctggtagcgaatgaggagtttcagcacattcttcgtgtgcagaacacgaatgttgatggaaaacagaagattatgttcgctatgacctccatcaaaggtattggtcgtcgtttctccaacatcgtctgcaaaaaggctgatatcgacatgaacaaaagagctggtgagctttcgaatgctgagattgacggtctgatgacaatcgtcgcaaacccacgccagttcaaaatcccagactggttcctcaacaggaagaaggattacaaggatggaaagttctctcaagttacatcaaatgcacttgacatgaaactcagggatgatcttgaacgcttgaagaagattaggaatcaccgtggtctacgtcactactggggtctgagagtccgtggtcagcatacaaagactactggcaggaggggtaaaaccgtcggtgtctcaaagaagagataagcttcttcttttctttctgcaatctatgctcttattacagacctgttttgttttcgtttgttcgaatttcaccccgagttcttcaggatcttttgagttttcttatttttagtacttattcggtaatttgtactggttttgatctgctgaatatcccatactacatcacttttgttcgatttagtagttttgtt

SEQ ID NO: 2655 - DNA, 986 bp, Citrullus lanatus
aaaactaaaagttcgaagagggtattttggtcaatttggtatagtcagaaaccctagaatctgaattgacaatatataaaatccttctccactctccacccaaagatctcctctggtgttttcctgcttttgctgccgccgggaattctacgaactccttgcttctatctacattcgccatgtcgctggtagcaaacgaggattttcagcacattctgcgtgtgctcaacaccaacgtggatgggaagcagaagattatgtttgctctcacttcaattaaaggtattggaagacgttttgctaacatcgtctgcaagaaggctgatgttgacatgaacaagagggctggtgaactaactgctgctgagttggacaatctcatggtggtggttgccaatccacgacaatttaaaattcccgactggtttttgaataggcagaaagactacaaggatgggaaatattctcaagtagtttcgaatgcattggacatgaagttgagagatgatttggagcggttgaagaagattaggaaccaccgaggtctaaggcactactggggcctccgagtccgtggtcagcacactaagaccactggtcgccgagggaaaactgttggtgtctccaagaagcgttgagcatttccttgtttctataagcgggttaagtatgtggttgttgggcaaatcaagttctttggccttctagttgaacatttgagctgtactttttggaatttttgtttaagatgtggtatttttgtttaagtttacccccttttttctactgtcttttaggctagaaaaggaaggttgacagtggcaaatggtaaagcttatgaaaccatattgatctttttggtgtgagaaagtgttgaaagattttatttatatagaattcttgtttggtgcaatcaggttttgcttgaaaacagggtgcagtttaattgggttgagaaatcaaatcatctccattttgttgatttt

SEQ ID NO: 2656 - DNA, 744 bp, Zostera marina
gggggctctcaaaaatctttattctttcgtccggaacggcaccgggaacctgaaaagaatagacctgaattcaaagttcccgaagtaggcggcgatggctttagttgcaaatgaggattttcagcatattctccgtgtgttgaacacgaatgtggatgggaagagaaagatcatgtacgcccttacctccatcaagggtattggacggcgttttgcaaacattgtctgtaagaaagctgatgttgacatgaacaagagggctggtgaaatatctgcagaagagcttgaaactttgatgaccattgtcgcaaatcccagacaattcaaaatcccagactggtttctcaacagaaagaaggattacaaggatggaagattctcccaagttgtttcaaatgcattggacatgaaactcagagatgatttggaacgtttgaagaagatcaggaatcaccgtggtctgagacattactggggtcttcgtgtccgcggacagcatactaagacaaccggtcgcagaggaaagactgtcggtgtttcaaaaaagcgttgattattcgtttatgtgtggttttttaacttttgttctctgcttatctttgttgagtaagattttggattatgtgatattttgaagaatgatttcactttagattatttaaatctcgacatcaatacattattctgtatgctttattttattcaaattgtttcttgttttctttactatatacatggaattta

SEQ ID NO: 2657 - DNA, 5443 bp, Malus domestica
atgttgagatctgggaaggtaaggggtgagagggataagcaaattgttgttcagaagaaaggggatgagttgaagcagggaggttcggattccggcggggagaaaacccggcatttggtttcgggtggggcggaggaatctgagaaagaattggaaggtggagaagatggtgatgtgggtgggaatgaaaatggtggagcaactgagagtgggaagaagaggtgcgttggtaacggtgaagaaattggtgatgataaaaagagagtgaaggaaaaagaggcagatagtgaagtgcgaatttttgggcgggttttgaaatcacagtcagcggcgaatggagggggtgataaggaggtgaatgatggggaactggttgcggaaaatagagaaaatgacgggactcagaaacaatgtagtgaggttaacaacaaagggaggaaggaaatgaaggtagatggtaaagtgcaagctattggttgggttctgcagtcacagtctgcggtgaatggtgggtatgataaggaagtgagtgatggtggtctggttgaagaaggtagagaaaacgacgggtctcataaacaacgtagtgaggtaaacaatgaatggaggaaggaaatggaggtggatggtgcagtgcaagttgttggtcgggttctgcaggcacagtcagcggtgaatggagggtgtgataaggatgtgagtgatggtgttctggttgccggaattagagaaagtgatgggtctgacaagcaatgtagtgaggtaaaagatgaaggggctgatctgttgggccagagtgaaaatgtgggagtaggtgagattgggaagaagaggaggcagggtgataatggcgaagaaattgatgatgatgctcttgaggaaaaaaaggtgaaggaagatgaggtggatggtaaagtgctaactacagttagggttcttcggtcacgagttgtggtgaatgaggggtgtgataaggcagggagtgatgggtcttgcaagaaatcttccaaagggggtgatcagttggttgaacggtttacaaagaagttgaaaggcaagagagggagcccactcaagatgaagaatttcaaacgcaagcgtgggagacctaagaaggtagaaaaggaacaaagtgatctgtcagttggtcagttgagaaaggaagaaagtgatggttcgggtgctgggctacataagatgaagattttgaaacgcaagcgtgggagacctaagaaggtagaaaaggaacagagtgatctgtcagttggtcagttgagaaaggaagaaagtgatggttcgggtgctgggcaacagaagatgaagaatttgaaacgcaagcgtgggagacctaagaaggtagaaagggaagagagtgatctgtcagttggttggttgagaaaggaagaaagtcatggttcgggtgctgggctactgcagatgaagaatttgaaacgtaagcgtgggagacctaagaaggtagaaaaggaggagagtgatctgtcagttggtcggttgagaaagaagtcaaaattgaagcacaagagatcacttaaggtgcagaagactaatgtggctttgaaaggaaagcttgctaaggaaggcaatatggttttgagatcgcaagaaagaatcaaagcgagtatgacaactaatggttcatatctggaaaggaggattattgggaaagagttggatgtgaaggccttttctccagctaaaagggataaaaaaggaaatgatttggagactgacgatagtgaggatggagaaggaagtaatgaacggaaacagaaacagaagggaaataaaggacagaaaaataagcagaagagtcgggatggagattgcgccagaagtaggcaaaaacagttggtgagagataagatagtggatctaattatgcgtgcaggttggaccattcaatataggcctaggaatggcaaagagtacaaggatgcagtgtacgtaactccagcaggacagactcactggtcggtcaccaaggcttacacaactcttaaagcgcattgtgaaaatggtgaaaataattccaagttttgtaagcctggcttcaaatttactttgataccaccagaggaaatcgacatgctagcaaggatacaagtcgtgaaaagggtggggaaaaagaaagggaagaagggcaaaaatggaatggagggtggaaagaagaaaaggcgtgggaatacagtggatggagttactgaagagaaaaagaaaaagaaattgggtaggccactcaaagggaaacgtttgcttcttgaaaaggatgattcagcacgtgcagcatgcaagggaaggcgaagtttatataagacaaaaaatagaaagcgatgtgctttactggttcggaactctgagaatgccgattcagatgatgatggccatgtactatatgacgggaaaagaacagttcttgcctggatgattgatttgggaaccctatcacttaattcgaaggtgaagtacatgaacaggagaaagacacaggtgcttcttgagggtaacattacaagagatggaattcattgtggttgctgtggagaaacaatctcgatttcgaagtttgtaacccatgccaaaagtgattactctgagccatttaaacatatatatctagactcagggtctacccttttgcaatgcctgcttgactcatggaatagacaggatgaatacgaccgtcggggattccatttcgtgggtgtcaacagggaagacccaaacgatgatacatgtggaatctgtggagatggtgggaacttgatttgttgtgatggctgtccatcaacattccatcaaaattgtttagagataaaggcaaaggatgctgtaaatgatgattccaatgatccatccttctgcgggaagaattgtcaagagctatttgcgagtcttcagatgcttcttggagtgaggcaagaaatcgaagatggattttcattgactctgattcaccgatctgatacgagctcaatttctatttgtgacacaccacagatagatgattgtgattcaaagctaattgaatgcaattccaagctggctgttgcatttttactaatggatgagtgttttttgcctatggttgaccacagaagtggagtcaatttgattcataatattctgtataatcgtgggtcaaattttagtagactgaattatagtggtttcttgactgcaattctagaaagaggtgatgagatcatatcagcggcatccatccggattcatgggaactatttagcagagatgccatttgttgggacccgatatatgtacaggcgtcaaggaatgtgccgtcggcttctaattggaattgaatctgctctcagctcgttgaatgttgaaagattggttatacctgcaatctcagaactcagagaaacatggacttctgtttttggttttaagccccttgaagaatcaagcaagcagaggatgaagaacatgaacatattggttttccctggtgtagatatcttagagaagccagtgtcgaagcacttaacagaagcaaatatgattcccgctgaaggtgtgaggtccactgaacttgagcatcagcaactcgagcaagaggttttatgtgatattaatgagaaacgtttggttgcgtctggaattgaagcatctgcaccctgtggaagtgaggcaagtgatgaacttgctgatgttgaatctgatacacagcatcactgtggtgtttctcaggataatctggaggagaaaagcaatacaattattattcctcctccatcaatgtgtgatatccatgaacaaactgaggaggtcaaccagagctctgcttcagttcctgatgtagggacagtggaagtggacacccaacaagaccagcatatcatgctcgaagtcgaaaacaaatctctgacatcacatcatagtagttctgttaggaaccacaattctcatgacgaaagatccatttgccgctctactgaaaataataccaccgagcagcagcacatcgcacatgaagtaaaggtttccgatgaaattactgtctgccatgattcagcgactacaactgaggcatctcatgaggcaagcgaccttaagcatcaggattctctaagtgtgcaggttgcaggatctattttctgtccggatggaaagatgtctgagacttgtgaagcggaatgtaaccatccttctactcagcatacacctgcagtgatagttgaggagcatccagaatctatcaagtgttatggctctgaaattctgactggaactagtgaggtcgccagtgatatacttcacccaactcccctgttgcctcaccagaaagcagatgagcttgaaggtaacaggctcaacactcataaagttgcagatgggtttgaaggcaacgggctcaacactcataatgttgcagatgagtttaaaggcaatgggctcaacactcaaaaagtcgactctgctcttacatgtggacatgccaagtccccggaggttactgatttgaatttaactcccgaggagtctcagaacacaacatccgtaaagcaatctgaactcgattctcagacaagtcccacacagtgcaactcgagcaatacgcctgttgtggctcttcactgcgcatccggtgggggtacttcgggggcggttattctatcaaatcaggctagggtttcgctcagcttcgcttccgtcttcacggcacacacacagaggcgtagagctgctccaaaagcttcaagatccgaaaccctagccatgtctctggtagcgaacgaagagttccagcacattctgcgtgtgctgaacacgaatgtggacgggaagcagaagattatgtttgccctgacctccatcaaaggtatcggccgccgttttgccaacattgtctgcaagaaggctgacgtcgacatgaacaagagagctggtgaactgtctgctgcggagcttgataccctcatgacgattgttgcgaatcctcgccagttcaaaattccggactggtttttgaacaggaagaaggattacaaggatgggaggtactctcaagttgtttccaatgcactggacatgaagctgagggatgaccttgagcgcttgaagaagatcagaaaccaccgtggtctccgtcactactggggtctccgggtgcgtgggcagcacaccaagaccaccggtcgcagaggaaagaccgttggtgtctccaagaagcgatagagtctgccttcgcattttccatttcttaagctctttgcgtatgtttacatgttagcttgagaaatttttgcttcttgagtacatctgagaattttattgaattctgaaaatgccattttggatttgtttcttggatttattttcttatttaaaccggaggcatgttttcgttaattgtaagttcactaatttccatagcgaaggtgttctagctattctcaaa

SEQ ID NO: 2658 - DNA, 4664 bp, Theobroma cacao
tctattataggacttatatttctacttgatcatgtaattttgtaggaccctgtgatgcgagaggaaaatatcatcgccacgtcatcagcaatctaagcgaacagcccctctaaagatatcttctctctcaccaaaaactctaccacctcttaaaattttccaagctaaggaaaaatacgtctttgccaaactgcagtttcttttttccttttagtaatacactcacattgtttatagcagagagttaaatctaaattaaaccaggagaaatatttagccgctcataccaaagcccagtaagaacatattttgattatcagttaaacagtaattcacaagttttacaaggcttgagaccgttagaggcagagactttgtggagactaataatactgttgtaaatttccagtccttttagagagagatgcaatagtttctcttgttgaattttctgcaggttcaatacaattttattttcgtcatttgatatatttttgtgggaatccgagagctgcacatgcttgggatgttgaattacgatatcttgattcttgattggtagcggttgcagagtggaagcttaggttctggtgtgtgttttgttggttgttccggtgattggttcaaaggggtatatttggaagatatatattgttcaagccacatggctagtccatctgagaggtggattgatggccttcagttctcatcactgttctggcctcctccacaagaccctcaacaacgaaaggttcaaattactgcatatgttgagtattttggtcaattcacatcagaacaattccctgaggatattgctgagcttgttcgcaaccgctatcctcacaaggaacagcgccttttcgatgatgttctggcaatgtttgttcttcaccatccggagcatgggcatgctgttgttcttcctattatttcatgcatcattgatggtacactggtgtatgataagagtacccctccctttgcttcattcatctccttagtctgcccaagtagtgagaatgagtattctgaacagtgggctctggcatgtggagagatcttgcgaattctgactcattacaaccgtccaatatataagatggaacagcaaaatagtgagacagatagaagcaatagcagtggccaagctacgacaagtgaacctgtagatggtgaaccatcctttcatatacctttgatgcaacaggagagaaagcctttaaggcccttatctccctggattactgatatattgcttgcggcacctttgggtatcagaagcgattacttccgttggtgcagtggtgttatgggtaaatatgcagctggagacctcaagccaccttcaactgcttcttctcgtggatctggcaagcatcctcagcttatgccatcaactccaagatgggctgttgcaaatggtgctggtgtcattttaagtgtatgtgatgaggaggttgcacgctacgagactgctactttaacagctgcagcagtccctgcacttctacttcctcccccaacaacagctttggatgagcatctagttgctgggctaccagctcttgaaccgtatgcacgtttatttcatcggtactatgccatcgcaactccaagtgccacccaaagactccttcttggacttctagaagcaccgccatcatgggctccagatgcacttgatgctgctgtacagcttgtggaactccttcgagctgctgaagattatgctactggtataaggcttccacgaaattggatgcatttgcattttttgcgtgcaatagggactgcaatgtctatgagagcaggtattgctgctgatgctgctgcagctttactttttcgcatactatcacaacctgcactgctatttcctccactaaggcaagttgagggagtggaagttcaacatgaaccttctggtggttatatttcgtgttacaggaagcagatagaggtgcctgctgctgaagcaactattgaagctactgcccaagggattgcatcaatgctttgtgctcatggaccggaggtggaatggagaatttgtactatatgggaagctgcttatggcctgattccattgagctcttctgctgttgatcttccagaaattattgttgcaaccccattgcagcctgctatactatcatggaacctatatatacctcttcttaaggtactggaatacctcccacgtggaagtccttctgaagcatgtctcatgaagatatttgtggccactgttgaagcaattctccagagaacttttccacctgaatcctccagggtgcaaaccagaaaaacaagatacagcataggttctgcctccaagaaccttgctgtggctgagcttcgtacaatggtccattccctctttttagaatcatgtgcttctgtagagcttgcttcacgcctactttttgttgtcttaactgtgtgtgttagccatgaagctcaattcagtgggagtaagagaccgagatgtgaagaaagttatcctcctgatgagggcattgaggaatcacagtcaccatcagaaaggccgagagacataaaacctagaaaaacaaaaaaacaagggcctgtagctgcatttgattcttatgtgctggctgctgtttgtgctcttgcgtgtgagcttcagttgttccctttggttacaagaggaagtaatcattcaactgctaaagatgttcaagctatagctaagcctgcaaagttaaatggatcttctattgagtatggccatagtattgactcagctattcatcatactcacagaatcttggcaattttagaggcacttttttctctgaagccatcttctgttggcacctcatggagttacagttcaaatgaaatagttgctgcagctatggttgcagctcatgtttctgaactattcaggcggtcaaaggcttgcatgcatgcactctctgtcctaatgcgatgcaagtgggacaatgaaatttacaccagggcatcatcattatataatctcattgatattcacagcaaggctgttgcatccattgttaacaaggctgaaccattagaagcacaattgatacatgcacctgtttggaaggattcccccgtttgcttagatggaagaaaacaaaacaaacgtacaaataccacttgctttgatccagggcagtcatctgcttcagaatgtgaagattcaactcattcagacaagaatctcagatgtgagagagtgttagcatcagatgaaggctcaggaaattccttgggcaaaggaatagcaagttttcctttagatgcctcagatttggccaactttctcacaatggacaggcacataggattcaattgcagtgcacaaattcttctgagatctgtgcttgtggagaaacaagagttatgtttctccgttgtttcactattgtggcacaagctaatagcagcacctgaaacacaaccaagtgccgaaagcacatccgcccaacagggatggagacaggtaatctgatatgtttcatgcttcagagaattaatattttaaaatctatttatcatattattatcacctgattaaaagcaatagaaaattctagtataatgttcattattgaaaccaatcttttgaaatcatttttttttaaagtacatgttgaaaacaacacatgggctatatcagttgaaatagtaaataggttgaaaattttgtttcactcagtattttgctatagtgctcttttctgcatgaatgcatatttcgtttagacttcgagtctagttgcattagctgtcgataggtggcctatgaaatcttgacatgggccttccaccaagggacttggctcctctccattatttttaggaccaatacttctaactatggatgtgatgatgagtgttaaaagttataggttcaaagaattttattatttttaaaaaatatattaattgacctttcgttacaaaaaccctagcttggcctgcgttagttattcgcttcttctcgtcagtaccccagagcctcttccgtcctctcgcaaaaatgtctctggtcgccaacgaagattttcagcacattttgcgtgttctgaacaccaacgtcgatggaaagcagaagattatgtttgctttgacctccatcaagggtatcggaaggcgtttcgctaacattgtctgcaagaaggctgatgttgacatgaacaagagggctggtgaattgactgcacaggagctggacaatctcatgaccattgttgcgaaccccaggcagtttaaaatcccagactggtttttgaacaggcagaaggattacaaggatggaaagtactcccaggttgtgtctaatgctcttgacatgaaattgagagatgacttggaacgcttgaagaaaatcaggaaccaccgtggtctgaggcactactggggccttcgtgtccgtggtcagcacaccaagactactggtcgcagagggaagactgttggtgtctctaagaagcgttgagtgcttcgtatatattttgaagaaatatatattcaggcagagaatttatttccttgctgttacgcacaaattttgaatgtgattttcttgattttgagttgtttttaaacccttgaagacaagtgtggattatagatgtttagattaaatgttgtttccttgaatggtc

SEQ ID NO: 2659 - DNA, 751 bp, Lippia dulcis
atgtttaaacagactcacttgaactcatagcgaagcagccgtcgaagaacgtaacataccgctgctcgattccaaaccctaaaaatgtctctcgtagcaaacgaagatttccagcacattctgcgtgtgcagaacaccaacgttgacggcaagcagaagattatgttcgccatgacctcgatcaagggtattggtcgacgtttcgccaacatcgtctgcaagaaagccgatattgatatgaataagagggctggtgaactcactgctgctgaaattgacagcttgatggttattgtggcaaacccccgtcagttcaagatcccgactggtttttgaacaggaagaaggattacaaggatggcaagttttcccaggtgacatccaatgctctggacatgaagctaagggacgatcttgagcgattaaagaagatcagaaaccaccgcggtctccgtcactactggggccttcgcgtacgtggacagcacaccaagaccaccggtcgcaggggaaagaccgtcggtgtctcaaagaagcgatgagtgttgtcatttcacctacctctttgctatggacacttttgttttaggctttgcaagagacatgaacaggctcctcgtgtctttgttttggatcccaatattgtgtttcaattttaattttgatcatggtttatgaaacagtaaatctggtaaggaacttgtagtctctgtctctttgtttctttaatcttttactttagaaaaaagaa

SEQ ID NO: 2660 - DNA, 571 bp, Fraxinus spp
gtgggcgattccctctactatagcgaagcagccgatcgggggaattattgcagcttctccacagccacttcgcagcagtagccatgtctctgatagcaaatgaggatttccagcatattctgcgtgtgcagaacacgaacgtggacgggaagcagaagatcatgttcgccttgacctccatcaagggtattggccgccgtttcgccaacatagtctgcaagaaagctgacatcgacatgaacaagagggctggtgagctctctgctgcggagattgacagcttgatgactattgtggcaaatccccgtaaattcaagatccctgactggtttctgaataggaagaaggattacaaggatggaaaattttctcaagtgacttccaatgctttggatatgaagctcagggatgatcttgaacgtttgaagaagatcaggaaccaccgtggtctccgtcactactggggacttcgtgtgcgtggacagcacacaaagaccactggccgcagggggaaaaactgttggtgtctccaagaagcgatgagcctcaactttttatactgttctctttg

SEQ ID NO: 2661 - DNA, 759 bp, Primula obconica
gggtttagagcatttcaccagccgtcgccttgacaaagaggagagagagagagagagagagagagctcaaacccaagctatgtcgttagttgcaaatgaggagttccagcacatactacgtgtgcaaaacacgaatgttgatgggaaacaaaagattatgtttgctatgacctctataaagggcattggtcgccgtttcgccaacatcgtttgacaaaaaagccgacgtcgatatgaacaagagggctggtgagctgacagcacaagaactggaaaatctgatgaccattgttgcgaaccctcgccagtttaacatcccagactggtttttaaataggaagaaagactacaaagatggcaagttttctcaggtgacatccaatgccctggacatgaagctgagagatgacttggagcgattgaagaagatcaggaaccaccgtggtcttcgtcactactggggtctcagagtacgtgggcagcacaccaagactactggtcgcaggggaaagactgttggtgtttccaagaagagataatctggttttaatgagtattttagggtttgttgtttgctagtactggtgaagaaaccttttttttgaacgctactgatgaaagaacttgttgtacttgcgtggaaagttttttcccttgtcggattatttgctagtattatgagcaccttcttttgatgtccttagttggtattcagtatatgttgacaacttttttctttttgattatgttggcaaccta

SEQ ID NO: 2662 - DNA, 902 bp, Citrullus lanatus
ggtaagacgttcgtttcgttgcagcctcttagaagaagaagaagaagaagaagaagaagaagaagaagcatcaggacgaagccgctcgccctctgccctgaaaaatggtaaaccctaacgctctatttacttcaccattgttgttccgtttcttcttcttactcggatcaatctctttttatttacaaaattcttgtggttttattttcgatcgtctattcagtcgttggtagcgaacgaagatttccagcacattttgcgtgtgcttaacacaaatgttgacgggaagcagaagatcatgttcgctcttacttccatcaaaggtattggaaggcgtttcgccaacatcgtctgcaagaaagccgatgtcgacatgaacaagagagctggtgaattaactgctgccgagctggacaatctcatggttgtcgttgcgaacccccgacagttcaaaattcccgattggtttttgaatagacagaaggactacaaggatggaaagtattcacaggtggtatcaaatgctcttgacatgaagctgagagatgacttggagcgtttgaagaagatcaggaaccatcgtggtctgaggcattactggggtctccgtgtccgtggtcagcacaccaagactaccggtcgccgagggaaaactgttggtgtctctaagaagcgttaaaaacctctccttttatattttgcaagcaaattttctgttggatgcaatattagattaatggaattagtccttttgagattgggtttgaacctttttggatttggcgtggggtttctgaaggcctctgccaggttatatttttatatcgctcattcatttttgctcgttataatagagattgaaatcccagttgagtttctttatctttctcgattatctgctt

SEQ ID NO: 2663 - DNA, 864 bp, Ricinus communis
acttccttcttttcgtatcctctttgctagcaattaggagctgcttctcctctcctccctctccctcgataagtcgctttgatccaaaatgtctctggtggcaaacgaggattttcagcacattctgcgtgtgctgaatactaatgttgatgggaagcaaaagattatgtttgctttgacatctatcaaaggtattggcaggcgattcgctaacattgtttgcaagaaggctgatgttgacatgaacaagagggctggtgaattgactgctgctgagctggataatctcatggtcattgttgcaaatcctcgtcaatttaagatcccagactggtttttgaatcggcagaaagattataaggatggcaaatattctcaagttgtgtctaatgcacttgacatgaagttgagagatgatttggagcgattgaagaagatcaggaaccatcgtggtctgaggcactactggggtcttcgggtcaggggacagcacaccaagaccactggtcggcgtggaaagacagttggtgtttctaagaagcggtgaacaacaatacatacacgattaaacaatgttatatatggattggcagagttggtccatgccgctagtaatttttgctctagagaagtttagatgtgagtttgttagacggagatggttttaattgtatcaacttcagttgcagaattgtttagaatattggcaatttacatcaattttagatgtgatctaatatcttgggttccctttgtgttcggtccttgtcagtagcaatagattataaattccaaaacaaaaatcaatgcgtttttgttttgttagttgttttcctcacttgacagtcccaattggagctctgg

SEQ ID NO: 2664 - DNA, 662 bp, Centaurea maculosa
atcgattttaggcatttgcgatcatcaggccgctagcaggaagaagaaactcaatcgcagccatgtcgttggtagcaaatgaagatttccagcatattcttcgtgtgcagaacacgaatgttgatggaaagcaaaagatcatgtttgctatgacttcgatcaaaggtattggtcgtcgtttctcaaacattgtctgcaaaaaggccgatgttgacatgaacaagagggctggagaattatcgaacgctgaaatcgataatctgatgacaattgtcgcaaatccccgacaattcaaaatcccagattggtttcttaacagaaagaaggattataaggatgggaagtactctcaagtcacatctaatgctcttgacatgaagctcagggatgatcttgagcgattgaagaagatcaggaaccaccgtggtcttcgtcattactggggtctccgagtacgtggacaacacaccaagaccactggacgtaggggaaagaccgttggtgtgtcaaagaagcgataagcgtcttttgttttgtgttttgcttttaacatgtttaaatccttcatttagaatttgggtgaagtttttattatggtatgtttgtacttttttggaatttgatgttagtaggattttaaagagagtttgtttacatttttg

SEQ ID NO: 2665 - DNA, 1350 bp, Prunus persica
atcctttaaatccatctttttctttcactggccctctctcacccggcgcgcttgcacacacacacgcagagtcgcagagagagagagcaaaccctaacgccgcaacaatgtctctcgtcgcaaatgaggagttccagcatattctgcgtgtgctgaacaccaacgtcgatggaaagcagaagatcatgttcgctctcacctccatcaagggtattgggagacgtttcgccaacatcgtctgcaagaaggccgacgtagacatgaacaaaagggctggtgagctatctgccgctgagctcgacaacctgatgaccatcgtggccaacccacgccagttcaagatccctgactggtttctgaacagaaagaaggactacaaggatggtaaatattctcaggtcgtctccaatgctctggacatgaagctcagggatgaccttgagcgcttgaagaagatcaggaatcaccgtggtcttcgacactactggggtcttcgtgtgcgtggacagcacaccaagaccactggccgcagggggaagactgttggtgtctccaagaagcgttgaagaatttttatcgtcattcttggatgttgtttggatatcatgtttgcgcattttgttttacattttcaaataccctctagtttagcaacctcaatctacttcagttttgatgggatcatgcagtatgtctagctgtcttttatttgttccttttggactgcttggtcttttgtgtttgaggatagtatgttatgcaatggaatttgatccccaatattagttaaaattctcaattatccttttttatgatttggagattgttgatagggcaatgcctttctgattagtatggcttaaatgggccgttacctttctctgatcggtgcagtcgagtggtttgtaaatcatataaaaatcatgcacgtatttggtttagctggcatcgaaatagattagtgcagagtggtttgttaaatcatagcaaaaccaatgcatatatttggtttagctggcatccaatgcctattgcgtccctttgtgccagtttagtgtcgtaaaaactggttatctaatatgtttcgaatataatcacggtaacttgagccttgaatgccaactcggcttcagacccagttgtatagtagtatggttctgtagtacaactcaatcacgtgttactttcagcttgtctcaaatattgaaaagaggtgttactttcagcttgtctcgaataataaaaagaggtgttacctccaagcttgcctcaaatattgaaagaggtgtgaattggaaacccacgacaagatgaaattgcctgcaaaactttgagtttggattagtggaa

SEQ ID NO: 2666 - DNA, 728 bp, Prunus persica
  misc_feature (690)..(690): n is a, c, g, or t
  misc_feature (706)..(706): n is a, c, g, or t
ttcgcaacgctgctaggcttctgtcttcacgctcacacaggcaaagagctgcacaaaaagcttcaagatctaaacccctagccatgtctctggtagcgaacgaagaatttcagcacattctgcgtgtgctcaacacaaatgttgacggcaagaagaagatcatgtttgccctaacctccatcaaaggtatcggtcgtcgtttcgccaacattgtctgcaagaaggccgatgtcgacatgaacaagagagctggagaactctctgctgcggagcttgataacctcatgaccattgtggcgaatcctcgccagttcaaaattccagactggtttttgaacaggaagaaggattacaaggatgggaggtattctcaagttgtttccaatgcattggacatgaagctgagggatgacctcgaacgcctgaagaagatcaggaaccaccgtggtctccgtcactactggggtctccgggtacgtgggcagcacaccaagactaccggacgcaggggaaagactgttggtgtctccaagaagcgatagtctgcttttgcaatttctatttcttaagctccttgctgatgatgttttcattttagcttgagaaatttgcttctttagtatatctgagatgtctttgactctgaaatactgtttggatattctgggactattgtatttactgagctanttcttatgtattcaangatggtcaatcaaaaaaaaaaa

SEQ ID NO: 2667 - DNA, 892 bp, Prunus mume
gtgccgcagcccataatacccatctagggttttgggctttgcgaacttcccccagatataatcctttaaaaccatctttttctttcatttgtcctctctcacccggcgcgctcgcacacacacacgcagagtcagagagagagagcgcaaaccctaacgccgcaaccatgtctctcgtcgcaaatgaggagtttcagcatattctgcgtgtgctgaacaccaacgtcgatggaaagcagaagatcatgttcgctctcacctccatcaagggtattgggaggcgtttcgccaacatcgtctgcaagaaggccgacgtagacatgaacaaaagggctggtgagctatctgccgctgagctcgacaacctgatgaccatcgtggccaacccacgccagttcaagatccctgactggtttctgaacagaaagaaggactacaaggatggtaaatattctcaggtcgtctccaatgctctggacatgaagctcagggatgaccttgagcgcttgaagaagatcaggaatcaccgtggtcttcgacactactggggtcttcgtgtgcgtggacagcacaccaagaccactggccgcagggggaagactgttggtgtctccaagaagcgttgaagaatttttatcgtctttcttggatgttgtttggatatcatgtttgcgcattttgttttacattttcaaataccctctagtttagcaacctcaatctacttcagttttgatggattcatgcagtatgtctagctgtcttttatttgttcctttggactgcttggtcttttgtgtttgaggatagtatgttatgcaatggaatttgatcccctatattagttaaaattctcaattatcctttttatgattttgagattgttgataaa

SEQ ID NO: 2668 - DNA, 855 bp, Prunus mume
cggcgcctaaaattagggttcgcaacgctgctaggcttctgtcttcacgctcacacaggcgaagagctgcacaaaaagcttcaagatctaaacccctagccatgtctctggtagcgaacgaagaatttcagcacattctgcgtgtgctcaacaccaatgttgacggcaagaagaagatcatgtttgccctaacctccatcaaaggtatcggtcgtcgtttcgccaacattgtctgcaagaaggccgatgtcgacatgaacaagagagctggagaactctctgctgcggagcttgataacctcatgaccattgtggcgaatcctcgccagttcaaaattccagactggtttttgaacaggaagaaggattacaaggatgggaggtattctcaagttgtttccaatgcattggacatgaagctgagggatgacctcgaacgcctgaagaagatcaggaaccaccgtggtctccgtcactactggggtctccgggtacgtgggcagcacaccaagactaccggacgcaggggaaagactgttggtgtctccaagaagcgatagtctgcttttgcaatttctatttcttaagctccttgctgatgttttcatttttgcttgataaattttgcgtctttagtgtatctgagaatgtttttgaattctgaaaatacctgttttggattatttcttggacgtatttgttattttaactgaggcatagtttctttaattgtaatttccaaagtgaatgtgttccagaattctgaagccctttgttttggtgtcacctaatttattgctagtgcaaccaaaggatccaaatgaaattggagtaatcttaggcacatcttctact

SEQ ID NO: 2669 - DNA, 934 bp, Acacia harpophylla
ggtttcggctttctcacatcctcaagagagagacagagcgccgaagagtgagaaatcattcgccatgtctcttgtagcgaacgaggattttcagcacattcttcgtgttcttaacacaaatgtcgatggtaagcagaagatcatgttcgcccttacttccatcaaaggtattggtcgtcgcttcgccaatatcgtctgcaagaaagccgacgtcgatatgaacagaagggctggtgaactgtcagctgctgaacttgatcagctcatgacaattgtggcaaatccacgccaattcaagattcctgattggtttctcaacaggaagaaggattacaaggatggcaaatactctcaggttgtttccaacgcattggacatgaaactcagggatgatcttgagcgtttgaagaaaataagaaaccaccgtggtctgcgacactactggggtcttcgggttcgtggacagcacaccaagaccacaggacgcagggggaagactgttggtgtctctaagaagcgttaaatgtgttctccaagttctttttcacaccccaaaagttttgctctttcagtttaacatggaagattttgttggtttggtagatttacaggatgtcatgatgtctgttttgtgtttttagcttttggtgttgagaggaaatgtttttctatgctttagcatcattatcttgaaatcggaagaagaccgtgattatttttgtttcctttatgatgcaaatactcatttttcttcaatttttttttgctcaattctataacttcctggaacttcatgttctgtcctgcattaatgtagtacacaatattattttggttgaaacaggatagcgaatcaatagtgtttttcggcaatattatgatgaaaatacactattccaatttttctcataacagtaagttctactaaagtcca

SEQ ID NO: 2670 - DNA, 976 bp, Amborella trichopoda
gagtactggggggcatattcgtaatttagtatatcgaagaggggtgttaacgttattgttttgatttcagtcgcactataagacctttgccgaaaccctagttatgcaaccttgcagttgtctctgagagaacttcaccctctctgcctttgaaggcctcgaaaaccctaatttatctttttctctgtagcctccaacaatgtctctgattgcgaatgaggaatttcaacacattcttcgtgttctgaacactaacgtggatgggaggcagaagattatgtttgccctaacctccattaagggtattggaaggcgttttgctaaccttgtttgcaagaaggcagatattgatatgaacaagagggctggagagttatctgctgcagagcttgaaagcttaatggttattgttgccaaccctcgtcaatttaaaatcccagattggttccttaacagaaagaaggattacaaagatggcaggtactctcaggtggtctcaaatgcattggacatgaagctgagggatgatcttgagcgtttgaagaagatcaggaaccaccgtgggttaaggcaccattggggtctgagggtcaggggtcagcacacaaagaccactggtcgcagggggaagactgtcggtgtctcgaagaagcgttgagttccctttccaatcttcccaagttttccagtaattctgaaatcttgttgtgcctttctctctctataaatgtttttggttttgttatcggaggatttattggttcaagtgacgagctcaattttgtgttaagaattatttgactatattgatcttttattcttatggtgttaatgggatttgggattagcttgtgtgtgaaactgtaacagttatcatatgtttgttgcttaccaaaatgcccagtcggggtattggagctcattgaattgatgtggcattgtatatattgagagaccattcacctttgtcaaagaa

SEQ ID NO: 2671 - DNA, 1043 bp, Malus domestica
ttcttcctcactagcccctctcacccggcgcgcacactcacactcgcacgcagagtcacagagagcaaagagccgccacactttaaggccgcagccatgtctctcgtcgcaaatgaggagttccagcatattctgcgtgtgctgaataccaacgtggatggcaagcagaagatcatgttcgcccttacctccattaagggtatcggcagacgtttcgccaacatcgtctgcaagaaggccgatgtcgacatgaacaaaagggctggtgaactatctgctgccgagctcgacaacctgatgactatcgtggcaaacccccgccagttcaagattcctgactggttcttgaacagaaagaaagactacaaggacggaaaatactcccaggtggtctccaatgctttggacatgaagcttagggatgaccttgagcgtttgaagaagatcaggaatcaccgtggtcttcgacactactggggccttcgtgtgcgtggacagcacaccaagaccaccggccgcaggggaaagactgttggtgtctccaagaagcgttgaagaactttagtgcctgttccggatgtcatgttgcgaattttgtgttactttttagaataccttctagtatttagcctcaatctacttcagttttgatggattaatagcagtatgtctgtcttttaattatattcctatagactgcatgatctttgtgtttgaggatgctatggtatgcgatggaattgagttccagaaattatgttgatattctaaaatctcaatcgtatgttcgaatttccatcggcggtcattcgtttgggtcttgaagttcctctgttatcctagttccagatcttgaattgtacggattctgagacctagacccggtttgatattcgcaccttgttccgaacgcagctttagacttggatctcaagtctaaatcaactcagtatttggggcttggagtatttttttttcttctccaaacggtagattttgtaagatttgatgttccactgactggatttgaattcatggcatca

SEQ ID NO: 2672 - DNA, 805 bp, Malus domestica
cttcttcctcacaagccccctctcacccggcgcgcccacactctcacacacacgcacgcagagttacagagagcaaatagccgcgaaaccctaaggtcgcagccatgtctctcgtcgcaaatgaggaattccagcatattctgcgtgtgctgaataccaacgtggatggaaagcagaagatcatgttcgcccttacctccatcaagggtatcggcagacgtttcgccaacatcgtctgcaagaaggctgatgtcgacatgaacaaaagggctggtgagctatctgctgccgagctcgacaatctgatgactattgtggcaaacccccgccagttcaagatccctgactggttcttgaacagaaagaaggactacaaggatggtaaatactcccaggtggtatccaatgctttggacatgaagctcagggatgaccttgagcgcttgaagaagatcaggaatcaccgtggtcttcgacactactggggccttcgtgtgcgtggacagcacaccaagaccactggccgcaggggaaagactgttggtgtatccaagaagcgctgaagaattttaccacctgtcccggatgtcatgttgcgaaagttgtgttactttttaaaataccctctagcgttttagcctcaatcgacttcagttttgatggattaatgcagtatgtctagctgtcgtttatttatattccttgattgagactgcttgatctttgtgtttgaggacggtatgctatgcaatggaattcgattctctatgttaagctgatattctcagtttatctgttgtatcaa

SEQ ID NO: 2673 - DNA, 456 bp, Aquilegia formosa
tctcttgttgcaaatgaagactttcaacacattcttcgtgttctgaacacaaatgtcgatggaaagaagaagattatgtttgccttaacttctatcaaaggtattggtcgtcgttacgccaatattgtttgcaagaaggctgatgtcgacatgaacaaaagagctggtgagctaactgctgctgagcttgagaacttgatggtcattgtcgccaatcctcgtcagttcaagatccctgattggtttttaaacaggaagaaagattataaggatggaaggtattctcaggttgtgtccaatgctctggacatgaaactaagggatgatttggagcggctaaagaaaatcagaaaccatcgtggtcttcgtcattactggggtctacgagtgcgtggacagcacaccaagacgactggtcgcaggggaaagactgttggtgtttccaagaagcgctga

SEQ ID NO: 2674 - DNA, 1025 bp, Musa acuminata
tgccgtcccccagttcgagagatcgcagtagaaggcaaagtcgccatgtcgctggtcgcgaacgaggatttccagcacattcttcgtgttctgaacacgaacgtcgatgggaagcagaagattatgttcgcccttacctccattaagggtatcggccgccgcttcgccaatatcgtctgcaagaaggccgacgtggacatgaacaaaagggccggtgagatctcagctgctgaactggagaacctgatgacggtcgtggctaatccacgccagttcaagatcccagattggttcttgaacaggaagaaggactacaaagatggcaggtactctcagattgtctcgaatagcttggacatgaagctgagggatgatcttgagaggctgaagaagataaggaatcatcgtggacttcgtcacttttggggtcttcgtgttcgtggtcagcacacaaagaccaccggcaggaggggaaagactgttggtgtctcaaagaagcgatgagtttaatcacttcattttgcccatcgatggtctttgtttggatctttaagaccacttcttggtgtttcttttatttcataatttagacaaaacagtcaatttatctatgtggctgcatttagacaacaattttgtttgtcaattggactataatattgtcatggttcaccctttctcttgatttaaagcagcagtgcgtttcggggatattttggatatcatggatgcttgtttacgtgaaggatgtattctggtcttaacttgatgggtgactattcaatcttctgaaaaatagctgtacatgtgtgtaaataatgcccactctttactctttactgaaactggtctcatgatcataatcatacgagggatctagtaagtacccctatgaaatgtacacctttgtttttctttcacttgattaggccattaattgttggcttcgcaaggctcaacaatagtcatgtttccaaattgatcctggtgtgcttttaacttgagaatctttaatgtcatgctca

SEQ ID NO: 2675 - DNA, 763 bp, Ocimum basilicum
gcacgaggcctcgtgcggaattcggcacgagggtggaggaaacgaaaaatacagcagcttcttgtcaagtcttcaaccgccaaagatgtctctggtagccaatgaggatttccagcatattctgcgtgtgcagaacaccaacgttgatggcaaacagaaaatcatgtttgctatgacctctatcaagggtattggccgtcgtttcgccaatatcgtctgcaagaaagccgatatcgacatgaacaagagggcgggtgaactttcagctgctgaaatcgacagcctgatggttattgtggctaatccccgtcagttcaagatacccgactggtttctgaacaggaagaaagattacaaggatggaaagttttcccaggtgacatccaatgctctggacatgaagctgcgtgatgatcttgagcgattgaagaagatcagaaaccatcgtggacttcgtcactactggggtcttcgtgtgcgcggacagcacacaaagactactggtcgtaggggaaagacagtcggtgtctccaagaaacgatgagctttctcttttatatattccgatctcatggatacatttctactttgtagtagggtttgcgagcggataagagttatatgaatctgttctgggttttgttttttatttaaagtttgtactccgcaattaattttggttataggtcttatgaggactccccaagtttggttacggaccaattatgtgggtttatctcctgttatgtgaatttcattcttg

SEQ ID NO: 2676 - DNA, 646 bp, Ocimum basilicum
tttgtttgtggaagtcaccggcataatcagagaaccctagagcgatgtcgcttgttgctaacgaggattttcagcacattctgcgtgtgcagaataccaacgttgatggaaaacagaagatcatgtttgccatgacctccatcaagggtattggccgccgatttgccaacattgtctgtaagaaagctgacatcgacatgaacaagagagctggtgagctttctgcagctgagatcgatagcttgatggtaatcgttgcaaatcctcgccagttcaagatcccggactggtttctgaacaggaaaaaggattacaaggacggcaaattctctcaagttacatccaatgccttggacatgaagcttagggatgatcttgagcgcttgaagaagatcaggaatcaccgtggtcttcgtcactactggggccttcgagtgcgtggacagcacaccaaaactaccggccgcagaggaaagacggttggtgtctctaagaagcgataagcatcttctttataccgttatggttattatgtttcctctttaagctaagatatgacttgtaattgctgcagagtttggttccgatttatgcctttctgtctaaaattttaatagtatatatctaagtttcatcatggatttat

SEQ ID NO: 2677 - DNA, 700 bp, Ocimum basilicum
aaaccctagccatgtctctggttgcgaacgaagattttcagcacattcttcgtgttcaaaacacaaatgttgatggaaagcagaagatcatgttcgctatgacctctatcaaaggtatcggtcgccgttttgctaacattgcttgcaaaaaagccgatatcgacatgaacaagagggctggtgaacttactgctgcagagcttgacagcttgatggtagttgtggctaatcctcgccaattcaaaatcccagattggtttttgaacagacagaaggattacaaggatggcaagttttcccaagttacatttaatgcccttgacatgaaacttagggatgacttggaaaggctgaagaagatcaggaatcaccgtggtttgcgtcactactggggcctccgtgttcgcggtcagcacacaaagaccactggtcgcaggggaaagactgttggtgtctccaagaagagataaatcgtttacatgcaaattcctttatgctttatgcttcccttttagaatttggaatttggacacttgcaaaaagtttgttagggtatttttgtattgtttgcatttaaacttccttgtcccgccttttggagattatagttcctataaatcttccgatggcagtgcaagcatgtgagggcttttgggatcaaagttttgccgatttcacttttgaaagggcatcaaatatg

SEQ ID NO: 2678 - DNA, 821 bp, Vaccinium corymbosum
cggcctattaccgggccggggtctagggttttgggggcttcttctgttttttgccgcatttacaagcacaagagcagcttccgcatagacccgatctgaaaccctagcgatgtcgctggtagcgaacgaagagttccagcacattcttcgtgtgcagaacaccaacgtcgatgggaaacagaagatcatgtttgcgttgacctctattaaaggtatcggccgtcgtttttccaacatcgcttgcaagaaagccgatatcgacatgaacaagagggctggtgagctttcctcgcaagagctggataacctgatgacaattgttgctaatcctcgccaattcaagatcccagactggttccttaacaggaagaaggattacaaggatgggaagttttctcaggtgacctcgaacgccttggacatgaaacttagggatgacttggagagacttaagaagatcagaaaccaccgtggtctccgtcactactggggtcttagggtgcgcgggcagcataccaagaccactggccgcagggggaagactgttggtgtctccaagaagcgataatctggtccttagatttgtctttgaactagttttgtttggttacagacttttttcttttatcggccgtttggttacagactttgtactttagtttgagagtgtggattgtttgtttctccttttgataccgtattcgatcatttggctggcttatataccataatcgttttcctccccattgtcaatgggtttgcatgcatgtcacatttcttctagttagggatatactcgggggtatgaatcccccttggac

SEQ ID NO: 2679 - DNA, 953 bp, Cannabis sativa
tccttcaaattagggtttgtaaattggaggcttcttcactatcttaacgcaccgagacgagtagcagcttcagatccgaaaccctagccatgtcgcttgttgcgaacgaagagtttcaacacattcttcgtgttctgaacaccaacgtcgatggaaaacagaagattatgtttgctctgacctccattaaaggtattggccgccgtttcgccaatctcgtttgcaagaaagctgatgtcgacatgaacaagagagctggtgagttatctgctgctgagcttgataccttgatgaccattgtcgccaatcctcgccagttcaaaatcccagactggtttctgaacagaaagaaggattacaaggatggaagatattcccaagttgtttccaatgcattggacatgaagcttagggacgatcttgagcgtttgaagaagatcaggaaccaccgagggcttcgtcactactggggtcttcgtgttcgtggacagcacactaagaccactggccgcagaggaaagactgttggtgtctccaagaagcgatagattggttattcacttctcttttcatttgggttgttttgtttcaatgttaccagcattactagtttagcgtccaggaatatttttggatatcccgtaattttgacttcagatatttcctttgcttctctcataaaattttaatggattttctatttcttttagtgtcatttagttttacctgtttggaaggaagtatgtagagaacaagcaaacgcagttgctcgttatctttttgaatgttatttaagaaatctgagaacggtcaatggttttctgtgagttatatttcattggctccaactggtttaatttttttagattcttttgcaattctgtggattttttgtggatgattcataaccttttcttatcatgattgttgaatttgaatctttctgttttgat

SEQ ID NO: 2680 - DNA, 788 bp, Manihot esculenta
atatacccccgcgccccctatctagggttttgggacttgtttattagctctgaactcatacgccgtcgcaggtggaagagagcttttccaaatctgaaaccctagccatgtcgttggtcgcaaatgaagatttccaacacattcttcgtgttctgaacacgaatgtagatgggaaacagaagattatgtttgccctaacctccatcaaaggtatcggtcgccgtttcgccaatatcgtctgcaagaaagccgatgttgacatgaacaagagagctggtgaactatcagctgaagaacttgacaaacttatggtgattgttgccaatccccgccaattcaagattccagattggtttcttaatagacagaaggattacaaggatgggaagtactctcaggttgtatccaatgctttggacatgaagctgagagatgatcttgagcggttgaagaagatcagaaatcaccgaggtctccgtcactattggggtcttcgagtgcgtgggcagcacaccaagaccactggacgcaggggaaagactgttggtgtctcgaagaagcgataatttgctttatctaattatttttgtgttctctggctttctggatattttacatgatatcagtattttgaactttaaaagaagttggcaagccttagaattttcatttcagtgaagttgcaattttgtactgcggatgctacttgttgcgtttgcttagttggatgcacttatttttatctcaagtattactcgaactttcaatatagtattgcattggccatc

SEQ ID NO: 2681 - DNA, 781 bp, Manihot esculenta
agatattcgaagctgcgtctcagtaggccattgtccatctcttctacccttcatccttgcaaaatcactgcagttcaaaatgtctctggtggcaaatgaggactttcagcatattttgcgtgtgcttaacactaatgttgatgggaagcagaagattatgtttgctttgacctcaatcaaaggtattggaaggcgattcgctaacattgtttgcaagaaggccgatgttgacatgaacaagagggctggtgaattaactgctgctgagctggataatcttatggtcattgttgcaaacccacgccagttcaagatcccagactggtttttgaatcggcagaaggattacaaggatgggaaatattctcaagttgtctctaatgcactggacatgaagctgagagatgatttggagcgattgaagaagatcaggaaccaccgaggtctgaggcactactggggtcttcgtgtcaggggacaacacaccaagaccactggtcgtcgtggaaagactgttggtgtctctaagaagcggtgaaaatctatttactgggttgatttattttatggatcggcagaattggttccttgctacaagttttgcactagtaaagtttagatgcgttttaggtaggttggaagcgttattatccgattaactatagaagttgagttgcataatcaattagtatatgttgtttggaagtttcaatttgcttctacttttgatgtgattttctatgtttttttctatataaaatcatgtttttcccctttcttt

SEQ ID NO: 2682 - DNA, 781 bp, Manihot esculenta
gcatctagggttttcgtacttaactagctctcaactgatacaccgccgcacaacgaagagagcttctcctcctctaggacactaccatgtcgctggtcgcaaatgaagatttccaacacattcttcgtgttctcaacacgaatgttgatgggaaacagaagattatgtttgccctaacctccatcaaaggtatcggccgccgttttgccaacatcgtctgcaagaaagccgatgtcgacatgaacaagagagctggtgaactatcagctgaagagcttgacaaacttatggtgatagttgccaatccccgccaattcaagattccagattggttcttaaatagacagaaggattacaaggatgggaagtactctcaggttgtatctaatgcattggacatgaagctgagggatgatcttgagcggttgaagaagatcagaaaccaccgtggtcttcgtcactattggggccttcgagtgcgtgggcagcacaccaagaccactggccgcagggggaagactgttggtgtctccaagaagcgataatttggttctttttgtttttatttctcccttggctttcttgatactctgctgttctaagaattttggatttctgaaagaacttggaatgtcttagaatgtttatttcagtgaaatttgacattttgtactgcgcatatttgttgcttttgcttagttggttttagttcttatttgcttaaagtgcctacttaatattctctattaaaaaagtattgctttgacatgccttgaaattt

SEQ ID NO: 2683 - DNA, 1133 bp, Ricinus communis
aaaatattttttatattttaacacagcaagaataaaaaaaaatattgtaagtttaatagaaaaaatagaaatttctgatttttttaaaattaaattgggcttgatcaaaagtatatatggtacatgtagttgggctgcctgcggcccagcctgacctctacaataaggtattgattcaggtaggacatgtcaggtataatgaggattgtaaaggtaaaaaagtctttctaaataaataaaaccctacatagtgatatgagacctttaaaacactacttccttcttttcgtatcctctttgctagcaattaggagctgcttctcctctcctccctctccctcgataagtcgctttgatccaaaatgtctctggtggcaaacgaggattttcagcacattctgcgtgtgctgaatactaatgttgatgggaagcaaaagattatgtttgctttgacatctatcaaaggtattggcaggcgattcgctaacattgtttgcaagaaggctgatgttgacatgaacaagagggctggtgaattgactgctgctgagctggataatctcatggtcattgttgcaaatcctcgtcaatttaagatcccagactggtttttgaatcggcagaaagattataaggatggcaaatattctcaagttgtgtctaatgcacttgacatgaagttgagagatgatttggagcgattgaagaagatcaggaaccatcgtggtctgaggcactactggggtcttcgggtcaggggacagcacaccaagaccactggtcggcgtggaaagacagttggtgtttctaagaagcggtgaacaacaatacatacacgattaaacaatgttatatatggattggcagagttggtccatgccgctagtaatttttgctctagagaagtttagatgtgagtttgttagacggagatggttttaattgtatcaacttcagttgcagaattgtttagaatattggcaatttacatcaattttagatgtgatctaatatcttgggttccctttgtgttcggtccttgtcagtagcaatagattataaattccaaaacaaaaatcaatgcgtttttgttttgttagttgttttcctcacttgacagtcccaattggagc

SEQ ID NO: 2684 - DNA, 1050 bp, Ricinus communis
caccacatctagggtttttgggacttctttcactatctctggacttagccgccgcatagagaagcgagcttctccatattcgaaaccctagccatgtcgttggtagcaaatgaagattttcaacacattcttcgtgttttgaacacgaacgtcgatgggaaacaaaagattatgtttgccctaacctcaatcaaaggtattggtcgccgtttcgcaaacattgtctgcaagaaagctgatgtcgacatgaacaagagagccggtgagctctcagctgaagagcttgacaaacttatggtgattgttgctaatccccgccaattcaagattccagattggttccttaacaggcaaaaggactacaaggatggcaagtactctcaagttgtatccaatgccttggatatgaagctgagagatgaccttgagcggttgaagaagatcagaaaccaccgtggtcttcgtcactactggggtcttagggtgcgtggtcaacacaccaagaccactggccgcaggggaaagactgttggtgtctccaagaagcgataaactggttctactttttgggtgtttcctggatttcttgatcttttgagcgatcttaaagttttctatttcgaaagaacttagcatgtcttagaattttgatgtcagtgcagttgcctttttgtaatgtggagtttacttattgcatttactcagttggatgcactcaatattttctcctaatagttttttgaaaagacattttgatttttgatcttagagatcaaatgcatatccaaagttttctgaatgcgtattgggatgtgatgctcagtgttcctagtgacatgtgaaacgttggtgatttttttcctgaaatggatggattaacaagtttacgagcagagaactttctgccagaggttcggccataattacagttacgtcctcgtttgaaatcaaatattttcatgttaagagtttattgttgtttatatgaaaaatgttaattttgtggtaaacctgaacatggaaaatctaaattgccttcaactcagaaca

SEQ ID NO: 2685 - DNA, 1051 bp, Ricinus communis
acaccacatctagggtttttgggacttctttcactatctctggacttagccgccgcatagagaagcgagcttctccatattcgaaaccctagccatgtcgttggtagcaaatgaagattttcaacacattcttcgtgttttgaacacgaacgtcgatgggaaacaaaagattatgtttgccctaacctcaatcaaaggtattggtcgccgtttcgcaaacattgtctgcaagaaagctgatgtcgacatgaacaagagagccggtgagctctcagctgaagagcttgacaaacttatggtgattgttgctaatccccgccaattcaagattccagattggttccttaacaggcaaaaggactacaaggatggcaagtactctcaagttgtatccaatgccttggatatgaagctgagagatgaccttgagcggttgaagaagatcagaaaccaccgtggtcttcgtcactactggggtcttagggtgcgtggtcaacacaccaagaccactggccgcaggggaaagactgttggtgtctccaagaagcgataaactggttctactttttgggtgtttcctggatttcttgatcttttgagcgatcttaaagttttctatttcgaaagaacttagcatgtcttagaattttgatgtcagtgcagttgcctttttgtaatgtggagtttacttattgcatttactcagttggatgcactcaatattttctcctaatagttttttgaaaagacattttgatttttgatcttagagatcaaatgcatatccaaagttttctgaatgcgtattgggatgtgatgctcagtgttcctagtgacatgtgaaacgttggtgatttttttcctgaaatggatggattaacaagtttacgagcagagaactttctgccagaggttcggccataattacagttacgtcctcgtttgaaatcaaatattttcatgttaagagtttattgttgtttatatgaaaaatgttaattttgtggtaaacctgaacatggaaaatctaaattgccttcaactcagaaca

SEQ ID NO: 2686 - DNA, 1030 bp, Castanea mollissima
cctctctcttctctctcgctcctcctccgctctctcattttccaaaccctctgaaacagagagaggctcacagagaacaaaaaccctaaccctaaccctaaccatgtctctggtagcgaacgaggatttccaacacatattgcgtgttctgaacaccaacgttgatggaaaacaaaagatcatgttcgctctcacttccatcaaaggtattggtcgccgtttcgccaatctcgtttgcaagaaagctgacgtcgacatgaacaaacgagctggtgagttgacagctgctgagctggataacctgatggtgattgtggcgaaccctcgccagttcaagatacctgattggtttctgaacaggaagaaggattacaaggatggtaaatattctcaggttgtctccaatgctttggacatgaaactcagggatgatcttgagcgtttgaagaagatcaggaaccaccgtggtctgcgacactactggggtctccgggtgcgtggacagcacactaagacaactggtcgccgtggaaagactgttggtgtctcaaagaagcgctaagtagtttctccctttctgggatgtttgcgaattttgtttggccttttagaatatcttgggtttagtattgtacttctctttttggcggactcatgcggtatcatttagctgtctttatgtgttctctagactgattgatcttgtttgagagattttggtatgtgtgatggtattaattattcataatttcatataatagttaaagttgacaatgcattttgcattttacttaaaaaaaatttgtacagttattctttgagtgactgggggagttgggatgttgaaagagttgacctgtactgggataggctgttgtaatattacatttttgtgattgaaagaatggtgaaatgtgcattcgttctatattcaatgcgctctctgttcagattattggtgcagtagttatcatgtttagagctcaccatcttacagttgattcagtcggagctcgtaagtcagtaactt

SEQ ID NO: 2687 - DNA, 771 bp, Castanea mollissima
tttctctcattcacggcgtccgtcgcaaacagcctcgcgatatcgtctcttctgcaaaatgtctctggtggcaaacgaggattttcagcacatccttcgtgtgctgaacacaaatgtggatggaaagcagaaaatcatgttcgctctcacctccatcaaaggtatcggtcgccgtttcgccaacctcgtctgcaagaaggccgatgtcgacatgaacaagagagctggggaattgagtgcagctgagctggacaatctgatgactattgttgccaaccctcgtcagttcaaaatcccagactggtttttgaatcggaagaaggattacaaggatggaaagtactctcaggtcgtttccaatgctcttgatatgaagttgagagatgatttggaacgcttgaagaagatcaggaaccatcgtggtctgaggcactactggggccttcgtgttcgtggccaacacaccaagactacaggccgcaggggaaagactgttggtgtctctaaaaagcgctgagatttttttctttgttctaaactaaatacatattgttgggcaatccagatttttggctatttagtatgtttgattggacatttttagatttttgttactgtgggctgtggttgggtgtttcactgtggttgtgtttttaagcctgtaaccctattatcatatttggtcaattttggtttttctatggttctatctagtgtagtccatctgcagacttgcattatatatcaagcaattgataaatgcatccatct

SEQ ID NO: 2688 - DNA, 663 bp, Cicer arietinum
accaattctccggcggcaatcatccctgtccaagcggctaggctaagatgtctttggtggcaaacgaagaatttcagcacattttgcgtgtgctgaacactaacgttgatggcaaacaaaagataatgttcgcactcacctccattaagggtattggaaggcgatttgccaacatttgctgtaagaaggctgatgttgacatgaacaagagggccggtgaattgagtgctgcagagttggataatttgatgacagtggttgcaaacccacgtcaattcaagatcccagattggtttttgaataggaagaaggattataaggatggaaagttctctcaagttgtttccaattcacttgacatgaagttgagggatgatttggagagactcaagaaaattagaaaccaccgtggtttgaggcactactggggccttcgtgttcgtggtcagcataccaagactactggccgcaggggaaagactgttggtgtctcaaagaagcgttaagctgttatgttttggctttaagattagatgattttgtggaggctttatttaagcacaatagacatgtttcttacatcaactttgtatggttgttaaatgttgtgacaatttcaattttgtttggattgtgttaaaagtttttgattagttgaatgga

SEQ ID NO: 2689 - DNA, 712 bp, Cicer arietinum
ttttgagtcgtcgaagaaaccctttcagcgagtgccgccgccgcagacctcttccctgcagcaccgcattcaacatgtctctcgtggcaaatgaagaatttcaacacattcttcgtgttttgaacacaaacgttgatggcaagcagaagataatgtttgcccttacctcaattaagggtattggaaggagatttgctaatatttgctgtaagaaggctgatgttgacatgaacaaaagagctggtgagcttagtgctgctgagttggacaatctgatgactgtggttgccaatcctaggcaattcaagattcctgattggtttttgaacagaaagaaggattacaaggatggcaagttttctcaggttgtttcaaattcattggatatgaagttgagggatgacttggagagactcaagaaaatcaggaaccaccgaggtttgagacactactggggtcttcgtgtacgtggtcagcataccaagactaccggtcgtcggggtaaaacagttggtgtctcaaagaagcgctgagttattatgttttttatctttgtatttctttctttgatttttgaagaatgagttatgttattctgttaaagacttgtttatcttttcctctgagaatgtattcgaattttgttgcatctgaatatggattgtggccagcttcgttgatattattttaaaattgatcactattatagctc

SEQ ID NO: 2690 - DNA, 1013 bp, Cicer arietinum
taaaaaggttagaaaaccctgttcttttctttctatcatcaacgaggttttgagtcgtcgaagaaaccctttcagcgagtgccgccgccgcagacctcttccctgcagcaccgcattcaacatgtctctcgtggcaaatgaagaatttcaacacattcttcgtgttttgaacacaaacgttgatggcaagcagaagataatgtttgcccttacctcaattaagggtattggaaggagatttgctaatatttgctgtaagaaggctgatgttgacatgaacaaaagagctggtgagcttagtgctgctgagttggacaatctgatgactgtggttgccaatcctaggcaattcaagattcctgattggtttttgaacagaaagaaggattacaaggatggcaagttttctcaggttgtttcaaattcattggatatgaagttgagggatgacttggagagactcaagaaaatcaggaaccaccgaggtttgagacactactggggtcttcgtgtacgtggccagcataccaagactaccggtcgtaggggtaaaacagttggtgtctcaaagaagcgctgagttattatgttttttatctttgtatttctttctttgatttttgaagaatgagttatgttattctgttaaagacttgtttatcttttcttctgagaatgtattcgaattttgttgcatctgagtatggattgtggccagcttcgttgatattattttaaaattgatcactattatagctctaacatgtcttggaggttctatttatttgcaaaaaccgttgtcgaatgctgagcaatattgatgtatgttcactactcaatttggtcttcaaaattagttcttgttgaattgacgaattagaggtaataaaacttgggattgtctaatgaattcattatccaaaggctatctcagacgaatccaacactttttgaatgaataaagattgccatatcatgttgataacagaagaggctttttgaaaaaacagttt

SEQ ID NO: 2691 - DNA, 965 bp, Citrus clementina
aggccaccctttataaccaacatcatacctccatttacactcacctccggagaaggcgaaggcacaaaagtcaaccataaaggaaaaaagagaaacgaacatctccagccatgtctctggtagccaacgaggattttcaacacattcttcgtgttctgaacacgaatgttgatgggaaacaaaagatcatgtttgctctcacatccattaagggtatcggtcgccgtttggccaatattgtctgcaagaaagctgatgtcgacatgaacaaaagagctggtgagctctctgccgctgagcttgaccaactgatggtggttgtggcaaatccacgccagtttaagatcccagactggtttcttaacaggcaaaaggattacaaggatgggaggtactcccaggtcgtgtctaatgcattggacatgaagcttagggatgatcttgagcgcttgaagaagatcagaaaccaccgtggtctacgacactactggggtcttagagttcgtggacagcacaccaagactactggacgcaggggaaagaccgttggtgtctccaagaagcgttgagttttgtcgtctcctattggttcatcaagctgcaagttttgtttacatgttagttttgcatcgttcagtatgtctgtcttgtagaagaattgtttttgataattttcttcagtttattttcttaggttgtctttttgactgcattgaaaggaattccatttgatattgtgattaaaaagtcatccatgttttatttaatcaggagggtaatatttcagttgagaattctatattctagagagttgaatgcattatatgctaccaaagcttgcttgagaatttatgtaggatgatgggatgttcttattgtaatcgagaactccatttcttacagttgtgaaactgactgtgtgtgaatgagatatttggatgaaagtaacaaaagctagtatgaaa

SEQ ID NO: 2692 - DNA, 816 bp, Cleome gynandra
gatacgcttctcactaatttgcagagatcgtggtactgctcgaagacggcgagagcctctactcttccaaggaagtttttctctgcaaatcaaaatgtctctggtcgcgaacgaggatttccagcacattctgcgtgtgctgaacactaatgttgatggtaagcaaaagatcatgtttgcccttacctctatcaagggtattggaaggcggtttgctaacatcgtttgcaagaaggccgacgttgacatgaacaagagagctggtgagctatctgcagctgaacttgacaacctcatgacaatcgttgcaaacccacgtcagttcaagattccggactggttcttgaacaggcaaaaagactacaaagacggtaagtactcccaagttgtatctaacgccctggacatgaagctgagagatgacctggaacgtctaaagaagatcaggaaccaccgtggtctgaggcattactggggtctccgtgttcgtgggcagcacaccaagaccactggtcgcagaggaaagaccgttggtgtctccaagaagcgttgagagagtggttctcgttgctattgtatggaatgctttttaaagaccggtcttaatttcgttctccgtagaattttgtggaacacgcttttggttcttcatgagtgaaattcttcatatgctttttgttttttcctttgagaagttttgcttttttattcttatatatttcttttgttttttgtgtgtggaaacttacaatttcttatttatgcctagagaataatgtctagaaaaaaatctaaacttgatataaattctcgaag

SEQ ID NO: 2693 - DNA, 816 bp, Cleome gynandra
tcggggtacttttgtctagtttgcggagatcgttttactgcttgaagacggcgagagctttctcctcttctcagtcggcttatctctgcaaatcacgatgtctctggttgcgaacgaggacttccagcacattctgcgtgtgctgaacactaacgttgatggtaagcagaagattatgtttgcccttacctctatcaagggtattggaaggcgttttgctaacatcgtctgcaagaaggctgatgttgacatgaacaaaagggcgggtgagttgtctgcagctgaactcgacaacctcatgacaattgttgccaacccacgacagttcaagatcccagactggttcttgaacagacaaaaagactacaaagacggtaagtattcccaagttgtctcaaatgctctggacatgaaactcagagatgacctggaacgtctcaagaagatcagaaaccaccgtggtctgaggcactactggggtctccgtgtccgcgggcaacacaccaagaccaccggtcgcagaggaaagacggttggtgtgtccaagaagcgttgagcggttgtgtttaggtgctattgtattggatactttataaagacagttttgtggggtcactcactggttttgtgtccttatgagtgaattcttcttcatttgctctttttgatcttgagtcttttgctgttcgaaacttgtagcttcgctattaaattaagtaagctgtttctctagttatgtccgactctttttgtgtgaactcgattttcttaccactattttgatatgaaatttcaaaattttgcgttttaagatcg

SEQ ID NO: 2694 - DNA, 659 bp, Cleome spinosa
ctctgatttctgggattgtgttgctgctcgaagacggcgagaactttccactattcccagacagcagatcacaatgtctctggtcgcaaacgaggacttccagcacattctgcgtgtgctgaacaccaatgttgatggaaagcagaagattatgtttgcccttacctctatcaagggtattggaagacggtttgctaacatcgtctgcaagaaggccgatgttgacatgaacaagagggctggtgagctgtctgcagcagaactcgacaacctaatgacaatagttgcaaaccctcgtcagttcaagattccggactggttcttgaacaggcaaaaggactacaaagacggcaagtactcccaagtcgtttctaacgctctggacatgaagctgagagatgatcttgaacgtctcaagaagatcaggaaccaccgtggtctgagacattactggggactccgagtgagagggcaacacaccaagaccaccggtcgcagaggaaagactgttggtgtctccaagaagcgttgagttagaatgtttctagttgcttttgtatgggatgctgctttataaaagaccgaccggttctagttttgttctccgcacaatttttttcgaacactctttctgctgctattattcatatgctttcccc

SEQ ID NO: 2695 - DNA, 644 bp, Cleome spinosa
aagccattacgctcaaagctcctcttcagctgctgcgccccatagtcttcaaggagcttcttccttacgctcgacccttctccgcttcccagaatgtctctggtggccaacgaggattttcagcacattctgcgtgtgttgaacaccaacgttgatgggaagcaaaagataatgtttgcactgacctccatcaagggtatcggtcggcgatttgccaacattgtctgcaagaaggctgatgttgacatgaacaagagggctggagaactaagcgctgctgagctagacaacctcatgactatcgttgcaaaccctcgccagtttaagatcccagactggttcttgaacaggcagaaggactacaaggatggcaaatattcccaggttgtctccaatgctcttgacatgaagctcagggatgaccttgagcgcctcaagaagatcagaaaccaccgtggtctgaggcactattgggggctgagggtgcgtggccagcacaccaagactactggccgtcggggaaagactgttggtgtctccaagaagcgctgatggatgccttgttttgctctttctgttgactggagaaggggctttcgtgttaatttcatcactacaatgttttatctcgtataaagattatt

SEQ ID NO: 2696 - DNA, 1112 bp, Cryptomeria japonica
  misc_feature (125)..(125): n is a, c, g, or t
  misc_feature (669)..(669): n is a, c, g, or t
  misc_feature (707)..(707): n is a, c, g, or t
  misc_feature (937)..(937): n is a, c, g, or t
  misc_feature (964)..(964): n is a, c, g, or t
  misc_feature (1008)..(1008): n is a, c, g, or t
ggtcaacttacgggtctttaaactcaccacatcgtaagattagggttttcctgcacagatattgatttttagggtttattatatgtcaaaccttctattgttgccgttaacagagttgcagggtncttgaagacgccgaaagctttagcgacaatgtctcttattgcgaatgaagaatttcaacatattcttcgtgttctcaacactaacgttgatgggcgacagaagatcatgtttgccctgacctccattaagggtattggtaggcgttttgccaatattgtttgtaaaaaagctgatgttgacatgagcaagagagctggtgagctttctgcccaggaacttgagaatctgatggtgattgtggcaaatccacggcaattcaagatccctgactggtttttgaatagaaagaaggatcataaggatggtcggttctctcaggtggtatccaatgcccttgacatgaaactcagggatgacttggaacgcttgaagaagatcaggaatcatcgtggtcttcgtcactattggggtctgcgagtgcgtgggcaacatacaaagaccactggtcgtagggggaaaactgttggtgtgtcaaaaaagcgttgagaaaggaaatattattggagaaacacaattttgcttgtgtcttcatattgtttcacnttattcctttaaggtgctttatgttgtatttgttgtcnttacaccggcccttttttcttttgaaagttggaaacacatcatgcgattgacaaggctgtaaagctttgattttgcactttttaatttgagaatggcttcctgaaagctctatctacattttgtagtactaaggaagaaggttaaatgttgagttcaatgaaatactggaaccatttgttttggtttttgaaatatttattttgatatatcttttccagtatattttggnctgatttctggcacagttctggcactnactattgggataacaatgttgctggcattgtaagcccataagcnatgttattaccattcctttctgctggagttgaaactgggtcttgctgttacctgttaatgggagtggtgtgtataattattacttaaatatacttgttttggat

SEQ ID NO: 2697 - DNA, 864 bp, Cryptomeria japonica
  misc_feature (107)..(107): n is a, c, g, or t
  misc_feature (120)..(120): n is a, c, g, or t
  misc_feature (138)..(138): n is a, c, g, or t
  misc_feature (159)..(159): n is a, c, g, or t
ggttgggtgatatccaaagtaaaaaagggtttattaataaatcctacttttttatctcgcaaaaaaacctaaggaaggtcttccttattaacagatctagggtttcngcgagggttttancagctgaagtccttcgtnagcagaggttctggattaccntaacaagctcatccgccattctttgcttgagcaatttcttcgaaaatgtcacttatagcgaacgaagagtttcagcacattcttcgtgtgctgaacaccaatgttgatgggcgacagaagattatgtttgctctgacttccatcaagggtattggtcgccgtttcgctaacatcgtctgcaagaaggccgatgttgatatgagtaaaagggctggagagctgtcagcacaggaattggaaaatcttatggtaatagtggcgaatcctagacagttcaagatcccagactggtttcttaacagaaagaaggaccacaaggacgggcgtttctctcaggtggtttccaatgccctcgacatgaagctcagagatgatttggaacgtctcaagaagatcaggaatcaccgtggtttaagacattactggggccttcgagtgcgtggacaacacacaaagaccactggtcgtaggggaaagactgttggtgtctcaaagaagcgttgattaattattttcagggagaacgttgttctgcttgggtgttatctttaatgatattttataggtatttttaaatataaacatttttgagaagtatcataatgtgccgacaatagcattaaatttttgagctttgactaaagcgaggtatttggatatttttctttggtcagtttaatgtgaattgcatttctgcattcggtc

SEQ ID NO: 2698 - DNA, 656 bp, Cucurbita pepo
gggggatctcctctcgttttttcctgcctctgctgccgccgggaattctttcaactccttgcttctatctacgtacgccatgtcgctggtagcaaacgaggattttcagcacattcttcgtgtgctgaacaccaacgtggatgggaagcagaagattatgtttgctctcacttcaatcaaaggtattggaaggcgtttggctaacatcgtctgcaagaaggctgatgtcgacatgaacaagagggctggtgaactaactgctgccgagttggacaatctcatggtgattgttgccaatccacgacaatttaaagttcctgactggtttttgaatcggcaaaaggactacaaggatgggaaatattctcaagtggtttctaatgcattggacatgaagttgagagatgatttggagcggttgaagaagatcaggaaccaccgaggtctaaggcactactggggcctccgagttcgtggtcagcacaccaagaccactggtcgccgaggaaaaactgttggtgtctccaagaaacgttgatattcttttccatgttttgatgagtttagtatgtgggtgggcaaatcagtaaatctttggcctgttagttgaacatttgaggtgtacctcctttctggaagttttggttgggatggta

SEQ ID NO: 2699 - DNA, 854 bp, Cyamopsis tetragonoloba
cacgaggagttagcacttacgagtctcaacacgcagaaacactccaattcgaaatccgattcggccaaggataagagcttcgtcggcaatcttcatcctcctccgcggaaaacatgtcattggtggcaaacgaggatttccagcacattctgcgtgtgcttaacacgaacgtagatggaaagcagaagataatgttcgctctgacctcaatcaaaggtattgggaggcgattcgcgaacattgcctgcaaaaaagccgatgttgatatgaacaagagagctggtgaattaagtgctgctgagttggatagcattatggctgttgttgcaaaccctcggcaattcaaggtccctgattggtttttgaataggaagaaggattacaaggatgggaagtattctcaggtagtatctaatgcacttgatatgaagttgagagatgatctggagcggcttaagaaaatcagaaaccaccgtggtttgaggcactattggggtcttcgtgttcgtggccagcatactaagactactggtcgtagggggaagactgttggtgtctcaaagaagcgttaagcttctatatttttctgcttggagagtaggcatttttagggaagcaaattttgagttacgttttacatgtttgccgtaatttgtattggttaaccgctgtgacgaattcaaattttgtttgtttttttgctttaccttgttttcagcacattttggtgtcaaacatggttgctgcattgtgattactacaaatttaaaacctatggtcttttcttcacttgttcaatgttttgcctattcacaagaatattccataatagagaattaagttcaaacctcgtg

SEQ ID NO: 2700 - DNA, 785 bp, Distylium racemosum
tttgtcggtggatggacttgttgaaatatttcacttcggagcgtagcgttggcggaagcggagatcctctgcgaaaatgtctcttattgcaaatgaagactttcaacatatccttcgtgtcctcaacactaatgttgatggacgacagaagatcatgtttgcccttacgtccatcaagggaattggtaggcgttttgccaacattgtttgtaaaaaggctgatgttgatatgaataaaagagctggtgaactctctgcagcggagcttgagaacctgatggtgattgttgccaatcccaggcaattcaagatcccagactggtttttgaacagaaagaaggatcataaggatggtcgttattctcaggtggtagcaaatgctcttgacatgaaactcagggatgacttggaacgcttgaagaagatcaggaatcatcgtggacttcgtcactactggggtctacgagtgcgtggacaacatacaaaaaccacaggccgtagggggaagactgtaggtgtctcaaaaaagcgttgagcaaacaaatattccagggaaacacagttttgcctgtggctgtgttgttttattttctcatcgtagatgcttttatgctgtattgttcaatttttcaaaaggccgatttacttttgacattacatataattgtgaaggctgtaaagcttgcattggtctttctttcaagttttttagaaactttttattatatttgcaaaggcgttgaggagattaaatgttttgcagtatcaataattagaatagtttg

SEQ ID NO: 2701 - DNA, 649 bp, Distylium racemosum
gaagtccaagatcttccattgtcatttgcggcttccctttgtggtgtgagatcctgctcttgaacgacaatttactgctaaaatgtcgcttatagccaatgaagattttcagcatattcttcgtgtgctgaacacgaacgtcgatgggcgacagaagataatgtttgccctcacttccatcaaaggtatcggtcgccgtttcgctaacatcgtctgcaagaaggcagatgttgacatgaacaaaagggctggggagctttcagcgcaggagctggaacaactgatggtaatcgtagcgaaccctaggcagttcaagatcccagactggtttcttaataggaagaaggatcacaaggacggccgttactcacaggtggtggccaatgccctcgacatgaagcttagagacgacttggaacgtcttaagaagatcaggaaccaccgtggtctaagacactactggggccttcgtgtacgtggacagcacacaaagaccactggtcgtaggggaaagactgttggtgtctcaaagaagcgttaattatttttcttttttctttttggtagtttacatcagaggatgtgcgcagatattctgtattgtggacatttggttgtgattctgaacttgcggtttcggttttagagt

SEQ ID NO: 2702 - DNA, 821 bp, Eucalyptus grandis
ccagtccttcagccgtctctctcttcaagcaagactcgctcctctctgcctcgctcgcctgctagcccaacgaccatgtcgctcgtggcgaacgaggagttccagcacatcctgcgtgtgctgaacaccaacgtcgatgggaagcagaagatcatgttcgccctcacctccatcaagggtatcggccgccgcttcgccaacatcgtctgcaagaaggccgacgtcgacatgaacaagagggctggtgaattgactgctgctgagctagacaacctcatggtcattgttgccaacccacgccaatttaagattccagactggtttttgaatagaaagaaggattacaaggatggaaagtactctcaggttgtctcgaacgcattggacatgaagctgagagatgatttggagaggttgaagaagatcaggaaccaccgtggtttgaggcactactggggcctgcgtgttcgtggccagcacacaaagactactggacgtagaggaaaaactgttggtgtctccaagaagcgttgagttcttattacttttaattatgggcgttacattcaatgtctttggggtagtgttttttgtttgaagttccttgcgtggactctgatacaattatagctcaaggttatttccttgccctagttgtacgatgtgctttgcctggcctgattgctgaagtgttagtgaagtaaagcggatcaaagttttaagtgataatcagtttcattaagcaagcaatgagaggtcgggacaattttgttgttgaatggtaaatgttattcatgcgatttaataacccattgtgagtt

SEQ ID NO: 2703 - DNA, 857 bp, Eucalyptus grandis
actcaaaaccctagctccagtccttcagccgtctctctcttcaagcaagactcgctcctctctgcctcgctcgcctgctagcccaacgaccatgtcgctcgtggcgaacgaggagttccagcacatcctgcgtgtgctgaacaccaacgtcgatgggaagcagaagatcatgttcgccctcacctccatcaagggtatcggccgccgcttcgccaacatcgtctgcaagaaggccgacgtcgacatgaacaagagggctggtgaattgactgctgctgagctagacaacctcatggtcattgttgccaacccacgccaatttaagattccagactggtttttgaatagaaagaaggattacaaggatggaaagtactctcaggttgtctccaacgcattggacatgaagctgagagatgatttggagaggttgaagaagatcaggaaccaccgtggtttgaggcactactggggcctgcgtgttcgtggccagcacacaaagactactggacgtagaggaaaaactgttggtgtctccaagaagcgttgagtattacttttaattatgggcgttacattcaatgtctttggggtagtgttttttgtttgaagttccttgcgtggactctgatacaattatagctcaaggttatttccttgccctagttgtacgatgtgctttgcctggcctgattgctgaaatgttagtgaagtaaagcggatcaaagtttaagagataatcagtttcattaagcaagcaatgagaggttgggacaattttgttgttgaatgataaatgttattcgtgcgacttattaacccgttgagtttgttggggatgtgagtaccgccttggc

SEQ ID NO: 2704 - DNA, 832 bp, Euonymus alatus
accctcaattggcttctctgtgccgctttcttgttgctgcgctgcttagacgccaagagcgaagagccacctctgtgtttttctcctagcgtccaaaatgtcgttggtggcgaacgaggattttcagcacatattgcgtgtgctgaacacgaacgttgatgggaaggataagataatgttcgctctgacctctatcaaaggtattgggaggcgatttgcaaacattgtctgcaagaaggctgaagtggacatgaacaagagggctggtgaattaactcctgctgagctggacagtctaatggtggtggttgctaatcctcgacaattcaaaatcccagactggtttttgaataggcaaaaggattacaaggatgggaaatattctcaggtcgtgtcaaacgctctggatatgaaattgcgagatgatttagaacgattgaagaagatcaggaaccaccgtggtctgaggcactactggggtctccgtgtccgtggtcagcacaccaagaccacaggtcgcagagggaagactgttggtgtctcaaagaagcgttgaaatattgttatttttatggcaatgctagtcctaaattattgggatcttttttgcatcagacagtcttggaggacctttcttgaactggacggggttttgaaattgtgaactttttatttctcttctttcaattgcttagatttggctttgtgtatgagttatttgcgttttaattcgatgtctggactttggctggtttcttactgttcttttgctatttatgtactataaaaggctagttgctgaacagtaaaatacttaaatgcatttaacgga

SEQ ID NO: 2705 - DNA, 855 bp, Euonymus alatus
gcagcagaatcggaaaaccctcaattggcttctctgtgccgctttcttgttgctgcgctgcttagacgccaagagcgaagagccacctctgtgtttttctcctagcgtccaaaatgtcgttggtggcgaacgaggattttcagcacatattgcgtgtgctgaacacaaacgttgatgggaaggataagataatgttcgctctgacctctatcaaaggtattgggaggcgatttgcaaacattgtctgcaagaaggctgaagtggacatgaacaagagggctggtgaattaactcctgctgagctggacagtctaatggtggtggttgctaatcctcgacaattcaaaatcccagactggtttttgaataggcaaaaggattacaaggatgggaaatattctcaggtcgtgtcaaatgctctggatatgaaattgcgagatgatttggaacgattgaagaagatcaggaaccaccgtggtctgaggcactactggggtctccgtgtccgtggtcagcacaccaaaaccaccggtcgcagagggaagactgttggtgtctctaagaagcgttgagatattgttctttttctgggaatgctagtgccacattactggaatgtttttgcatcagacagttgtgaacttttgttactcttctcgttcaattgcttatatttggctttgtcgatgaattatttgaatttctattgcgtgtccgaacttccgctggttttttattgttcttttggtatttacgtactaaatagctagctgctgaatagtgaattaccttaatgcatttggcggattgattgtaaggtctctgagacatccaggctagctgtccctttttttt

SEQ ID NO: 2706 - DNA, 812 bp, Euonymus alatus
gcggccttgttgttgcggcgctgctcagactccaagagcgaagagcctccgctgtcttttctcagtgttcaaaatgtcgctggtggcgaacgaggattttcagcacatattgcgtgtgctgaacacaaacgttgatgggaaggataagataatgttcgctctgacctctatcaaaggtattgggaggcgatttgcaaacattgtctgcaagaaggctgatgtggacatgaacaagagggctggtgaattaactcctgctgagctggacaatctaatggcggtggttgctaatcctcgacgattcaaaatcccagactggtttttgaataggcaaaaggattacaaggatgggaaatattctcaggtcgtgtcaaacgctctggatatgaaattgcgagatgatttagaacgattgaagaagatcaggaaccaccgtggtctgaggcactactggggtctccgtgtccgtggtcagcacaccaagaccacaggtcgcagagggaagactgttggtgtctcaaagaagcgttgaaatattgttatttttatggcaatgctagtcctaaattattgggatcttttttgcatcagacagtcttggaggacctttcttgaactggacggggttttgaaattgtgaactttttatttctcctctttcaattgcttagatttggctttgtgtatgagttatttgcgttttaattcgatgtctggactttggctggtttcttactgttcttttgctatttatgtactataaaaggctagttgctgaacagtaaaatacttaaatgcatttaacggattga

SEQ ID NO: 2707 - DNA, 757 bp, Linum usitatissimum
agggttttataggctgtttcacttctcactcttcgaagcaaaaggaaagcgcggcgccgctcttgaaagaagaaatcgccgccatgtctcttgttgcgaatgaggagtttcagcacattcttcgtgtcctcaacactaacgttgatggaaagcagaagatcatgtttgccctgacctctatcaagggtatcggtcgtcgatttgccaacatcgtctgcaaaaaggctgatgttgacatgaacaagagggctggtgagctgtcttcagaagagcttgacaagctcatgacagtggttgcgaaccctcgtcagttcaagatcccagactggttcctgaacagacagaaggattacaaggatggaaagtactcccaggttgtttctaacgctgtggacatgaagctgagggatgatcttgagaggctcaagaagatcaggaatcaccgtggtctccgtcactactggggcttgagagtccgtgggcagcacaccaagaccactggtcgcaggggaaaaactgttggtgtgtcaaagaagcgataagctgtttggaatatctgtggaaccctttgggcatatgcttttttggtactatgttttacagactatttgttcagtacttgtttagggtcttttgccggagtttaattaaagttgatatctgtagcttggatagtgtttccagagtttgagatgaattatgaatgaatggttttgatgatataacttttcttcctgaatgaaactgccgatttagt

SEQ ID NO: 2708 - DNA, 744 bp, Linum usitatissimum
attggtgtcgcatctcctcttcgctttctgcttcttaatcaggataggatcgccgttcaaccccagcagccatgtcgctagttgccaatgaagagttccagcacattcttcgtgtgctcaacaccaacgtcgatggaaagcagaagataatgtttgcccttacctccatcaagggtattggtcgccgatttgccaacatagtctgcaagaaggccgacgtcgacatgaacaagagggctggagagttgtcatccgaagagctcgacaagctaatgacagtggttgctaaccctcgtcagttcaagatcccagactggttcctgaataggcagaaggattacaaggatggaaagtattcccaagtggtctctaatgcattggacatgaagctgagggacgatctcgagaggctcaagaagatcagaaaccatcgcggtctgcgtcactactggggtttgacagtccgaggacagcacaccaagaccactggccgtagagggaagactgttggtgtgtccaagaagcgataagctgcttcaagacgtttggctgttgtatcgattttggatttgacaagactgttagtgatgtttcgaggacttgtttcgtggacttgtttcgtttagtaattagttggtgttaagggttatattgcatgaaactgaatatttgtctgtcatctggataattgttcgagtgttacctaagaagagtttcgaagaatgaaactgaacatctattttc

SEQ ID NO: 2709 - DNA, 717 bp, Linum usitatissimum
ggtcgtctccgtatcgcatctcctcttcacttactgctcagcagctgcatcgcagtcccagcctaagcagccatgtcgctcgttgccaatgaagaattccagcacattcttcgtgttctcaacaccaatgtcgacggaaagcagaagattatgtttgccctgacctccattaagggtattggtcgccgatttgccaatatcgtctgcaagaaggccgatgttgacatgaataaaagagctggagagttgtcatctgaagagcttgacaagctaatgacagttgttgctaatcctcgtcagttcaagatcccagactggttcctgaataggcagaaggattacaaggacggaaagtattcccaagttgtctctaacgcagtggacatgaagctgagggatgatctcgagaggctgaagaagatccggaaccaccgtggtctgcgtcactactggggtttgagagtgcgaggacagcacaccaagactactggtcgtagaggaaagacggttggtgtgtccaagaagcgataagctgctcgagcttccgattttcaggactgttagtcatgttttcgaggccctgttttttgtactgaatatttcgtcggggtttgggggcatttcatcgcatgaaagttgaatacctatgatgagatctctctgcttctggaagttattactcgcttatgatttcagcaaagcatcgaaatttttgtt

SEQ ID NO: 2710 - DNA, 853 bp, Linum usitatissimum
agggttttagttttataggtatcgcatcttctcttcttcgctttctgcttcttgatcaggatcgccgttcaacctcagcagcagccatgtcgctagtcgccaatgaagagttccagcacattcttcgtgtgctcaacaccaacgtcgatggaaagcagaagatcatgtttgcccttacctccatcaagggtatcggtcgccgatttgccaacatagtctgcaagaaggccgacgtcgacatgaacaagagggctggagagttgtcatccgaagagcttgacaagctaatgacagtggttgctaaccctcgtcagttcaagatcccagactggttcctgaacaggcagaaggattacaaggatggaaagtattcccaagtggtctctaatgcagtggacatgaagctgagggacgatctcgagaggctcaagaagatcagaaaccatcgcggtttgcgtcactactggggtttgagagtccgcggacagcacaccaagaccaccggccgtagagggaagactgttggtgtgtccaagaagcgataagctgcttttcaagacatttggctgttgtatggagtttgattttgacaagactgttagtgatgttttgaggacttgtttcagtgagtaattagttggtgttaagggttatattgcatgaaactggatatctgtctgtcatttggataattgttcaagtgttaccttggatgagttttgaagaatgaaaactgcatatctattgtctaccattaggataatagcattgatgatggctccagaaccgagtaattgctcttcaattttgttgaacagaagttatataaattcaatgaatgtttcatcttttt

SEQ ID NO: 2711 - DNA, 751 bp, Fraxinus spp
gaggtttttttctctctctgaagcgaagcagccgtcttgcccaagcagaccgaattctagccatgtctttgatagcaaatgaggagtttcagcacattcttcgtgtgcagaacacgaatgtggatggaaagcagaagataatgttcgcacttacgtcaatcaagggtatcggtcgtcgattcgccaatattgtctgcaagaaagctgatattgacatgaacaagagggctggtgagctttcggctgctgagattgacagcttgatgacgattgtggccaatcctcgccaattcaaaatccccgactggtttctgaacaggaagaaggattacaaggatggaaaattttctcaagtgacttccaatgctctggacatgaaactgagggatgatcttgagcgtttgaagaagattaggaaccaccgtggtctccgtcactactggggtcttcgagtgcgtggacaacacaccaagaccactggccgtaggggaaagaccgttggtgtctccaagaagcgatgatcctctttttctcgcattgttctcatgaatactctggttttaggcttcacttgacctatgatcttgcatctgataaaattctttctttcgggtctcttctcagtgtctgattataggtattgttgttaaatgttactctcgtttttagagcgattttgtttcatttgaagtttttatagagcaatgaatcagcctgtccctctattgtggtgtcacattcgataattacg

SEQ ID NO: 2712 - DNA, 658 bp, Gerbera hybrid cultivar
ggttttctccgcgatcagagcgttccggagtgacagccgctaggtgaagacgatcaaccgcaactatgtcgctggtagcaaatgaagattttcagcacattcttcgtgtacagaacacgaacgttgatggaaaacagaagattatgtttgcaatgacctcgatcaagggtattggtcgtagatttgccaacatcgtctgcaagaaggctgacattgacatgaacaagagggctggagagctttccaatgcagagatagatagtctgatgacaatcgtggctaatccacgccagttcaaaatcccagactggtttttgaataggaagaaagattataaagatggcaagtactcccaagtaacatcaaatgctctcgacatgaaattgagagacgatcttgagcgtttgaagaaaatcaggaaccaccgtggtcttcgacattactggggtctccgagtacgtgggcagcacaccaagaccactggacgcagaggaaagactgttggtgtatccaaaaagagataagtttttctgtgtttgcgctttatatttgaaaatgaattaatttttttgttttagacattttcttttatctctagtcatcaattttgaatgttgggctaagttatgttatggttatagacttaaaaaaaaaaaaa

SEQ ID NO: 2713 - DNA, 610 bp, Gerbera hybrid cultivar
gatttgggagcatcagccgctaagagaagaagctcaatcgcaaccatgtcgctggtagcaaatgaagatttccagcacattcttcgtgttcagaacacgaatgttgatgggaagcaaaagatcatgttcgccatgacctccattaagggtattggtcgtcgtttcgcgaatattgtctgcaagaaggccgatattgacatgaacaagagggctggagaactttctaatgctgagattgatagtctaatgacaatcgttgctaatcctcggcaattcaaaatcccagattggtttcttaatagaaagaaagattacaaagatgggaaatactctcaggtcacatctaatgcccttgacatgaagctcagggatgatcttgagcgattgaagaagatcaggaaccaccgtgggcttcgtcattactggggtcttcgagtgcgtggtcagcacaccaagactactggtcgcaggggaaagactgttggtgtgtccaaaaagcgatagatctgtttttttgagccaacttttatttttgtttttagataccgaatgttatgttatgaccggtacttttgtgttatctttatatgaagattttgatatttgtcta

SEQ ID NO: 2714 - DNA, 997 bp, Humulus lupulus
agggttcgtaaattggaggcttcttcactatctcgacgcacacagacgagtagctgcttcagatctgaaaccctagccatgtcgctggttgcgaacgaagagtttcaacacattcttcgggttctgaacaccaacgtagatggaaagcagaagattatgtttgctctgacctccattaaaggtataggccgccgttttgccaacctcgtttgcaagaaagccgatgtcgacatgaacaagagagctggtgagttatctgctgctgagcttgatactttgatgaccattgtcgccaatcctcgccagttcaaaatcccagactggtttttgaacagaaagaaggattataaggatggaaggtattcccaagttgtgtccaatgcattggacatgaagcttagggacgatcttgagcgtttgaagaagatcaggaaccaccgtgggctccgtcactactggggtcttcgtgttcgtggacagcacactaagaccactggtcgcaggggaaagactgttggtgtctccaagaagcgatagtctggttatgcacttctcttttcatttggttgttttgcttcaatgttacgagttttactagtttagcaggaatatttttggatatccagtaattttgactaaagatatttcctttgttctctcataaaaacttaaatgaattttctatttattttagtgttatttagttttacttgattggaacgaagtatgtagagaacaagcaaaagcatttgctcgttatctttttgaatggtatttgagaaatctgagaatggtcagtggttttcttcaagttatattttctcggctctacccttttatttttaaattgttttgcactttgacgtattttatgtggatgttccttggatttttgttgtaatgaaaaaaaaatcaatttgctgtacaagtcatgggattacaaaagctaagttcttctgtttctggttttgggcgtgcaaatttaattgaatttgtg

SEQ ID NO: 2715 - DNA, 767 bp, Ipomoea batatas
caaaaccctagtctcccaacccggcgctgcgcagtgctagagagtagagacagaaggcgagaggaaaagccgcagccatgagtcttgtagcgaacgaggatttccagcacattttgcgtatcctgaacaccaatgttgatggaaagcagaagataatgttcgctctcactcccatcaaaggtattggtcgcaggttcgccaacatctgctgcaaaaaagccgatatcgacatgaacaaaagggctggtgagctttctgctgctgagattgataacttgatgacagttgtggcaaatcctcgccaattcaaggtccctgactggtttctgaacagacaaaaagactataaagatggaggttattcacaggttgtgtccaatgcattggatatgaagctcagggatgaccttgagcgtttgaagaaaattaggaatcaccggggtctccgacactactggggtcttcgtgtacgtggtcagcacaccaagacaactggacgtaggggaaagactgttggtgtctcgaagaagcgttgagctcttttggtttcagttctattttaatttttgttcctctattatgatgtctttgtgaatgaacattttggttattagcctgggactctttgcgctagctctgttttctcactacagtactggttgagcttgaatgagctcaattaagattttatagatgattttggaacaaatattttcgattttgattgttaagcctaatgtttgtttttttattacaattttcattac

SEQ ID NO: 2716 - DNA, 834 bp, Actinidia deliciosa
  misc_feature (566)..(566): n is a, c, g, or t
  misc_feature (693)..(693): n is a, c, g, or t
aattcggacgagggcgattcataacttgagccgcagctacaagcaagaagagcattcgcagatcccggtctgaaaccctaagcaagcaatgtcgctggtagcgaacgaggagttccagcacattcttcgtgtgcagaacacgaacgtcgatggaaagcagaagatcatgtttgctctgacctcaatcaagggtatcggccgccgtttcgccaacatcgtctgcaagaaagccgatgtcgacatgaacaagagggctggtgaacttacagctcaagagctggataacctgatgactattgtcgcaaatcctcgccaattcaaaattcccgattggtttctgaacaggaagaaggattacaaggatggtaagttttctcaggtgacatccaatgcattggacatgaagctgagggatgacttggagcgcttgaagaagatcagaaaccaccgtggtctccgtcactactggggccttagggtgcgtgggcagcataccaagacaactggccgcagggggaagactgttggtgtctcgaagaagcgataagctggttattgattttctnaggttttcaatcgttcttgattccaaacatgtttggtttagatcttcctgactttagtacttgtgcaagagttttggcattggatggattgtttgcttagaaatttggtaccattttgaatctattnagctacttatctatttttgttctctctctctacattatcatgcaagtctgatgtatttttctattagtttatagctttgcagatggagtaatatattttgtgtttgaagtttcttgggctttaaatgcatgcatttaaaag

SEQ ID NO: 2717 - DNA, 1106 bp, Actinidia deliciosa
  misc_feature (944)..(944): n is a, c, g, or t
  misc_feature (1031)..(1031): n is a, c, g, or t
  misc_feature (1062)..(1062): n is a, c, g, or t
  misc_feature (1078)..(1078): n is a, c, g, or t
atcataaggtgggtatgtgggacccattattgcaataattctaattaccagccaatacaaactatcaaccataatcaaaatcaaagttctccatcccaaagttcctcaattgtcttgaaaggtccattgagaaagaggaactcctccccactgtgtcttctactttgagggatctcaccaatcttcttagactcttcatcactcaatgcccagtcaaatatctcaaggttttgcttgattctctccttattgtagctcttcactactatgcctattccttgttcatattcccatctcaggcaaacctgagcaaccgtcttgcctttggccctcgtgccgaattcggcacgaggcttgagccgcagctacaagcacgaagagcatttgcagatcccgctctgaaaccctaagcaagcaatgtcgctggtagcgaacgaagagttccagcacattcttcgtgtgcagaacacgaacgtcgatggcaagcagaagatcatgtttgctctgacctccatcaagggtatcggccgccgtttcgccaacatcgtctgcaagaaagccgatgtcgacatgaacaagagggctggtgaacttactgctcaagagctggataacctgatgacgattgtcgcaaatcctcgccaattcaaaattcctgactggtttctgaacaggaagaaggattacaaggatggtaagttttctcaggtgacatccaatgcattggacatgaagctgagggatgacttggagcgcttgaagaagatcagaaaccaccgcggtctccgtcactactggggccttagggtgcgtgggcagcataccaagacaactggccgcagagggaagactgttggtgtctcaaagaagcgataagctggttattgaatttgtaaggttttcaattcttgataccggatatgtttggttttagattttcccgnctttagtacttgtgcaagagttttggcattggatggattgtttgcttagaaatttggtaccattttggatcttttcagctactactntgttattgttttttccctttacattatcatncatttggctgatctanttttctattagtttatagctttccatat

SEQ ID NO: 2718 - DNA, 833 bp, Medicago truncatula
gagcatgatataaataatgaattctccgaaaccctaattctcttcttcatcatttacattggccacagaaacacacccttggcggcagttatcaccgttcactgggaaccttcatcggctagtctaaaatgtctttggttgcgaacgaagaatttcagcacattctgcgtgtgttgaacacaaatgttgatggaaagcagaagatccagttcgcaatgacctcaatcaagggtattggaagaagatttgctaacatctgctgtaagaaagctgatgttgacatgaacaagagggctggtgaattgagtgctgcagagttggataatattatgacagtggttgcgaatcctcgtcaatttaaggttccagattggtttttgaacagaaagaaggattacaaggatgggaaattctctcaggttgtctccaatcaactcgacatgaagttgagagatgatttggagagactcaagaagatccgtaatcatcgtggtttgaggcactactggggccttcgtgttcgtggtcagcataccaagactactggccgcagaggaaagacagttggtgtgtcaaagaagcgttaagctgttatgttttgacttggagattagatgattttgaggaagcatattttaagcttattattagacatgtttcctatacagactttgtatggttgttaaatgctgcgactatttcaattttatttgaattctgttaaaagtgtctttttttcttatttgttgaatgatattggtgtttattcccgttggttcttagcatagtaatgatatttctcaaataaaaataacgcaaattttcaaaaagta

SEQ ID NO: 2719 - DNA, 784 bp, Medicago truncatula
atagcccattctcacaaaccctaaaatttctttcgcattctcaactccctcttcaacaaatcctccgcagttaggttaaaatgtctttggttgcgaacgaagaatttcagcacattctgcgtgtgttgaacacaaatgttgatggaaagcagaagatccagttcgcaatgacctcaatcaagggtattggaagaagatttgctaacatctgctgtaagaaagctgatgttgacatgaacaagagggctggtgaattgagtgctgcagagttggataatattatgacagtggttgcgaatcctcgtcaatttaaggttccagattggtttttgaacagaaagaaggattacaaggatgggaaattctctcaggttgtctccaatcaactcgacatgaagttgagagatgatttggagagactcaagaagatccggaatcaccggggtttgaggcactactggggccttcgtgttcgtggtcagcataccaagactacaggccgcaggggaaagaccgttggtgtctcaaagaagcgttaagccgtgatgtcctgttttggagattagatgattttgaggcatattttaagcacattagacatgtttcatataccgagtttgtatggtttttaattgaatgcattggcaatttcaattttgtttggtttgtgttcaagtgcctgattagttgaatggtgttggtatttttatgtctactttagcattactaatttggacaccacgtgataatgaattaaagatagaaatactattttgaaaatggg

SEQ ID NO: 2720 - DNA, 621 bp, Momordica charantia
aagtcgttcgtcgcgctgcagcctctgaaagaagaagcaccaggacgaagccgctcgccctttgccgtcaaaatgtcgttggtagcgaacgaggaattccagcacatattgcgtgtgctcaacacaaatgttgatgggaagcagaagattatgttcgctcttacctccatcaaaggtattggaaggcgtttcgctaacattgtctgcaaaaaagccgatgtggacatgaacaaaagggctggtgaattgactgctgctgagctggacaatctcatggtggttgttgccaacccacgacagttcaaaattcccgactggtttttaaacagacagaaggattacaaggatggcaagtactcgcaggtcgtatccaatgctcttgacatgaagctgagagatgacttggagcgtttgaagaagatcaggaaccaccgtggtctgaggcactactggggtctccgtgtccgtggtcagcacactaagactactggtcgccgagggaagactgttggtgtctctaagaagcgttaaaatccttctcccttctttttgcaagtgattttatgttggatggatgcaatagattaatataattagtctttgagattggcttggacctta

SEQ ID NO: 2721 - DNA, 911 bp, Momordica charantia
cactcgaagatctcccctgattttttttcccttgccatttgctgcctgcgcgaattctacgaagtccttccatcttcatccgccatgtcgctggtagcgaacgaggaatttcagcacattctgcgtgtgctgaacacgaacgtggatgggaagcagaagattatgtttgctcttacttcaatcaaaggtattggaaggcgtttcgctaatatcgtttgcaagaaggccgatgtcgacatgaacaagagggctggtgaattgactgctgctgagttggacaatctcatggtggttgttgccaatccacgtcaatttaaaattcctgactggtttttgaatcggcaaaaggactacaaggacgggaaatattctcaagtggtttcaaatgcattggacatgaagttgagagatgatttggaacggttgaagaagatcaggaatcaccgaggtctgaggcattactggggtctccgagtccgtggtcagcacaccaagaccactggtcgccgagggaaaaccgttggtgtctccaagaagcgttaagcttttccaggtttttataatcgagttgagcatgtggttgggcaaatcgggttctttggccttttagttgaacgttttgagttggaactttgtttttggaatttttgcttgggatgatatttttggttaacttattaccccccttcttttatactgtctttttgggccagaaaatattgatagtggcagatggcaaaagcttatggatcttgtttattggtcattttagtgtgaagatttttatttatagaattattctcatttggtgcaaccatgttgttatcatcaatttgctgacgagaaaacattgaaaacattttggacattagttaattaaatttgtaaacttgaggggtaatattcataac

SEQ ID NO: 2722 - DNA, 647 bp, Nuphar advena
cccttctcacaatgtctctcatctccaacgaggatttccagcacattctccgtatcgtgaatacgaacgtcgatgggaggcagaagatcatgttcgccctcacctccatcaagggtatcggccggaggttcgcaaacatcatatgcaagaaagccgatatcgacatgaacaagagggctggtgaattgtcagctgctgagcttgagcaacttatggtgattgttgcaaacccccggcagttcaagatcccagactggtttctcaacaggaagaaagattacaaggatgggagatactctcaggttgtttcaaatgcgttggacatgaaattgagggatgatttagagcgtttgaagaagattaggaaccaccgtggtcttcgccactactggggcctccgtgttcgtgggcagcataccaagaccacaggccgtcgtggaaagactgttggtgtctcaaagaagcgatgagaagtctttgtccttgtgttttgatagtttactgcgtctgttttggatttctttcatgaacacctcaactaccttgggcagacatgacacatcatctttggattacaattttgattcgagattagtactttcataattgctattctaaattaatataggtgaacaattttgtgagcc

SEQ ID NO: 2723 - DNA, 922 bp, Quercus alba
ggggtctccgaagacctttaaataccatctttacaaacccctctcttctctctcgctcctccgctctctcattttccaaaccctctgaaacagagagagctcagagaacaaaaaccctaaccctaaccatgtctcttgtagcgaacgaggatttccaacacatattgcgtgttctgaacaccaacgttgatggaaaacaaaagatcatgttcgctctcacttccatcaaaggtattggtcgccgtttcgccaatctcgtttgcaagaaagctgacgtcgacatgaacaaacgagctggtgagttgacagccgctgagctggataacctgatggtgattgtggcaaaccctcgccagttcaagatacctgattggtttctgaacaggaagaaggattacaaggatggtaaatattctcaggttgtctccaatgctttggacatgaaactcagggatgatcttgagcgtttgaagaagatcaggaaccaccgtggtctgcgacactactggggtctccgagtgcgtggacagcacactaagacaactggtcgccgtggaaagactgttggtgtctcaaagaagcgttgagtttgtttctccctttttgggatgtttgcgaattttgtttggccttttagaatatcttgggtttagtattgtacttttctttttggcagactcgtgcagtatcatttagctgtctttatgtgttctttagactgattgaacttgtttgagagattttggtatgtgtgatggtattaattattcataatttcatataatagttaaagttgacaatgcattttgcattttaccttattatgaacaaaaacctatttgacaaaacaaaaagcaggagcaaaaagggtgtcttttaatgggaccccatagcccccccccctctttgtgcaaaatgtgtg

SEQ ID NO: 2724 - DNA, 787 bp, Quercus alba
ggaaagaaagaaaagcaagaaagcggtttctctcattcacggcgtccgtcgcaaacagcctcgcggtggtctcttctgcaaaatgtctctggtggcaaacgaggattttcagcacatccttcgtgtgctgaacacaaatgtggatggaaagcagaaaatcatgttcgctctcacctccatcaaaggtatcggtcgccgcttcgccaacctcgtctgcaagaaggccgatgtcgacatgaacaagagagctggggaattgagtgcagctgagctggacaatctgatgactattgttgccaaccctcgtcagttcaaaatcccagactggtttttgaataggaagaaggattacaaggatggaaagtactctcaggtcgtttccaatgctcttgatatgaagttgagagatgatttggaacgcttgaagaagatcaggaaccatcgtggtctgaggcactactggggccttcgtgttcgtggccaacacaccaagactacaggccgcaggggaaagactgttggtgtctctaaaaagcgctgagattttttttttctttgttccaaactaaatatatatggttgggcaatccagatttttggctatttagtatgtttgattggacatttttagatttttgttactgtgggctgtggttgggtgtttcactgtggttgtgtttttaagcctgtaaccctattatcatatttggtcaattttggtttttctatggttctatctagtgtagtccatctgcagagttgcattatatatcaagcaattgataaa

SEQ ID NO: 2725 - DNA, 965 bp, Citrus sinensis
aggccaccctttataaccaacatcatacctccatctacactcacctccggagaaggcgaaggcacaaaagtcaaccataaaggaaaaaagagaaacgaacatctccagccatgtctctggtagccaacgaggattttcaacacattcttcgtgttctgaacacgaatgttgatgggaaacaaaagatcatgtttgctctcacatccattaagggtatcggtcgccgtttggccaatattgtctgcaagaaagctgatgtcgacatgaacaaaagagctggtgagctctctgccgctgagcttgaccaactgatggtggttgtggcaaatccacgccagtttaagatcccagactggtttcttaacaggcaaaaggattacaaggatgggaggtactcccaggtcgtgtctaatgcattggacatgaagcttagggatgatcttgagcgcttgaagaagatcagaaaccaccgtggtctacgacactactggggtcttagagttcgtggacagcacaccaagactactggacgcaggggaaagaccgttggtgtctccaagaagcgttgagttttgtcatctcctattggttcatcaagctgcaagttttgtttacatgttagttttgcatcgttcagtatgtctgtcttgtagaagaattgtttttgataattttcttcagtttattttcttaggttgtctttttgactgaattgaaaggaattccatttgatattgtgattaaaaagtcatccatgttttatttaatcaggagggtaatattttagttgagaattctatatcctagagagttgaatgcattatatgctaccaaagcttgcttgagaatttatgtagggtgatgggatgttcttattgtaatcgagaactccatttcttacagttgtgaaactgactgtgtgtgaatgagatatttggatgaaagtaacaaaagctagtatgaaa

SEQ ID NO: 2726 - DNA, 737 bp, Capsicum annuum
ggttttctaagagcttagcatctctcccaaacaaaagcagccgccgccgcactgcgaacacagtgaaaccctagccatgtcgcttgtggcaaacgaagattttcagcacattcttcgtgtgcaaaatacaaatgttgatggaaagcagaagattatgtttgctatgacctctattaaaggtatcggtcgtcgttttgcaaacattgcttgcaaaaaagccgatatcgatatgaacaagagggctggtgagctttctgctgccgagcttgacagcttgatggtggttgtggctaatcctcgccaattcaaaatcccagattggtttttgaacagacagaaggattataaggatggcaagttttcccaagttacatctaatgcccttgacatgaaacttagggatgatctggaacgcttgaagaagatcaggaaccatcgtggtttgcgtcactactggggcctccgtgtccgtggtcagcacacaaagaccactggccgcaggggaaagactgttggtgtctccaagaagagataaatcatccacatgtcaattccttatgttttgtccctctttagtattgaatccggacatttacgaaaagtttgttaggtatttttgtggtgtttgcatttgaattttcttgtcctgccttttgggtggtgaaagcatgttttgctgttgggatcaaagttttgccgattgcacttggattaatacatcaaatatgcgtactttt

SEQ ID NO: 2727 - DNA, 929 bp, Physcomitrella patens
gcaaacccctaaatgttgcttccactctgtctggaatgccctctctcctcggcccagacgctcgaatcccgttttcagccctaagctctgttacgttagttgccgccgaacagcgcgatgtcgctcatcgcgggtgaagagtttcaacatattcttcgtgtgctgaatacaaacgtcgatggacggcagaagatcatgttcgccctgacctccattaaaggagttgggcgtcgttttgccaacttggtgtgcaagaaagctgacgttgacatgagcaagagggctggtgagctctccgctgctgaactcgagaatttgatggttattgttgccaaccctcgccagttcaaggtcccagattggttcttgaataggaagaaagatcacaaggatggtcgctactcccaggttgtttcgaacgccttggacatgaagctgagggatgacctcgagcgcctaaagaagatcaggaaccaccgtggacttcgacactactggggcttgcgcgtgcgtggacagcataccaagactacagggcgacgtggaagaaccgtcggtgtgtccaagaagcgatagagagtttattttgtgttgatgtttagtgttttactggcccttttcaaagtaaaatcctcgttcagtatcacgctcaaatttctcagtacacactggttttgtatgatcaactttgtgagaacttagatgttagggttttgtgagaaaccgctatttcaaaatactcttctcccctgcatgtttgtgctgtactttggacaggtcttagtttgttttggtcatagtcagtgattgtctttgaagtggagtgcaagcaatatagtttgaactgtctccacgaatgcagcagctcgtcagtattgaaatggaaagttgggtcaagtactgacctgatctagtatgacctttattcc

SEQ ID NO: 2728 - DNA, 622 bp, Physcomitrella patens
ccctttctctggtcggctcccctgcgtatgcccagcgccagccccacgctgtgcttcttgtcgtccctcctcatccaccatgtcgctcatcgcgggtgaggaatttcagcacattcttcgtgtccttaacacgaacgtcgatggacgccagaagatcatgtttgccttgacctccattaagggagttggtcgtcgtttcgccaacttagtgtgcaagaaggccgatgtcgatatgagcaagagagccggtgagctctccgcagcagagctggagaacttgatggtgattgttgctaaccctcgccagttcaagattccagattggtttcttaacagaaagaaagaccacaaggatggtcgtttctcccaggttgtttctaacgctttggacatgaagctgagggatgatctggagcgtctcaagaagatcaggaaccaccgtggtcttcgtcactactggggcttgcgtgtacgtggacagcacaccaagacaactggacgtcgtggacggaccgttggtgtgtctaagaagcggtagaaagtcctgcatgtgttgtcttgagggtattataattgaccttctggcaagtgcactcttaatgaagcagcatttacaatttta

SEQ ID NO: 2729 - DNA, 965 bp, Cajanus cajan
agtttgaggttttagcctaggagccgtgttcatcgaccgcgagccgcatcagtcccctcaatcgtgaatccctgcgttcaacatggcccttgtggcaaatgaagattttcagcacatacttcgtgttttgaacacgaacgtagatgggaagcagaagataatgttcgctcttacctcaatcaaaggtatagggaggcgatttgctaacatggtttgcaagaaggctgatgttgacatgaacaaaagagctggtgaactgagcgctgctgaattggataatctcatgactgtggttgccaaccctaggcagttcaagattccggactggtttttgaacagaaagaaggactacaaggatgggaagtattctcaggtggtgtcaaatgcattggacatgaagttgagagatgatttggagagactcaagaaaatcaggaaccatcgaggtttgaggcactactggggtcttcgtgtacgtggccagcacaccaagaccactggtcgtaggggtaaaactgttggtgtctctaagaagcgttgagcagagacatctcacttccttttttactggtttttaagaatgagatatgtggttaaagccagcaaaattttattttgagaatgcacttggattttgtcgcctttgaacgttgattgtggttgggttgggtacttggttgatcgtattttttacttacgaatcagacgtcgcatgttgatttccttcgaacaagattgatgcatgatcactacgtgagacttatcttagaaggagcataatgcttgagtgaaaattttcttagagggggcgtgtttatgatcacaacaaacataaaatttaaaaatatttaagataataatgaaaaggatgatgatatccttattgtagttatttaactactatggaactctcaatctcttcataagaatttacttaatttagttggatatattatatttatcaa

SEQ ID NO: 2730 - DNA, 991 bp, Populus trichocarpa
ctagggttttgggacttcttcaccttcttcacactctaagagcaggcgccgcttagccaaagaccaacccttgctccgaaaccctagcccaaagccatgtcgctggtagcaaatgaggaattccaacacattcttcgtgttttgaacaccaacgttgatggcaaacagaagattatgtttgctcttacatccattaaaggtattggtcgtcgtttcgccaacattgtctgcaagaaggccgatgtagacatgaacaagagagctggtgaactgtcagctgaggagcttgacaagcttatgaccattgttgctaatcctcgtcagttcaagattccagactggttccttaacaggcagaaggactacaaagatggaaagtactcccaggttgtttccaatgcattggacatgaagctgagagatgatcttgagcgtttgaagaagatcagaaatcaccgtggtctccgtcactactggggtctccgagtgcgcgggcagcacaccaagaccactggccgtaggggaaagactgttggtgtctccaagaagcgatgatctggttacacagattgtgttctcttgctacaatgcagtatttttcgggttctcagtcatttctttttcaagcaaaaaactttagtataacttagattgtttgcttgaactctgttttgtttttgctggttggatatttctctatgcgttgtctctgagaagatcatatttttgcttaaatatttttccttgagatatctttttgtgtgtttacttatattctggtttctgattttggatggaggcataggcaagaacaagcagcataagtgtttcctaccgggttaccaaactaacatgtgtcttcaatgagatagaagcagttgcatgattaggggatagtctgtaattgccaagaaaacgcatgtcttaatcttaatacctgttggacggtgccagtcttgggtgttgtagttggaaacatctgctatcctac

SEQ ID NO: 2731 - DNA, 1085 bp, Populus trichocarpa
cggcacgctgtctctgtatctagggttttgggacttcttcaccttcttcacactctaagagcaggcgccgcttagccaaagaccaacccttgctccgaaaccctagcccaaagccatgtcgctggtagcaaatgaggaattccaacatattcttcgtgttttgaacaccaacgttgatggcaaacagaagattatgtttgctcttacatccattaaaggtattggtcgtcgtttcgccaacattgtctgcaagaaggccgatgtagacatgaacaagagagctggtgaactgtcagctgaggagcttgacaagcttatgacaattgttgctaatcctcgtcagttcaagattccagactggttccttaacaggcagaaggactacaaagatggaaagtactcccaggttgtttccaatgcattggacatgaagctgagagatgatcttgagcgtttgaagaagatcagaaatcaccgtggtctccgtcactactggggtctccgagtgcgtgggcagcacaccaagaccactggccgtaggggaaagactgttggtgtctccaagaagcgatgatctggttacacagattgtgttctcttgctacaatgcagtatttttcgggttctcagtcatttctttttcaagcaaaaaactttagtataacttagattgtttgcttgaactctgttttgtttttgctggttggatatttctctatgcgttgtctctgagaagatcatatttttgcttaaatatttttccttgagatatctttttgtatgtttacttatattctggtttctgattttggatggaggcataggcaagaacaagcagcataagtgtttcctaccgggttaccaaactaacatgtgtcttcaatgagatagaagcagttgcatgattaggggatagtctgtaattgccaagaaaacgcatgtcttaatcttaatacctgttggacggtgccagtcttgggtgttgtagttggaaacatctgctatcctaccgcccctcaccgctttgatacagtaactttcacatatataatagtatggctgtaagggaatcagatttgtaaccc

SEQ ID NO: 2732 - DNA, 664 bp, Papaver somniferum
gtaggagtttaggagacgccaagatccatcaaccaacaaaatgtctttggttgcaaacgaagattttcagcacattttgcgtgtgctgaacaccaacgttgatggaaagcaaaagatcatgtttgctttgacctccattaagggtattgggaggagattcgctaacatcgtctgcaagaaggccgatgttgacatgaacaagagggctggtgaattatctgctgcggagctggagaatctcatggtgatcatcgcaaacccccgacaattcaaaatcccagactggtttttgaacaggaagaaggactacaaggatgggagatactcacaggttgtgtcaaatgctcttgagatgaaactgagagatgatttggagcgattgaagaagatcaggaaccaccgtggtttgaggcactactggggtctcagagttcgtggtcagcacaccaagacaactggtcgtagggggaagactgttggtgtgtctaagaagcgctgagctcttgttctactctttgaatgtcaggcgcaattaatgtggtagtgaggtttgtgtttctgttacaggttcgagacctacaaacatgatctatatagtttaggattgcagatctcttaattcaaatgtggtgttttttcttacttttgagaaccagtgaatatg

SEQ ID NO: 2733 - DNA, 756 bp, Solanum tuberosum
ctcttccaaaacaaaagcagcagccgcagtgtaacacagtgaaaccctagccatgtctctggttgcaaacgaagagtttcagcacattcttcgtgtgcaaaacacaaatgttgatggaaagcagaagatcatgttcgctatgacctctatcaaaggtatcggtcgccgttttgctaacattgcttgcaaaaaagccgatatcgatatgaacaagagggctggtgagcttactgctgcagagcttgatagcttgatggtagttgtggctaatcctcgccaattcaaaatcccagattggtttttgaacagacagaaggattacaaggatggcaagttttcccaagttacatctaatgcccttgacatgaaacttagggatgacttggaaaggctgaagaagatcaggaatcaccgtggtttgcgtcactactggggcctccgtgtccgtggtcagcacacaaagaccactggccgcaggggaaagactgttggtgtctccaagaagagataaattatctacatgcgaattcctctatgttttatgctttctctttagaatgcggaatctggacacttgcaaaaagtttgttagggtatttttgtattgtttgcatttgaactttcttgtcctgccttttggagatctatagttcctataaatcttcccatggcagtgcaagcatgtttttacttttgggatcaaagttttgtcgattgcacttggattatacatcaaatatgagtactttttacgga

SEQ ID NO: 2734 - DNA, 1387 bp, Prunus persica
atgatggacggctacgaattcatcaataaggagtgcacatataatcctttaaatccatctttttctttcactggccctctctcacccggcgcgcttgcacacacacacgcagagtcgcagagagagagagcaaaccctaacgccgcaacaatgtctctcgtcgcaaatgaggagttccagcatattctgcgtgtgctgaacaccaacgtcgatggaaagcagaagatcatgttcgctctcacctccatcaagggtattgggagacgtttcgccaacatcgtctgcaagaaggccgacgtagacatgaacaaaagggctggtgagctatctgccgctgagctcgacaacctgatgaccatcgtggccaacccacgccagttcaagatccctgactggtttctgaacagaaagaaggactacaaggatggtaaatattctcaggtcgtctccaatgctctggacatgaagctcagggatgaccttgagcgcttgaagaagatcaggaatcaccgtggtcttcgacactactggggtcttcgtgtgcgtggacagcacaccaagaccactggccgcagggggaagactgttggtgtctccaagaagcgttgaagaatttttatcgtcattcttggatgttgtttggatatcatgtttgcgcattttgttttacattttcaaataccctctagtttagcaacctcaatctacttcagttttgatggattcatgcagtatgtctagctgtcttttatttgttccttttggactgcttggtcttttgtgtttgaggatagtatgttatgcaatggaatttgatccccaatattagttaaaattctcaattatccttttttatgatttggagattgttgatagggcaatgcctttctgattagtatggcttaaatgggccgttacctttctctgatcggtgcagtcgagtggtttgtaaatcatataaaaatcatgcacgtatttggtttagctggcatcgaaatagattagtgcagagtggtttgttaaatcatagcaaaaccaatgcatatatttggtttagctggcatccaatgcctattgcgtccctttgtgccagtttagtgtcgtaaaaactggttatctaatatgtttcgaatataatcacggtaacttgagccttgaatgccaactcggcttcagacccagttgtatagtagtatggttctgtagtacaactcaatcacgtgttacttcaagcttgtctcaaatattgaaagaggtgttacttcaagcttgtctcgaatattaaaagaggtgttacttcaagcttgcctcaaatattgaaagaggtgtgaattggaaaccacgacaagatgaaattgcatgcaaaacttgagttttgattagtgaa

SEQ ID NO: 2735 - DNA, 728 bp, Prunus persica
ggttcgcaacgctgctaggcttctgtcttcacgctcacacaggcaaagagctgcacaaaaagcttcaagatctaaacccctagccatgtctctggtagcgaacgaagaatttcagcacattctgcgtgtgctcaacacaaatgttgacggcaagaagaagatcatgtttgccctaacctccatcaaaggtatcggtcgtcgtttcgccaacattgtctgcaagaaggccgatgtcgacatgaacaagagagctggagaactctctgctgcggagcttgataacctcatgaccattgtggcgaatcctcgccagttcaaaattccagactggtttttgaacaggaagaaggattacaaggatgggaggtattctcaagttgtttccaatgcattggacatgaagctgagggatgacctcgaacgcctgaagaagatcaggaaccaccgtggtctccgtcactactggggtctccgggtacgtgggcagcacaccaagactaccggacgcaggggaaagactgttggtgtctccaagaagcgatagtctgcttttgcaatttctatttcttaagctccttgctgatgatgttttcattttagcttgagaaattttgcttctttagtatatctgagaatgtctttgaactctgaaaatacctgttttggattatttctgggacgtatttgttattttaactgaggcatagtttctttaattgtaatttcca

SEQ ID NO: 2736 - DNA, 710 bp, Secale cereale
gaggagttccagcacatcctgcgtgtgctcaacaccaacgtcgatggtaagcagaagatcatgttcgcgctgacctccatcaagggtgtgggccgccgcttctccaacatcgtctgcaagaaggccgacatcgacatgaacaagagggctggagagctgtccgcggaggagatggaccgtctgatggcggtggtgcacaacccgcgccagttcaaggtgccggactggttccttaacaggaagaaggactacaaagacgggaggttctcccaggtcgtctccaacgctgtcgacatgaagctcagggatgaccttgagaggctcaagaagatcaggaaccatcgtggtctccgtcactactggggcgtgcgtgtccgtggtcagcacaccaagactaccggcaggagaggaaagactgttggtgtctccaagaagcgataagctttgcaaccatcctgcatagctttgctactactgtgttggtccattttcagaatatggagggttcttgtttagacgattaccttggatgatgttttgccctagataatgttttgctggaacctttaatatattgtatcttgaattccttgttgaactcctaagagtttgtttgccatgggcttcaagtcatttcaatggttggcaagagcttgtctattctatgcatttccgtgcattacagatttgttggctaattgaatccttgt

SEQ ID NO: 2737 - DNA, 579 bp, Salvia sclarea
cggcacgaggcttcatcagagtttggtcggcaccgagagacaccgagaatcctagtcgactagagcaatgtcacttgttgcaaacgaggattttcagcacattctgcgtgtgcagaacactaatgtcgatggcaagcagaagatcatgttcgccatgacctcgatcaagggtatcggccgccgtttcgcgaacattgtctgtaagaaagctgatgtcgacatgaacaagagggctggtgagctttctgctgctgagttagatagcttgatggtgattgtggcaaatccccgccaattcaagatcccagactggtttctgaataggaagaaagattacaaggacgggaagttctctcaagtgacgtccaacgccttggacatgaagctcagggatgatcttgaacgattgaagaagatcaggaaccaccgtggtctccgtcactattggggccttcgtgtgcgtggtcaacacaccaagactactggtcgcaggggaaagactgttggtgtctcaaagaagcgatgagaatcttttttctgtgtctttatcctggatatctaggctttccatcacatata

SEQ ID NO: 2738 - DNA, 729 bp, Salvia sclarea
ctactagaccttggctgtcactcagaaaactcactcatagcggagcagccgtcgaagaaggtagaacaccgcagctgctcgattccaaaccctaaaaatgtctctggtagcaaatgaagatttccagcacattctgcgtgtgcagaacacgaacgtcgacggaaagcagaagatcatgttcgccatgacctcaatcaagggtattggccgccgtttcgccaacatcgtctgcaagaaggccgatattgacatgaacaagagggctggtgaactctccaatgctgaaatcgacagcttgatggtcattgtggcgaatccccgccagtttaagatccccgactggttcttgaacaggaagaaggattacaaggatggcaagttctcccaggtgacctcaaacgctctggacatgaagctcagggacgatcttgagcgattaaagaagatcaggaaccaccgtggtctccgtcactactggggcctccgcgtgcgtggacagcacaccaagaccaccggccgcaggggaaagactgtcggtgtgtccaagaagcgatgagcgttgtgttatctcgttgttatggataccttttcgttttgttttaggctttgcaaacacctaagagatctttctacatgaaccggcacccgttatcgctgttttggattttaaatttgtgttccaatattaattttgatcatggttttcaagacttggttaatctgggttcg

SEQ ID NO: 2739 - DNA, 497 bp, Scabiosa columbaria
atccttaacaatgtcgctggtagcaaatgaggagtttcaacacattcttcgtatacagaacacaaatgtcgacggcaaacagaagattatgtttgccatgacctccatcaagggtattggtcgtcgtttttccaacatcgtctgcaaaaaagctgatattgacatgaacaagagggctggtgaactttcaagtgccgagattgatagtttgatgactatcgttggtaatcctcgccagttcaaaatcccagactggttccttaacaggaagaaggattacaaggatggaaagttctctcaagtcacatcaaatgcactggacatgaaactcagggatgatcttgagcgcttgaagaagattaggaaccatcgtggtctgcgtcactattggggtctgcgtgttcgtggacaacatactaagactactggacgtaggggaaagactgttggtgtctccaagaagagataagccttcccatacaaaatatggatttatt

SEQ ID NO: 2740 - DNA, 612 bp, Scabiosa columbaria
aatagagtttgtgcagagtccgatctaaaaaatccgtaaccatgtcgctcgtagcaaatgaggaatttcaacacattcttcgtatacagaacactaatgtcgatggaaaacagaagatcatgtttgccatgacctctatcaaaggtatcggtcgtcgtttctccaacatcgtctgcaaaaaagctgatatcgacatgaacaaaagggctggtgaactctcaagtgctgagattgatagtttgatgactattgttggaaatcctcgccaattcaaaatcccagactggttccttaacaggaaaaaggattacaaggatggaaagttctcacaagttacatcaaatgcactggacatgaaactcagggatgacctcgagcgcttgaagaagattaggaaccatcgtggtctgcgtcactattggggcctcagagttcgtgggcaacatactaagactactggacgtaggggaaagactgttggtgtctcgaagaaaagataagccatttgcttcaggatcaggactcttactatgcatcttgttctttggttgttgaattttcacccaagtctaggattttgtttttctaaaaatttactaaacttttgtagca

SEQ ID NO: 2741 - DNA, 847 bp, Sciadopitys verticillata
tcttgcatcgttgcctgcgatcttgcgctcgaggacaatatccagcaaaaatgtcgcttatagcagacgaagagtttcagcacattcttcgtgtgcttaacaccaacgtcgatgggcggcagaagattatgtttgctctcacctccattaagggtatcggtcgccgttttgccaacatcgtctgcaagaaggcagatgtcgacatgagcaaaagggctggggagctgtcagcacaagaacttgagaatcttatggtgatagtggcaaaccctaggcagttcaagatcccagactggtttctcaacagaaagaaggatcacaaggatggtcgtttttctcaggtggtttcaaatgcccttgatatgaagctcagggatgatttggaacgcctcaagaagatcaggaatcaccgtggtctgagacactactggggccttcgtgtacgtggacagcacacaaaaaccactggtcgtaggggaaagactgttggtgtttcaaagaagcgttgattgcttttcttattttgtttagaattgttaatgtttagctggttaattctgttgcagctggaggctaagatgtcctgtgttatgggtgtccagttgtgattccgagtacttagtttcatgcttaggttcttttgataatatttatatgtattccggaatattgacatctttgagaactaccataaagagctgacaatctgggtacttgcgaccatagtgtcaggcaaggaattttgttattcttctgttagtttgatatcaagatttgtttttgactgaaatatttgattcaagttcttgttcacttcattactttgattagtgtatacttttggaac

SEQ ID NO: 2742 - DNA, 739 bp, Sequoia sempervirens
gtttccgcgagggttttatgtcgaagttcttcgcaagcgtaggtcctggattagcataacaagctcatcaaccattctgtgcttgagcaatttcttcgaaaatgtcacttatagcgaacgaagagtttcagcacattcttcgtgtgctgaacaccaatgttgatgggcgacagaagattatgtttgctctgacttccatcaagggtattggccgccgtttcgctaacatcgtctgcaagaaggcggatgttgatatgagtaaaagggctggagagctgtcagcgcaggaattggaaaatctaatggtaatagtggcgaatcctagacagtttaagatcccagactggtttcttaacagaaagaaggaccacaaggatgggcgtttctctcaggtggtttccaatgccctcgacatgaagctcagagatgacttggaacgtctcaagaagatcaggaatcaccgtggtctaagacattattggggccttcgagttcgtggacaacacacaaagaccactggacgtaggggaaagactgttggtgtctcaaagaagcgttgattactttcttttcagggagaaggttgttctgcttgggtgttgtctttgatgatatctatagttatttttgaatataaacatttttgagaactaccataatgtgccaacaataccattaatttttttgagcattgactaaggtgaggtatttggatatttttcttaggtcagttaatgtg

SEQ ID NO: 2743 - DNA, 749 bp, Sequoia sempervirens
aaggcgccgaaagctttagcgacgatgtctcttattgcgaatgaagaatttcaacatattcttcgtgttctcaacactaacgttgatggacgacagaagatcatgtttgccctgacctccattaagggaattggtaggcgttttgccaatattgtctgtaaaaaggctgatgttgacatgagcaagagagctggtgagctatctgcccaggaacttgagaatctgatggtgattgtggcaaatccacggcaattcaagatccctgactggtttttgaatagaaagaaggatcataaggatggtcggttctctcaggtggtatccaatgcccttgacatgaaactcagggatgacttggaacgcttgaagaagatcaggaatcatcgtggtctccgtcactattggggtctgcgagtgcgtgggcaacatacaaagaccactggtcgtagggggaagactgttggtgtgtcaaaaaagcgttgagaaaagaaatattattggagaaacacaattttgcttgtgtcttcatattgtttcacattactcctttaaggtgctttatgttgtatttgttgtctttacacaggcctatttttttcttgaaagttcgaaacataacatgtgtttgacaaagctgaaagctttgattttgcactttttaatttgagaatggcttcctgaaagctctatttacattttgtaggactcatcttgagaaggaagaaggttaaatgttgtgttcaatgaag

SEQ ID NO: 2744 - DNA, 676 bp, Silene vulgaris
caatcatgtctcttgttgcgaacgaagagtttcagcacattttgcgtattttgaatacaaatgttgatggaaagcagaagattatgtttgctttgacttcaatcaagggtattggtcgtcgttatgctaacatttgctgcaaaaaagctgatattgatatgaacaagagagctggtgaactctcaactgcagagctggacaatctcatgactgttgttgccaacccaaggcaattcaaaatccccgattggttccttaacaggcagaaggactacaaggatggtcgtttcagccaggttgtttctaatcagctcgacatgaagttgagggatgatcttgagcgcctgaagaagatcaggaaccatcgtggtcttcgtcattactggggtctgagagttcgtggtcagcacaccaaaaccactggccgtaggggaaagactgttggtgtctcaaagaagcgttaaaaggggttggagatatcttgctttctggacgttatccttattatgagattttgtgtcgtctgtttacctagacttgatcgttgtaatgactgattactgctgtcttggccagttcctggctgtttgatggaatacttggtttttgtagatcaggaaaccggctcctgagggcttagtttattatgcattgtttcgaacatgtagtaaaagtt

SEQ ID NO: 2745 - DNA, 736 bp, Silene vulgaris
tttgtgagagagagacaaagagagcgccgcagcagctacacagcaagagcagcaacaatgtctttggttgcaaacgaagattttcagcacattttgcgtattttgaatacaaatgttgatggaaaacagaagatcatgtttgcaatgacatcaatcaagggtattggtcgtcgttatgctaacatttgctgcaaaaaggctgacattgacatgaacaagagggcgggtgagctatctactgcagagcttgaaaatctgatgaatgttgtgcaaaccccaaggcagttcaagatcccagactggttcttgaataggcagaaggattacaaggatggtaggttcagtcaggttgtttctaaccagcttgacatgaagttgagggatgatcttgaacgtctgaagaaaatcaggaaccaccgtggactacgtcactactggggtctcagagttcgtgggcagcacaccaagaccactggacgcaggggaaagactgtaggtgtctcaaagaagcgttaagatggaattgtcttccaatttcgatcacttgtggctttgctttacttgatcttgagcatagtaatgacattgtctttctgttttggtataatcagacaatttatggtatttttgtaggatcgtgcaactatctgtttgtttagttgagtattctctattcggaatatgcatgagtaaacaagtaattacaaagaaagagtgccttgtccaattatgtctc

SEQ ID NO: 2746 - DNA, 795 bp, Solanum phureja
cttctcgtatctagggttttctaagagcttggcatctcttccaaaacaaaagcagcagccgcagtgtaacacagtgaaaccctagccatgtctctggttgcaaacgaagagtttcagcacattcttcgtgtgcaaaacacaaatgttgatggaaagcagaagatcatgttcgctatgacctctatcaaaggtatcggtcgccgttttgctaacattgcttgcaaaaaagccgatatcgacatgaacaagagggctggtgagcttactgctgcagagcttgatagcttgatggtagttgtggctaatcctcgccaattcaaaatcccagattggtttttgaacagacagaaagattacaaggatggcaagttttcccaagttacatctaatgcccttgacatgaaacttagggatgacttggaaaggctgaagaagatcaggaatcaccgtggtttgcgtcactactggggcctccgtgtccgtggtcagcacacaaagaccactggtcgcaggggaaagactgttggtgtctccaagaagagataaattatctacatgcagattcctttataatgcgtaatctggacacttgcaaaaagtttgttagggtatttttgtattgtttgcatttgaactttcttgtcccgccttttggagatctatagttcctataaatcttcccatggcagtgcaagcatgtttttacttttgggatcaaagttttgccgattgcacttggattaatacatcaaatatgagtactttttacggagatgcatccttttttcaatttcc

SEQ ID NO: 2747 - DNA, 859 bp, Glycine max
gtgagtgaggagccacaacactgagagtacagaacgcggtaaccctagaatcccaaatccccaatcaatcgaccaagagcaggagcttcggtggcgatcttcatccgcctcggtgaaaaaaatgtctctggtggcgaacgaggatttccagcacattctgcgtgtgctgaacaccaacgtagatgggaagcagaagataatgttcgctctcacctctatcaaaggtattggcaggcgattcgctaacatttgctgcaaaaaagctgatgtcgacatgaacaagagagctggtgaattgagtgctattgagttggatagcgttatgactgtggttgccaaccctcggcaattcaagatcccggattggtttttgaataggaagaaagactacaaggatgggaagtattctcaggtggtgtcaaatgcactggatatgaagttgagggatgatttggagcgcttgaagaaaatcagaaatcaccgtggtttgaggcactactggggtcttcgtgttcgtggtcagcacactaagactactggtcgcaggggtaaaactgttggtgtctctaagaagcgttaagctgtgttatatgtttgctttgagaaatagatatttgttagggaagcaaattttgaattatgttggacaagtttccatagaacataaattttattggttaagtgctgtgatgctttcaatttttttatttgctttacctggtgctcgttagtatttgatacggaccagaaaaacagtgacattttccaacagatttaaggggaacatggcatgtgtcgaagaatatgacacttattaaatttgctagtcaaaatagtatttttgactgatcaatggtca

SEQ ID NO: 2748 - DNA, 999 bp, Glycine max
attggcttccttcaaggggcagaatcgtcattctcaattgtcttcgtctgcatgaaaaccctagcgaataaagtagagtgagtgaggagccacaacactgagagtacagaacgcggtaaccctagaatcccaaatccccaatcaatcgaccaagagcaggagcttcggtggcgatcttcatccgcctcggtgaaaaaaatgtctctggtggcgaacgaggatttccagcacattctgcgtgtgctgaacaccaacgtagatgggaagcagaagataatgttcgctctcacctctatcaaaggtattggcaggcgattcgctaacatttgctgcaaaaaagctgatgtcgacatgaacaagagagctggtgaattgagtgctattgagttggatagcgttatgactgtggttgccaaccctcggcaattcaagatcccggattggtttttgaataggaagaaagactacaaggatgggaagtattctcaggtggtgtcaaatgcactggatatgaagttgagggatgatttggagcgcttgaagaaaatcagaaatcaccgtggtttgaggcactactggggtcttcgtgttcgtggtcagcacactaagactactggtcgcaggggtaaaactgttggtgtctctaagaagcgttaagctgtgttatatgtttgctttgagaaatagatatttgttagggaagcaaattttgaattatgttggacaagtttccatagaacataaattttattggttaagtgctgtgatgctttcaatttttttatttgctttacctggtgctcgttagtatttgatacggaccagaaaaacagtgacattttccaacagatttaaggggaacatggcatgtgtcgaagaatatgacacttattaaatttgctagtcaaaatagtatttttgactgatcaatggtcaaaataaactcatgccggtaaattggtttaaaacagatccatattgatgtttttttttatttat

SEQ ID NO: 2749 - DNA, 762 bp, Solanum lycopersicum
tagggtttttgggagttctgcatctcttcgccagttaaagaagcagccgcaccgcagagaaggatttgaaaccctaatcatgtcgcttgttgcaaatgaagattttcagcatattcttcgtgttcagaacacaaatgttgatgggaaacagaagatcatgttcgctatgacatcaatcaaaggtattggtcgtcgttttgctaacattgcctgcaagaaagctgatatcgacatgagcaagagggctggtgaactcactgctgctgaactcgatagcttgatggttgttgtggctaatccacgtcaattcaaaatccctgattggtttttaaataggcaaaaggattacaaggatggaaagttttcacaagttacatctaatgcactggacatgaagcttagggatgatctggaacgcctgaagaagatcaggaatcatcgcggtttacgtcactactggggtcttcgtgtgcgtggtcagcataccaagaccactggtcgccgaggaaagactgttggtgtctccaagaagcgataaattccttctcctgagccaattttgcatgttttatgctatttcgttttgatatgggacaagagatggtttgacagtggaacttgttagttttataattttgtttaatgtaatggatttttgagttctatagaacaacattgctttggaagaatgtattatctgcactagtcttttgttactaatgaggttcaattttctaccccattaatggatggtctttttta

SEQ ID NO: 2750 - DNA, 804 bp, Valeriana officinalis
catttctcctctgcagccgcatcgtagctcagcgaaaacagatctcaaaccctaacaaccatgtcgcttgttgcgaacgaggagtttcagcacattcttcgtgttcagaacactaacgtcgatggaaaacagaagatcatgttcgccatgacctcaatcaaaggtattggtcgtcgttttgccaacatcgtctgcaaaaaggcagatatcgatatgaacaaaagggctggtgaactctcgaatgctgagattgatggcttgatgactattgttgctaacccaagacaattcaaaatcccagactggtttcttaacagaaagaaagattacaaagatgggaaattctctcaagtcacctcaaatgctcttgacatgaaactcagggacgatcttgaacgtctaaagaagatcaggaatcaccgtggtctccgtcattactggggtctgagagtgcgtggtcagcacaccaaaactactggtcgcaggggaaagaccgtcggtgtttccaagaagcgataagcattttctttcttatatcgtctggtttatctctgtttgcattaagacaatattagaactattatgatcatgaaattttgaagggttattttgcttgtatcgtcttatgaatatttctcgttttttcttttatgtcattgtgagctaaatctacttttattgtattcgggttattctagtttttagacattttgctcatttgagtttctggtgttttcttgatgtgttttaagtttcttggaacattatttaagccaaaactaagtactcccgccaaaaaaaaaa

SEQ ID NO: 2751 - DNA, 822 bp, Zamia vazquezii
  misc_feature (9)..(9): n is a, c, g, or t
ggaaggctngcttctgttctggttcccttcgtctgtgtcaagggcatgcgattcccaggcacttgccaacatgtctcttattgcgaatgaagacttccagcacattcttcgtgtcctcaacactaatgttgatgggcggcagaagataatgtttgctcttacttccatcaagggcgtggggcgccgttttgccaatcttgtctgtaaaaaggcagatgtggatatgaacaaaagggctggtgagctctctgcagcagagcttgaaaatctgatggtgattgttggaaatccccggcaattcaagatcccggattggttcttgaacagaaagaaagatcacaaggatggccggtactcccaggtggtatccaatgcgttggacatgaaactcagagatgatttggagcgtttgaagaagatcaggaaccaccgaggtcttcgtcattactggggtcttcgggtgcgtggacagcatacaaaaaccactggtcgcagggggaaaactgttggtgtctcaaaaaagcgttgagtatgctattttgtgggagacattcaattttactgcacttgattttgtgggaaacgattgattttacatcttttgtttctgagggtggttttgaagttctggagttttagttttagttttgttaatgaggattcccatgtgtattatttgatcttgtaagagatctatttacatttcaaaagattcaagtagttcaaggtcggttataactttggttttgtactcttaaaatctcttattttgaaaagactggcttttacacttgttcttttcttttaggctcaaaaaaaacg

SEQ ID NO: 2752 - DNA, 700 bp, Centaurea maculosa
ttacgagctacatcgattttaggcattttgcgatcatcagccgcttgctagcaagaagaaactcaatcgcagccatgtcgttggtagcaaatgaagatttccagcatattcttcgtgtgcagaacacgaatgttgatggaaagcaaaagatcatgtttgctatgacttcgatcaaaggtattggtcgtcgtttctcaaacattgtctgcaaaaaggccgatgttgacatgaacaagagggctggagaattatcgaacgctgaaatcgataatctgatgacaattgtcgcaaatccccgacaattcaaaatcccagattggtttcttaacagaaagaaggattataaggatgggaagtactctcaagtcacatctaatgctcttgacatgaagctcagggatgatcttgagcgattgaagaagatcaggaaccaccgtggtcttcgtcattactggggtctccgagtacgtggacaacacaccaagaccaccggtcgtaggggaaagaccgttggtgtgtcaaagaagcgataggcgttttttgttattgtgttttgctgttagcatgttgaaatccttcatttagaatttgggtgaagtttttattatggtatgtttgtacttttttggaatttgatgttagtaggattttaaagagagtttgtttacatttttggatcatgattatgagttcttttggc

SEQ ID NO: 2753 - DNA, 800 bp, Phaseolus vulgaris
ctagagtttcagatcctcattcaaccagcaccgatagcagcggcggcgaccgtcactctccaacgacacttctgcggcgaaaatggctctggtggcgaacgaggagttccagcacattctccgtgtgctgaacactaatgtcgatggcaagcagaagatcatgtttgcccttacctccatcaagggtattggtagaagatttgccaacatggtttgcaagaaggctgatgttgacatgaacaagagggctggtgaattgagtgccgctgagttggataatctgatgactgtggtggccaacccaaggcaattcaaaatcccagactggtttcttaacaggaagaaggattacaaggatggcaagtactcccaggttgtgtccaatgctctcgatatgaagctcagagatgacttggagagactcaagaaaatcagaaaccaccgtggattgaggcactactggggccttcgagtccgtggtcagcacaccaagaccactggccgtagggggaagactgttggtgtctctaagaagcgttaagctgttatgttttggcttcaagattagattttgttgaggaggcaaattttaaagaacactagacatgtttttcataacgaaacgactttgtatcagttatttaatgtggtgacaatttcaattttgtttgttttgcgttaagctttttacgatgctggttttttttatttgtagagaaccttcaatattattgatgaaattatatattcactcccgaagtaaaatccacctttttactttttcacatttaagcaattaa

SEQ ID NO: 2754 - DNA, 744 bp, Phaseolus vulgaris
attcaaccagcaccgatagcagcggcgaccgtcactctccaacgacactttcgcggcgaaaatggctctggtggcaaacgaggagttccagcacattctccgtgtgctgaacactaacgtcgatggcaagcagaagataatgtttgcccttacctccatcaagggtattggtaggagattcgccaacatggtttgcaaaaaggctgatgttgacatgaacaagagggctggtgagttgagtgctgctgagttggataatctgatgactgtggtggccaacccaaggcaattcaaaatcccagactggtttcttaacaggaagaaggattacaaggatggcaagtactcccaggttgtgtccaatgctctcgatatgaagctcagagatgacttggagagactcaagaaaatcagaaaccaccgtggattgaggcactactggggccttcgagtccgtggtcagcacaccaagaccactggccgtagggggaagactgttggtgtctctaagaagcgttaagctgttatgttttggcttcaagattagattttgttgaggaggcaatttttaaagaacactagacatgttttgcataacgaaaggactttgtatcagttatttaatgtggtggcaatttcaattttgtttgttatttgcgttaagctctcttatgatgctggtttttatttgtagataaccttcaatattattgatgaaattacattctcactcccgaagtaaaa

SEQ ID NO: 2755 - DNA, 644 bp, Centaurea maculosa
ccgccaagacctgcaactctcaaactgcaatcatgtcgctggtagcaaacgaagattttcagcatattcttcgtgtacagaacacgaatgttgatggaaagcagaagattatgttcgccatgacctccattaaaggtatcggacgtcgttttgccaacatcgtctgcaaaaaggctgatgtcgacatgaacaagagggctggagagctttcaaatgctgagattgacaacctgatgacaatcgtggcaaacccacgccagttcaaaatcccagactggtttttgaacaggaagaaggattacaaggatggaaagtactcccaggtcacatctaatgcactcgacatgaagttgagagacgaccttgagcgtttgaagaaaatcaggaaccatcgtggtcttcgtcattactggggcctgcgtgtgcgtggtcagcacacaaaaaccaccggccgcaggggaaagactgttggtgtgtccaagaagagatagatttcgaatcaaaatttacttcacattatggttttagacattttatctataaagatctctttatcaattttgaatgtttggttttaagttgttatgtcatggtgatagttgtactttctcttggatgatctttgccagtatgtctctttttgg

SEQ ID NO: 2756 - DNA, 690 bp, Centaurea maculosa
atcgattttaggcattttgcgatcatcagccgctagcaggaagaagaagaaactcaatcgcagccatgtcgttggtagcaaatgaagatttccagcatattcttcgtgttcagaacacgaatgttgatggaaagcagaagatcatgtttgccatgacttcgatcaaaggtattggtcgtcgtttcgcaaacatcgtctgcaaaaaggctgatgttgacatgaacaagagggctggagaattatcgaacgctgaaatcgataatctgatgacaatcgtcgcaaatccccgacagttcaaaatcccggattggtttcttaacagaaagaaggattacaaggatgggaagtactctcaagtcacatctaatgctcttgacatgaagctcagggatgatcttgagcgattgaagaagatcaggaaccaccgtggtcttcgtcattactggggtctccgagtacgtggacaacacaccaagaccaccggtcgtaggggaaagaccgttggtgtgtcgaagaagcgataagtgttttttgtttttgtgttttgcttttagcatctttaaatccttcatttagaatttgggtgaagttattatggtatgtttgtacttttttggagtttgatgttagtaggattttaaagagagtttgtttacatttttggatcatgattatgagttcttttggcca

SEQ ID NO: 2757 - DNA, 712 bp, Centaurea maculosa
ctcgccgattacagatttccgaagctccagccgccaagacctgcaactctccaactgcaatcatgtcgctggtagcaaacgaagattttcagcacattcttcgtgttcagaacacgaatgttgatggaaagcagaagattatgttcgccatgacctccattaaaggtatcggacgtcgttttgccaacatcgtctgcaaaaaggccgatgtcgacatgaacaagagggctggagaactttcaaatgctgagattgacaatctgatgacaatcgtggcaaacccacgccagttcaaaatcccagactggttcttgaacaggaagaaggattacaaggatgggaagtattcccaggtcacatctaatgcactcgacatgaagttgagagatgaccttgagcgcttgaagaaaatcaggaaccatcgtggtcttcgtcattactggggtctgcgtgtgcgtggtcagcacaccaaaaccactggacgtaggggtaagactgttggtgtgtccaagaagagatagatttcgaatcaaagtttacttcacattatggttttagacattttatctataaagatctctttatcaattttggatgtttggttttaagttgttatgtcatggtgatagttgtactttctcttggatgatctttgccagtatgtctctttttggatcttatatgaagaattgacttcatttcggttgattac

SEQ ID NO: 2758 - DNA, 1009 bp, Centaurea maculosa
gtaccgactgcgactctgcggggagggtttacgagctacatcgattttaggcattttgcgatcatcagccgcttgctagcaagaagaaactcaatcgcagccatgtcattggtagcaaatgaagatttccagcatattcttcgtgtgcagaacacgaatgttgatggaaagcaaaagatcatgtttgctatgacttcgatcaaaggtattggtcgtcgttttgcaaacattgtctgcaaaaaggccgatgttgacatgaacaagagggctggagaattatcgaacgctgaaatcgataatctgatgacaatcgtcgcaaatccccgacagttcaaaatcccagattggtttcttaacagaaagaaggattataaggatgggaagtactctcaagtcacatctaatgctcttgacatgaagctcagagatgatcttgagcgattgaagaagatcaggaaccaccgtggtcttcgtcattactggggtctccgagtacgtggacaacacaccaagaccactggacgtaggggaaagaccgttggtgtgtcgaagaagcgataagcgttttttgttttgtggtttgcttttagcatctttaaatctttcatttagaatttgggtgaagttaccatggcatgtttgtacttttttgaagtttgatgttagtaggattttaaagagagtttgtttacatttttggatcatgattatgagttcttttggccaaaaaagatggccgccaactattttaaacaggatgaggataggcagtcgaccaataatgcagaggtcggaaaaccacaaccaaactccttaggttgcaaaagctttgccaattttcatgtttttcagtgattcttcaacaacgccttgaacctgtatggtgaatatttggttccagattcaagtaacctccatagtcttgactgcctcatttgtgttaaggttgtctactttttcacgtgtctttatcgtaggtgaggtctttgtgtcagtggctggccgtctc

SEQ ID NO: 2759 - DNA, 700 bp, Centaurea maculosa
tacatttttctctctagccgattacagatttccggagctccagccgccaagacctgcaactctcaaactgcaatcatgtcgctggtagcaaacgaagattttcagcatattcttcgtgttcagaacacgaatgttgatggaaagcagaagattatgttcgccatgacctccattaaaggtattggacgtcgttttgccaacatcgtctgcaaaaaggccgatgtcgacatgaacaagagggctggagaactttccaatgctgagatcgacaatctgatgacaatcgtggcaaacccacgccagttcaaaatcccagactggtttttgaacaggaagaaagattacaaggatgggaagtactcccaggtcacgtctaacgcactcgacatgaagttgagagatgaccttgagcgcttgaagaaaatcaggaaccatcgtggtcttcgtcattactggggtcttcgtgtgcgtggtcagcacaccaaaaccaccggacgcaggggtaagactgttggtgtgtccaagaagcgatagatttcgaagcaaaaattacattatggttttagacattttatctataaaagatctcttatcaattttgaatgtttggttttaagttgtacttttatcttggatgatctttgccagtatgtctcttttttggatcttatatgaggaattgactttcatttggttgatt

SEQ ID NO: 2760 - DNA, 757 bp, Nicotiana benthamiana
ccgtatctagggttttctttggagcttggcatctctttcaaactaaagcagccgcagcggcactgccgaaagcagtgaaaccctaaccatgtcgctggttgcaaacgaagagtttcagcacattcttcgtgtgcaaaacacgaacgttgatggaaagcagaagatcatgttcgctatgacctctatcaaaggtatcggtcgccgttttgctaacattgcttgcaagaaagccgatatcgacatgaacaagagggccggagaactctctgctgcagagcttgatagcttgatggtggttgtggctaatcctcgccaattcaaaatcccagattggtttttgaacaggcagaaggattacaaggatggcaagttttctcaagttacatctaatgcacttgacatgaaactcagggatgatctggaacggctgaagaagatcagaaatcaccgtggtttgcgtcactactggggccttcgtgtacggggtcagcacacaaagaccactggccgcaggggtaagactgttggtgtctccaagaagagataaatcatatgttttatgctctgctctttagtatgcgtagtccgaacgcttacaagaagtttattagggttttgtaatgtttgcactgaaattttcttgtcttgccatttggagggttatagtttatataaatcctctgatggctttgcaagcaatttgtttactgtgggatcaaagttttaccggttgcctttgaattaatacattgaattg

SEQ ID NO: 2761 - DNA, 864 bp, Olea europaea
ggctatttcctctactgaagcgaagcagcagatctgggttaatcgcagcttctccacatccaaattcgcaactttagccatgtctctgatagcaaatgaggatttccagcatattctgcgtgtgcagaacacgaacgtggatgggaagcagaagatcatgttcgccttgacctccatcaagggtattggtcgccgatttgccaatatcgtttgcaagaaagccgacatcgacatgaacaagagggccggtgagctctcagctgcagaaattgacagcttgatgacgattgttggaaatcctcgtcaattcaagatccccgactggtttctgaataggaagaaggattacaaggatgggaagtattctcaagtgacttcaaatgctttggatatgaagctcagggacgatcttgaacggttgaagaagatcaggaatcaccgtggtctacgtcactactggggtcttcgcgtgcgtggacagcacaccaaaaccactggccgcaggggaaagactgttggtgtctccaagaaacgatgagcctcatctttttataccgttctctttggcgttttgtcaggatatttgctgctgcttaccaaagttcttacagttagtaatttgcttatttggacatctttactattaaatatatctatttttgttcatttttgatgtttttggattccattaaatcttgtggcaaaatcattagactaatgaatgagtttagttgtcgaattaaccttgtaatgttccctttctggaataagtaatgttattcattacaaccattcaagatcccaattacataacattaaacaatagatttatttaattgcaatgttgggtgactcatttagttg

SEQ ID NO: 2762 - DNA, 839 bp, Ambrosia trifida
gggtttatacattttaggcgaacacagcatatcggagcactagccgccgccgccgccaccaccacctgcatctccgtcagcaaccatgtcgctagtggcaaatgaagactttcagcacattctgcgtgtccagaataccaatgtggacggcaaacaaaaaataatgtttgctatgacatccatcaagggtattggtcgtcgtttcgctaacatcgtctgcaaaaaagctgatgtcgacatgaataagagagctggagaactttcaagtgccgagattgataatctgatgaccattgtggccaatcctcgccaattcaagatcccagattggtttttgaacaggaagaaagattacaaggatggaaagtactcgcaagtcacatcgaatgctcttgacatgaagttgagagatgatcttgaacgtttgaagaagatcaggaaccatcgtggtcttcgtcattattggggtcttagggtgcgtggacagcacaccaaaaccaccggtcgtaggggaaagaccgttggtgtgtccaagaagagataagttttttcttcttctagagaacatgtttctttcaaatttagacatcgttatcaattgaacgttttgggttaagtttttatgtcatggttatagctgtactttttttcgaagtggatgtttgatgaaatttggggcttgttttatcatctcttgttctgtttccttattttgactagaaaggccttaaaaacctttagcgtttagatattccgaaaaccaaaatactggatgtgtgttttggtttggttttaagtgacggtgtttcaattcaaaaaagaaaaaagtaccgactgcg

SEQ ID NO: 2763 - DNA, 542 bp, Ambrosia trifida
agggtttatacattttaggccaacacagcatatcggaccactagccgccgccaccaccctgcaactccgtcagcaaccatgtcgctagtggcaaatgaagactttcagcacattctgcgtgtccagaacacaaatgtggacggcaaacaaaaaattatgtttgctatgacttcaatcaagggtattggccgtcgttttgctaacatcgtttgcaaaaaagctgacgtcgacatgaacaagagggctggagaactttcaagtgctgagattgataatctgatgaccatcgtggctaatcctcgccaattcaaaatcccagattggtttttgaacaggaagaaagattacaaggatggaaagtactcgcaagtcacatcgaatgcgcttgacatgaagttgagagatgatcttgaacgtttgaagaagatcaggaaccatcgtggtcttcgtcattactggggtctccgagtgcgtggacagcacaccaaaaccactggtcgtaggggaaagactgtcggtgtgtcaaagaagagataagttta

SEQ ID NO: 2764 - DNA, 638 bp, Ambrosia trifida
acacttcacactgtcatcctttagcatttcagtagccgcttgaacacctaacccaaatcccagctatgagtttggtagcaaatgaagattttcagcatattcttcgtgttcagaacaccaacgtggatggcaagcagaagatcatgtttgctatgacttctattaaaggtattggtcgtcggtttgcgaatattgtttgtaagaaggctgatgttgatatgaacaagagggcgggagaactttctagtgctgagatcgataatctcatgacaattgttgctaatccccgacagtttaaaatcccagactggttccttaatagaaagaaggattacaaggacggcaagtactctcaagtcacatctaacgctctcgacatgaagctcagggacgatctcgagagattgaagaagatcaggaaccaccgtggtcttcgtcattattggggtctgcgagtgcgtggacaacacaccaagactacaggtcgcaggggtaagaccgttggtgtgtcgaagaagcgataagctggcctggttcctatttagaacacacggtttttgttttgtgtttgtacttgtgttatggtgttgatgtaggaatgtttaattatgagaagttgcatatttcggatcatgata

SEQ ID NO: 2765 - DNA, 683 bp, Antirrhinum majus
ccgccagcagagaagagagagagtagtactcgaaaccctgatcatgtcgctcgtagcaaatgaggaattccagcacattctgcgtgtgcagaacactaacgtggacggcaagcagaagatcatgttcgccatgacctccatcaagggtattggccgccgttttgccaacatcgtctgcaagaaggccgatgtcgacatgaacaagagagctggtgaactctctaacgccgagattgataacttgatgactattgtggccaaccctcgccaattcaagatcccagactggtttcttaacaggaagaaggattacaaggatggaaaattttctcaagtgacatccaatgcccttgacatgaaactcagggatgatcttgagcgattgaagaagatcagaaaccatcgtggtctccgtcactactggggtctccgtgtacgtggacagcacaccaagactactggacgtcgaggaaagactgttggtgtctccaagaagcgatgagccttactgtcgattttgcatggtttcatggaacttttgctgttcgtttgggctagacttttgttttaagagttatatctttggatgattatacatgattttctggttggatgttagaatcaatccttttttgttacaactttcagttttattcaagtttaagaactcataattcacatgc

SEQ ID NO: 2766 - DNA, 1186 bp, Aristolochia fimbriata
cctagggtttttagtctcacagcttcactgatctcgtctctcttaaaagggccgccgttcctccaccccctgttcgtcccctgcgtggttggagacgaaacagccggagacgaaatccgctaaccaaccatgtctctggtggcgaacgaggacttccagcacattttgcgtgttctgaacactaatgtcgatgggaagcagaaaattatgttcgccctcacttctattaagggtatcggtcgtcgtttggctaacatcgtctgcaagaaagccgatgtcgatatgaacaagagggctggtgagctttctgcagctgagcttgaaagcctcatggttattgttgcaaatcctcgccagttcagaatccctgattggttcttgaacaggcagaaagattacaaagatggtaggtactctcaggttgtctccaatgcgttggacatgaaactgagggatgatctggaacggctaaagaagatcaggaaccatcgaggtctgcgacattactggggtctgcgcgtgcgtgggcagcacacaaaaacaactggccgacggggcaagactgttggtgtctcaaagaagagataatgacttctcctgtggtcgctgttttgggttttcgattttgataactcgtttgaggattgtgttgagtacttctgttataggttacatattctttagttatgaatctcgtctaaagtaatttagctgtgtaccttctcttgagtgttattttttgtgagaatttatcagtgataagaaaaactttctgtctgttattttctcatttgtttgcttttgtgatgcctgctatttgggatgagggcaacataacttatcattttgtccccaaattgcagttgtttagattttaggattgttggcagtctctcaccaagcgacgtttctttgtttactttatggacaaaggttcagaggccgcagaacataccttgggattttttgacataatgcacgccatttcattcaagatatttctcaaatgagacctgatttgtgacgggatacattaagcaagaatttcttcatgatatttctcaaatgagcactacataattctatttcatttaaagaaaatcaaccggaacctgaataagacattttatgaatcacttctagacctgatttgtgactggatagattaagcaagaatttcttcatg

SEQ ID NO: 2767 - DNA, 591 bp, Arnica chamissonis
agcaccagccgcaaagacctgctactccgactgcaatcatgtcgctagtcgcaaatgaagactttcagcacattcttcgtgtacagaacacgaatgtcgatggaaagcaaaagattatgtttgctatgacctctattaagggtattggtcgtcgttttgccaacatcgtctgcaaaaaggccgacgtcgacatgaacaagagggctggagaactttcaaatgctgaaatagataatctgatgacaattgttgctaatcctcgccaattcaaaatcccagattggtttttgaatcgaaagaaagactacaaggacgggaagtactctcaagtcacatcaaacgctcttgacatgaaactgagagatgacctcgagcggttgaagaaaatcaggaaccaccgtgggcttcgtcattactggggtcttcgggtgcgtggacagcacaccaaaactactggccgtcggggaaagaccgtcggtgtgtccaagaagagataaggtgatgtgtgtttttaaaatcgagttatatccgagtttaggacattctcatgaatctttattgtcatcagttttgaatggttgggtcaaaagt

SEQ ID NO: 2768 - DNA, 842 bp, Arnica chamissonis
aaacgtgtattacttaggcccagcccacgtattgcgttttgacgctttcagagttccctcattttaactcgattttagggttcttttgttacttctctggagaacgaaagaggcagtccgccgtcgccgtctatcggagtagtccatctgaggtgtctgcatcagagaagaagctcaattgcattttagccatgtctcttgttgcaaatgaggacttccagcacattcttcgtgtacaaaacacaaatgttgatggcaaacaaaagatcatgtttgctatgacttccatcaagggtattggtcgtcgatttgcaaatattgtttgcaagaaggctgatgtggacatgaacaagagggctggtgaactgtcgaatgctgagattgataacctaatgacaatcgttgctaatcctcgccagtttaaaatcccagactggtttcttaacagaaagaaagattacaaggatggaaagtactcccaggtgacctctaatgcccttgacatgaagctcagagatgacttggagcgattgaagaaaatcaggaaccatcgtgggcttcgtcactactggggtctccgggttcgtggacagcacacgaagactactggtcgcaggggaaagactgttggtgtgtccaagaagcgataagtttgttgtttttcacttcttttggtttagaagatatcgttctgaaactttattctcatcaatttgaaaaggtaatatgggtttaagtttttagagattatttatggagaagaaattactgtcgactttaaatcatttattgtgcttgttgttggggaaccatattcccccattttattatgatttccattc

SEQ ID NO: 2769 - DNA, 555 bp, Arnica chamissonis
atttcttcgcattagccactcgaagaagaaactcaaatcgcagcaatgagcctggtagcaaatgaagatttccagcatattcttcgtgtacagaacacgaatgttgacggaaagcagaagatcatgtttgctatgacctccattaaaggtatcggtcgtcgtttcgccaacattgtctgcaaaaaggccgatgttgatatgaacaagagggctggggaactttccagtgctgaaattgataatctcatgacaattgttgccaatccccgacaatttaaaatcccggactggtttctcaacagaaagaaggattacaaggatggcaagtactctcaagtcacatctaacgcccttgacatgaagctcagggatgatctcgagagattgaagaagatcaggaaccaccgtggtcttcgtcattattggggtctgcgagtacgtggacagcacaccaagactactggtcgtaggggtaagaccgttggtgtgtcgaagaagcgataagcaccttgtcttggtttttattttcatcacatttagaatgcgggggaattc

SEQ ID NO: 2770 - DNA, 850 bp, Artemisia annua
tactccgacggggacaacacacaaacacaagcgcagccgccatcaccagcaacaacaacaaccaactcagacagcaatcatgtcgttggtggcaaatgaagacttccagcacattcttcgtgttcagaacacaaacgttgacgggaaacaaaagatcatgtttgccatgacttccatcaagggtattggtcgtaggtttgctaacattgtttgcaagaaagctgacgtcgacatgaacaagagggctggagaactctccaatgctgagattgataatctgatgactattgtggctaatccacgccaattcaaaatcccagactggtttttgaacagaaagaaggactacaaggatggaaagtactcccaggttacatcaaatgctcttgacatgaagttgagagatgatcttgagcgtttgaagaaaatcaggaaccatcgtggtcttcgtcattactggggtctcagagttcgtggacagcacaccaagaccactggtcgtaggggaaagactgttggtgtgtccaagaagagataagctcatatgtgtctttaaagtcaagttacattcgggttttagacagtttcgtgaatctttattgtcatcaattttggatgttttggtttaacgtttaatgtcatggtcatagtaaaactttcgttatgggtagtatgtgttttggatctcatgtgggaaattgttgtttgcagtggataatttatgaattttggcgtatgatctttacattggttttctggttttacatccggcttgtgaatttaactctagacatctgttgcagaaaattatgtatggttgttcaatcagtataatttggatgttttattc

SEQ ID NO: 2771 - DNA, 746 bp, Artemisia annua
gccattacggccggggagggttaacaagctacacaccatcttcaaaccatatcagccgcttgaagaagaacaagaaaacaaacccaaatcacagctatgtcgttggttgcaaatgaggatttccagcatattcttcgtgttcaaaacacgaacgttgatgggaagcagaagatcatgtttgcaatgacttcgatcaaaggtattggtcgtcgttttgctaacattgtttgcaagaaggctgatgttgacatgaacaagagggctggagaactttccaacgctgagatcgataacctcatgacaattgttgctaatccccgacagttcaaaatcccagactggtttcttaacagaaagaaggattacaaggatggcaagtactcccaggtcacatctaatgctcttgacatgaagctcagggacgatctcgagcgattgaagaagatcaggaaccatcgtggtcttcgtcattactggggtctcagagtacgtggacaacacaccaagacaactggccgtaggggtaagactgttggtgtgtcgaagaagcgataagcattttcgtgctcttgttttggttctagaaatcatctaaaaatcccatttttcgctagatttagaatctgggaaaaattgttatggttgtacttttttggatgttgatggtggcatgtttctaggattttattattaaagttggtttacattgtgagttgatgcatatttccggattatgatatactttt

SEQ ID NO: 2772 - DNA, 836 bp, Artemisia annua
gaaacaaccacaccgccgtccaccggaagtactccatttcaggtaaggagcttattcgcatttgaaccatgtcgcttgttgcaaatgaagacttccagcacattcttcgtgttcagaacacgaatgttgatggaaagcaaaagatcatgtttgctatgacatccatcaagggtattggacgtcgttttgcaaacattgtttgcaagaaggctgatgttgacatgaacaagagagctggtgaactctccaatgctgagatcgacaatctgatgactattgttgctaatcctcgccagttcaaaatcccagactggtttcttaacagaaagaaagattacaaggatggcaagtactcccaggttacctctaacgcacttgacatgaagttgagggatgacttggaacgtctcaagaagatcaggaatcaccgtgggcttcgtcactactggggtctccgagttcgtggacagcacacaaagaccactggtcgcaggggaaagactgttggtgtgtccaagaagcgataagctcgtctcttttacttgttttttactatgcagttttgaacttgtattctcagcagtctgaaaagtatggggtagtttaatagtagttcgtatctttgtttaaactttagcaagttttaagtgtttttctatcaagagatttctgctcaaattgttggttgaaagcttatgttctctagcttgtcaaatccttgaacgtaccagcctggcccatttaaaagctgaatgagattattgtttctgatattaacttatgccagtaggcttgtgtgccaaaaaaaaagaaaaaaaacatgtcggatctagaat

SEQ ID NO: 2773 - DNA, 830 bp, Phaseolus vulgaris
caaaaccctagaactggctcagcacatttgtataacattactcattcccaaaccctagagtttcagatcctcattcaaccagcaccgatagcagcggcgaccgtcactctccaacgacactttcgcggcgaaaatggctctggtggcaaacgaggagttccagcacattctccgtgtgctgaacactaacgtcgatggcaagcagaagataatgtttgcccttacctccatcaagggtattggtaggagattcgccaacatggtttgcaaaaaggctgatgttgacatgaacaagagggctggtgagttgagtgctgctgagttggataatctgatgactgtggtggccaacccaaggcaattcaaaatcccagactggtttcttaacaggaagaaggattacaaggatggcaagtactcccaggttgtgtccaatgctctcgatatgaagctcagagatgacttggagagactcaagaaaatcagaaaccaccgtggattgaggcactactggggccttcgagtccgtggtcagcacaccaagaccactggccgtagggggaagactgttggtgtctctaagaagcgttaagctgttatgttttggcttcaagattagattttgttgaggaggcaatttttaaagaacactagacatgttttgcataacgaaaggactttgtatcagttatttaatgtggtggcaatttcaattttgtttgttatttgcgttaagctctcttatgatgctggtttttatttgtagataaccttcaatattattgatgaaattacattctcactcccgaagtaaaatccacctttttacc

SEQ ID NO: 2774 - DNA, 905 bp, Fagus grandifolia
ctggaccttggctgtcactcacgctgctccgctctctcattttccaaaactctccgctatcactcagattcagagagagcgcagagaaaaaaaaaaacctaaccatgtctctggtagcgaacgaagaattccagcacattttgcgtgtgctgaacaccaacgtggatggaaagcagaagataatgttcgcccttacctccatcaaaggtatcggtcgccgtttcgccaatctcgtttgcaagaaagccgatgttgacatgaacaaacgagctggtgagttgacagctgctgagcttgataacctgatggtgattgtggcgaaccctcgccagttcaagatccccgattggtttctgaacaggaagaaggattacaaggatggtaaatattctcaggttgtctccaatgcgttggacatgaagctcagggatgatcttgagcgtttgaagaagatcaggaaccaccgtggtctgcgacactactggggtctccgagtacgtggacagcacacaaagacaactggtcgccgtggaaagactgttggtgtctcaaagaagcgttgaacttgtttctcccctttctgggatggtgtgttcctgttgcgaattttgttttgccttttagaatatcatgggtttagtattgtacttttctttttggtggattcttgcagtatcatctagctgtctttctttgttctctagactgcttgatcttgtttgaggagattttggtatgtgatggtattaatgattcataatttcatataatagttaaagttgacaacccattttattttttaaattttatactttgttctatttcgtcttgattattggtgtggtggctagtggggcgatgctggtactttatgggttgtagtttgaggtgagaagtggcagcag

SEQ ID NO: 2775 - DNA, 670 bp, Fagus grandifolia
cgcatagaaaaccctaaccatgtctctggtagcgaacgaggaattccagcacattttgcgtgtgctgaacacgaatgtggatggaaagcagaagattatgttcgccctcacctccatcaaaggtatcggtcgccgtttcgccaatctcgtttgcaagaaagccgatgttgacatgaacaaacgtgctggtgagttgacagctgctgagcttgataacctgatggtgattgtggcaaaccctcgccagttcaagatccccgactggtttctgaacaggaagaaggattacaaggatggtaaatattctcaggttgtctccaatgctttggacatgaagctcagggatgatcttgagcgtttgaagaagatcaggaatcaccgtggtctgcgacactactggggtctccgagtgcgtggacagcacacaaagacaactggtcgccgtggaaagactgttggtgtctcaaagaagcgttgagcttatttcatccctttctgggatggcgtgttcctgttgcgaattttattttgctttttaggatatcgtggatttagtattgtacttttcttttggttggtattcatgcagtatcatctaagttgttctttctgttgttctttagtactgcttgtatcttgtttgtaggtaaattttggtatgtgatggcat

SEQ ID NO: 2776 - DNA, 714 bp, Centaurea maculosa
  misc_feature (711)..(711): n is a, c, g, or t
ggcggggaggtttcgagctacatcgattttaggcattttgcgatcatcagccgcttgcacaagaagaaactcaatcgcagccatgtcgttggtagcaaatgaagatttccagcatattcttcgtgtgcagaacacgaatgttgatggaaagcaaaagatcatgtttgctatgacttcgatcaaaggtattggtcgtcgttttgcaaacattgtctgcaaaaaggccgatgttgacatgaacaagagggctggagagttatcgaacgctgaaatcgataatctgatgacaattgtcgcaaatccccgacaattcaaaatcccggattggtttcttaacagaaagaaggattataaggatgggaagtactctcaagtcacatctaatgcccttgacatgaagctcagggatgatcttgagcgattgaagaagatcaggaaccaccgtggtcttcgtcattactggggtctccgagtacgtggacaacacaccaagaccaccggtcgtaggggaaagaccgttggtgtgtcaaagaagcgataggcgttttttgttattgtgttttgctgttagcatgttgaaatccttcatttagaatttgggtgaagtttttattatggtatgtttgtacttttttggaatttgatgttagtaggattttaaagagagtttgtttacatttttggatcatgattatgagttcttttggccanttt

SEQ ID NO: 2777 - DNA, 731 bp, Centaurea maculosa
ttttctctctcgccgattacagatttccggagctccagccgccaagacctgcaactctcaaactgcaatcatgtcgctggtagcaaacgaagattttcagcacattcttcgtgttcagaacacgaatgttgatggaaagcagaagattatgttcgccatgacctccattaaaggtatcggacgtcgttttgccaacatcgtctgcaaaaaggccgatgtcgacatgaacaagagggctggagaactttcaaatgctgagattgacaacctgatgacaatcgtggcaaacccacgccagttcaaaatcccagactggtttttgaacaggaagaaggattacaaggatggaaagtactcccaggtcacatctaatgcactcgacatgaagttgagagatgaccttgagcgtttgaagaaaatcaggaaccaccgtggtcttcgtcattactggggtctacgtgtgcgtggtcagcacaccaaaaccactggacgcaggggtaagactgtcggtgtgtccaagaagagatagatttcgaatcaaaatttacttcacattatggttttagacattttatctataaagatctctttatcaattttgaatgtttggttttaagttgttatgtcatggtgatagttgtactttctcttggatgatctttgccagtatgtctctttttggatattatgaggaattgactttatttggttgattcattagttttgcatta

SEQ ID NO: 2778 - DNA, 749 bp, Centaurea maculosa
cgggggagctgggtttacattttctctctgccgattacagatttccggagctccagccgccaagacctgcaactctcaaactgcaatcatgtcgctggtagcaaacgaagattttcagcacattcttcgtgttcagaacacgaatgttgatggaaagcagaagattatgttcgccatgacctccattaaaggtatcggacgtcgttttgccaacatcgtctgcaaaaaggccgatgtcgacatgaacaagagggctggagagctttcaaatgctgagattgacaacctgatgacaatcgtggcaaacccacgccagttcaaaatcccagactggtttttgaacaggaagaaggattacaaggacggcaagtactcccaggtcacatctaacgcactcgacatgaagttgagagatgaccttgagcgtttgaagaaaatcaggaaccaccgtggtcttcgtcattactggggtctacgtgtgcgtggtcagcacaccaaaaccactggacgcaggggtaagactgtcggtgtgtccaagaagagatagatttcgaatcaaaatttacttcacattatggttttagacattttatctataaagatctctttatcaattttgaatgtttggttttaagttgttatgtcatggtgatagttgtactttctcttggatgatctttgccagtatgtctctttttggatattatgaggaattgactttatttggttgattcattagttttgcatta

SEQ ID NO: 2779 - DNA, 710 bp, Centaurea maculosa
tctcgccgattacagatttccgaagctccagccgccaagacctgcaactctccaactgcaatcatgtcgctggtagcaaacgaagattttcagcacattcttcgtgttcagaacacgaatgttgatggaaagcagaagattatgttcgccatgacctccattaaaggtattggtcgtcgttttgccaacatcgtctgcaaaaaggccgatgtcgacatgaacaagagggctggagaactttcaaatgctgagattgacaatctgatgacaatcgtggcaaacccacgtcagttcaaaatcccagactggtttttgaacaggaagaaggattacaaggatggaaagtactcccaggtcacatctaatgcacttgacatgaagttgagagatgaccttgagcgcttgaagaaaatcaggaaccatcgtggtcttcgtcattactggggtctgcgtgtgcgtggtcagcacaccaaaaccaccggccgcaggggaaagactgttggtgtgtccaagaagagatagatttcgaatcaaaatttacttcacattatggttttagacattttatctataaagatctctttatcaattttggatgtttggttttaagttgttatgtcatggtaatagttgtactttctcttggatgatcttttgccagtatgtctttttttggatattatatgaggaattgacttcatttggttgat

SEQ ID NO: 2780 - DNA, 737 bp, Centaurea maculosa
gcgggggagctgggtttcattttctctcgccgattacagatttccgaagctccagccgccaagacctgcaactctccaactgcaatcatgtcgctggtagcaaacgaagattttcagcacattcttcgtgttcagaacacgaatgttgatggaaagcagaagattatgttcgccatgacctccattaaaggtattggtcgtcgttttgccaacatcgtctgcaaaaaggccgatgtcgacatgaacaagagggctggagaactttcaaatgctgagattgacaacctgatgacaatcgtggcaaacccacgtcagttcaaaatcccagactggtttttgaacaggaagaaggattacaaggatggaaagtactcccaggtcacatctaatgcacttgacatgaagttgagagatgaccttgagcgcttgaagaaaatcaggaaccatcgtggtcttcgtcattactggggtctgcgtgtgcgtggtcagcacaccaaaaccactggacgcaggggtaagaccgttggtgtgtccaagaagagatagatttcgaatcaaaatttacttcacattatggttttagacattttatctataaagatctctttatcaattttggatgtttggttttaagttgttatgtcatggtaatagttgtactttctcttggatgatcttttgccagtatgtctttttttggatattatatgaggaattgacttcatttggttgattca

SEQ ID NO: 2781 - DNA, 1226 bp, Ceratodon purpureus
tagcagctcacgactcccccgcacctccatcgccacgcccatctctgcctgctgcggtgttccaccatgtcgcttatcgcgggtgaggagtttcagcacattcttcgtgtgttgaacacgaacgtcgatgggcgccagaagatcatgttcgcgctgacctccatcaagggagtggggcgtcggtttgctaacttggtgtgcaagaaggccgatcttgacatgagcaagagagccggtgagctgagcgcggccgagcttgagaacttgatggttattgtggccaaccctcgtcagttcaagatcccagattggtttctgaacaggaagaaagaccacaaggatggtcgctactcgcaggtggtgtctaacgctttggacatgaagctgagggatgacctcgagcgcctgaagaagatcaggaaccaccgtggtcttcgtcactactggggcttgcgcgtgcgtggacagcacaccaagacgactggacgtcgtggaaggaccgtcggtgtgtccaagaagcgatagagaatttatagtcgatcagaagggatttgtttcttacgttttttggaagttaaattcttcggagcatagagcccagttctcgtaatttgtgctcgttgtgcaactaagttgcagagatttgcatcatgtatatggaagggaccttgtttttcaagtggtttcacagtcgaagtttctgaaagtctcatttgtgaaaacggattttttttttggtcaacttcctgaagcatgtcattacggggtttaaggtagactgttagtgaaggattccgaattgatgagacgccggacttgggtcgctgagtgtggtgaaagaattcctagccttgaaccacatgtcagatttgtttcaagtgtctccttaggaattgacttactacgtgtgcattgtctagaaaggattacgaattgtttactggatgctggcataggtaagctccacaggggtcgttctacaggtttagatgctgccagaataggttgtttagaagaggtgtcctgggaataaatggtcgagctggatgaatccggtgggttctccaaatttgagttttctcaggtatcactactcggcctgcacatgagaactccggagtgacggttccatgtgaatattggccaggtgatcagaggagttcaaaattatgtgttagtgccacgatcttgaacgactttcagagtatatattgaaaaaaaataac

SEQ ID NO: 2782 - DNA, 844 bp, Ceratodon purpureus
gcgagggttggccacgagcttttttcgcgctcggccgagtcgcccctgcgctgcgccatcgccagccctccgctgtgcttcgcttcgtcgttgcgctgcattcaccatgtcgctcattgcgggtgaggagtttcagcatattcttcgtgtgctgaacacgaacgtcgatggacgccagaagatcatgttcgccttgacctccatcaagggagtggggcgtcggttcgccaacttggtctgcaagaaggccgatgttgacatgagcaagagggctggcgagttgtccgcagccgagcttgagaacttgatggtcatcgtggccaaccctcgccagttcaagatcccagactggttcctgaacagaaagaaagaccacaaggatggtcgctactcccaggttgtgtctaacgccttggacatgaagctgagggacgatctcgagcgtcttaagaagatcaggaaccaccgtggtcttcgtcactactggggcttgcgagtgcgtggacaacacacgaagaccaccgggcgacgtggaagaaccgtcggtgtgtccaagaagcgatagagagtttatcatctgttgtctggagggtatgattgatgaccctctagaaagtacgatcttaatgaagcccgttgcacaaattttcgcagcacacccatcttgttgatgactgttctcacgagatatcagtatgaatgtgagttttgacaaccaacagtattgatgcgtttttagaagctccttgtgttccaattgtgttcatgatgatgtgacaaattgttgctgtttgcaagcgcctgaactgaaatttggaacatgcctatctggaggcccgtcaaa

SEQ ID NO: 2783 - DNA, 749 bp, Ceratodon purpureus
ggacgaagaagctctttctctgccttgcgccatcgccacctcatcgctgcgcttcgctccgtcgtcacccaccatgtcgctcattgcgggcgaggagtttcaacatattcttcgtgtgctgaacacgaatgtcgatgggcgccagaagatcatgttcgccctgacctccatcaagggagtggggcgtcggtttgccaacttggtgtgcaagaaggctgacgtcgacatgagcaagagggccggcgagctgtccgcggccgaacttgagaacttgatggtgatcgttgccaaccctcgccagttcaagatcccagactggttccttaacaggaagaaagatcacaaggatggtcgctactcccaggttgtttccaacgccttggacatgaagctgagggatgatcttgagcgtttgaagaagatcaggaaccaccgtggtcttcgtcactactggggcctccgtgtgcgtggacagcacaccaagacaaccggacgacgtggaagaaccgtcggtgtgtccaagaagagatagagtgcatgtcatgtgttgggttcgagggtttcaatttatatcatgtttgatatcccaaacttaatacaagtcttttcccaaagttacttggcggttttcactgtctttcttgtcagttgtgtaatttaatgtgtatacttcaaggaagaacagttctgtttattaccaattcctcatgagtggaggcattggatctggtcatcaatctatacaggag

SEQ ID NO: 2784 - DNA, 743 bp, Cicer arietinum
gaatagtctcaacagagcgtaaacacgggttagatcttcggcgacaatcttcatcttcctactctcaccaatcaatcaataacttcatctccaaaaatcaacatgtcgttggtagcaaacgaagagttccaacacattcttcgtgtattgaataccaatgttgatggaaaacagaagattatgttcgctcttacctcaatcaaaggtattggcagacgattcgctaacattgcttgcaaaaaagctgatgtcgacatgaacaagagagctggtgaattgactgctgctgagttggataatattatgactgtggttgccaatcctcgacaattcaagatccctgattggtttttgaataggaagaaggattacaaggatggcaagtattctcaggttgtgtcaaattcactcgacatgaaattgagggatgatttggagcgcttaaagaaaatcagaaatcaccgcggtttaaggcactactggggtcttcgagttcgtggacagcatactaagactaccggtcgcaggggaaaaactgttggtgtctcgaagaagcgatgaagtttttctgtttttacttgcagaagagaatttatcagggaaagagtttttgaattgcatttagacttgttttccataatttatatatttgtcaatttctttacaaaattttattttttgcttgaccttataagttgcagagatatttaatagtattgttgaaattataaatgtgctttaac

SEQ ID NO: 2785 - DNA, 927 bp, Cicer arietinum
gttaggggcaaagtagccatttcgaattgaaatgttgatcaaatgaaaaaaccctagtatagtattagtgtataataagcacattgaatagtctcaacagagcgtaaacacgggttagatcttcggcgacaatcttcatcttcctactctcaccaatcaatcaataacttcatctccaaaaatcaacatgtcgttggtagcaaacgaagagttccaacacattcttcgtgtattgaataccaatgttgatggaaaacagaagattatgttcgctcttacctcaatcaaaggtattggcagacgattcgctaacattgcttgcaaaaaagctgatgtcgacatgaacaagagagctggtgaattgactgctgctgagttggataatattatgactgtggttgccaatcctcgacaattcaagatccctgattggtttttgaataggaagaaggattacaaggatggcaagtattctcaggttgtgtcaaattcactcgacatgaaattgagggatgatttggagcgcttaaagaaaatcagaaatcaccgcggtttaaggcactactggggtcttcgagttcgtggacagcatactaagactaccggtcgcaggggaaaaactgttggtgtctcgaagaagcgatgaagtttttctgtttttacttgcagaagagaatttatcagggaaagagtttttgaattgcatttagacttgttttccataatttatatatttgtcaatttctttacaaaattttatttttttgcttgaccttataagttgcagagatatttaatagtattgttgaaattataaatgtgctttcaatttaaggagtgtttgaaggagataattgaagtttcttgtgaactgtgtttagcttatttcataaatcttatcagaatagtttttggataagtgattaa

SEQ ID NO: 2786 - DNA, 758 bp, Cichorium intybus
cagcgattcccataaattagcagcatcaacggcttgaagaaggaactaaaatcgcagccatgtctctggtagcaaatgaagatttccagcatattcttcgtgtgcagaacacgaatgttgatggaaagcaaaagatcatgtttgctatgacctccatcaaaggtattggtcgccgtttcgccaacattgtctgcaaaaaggccgatgtcgacatgaacaagagggctggagaactctctaatgctgagattgataatctcatgacaattgttgcaaatccccgacaattcaagatcccagattggtttcttaacagaaagaaggattacaaagatggaaagtactctcaagtcacatctaatgcacttgacatgaagctcagagacgaccttgagcgattgaagaagatcaggaaccaccgtggtcttcgtcattattggggtctcagagttcgtggacagcacaccaagaccactggtcgtaggggaaagactgttggtgtgtccaagaagcgataagtttttttgttttcttttttgttttctggtaactccttaaaattgttatttgcatcaggtttagaatattatgcagaagttgttttgttattggctgtacttttttttggatctgtcaagttttatgttgagagttttgttacatgtaagggtgggtgatagaccattttgttcaaaatattttatgggtactacttgagtactttttatgggaagaggtcatcaacagtttgttttaga

SEQ ID NO: 2787 - DNA, 842 bp, Cichorium intybus
ttggcggggggtactagggttttcatttttcggctagtagaacttccggagcaccagccgcctagacctgcaattccgactgcaatcatgtcgctggtagcaaacgaagattttcagcacattcttcgtgtgcagaacacgaatgttgatggaaagcagaagattatgtttgctatgacctcaattaaaggtattggtcgtcgttttgccaacatcgtctgcaagaaggccgacgtcgacatgaacaagagggctggagaactttcgaatgcagagatagataatctgatgacaattgtggctaatccacgccaattcaaaattccagactggtttttgaatagaaagaaggattacaaggatggcaagtactctcaggtcacatccaatgctcttgacatgaagttgagagatgaccttgagcgtttgaagaagatcaggaaccaccgtggtcttcgtcattactggggtctacgagtgcgtggacagcacaccaagaccactggtcgcaggggtaagactgttggtgtgtccaagaagagataggttaaagttatgctgattgacgttctcatgagtctctgttgtcatcagttttggatgtttgggttataagctgttatgtcatggttataattttactttcttggatgttcatgttagtatttcttttggttctcatatgagaaagtgtctgcgatagattatgattaattttggcttgtgattttcttgttggctctatattttagcttttgcatagggacattttgtcataaaatcttgttgatatgaacaaacaacgtcaaaatgaaaacccccaaagttcatattacaaaaca

SEQ ID NO: 2788 - DNA, 536 bp, Cirsium arvense
gagtcatttgggagcatcagccgctaggagaaggaactcaaatcgcagccatgtcgttggtagcaaatgaagatttccagcatattcttcgtgtacaaaacacgaatgttgatggaaagcagaagatcatgtttgctatgacttcgatcaagggtattggtcgtcgtttcgctaacattgtctgcaaaaaagctgatgttgatatgaacaagagggctggagaattatcgaatgcagagattgataatctgatgacaattgttgcaaatccgcgacaattcaaaatcccagattggtttcttaacagaaagaaggattacaaggatgggaaatactctcaagtcacatctaatgctcttgacatgaagcttcgggatgatcttgaacgattgaagaaaatcaggaaccaccgtggtcttcgtcattactggggtcttcgagtacgtggacaacacaccaagaccaccggtcgcagaggaaagactgttggtgtgtcgaagaagcgataagtgtttttgtttttatgttatggtttt

SEQ ID NO: 2789 - DNA, 716 bp, Cirsium arvense
ggggtttacattttctctcgccgatttcagatttccgaagctccagccgccaagacctgcaactctaaactgcaatcatgtcgctggtagcaaacgaagattttcagcacattcttcgtgttcagaacacgaatgttgatggaaagcagaagattatgttcgccatgacctccattaaaggtattggacgtcgttttgccaacatcgtctgcaaaaaggctgatgtcgacatgaacaagagggctggagaactttcaaatgctgagattgacaatctgatgacaatcgtggcaaacccacgtcagttcaaaatcccagactggtttttgaacaggaagaaggattacaaggatggaaagtactcccaggtcacatctaatgcacttgacatgaagttgagagatgaccttgagcgcttgaagaaaatcaggaaccatcgtggtcttcgtcattactggggtctgcgtgtgcgtggtcagcacaccaaaaccaccggccgcaggggaaagactgttggtgtgtccaagaagagatagatttcgaatcaaaatttacttcacattatggttttagacattttatctataaagatctctttatcaattttggatgtttggttttaagttgttatgtcatggtgatagttgtactttctcttggatgatctttttgccagtatgtctttttttggtatattatatgaggaattagtactt

SEQ ID NO: 2790 - DNA, 694 bp, Cirsium arvense
gggagggtttacgagctacatcgattttaggcattttgcgatcatcagccgctagctagcaggaagaagaagaaactcaatcgcagccatgtcgttggtagcaaatgaagatttccagcatattcttcgtgttcagaacacgaatgttgatggaaagcagaagatcatgtttgctatgacttcgatcaaaggtattggtcgtcgtttcgctaacattgtctgcaaaaaggctgatgttgacatgaacaagagggctggagaattatcgaacgctgaaatcgataatctgatgacaatcgtcgcaaatccccgacagttcaaaatcccggattggtttcttaacagaaagaaggattacaaggatgggaagtactctcaagtcacatctaatgctcttgacatgaagctcagggatgatcttgagcgattgaagaagatcaggaaccaccgtggtcttcgtcattactggggtctccgagtacgtggacaacacaccaagaccaccggacgtaggggaaagaccgttggtgtgtcgaagaagcgataagtgttttttgtttgtgttttgctgttagcatctttaaatccttcatttagaatttgggtgaagttattatggtatgtttgtacttttttggagtttgatgttagtaggatattaaagagagtttgtttacatttttggatcatgatt

SEQ ID NO: 2791 - DNA, 722 bp, Cirsium arvense
gaacgagaagtggcggagcatcgttcgtcggactaatcctttcagttcaggtgtcagtctaagagaaggaactcaaacgaaagtgaaccatgtcgcttgtggcaaatgaagactttcagcacattcttcgtgtacagaacacaaatgttgatggaaagcaaaagatcatgtttgccatgacctccattaaaggtattggtcgtcgttttgcaaacatcgtttgcaagaaagccgatgttgacatgaacaagagggctggtgagctatctaatgccgagatcgataacttaatgaccattgtcgccaatcctcgccagttcaaaatcccagactggtttctgaacagaaagaaggattacaaggatggaaagtactcccaagtaacctccaacgccctcgatatgaagctcagagacgatttggagcgcctcaagaagatcaggaaccaccgtggacttcgtcactactggggtctccgagttcgtggacaacacaccaagaccaccggtcgcagaggaaagaccgtcggtgtgtccaagaaacgataaaccaagaggtatgggttattttttctcgatgtttttgggattttatatttaggaattgcggttcggaagtagaattcatgagtttttatcaacttgaaaagattgttgttctatttttgttttctacaagaagaaatatatttggatcaaaaaagaaaaagtaaccgaactgcg

SEQ ID NO: 2792 - DNA, 719 bp, Cirsium arvense
acgcgggagggtttacattttctcgccgattacagctttcaggagcaccagccgccaagacctgcaactctaactgcaatcatgtcgctggtagcaaatgaagattttcagcacattcttcgtgtacagaacacgaatgttgatggaaagcaaaaaattatgttcgctatgacctccatcaagggtattggtcgtcgttttgccaacatcgtctgcaaaaaggctgatgtcgacatgaacaagagagctggagaactttccaatgctgagatcgacaatctgatgaccatcgttgcaaacccacgtcagttcaaaatcccagactggtttttgaacagaaagaaagattacaaggatggaaagtactcccaggtcacatcaaatgcactcgacatgaagttgagagatgaccttgagcgcttgaagaaaatcaggaaccatcgtggtcttcgtcattactggggtctgcgtgttcgtggtcaacacactaaaaccactggacgcagaggtaagactgttggtgtgtccaagaagagatagatttcgttacattctggtttttagaacatttatctataaaatctctcttttatttttatcaattttgttgaatgtttggtttttaagttgttatgtcatgggtaatagttgtatggatgatcttgcaagtatgtgttttttgggatcttatatgaggaattgactatcgttttcgatga

SEQ ID NO: 2793 - DNA, 883 bp, Citrus clementina
gtgaagcaattgcatcatatataaagaacttaaaaaaccctaagctgacttctcagttggcttggctacttgctgcagcttcatctgtcgccgaagagcctctcttctcttcatcatcaatcctcacaatcgaaaatgtctctggtggcgaacgaagattttcagcacattttgcgtgtgctgaacactaacgtcgacgggaagcagaagattatgtttgctcttacttcaattaagggtattggaaggcgactggctaacatcgtttgcaagaaagctgatgttgacatgaacaagagggccggtgaactatctgctgctgaacttgacaatctcatggtcgttgttgcaaatccccgacagtttaaaatccctgattggttcttgaacagacagaaggattacaaagatggaaagtattctcaggttgtatccaatgcactggacatgaagttgagagatgatttggagcgtctgaagaagatcaggaaccaccgtggtctcaggcactactggggtcttcgtgtccgtggacaacacaccaagaccaccggtcgtcgtggaaagactgttggtgtctccaagaagcgttgagctgtcctttatcaatgttttgaacaatctatacacatgttcaggaagagtttggacttgctattgctgaacatttgcgtaagacaatattagatttattttcttttctttggatgggttttaagcatttgaactgtctgtcttttatctattattttctctatggtaatatttttattcagatgttttgcaacaaatattttatctccctcttttatctcattgaattttgagctcttttgttttgtatgtattcctgaggaattaaggtgtaggtgtcttgatacga

SEQ ID NO: 2794 - DNA, 782 bp, Vigna unguiculata
ttcaaccagcaccgatagcagcggcggcgaccgtcactctccaacgacacttccgcggcgaaaatggctctggtggcgaacgaggaattccagcacattctccgtgtgctgaacactaacgttgatggcaagcagaagataatgttcgcccttacctccatcaagggtattggtaggagattcgcaaacatggtttgcaagaaggctgatgttgacatgaacaagagggctggtgagttgagtgctgcggagttggataatctaatgactgtggtggccaaccctaggcaattcaaaatcccagattggtttcttaacaggaagaaggattacaaggatggcaaatactcccaggttgtttccaatgctctcgatatgaagctcagggatgatttggagagacttaagaaaatcagaaaccaccgtggattgaggcactactggggccttagagtccgtggtcagcacaccaagacaactggccgtaggggaaagactgttggtgtctctaagaagcgttaagatattatgttttggctttggagattagattttgttgaggagacaaatttgaaagaacactagacatgttttgcataccgactttgtatcagttttatttaaatgcggtgacaatttcaattttgtttgttatttgcgttaagctctacttatgatgctggttttttatttgtagagaaccttggatattattgatgaaattacatattcacttcaaccccgaatcaaaatactacctttttaccaaaaaaaaaaaaaaa

SEQ ID NO: 2795 - DNA, 797 bp, Vigna unguiculata
agcctaggaacggcgttcacctactctcagccgcatcacttcccggaatcgcgcatcccttgcgttcaagatggccttggtggcaaatgaggaattccagcacatacttcgtgttttgaacacgaacgtagatgggaagcagaagataatgttcgctcttacctcaatcaaaggtatagggagacgatttgctaacatggtgtgtaagaaggctgatgttgacatgaacaaaagagctggtgagctgagtgccgctgagttggataacctcatgactgtggttgccaatccccgccaattcaagattccagactggtttttaaacaggaagaaggactacaaggatgggaagtattctcaggtagtgtccaatgcattggatatgaagttgagggatgacttggagagactaaagaaaatcaggaaccatcgggggttgagacactactggggtcttcgtgtacgtggccaacataccaagaccactggtcgtaggggtaaaactgttggtgtctctaagaagcgctgagcttaaagctctctctttttctttttcttactgttttttgaacaatgggatatattatttgttaaagtcaacaattctattttgagaatgcatttggattttgttgcatttgaattttaaccgtgattgggttgttctttttatttccttatgaatcttgttttttttttggtcccccatttgtcccatttgaaggggggacgccatgttcatttccgttaaaatatggcttaatattgagcaagattaatatatgattgccatgcct

SEQ ID NO: 2796 - DNA, 725 bp, Cucurbita pepo
gggaattctacgaactccttgcttctatctacattcgccatgtcgctggttgcaaacgaggattttcagcacattctgcgtgtgctgaacactaacgtggatgggaagcagaagattatgtttgctctcacttcgattaaaggtattggaaggcgtcttgctaacatggtttgcaagaaggctgatgttgacatgaacaagagggctggtgaactaactgctgctgaattggacaatctcatggtggtggttgccaatccacgtcaatttaaaattcctgactggtttttgaatcggcagaaggactacaaggatgggaaatactctcaagtagtttcaaatgcattggatatgaagttgagagatgatttggagcggttgaagaagatcagaaaccaccgaggtctaaggcactactggggcctccgagtccgtggtcagcacactaagaccactggtcgccgagggaaaactgttggtgtctccaagaagcgttaagcgtatccatgtttttatgattgagttaagtatgtggttattgggcaaatcaagttctttggccttttagttgaacatttgagctgttctttttggaatttttatttgggatatggtatctttgttcaattttaccccttttctcctgtctttaggctagacaaggaaggttagtagtggcaaatggcgaaacttttttatttatagaattattgtttgttaccatc

SEQ ID NO: 2797 - DNA, 819 bp, Cucurbita pepo
ggttagagtgttatcaactccaagtaagctctatattcagacaacttatttgttcatagctgggggttacatgtcaatcatggtgtgccctctacttttgggtttaaggcgttcgttgcgttgcggcttcagagagaagaagcaccgggaggaatccgcgcgccatcttccgtcaaaatgtcgttggtagcgaacgaagatttccagcacatattgcgtgtgctcaacacaaacgtcgatggaaagcagaagattatgttcgctcttacttccatcaaaggtattggaaggcgtttggccaacatggtctgcaaaaaagccgatgttgacatgaacaaaagggctggtgagttgactgctgcggagctggacaatctcatggtcgttgttgccaacccccgacagttcaaaattccggactggtttttgaatagacagaaggactacaaggatggcaagtattcacaggtggtgtcaaatgctctcgacatgaagctgagggacgacttggagcgtttgaagaagatcaggaaccaccgtggtttgaggcactactggggtcttcgtgtccgtggtcagcacaccaagactaccggtcgccgagggaagactgtcggtgtctctaagaagcgttaaatttctgctctccttttgtttccaagcttctgttgaatgcaataggttaatataattagtctttgagattggcttggtggacctcttcggatttggctgggttttgaaaacctttgccaggttatatttcatatgggtcattcatttttggtcgttataatagagattgagatatcctggttg

SEQ ID NO: 2798 - DNA, 770 bp, Cycas rumphii
gattttctgtggggtggtgctttattctgctcggggtcctggcagtggtggatctgcagtcaacatgtctctgatagcgaacgaagactttcagcacattcttcgtgtgttaaataccaatgttgatgggagacagaagataatgtttgccctaacttccattaaaggtgttggccggcgctttgctaatctcgtatgtaagaaggccgatgtcgacatgaataagagagctggtgagctatcagcaagtgagcttgagaatttgatggtgattattggaaaccctagacaatttaagatacctgactggtttctcaacagaaagaaggatcacaaagatggtcgatactctcaagttgtttccaatgcgctcgatatgaaacttagggatgacttggaacgtttgaagaagatcaggaaccaccgtggtcttcgtcattattggggccttcgtgtgcgtggacagcacacaaagaccactggccgtaggggaaagactgttggtgtctcaaagaagcgttgaggagaatattgtttgtcacatgcgaaggtcctttggcagataattttgtgacagttggagtgaacttgagtttttgttttgttgtgaattgagtttcaatcctaattttgaaggatacgtagggcatttgtttctacctttgtaagaaatctgtttacatttataagatacatgtttaatgaagccatttaaagacttcattttcaaattatgtattagcactcttgatctgttattacattgcatc

SEQ ID NO: 2799 - DNA, 714 bp, Cycas rumphii
gacattgttcagtgggactctagtggctagagtggagctgcaaacatgtctctgatagcgaatgaagactttcagcacatacttcgtgtgctcaacaccaatgttgatgggcgacagaacataatgtttgcgcttacgtcgattaagggtgttggacggcgtttcgcgaaccttgtctgtaagaaggcagacattgatatgaacaagagagctggagagctgtcagcaaacgagctcgagaatctgatggtgataattggaaacccaaggcaattcaagatcccagactggtttcttaacagaaagaaggatcataaggatgggcgttactctcaagtggtttccaatgcactcgatatgaagctcagggatgacttggaacgtctcaagaaaatcagaaaccatcgcggtctccgacattactggggccttcgtgttcgtggtcagcacacaaagaccactggtcgtagaggaaaaactgttggtgtgtcgaagaagcgttgattacaatctaattatggatatgggattgatataccttgctgggcaactttgtgacagctggaggcttaatgtttgttcgttatgtacaagtattgaattcattgatggtgatcaggcttttgtaatgttatgttgctagttggagctgtgtaaatcttgaagtgatagttgctaattagagtcgtgtgctttgcaaattatatcaaagat

SEQ ID NO: 2800 - DNA, 746 bp, Cynara scolymus
gcggggaggtttcgggctgcatcgatcggagggcatttgggagcatcagccgctaggagaaggaactcactcactcgtagatatgtcgttggtagcaaatgaagatttccagcatattcttcgtgtacagaacacgaatgttgatggaaagcaaaagatcatgtttgctatgacttcgatcaagggtatcggtcgtcgtttcgctaacattgtctgcaaaaaggctgatgttgatatgaacaagagagccggagaattatcgaatgcagagattgataatctgatgacgattgttgcaaatccccgacaattcaaaatcccagattggtttcttaacagaaagaaggactacaaggatgggaagtactctcaagtcacatctaatgcccttgacatgaagctcagagatgatctcgaacgattgaagaagatcaggaaccatcgtggtcttcgtcattactggggtctgcgagtacgtggacaacacaccaagaccaccggtcgcaggggaaagaccgttggtgtgtccaagaagcgataaatgtttttgtgttttggtcttaaatccttgagatttagaatttggggtaagttatggtttggttgtacttttttggatcttgatgtgttgtaggggattctaaactgagttttatttacattttgtgagagttgatattgcatattttttggatcatgataatgagttcagcatctctgttttaattgttttggcctctttcagt

SEQ ID NO: 2801 - DNA, 720 bp, Cynara scolymus
ggtttacatttctcgccgattacagctttccggagcaccagccgccaagacctgcaactttaactgcaatcatgtcgctggtagcaaatgaagattttcagcacattcttcgtgtacagaacacgaatgttgatggaaagcaaaaaattatgtttgctatgacctccatcaaaggtatcggtcgtcgttttgccaacatcgtctgcaagaaggctgatgtcgacatgaacaagagggctggagaactttccaatgccgagattgacaatctgatgacaatcgtggcaaacccacgtcagttcaaaatcccagactggtttttgaacaggaagaaagattacaaggatggaaagtactcccaggtcacatcaaatgcactcgacatgaagttgagagatgaccttgagcgcttgaagaaaatcaggaaccatcgtggtcttcgtcattactggggtcttcgtgtgcgtggtcagcacaccaaaaccactggacgcaggggtaagactgttggtgtgtcgaagaagagatagattggaaacgaaaattacattctggttttagacatttatctataaaatctctgatcaattttgttgaatgtttggttttaagctgttttatgtcatcgtaatagttgtaactttctcttggatgatcttgcaagtatgtgttttttgggatcttatatgaggaattgactttccctttggatggttcacg

SEQ ID NO: 2802 - DNA, 759 bp, Cynara scolymus
  misc_feature (737)..(737): n is a, c, g, or t
agggttcttatacaactctgaaggaccgaagaggcggagcgtcgtccatcggagtaatccatctcaggtatcagcatcagagaaggaacttgatcgaaatcgaaccatgtcgcttgtggcaaatgaagactttcagcacattcttcgtgtacagaacacaaatgtcgacggaaagcaaaagatcatgtttgccatgacctccatcaaaggtatcggtcgtcgttttgccaatatcgtttgcaagaaagccgatgttgacatgaacaagagggctggtgagctctctaatgctgaaatcgacaacttaatgaccatcgttgctaatcctcgccagttcaaaatcccagactggtttcttaacagaaagaaggattacaaggacgggaagtactcgcaggtaacctccaacgccctcgatatgaagctgagagatgatttggagcgcctcaagaaaatcaggaaccaccgtgggcttcgtcattactggggtctccgagttcgtgggcaacacaccaagaccaccggtcgccgtggaaagaccgttggtgtgtccaagaaacgataaacgaatggttatgagttgcccttttcgcatgttcttaggattttacatctacaaatcgaggttcgcagtagaattggtgagtttttttcgtcgaaatccctacaacttgaaaagattgttctattttttcacaaagaggaattaaatatatttggatcttatttttggcagntttattgtgatcgtaagaccaa

SEQ ID NO: 2803 - DNA, 785 bp, Taraxacum officinale
gcgggggggtttcaattctcgcatattagaacttcagttccggagcaccagccgtcgagacctgcaattccgactgcaacaatgtcgctggtagcaaacgaagattttcagcacattcttcgtgtacagaacacgaacgttgatggaaagcagaagattatgttcgcgatgacctcaattaaaggtattggtcgtcgttttgccaacatcgtctgcaagaaggccgatgtcgacatgaacaagagggctggagaactttcgaatgctgagatagacaatctgatgacaatcgtcgccaatcctcgtcaattcaaaatcccagactggtttttgaacagaaagaaagattacaaggatggaaagtactcccaggtcacctccaatgctcttgacatgaagttgagagatgacctcgaacgtttgaagaagatcagaaaccaccgtgggcttcgtcattactggggtctgagagtccgtggacagcacaccaagaccactggtcgtaggggaaagactgttggtgtttccaagaagagataagtttaaaaagttatgttcttgctttgatctcttttactactactttcatcagttttggatgttttgtgatggttataagctcacttttttggatttcttgttagtatgctttttcagatctctatgagaaattgttgtttcggatttagattattgatgaattttacttgggtttggtcgttctcatgaattatgttacgaatttatcagtgttatttatgaattaggtttggtttgaaaaatgt

SEQ ID NO: 2804 - DNA, 702 bp, Taraxacum officinale
gaggcggagccgccaatcggagtgattcatcgcaggtattgataagagaaaaagcttattcacaatacaaccatgtcgcttgtagcaaatgaagacttccaacacattcttcgtgtacaaaacacaaacgttgatggaaagcaaaaaatcatgttcgccatgacctccatcaagggtatcggacgtcgttttgcaaacattgtctgcaaaaaagctgacgtggacatgaacaaaagggctggtgaactctcgaacgctgagattgataacctgatgacaattgtcgctaaccctcgtcagttcaagatccctgattggtttttgaacagaaagaaggattacaaagatggaaaatactctcaggttacttctaacgcacttgacatgaagcttagagatgatttggagaggctcaagaagattaggaaccaccgtgggctccgtcactactggggtcttagagtccgtggtcaacacaccaagacgactggtcgtaggggaaagactgttggtgtgtccaagaagcgataagtttgtgtgttttttatttactttttgtggacttttgctgttattattttgaaagatatgtggtagtttgacaatttggtgcgatttttgtttttttatttttctgctagcaaggttctaggatttcttatcgagaatttgctatatgaactgatgagttaacgagttttt

SEQ ID NO: 2805 - DNA, 710 bp, Taraxacum officinale
cgggggctccgttagggttttactggctgcagcgatttatagtatttggtagcatcagcagcttggggaagaagcgcaaatcgcagccatgtctcttgtagcaaatgaagatttccagcatattcttcgtgtacagaacacgaatgttgatggaaagcaaaagatcatgtttgccatgacctccattaaaggtattggtcgtcgtttcgcaaacatcgtctgcaagaaagccgacgttgatatgaacaagagagcaggagagctatcaaatgcggagattgataacctgatgacaatcgtggcaaatcccagacaattcaaaatcccagattggtttcttaatagaaagaaggattacaaagatggaaagtactctcaagtcacatccaatgcactcgacatgaagctcagggacgaccttgaacgattgaagaagatcaggaaccaccgtggtcttcgtcattactggggtcttcgggtccgtggacagcacaccaagactacaggtcgtaggggaaagactgttggtgtgtccaagaagagataagtgtttgtttttttttattattttgggaattttcttaaattgttatttcggatcagatgtagaagaatgttatagtggaagttgttatgtttatggatggatgtacctttttttttgtggatttcatataagcgttgatgagaattaagtgatagacttgttt

SEQ ID NO: 2806 - DNA, 742 bp, Taraxacum officinale
ttagagaatttggtagcatcagcagcttgaggaagaagcgcaaatcgcagccatgtctcttgtagcaaatgaagatttccagcatattcttcgtgtacagaacacgaatgttgatggaaagcaaaagatcatgtttgccatgacctccattaaaggtattggtcgtcgtttcgcaaacatcgtctgcaagaaagccgacgttgatatgaacaagagagcaggagagctatcaaatgctgagattgataacctgatgacaatcgtggcaaatccaagacaattcaaaatcccagattggtttctcaacagaaagaaggattacaaagatggaaagtactctcaagtcacatccaatgcactcgacatgaagctcagggacgatcttgaacgattgaagaaaatcaggaaccaccgtggtcttcgtcactactggggtcttcgagtccgtggacagcacaccaagactacgggtcgtaggggaaagactgttggtgtgtccaagaagagataagtgtttgtttttttttattatgggaattttcttaaattgttgtttgggatgagatttagaagaatgttatagtggaagttgctatgtttatggatggatgtatttttttttgtaagtggtaagtttttttggatttcatataagcgttgatgaggattaagtgatagacctgtttctttaaagtaggtatagtcagcttaatataatatatgtcatttaaatccaaaaaaa

SEQ ID NO: 2807 - DNA, 728 bp, Solanum melongena
atacacggaagaagaagaagaagccgccgccgagggagcaagattcagaagaagctagccatgtcgcttgttgctaatgaagatttccagcacattcttcgtgtgcaaaacaccaacgtcgatggaaaacaaaagatcatgttcgccttgacctcaatcaaaggtattggccgtcgtttcgccaacattgcctgcaagaaagccgatatcgacatgaacaagagggctggtgaactcactgctgcagagctcgacagtatcatggtggttgttgctaatcctcgtcaattcaaaatccctgattggtttttgaacaggcagaaggattacaaagatggcaagttttcacaagtcacatctaatgcacttgacatgaagcttagggatgatcttgagcgcctgaaaaagatcaggaatcatcgtggtttacgtcactactggggcctccgagtgcgtggtcagcacacaaagacgactggccgcaggggaaagactgttggtgtctcaaaaaagcgataaatcatctacttgtcagtttcagtttgttacatgctctgtcttatgtctaagatgcttgttagggattctgtactgattatgtttaaattttccagttggtgggttatagtttaatttcttgccttagtgacaaaaggaatactttgctgtatgatgatcaagttttgcagattgctcttgaattaaattgaatgagtagtttgttggag

SEQ ID NO: 2808 - DNA, 771 bp, Solanum melongena
acttctcgtatctagggttttctaagagcttggcatctcttccaaaacaaaagcagcagccgcactgtgactcagtgaagctctagccatggctctggtcgcaaacgaagattttcagcacattcttcgtgtgcaaaacacaaatgttgatggaaagcagaagattatgttcgctatgacctctatcaaaggtatcggtcgccgttttgctaacattgcctgcaaaaaagccgatatcgatatgaacaagagggctggtgagctttctgctgctgagcttgacagcttgatggtggttgtggctaatcctcgccaattcaaaattccagattggtttttgaacagacagaaggattacaaggatggcaaattttctcaagttacatctaatgcccttgacatgaaactaagggatgacctggaacgtctgaagaagatcaggaatcatcgtggtttgcgtcactactggggcctccgtgtccgtggtcagcacacaaagaccactggccgcagggggaagactgttggtgtctccaagaagagataaatcatttacatgccaagtcctttatgtgttatgtttctccttagaatgcggaatttgagcaaaaagtttgttagggtatttttgttttgtttgcatttgaattttcttttcctgccttttggagatttttaaatctttcaacaagcatgtgcttactgttgggattaaagttttgccgattgcacttgggttattacatcaaatatgagtactttttatgagac

SEQ ID NO: 2809 - DNA, 869 bp, Eucalyptus grandis
ggtatatataactcgctccaaaccctagctcttctctacacggccaacgaaaggaaagagagttctcgcgccccctcccgcatcgccgccgcccgccgccgccgcgtctccgaagcccgtgtcaaccgcgatgtcgctggtggcgaacgaggagttccagcacatcctgcgtgtgctgaacaccaacgtcgatgggaagcagaagatcatgttcgccctcacctccatcaagggtatcggccgccgcttcgccaacatcgtctgcaagaaggccgacgtcgacatgaacaaaagggctggtgaattgtctgctgcagagctagacaacctcatggttattgtcgccaacccccgtcagtttaagattccagattggtttttgaacagaaagaaggactacaaagatggaaagtattcccaggttgtctcaaatgccctggacatgaagctgagggatgatttggagaggttgaagaagatcaggaaccaccgtggtctgaggcactactggggcctgcgtgtccgtggccagcacacaaagactactggccgtagaggaaaaactgttggtgtctccaagaagcgttgagttttattcctttcaattgttggcattacatggaatgccttcagaggagttcttccgcttgatctctgagtttaagttccttgcatggacttagtagatttgaaactcaatattttttttcctttcagttgtatgatgtgttttgcccggttttgctgaagtggtagtgcaattacatgaatcaaatttttgaaagaatgctgtttctcgtcaagcctgctgtttgttatattcaatggcaaatgatcatgtagttgatatggtctatgctgaattcatc

SEQ ID NO: 2810 - DNA, 824 bp, Euonymus alatus
ggattgcactctagggtttttggtcgccacaaaagaacacagcctcctacctgctctctcgcttgcaagagaactgcattcaaaattttgatcgataaactgataagctatgtcgttggtagcaaacgaggacttccaacatatacttcgtgtgctgaacacgaacgttgatggcaaggataagatcatgtttgccctaacctccatcaaaggtatcggtcgccgcttcgccaacatcgtgtgcaagaaagctgatgttgacatgaacaagagagctggtgagctaactgctgctgagctggagaacttgatggcggttgtaggcaatccgcggcagtacaagatccctgattggttccttaacaggcagaaagattacaaagatggcaaatattctcaggttgtctcaaatgcattggacatgaagcttagggatgatcttgagcgtttgaagaagatcaggaaccaccgtggtcttagacactactggggtcttcgagtccgtggtcagcacaccaagacaactggccgcagggggaagactgttggtgtctcaaagaagcgttaaattgcctctgtttttttttattaatttgatgtccttttcctgctacaaattttgttttctttttaggttttacaagtctagggcagaatggatcctataattttgttgtggtagggatggcatcatatatcttgatatcttaccttatgttcttgcttttgaagatttttgctatgcattgcgttaacttattactatttcattgaacgagcacaaggtttgtttcccatgggaatatatacatatgttgcttatc

SEQ ID NO: 2811 - DNA, 721 bp, Fagopyrum esculentum
aattccgatttgcagccgccgcacttggagctaccagtagagaccaaagccgtccgaggaagtactcaaaatgtcacttgtagcaaatgaagattttcagcacattcttcgtgtgttgaacaccaatgtcgatgggaaacagaagatcatgttcgctctcacctctatcaaaggtattggacgcaggttctccaacatcgtttgcaagaagggcgatgttgacatgaacaagagggctggtgaactttccaatgctgaaattgacaatttgatgagcattgtcgctaatcctagacagttcaagatccctgattggtttttgaacagaaagaaggattacaaggacgggaggtactctcaagttgtgtccaatggactggacatgaaactgagagatgatcttgagcgtctcaagaaaattaggaaccaccgtggtctacgtcactattggggccttagagttcgtggtcaacacacaaagacaactggacgtaggggaaagaccgtcggggtgtcaaagaagcgttgaagtttggccgtccggcaatgcttcattctttttctactgcaaattttgttttcactcaacttgtttgtcactttgaatccttttcttttgtgctatcttattatgaaatcattaggatgaaagaattgtttctgttttaccagattttctgtagatcatagattccaagtttgatcttgaaatcaattttca

SEQ ID NO: 2812 - DNA, 713 bp, Fagopyrum esculentum
gaggagagaccgagagagccgccgtccagtacacaggaagttatcaaaatgtcacttgtagcaaacgaagattttcagcacattcttcgtgtgttgaacaccaatgtcgatgggaaacagaagatcatgttcgccctcacctctatcaaaggtattggacgcaggttctccaacatcgtttgcaagaagggcgatgtagacatgaacaaaagggctggtgaactgtcgaatgctgaaattgacaatttgatgagcattgtcgctaatccgaggcaattcaagatccctgattggtttttgaacagaaagaaggattacaaggacgggaggtactctcaagttgtgtccaatggactggacatgaaactgagagatgatcttgagcgtctcaagaaaattaggaaccaccgtggtctacgtcactattggggccttagagttcgtggtcaacacacaaagacaaccggtcgtaggggaaagaccgtcggtgtgtcaaagaaacgttgaatccttttctttggtgctatcttattatgaatcattaggatgaaagaagtgtttctgtttcaccaagttggtagactctttagattttctgtagatcatatattccaagtttgatcatgagaagatgcctactgcttctgctttcgacaatgttgaaatcaatcaattttcattttaacttggttctgtttttctactttaaaaaa

SEQ ID NO: 2813 - DNA, 744 bp, Fagopyrum esculentum
ttgcgcagaagaaattctcagaatgtcgcttgtagcaaacgaagattttcagcacattcttcgtgtgttgaacaccaacgtcgatgggaagcagaaaatcatgttcgctctcacctctatcaaaggtattggacgcaggttctccaacatcgtttgcaagaaaggcgatgtcgacatgaacaagagggctggtgaactttctaatgctgaaattgacaacttgatgagcattgttgctaatccgagacagttcaagatcccagactggtttttgaacagaaagaaggattacaaggacgggaggtactctcaagttgtgtccaatggactcgacatgaaattgagagatgatcttgagcgtcttaagaagattaggaaccaccgtggtcttcgacactactggggccttagggttcgtggacagcacaccaagacaactggccgtaggggaaaaactgttggtgtgtccaagaagcgttgaagtttggtcgtattgcaacgctacattccggttctactgcaaattttgttttcattaagctttgttatccttttctttggttattatgaattattagattgaaaaagcagtgttcctgtttcaccaagttgatagacttaaatcatgatcctagttgtttgcatcaatgttgaaatcaaaattcgttttaacttggattggttggttgacttctctcccggtttggtttctgttctatcattgattgtatgattcgtggttac

SEQ ID NO: 2814 - DNA, 633 bp, Festuca arundinacea
ggcacgaggcgatcgccgccgccaccctcctcctccagcgagagctccgaccacagccgtcgccatgtcgctgatctcgggtgaggagttccagcacatcctgcgtgtgcagaacaccaacgtcgatggcaagcagaagatcatgttcgcgctcaccgccatcaagggtatcgggcgtcgctactccaacatcgcctgcaagaaggccgacatcgacatgaacaagagggctggtgagcttactactgaagagcttgaacgtgtcatgcacgtggtgcaaaaccctcgctcgttcaaggtccctgactggttcctgaacaggaagaaggattacaaggatggcaagttctcccaggttacttccaatgccgttgacatgaagttgagggatgaccttgagaggctcaagaaaatcaggaaccaccgtggtctgcgtcactactggggtgtccgtgtccgtgggcagcacaccaagaccaccggcaggaggggaaagactgttggtgtctcgaagaagagataaacctgttgcccatcagtcgctgcatgctggcttatctttgttgtcttttaatgatgtgaaatcctcgtcctggatagttctgttgggggttctatttgcatgtctcctat

SEQ ID NO: 2815 - DNA, 725 bp, Flaveria ramosissima
catctcattcttgacacctcgaacactcaggagcaccggccgccgatacctgctacaccaactgcagtcatgtcgttggttgcaaatgaagactttcagcacattcttcgtgtgcagaacacgaatgttgatggaaagcagaagattatgttcgctatgacttcaatcaagggtattggtcgtcgttttgctaacatcgtctgcaaaaaggccgatgttgatatgaacaagagggctggtgaactctctagtgctgagatcgacaatttgatgacaattgttgctaatccgcgccaattcaagatcccagactggtttttgaatagaaagaaagattacaaggatgggaagtactcgcaagtcacatcaaatgctcttgacatgaaattgagagatgaccttgagcgattgaagaaaatcaggaatcatcgtggtcttcgtcattactggggtctccgtgtgcgtggacagcacaccaaaaccactggtcgtcgtggaaagactgttggtgtgtcgaagaagagataagttgatgtttgtttaaaattcctgttacattcagtgttttagacaagttcatggcaccagttttgaatgtatgggttaaaagtttttattttatggttatagtcctttgatgtttttatcttgtgttagaaagaggttgtcatttgaaacggataagtggtggattttatttgtttatctttataatctttatgatt

SEQ ID NO: 2816 - DNA, 673 bp, Flaveria ramosissima
aacgaaagaagtagcagtctaccggaggcgtcggcataagagaagcctcgcgtttcagccatgtctcttgttgccaatgaggacttccagcatattcttcgtgtacagaacacaaatgttgatggcaaacaaaagatcatgtttgccatgacctccatcaagggtattggccgtcgttttgcaaatatcgtctgcaagaaggctgatgtcgacatgaacaagagggctggtgaactctcgagtgctgagattgataacttgatgacgatcgttgctaatcctcgtcagtttaaaatccccgactggtttcttaacagaaagaaagattacaaggatggaaagtactcccaggtgacctctaacgccctcgacatgaagctcagagacgacttggagcgtttgaagaaaatcaggaaccaccgtgggcttcgtcactattggggccttcgggttcgtggacagcacactaagaccaccggtcgcaggggaaagactgttggtgtctccaagaagcgataggtttgtcttgtttcacttcttttggtttaggagataccctcttgagcctttattctcatcaatataaaaaggtattatgatgttaagtcttgagattttatatggtgaagatttttctgttgaacatttgttctctagcatgtttgactttata

SEQ ID NO: 2817 - DNA, 597 bp, Flaveria ramosissima
gggttcactttagcgacatttgagcatcttgtagcattcgccgcttgaagaaggaactcaaattgcagctatgagcctcgtagcgaatgaagactttcagcatattcttcgtgtgcagaacacgaacgttgacggtaagcagaagatcatgtttgctatgacttcgattaaaggtattggtcgtcgtttcgcgaacattgtctgcaaaaaggctgatgttgatatgaacaagagggcaggagaactttctaatgctgagattgacaatctcatgacaatcgttgctaatcctcgacaatttaagatcccagactggtttcttaacagaaagaaggattacaaggatggcaagtactctcaagtcacatccaacgcccttgacatgaagctcagggatgatctcgagagattgaagaaaattaggaaccaccgtggtcttcgtcattactggggtctgcgagtacgtggacagcacaccaagaccactggtcgtaggggtaagaccgttggtgtgtccaagaagcgataagcagcttgtttttgtttttgttctcatcagatttagaacgcgaggaaatttgttatgttgtgttatgt

SEQ ID NO: 2818 - DNA, 721 bp, Flaveria ramosissima
gggttttataataatctccatcgactagagcaaatcggagcaacagccgccgccacctgcaactccgacagcaaccatgtcgctagtcgcaaacgaggactttcagcacattcttcgtgtacagaacaccaacgttgatggcaaacagaagatcatgtttgctatgacctcgatcaagggtatcggtcgtcgttttgccaacatcgtctgcaaaaaggctgacgtcgacatgaacaagagggctggagaactttcaagtgctgagatagacaatctgatgaccatcgtggctaatcctcgccaattcaaaatcccagattggtttttgaacaggaagaaagattacaaggatgggaagtactcacaggtcacatccaatgctctcgacatgaaattgagagatgaccttgaacgtttgaagaagatcaggaaccatcgtggtctgcgtcactactggggtctacgagtgcgtggacagcacaccaaaaccactggtcgtaggggaaagactgttggtgtgtccaagaagagataagtttttctttgcctccgaaaacaagctacttttgtggcttagacgttctcaagaatctttcttgttctcatcaattttgaacgttttggttatgatttcgtggttatagttgtactttccgatttcatgtgagtcactgtttttttgaatggatgttttgatgaaatttggtgattttatgtgacc

SEQ ID NO: 2819 - DNA, 565 bp, Flaveria ramosissima
ggagggtttgcagagctgccatcaattttgagcattttgaccaatagccgcttgaagtagtgactgaaatcgccaccatgagtttggtcgcaaatgaagattttcagcatattcttcgtgttcaaaacacaaatgtcgatggcaaacagaagatcatgttcgccatgacctcaattaaaggtattggtcgtcggttcgccaacatcgtctgcaagaaggctgatgttgatatgaacaagagggcaggagaactttctagtgcagagattgataatctgatgacaatcgttgccaacccacgacagtttaaaatcccagattggtttcttaacagaaagaaggattacaaggatggcaagtactctcaagttacatctaacgcccttgacatgaagcttagggatgatcttgagagattgaagaaaatcaggaaccaccgtggtcttcgtcattactggggtctgcgagtacgaggacagcacacaaagactactggtcgtcggggtaagaccgttggtgtgtcgaagaagcgatgagcttgtttgaattttagaaaatctttatt

SEQ ID NO: 2820 - DNA, 675 bp, Flaveria ramosissima
agggttcactttagcgacattgagcatcttgtagcattcgccgcttgaagaagaaactcaaattgcagctatgagcctcgtagcgaatgaagactttcagcatattcttcgtgtgcagaacacgaacgttgatggtaagcagaagatcatgttcgctatgacttcgattaaaggtattggtcgtcgtttcgcgaacattgtctgcaaaaaggctgatgttgacatgaacaagagggcgggagaactttctagtgctgagattgataatctcatgaccattgtcgctaatcctcgacaatttaaaatcccagactggtttctcaacagaaagaaggattacaaggatggcaagtactctcaagtcacatccaacgcccttgacatgaagctcagggatgatctcgagagattgaagaagatcaggaaccaccgtggtctgcgtcattactggggtctgcgagtacgtggacagcacaccaagaccactggtcgtaggggtaagaccgttggtgtgtccaagaagcgataagcggtttgtttttgtttttattcacatcagatttagaacgcggggaaatttgttatgttgtgttatgttatctttttctaagagttcctttacatcatgaaaagttagcgtatttttggtattatgatatatgttttgttaagcac

SEQ ID NO: 2821 - DNA, 606 bp, Flaveria ramosissima
agggttcactttagcgacattgagcatctcgtagcattcgccgcttgaagaagaaactcaaatcgcagctatgagcctcgtagcgaatgaagactttcagcatattcttcgtgtgcagaacacgaatgttgatggtaagcagaagatcatgtttgctatgacttcgattaaaggtattggtcgtcgtttcgcgaacatcgtctgcaaaaaggctgatgttgatatgaacaagagggcgggagaactttctagtgctgagattgataatctcatgaccattgtcgctaatccccgacaatttaaaatcccagactggtttctcaacagaaagaaggattacaaggatggcaagtactctcaagtcacatccaacgcccttgacatgaagctcagggatgatctcgagagattgaagaaaattaggaaccaccgtggtcttcgtcattactggggtctgcgagtacgtggacagcacaccaagaccactggtcgtaggggtaagaccgttggtgtgtccaagaagcgataagcagcttgtttttgttttgttctcatcagatttagaacgcgaggaaatttgttatgttgtgttatgttatctttttc

SEQ ID NO: 2822 - DNA, 754 bp, Flaveria ramosissima
cttctctggagaacaaaagaggtagtccgccgtcgccggagcagtcgccggagcagtctaccggaggtgtcgggataagagaagaagctcaattgcgtttcagccatgtctcttgttgcaaatgaggacttccagcatattcttcgtgtacagaacacaaatgttgatggcaaacaaaagatcatgtttgctatgacctccatcaagggtattggccgtcgttttgcaaatatcgtttgcaagaaggctgatgtcgacatgaacaagagggctggtgaactctcgagtgctgagatcgataacctgatgacgattgttgctaatcctcgtcagtttaaaatcccagactggtttcttaacagaaagaaagattacaaggatggaaagtactcccaggtgacctctaatgccctcgacatgaagctcagagacgacttggagcgtttgaagaaaatcaggaaccaccgtgggcttcgtcactattggggtctccgggtccgtggacagcacactaaaaccactggtcgcaggggaaagactgttggtgtctcgaagaagcgataggtttgtcttgtttcacttcttttggtttaggagataccctcttgagcctttattctcatcaattcgaaaaggtattatgatgttaagttttagggattttatatggtgaagatttttctgttgactttttgttctttagcatgtttgactttaaatcattattgggctgttcttggggacccattatatt

SEQ ID NO: 2823 - DNA, 583 bp, Flaveria ramosissima
gaaactcaaatcatagctatgagcctcgtagcgaatgaagactttcagcatattcttcgtgtgcagaacacgaacgttgatggtaagcagaagatcatgttcgctatgacctctatcaaaggtattggtcgtcgtttcgcgaacatcgtctgcaaaaaggccgatgttgatatgaacaagagggcaggagaactttctagtgctgagattgataatctcatgaccattgtcgctaatccccgacaatttaaaatcccagactggtttctcaacagaaagaaggattacaaggatggcaagtactctcaagtcacatccaacgcccttgacatgaagctcagggatgatctcgagagattgaagaagatcaggaaccaccgtggtcttcgtcattactggggtctgcgagtacgtggacagcacaccaagaccactggtcgtaggggtaagactgttggtgtgtccaagaagcgataagcagcttgtttttgtttttattttcatcagatttagaatgcggggaaatttgttatgttgtgttatgttatctttttcaagagttcgtttacatcatgagaagttg

SEQ ID NO: 2824 - DNA, 676 bp, Flaveria ramosissima
gggtttataacatccgtcgactagagcaaatcggagcaacagccgccgccacctgcaactccgactgcaaccatgtcgctagtcgcaaacgaggactttcagcacattcttcgtgtacagaacacgaacgttgatggcaaacagaagatcatgtttgctatgacttccatcaagggtatcggtcgtcgttttgccaacatcgtctgcaaaaaggccgacgtcgacatgaacaagagggctggagaactttcaagtgccgagatagacaatctgatgaccatcgtggctaatcctcgccaattcaagatcccagattggtttttgaacaggaagaaagattacaaggatgggaagtactcacaggtcacatccaatgctcttgacatgaaattgagagatgaccttgaacgtttgaagaagatcaggaaccatcgtggtctgcgtcactactggggtctccgagtgcgtggacagcacaccaaaaccactggtcgtaggggaaagactgttggtgtgtccaagaagagataagtttttccatgcttttgaaacaaagctacttttgtggtttagcgttctcatgaatctttattgttatcatcaattttgaacgttttgggttaagttattatctcgtggttatagttgtactttcctatttcatgtgagttactgt

SEQ ID NO: 2825 - DNA, 628 bp, Flaveria ramosissima
gacacctcgaacactcaggagcaccgaccgccgatacccgctacaccaactgcaatcatgtcgttggttgcaaacgaagactttcagcacattcttcgtgtgcagaacacgaatgttgatggaaagcagaagattatgtttgctatgacttcaatcaagggtattggtcgtcgttttgctaacatcgtctgcaaaaaggccgatgtcgatatgaacaagagggctggtgaactttctaatgctgagatcgacaatttgatgacaattgttgctaatccgcgccaattcaaaatcccagactggtttttgaatagaaagaaggattacaaggacgggaagtactcacaagtcacatcaaatgctcttgacatgaaattgagagatgaccttgagcgattgaagaagatcaggaatcatcgtggtcttcgtcattactggggtctccgtgtgcgtggacagcacaccaaaaccactggtcgtcgtggaaagactgttggtgtgtcgaagaagagataagttgacgtgtgttttaaaattcctgttacattcagttttttagacaagttcatgtcatcagttttgaatgtatgggttaaaagttcttaacttatggttgtagtcctttgat

SEQ ID NO: 2826 - DNA, 633 bp, Flaveria ramosissima
tatcgacacctcgaacactccggagcaccggccgccgatacctgctacaccgactgcaatcatgtcgctggttgcaaatgaagactttcagcacattcttcgtgtgcagaacacgaatgttgacggaaagcagaagattatgttcgctatgacttcaatcaagggtattggacgtcgttttgctaacatcgtttgcaaaaaggccgatgttgatatgaacaagagggctggtgaactgtctagtgctgagatagacaatctgatgacaatcgttgctaatccgcgccagttcaaaatcccagactggtttttgaatagaaagaaagattacaaggatgggaagtactcacaagtcacatcaaatgctcttgacatgaaattgagagatgatcttgagcgattgaagaagatcaggaaccatcgtggtcttcgtcattactggggtctccgtgtgcgtggacagcacaccaaaaccactggtcgtcgtggaaagactgttggtgtgtcgaagaagagataagttgacgcgtagtttaaaaattcctgttacattcggttttagacaagttaatgtcatctagttttgaatgtatggaattaaaagttcttatcgtatggttatagtcgtcgatt

SEQ ID NO: 2827 - DNA, 587 bp, Flaveria ramosissima
gggttcactttagcgacattgagcatctcgtagcaaagcattcgccgcttgaagaagaaactcaaattgcagctatgagcctcgtagcgaatgaagattttcagcatattcttcgtgtgcagaacacgaatgttgatggtaagcagaagatcatgttcgctatgacctctatcaaaggtattggtcgtcgtttcgcgaacattgtctgcaaaaaggctgatgttgatatgaacaagagggcaggagaactttccagtgctgagattgataatctcatgacaattgttgctaatccacgacagtttaagatcccggactggtttcttaacagaaagaaggattacaaggatggcaagtactctcaagtcacatcaaacgcccttgacatgaagcttagagatgatctcgagagattgaagaagatcaggaaccaccgtggtcttcgtcattactggggtctgcgagtacgtggacagcacaccaagaccactggtcgtaggggtaagaccgttggtgtgtccaagaagcggtaagcagcttgtttttgtttttattcacatcagatttagaacgcggggaaatttgtt

SEQ ID NO: 2828 - DNA, 694 bp, Flaveria ramosissima
aacgaaagaaatagcagtctaacggaggcgtcggcataagagaagctgctcgatcgcgtttcagccatgtctcttgttgcaaatgaggacttccagcatattcttcgtgtacagaacacaaatgttgatggcaaacaaaagatcatgtttgccatgacctccatcaagggtattggccgtcgttttgcaaatatcgtctgcaagaaggctgatgtcgacatgaacaagagggctggtgaactctcgagtgctgagattgataacctgatgacgattgttgctaatcctcgtcagtttaaaatccccgactggtttcttaacagaaagaaagattacaaggatggaaagtactcccaggtgacctctaacgccctcgacatgaagctcagagacgacttggagcgtttgaagaaaatcaggaaccaccgtgggcttcgtcattattggggccttcgggtccgtggacagcacactaagaccaccggtcgcaggggaaagactgttggtgtctccaagaagcgataggtttgtcttgtttcacttcttttggtttaggagataccctcttgagcctttattctcatcaatataaaagttatcatgatgttaagtttagggattttatatggtgaagatttttctgttgactatttgttctctagcgtgtttgagtttgaatcattattgggctgtt

SEQ ID NO: 2829 - DNA, 517 bp, Flaveria ramosissima
ttttgagcattttgtaccattagccgcttgaagaagaaactcaaatcaccatcatgagtttggtagcaaatgaagattttcagcatattcttcgtgttcagaacacgaatgttgatggcaaacagaagatcatgttcgccatgacctccattaaaggtattggtcgtcgttttgcgaacatcgtctgcaagaaggctgatgtagatatgaacaagagggcaggagaactttctactgctgagattgataatctgatgacaatcgttgccaacccacgacagtttaaaatcccagattggtttctcaacagaaagaaggattacaaggatggcaagtactctcaagtcacatctaacgcccttgacatgaagcttcgggatgatcttgagagattgaagaaaatcaggaaccatcgtggtcttcgtcattactggggtctgcgagtacgaggacagcacacaaagactactggtcgtcggggtaagactgttggtgtgtcgaagaagcgatgagcttg

SEQ ID NO: 2830 - DNA, 769 bp, Flaveria ramosissima
aacgaaagaaatagcagtctaacggaggcgtcggcataaagaagaagctgctcaatcgcgtttcagccatgtctcttgttgcaaatgaggacttccaacacattcttcgtgtacaaaacacaaatgttgatggtaaacaaaagatcatgtttgctatgacctctatcaagggtattggtcgtcgttttgctaatatcgtttgcaaaaaggctgatgtcgacatgaacaagagagctggtgaattgtctagtgctgagattgataacctaatgacaatcgttgctaatcctcgccagtttaaaatcccagactggtttcttaacagaaagaaagattacaaggatggtaagtattcccaggtaacatccaatgcccttgacatgaagctcagagacgacttagagcgtttgaagaaaatcaggaaccaccgtgggcttcgtcactattggggtcttcgggttcgtggacagcacactaagaccactggtcgcaggggaaagactgttggtgtctcaaagaagcgataggtttgtcttgtttcacatcttttggtttaggagataccctcttgagcctttattctcatcaatttgaaaaggtattatggtgttaagttttagggattttatattgtgaagatttttctgttgactttttgttctctagcatgtttgactctaaatcattattgggctgttcttggggacccgtttcttttcctatttttgttagttatataattttgtagttggcatgttggtacttgacg

SEQ ID NO: 2831 - DNA, 723 bp, Fraxinus spp
tggtagtcaacgcgagagtagggccttacggccgggaagggttgtggcattcctcactgaagcgaggcagcagatctgggttaatagcagcttctccacatccaaattcgcaacgttagccatgtctctgatagcaaatgaggatttccagcatattctgcgtgtgcagaacacgaacgtggatgggaagcagaagatcatgttcgccttgacctccatcaagggtattggccgccgttttgccaatatcgtttgcaagaaagccgacatcgacatgaacaagagggctggtgagctctcagctgcggaaattgacagcttgatgacgattgttggaaatcctcgccaattcaagatccccgattggtttctgaataggaagaaggattacaaggatgggaagtattctcaagtgacttccaatgctttggatatgaagctcagggacgatcttgaacgtttgaagaagatcaggaatcaccgtggtctacgtcactactggggtcttcgcgtgcgtggacagcacaccaaaaccactggtcgcaggggaaagactgttggtgtctccaagaagcgatgagccacatctttttataccgttctctttggccttcttgtctggatttttgctgctgcttacaaaagttcttacagttagtaatttgcttatttgggcgtctttactattaaatgctagcatctctctattttatgttcattttt

SEQ ID NO: 2832 - DNA, 722 bp, Panax ginseng
ttacggccggggactgaaaaccctagccgcgattacgtttgagcctctgagcttcttatccctcggctagtgaaatttcgatctccggcagccgccatgtcgctggtagcaaatgaagatttccaacacattcttcgtattcagaacacgaacgtcgatggaaagcagaagattatgtttgctctcacttccatcaaaggtataggtcgccgttttgccaacatcgtctgcaagaaagccgatgtcgacatgaacaagagggctggtgaactttcagctgcggaaattgatagcttaatgactattgttgcaaatcctcgacagttcaagatcccagactggttcttgaacaggaagaaggattacaaggatggaaagttctctcaggtgacatcaaatgcactggacatgaaactgagagatgatcttgaacgcctgaagaagatcaggaatcaccgtggtcttcgccactactggggtcttcgagtacgtggacagcatactaagactactggccgcaggggaaagactgttggtgtctccaagaagcgatagactggctctgcattttctatattgattttcagctagttttgttggattgatccatcctcaaaacaagttttggactaatgagtgtactgtttacctggtaatttgtgctgttttggtatcagctagaaattaatatatatttatggttagacaatcttacaactttg

SEQ ID NO: 2833 - DNA, 676 bp, Guizotia abyssinica
gctctggagatcgatagaggccgtccgccgttcgtcggagtagtacatccgaggtgtctgcaaaagagaggaagatcacccgttttattcaaccatgtctcttgttgcaaatgaggacttccagcacattcttcgagtacagaacaccaacgttgatggcaaacagaagatcatgtttgctatgacctctatcaagggtattggtcgtcgttttgcaaatattgtctgcaagaaagctgatgtggacatgaacaagagggctggtgaactgtctagtgctgagattgataacctaatgacaatcgttgctaatcctcgccagtttaaaatcccagactggtttcttaacagaaagaaagattacaaggatggaaagtactcccaggtgacctccaatgcccttgacatgaagctcagagatgacttggagcgtttgaagaaaatcaggaaccatcgtgggcttcgtcactactggggtctccgtgttcgtggacagcacactaagaccactggtcgcaggggaaagaccgttggtgtctccaagaagcgataagttcatttttttcacttctttttgttagaagatgtcttgttgaaccttattcttatcattcggaaaggtatgtttaagctttagggattccaaatgaagagacattggtttttacttttttgt

SEQ ID NO: 2834 - DNA, 664 bp, Guizotia abyssinica
agggtttgtattttggggcgaatagagcatatcggagcaccagccgccgccaatacctgcatctccgactgcaatcatgtcgctagtcgcaaatgaagactttcagcacattcttcgtgtacagaacacaaatgttgatggaaaacagaagattatgttcgctatgacttctatcaagggtattggtcgtcgttttgccaacatcgtctgcaaaaaggccgatgttgatatgaataagagggctggagaactttcaagtgctgagatagataatctgatgaccatcgtggctaatccacgccaattcaaaattccagattggtttttgaacagaaagaaagattacaaagatgggaagtactcacaagtcacatcaaatgctcttgacatgaaattgagagatgaccttgaacgtttgaagaagatcaggaaccatcgtggtcttcgtcattactggggtctccgagtgcgtggacagcacaccaagaccactggtcgtaggggaaagaccgtcggtgtgtccaagaagagataagttttctcttgtttttgaaaacaagctacttttggggtttagacattctgataaatctttattgttgtcaattttgaacgttttgaggttatgtcatggttatagttgacttttggatttcatttgaga

SEQ ID NO: 2835 - DNA, 739 bp, Guizotia abyssinica
tttttggcgataagagcattccgtagcaccagccgccgagacctgctgctccgactgcaatcatgtcgctagtcgcaaatgaagactttcaacacattcttcgtgtacagaacacgaatgtcgacgggaagcagaagattatgttcgctatgacctccatcaaaggtattggtcgccgttttgctaacatcgtctgcaaaaaggccgacgtcgacatgaataagagagctggagaactttcaagtgctgagatagacaatctgatgacaattgtggcaaatccacgccaattcaaaattccagactggtttttgaatagaaagaaagattacaaggatggaaagtactcacaagttacatcaaatgctcttgacatgaaattgagagatgaccttgagcggttgaagaagatcaggaaccaccgtggtcttcgtcattactggggtcttcgtgtgcgtggacagcacaccaaaaccactggtcgtcgtggaaagactgttggtgtgtcgaagaagagataagttgacgtaagtttttaaaatgaagttacagttgtgttttagacgttgttatggagcttttattgtccccagttttgaatgtttgggttaaaagttgtcttacggtaatggttatactgttgtagtcctactttctttgatgtttttgcatcatgtttttgatctcctgttagaaggacagttgtcctttcaatcggataagtgatttatatttgtat

SEQ ID NO: 2836 - DNA, 744 bp, Carpinus betulus
tccgctctctcattttgcactctcggcgatcactcaaattcacgaagagagagagagaaagagcagagaaaacccaaaccatgtcccttgtagcaaacgaggagtttcagcacattctgcgtgtgctgaatacaaatgtcgatgggaagcagaagataatgttcgccctcacctccatcaaaggtatcggtcgccgtttagccaacatcgtctgcaagaaagccgatgttgacatgaataaaagagctggtgagttgacagctgctgagcttgataacctgatggtgattgtggcaaaccctcgccagttcaagatccctgattggttcttgaacagaaagaaggattacaaggatggtaaatattcccaggttgtctccaatgctttggacatgaagctcagggatgatcttgagcgcttgaagaagatcaggaatcaccgtggtctgcgacactactggggtcttcgagtgcgtggacagcacacaaaaacaactggccgtcgtgggaagactgttggtgtctcaaagaagcgttgagattgtttctcccttactgggatgttgtgctacatgttgcaaattttattttgccctttaagatatgttggatttaggagtgtactctttatttttcgggaattatgcagtattatctagctgtctttctatacctctctggagatcttgagatttttggtatgtgatcgcattcgtcatatagtggttaaatggtcataatgga

SEQ ID NO: 2837 - DNA, 719 bp, Jatropha curcas
gagtacgcggggatctagggttttagtattttttcactcgctctgaactttgccgccgcatagagaagagaacttctctccgcatctgaaaccctagccatgtcgctggttgccaatgaagagtttcaacatattcttcgtgtcttgaacacgaacgtcgatgggaaacagaagattatgtttgcactgacctccatcaaaggtatcggtcgccgttttgccaacatcgtctgcaagaaagccgatgtcgacatgaacaagagagctggtgaactatcagctgaagagctagataaacttatggtgattgttgctaatcctcgccaattcaagattccagactggttccttaacaggcagaaggattacaaggatgggaagtactctcaggttgtatccaatgcattggacatgaaactcagagatgatcttgagaggttgaagaagatcagaaaccaccgtggtcttcgtcactactggggtcttcgagtacgcggacagcacaccaagacgactggacgcagggggaagactgttggtgtctccaaaaagcgatgatctggttctactttttttgtgttctcatattctggatcttttgagtgttcgccgtcttttcttttctttaaaagaacttagcatgtttagaattttctttttgtaatgcggatattacttgttttgtttactcatttggattcaagattctcttaaaaaaa

SEQ ID NO: 2838 - DNA, 760 bp, Actinidia deliciosa
  misc_feature (22)..(22): n is a, c, g, or t
  misc_feature (28)..(28): n is a, c, g, or t
ggttttgaggctttctctctgnccagcngcagcagttacacgccacagctcccgatctgaaaccctagccatgtcgctggtagcgaatgaagaattccagcacattcttcgtgtgcagaacacgaacgtcgatgggaagcagaaaatcatgtttgcgctgacctctatcaaaggtatcggccgtcgtttcgccaacatcgtctgcaagaaagccgatgtcgacatgaacaagagggctggtgaactctcaagtcaagaactggataacctaatgaccatcgttgcaaatcctcgccagttcaaaatccctgactggtttcttaataggaagaaggattacaaggatgggaaattttctcaggtgacatccaatgccctggacatgaagctgagggatgacttggagcgactgaagaagatcaggaaccaccgcggtctccgtcactactggggtcttagagtgcgtggacagcataccaagaccactggccgcaggggaaagactgtcggggtctccaagaagcgataatctggttttcattttcttaatggtccttgcacctagttttgtttaaagacttttcctgatactagtactttgtgttgtgtttggattgttttgctcgtaattttgatgccattttgagattctcagctaatatatcctgtttttctaccttacgacttcttggccatctgttagttttgtaggttgtagggtttaatatgaatggatttggttatgaaggtaaaaaaaaaa

SEQ ID NO: 2839 - DNA, 810 bp, Lactuca sativa
gtggtttcggagttcggactacaaatacgtttttaactcgattttagggttctttttagttctaccctgaagaaggaaagaggcagagccgtccattggagtgaattatcgcaggttttgaaaggagaaaaagcttaattgcaatacaaccatgtcgcttgtagcaaatgaagaatttcagcacattcttcgtattcaaaacacaaatgttgatggaaagcaaaaaatcatgtttgctatgacctctatcaagggtattggtcgtcgtttttcaaatattgtttgcaagaaggccgatgttgacatgaacaagagggctggtgaactctcgaatgctgagattgataatctgatgactattgttgcaaaccctcgtcagttcaaaatcccagattggtttcttaacagaaagaaggattacaaagatgggaaatactcccaggttacctctaatgcacttgacatgaagctcagagatgacttggagcgtctcaagaagatcaggaaccaccgtgggctgcgtcactactggggtctcagagtccgtggacaacacaccaagaccactggtcgcaggggaaagactgttggtgtgtccaagaagcgataagttttttactattggtgcttttttattttgtgctagcaagctgttagaatttcttatcaagagatttttggtttatgaactggtgagttgatgggttttagttttttttgttttgtcgaaatcttgagttaacttttgagttaccaaagcactaagactgattataaattatcgttctattttttgcacttcaacctgga

SEQ ID NO: 2840 - DNA, 730 bp, Tropaeolum majus
tttggtaatcgttgccgcttccagacgcttagagcttcttcgcaaacgcaaataactctttgtacaaaatgtctctggtggccaacgaagagttccagcacattttgcgtgtgcttaacaccaacgtcgatggaaagaagaagatcatgtttgctatgacctcaatcaaaggtattggaagaaggtttgccaacattgtctgcaagaaggctgatgtagacatgaacaagagggctggtgaacttacagctgccgagctcgacaatctgatggttattgttgccaacccacgtcagttcaagatcccagattggtttttgaacagacaaaaggattacaaagatgggaaatactctcaagttgtgtctaatgctttggacatgaagctaagggatgacttggaacgtctgaagaagatcaggaaccatcgtggtctgaggcactactggggtctccgtgtccgtggtcagcacactaagacaaccggccgcagaggaaagactgttggagtctcaaagaagcgttaagcttttccttttttgggtgttttacagcaaaaatattatggattagctcttcaaatgtttttcatgttggccaatttcttcaagacaatttaaatgtttttgttttgaatcctgaggacccttgagatcttaaattagctgccggtcttactcttttttcctgtcaagaatgtttacatagttatgtatggagttgtctattt

SEQ ID NO: 2841 - DNA, 883 bp, Citrus sinensis
gtgaagcaattgcatcatatataaagaacttaaaaaaccctaagctgacttctcagttggcttggctacttgctgcagcttcatctgtcgccgaagagcctctcttctcttcatcatcaatcctcacaatcgaaaatgtctctggtggcgaacgaagattttcagcacattttgcgtgtgctgaacactaacgtcgacgggaagcagaagattatgtttgctcttacttcaattaagggtattggaaggcgactggctaacatcgtttgcaagaaagctgatgttgacatgaacaagagggccggtgaactatctgctgctgaacttgacaatctcatggtcgttgttgcaaatccccgacagtttaaaatccctgattggttcttgaacagacagaaggattacaaggatggaaagtattctcaggttgtatccaatgcactggacatgaagttgagagatgacttggagcgtctgaagaagatcaggaaccaccgtggtctcaggcactactggggtcttcgtgtccgtggacaacacaccaagaccaccggtcgtcgtggaaagactgttggtgtctccaagaagcgttgagctgtcctttatcaatgttttgaacaatctatacacatgttcaggaagagtttggacttgctattgctgaacatttgcatcagacaatattagatttattttcttttctttggatgggttttaagcatttgaactgtctgtcttttatctattattttctctatggtaatatttttattcagatgttttgcaacatatatttcatctccctcttttatctcattgaattttgagctcttttgttttgtatgtattcctgaagaattaaggtgtaggtgtcttgatacga

SEQ ID NO: 2842 - DNA, 687 bp, Parthenium argentatum
catattgggcgaacacagcatctcgtaaccccagccgccatcacctgcatctccgtctgcaaccatgtcgctagtggcaaatgaagacttccagcacattctccgtgtccagaacacaaacgttgacggaaaacaaaagattatgttcgctatgacttctattaagggtattggtcgtcgttttgctaacattgtttgcaaaaaagctgacgtggacatgaacaagagggctggagaactttcaagtgctgagattgataatctgatgactattgtggcaaatccacgccaattcaaaatcccagattggtttttgaacaggaagaaggattataaggatggaaagtactcacaggtcacatcaaatgctcttgacatgaagttgagagatgaccttgaacgtttgaagaagatcaggaaccatcgtggtcttcgtcattactggggtcttcgagtgcgtggacagcacaccaaaaccactggtcgcaggggaaagactgttggtgtgtccaagaagagataagttttttcttgttttttaaggacatgctacgtttggatttagacctctcttgaatcttttctgtcatcagttttgaacattttgggttaatctgttatgtcatggttacaaatttttcttgtttttatgtcatagttgtactctcgggttttatgtgagactgt

SEQ ID NO: 2843 - DNA, 653 bp, Parthenium argentatum
ccaaatagcagctatgagtttggtagcgaatgaagatttccagcatattcttcgtgttcagaacacgaacgttgatggaaagcagaagatcatgtttgctatgacttctattaaaggtattggtcgtcgattcgcgaatattgtttgcaagaaggccgatgttgatatgaacaagagggcaggagagctttcaagtgccgagattgataatctcatgacaattgttgctaatccgagacagtttaaaatccccgactggtttcttaacagaaagaaggattacaaggatggcaagtactctcaagttacatctaacgctctcgacatgaagctcagggatgatcttgagagattgaagaagatcaggaaccaccgtggtcttcgtcattactggggtctgcgagtacgtggacaacacaccaagactacaggtcgcaggggtaagactgttggtgtgtcgaagaagcgataagctctattagtggtatttagttcgtggtggttttgttttgttatgtttgtacctgttttctttgttggtgtagggattgtttaattatgagaggttgcatattttcggattatgatataagttttgtgctttaaaaactcagatcagactgaatgttttggtttaaagtaacgtgaaacta

SEQ ID NO: 2844 - DNA, 836 bp, Capsicum annuum
gcgaacatagcagccgcaccgctgagcaggaatttgaaacccttatcatgtcgctggttgcaaatgaagattttcagcacatacttcgtgtgcaaaacacgaatgtggatggtaagcagaagatcatgttcgctatgacatcaatcaaaggtatcggccgtcgttttgctaacattgcctgtaagaaagccgatatcgacatgagcaagagggctggtgaactttctgctgctgaactcgacagcttgatggtggttgtcgctaatcctcgtcaattcaagatccctgattggtttttgaataggcagaaggattacaaggatgggaagttttcccaagtcacatcgaatgctctggacatgaagcttagggatgatctggaacgcctgaagaagatcaggaatcatcgtggtttacgtcactactggggtcttcgcgtgcgtggtcagcatacaaagaccactggtcgccggggaaagactgttggtgtctccaagaagcgataatcaccttcgcctgagccaattttgcatgttttatgcatatttctatttgatatgtgatgagatgtggtttaaatggaacttagctttatgattttgttgaatgtaatggatttttgagttctatagagagcagcatagcattgcttttgtaagaatgtattgtctgcacttgtccttgttggcaacgaatgaagttcatttttcagacattttaatcttttatttgctatgaattttttcttccatctgcttgactagttttgccatcggatgtgcattgttgtgggaaaattttcaattttatgtactctattttatggaaaaaaaaaa

SEQ ID NO: 2845 - DNA, 719 bp, Capsicum annuum
gggatacacagaataagccgccgcagcacagagcaagataaggaagaagctaagccatgtcgcttgttgcaaatgaagattttcagcacattcttcgtgtgcaaaacaccaatgtggatggaaaacaaaagatcatgttcgcattgacctccatcaaaggtattggccgtcgtttcgccaacattgcctgcaagaaagccgatatcgacatgaacaagagggctggtgaactcactgcagcagagctcgacagtgtcatggtggttgttgctaatcctcgtcaattcaaaatccctgattggtttttgaacaggcagaaggattacaaggatgggaaattttcacaagtcacctctaatgctcttgacatgaaacttagggatgatctggagcgtctgaaaaagatcaggaatcatcgtggtttacgtcactactggggtctccgagtgcgtggtcagcacacaaagaccactggccgcaggggaaagactgttggtgtctcaaagaagcgataaatcatctacttgtctgtttcagtttgttacatgctttcttttatgtgttgcaggcgatgtgtctaagatgtttcttagggattctgtattggttatgtttaaattttcggtgggttatagtttaatttcttgctttagtggcaaaatgattgctctgctatatgattaagttttgcagattgctattgaattagattgctcttg

SEQ ID NO: 2846 - DNA, 722 bp, Petunia hybrida
gagttttgttgcagcagccgcagaagaagcaaagatcccaaaacccctaaccatgtcgctggttgcaaatgaggagtttcagcacattctgcgtgtgcaaaacacaaacgtagatggtaaacaaaagatcatgtttgctatgacctctattaaaggtattggtcgtagatttgccaacattgcttgcaagaaagctgacattgacatgaacaaaagggctggtgaactttctgctgcagaactcgatagtttgatggttgttgtggcaaatcctcgccagttcaaaatcccagattggtttttgaacagacagaaagattacaaggacggaaagttttctcaagttacatctaatgctcttgacatgaagcttagggatgatctggaacgcttgaagaagatcaggaatcaccgtggtttgcgtcactactggggtcttagagtgcgtgggcaacacacaaagaccactggtcgcaggggaaagactgttggtgtctccaagaagcgataaatccctcctcccccctcccatcagttttgcttatggtattctgttttaagatgcgacaagagatatagtgttaaaggagttggcctgttattgtgtttttttggatgattttggccttattgaactattaaccgtttggtatctgtgttctttcagttttggatcttttttctctataaactttctctggttaatggctgatttcctgccg

SEQ ID NO: 2847 - DNA, 809 bp, Lippia dulcis
ccctataactgagtgataggagagcagccgtcgaagatccaacctccattctccgctgctcgaatcgaaactctagccatgtcgctggtggcaaacgaggatttccagcacattctgcgtgtgcagaacaccaacgtcgatgggaagcagaaaatcatgttcgccatgacatccatcaagggtatcggccgccgtttcgccaacatcgtctgcaagaaagccgacgttgacatgaacaagagggctggtgagctctctgctgctgagattgacggtctgatgaccattgttgcaaatcctcgccaattcaagattcctgactggttcctgaataggaagaaagattacaaggatggaaagtactctcaagtcacatccaatgccctggacatgaagctcagggatgaccttgagcgattgaagaagatcagaaaccaccgtgggctccgtcactactggggccttcgtgtccgtggacagcacaccaagactaccggtcgtaggggaaagactgttggtgtctccaagaagcgatgaacaataccttccttatttcagtttatggataatttaatttggttttaggctgttctcccatacctaagaggcttacatgtactgagtgttattcatgttttggaatgttgaagttttggactctactgtgcggtattgtcgtgtttcttgtgactaaattcgacttggtgaggaatgagtagttctgtgcttgccggtttttaatttggtgaaggcatttcatacttttataaaactgcgtctttcaatcttgtttcgtcgacgtctttttt

SEQ ID NO: 2848 - DNA, 689 bp, Lippia dulcis
aagaacaacacgccccttgcgaaaccctaaccatgtcgcttgttgcgaatgaagattttcagcacattctccgtgtgcagaacacgaatgtggatgggaagcagaagatcatgtttgccatgacctccatcaagggtatcggccgccggtttgccaacatcatttgtaagaaagccgatgtcgacatgaacaagagggctggtgaactttctgctgctgagattgatggtttgatgactattgtggcaaatcctcgtcagtttaagatcccagattggttccttaacagaaagaaggattacaaagatggaaagttttcacaggttacatctaatgccctggacatgaaactcagggatgatcttgagcgtttgaagaagatcaggaaccaccgtggtcttcgtcactactggggtctccgtgttcgtggtcagcacaccaagacaaccggacgtagaggaaagactgtcggtgtgtcgaagaagcgatagagaatttcttaattctgtttcattttgtttggttggaattttgatctgttactctgaatatttctctcttgttggcgattatagaaagacagcaatctatttcgcagaagttcatctttcatctttgggaggagtggttatcatcttgttagttaattttgcagtaaattctacacttatttgcaacacctaagtttt

SEQ ID NO: 2849 - DNA, 846 bp, Physcomitrella patens
gctctttcgctgctcgcgctttctctgcttcgtgccatcgccagccccacgctgtgcctcgcctcgctgcgtctcagccaccatgtcgctcattgcgggcgaggaatttcagcacattcttcgtgtgctgaacactaacgtcgatggacgtcagaagatcatgtttgccctgacttcgattaagggagttgggcgtcgttttgcaaacttggtgtgcaagaaggccgacgtggatatgagcaagagggccggcgaattgtctgcagccgagcttgagaacttaatggtcatcgttgccaatcctcgccagttcaagatcccggattggtttctgaacagaaagaaagaccacaaggatggtcgctactcccaggtcgtgtccaacgccttggatatgaagttgagggatgatctcgaacgtttgaagaagatcaggaaccaccgtggtcttcgtcactactggggcttgcgagtacgcggacagcacacaaagactactggacggcgtggaaggaccgtcggtgtgtccaagaagcgatagagtttttaatcttttgtctgaagggtaataaacattatctttcagcgagttaaatcgtagtgccagcaccattcacaattttacgcaattcaagcaggttctgtatgaccgacttcctaaaatcgctatcatggaggtgaagtttttgtcgatttcacaattcttttgttctggtgatattttgaatcttttgaaatccagaatcgtttgccttcacttgaagtaattattaatttcgagatgaaatgtaatgagcaaacagcagctgcatcttcttctgtttctcaactcaatgatgatttagc

SEQ ID NO: 2850 - DNA, 913 bp, Physcomitrella patens
tttctgttctaggcccctgtcgcctcagcgtttgcgccatcgccagcctttcgctacacttcgcttcttgccgaccatgtcgctgatcgcgggtgaggagtttcagcacattcttcgtgtgttgaacactaacgtcgatggacgtcaaaagattatgtttgccttgacctccattaagggagttggacgtcgttttgcgaatttggtctgcaagaaggccgatgttgacatgagcaagagagccggtgagctgtccgcggctgagcttgagaacttgatggtgatcgttgccaatcctcgccagttcaagatcccagattggtttctgaacagaaagaaggaccacaaggatggtcgctactcccaggttgtttccaacgccttggacatgaagctgagggacgatcttgagcgcttgaagaagatcaggaaccaccgtggtcttcgtcactactggggcttgcgtgtacgtggtcaacacaccaagacaactggaagacgtggtagaaccgtcggagtgtccaagaagagatagagtgtttatcatgtgttgatcccgaaggtcttatttttcgccttcctggatgtagctatttgaatacagctccatgcccaactacactctttggccgtcattgttcctgagcacttgcgtagcttgaatgcgagggttcgaaagagatttttaagagcagtcattggagtggagtaaaaaaaaaaaaagtcagatctgtgtcaaattttgttcgagtttcttaagtgtattcgagctgtgcacacttcagttgcgttgccatgcgtcctagctacccttgtcggcgagtgagatgcacttcagtttgactgaagcctgtttcgatgtcttttgttttccgaggtccttacacattggattttctcagcaaattctagg

SEQ ID NO: 2851 - DNA, 681 bp, Physcomitrella patens
ctttctctgctttgcgctttcaccatcgcccctctgtgctgcgtttccttgctgctcagtcaccatgtcgctcattgcgggcgaggagttccagcacattcttcgtgttctgaataccaacgtcgatgggcgtcagaagattatgtttgccctaacctccatcaagggagtcgggcgtcgttttgctaacttggtgtgcaagaaggctgacgtcgacatgagcaagagggccggcgagctttccgcagcagagctggagaacttaatggtgatagttgctaaccctcgccagttcaagattccagattggttcttgaacaggaaaaaagaccacaaagacggtcgctactcccaggttgtatctaatgccttggacatgaagctcagggatgaccttgagcgtctgaagaagatcaggaaccaccgtggtcttcgtcactactggggcttgcgagtacgtggtcaacacacgaagacaactggacgtcgtggaaggaccgtcggtgtgtctaagaagagatagagtattcgttatgtatcggttcggagtgttatattaaaaagtcgcagttttaatgcaactccttcctttgtcgaatgtacttgatgcagttctattcaatagtaacttaagaaaccccaactgaaataatgaattggctaaccaacatctttctggca

SEQ ID NO: 2852 - DNA, 1139 bp, Plantago ovata
tgttgaagacccttgggaaaagtcttcggggagattgtagtttggaaacgtgtggattctgagtcatggctcccagcatccatccgcccgaaaaaggccaagtatcttcaggagaaacttctactaggccacaaatatctcaagagagccttgcggaaatcctggctgctggtttcactgattcaaccagtgaggttgctcgtattgactagagagctagctagctaggtagataaatgatatattctgggtgagctcataattgtactctactgctaacctggcatgagcttcatatggtgttgatttcatagttattgtttccattttcttgaatataccattctctttttcctagttacaaaaaaaaaaaaaaacctcagcggccgaaacgaatcagagaagctctgagctcgaaaccctagccatgtcgttggttgcaaatgaggagttccagcacattcttcgtgtgcagaacacgaatgttgacggaaaacagaagatcatgttcgccttgacctccatcaagggtattggacgccgtttcgctaacatcgtctgcaaaaaagccgatattgacatgaacaagagagctggtgaactgtccaatgctgaaattgatagcttgatgacgatcgttgccaaccctcgccaatttaagatcccagattggttccttaacagaaagaaggattacaaggatgggaagttttctcaggtgacatccaatgctcttgacatgaagcttagggatgatcttgagcgtctcaagaaaatcaggaatcaccgtggtttgagacattactggggcctcagggttcgtggacagcacactaagaccactggtcgcaggggaaagactgttggtgtctccaagaagcgttagattcacctgtcttcttatttggttcgactgcacttttttgttctaaaatgtactgttttcgatgggaaatcgcattatggagagctttgggtgttctttctttggattttgtcaccaaaagtcaaatctatgtttagtttacttggatgttaagagttaattagtctgtgagccatggattttatagtttcttgttgaattatttttcttgaagaaatagtattctgctggctgatgttagtctgaatttcat

SEQ ID NO: 2853 - DNA, 955 bp, Plantago ovata
tcgactagccaagcagcagccgctcgcctgaattcctccgcagctcgatccgagaagaagctcaacaatgtctctggttgcgaatgaagagttccagcacattctccgtgtgcagaacaccaacgttgatggaaagcagaaaatcatgttcgccttgacctccatcaagggtattggccgtcgttttgccaacatcgtctgcaaaaaggctgatattgacatgaacaagagggctggtgaactctccaacgctgagatcgatagcttgatgaccattgttgctaatccccgccagttcaagattccagactggttcctcaacaggaagaaagactacaaggatggaaaattctcccaggtaacctccaatgccctggacatgaagctcagggatgatcttgagcgtttgaagaagatcagaaaccacaggggtcttcgtcactactggggcctcagggttcgtggacagcacactaaaacaactggccgcagaggaaagactgttggtgtgtccaagaagagatgaggtgcttctttgttctgtttggtcttacggagagttttgttctgtgttaggttgtcctttttcctgttctatggatcaatagctatgtttttggattaaaatatgggaaccaaactttgagtattgcctgttcttgccctttagactctaaattcacaagtgaactatgcagttgtttattattgacttaaatttttctattgtttttatggtgtaatggttcttggtaagaacgtagtgagagttttgaagtaattccatctctgttgccaaaacaccaaaacgcattgctatgatcatctttgtatcaaatgcccaaacgacgttagtaatttagtcactgttgtcatttctaatacttcgtagtaagtagttagttttgttttgttcgtctacgaccgaaccgtactactccggccccggtacccg

SEQ ID NO: 2854 - DNA, 784 bp, Populus trichocarpa
agggttttagactttgtgatttgcctccacactcaaaaagcaggcgccgcttagccaaggactcactctgtctctgaaaccctagcccatagccatggctcttgtagcaaatgaggaattccaacacattcttcgtgttctgaacaccaacgttgatggcaaacagaagattatgtttgctcttacctccatcaaaggtattggtcgccgttttgcgaacattgtctgcaagaaggccgatgtagacatgaacaagagagctggtgaactgtcagctgaggagcttgacaagcttatgacaattgttgctaatcctcgccagttcaagattccagactggttccttaacaggcagaaggattacaaagatggaaagtactctcaggttgtttccaatgcattggacatgaagctgagggatgatcttgagcgtttgaagaagatcaggaatcaccgtggtctccgtcactattggggtcttcgagtgcgaggacagcacaccaaaaccactggccgtagggggaagactgttggtgtctccaagaagcgatgatcttgttatgcagaacgggctcgtttgctttttatgcagtatttttcgcgttctaagttttttctttttcaaacaaaaaaccttaatatagcttagattgtttgcttgaattctgttgtgttttgttggttgaatgtttctctatgcattgccgctgagaagatcatatttttgtttaaatatttttccttgagattaccctttagtctttcttgtggtattctgatttct

SEQ ID NO: 2855 - DNA, 1453 bp, Populus trichocarpa
ttgtttgactgacaaggggcagaacagtccacacacattttaatctcggcaaaaaatcattctccttctccctcaaagctaactatatataaagctgtctccgcatttagggttttagactttgtgatttgcctccacactcaaaaagcaggcgccgcttagccaaggactcactctgtctctgaaaccctagcccatagccatggctcttgtagcaaatgaggaattccaacacattcttcgtgttttgaacaccaacgttgatggcaaacagaagattatgtttgctcttacctccatcaaaggtattggtcgccgttttgcgaacattgtctgcaagaaggccgatgtagacatgaacaagagagctggtgaactgtcagctgaggagcttgacaagcttatgacaattgttgctaatcctcgccagttcaagattccagactggttccttaacaggcagaaggattacaaagatggaaagtactctcaggttgtttccaatgcattggacatgaagctgagggatgatcttgagcgtttgaagaagatcagaaatcaccgcggtctccgtcactattggggtcttcgagtgcgaggacagcacaccaaaaccactggccgtagggggaagactgttggtgtctccaagaagcgatgatcttgttatgcagaacgggctctcttgctttttatgcagtatttttcgcgttctaagttttttctttttcaaacaaaaaactttaatatagcttagattgtttgcttgaattctgttgtgttttgttggttgaatgtttctctatgcattgccgctgagaagatcatatttttgtttaaatatttttccttgagattaccctttagtctttcttgtggtattctgatttctgttttctgatggagtcatatgcaagaacaaggaacataagtgtttcctgttgtgttaccaatgcaacacgacttggatgggatgtagaagctgtacgcataattggtggataatatgcaagttcaagcaaaatcttgtcaaattcttaataccagccggactgtcctaaacttacatgttgttggacaaatattggccatctcccccagcttggattgatttaaacagtcagtatgtattaggagggccgtcaacaaatcagatttgatgaatggacgggtttgtcgttttcggtggcacttgatactgaaatataagtgaactggagttgcacataacttgaaattatacttgtgtagattaggtgggcattatttgctcatttggatgtcttcaataacatggcatgcttatatggatgccccgttgcgctatttccgaatgcctttttcaatccttttctagggaaaccacgaatcagtgcgcatgtattttagggtatcggaatccaagtatgatagctaggaaattgttaaagattctgctggtgatggcttccag

SEQ ID NO: 2856 - DNA, 738 bp, Solanum tuberosum
gttgaagaagccgccgccgccgcagagaggaagattcagaagaagctagcaatgtcgcttattgcgaatgaagagtttcagcacattcttcgtgtgcaaaacaccaacgtcgatggaaagcagaagatcatgttcgccttgacctccatcaaaggtattggccgtcgtttcgcgaacattgcatgcaagaaagccgatatcgacatgaacaagagggctggtgaactcactgctgcagagcttgacagtgtcatggtggttgttgccaatcctcgtcaattcaaaatccctgattggtttttgaacaggcagaaggattacaaggatgggaagttttcacaagttacctctaatgctcttgacatgaaacttagggatgatctggagcgcctgaaaaagatcaggaatcatcgtggtttacgtcactactggggcctccgagttcgtggtcagcacacaaaaaccactggccgcaggggaaagactgttggtgtctcaaaaaagcgataaattatctacttgtcagttccagtttgttacatgctttcttttatgcgctgctggcgatatatgtctaagatgtttgttagggattatgtactggttgtgtttaaaatttcccgttggtgggttatagtttaatttcttgctttagtggcaaaaggattaggttgctgtatgatcatgttttgccgattgttcttgaattttaaattgaatgagtagttttttggatgc

SEQ ID NO: 2857 - DNA, 646 bp, Rhizophora mangle
gggtttagcggctctgccattgtatacttctgtacaattgaaatcaggcgccgcagagcgaaacagctgctccacgtcccaaaccctagccatgtcgttggttgcaaatgaagattttcaacacattcttcgtgtgctgaacacgaacgtggacggtaaacaaaagataatgtttgcccttacctccatcaaaggtatcggtcgccgtttagccaacatcgtctgcaagaaggccgatgtcgatatgaacaagagagctggtgagctatcagctgaagagctagacaagcttatggtgattgttgctaatcctcgccaatttaagattccagactggttcctcaacaggcagaaggattataaggatggaaaatactctcaggttgtctctaatgcattggacatgaagctgagagatgaccttgaacgcttaaagaagatcagaaatcatcgtggtctccgtcattactggggtcttcgagtgcgtgggcagcacaccaagactactggtcgtaggggaaagactgttggcgtgtccaagaagcgctaatctgggtcatctttggcttgttgtttgcccgctagtgctttttctgatctgttgcatgttctctcatttttgcaaacaaactttgttcttagaagg

SEQ ID NO: 2858 - DNA, 709 bp, Carthamus tinctorius
cggggaggttacagctacatcgattggaggcatttgcgatcatcagccgctaggaggaagaagaaactcaatcgcagccatgtcgttggtagcaaatgaggatttccagcatattcttcgtgtgcagaacacgaatgttgatggaaagcaaaagatcatgtttgccatgacttcgatcaaaggtattggtcgtcgtttcgctaacattgtctgcaagaaggctgatgttgacatgaacaagagggctggagaattatcgaatgcggagatcgataatctgatgacgatcgttgcaaatccccgacaattcaaaatcccagattggtttcttaacagaaagaaggattataaggatggaaagtactctcaagtcacatccaatgctcttgacatgaagctcagggatgatcttgagcgattgaagaagatcaggaaccaccgtggtcttcgtcattactggggtctccgagtacgtggacaacacaccaagaccaccggtcgtaggggaaagaccgttggtgtgtcgaagaagcgataagtgttttttcgtttttgtgttttgctgttagcatctttaaatccttcatttagaatttgggtgaagttactatggtatgtttgtacttttttgggaatttggtgttagtaggattttaaagagtttgtttacatttttgaatcattattatgagttcttttggccattttt

SEQ ID NO: 2859 - DNA, 752 bp, Carthamus tinctorius
gggaggttacattttctcgccgattacgatttccggagctccagccgccaagacctgcaactcaaactgcgatcatgtcgctggtagcaaacgaagattttcagcacattcttcgtgttcaaaacacgaatgttgatggaaagcagaagattatgttcgccatgacctccattaaaggtatcggtcgtcgttttgccaacatcgtctgcaaaaaggctgatgtcgacatgaacaagagggctggagaactttccaatgctgagattgacaatctgatgacaatcgtggcaaacccacgccagttcaaaatcccagactggtttttgaacaggaagaaagattacaaggatgggaagtactcccaggtcacatctaatgcgctcgacatgaagttgagagatgaccttgagcgcttgaagaaaatcaggaaccaccgtggtcttcgtcattactggggcctgcgtgtgcgtggtcagcacaccaaaaccactggacgcaggggtaagactgttggtgtgtccaagaagagatagatttcgaatcaaaatttacttcacattatggttttagacattttatctataaagatctcttatcaattttgaatgtttggttttaagttgttatgtcatggtaatagttgtactttctcttggatgatctttgccagtatgtctctttttggatcttatatgaggaattgacttcatttggttgattcattaattttgcattatgttttcctttagaaa

SEQ ID NO: 2860 - DNA, 833 bp, Sarracenia psittacina
cggagggtaatcccattctcttcttctcagccgccgttctccaagccacagcagctgcaaggaagagctcttggtaaccctaaccatgtctctggtatccaatgaggatttccagcacatacttcgtgtgcagaacacgaacgtcgatggaaaacagaaaataatgtttgcactgacctccatcaagggtatcggccgtcgtttcgctaacatcgtctgcaagaaagccgatatcgacatgaacaagagggctggtgaactctcaaatcaagaattggataatctgatgactattgttgcaaatcctcgccaattcaaaatccccgattggtttctaaacaggaagaaggattacaaggatgggaaatattctcaggtgacatccaatgctctagacatgaagctgagggatgacttggagcggctgaagaagatcaggaaccaccgtggtcttcgtcactactggggtcttagagttagaggacagcatacgaagaccactggccgcaggggaaagactgtgggtgtctcaaagaagcgataatctggttcttcgtttcttatggtgcttgcacctaatattcttgaatgatgtttcctgacaatagtacttatttaagagttatggtttggattctttgctcgtaatttttggcaccattttgacgttctcagctacttatattttttttgttgacgttctgacttttggtttacgtcgttaagttttagagtttaaaaccaatagatttggttttggagcctttgaatttcaaaagcattaattcttatggtgcttgcacctactattcttgaatgatgtttcctgacat

SEQ ID NO: 2861 - DNA, 881 bp, Senecio madagascariensis
aaatttagaaatgatctagtagtctttgagaatgtgttgatgttcataaggtgctttgacggaacataataatatgcagttccatcttctgaacatgattcgatgtttcacctttttgtgtgtgtctttttgagatttttagaaacagtttgttgttattgttgtattgtgatctaatttgaggttttgaagccgctcagattgtagctatgtcgcttgttgcaaatgaagatttccagcacattcttcgtgtacaaaacactaatgttgatggaaagcaaaagatcatgtttgccatgacttcgatcaagggtattggtcgtcgatttgccaacatcgtctgcaagaaggctgatattgacatgaacaagagggctggagaactttcaaatgctgatattgataatctcatgacaatcgttgctaatccccgacaattcaaaatcccagattggtttcttaacagaaagaaggattacaaggatggaaagtactcccaagtcacatctaatgcacttgacatgaaactcagggatgatcttgaacgtttgaagaagatcaggaaccatcgtggtcttcgtcattactggggtctcagagtccgtggacaacacaccaagacaactggtcgtaggggtaagaccgttggtgtgtccaagaagcgatagatctgttcgtttttctagttttggttctacaaaccccattatattcatattgtctgatttagaatgtgggggaatcgttatgttatgaaatcaaggttgtacttgtttttggatgttgatggtctcgagtttttaggattcctttttaacagttttattacattttgtgagttgcatattttcggattatgataatataaggtttttaagcaa

SEQ ID NO: 2862 - DNA, 705 bp, Sesamum indicum
atactgagtgaaagcagagcagccgtcgaagaccacagcattctccgctgctcgattccaaaccctagccatgtcgttggtggccaatgaagatttccagcacattctgcgtgtgcagaacacaaacgtagatgggaagcagaagatcatgttcgccttgacctccatcaagggtattgggcgccgtttcgccaacatcgtctgtaagaaagccgacatcgatatgaataagagggctggtgaactgtcgaatgctgaaattgacagcttgatggttattgtggcaaatccccgccagttcaaaattcctgactggtttctgaataggaagaaagactataaggatgggaaattttctcaggtgacatcaaatgctctggacatgaagctcagggatgatcttgagcgattgaagaagatcaggaaccatcgtggactccgtcactactggggccttcgtgtgcgtggacaacacaccaagactactggtcgtaggggaaagactgttggtgtgtccaagaagcgatgagcgtaaacttctatgttggttttatggataattttgtttgttttaggctacccaaatctaagaggttacatgtactgagttttattatctctgtttgtgacttttgaagtttgaactccactgttaatttttatcttgaatattgaagactcaattcgtttggaatggctggcatt

SEQ ID NO: 2863 - DNA, 768 bp, Solanum phureja
ttagggttttgggagttctgcatctcttcgccagttaacgaagcagccgcaccgcagagaaggatttgaaaccctaatcatgtcgcttgttgccaatgaagaatttcagcacattcttcgtgttcaaaacacaaatgttgatgggaaacagaagatcatgttcgctatgacatcaatcaaaggtattggtcgtcgttttgctaacattgcctgcaagaaagccgatatcgacatgagcaagagggctggtgaactcactgctgctgagctcgatagcttgatggttgttgtggcaaatcctcgtcaattcaaaatccctgattggtttttgaataggcaaaaggattacaaggatggaaagttttcacaagttacatctaatgcactggacatgaagcttagggatgacctggaacgcctgaagaagatcaggaatcatcgtggtttacgtcactactggggtcttcgtgtgcgtggtcagcatactaagaccactggtcgccgaggaaagactgttggtgtctccaagaagcgataattgccttttcctgagccaattttgcatgttttatgctaattcattttgatatgggacaagagatggtttgacagtggaacttagttttataattttgttgaatgtaatggatttttgagttctatagaacaacattgctttggaagaatgtattatctgcactagtcgtttgttactaatgaagttcaattttctacgccatcaatgaatggtctttgtttggtatgcat

SEQ ID NO: 2864 - DNA, 632 bp, Helianthus annuus
atgagtctggtagcaaatgaagattttcagcatattcttcgtgtgcagaacacgaatgttgatggcaagcagaagatcatgtttgctatgacctcgattaaaggtattggtcgtcggtttgcgaatattgtctgcaagaaggctgatgttgatatgaacaagagggcgggagaactttcaagcgctgagattgataatctgatgacaatcgttgccaatcctcgacagtttaaaatcccagattggtttcttaacagaaagaaggattacaaggatggcaagtactctcaagtcacttctaacgcccttgacatgaagcttagggatgatctcgagagattgaagaaaatcaggaaccaccgtggtcttcgtcattactggggtctgcgagtacgtggacagcacaccaagactactggtcgtcggggtaagaccgtcggtgtgtcaaagaagcgatgagcttgttttggttttagaaaatctttgtttttcatcatatttagaatgttttgttatgcttttttggatgtctgtagattctaggattcctttacaagagcatgttgttagaaagttcttatatgtttggattatgttataagttttgttaaaaagttcgtatttgtcgtaaa

SEQ ID NO: 2865 - DNA, 886 bp, Helianthus annuus
ctctggagaacgaacgaacgaacgaaagaggcaggccgccgtcctccatctcaggtatttgcataagagaagaagctcagtcgcctttcagccatgtctcttgttgcaaatgaggacttccagcacattcttcgtgtacagaacacgaatgttgatggcaagcaaaagatcatgtttgctatgacctctatcaagggtatcggtcgtcgttttgcaaatatcgtttgcaagaaggctgatgtagacatgaacaagagggctggtgagctgtctagtgccgagattgataacctgatgacaattgtggctaatcctcgccagtttaaaatcccagactggtttcttaacagaaagaaagattacaaggatggcaagtactctcaggtgacctctaacgctcttgacatgaagcttagagatgacttggagcgtttgaagaaaataaggaatcatcgtgggcttcgtcactattggggtctccgggttcgtggacagcacaccaagaccaccggtcgcaggggaaagactgttggtgtctccaagaaacgataagtttgttttcacttcttttggtttagaagatatcttcttgaacctttattttcatcgattcgaaaaggtgttatggtctttaagttttaggatttcatatgaaggaattgctgttgagttttgttctctagtttgtttgacttaaaatcatttattgggcatgttgttggggacccattttttctattttataactattaattttaagtaaaccagtttcgtatatgttatagccttgaaaacctatgcactgcctatcatctattcattgtatgtataaatccactaagagtgaaacaactcacaacgtattatcagaaccattattatgagc

SEQ ID NO: 2866 - DNA, 859 bp, Helianthus annuus
agggtttatacattttgggcgaaagcagcatctcggagcaccagccgccacaacctgcaactccgactgcaatcatgtcgctagtcgccaatgaagactttcagcacattcttcgtgttcagaacactaacgttgacggaaaacagaagattatgttcgctatgacctctatcaagggtattggtcgtcgttttgctaacattgtttgcaaaaaggctgacgttgacatgaacaagagggctggagaactttcaaatgctgagatcgataatctgatgaccatcgtggcaaatccacgccaattcaaaatccctgattggtttttgaacaggaagaaagattacaaggatggaaagtactcacaagtcacttctaatgctctcgacatgaaattgagagatgaccttgaacgtttgaagaagatcaggaaccatcgtggtcttcgtcactactggggtcttcgagtgcgtggacagcacaccaaaaccactggtcgtaggggaaagactgtcggtgtgtccaagaagagataagttttttcttgtttttgaaaacatgttacttttcgggtttagacattttcgtgaatctttattgtcatcaattttggatgcttttggttaagttgttttgtcatggttatagttgtactttttgtcgaaatggattattgatgaaagtttggtatttgttttaaaaaaacccccaacaaaaaaaaaacaaaaaaaaaaactgttgggcccgccttggcccaggtcaattttaaatccgggcaagctttatgcttgcgggcccgaatatggaccttcctttgcgccaattcgcccctttaagggggggcgttttaccaattcccggg

SEQ ID NO: 2867 - DNA, 779 bp, Helianthus annuus
acgcgggggtatcagctagggtttacagagctgtcatcgattttgagcatttcagtagccgcttgaacaacagcaaactcaaatcgcagctatgagtttggtagcgaatgaagatttccagcatattcttcgtgttcagaacacgaatgttgatggaaagcagaagatcatgtttgctatgacctctattaaaggtattggtcgtcggtttgccaatattgtctgcaaaaaggccgatgttgatatgaacaagagggcgggagagctttcaagtgccgagatcgataatctcatgacaattgttgctaatccccgacagtttaaaatcccagactggtttcttaacagaaagaaggattacaaagatggcaagtactctcaagtcacatctaatgcacttgacatgaagcttagggatgatcttgagagattgaagaagatcaggaaccaccgtggtcttcgtcattactggggtctgcgagtgcgtggacaacacaccaagactactggtcgtaggggtaagaccgttggtgtgtcgaagaagcgataagctgttatgcttcttatttagaacgtgggggtttgttatgtttgtacttgtttttggtgttggttggcgtaggattgtttaagtatgagaagttgcatatttgcggattatgatataagttttgtgctttaaaactaagagcagactaatggttttggtttaaagtaacgtgaaactagttgggtgtttatgaagttgtgttgtatcggtcctaaaacatataaccata

SEQ ID NO: 2868 - DNA, 732 bp, Helianthus annuus
cattatatagcgactgcatcttcccggagcttcagccgccgatacctgcaactccgactgtaatcatgtcgctagtcgcaaatgaagatttccagcacattcttcgtgtgcagaacacgaacgttgacggaaagcagaagattatgttcgctatgaccagtattaaaggtattggtcgtcggtttgctaatatcgtctgcaaaaaggctgacgttgatatgaacaagagggctggtgaactctcaagtgctgagatagataatctgatgacaattgtggctaacccacgccaattcaaaatcccagactggtttttgaacaggaagaaagattacaaggacgggaagtactcgcaagtcacatcaaatgctcttgacatgaaattgagagatgatcttgagcggttgaagaagatcaggaaccatcgtggtcttcgtcattactggggtcttcgtgtgcgtggacagcacaccaaaaccactggtcgtcggggaaagaccgttggtgtgtccaagaagagataaggtgttttgttttttttgaaatcaggttacgttctgggcttagacattttaatggatctttattgtcatcagttttgaatgtttgggttaaagttctcattttatggttatactgttacagtcttttatttgatgttcttgccagcatgtttttgatttcatgttagaagggagctgttgtttgaaatggataaatgatgaattttta

SEQ ID NO: 2869 - DNA, 562 bp, Helianthus annuus
atgagtctggtagcaaatgaagattttcagcatattcttcgtgtgcagaacacgaacgttgatggcaagcagaagatcatgtttgctatgacctcgattaaaggtattggtcgtcggtttgcgaatattgtctgcaagaaggctgatgttgatatgaacaagagggcgggagaactttcaagcgctgagattgataatctgatgacaatcgttgcgaatcctcgacagtttaaaatcccagattggtttcttaacagaaagaaggattacaaggatggtaagtactctcaagtcacttctaacgcccttgacatgaagcttagggatgatctcgagagattgaagaaaatcaggaaccaccgtggtcttcgtcactactggggcctgcgagtacgtggacagcacaccaagactactggtcgtcggggtaagaccgttggtgtgtcaaagaagcgatgagcttgttttggttttagaaagtctgtttttcatcatatctagaatgttttgttatgctttcttggatggcatagatcctaggattcctttacaagagcatgtt

SEQ ID NO: 2870 - DNA, 673 bp, Helianthus annuus
acagcaaactcaaatcgcagctatgagtttggtagcgaatgaagatttccagcatattcttcgtgttcagaacacgaatgttgatggaaagcagaagatcatgtttgctatgacctctattaaaggtattggtcgccggtttgccaatattgtctgcaaaaaggccgatgttgatatgaacaagagggcaggagagctttcaagtgccgagatcgataatctcatgacaattgttgctaatccccgacagtttaaaatcccagactggtttcttaacagaaagaaggattacaaagatggcaagtactctcaagtcacatctaatgcacttgacatgaagcttagggatgatcttgagagattgaagaagatcaggaaccaccgtggtcttcgtcattactggggtctgcgagtgcgtggacaacacaccaagactactggtcgtaggggtaagaccgttggtgtgtcgaagaagcgataagctgttatgcttcttatttagaacgtgggggttttgttttgttatgtttgtacttgtttttggtgttggttggcgtaggattgtttaattatgagaagttgcatatttgcggattatgatataagttttgtgctttaaaactcagagcagactaatggttttggtttaaagtaacgtgaaactagttgggtg

SEQ ID NO: 2871 - DNA, 671 bp, Helianthus annuus
agggtttatacattttgggcgaaagcagcatctcggagcaccagccgccacaacctgcatctccgactgcaatcatgtcgctagtcgccaatgaagactttcagcacattcttcgtgttcagaacactaacgtcgacggaaaacagaagattatgtttgctatgacctctatcaagggtattggtcgtcgttttgctaacattgtttgcaaaaaggctgacgttgacatgaacaagagggctggagaactttcaaatgctgagatcgataatctgatgaccatcgtggcaaatccgcgccaattcaagatccctgattggtttttgaacaggaagaaagattacaaggatggaaagtactcacaagtcacttctaatgctctcgacatgaaattgagagatgaccttgaacgtttgaagaagatcaggaaccatcgtggtcttcgtcattactggggtcttcgagtgcgtggacagcacaccaaaaccactggtcgtaggggaaagactgtcggtgtgtccaagaagagataagttatttcttgtttttgaagacatgttacttttcgggtttagacattttcgtgaatctttattgtcatcaattttggatgcttttggttgttttgtcatggttatagttgtactttttgtcgacatggattattgatg

SEQ ID NO: 2872 - DNA, 750 bp, Helianthus annuus
gcaggccgccgtcctccatctcaggtatttgcataagggaagaagctcaatcgcctttcagccatgtctcttgttgcaaatgaggacttccagcacattcttcgtgtacagaacacgaatgttgatggcaagcaaaagatcatgtttgctatgacctctatcaagggtatcggtcgtcgttttgcaaatatcgtttgtaagaaggctgatgtagacatgaacaagagggctggtgagctgtctaatgccgagattgataacctgatgacaattgtggctaatcctcgccagtttaagatcccagattggtttcttaacagaaagaaagattacaaggatggcaagtactctcaggtgacctctaacgctcttgacatgaagcttagagatgacttggagcgtttgaagaaaatcaggaatcatcgtgggcttcgtcactattggggtctccgggttcgtggacagcacactaagaccactggacgcaggggaaagactgttggtgtctccaagaaacgataagtttgttttcacttcttttggtttagaagatatcttcttgaacctttattcacatcgattcgaaaaggtgttatggtctttaagttttaggatttcatatgaagaaggaattgctgttgagttttgttctctagtttgttcgacttaaaatcatttattgggcatgttgttggggacccatttttttctattttataactattaattttaagtaaaccggtttcgtat

SEQ ID NO: 2873 - DNA, 752 bp, Helianthus annuus
gcaggccgccgtcctccatctcaggtatttgtatacgagaagaagctcaattgcctttcagccatgtctcttgttgcaaatgaggacttccagcacattcttcgtgtacagaatacgaatgttgatggcaagcaaaagatcatgtttgctatgacctctatcaagggtatcggtcgtcgttttgcaaatatcgtttgcaagaaggctgatgtagacatgaacaagagggctggtgagctgtctagtgccgagattgataacctgatgacaattgtggctaatcctcgccagtttaaaatcccagactggtttcttaacagaaagaaagattacaaggatggcaagtactctcaggtgacctctaacgctcttgacatgaagcttagagatgacttggagcgtttgaagaaaataaggaatcatcgtgggcttcgtcactattggggtctccgggttcgtggacagcacaccaagaccaccggtcgcaggggaaagactgttggtgtctccaagaaacgataagtttgttttcacttcttttggtttagaagatatcttcttgaacctttattttcatcgtttcgaaaaggtgttatggtctttaagttttaggatttcatatgaagaaggaattgctgttgagttttgttctctagtttgtttgacttgaaatcatttattgggcatgttgttggggacccatttttttttctattatataagtattaattttaagtaaaccagtttcgtat

SEQ ID NO: 2874 - DNA, 725 bp, Helianthus annuus
tagcgactacatcatcccggagcttcagccgctagacacctgcaactccgactgcaatcatgtcgctagtcgcaaatgaagatttccagcacattcttcgtgtgcagaacacgaacgttgacggaaagcagaagattatgttcgctatgaccagtattaaaggtattggtcgtcggtttgctaacatcgtctgcaaaaaggctgacgttgatatgaacaagagggctggtgaactctcaagtgctgagatagataatctgatgaccattgtggctaacccacgccaattcaaaatcccagactggtttttgaataggaagaaagattacaaggacgggaagtactcgcaagtcacctctaatgctcttgacatgaaattgagagatgatcttgagcggttgaagaagatcaggaaccatcgtggtcttcgtcattactggggtcttcgtgtgcgtggacagcacaccaaaaccactggtcgtcggggaaagaccgttggtgtgtccaagaagagataaggtgttttgtttttttgaaatcaggttacattctgggtttagacattttaatggatctttattgtcatcagttttgaatgtttgggttaaagttctcattttatggttatactgttacagtcttttatttgatgttcttgccagcatgtttttgatttcatgttagaaggaagctgttgtttgaaatggataaatgatgaattttta

SEQ ID NO: 2875 - DNA, 716 bp, Helianthus annuus
tagcgactacatcatcccggagcttcagccgctagacacctgcaactccgactgcaatcatgtcgctagtcgcaaatgaagatttccagcacattcttcgtgtgcagaacacgaacgttgacggaaagcagaagattatgttcgctatgaccagtattaaaggtattggtcgtcggtttgctaatatcgtctgcaaaaaggctgacgttgatatgaacaagagggctggtgaactctcaagtgctgagatagataatctgatgacaattgtggctaacccacgtcaattcaaaatcccagactggtttttgaataggaagaaagattacaaggatgggaagtactcgcaagtcacatcaaatgctcttgacatgaaattgagagatgatcttgagcggttgaagaagattaggaaccatcgtggtcttcgtcattactggggtcttcgtgtgcgtggacagcacaccaaaaccactggtcgtcggggaaagaccgttggtgtgtccaagaagagataaggtgttttgtttttttggaatcaggttacattctgggtttagacattctaatggatttttattgtcatcagttttgaatgtttgggttaaagttctcattttatggttaatactgttacagtcttttatttgatgttcttgccagcatgtttttgatttcatgttagaaggaagctgttgtttgaaatggataaatga

SEQ ID NO: 2876 - DNA, 743 bp, Helianthus annuus
gggtttccattattatagcgactacatcctcccggagattcagccgctagctacctgcaactccgactgcaatcatgtcgctagtcgcaaatgaagatttccagcacattcttcgtgtgcagaacacgaacgttgacggaaagcagaagattatgttcgctatgaccagtattaaaggtattggtcgtcggtttgctaacatcgtctgcaaaaaggccgacgttgatatgaacaagagggctggtgaactctcaagtgctgagatagataatctgatgacaattgtggctaacccacgccaattcaaaatcccagactggtttttgaataggaagaaagattacaaggacgggaagtactcgcaagtcacctcaaatgctcttgacatgaaattgagagatgatcttgagcggttgaagaagatcaggaaccatcgtggtcttcgtcattactggggtcttcgtgtgcgtggacagcacaccaaaaccactggtcgtcggggaaagaccgttggtgtgtccaagaagagataaggtgttttgttttttgaaatcaggttacattctgggtttagacattctaatggatctttattgtcatcagttttgaatgtttgggttaaagttctcattttatggttatactgttacagtctttttatttgatgttcttgccagcatgtttttcatttcatgttagaaggaagctgttgtttgaaatggataaatgatgaatttttatgt

SEQ ID NO: 2877 - DNA, 728 bp, Helianthus annuus
tagcgactacatcttcccggagcttcagccgccgctagatacctgcaactccgactgcaatcatgtcgctagtcgcaaatgaagatttccagcacattcttcgtgtgcagaacacgaacgttgacggaaagcagaagattatgttcgctatgaccagtattaaaggtattggtcgtcggtttgctaacatcgtctgcaaaaaggctgacgttgatatgaacaagagggctggtgaactctcaagtgctgagatagataatctgatgacaattgtggctaacccacgccaattcaaaatcccagactggtttttgaataggaagaaagattacaaggacgggaagtactcgcaagtcacatcaaatgctcttgacatgaaattgagagatgatcttgagcggttgaagaagatcaggaaccatcgtggtcttcgtcattactggggtcttcgtgtgcgtggacagcacaccaaaaccactggtcgtcggggaaagaccgttggtgtgtccaagaagagataaggtgttttgtttttttgaaatcaggttacattctgggtttagacattttaatggatctttattgtcatcagttttgaatgtttgggttaaagttctcattttatggttatactgttacagtcttttatttgatgttcttgccagcatgtttttgatttcatgttagaaggaagctgttgtttgaaatggataaatgatgaattttta

SEQ ID NO: 2878 - DNA, 674 bp, Helianthus annuus
acctgcaactccgactgcaatcatgtcgctagtcgcaaatgaagatttccagcacattcttcgtgtgcagaacacgaacgttgacggaaagcagaagattatgttcgctatgaccagtattaaaggtattggtcgtcggtttgctaacatcgtctgcaaaaaggctgacgttgatatgaacaagagggctggtgaactctcaagtgctgagatagataatctgatgaccatcgtggctaacccacgccagttcaaaatcccagactggtttttgaataggaagaaagattacaaggacgggaagtactcacaagtcacatcaaatgctcttgacatgaaattgagagatgatctcgagcggttgaagaagatcaggaaccatcgtggtcttcgtcattactggggtcttcgtgtgcgtggacagcacaccaaaaccactggtcgtcggggaaagaccgttggtgtgtccaagaagagataaggtgttgtttttttgaaatcaggttacattctgggtttagacgttttaatggatctttattgtcatcagttttgaatgtttgggttaaagttctcattttatggttatactgttacagtcttttatttgatgcatgtttttgatttcatgttagaaggaagctgttgtttgaaatggataaatgatgaatttt

SEQ ID NO: 2879 - DNA, 751 bp, Helianthus annuus
gaggcaggccgccgccctccatctcaggtatttgcataagggaagaagctcaatcgcctttcagccatgtctcttgttgcaaatgaggacttccagcacattcttcgtgtacaaaacacgaatgttgatggcaagcaaaagatcatgtttgctatgacctctatcaagggtatcggtcgtcgttttgcaaatatcgtttgcaagaaggctgatgtagacatgaacaagagggctggtgagctgtctagtgccgagattgataacctgatgacaattgtggctaatcctcgccagtttaaaatcccagactggtttcttaacagaaagaaagattacaaggatggcaagtactctcaggtgacctctaacgctcttgacatgaagcttagagatgacttggagcgtttgaagaaaataaggaatcatcgtgggcttcgtcactattggggtctccgggttcgtggacagcataccaagaccaccggtcgcaggggaaagactgttggtgtctccaagaaacgataagtttgttttcacttcttttggtttagaagatatcttcttgaacctttattttcatcgattcgaaaaggtgttatggtctttaagttttaggatttcatatgaagaaggaattgctgttgagttttgttctctagtttgttcgacttcaaatcgtttattgggcatgttgttggggacccatttttttctattttataactattaattttaagtaaaccagtttcgt

SEQ ID NO: 2880 - DNA, 665 bp, Helianthus annuus
cattttgggcgaaacagcatctcggagcaccagccgccacaacctgctactccgactgcaatcatgtcgctagtcgccaatgaagactttcagcacattcttcgtgttcagaacactaacgttgacggaaaacagaagattatgttcgctatgacctctatcaagggtattggtcgtcgttttgctaacattgtttgcaaaaaggctgacgttgacatgaacaagagggctggagaactttcaaatgctgagatcgataatctgatgaccatcgtggcaaatccgcgccagttcaaaatccctgattggtttttgaacaggaagaaagattacaaggatggaaagtactcacaagtcacttctaatgctctcgacatgaaattgagagatgaccttgaacgtttgaagaagatcaggaaccatcgtggtcttcgtcactactggggtcttcgagtgcgtggacagcacaccaaaaccactggtcgtaggggaaagactgtcggtgtgtccaagaagagataagttttttcttgtttttgaaaacatgttacttttcgggtttagacattttcgtgaatctttattgtcatcaattttggatgcttttggttaagttgttttgtcatggttatagttgtactttttgtcgaaatggattattgatg

SEQ ID NO: 2881 - DNA, 747 bp, Helianthus annuus
gcggggaggttccattattatagcgactacatcttcccggagcttcagccgccgatacctgcaactccgactgcaatcatgtcgctagtcgcaaatgaagatttccagcacattcttcgtgtgcagaacacgaacgttgacggaaagcagaagattatgttcgctatgaccagtattaaaggtattggtcgtcggtttgctaacatcgtctgcaaaaaggctgacgttgatatgaacaagagggctggtgaactctcaagtgctgagatagataatctgatgaccattgtggctaacccacgccagttcaaaatcccagactggtttttgaataggaagaaagattacaaggatgggaagtactcgcaagtcacatcaaatgctcttgacatgaaattgagagatgatcttgagcggttgaagaagatcaggaatcatcgtggtcttcgtcattactggggtcttcgtgtgcgtggacagcacaccaaaaccactggtcgtcggggaaagaccgttggtgtgtccaagaagagataaggtgttttgttttttgtaatcaggttgcattcttggtttagacattctaatggatctttattgtcatcagttttgaatgtttgggttaaagttctcatttatggttaatactgttacagtcttttatttgatgttcttgccagcatgtttttgatttcatgttagaaggaagctgttgtttgaaatggataaatgaatgaattttatgtg

SEQ ID NO: 2882 - DNA, 785 bp, Camellia sinensis
tttgaggctttgtctgtccagtcgaagttgcaagccgtcgcagcgagtaaagaaagagctttcgcagagcccgatctgaaaccctagccatgtcgctggtagcgaatgaagagttccagcacattcttcgagtgcagaacacgaacgtggatgggaaacagaagatcatgtttgcaatgacatccatcaaaggtatcggccgtcgtttcgccaacatcgtctgcaagaaagccgatgtcgacatgaacaagagggctggtgaactctcaaatcaagaaattgataacctgatgacaattgttgcgaatcctcgccagttcaaaatccctgactggtttctaaataggaagaaggattacaaggatgggaaattttctcaggtgacatccaatgcactggacatgaagctaagggatgacttggagcgattgaagaagatcaggaatcaccgtggtctccgtcactactggggtcttagagtgcgtgggcagcataccaagaccactggccgcaggggaaagactgttggtgtatccaagaagcgttaatctcactctcaagtttttatggttcttgcagctaagttttgttgaataactcttccctacattagtactcattgagagttttattattggctggattgtttgttggtaattttggtatcattctcagttacttatctatatgttttttctctacatgtttatgacttctggttgatgtggttttcttctaatttagagtttaatatgaatagatttgattttggagctgaaaaaaaa

SEQ ID NO: 2883 - DNA, 837 bp, Nicotiana tabacum
ggtatctagggttttctttggagcttggcatctctttcaaactaaagcagccgcactgtgcccaaagcagtgaaaccctagccatgtcgctggttgcaaacgaagagtttcagcacattcttcgtgtgcaaaacacgaacgttgatggaaagcagaagatcatgttcgctatgacctctatcaaaggtatcggtcgccgttttgctaacattgcttgcaaaaaagccgatatcgacatgaacaagagggccggagaactctcttctgcagagcttgacagcttgatggtggttgtggctaatcctcgccaattcaaaatcccagattggtttttgaacaggcagaaggattacaaggatggcaagttttctcaagttacatctaatgcacttgacatgaaactcagggatgatctggaacggctgaagaagatcaggaatcaccgtggtttgcgtcactactggggccttcgtgtacgtggtcagcacacaaagaccactggccgcagggggaagactgttggtgtctccaagaagagataaattatctacttgccagttcctatatgttttatgcttctctgtagtatgcggagttcgaacacttgcaagaagtttattaggtattttgtaatgtttgcactgaaattttctcgtcttgccatctcgagggttatagtagttactataaatcctctgatggcgttgcaagcattttgtttactgcgggatcaaagttatgccagttgcgcttgaattaatacattgaattgagtactttttattgagatgcatcccgttttcctaaataaatatcaagtaagaagtagctcgagac

SEQ ID NO: 2884 - DNA, 781 bp, Nicotiana tabacum
ggtatctagggttttctttggagcttggcatctctttcaaactaaagcagccgcagccgcactgtgaaagcagtgaaaccctagccatgtcgttggttgcaaacgaagagtttcagcacattcttcgtgtgcaaaacacgaacgttgatggaaagcagaagatcatgttcgctatgacctctatcaaaggtatcggtcgccgttttgctaacattgcttgcaagaaagccgatatcgacatgaacaagagggccggagaactctctgccgcagagcttgatagcttgatggtggttgtggctaatcctcgtcaattcaaaatcccagattggtttttgaacaggcagaaggattacaaggatggcaagttttctcaagttacatctaatgcacttgacatgaaactcagggatgatctggaacggctgaagaagatcaggaatcaccgtggtttgcgtcactactggggccttcgtgtacgtggtcagcacacaaagaccactggccgcagggggaagactgttggtgtctccaagaagagataaatcatttacttgccggttcctatatgttttatgcttctctttagtatgcggagtccgaacacatagaggaagtttattaggtattttgtaatgtttgcactgaaatgttcttgttttgccattgggagggttatagtctataaatcctctgatggcgttgcaagcatttgtttactgtgggatcaaagttttgccggttgcgtttgaattaatacattgaatgagtactttttatt

SEQ ID NO: 2885 - DNA, 702 bp, Tragopogon dubius
gggtttacaatttctcggctagtaggactttcacggagcacccgccgccgagacctgcaattccgactgcaatcatgtcgttggtagctaatgaagatttccagcacattcttcgtgttcagaacacgaatgttgatggaaagcaaaaaattatgtttgctatgacctcgattaaaggtattggtcgtcgtttcgccaatatcgtctgcaagaaggccgacgtcgacatgaacaagagggctggagagctttccaatgctgagattgataatctgatgacaattgttgctaatccacgccaattcaaaatcccagactggttcttgaacagaaagaaggattacaaggatgggaagtactcccaggtcacatccaatgctcttgacatgaagttgagagatgatcttgagcgtttgaagaagatcagaaaccaccgtggtctgcgtcattactggggcctgcgagtgcgtggacagcacaccaagactactggacgcaggggaaagactgttggtgtgtccaaaaagagataagtttttggatgtgtttctaaagttcttgaatttttattgtccacagttttggatgttggggttataagatgttatgttatggttataattttctagtttcttggatgtttttgttagtatgttattcagatttcatatgagaaattgttgttcgggatcaatcattgat

SEQ ID NO: 2886 - DNA, 779 bp, Tragopogon dubius
ttcggggagggttttactggctccagcgatttagagattttcatagcaacagccgcttgaagaagaaactcaaatcgcagccatgtctctggtcgcaaacgaagatttccagcatattcttcgtgtacagaacacgaatgttgacggaaagcaaaagatcatgttcgccatgacctccatcaaaggtattggtcgtcgattcgccaacatcgtctgcaagaaggccgatgttgatatgaacaagagggctggtgaactttcaaatgctgagatcgataatctgatgaccattgttgcaaaccctagacaattcaaaatcccagattggtttctgaacagaaagaaggattacaaggatggaaagtactcacaagttacatctaacgcactcgacatgaaactcagggatgatcttgagaggttgaagaagatcaggaaccatcgtggtcttcgtcattactggggtttgagagttcgtgggcagcacaccaagaccactggtcggaggggaaagactgttggtgtctccaagaagagataagtttcttggtgttccttaaaattatatttagaagaatgttatggatgtagtttttttggatgattatgatggcaagttttttggattctttatggagagtttgtttacgttgaagggtttggagatgattaatgatagacgtttttgttccaaatgttttatgtgtactttgaatacatattgtgagaagaacattatgttaaagtcttagtatgattcgtttttctattttataagt

SEQ ID NO: 2887 - DNA, 709 bp, Triphysaria pusilla
tctaacagcagagcagccatcgcactccgcttctcgtctccaaaccctaaccatgtcgctggtagcaaatgaggagtttcagcacattctgcgtattcagaacactaatgttgacggtaagcagaagatcatgttcgctatgacctctatcaagggtattggccgccgtttctccaacatcgtctgtaagaaagccgatgtcgacatgaataagagggccggtgaactctctaatgctgaaattgacggcttgatggctatcgtggctaacccacgccaattcaagatcccagactggttccttaacagaaagaaggattacaaggacggtaagttttctcaagtgacatccaacgctctcgacatgaagctcagggatgatctcgaacgtctaaagaaaatcaggaaccatcgtggtctccgtcactactggggccttagggttcgtggacagcacaccaaaactactggccgtaggggaaagactgttggagtctccaagaagcgataagcctttgttttctttctcttatttgtgttgtctctatgagtaatttatttggttttaggatggatgactattatatctaaagaggttatatgtactgagaactgtgttatctttactgttttgggggttttgaagttttgtactgcattattaaaatatttttcatggtttttgagacttatttgttaacaaaaaaaa

SEQ ID NO: 2888 - DNA, 844 bp, Nicotiana benthamiana
cttccgtatccagggttttctttggagcttggcatctctttcaaactaaagcagccgcagccgcagccgcactgtgccgaaagcagtgaaaccctagccatgtcgctggttgcaaacgaagagtttcagcacattcttcgtgtacaaaacacgaacgttgatggaaagcagaagatcatgttcgctatgacctctatcaaaggtatcggtcgccgttttgctaacattgcttgcaagaaagccgatatcgacatgaacaagagggccggagaactctctgctgcagagcttgacagcttgatggtggttgtggctaatcctcgccaattcaaaatcccagattggtttttgaacaggcagaaggattacaaggatggcaagttttctcaagttacatctaatgcacttgacatgaaactcagggatgatctggaacggctgaagaagatcaggaatcaccgtggtttgcgtcactactggggccttcgtgtacgtggtcagcacacaaagaccactggccgcagggggaagactgttggtgtctccaagaagagataaatcatttacttgccagttcctttatgttttatgcttctctttggtatgtggagtccgaacacccgcaggaagtttattaggtattttgtaatgtttgcactggaattttctagtcttgccatttggagggttatagttcctataaatcctctggcggcattgcaagcatttgtttattgtgggatcaaagttttgccggttttacgcttgaattattacattgattgagtactttttattgagatgcattctgttcttctaaataaatagcgagtaagaaatagct

SEQ ID NO: 2889 - DNA, 706 bp, Zostera marina
aaaatctttattctttcgtccggaacggcaccgcgaacccgaaaagaatagacctgaattcaaagttcccgaagtaggcggcgatggctttagttgcaaatgaggattttcagcatattctccgtgtgttgaacacgaatgtggatgggaagagaaagatcatgtacgcccttacctccatcaagggtattggacggcgttttgcaaacattgtctgtaagaaagctgatgttgacatgaacaagagggctggtgaaatatctgcagaagagcttgaaactttgatgaccattgtcgcaaatcccagacaattcaaaatcccagactggtttctcaacagaaagaaggattacaaggatggaagattctcccaagttgtttcaaatgcattggacatgaaactcagagatgatttggaacgtttgaagaagatcaggaatcaccgtggtctgagacattactggggtcttcgtgtccgcggacagcatactaagacaaccggtcgcagaggaaagactgtcggtgtttcaaaaagcgttgattattcgtttatgtgtggttttttaacttttgttctctgcttatctttgttgagtaagattttggattatgtgatattttgaagaatgatttcactttagattatttaaatctcgacatcaatacattattctgtatgcttttattttattcaaattgtttcttg

SEQ ID NO: 2890 - DNA, 840 bp, Cicer arietinum
ggcgagtgcagttaatccgatttccactatatataatgctattctccctgaaaccctaattctttcttcacgcagttggccacagcaacaaccaattctccggcggcaatcatccctgtccaagcggctaggctaagatgtctttggtggcaaacgaagaatttcagcacattttgcgtgtgctgaacactaacgttgatggcaaacaaaagataatgttcgcactcacctccattaagggtattggaaggcgatttgccaacatttgctgtaagaaggctgatgttgacatgaacaagagggccggtgaattgagtgctgcagagttggataatttgatgacagtggttgcaaacccacgtcaattcaagatcccagattggtttttgaataggaagaaggattataaggatggaaagttctctcaagttgtttccaattcacttgacatgaagttgagggatgatttggagagactcaagaaaatagaaaccaccgtggtttgaggcactactggggccttcgtgttcgtggtcagcataccaagactactggccgcaggggaaagactgttggtgtctcaaagaagcgttaagctgttatgttttggctttaagattagatgattttgtggaggctttatttaagcacaatagacatgtttcttacatcaactttgtatggttgttaaatgttgtgacaatttcaattttgtttggattgtgttaaaagtttttgattagttgaatggatattggtatttttagatgtctccttgaacatacaaataggtatttacgttggttcttaacatggaaatgctatttctcagataataat

SEQ ID NO: 2891 - DNA, 803 bp, Nicotiana benthamiana
agtgttagggttttggtagttctgcatctcttcaggagtgaacgaaacagccgcaccgcggagcagaattcgaaactgtagcaatgtcgctggttgcaaatgaagaatttcagcacatacttcgtgtgcaaaacacgaatgttgatgggaaacagaagataatgttcgcaatgacatctatcaaaggtatcggccgtcgtttcgctaacattgcctgtaagaaagccgatatcgatatgagcaagagggcgggtgagctttctgctgctgaactcgatagcttgatggtggttgtggcaaatcctcgccaattcaaaatccccgactggtttttgaataggcaaaaggattacaaggatggtaagttttcgcaagttacatctaatgctctggacatgaagcttagggatgatctggaacgcctaaagaagatcaggaatcatcgtggtttgcgtcattactggggtcttcgagtccgtggtcagcacacaaagaccactggtcgtcgggggaagactgttggtgtctccaagaagcgataatctcctttcccctgagccagttttgcatggttatgctattttgtttttatatgcagcaacaaagtttgaatggagttagctttatgattttctggaatgtattggtttgagttttatagagcagcattgcttttgaggttttgttatctacctgtcctcatttataaccgatgaagttcaactttctacacctttgatggtcattgtttgatatgcattttgtctgcgttgtctctatggaaaattttcaatgtctttagt

SEQ ID NO: 2892 - DNA, 811 bp, Panicum virgatum
gctcaacaccaacgtggatggcaagcagaagatcatgtcgcgctcacctccatcaaggggtgtcgggccgccgcttctccaacatcgtctgcaagaaggccgacatcgacatgaacaagcgggctggtgaactgaccccagatgagcttgagcgcctcatgactgtggttgccaacccccgccagttcaaggtccctgactggttcctcaacaggaagaaggattacaaggatggtaggttctcccaggtcgtttctaacgctctcgacatgaagctcagggatgaccttgagagactgaagaagatcaggaaccaccgtggtctgcgtcactactggggccttcgtgtccgtggccagcacaccaagaccaccggaaggcgtggaaagactgttggtgtgtcgaagaagagataagccccatgtcgatgcgccttgtattggcttggcctagtttgtgtcgagtacgcggacctttgtgctgtgttttgctgaaggatatgtttatctctaggattgatggtgagctgtttgggttcatgaatacttgtagcgactcctttggcgcctatgttcgttcgaagcacggattgaatttcagtgttctgtgaaaaacaatgaagttttgcctgtttggaaaaagcatcctatgtcctttcgtgggtcttttcggcaacagggttcatgagcagctgtttcgatctgtgttccaacctgctacccttaccattccaaatttttggttgttttagcaattttagatacataatttttactttgcatctaaataaacactatgtctaggtatggta

SEQ ID NO: 2893 - DNA, 708 bp, Ambrosia trifida
aaaaaaaggcagttagtccgccgtcatcggagcagtccatctcaggtgtctgcataacagaagaagctaaatcgtcttttcagccatgtctcttgttgcaaatgaggacttccagcacattcttcgtgtacagaacactaatgtcgatggcaacaaaaaatcatgtttgctatgacctctatcaagggtattggtcgccgttttgcaaatattgtttgcaaaaaggctgatgtggacatgaacaagagagccggtgaactgtctagtgctgagattgataacctgatgacaatcgtggctaatccacgccagtttaaaatcccagactggtttcttaacagaaagaaagattacaaggatggaaagtactcccaagtgacctctaatgccctcgacatgaagctcagagatgacttggaacgtttgaagaaaatcagaaaccatcgtgggcttcgtcactattggggtctccgggtccgtggacagcacaccaagactactggtcgcagggggaagactgttggtgtctctaagaagcgataagtttgtgtttcactctttttggtttagaagatatcttcttgaacctttattatcatctatttcgaaaacatattatggtctttaagttttaggatttcatatgaagaaaatgctgttgagttttgttctctagtttgtttgacttaaaatcatttatattggaca

SEQ ID NO: 2894 - DNA, 538 bp, Ambrosia trifida
agggtttccattacattaacagttagagcatatacagaatccctagccgccgataccttttactccgactgcaatcatgtcgctagttgcaaatgaggattttcagcatattcttcgtgttcagaacactaatgtagacggtaagcaaaaattatgttcgctatgacctctattaaaggtatcggtcgtcggtttgctaacatcgtctgcaagaaggctgacgtggacatgaacaagagggctggagaactctcaagtgccgagattgataatctgatgacaattgtggctaatccacgccaattcaaaatcccagactggtttttgaacagaaagaaggattacaaagacgggaagtactcccaagtcacatcaaatgctcttgacatgaaactgagagatgaccttgagcgattgaagaagatcaggaaccatcgtggtcttcgtcattactggggtcttcgtgtgcgtggacagcacaccaaaaccactggtcgtcgggggaagactgttggtgtgtccaagaagagataaggtg

SEQ ID NO: 2895 - DNA, 772 bp, Ambrosia trifida
gggagggtttccattacattagcggttagagaatatacaggattcctagccgccgataccttttactccgactgcaatcatgtcgctagttgcaaatgaggattttcagcatattcttcgtgttcagaacactaatgtagacggtaagcaaaaattatgttcgctatgacctcgattaaaggaattggtcgtcggtttgctaacatcgtctgcaagaaggctgacgtggacatgaacaagagggctggagaactctcaagtgctgagattgataatctgatgacaattgtggctaacccacgccaattcaaaatcccagactggtttttgaacagaaagaaggattacaaagacgggaagtactcccaagtcacatcaaatgctcttgacatgaaattgagagatgaccttgagcgattgaagaagatcaggaaccatcgtggtcttcgacattactggggtcttcgtgtgcgtggacagcataccaaaaccactggtcgtcgggggaagactgttggtgtgtccaagaagagataaggtgttttgttctcttaaaattatgctacattcgggttttagacagtctcatgaatttttattgttatcagttttgaatgtttgggttaaacttctcatcttatggttatgatgttttagtcgaactttctttgatgtacttgccagaatgttttcgatctcatgttagaaggaagctgttgtttgaaatggataaatgatgaatttttaatttgtgcatcttttattaaaaaga

SEQ ID NO: 2896 - DNA, 531 bp, Ambrosia trifida
ttttaggcgaacacagcatatcggaccactacccgccgccgccaccaccacccttcaactccgtcagcaaccatgtcgctagtggcaaatgaagactttcagcacattctgcgtgtccagaacacaaatgttgacggcaagcaaaaattatgtttgctatgacttcaatcaagggtattggccgtcgtttcgctaacatcgtttgcaaaaaagctgacgtcgacatgaacaagagggctggagaactttcaagtgctgagattgataatctgatgaccatcgtggctaatcctcgccaattcaaaatcccagattggtttttgaacaggaagaaagattacaaggatggaaagtactcgcaagtcacatcgaatgcccttgacatgaagttgagagatgatcttgaacgtttgaagaagatcaggaaccatcgtggtcttcgtcattactggggtctcagagtgcgtggacagcacaccaaaaccactggtcgtaggggaaagactgtcggtgtgtcaaagaagagataag

SEQ ID NO: 2897 - DNA, 730 bp, Persea americana
tagcgaacgaggaatttcagcacattcttcgtgttctgaacacgaatgtcgatggcaagcagaagatcatgtttgctctgacctccattaaaggtattgggaggcgttttgcaaacctcgtctgcaagaaggcagatgtcgacatgaacaagagggctggtgaattatctgcagcggaactggagagtctgatgactattgtggccaatcctcgccaattcaagatcccagattggttcttgaacaggaagaaggattacaaggatggcaggtattctcaggtggtttccaatgcactggatatgaagctgagggatgatttggaacggttgaagaaaatcaggaaccaccgtggtttgaggcactattggggtcttcgtgtccgtggacagcacaccaagacaacagggcgcagaggaaagactgtaggtgtctctaagaaacgctgagttctgcttatttttcttttcaagacagttacgatggatagatgattggtgagtgttcttttgagttttgagaccatttaactagtgttttaattgttattttgagccacttctatttggaagccgcttgaggataaaagagattttaagtgaaaattgccattttccatttttgcttgaacatagaagtgaactgtggttggcgaaattacaagattattgaatgagtcgttctaaatttggttgcctattaagaataaaaggaatgattccagttacct

SEQ ID NO: 2898 - DNA, 1461 bp, Cannabis sativa
taatcgtacggctaatattgaaatatgatatagaactgggtgtagggtgtaatcgtctgtctagggtttttggtttgcagcccttaacactttaaaacctatctcacaaattcctctcactcctcctccgctgcgttcctttccgctgctctcagtgagagattttacagagagagagagagagcagaacaaagtattcatcatgtctctggtagctaacgaggagtttcagcacattttgcgtgtgctgaacaccaacgttgatgggaagcaaaagatcatgtttgcccttacctcaatcaaaggtatcggtcgccgtttcgctaacctcgtatgcaagaaggccgatgtcgacatgaacaagagagctggtgaactttctgcccaagagctcgataacttgatggtaattgttgccaatcctcgccagttcaagatccctgactggttccttaacagaaagaaggattacaaggatggaaaatattcccaagtcgtctccaatgctttggatatgaagcttagggatgaccttgagcggttgaagaagatcagaaatcaccgcggtctgcgacactactggggtcttcgtgttcgtggacaacacaccaagactactggccgaaggggaaagactgtcggtgtctcaaagaagcgttgagtttgtttcttcttcagatattcaatgtttttgctgcgaatttttgctcaacaaattttacttgtttagtttatcgtatcatactaaggaacttgtgttttagtgacttatgcataatcctgcttgtctagattgcccttcacttctcatatcttctaattgactgcttgttttcattttttttatttttcttttgaggatttgatatgcggttgcattaatcatttatttgaatagattttttgtttattttaaccattttgtgtaatgctttttggttactagcttttttcaaatcattaccaattacctactgctccttagagtgtgcataaattgatacaatttaatgacaattgaaatttaaaatttagatgttcaattgtggttagattggatttgatgttattttcaaatattcaattggataggatgttggatgaggtgtttaaaaatttaatattgttgtgaaagaaagagtgcagagtggacagatttccatagagcatattgggacaaactccatgatagcggatccgctcacaaaaggattaccacccaaggtctttcatgagcacactgctcatatgggtgtagtattgcttgaggatatcatgatttagtgggagtttgtattttctttgctttatgtttgtttaagacatttatgtatttggttattttctgatcagaaatagttttcagtttattcactctgttttgttatgtttaagtttgacctcactttggtttaaggaggaccagttggaaataggcatgttcggttcacattgcatgta

SEQ ID NO: 2899 - DNA, 596 bp, Cirsium arvense
aagaacgagaagtggcggagcatcgttcctcggagtaatccatttcagttcaggtgtcagtctaagagaaggaactcaaacgaaagtgaaccatgtcgcttgtggcaaatgaagactttcagcacattcttcgtgtacagaacacaaatgttgatggaaagcaaaagatcatgtttgccatgacctccattaaaggtattggtcgtcgttttgcaaacatcgtttgcaagaaagccgatgttgacatgaacaagagggctggtgagctatctaatgccgagattgataatttgatgaccattgttgcaaatccgcgtcagttcaaaatcccagattggttttttaacagaaagaaggattacaaggatgggaagtactctcaggtcacatcaaatgcactcgacatgaagttgagagatgaccttgagcgcttgaagaaaatcaggaaccatcgtggtcttcgtcattactggggtctgcgtgttcgtggtcaacacactaaaaccactggacgcagaggtaagactgttggtgtgtccaagaagagatagatttcgttacattctggtttttagaaatctctcttttttatcaat

SEQ ID NO: 2900 - DNA, 754 bp, Cucurbita pepo
aggtaagcgttcgtttgttgcagcctctgggagaagaagcatcaggacgaagccgctcgccgtctgccgtcaaaatgtcgttggttgcgaacgaagatttccagcacattttgcgtgtgctcaacactaatgtcgatgggaagcagaagattatgttcgctcttacttccatcaaaggtattggaaggcgtctcgccaacatggtctgcaaaaaagccgatgttgacatgaacaaaagggctggtgaattaactgcggccgagctggacaatctcatggtggttgttgcgaaccccgacagttcaaaattcctgattggtttttgaatagacagaaggactacaaggatggtaagtactcacaggtggtatcgaatgctctcgacatgaagctgagagacgacttggagcgattgaagaagatcaggaaccaccgtgggctgaggcactactggggtcttcgtgtccgtggtcagcacactaagactactggtcgccgagggaagactgttggtgtctcgaagaagcgttaataatcttaatccctttcttattttgcaagcgatttttcggttggatgaagtactagatgaatgttattagtgtttgagattttgggtttggatctctttggattttggcatgggtttttgaaacctttggctcgcttatatttcatttcgctcattcatttttgctcgttataatagagattgaaatcccatttgaggtttattatttatcttctccatcat

SEQ ID NO: 2901 - DNA, 814 bp, Cucurbita pepo
atctctcctggtttttcgtgcctttcctgccgccgggaattctacgaactccttgcttctatctacattcgccatgtcgctggttgcaaacgaggattttcagcacattctgcgtgtgctgaacactaacgtggatgggaagcagaagattatgtttgctctcacttcgattaaaggtattggaaggcgtcttgctaacatggtttgcaagaaggctgatgttgacatgaacaagagggctggtgaactaactgctgcagaattggacaatctcatggtggtggttgccaatccacgacaatttaaaattcctgactggttttgaatcggcaaaaggactacaaggatgggaaatactctcaagttgtttcaaatgcattggatatgaagttgagagatgatttggagcggttgaagaagatcagaaaccaccgaggtctaaggcactactggggcctccgagtccgtggtcagcacactaagaccactggtcgccgaggtaaaactgttggtgtctccaagaagcgttgagcgtttccatgttttatgatcgagttaagtatgtggttgttgggcaaatcaagttctttggccttttagttgaacatttgagctgtactttttggaatttttatttgggatatggtatctttgttcaattttacccccttttcttctgtcttttaggctcgacaaggaaggttagtagtggcaaatggcgaaactttttatttatagaattattgtttgttaccatcaaattttgcttgaaatcagtgtgcattttatggcaaaaaaaaagaaaaaataatct

SEQ ID NO: 2902 - DNA, 791 bp, Cycas rumphii
  misc_feature (383)..(383): n is a, c, g, or t
  misc_feature (442)..(442): n is a, c, g, or t
  misc_feature (607)..(607): n is a, c, g, or t
gcgagaaccttgagaacgctttgctctggttaaagccactctgccctcgttgcttcattcgtctgtgtcacggtcgtgcgatctgctgacgctgctggactcccgaagctcttaccaacatgtccctaattgcgaatgaagattttcagcacattcttcgtgtcctcaacaccaacgttgatggacgacagaagataatgtttgctcttacctccatcaagggagtggggcgacgttttgccaatcttgtctgtaaaaaggcagacgtggatatgaacaagagagctggcgagctctcgtcaaccgagctcgagaatctgatggtgatcgttggaaatcctcgacaattcaagatccctgattggttcttgaacagaaagaangatcacaaggatggtcgttattcccaggtggtatccaatgcgctggacatgaaactcanggacgacctggaacgtttgaagaagatcaggaaccaccgtggtcttcgtcattactggggtcttcgtgtgcgtggacagcatacaaagaccactggccgcaggggaaaaactgttggtgtctcaaaaaagcgttgagtatgctatttcttgggaaacaatcaatnttgctacactttattattatttctggtggttttgggatcttggaatttcagttttaaaattctcgaggatcctcatgtattatttggccttataagaggttgatttacattttcacaaaattcaattttgtttgagaaagttcttgtaaagttgtcagtgctatgaaactttgattttggtctc

SEQ ID NO: 2903 - DNA, 722 bp, Solanum melongena
agggttttgggagtgcatctctttgccagtgaacaaagcagccgcaccgcagagcaggatttgaaaccctaatcatgtcgcttgttgctaatgaagagtttcagcacattcttcgtgtacaaaacacgaacgtcgatgggaaacagaagatcatgttcgctatgacatcaatcaaaggtattggccgtcgttttgccaacattgcctgcaagaaagccgacatcgacatgagcaagagggctggtgaactctctgctgctgaacttgatagcttgatggtggttgtggcaaatccacgtcaattcaaaatccctgattggtttttgaacaggcaaaaggactacaaggatgggaaattttcccaagttacatctaatgcactggacatgaagcttagggatgacctggaacgcctgaagaagatcaggaatcatcgtggtttacgtcactactggggtcttcgcgtgcgtggtcagcatacaaagaccactggtcgccgagggaagactgttggtgtctccaagaagcgataattgccttacctcgggccaattttgcatgttttatgctatttcctttagatatggagcaagaaatggtttgagtggaacttagctttatgattttgttgaatgtaatggatttttagagcaacactgctttggaagaatgtattatctgcacttggaccttattttttttaactaatgaagttcaatttt

SEQ ID NO: 2904 - DNA, 726 bp, Fagopyrum esculentum
cgcacatttgagagaaggcgccgagaacaggagaaggaagcggtcaaaatgtcgcttgttgcaaacgaagattttcagcatatccttcgtgtgttgaacaccaatgtcgacggtaagcaaaggatcatgtacgctctcacttcgatcaaaggtattggtcggcgattttccaatatcgtctgcaagaaagctgatgtcgacatgaacaaaagggctggtgagttatcgaatgcagatattgacaacctgatgactattgtcgccaacccaaggcaattcaagattccagattggtttctgaacagaaagaaggattataaggatggcagatattctcaggtcgtttccaatggtctcgacatgaagctcagagatgatcttgagcgtctcaagaagatcaggaaccaccgaggtcttcgtcactactggggtctcagagttcgtggacagcacaccaagacaaccgggcgtaggggaaagaccgtgggtgtgtcaaagaagcgttaaggtgtcttggcattttttgcttctatgatgttgcaagttttgctctcgtttcaattattgctatgagcactttagtaatgaaggaagataatttttcttttgccaaatttatgcactggcagcaatacttcatggaatttctttagcagttttcattttcatgaatgatgcgaggttttaatgtgctttgtgaactggaatgatcaaccaacagagcct

SEQ ID NO: 2905 - DNA, 787 bp, Flaveria ramosissima
agcattcgccgcttgaagaagaaactcaaatcgcagctatgagcctcgtatcaaatgaagattttcagcatattcttcgtgtgcagaatacgaatgttgacggtaagcagaagatcatgttcgctatgacttccatcaaaggtattggtcgtcgtttcgccaacattgtctgcaaaaaggcggatgttgatatgaacaagagggcgggagaactttctagtgctgagatcgacaatctcatgacaatcgttgctaatcctcgacaatttaagatcccagactggtttcttaacagaaagaaggattacaaggatggcaagtactctcaagtcacatccaacgcccttgacatgaagctcagggatgatctcgagagattgaagaagatcaggaaccaccgtggtcttcgtcattactggggtctgcgagtacgtggacagcacaccaagaccactggtcgtaggggtaagaccgttggtgtgtccaagaagcgataagcggtttgtttttgtttttattcacatcaggtttagatgcggggaaatttattgtgttgtgttatgttatctttttcaagagttcctttacatcatgaaaagttgcgtatttttggattatgatatatgttttgttaagcacttcttatttgctttgagtagactaatgttttgggtttagagcttgtttaaagtaacatgtaattgaaactagaggtgttcttagctagaaaattgtgatctaaaggttcggacatctctttgtcgttgaaaccgaaccagttgctata

SEQ ID NO: 2906 - DNA, 650 bp, Flaveria ramosissima
gcaaccatgtcgctagtcgcaaacgaggactttcagcacattcttcgtgtacagaacacgaacgttgatggcaaacagaagatcatgtttgctatgacttccatcaagggtatcggtcgtcgttttgccaacatcgtctgcaaaaaggccgacgtcgacatgaacaagagggctggagaactttcaagtgccgagatagacaatctgatgaccatcgtggctaatcctcgccaattcaagatcccagattggtttttgaacaggaagaaagattacaaggatgggaagtactcacaggtcacatccaatgctcttgacatgaaattgagagatgaccttgaacgtttgaagaagatcaggaaccatcgtggtctgcgtcactactggggtctccgagtgcgtggacagcacaccaaaaccactggtcgtaggggaaagactgtggtgtgtccaagaagagataagttttctatgccttcgaaaacaagctacttttgtggctttgacgttctcaagaatctttattgttatcatcaattttgaacgttttggttaagttatcattttgtggttatagttgtactttcggatttcatgtgagttactgtttttttaatggatgttttgatgaaatttggtgattttatgtg

SEQ ID NO: 2907 - DNA, 712 bp, Flaveria ramosissima
gggtttatacattccatcgactaaagcaaatcggagcaacagccgccgccacctgcaactccgacagcaaccatgtcgctagtcgcaaacgaggactttcggcacattcttcgtgtacagaacacgaacgttgatggcaaacagaagatcatgtttgctatgacttcgatcaagggtatcggtcgtcgttttgcaaacatcgtttgcaaaaaggccgacgtcgacatgaacaagagggctggagaactttcaagtgccgagatagacaatcttatgaccattgtggctaatcctcgccaattcaaaatcccagattggtttttgaacaggaagaaggattacaaggatgggaagtactcacaggtcacatcaaatgctctcgacatgaaattgagagatgaccttgaacgtttgaagaagatcaggaaccatcgtggtctgcgtcactacgtggggtctccgagtgcgtggacagcacaccaaaaccactggtcggtaaggggaaagactgttggtgtgtccaagaagagattaagtttttctatgccttacgaaaaacaagcttacttttgtggctttgacgttctcaagaattctttattgttatcatctaattttgtaacgttttggttaagttatttgttttgtggttatagttgtactttcggatttcatgtgagttactgtttttttaatggatgttttgatgaaa

SEQ ID NO: 2908 - DNA, 561 bp, Flaveria ramosissima
ttttgagcattgtgtaccattagccgcttgaagaagaaactcaaatcaccatcatgagtttggtagcaaatgaagattttcagcatattcttcgtgttcagaacacgaacgttgatggcaaacagaagatcatgtttgccatgacctccattaaaggtattggtcgtcgttttgcgaacatcgtctgcaagaaggctgatgttgatatgaacaagagggcaggagaactttctagtgcagagattgataatctgatgaccattgttgccaacccacgacagtttaaaatcccagattggtttcttaacagaaagaaggattacaaggatggcaagtactctcaagtcacatctaacgcccttgacatgaagcttagggatgatcttgagagattgaagaaaatcaggaaccaccgtggtcttcgtcattactggggtctgcgagtacgaggacagcacacaaagactactggtcgtcggggtgagaccgttggtgtgtcgaagaagcgatgagcttgtttcaattttagaagatttttattttcatcatatgtagaatgtg

SEQ ID NO: 2909 - DNA, 699 bp, Flaveria ramosissima
gggtttatacattccatcgactagagcaaatcggagcaacagccgccgccacctgcaactccgacagcaaccatgtcgctagtcgcaaacgaggactttcagcacattcttcgtgtacagaacacgaacgttgatggcaaacagaagatcatgtttgctatgacttcgatcaagggtatcggtcgtcgttttgccaacatcgtctgcaaaaaagccgacgtcgacatgaacaagagggctggagaactttcaagtgccgagatagacaatctgatgaccatcgtggctaatcctcgccaattcaaaatcccagatggtttttgaacaggaagaaagattacaaggatgggaagtactcacaggtcacatccaatgctcttgacatgaaattgagagatgaccttgaacgtttgaagaagatcaggaaccatcgtggtctgcgtcactactggggtctccgagtgcgtggacagcacaccaaaaccactggtcgtaggggaaagactgttggtgtgtccaagaagagataagttttttcatgcttttaaaagcaaactacttttgtggtttagacgttctcatgaatctttattgttatcatcaattttgaacgttttggttaagttatcatttcgtggttatagttgttactttcgtatttctatgtgagttacttgttttttgaatggatgttttgat

SEQ ID NO: 2910 - DNA, 523 bp, Guizotia abyssinica
tttactgagctgccagcaattttgagcattttgtcgcagaagaaactcaattagccgccatgagtttggtagcgaatgaagattttcagcatattcttcgtgtccagaacacgaacgttgatggcaaacagaagatcatgtttgccatgacctctattaaaggtattggtcgtcgttttgccaacatcgtctgcaagaaggccgatgttgatatgaacaaaagggccggagaactttctagtgctgagattgataatctgatgacaatcgttgcgaatcctcgacagtttaaaatcccagattggtttcttaacagaaagaaggattacaaggatggcaagtactctcaagtcacatccaacgccctcgacatgaagcttagggacgatcttgagagattggagaaaatcaggaaccaccgtggtcttcgtcactactggggtctgcgagtacgtgggcagcacacaaagacaaccggtcgtcggggtaagactgtcggtgtgtcaaagaagcgataaggttg

SEQ ID NO: 2911 - DNA, 683 bp, Humulus lupulus
gagagattttagagagagagcagaacaaagccttcatcatgtctctggtagctaacgaggagtttcagcacattttgcgtgtgctgaacaccaacgttgatgggaagcaaaagatcatgtttgcccttacctccatcaaaggtattggtcgccgtttcgctaacctcgtctgcaagaaggccgatgtcgacatgaacaagagagctggtgaactttctgcccaagagcttgataacttgatggtaattgttgccaatcctcgtcagttcaagatccctgactggttcctcaacagaaagaaggattacaaggatggaaaatattcccaagtcgtctccaatgctttggatatgaagcttagggatgaccttgagcggttgaagaagatcagaaaccaccgtggtctgcgacactactggggtcttcgtgtgcgtggacagcacaccaagactactgggcgaaggggaaagactgttggtgtctcaaagaagcgttgagtttgtttcttcttggatatcaatgttttgctgcgaatttttgctccacaatttacttgtttagtttaccatatcattgtaaggaacttgtgtttttggtgacttgtgcaatatcctgtatgcctaggtggccccttcttctaattgactgcttgtttttatttttttattttaattttgaggatt

SEQ ID NO: 2912 - DNA, 835 bp, Lactuca sativa
ggcgatctagggtttacgattctcggctattagaacttccggagcaccagccgccgatacctgcaattccgactgcaataatgtcgctggtagcaaacgaggagtttcaacacattcttcgtgtccagaacacaaacgttgatggcaagcagaagattatgttcgctatgacctcaatcaaaggtattggtcgtcgttttgccaacatcgtttgcaagaaggcagatgtcgacatgaacaagagggctggagaactttcaaatgctgagattgataatctgatgacaatcgtggccaatccaagacaattcaaaatcccagactggtttttgaataggaagaaggattacaaggatgggaaatattcccaggtgacatccaatgctcttgacatgaagttgagagatgaccttgagcgtttgaagaagatcagaaaccaccgtggtcttcgtcattactggggtttgagagtgcgtggacagcacaccaagactactgggcgcaggggaaagactgttggtgtgtcaaagaagagataagttattgtttttgttttcagcagttttggatgtttggggttatgtcatggtgttataattttactatcttggatgatgtttttgttagtctgtttttcagatctcatttgagaaattgttgttccggatatatagattattgatgaattttggcttttctctgatttacatattactcgtcaagttgcatattcatattaaagctcatggtattatgtattcatgttagcgtgaagaaacaaagtcatgattacaaaacttggttaaaaattatctacgtattggttctaaccgaa

SEQ ID NO: 2913 - DNA, 891 bp, Lactuca sativa
gttcgggccatataattgaacaagcccaatacccgattgaatacaatataaaccaccacaaccctccctcaattagggttttactggctgcagcgatttggagaatttcgtcgcatcaacgtcttgaagaagaaacccaaatcgcagccatgtctctggtagcaaatgaagatttccagcatattcttcgtgtacagaacacgaatgttgatggaaagcaaaaaatcatgttcgctgtgacctccattaaaggtatcggtcgtcgattcgcaaacattgtctgcaagaaggccgacgttgatatgaacaagagggcgggagaactttcaaatgctgagattgataacctgatgacaattgtcgcaaatccaagacaattcaaaatcccagattggtttcttaacagaaagaaggattacaaagatggaaagtactctcaagtcacatctaatgcactcgacatgaagctcagggatgatcttgaacgattgaagaagatcaggaatcaccgtggtcttcgtcattactggggtctccgagtacgtggtcaacacaccaagactactggtcgtaggggaaagactgttggtgtgtccaagaagagataagtgtgttttttatttttgtttttgggaaatcccttaaaattgttatttgcatcagatttagaatattattatgattgtggggtaaaagttgttatgttatggctgtattttttttggattctttatcgaagaggtttttattttatacatttaagggttgattgtaatgagtgaatgtgataagacctttttttcccccgatgtgcacttctacaaaatagatgggttaagtttgaactgggcctccgttattgacccaaacatggcccaaaattttaaccgg

SEQ ID NO: 2914 - DNA, 747 bp, Lolium multiflorum
ggctcgccccgcagctgcagacgatccctcgctccgccgccgccgccaccctcctccagcgagagctccgatcaccgccgtcgccatgtcgctgatctcgggtgaggagttccagcacatcctgcgtgtgcagaacaccaacgtcgatggcaagcagaagatcatgttcgcgctcaccgccatcaagggtatcgggcgtcgctactccaacatcgcctgcaagaaggccgacatcgacatgaacaagagggctggtgagctcactactgaagagcttgaccgtgtcatgcacgtggtgcaaaaccctcgctcgttcaaggtccctgactggttcctgaacaggaagaaggattacaaggatggcaagttctcccaggttacttccaatgccgttgacatgaagctgagggatgaccttgagaggctgaagaaaatcaggaaccaccgtggtctgcgtcactactggggtgtccgtgtccgtgggcagcacaccaagaccaccggcaggaggggaaagactgttggtgtctcgaagaagagataaacctgatgcccatcagtctctgcatgctggcttatctttgttgtctcaaaccctcgtcctggacagttttgttggggtttctatttggatgtctcttattataagtcatggtctgctctggtttacggtactctgagcgtcattagctatgagtcttgtttgtggattcagttatctgttttctgaatggagatagtttattt

SEQ ID NO: 2915 - DNA, 795 bp, Lotus japonicus
gggaggtttaagcttgagacagagagaagaagagccgcagtgccgccgcgccaatctactcagagcagcaatcgttctctgaatctctgccttcaacatgtctcttgtggcgaacgaggatttccagcacattctgcgtgtgttgaataccaacgttgatgggaaacagaagatcatgtttgctctgacctccatcaagggtattggaaggagattcgccaacatctgttgcaagaaggctgatgtcgacatgaacaagagagctggtgagttgagtgctgcggaattggacaatgtgatgactgttgttgccaatcctaagcaattcaagatcccagattggttcctcaacaggaagaaggactacaaggatggcaagtaccatcaggttgtctccaatgccctcgacatgaagctcagggatgatttggagaggctcaagaaaatcaggaatcatcgaggtttgagacactactggggtcttcgagtgcgtggccagcataccaagactactggtcgtaggggtaaaacggttggtgtctcaaagaagcgctgagttctcatttcctatatttttctttctttttgtttcggaagagtgagatgtgttgtttggacaaaattttattttgataatgcatccggattttgttgaaattgaatgtggattgtggtcaggtttgttgatgtgatttctatatagacgtgttgtttttaaatctttttgtgatggaagctattttcgtttcaattaactgtctatggccaaatctaaagcaagattagtgttgatta

SEQ ID NO: 2916 - DNA, 719 bp, Marchantia polymorpha
cacgaagctggctccccggaagtggcagcagcggagcttcacaactttctcgtaattcctccccctgacgtgcagccgtttgccgcgactggaaaatttacaccatgtcgctcattgccggtgaggagttccaacacattcttcgtgttttgaacacgaatgtcgatggcaggcaaaagatcatgtttgctctaacctccatcaagggagttgggcgtcgattcgccaatctagtctgcaagaaggctgatgtcgacatgagcaagagagccggagagctttccgcagcggagcttgagaatttgatggttattgtcggtaaccctaggcagtttaagattcccgactggttcctgaacaggaagaaggaccacaaggatggtcgttactcacaggtcgtgtccaatgccctcgacatgaaattgagggacgatcttgagcgactcaagaagatcagaaaccaccgaggtttgcgtcactactggggtctccgtgtgcgtggacagcacaccaagaccactggacgtcgtggaagaactgtcggtgtgtcgaagaagcgatagaagtgttgatatatacaaattttgcatcttatcaaatgtaaacccgcaatacacaggtgttgaagtcctggtactgcttgaatgcatcactcgagaatgtggatacctattgagccttggtctaatttttcgcccacggggatatgttccattcac

SEQ ID NO: 2917 - DNA, 1020 bp, Marchantia polymorpha
ctcgtcgttctcgctctttttcgtgtcctcgaagctcgaagcggttcacgcgctctctcgttctgaagaattccgcctgtagacggaggagattccttcatcatgtcgttgatagctggggaagaatttcagcacattcttcgtgtgctgaacacaaatgtcgacgggaggcagaaaattatgttcgctctgacctctatcaaaggtgtgggtcgtcgttttgccaacctcgtctgcaagaaggcagatgttgacatgagcaagagggctggagagctttcagctgcagagctggagaacttaatggtcatcgtcggtaacccaaggcagttcaaaatcccagattggtttttgaacagaaagaaagaccacaaggatggtcgatactcgcaagtagtgtcgaatgctctcgacatgaaactcagagatgatctggagcgactgaagaagatcaggaaccaccgtggtctccgacattattggggcctgcgtgtgcgtggtcagcacacaaagaccactggtcgtcgcggaagaacagtcggtgtgtcgaagaagcggtagggtctttgtctgatgtagggaacttcaaacgtgaatccttcaacactgtgcactggccttcaattcagaccactaaccatgctgggtctacggaggtcatcacagtagttatcttcaaaatagataattttcttagtcgggaaggataccaggtccgtattacctgctgcgccaaactttcttcttgaaggaggtttcggaatatttattctgcgcgacgctgctcgtgggggaaagcagtaattcaaattcgtctgcagcagtctcgactattccagatctactgctgtagaaaattttcctgagaatgttcggttctttcatcacctcctgtcgcagatttcttccacaggaaacaaatgtacaagcaatggacctagacggccttgacagtggaaggttctgtcctactgtgttatgtagcttaccaaattcggtgtcatttttttccaaaaaaaa

SEQ ID NO: 2918 - DNA, 956 bp, Mimulus guttatus
aacaggttgcgagatctaacggagtgagagcccccccccaacgctcagtgaagaacgcagcccaaattcgaaaccctagccatgtcgctggtagcaaatgaggagtttcaacacattctgcgtatacagaacacaaatgtagacggaaagcagaagatcatgttcgccatgacctccatcaagggtatcggccgccgttttgccaacatcgtctgcaagaaagccgatgtcgacatgaacaagagggctggagagctatcgaatgctgaaattgacagcttgatggttattgtggcgaacccacgtcagttcaagatcccagactggttcttgaacagaaagaaggattacaaggatggcaagttttctcaagttacatccaatgctttggacatgaagcttagggatgatctcgagcgccttaagaagatcaggaatcaccgtgggcttcgtcactactggggtcttcgtgtgcgtggacagcacaccaagaccactggtcgcaggggaaagactgttggtgtctccaagaagagatagatcgtttttgtctttctatattattactactatggagataactttatgttttgcgttagctgccctttatctattatgatattatatgtactgagttcggtgatccttcgtgttttggattcaatttttggatattaattttgttaagtcttgtctgtcttggttttacaaagtaccttttgctaaaggatcaatgagtttgaaacattatttaccattttttgttggtcggatggttttgcattttgggttcgatttttattgatcaagtatattcgatttagcttgaaggaatgttttcttattccttttttcaatttaagtttaggatttgatggtaatttgtgtcaccaaggtcttagtataactgcaggatgccgaatgagggttaatggatagaatgttattttttccct

SEQ ID NO: 2919 - DNA, 1004 bp, Mimulus guttatus
aacaggttgcgagatccaacggagtgagagcccccacccaacgctcagtgaagaacgcagcccaaattcgaaaccctagccatgtcgctggtagcaaatgaggagtttcaacacattctgcgtatacagaacacaaatgtagacggaaagcagaagatcatgttcgccatgacctccatcaagggtatcggccgccgttttgccaacatcgtctgcaagaaagccgatgtcgacatgaacaagagggctggagagctatcgaatgctgaaattgacagcttgatggttattgtggcgaacccacgtcagttcaagatcccagactggttcttgaacagaaagaaggattacaaggatggcaagttttctcaagttacatccaatgctttggacatgaagcttagggatgatctcgagcgccttaagaagatcaggaatcaccgtgggcttcgtcactactggggtcttcgtgtgcgtggacagcacaccaagaccactggtcgcaggggaaagactgttggtgtctccaagaagagatagatcgtttttgtctttctatattattactactatggagataactttatgttttgcgttagctgccctttatctattatgatattatatgtactgagttcggtgatccttcgtgttttggattcaatttttggatattaattttgttaagtcttgtctgtcttggttttacaaagtaccttttgctaaaggatcaatgagtttgaaacattatttaccattttttgttggtcggatggttttgcattttgggttcgatttttattgatcaagtatattcgatttagcttgaaggaatgttttcttattccttttttcaatttaagtttaggatttgatggtaatttgtgtcaccaaggtcttagtataactgcaggatgccgaatgagggttaatggatagaatgttattttttccctaatctcttgaactctaaatatgtgacattggacgtatgtttgaaaatg

SEQ ID NO: 2920 - DNA, 721 bp, Tropaeolum majus
ttgctgcttaagagtcgcgaagagccttttctctccgccgcattcctccataatgtctctggttgctaacgaagaatttcagcacattttgcgtgtgctgaacaccaatgtcgatggtaagaagaatataatgtttgctatgacctccatcaagggtattgggaggcgatttgccaacattgtctgcaagaaggctgatgttgatatgaccaaaagagctggtgagttgactgctgctgagctcgacaatcttatgacaattgttgcaaatccccgtcagttcaaaatcccagactggtttctgaacaggcagaaggactacaaggacggaaagtattctcaggttgtctccaatgcattggacatgaagctgagagatgatttagagcgtttgaagaagatcaggaaccatcgtggtttaaggcactactggggtcttcgtgtccgtggtcagcacactaaaaccactggtcgcagaggaaagactgttggtgtctcaaagaagcgttaaggaattcattttcagtgtttttactagaaatttttgtatgtgttcattaggttttccaatggtcattattatatgagaattttgatttcatttcagttataaatggattgagttttgacaactttaaagttatgaaacgtaagcacattttgattagtttaaagacatttagagttttttccttctcctttaatcaatctataggtactt

SEQ ID NO: 2921 - DNA, 783 bp, Nicotiana benthamiana
gtagggttttgagctcacatctcttgaatacagaagaagccgccgccgcacagagcaagatttgaaacctagcaatgtcgctcgttgcaaatgaagaatttcagcacattcttcgtgtgcaaaacaccaacgtcgatgggaagcaaaagatcatgttcgctttgacctcaatcaaaggtatcggtcgtcgttttgccaacattgcctgcaagaaagctgatatcgacatgaacaagagggcgggagaacttactgctgcagagcttgacagtgtgatggtggttgttgcaaatccccgtcaattcaaaatacctgattggtttttgaataggcagaaggattacaaggatgggaagttttcacaagttacctctaatgctcttgacatgaagcttagggatgatctcgagcgcctgaagaagatcaggaatcatcgtggtttacgtcactactggggtctccgagtgcgtggtcagcacacaaagaccacagggcgcagggggaagactgttggtgtctccaaaaagagataaatcatctacttgttcagtttgttatgtgctttctctttatgtgctccgggcgatacatgtttaagatattttaggggattttgtgttggtatgcttaaattttcctttccgttggtggattacagtataatttttttccatagtgacaaggatttctctgctttatgatctaggttttgcagaatgatcttgaattaaattgaatgagtatttccttaaatatactctgttctttcgactgtttgaatga

SEQ ID NO: 2922 - DNA, 639 bp, Nicotiana benthamiana
ggggagggttttgagctcacatctcttgaatacagaagaagccgccgccgcacagagcaagatttgaaacctagcaatgtcgctcgttgcaaatgaagaatttcagcacattcttcgtgtgcaaaacaccaacgtcgatgggaagcaaaagatcatgttcgctttgacctcaatcaaaggtatcggtcgtcgttttgccaacattgcctgcaagaaagctgatatcgacatgaacaagagggcgggagaacttactgctgcagagcttgacagtgtgatggtggttgttgcaaatccccgtcaattcaaaatacctgattggtttttgaataggcagaaggattacaaggatgggaagttttcacaagttacctctaatgctcttgacatgaagcttagggatgatctcgagcgcctgaagaagatcaggaatcatcgtggtttacgtcactactggggtctccgagtgcgtggtcagcacacaaagaccacagggcgcagggggaagactgttggtgtctccaaaaagagataaatcatctacttgttcagtttgttatgtgctttctctttatgtgctccgggcgatacatgtttaagatattttaggggattttgtgttggtatgcttaaattttc

SEQ ID NO: 2923 - DNA, 775 bp, Nicotiana benthamiana
tagggttaggagcttacatctcttgaatacagaagaaaccgtcgccgcacagagcaagatttgaaacctagcaatgtcgctcgttgcaaatgaagaatttcagcacattcttcgtgtgcaaaacaccaacgtcgatgggaaacaaaagatcatgttcgctttgacctcaatcaaaggtatcggtcgtcgttttgccaacattgcctgcaagaaagctgatatcgacatgaacaagagggcgggagaacttactgctgcagagcttgacagtgtgatggtggttgttgcaaatccccgtcaattcaaaatacctgattggtttttgaataggcagaaggattacaaggatggaaagttttcacaagttacctctaatgctcttgacatgaagcttagggatgatcttgaacgcctgaagaagatcaggaatcatcgtggtttacgtcactactggggtctccgagtgcgtggtcagcacacaaagaccacagggcgcagggggaagactgttggtgtctccaaaaagagataaatcatctacttgccagtttcagtttgttatgtgctttctctttatgtgctccgggcgatatatgtttaagatattttaggggattttgtgttggtatgcttaaattttcttttccgctggtggactacagcataattttgttcgatggtgacaaggatttctctgctttatgatctaggttttgcagattgctcgtgaattaaattgaatgaatagttccttaaatgcactctgtttctttcc

SEQ ID NO: 2924 - DNA, 760 bp, Nicotiana benthamiana
gagcttacatctcttgaatacagaagaaaccgtcgccgcacagagcaagatttgaaacctagcaatgtcgctcgttgcaaatgaagaatttcagcacattcttcgtgttcaaaacaccaacgtcgatgggaaacaaaagatcatgttcgctttgacctcaatcaaaggtatcggtcgtcgttttgccaacattgcctgcaagaaagctgatatcgacatgaacaagagggcgggcgaacttactgctgcagagcttgacagtgtgatggtggttgttgcaaatccccgtcaattcaaaatacctgattggtttttgaataggcagaaggattacaaggatggaaagttttcacaagttacctctaatgctcttgacatgaagcttagggatgatcttgaacgcctgaagaagatcaggaatcatcgtggtttacgtcactactggggtctccgagtgcgtggtcagcacacaaagaccacagggcgcagggggaagactgttggtgtctccaaaaagagataaatcatctacttgccagtttcagtttgttatgtgctttctctttatgtgctccgggcgatatatgtttaagatattttaggggattttgtgttggtatgcttaaattttcttttccgctggtggactacagcataattttgttcgatggtgacaaggatttctctgctttatgatctaggttttgcagattgctcgtgaattaaattgaatgaatagttccttaaggaatttaaaaaa

SEQ ID NO: 2925 - DNA, 752 bp, Petunia hybrida
cgcggggtagggttttgagctcgcatctcttgtatacagaagaagccgccgcacagagctagatttggagcttaaccatgtcgctagttgcaaatgaagagtttcaacacattcttcgtgtgcaaaacacaaacgttgatggaaaacaaaagatcatgtttgctttgacctctattaaaggtattggtcgtcgtttcgcaaacattgcttgtaagaaagccgatatcgacatgaacaagagggctggtgagcttactgctgcagagcttgacagtgtgatggtggttgttgcaaatcctcgtcaattcaaaatccctgattggtttttgaataggcagaaggattacaaggatgggaagttttcacaagttacttctaatgctcttgacatgaagctcagggatgacctggaacgcctgaaaaagatcaggaatcaccgtggtttacgtcactactggggcctccgagtccgcggtcagcacacaaagaccactggtcgcagggggaagactgttggtgtctcgaaaaagcgataaatcatctacttgccagtttcagtttgttacatgctctctctttatgtgcttctagctatatatgtcttaagatgtttgctagggattttgtactgattttgctgaagttctcttgcctgttgggttatatttgagtttctttggtagtgggcatagcattgccttgctgtatgatcagatttttgcgtattgctcttgaatttaattgaatgagta

SEQ ID NO: 2926 - DNA, 872 bp, Physcomitrella patens
actgctctctcttaacggggtgttgctctttctctggctcggcctggacatttacagttctgcgcctccgccttcctcaagttcctcgacgtgcgttggcacagagtagcaaccatgtcgctcgttgcgggtgaggagttccaacatattcttcgtgtgctcaacacgaacgtcgatggacgtcagaagatcatgtttgccctgacctccattaagggggttgggcgtcgttttgccaacttggtttgcaagaaggccgatgtcgacatgagcaagagggctggcgagctctccgcagctgagctcgagaacctgatggtcatcgttgctaaccctcgtcaattcaagatcccagactggttcttgaacaggaagaaagaccacaaggacggtcgctactcccaggttgtttcaaacgccttggacatgaagctgagggacgacctcgagcgactgaaaaaaatcaggaatcaccgtggtcttcgtcattactggggcttgcgcgtgcgtggtcaacacaccaagactaccggacgacgtggaagaaccgttggtgtgtccaagaagcgttagattgcttcttattaatttttgtcgatgtagtgggttttgatcaccctttccgaagtaaaactttagtgctgcaacattcccaattttcaatattacacgctggttgcttgtaaatcagattttgtgatttttccatcatgaatgtgagggttccgagagcgactgtgtcattcttttctcattttctcctcctttctttgtttagtaatctgagtttgtatacccctgaagtggacctcaagcaacataggtctggctttctttgcgaacatggaatagagaaaaagctagttaaaaat

SEQ ID NO: 2927 - DNA, 748 bp, Podocarpus macrophillus
gctgttcaacaacaatttttctgcgaaaatgtcgctcatagcgaacgaagaatttcagcacattcttcgtgtgctgaacactaacgttgatgggcggcagaagataatgtttgctctcacatcgatcaagggtattggccgccgttttgccaatatcgtctgcaagaaggccgatgttgatatgaacaaaagggctggtgagctatccgcccaggaattggaacaactgatgacaatagtagccagccctaggcagttcaagatcccagattggtttctcaacaggaagaaggatcacaaggacggaaagtactctcaggtggttgccaatgcccttgacatgaagctcagggacgacttggaacgcctcaagaagatcaggaatcaccgtggtttgaggcactactggggccttcgggtgcgtggacagcacacaaagaccactggtcgcagagggaaaactgttggtgtctcaaagaaacgttaatttcgacattaagtactttcatgttttttggtaggttctgtcacagcttcaggtccaaatgttttacattttgggctttaagctatgattccatttttcctataacttgaggagctgttgataatttctatgggtcctttatatatttcagcatacaaacatgtttgagaattttcatgaacaaccgagaatcataatagttatctgacgtttagttaggcaaagctattatatttgtttcccaatgagtttgatggcaac

SEQ ID NO: 2928 - DNA, 633 bp, Primula obconica
cagctgcagatcttaaacatgtctttggtagcaaatgaagagtttcagcatattctgcgtgtgcaaaatactaatgtggatggcaagcagaagattatgttcgctatgacctcaatcaaaggtatcgggcgtcgtttcgccaacatcgtctgcaagaaggccgatgttgacatgaacaagagggctggtgagctttcttctcaggagatcgataacctgatgacgattgttgccaatccacgccaattcaacattccagactggtttctaaacaggaagaaggattacaaggatggaaagttttctcaggtcacatccaatgccctcgacatgaagctcagagatgacttggagcgtttgaagaagatcaggaaccaccgtggtctccgtcactactggggtctgagggtgcgtgggcagcacaccaagaccactggccgcaggggaaagactgttggtgtctccaagaaacgttaagcttttatcgagtttctctttttgtttggcaacttgttcggttttgcctagacctttcgagtctttacttatttactagtttggacgtctttttgaattatggttgtttgatcagttgaaagatttaacttttgtctatgttctatatcattactt

SEQ ID NO: 2929 - DNA, 659 bp, Primula obconica
aattcacagccgcccaagcagcagatcgaactccaaacccaaagccatgtcgttggtagcaaatgaggagtttcaacacatactgcgtgtgcagaatacaaatgtggatggcaagcagaagattatgtttgccatgacttccattaagggtatcggtcgccgtttcgctaacatcgtctgcaagaaggctgatgttgacatgaacaagagggctggtgagctttcatcccaggagattgataacctgatgaccattgttgccaatcctcgtcaattcaacattccggactggttcctgaacagaaagaaggattacaaagacggaaagttttctcaggtcacatccaatgcccttgatatgaagctcagggatgacttggagcgtttgaagaagatcaggaatcaccgtggtcttcgtcactactggggtctcagggtgcgtgggcagcataccaagaccactggccgtaggggaaagactgttggtgtctcgaagaagcgataaactgttgtcaaattctctttctgatttttctaattagttttgttttggtttaaagacatttttgagtttgttacttgttcaagagttttgactaatgacatttggtgaaattatggttgtgttattgttatgaggatgatctgtttgcctatca

SEQ ID NO: 2930 - DNA, 809 bp, Primula obconica
tctctccggctgcgtaaattagggtttgagaactatcagctgcagatcgtaaccatgtctttggtggcaaatgaagagtttcagcatattctgcgtgtgcaaaatactaatgtggatggcaagcagaagattatgtttgctatgacctcaatcaaaggtatcgggcgtcgtttcgctaacatcgtctgcaaaaaggccgatgttgatatgaacaaaagggctggtgagctttcttctcaggagatcgataacctgatgaccattgttgccaacccacgccaattcaacattccagactggtttctgaacaggaagaaagattacaaggatgggaaattttctcaggtcacatccaatgccctcgacatgaagctcagagacgacttggagcgtttgaagaagatcaggaaccaccgtggtctccgtcactactggggtctgagggtgcgtgggcagcacaccaagaccactggccgcaggggaaagactgttggtgtctctaagaaacgttaagcttctatcgatgttgtctttttgtctggcaacttgttcgactttttgcgtagacctttcgtggttcttacttatctactagtttggacgtatttctgaattatggttgtttgatgatctgttgaaagattaaacttttgtctatgttctatatcattacttctcggttgttttggctcgtcgaacgatatggtcatttatttgagttcagtacttaaccttgaacaagttgtttggaaggtcattatgtgcttgtttttgtggtcaagtgatgatgctgcttgatgctctgataa

SEQ ID NO: 2931 - DNA, 710 bp, Pteridium aquilinum
tttaagcttcgttggtctgcatcggtgtggtctttttgcgtattgttctgaaggcatccctgaagcaatccgcgggcgactctctacaggcgaagatgtcgctcgtagcaaacgaggagtttcagcacattttgcgtgttctgaacaccaatgttgatggacgtcagaagatcatgttcgccctaacatccattaagggtattggtcggcgatttgcaaacctcatttgtaagaaagcggatgtggatatgaacaagagagctggtgagctttcggctcaagagttagagaacctcatgttcattgttgcaaaccccagacaattcaagatccccgactggttcctgaataggaagaaggattacaaggatggacgcttctctcaagtagtgtccaatgctctggatatgaagctgagagatgaccttgaaaggctgaagaagatcaggaaccatcggggtcttcgccactactggggcttacgtgtacgtggacagcacaccaagaccacaggcaggcgtgggagaactgttggtgtgtctaagaagcgttaagctaggcctgaacatcaaggattgctttatgccccaaatgcattgccttgcaattttggtcccagtctcttgttaactcctgcagacagattttgtggttctaatttttgttatcggtttcactaagacatttcaaatagtaaaaaagaaaaaagc

SEQ ID NO: 2932 - DNA, 737 bp, Pteridium aquilinum
agaatactaagtttacacttacaccgtgatactcaatcaacgtgaacagcatttagggtttctcgtggtctgcccgagcgaccaagttctctcgcgatcctgctgctgctcaacatgtcacttgttgcaaatgaagaattccagcatattctgcgtgtactcaacaccaatgtcgatggacggcaaaagatcatgtttgcgttgacttccataaagggtattggccgacgatttgcaaatcttatttgcaagaaggctgatgtggacatgaataagagagctggggagctttctgctcaagagttggagaatcttatgtttattgttgcaaatccaagacagttcaaaatcccagactggttcctaaatagaaagaaagattataaggatggccgcttctctcaggttgtgtcaaatgctctggatatgaagctcagggatgaccttgagcggcttaagaagatcaggaaccatcgaggtctgcgccattactggggattgcgtgtgcgaggccagcacacgaaaaccactggcagacgcggcaggactgttggtgtctccaagaagcgctaagacagggaagctgctgttaggcattagttgtgcatgagttctagttttgatacggacaggtgagccttagcttactggcagagtgttcaaagatctgtttgtctttctttaccaggtgttgtcatgaacagggctgcaattcagcaggatgtttgtccaagaaa

SEQ ID NO: 2933 - DNA, 719 bp, Rosa hybrid cultivar
aggcaaggagctgctcagagcctcaagatccaaaaccctagccatgtcgctcgttgccaacgaagaattccagcacattctgcgtgtgctcaacaccaacgtcgatgggaagcagaagatcatgtttgccatgacctccatcaaaggtattggccgccgtttggccaatatcgtctgcaaaaaggccgatgtcgacatgaacaagagagctggtgaactatctgctgctgagattgataacctcatgacaattgttgggaatcctcgccagttcaaaattccagattggtttttgaacaggaagaaggattacaaggatggcaggtattcccaagttgttgccaatgctttggacatgaagctgagagatgatctcgagcggttgaagaagatcaggaaccaccgtggtcttcgtcactactggggccttcgggtacgtgggcagcacaccaagactactggtcgcaggggaaagaccgttggtgtctccaagaagcgataatctgcttgcacttaacccttcttatggccctttctggatatttagcttgaaaattttgctgctttagtatatctggcaatattatttgagttatgaaccatcatattctggattatttcctggttgcattttgtattgttaactcttcctatttttcttttcattgcaatgatgatgttttagtctataacagaatcttaagccccttgttttttct

SEQ ID NO: 2934 - DNA, 930 bp, Sarracenia psittacina
cggggaactcacaagccctagcaccagcagcgccgccaccaccccgtctctttttacctctcttcctctcggtctttccgttcatcatcgccgggaaatccctctctgttctctctcggcggactcgcaaagttatctctctctttctctctcttgctatcccttcaagacttcaagataatgtcgcttgttgcgaacgaagaattccagcacatacttcgtgtgcagaacacgaatgtcgatggtaaacagaaaatcatgtttgcattgacctccatcaaaggtattggccgtcgtttcgcgaacattgcctgcaagaaagccgatatagacatgaacaagagggctggtgaactttcaagccaggagctggataacctgatgacaatcgtggcaaacccgcgccaattcaaaattcctgactggtttctaaacaggaagaaagactacaaggatgggaagtattctcaggtgacatccaatgcattggacatgaagctgagggatgacttggagcgactgaagaagatcagaaaccaccgtggtcttcgtcactactggggtcttagagtccgtgggcagcataccaaaactactggccgcaggggaaagactgttggtgtctctaagaagcgctaatctggttttctatcgttcttgcaactacttttgtttggttttagattcgcccacattagtacttatttaagagttaagctttggatgtattgtttgcttccgattttggcacaattttttatgttttcagctacttatcattgtctgtttctctacattattgtgacttctgtttgatgtttcattattctagtttatttggtttaataataagaaaaaaaaaaaacaaaataaatactctgtgtatactactactctcagagtaccacgagacacacggaggagtagccc

SEQ ID NO: 2935 - DNA, 805 bp, Sarracenia psittacina
ccattctcttcttctcagccgccgttctccaagccacagcagctgcaaggaagagctcttggtaaccctaaccatgtctctggtatccaatgaggatttccagcacatacttcgtgtgcagaacacgaacgtcgatggaaaacagaaaataatgtttgcactgacctccatcaagggtatcggccgtcgtttcgctaacatcgtctgcaagaaagccgatgtcgacatgaacaagagggctggtgaactctcaaatcaagaattggataatctgatgactatcgttgcaaatcctcgccaattcaaaatccccgattggtttctaaacaggaagaaggattacaaggatgggaaatattctcaggtgacatccaatgctctagacatgaagctgagggatgacttggagcggctgaagaagatcaggaaccaccgtggtcttcgtcactactggggtcttagagttagaggacagcatacgaagaccactggccgcaggggaaagaccgtgggtgtctcaaagaagcgataatctggttcttcgtttcttatggtgcttgcacctaatattcttgaatgatgtttcctgacaatagtacttatttaagagttatggtttggattctttgctcgtaatttttggcaccattttgacgttctcagctacttatattttttttgttgacgttctgacttttggtttacgtcgttaagttttagagtttaaaaccaatagatttggttttggagcctttggatttcaaaagcattaattcttatggtgcttgcacctactattcttgaa

SEQ ID NO: 2936 - DNA, 853 bp, Sciadopitys verticillata
gtgatagcacagttccagcctccgcaattgctagagttgcagaagctggtaaagcttcctaactttaacgaaaatgtctcttattgcaaacgaagagtttcaacatattcttcgtgtcctaaacaccaatgttgatgggagacagaagatcatgtttgcccttacatccatcaagggaatcggcaggcgttttgctaacattgtttgtaaaaaggctgatgttgacatgagcaaaagagctggtgagctttctgctcaagagcttgagaatctgatggtcattgttgcaaatccccgacaattcaagattcctgactggtttttgaacagaaagaaggatcataaagatggccgatactctcaggtggtagccaatgctctggacatgaaacttagggatgacttagaacgcttgaagaagatcaggaatcaccgaggtctccgtcactattgggggctgcgagtgcgtggacaacatacaaagaccacaggccgtaggggaaaaactgttggtgtctcaaaaaaacgttgagaaagatatttttctggaggaaaaataattttgtttgtggcttcgtatttttaatggttctccatataggtgccttctgttgtattgtttgatgtcagcaataggtctatttaccttttgaaacttcaaatatatttagaaggttgtaaagcatttgtactcttatctcagaatgcttttctgaaagttgtatttacatttgtaagactcaggttgaggaggaagacgttaaatgtttggtatctgtaatttacgtatgatgatctgattgttcccttttggtttgagcatgttctttaccatttggaaatcactattgat

SEQ ID NO: 2937 - DNA, 726 bp, Senecio madagascariensis
atttctcatcatcatcctacctaccaacgccgccgccgtaaaaacctgcaactccggttacaatcatgtcgcttgttgcaaatgaagagttccagcatattcttcgtgtacagaacacgaacgttgacggaaagcagaagatcatgtttgcgatgacctcgattaaaggtatcggtcgccgttttgctaacatcgtttgcaaaaaagctgatatcgacatgaacaagagggctggagaactttctaatgctgacattgataacttgatgacaattgtggctaatccacgtcaattcaaaatcccagactggtttttgaacagaaagaaggattacaaggacggaaagtactcccaggttacctctaatgctctcgacatgaagttgagagatgatcttgagcgtttgaagaagatcaggaaccaccgtggtctccgtcattactggggtctccgtgttcgtggacagcacaccaaaaccactggtcgtaggggaaagactgtcggtgtgtcaaagaagagataagctcacatttgtttctaaacctaagttacattcctgttttagacgttctcatggatctttattgtcatcaattttgaatatttgggttttatgtcatggttcttatagttgtactttttgggatgttctcgctagtatctcttttgagtttcatgtgctgaattgttgtttgcaatggataatcgaagaattttggcttatt

SEQ ID NO: 2938 - DNA, 789 bp, Solanum phureja
gtagggttttggaggtccgtatctgttgaagaagccgccgccgccgcagagaggaagattcagaagaagctagcaatgtcgcttgttgcgaatgaagagtttcagcacattcttcgtgtgcaaaacaccaacgtcgatggaaagcagaagatcatgttcgccttgacctccatcaaaggtattggccgtcgtttcgcgaacattgcatgcaagaaagccgatatcgacatgaacaagagggctggtgaactcactgctgcagagcttgacagtgtcatggtggttgttgccaatcctcgtcaattcaaaatccctgattggtttttgaacaggcagaaggattacaaggatgggaagttttcacaagttacctctaatgctcttgacatgaaacttagggatgatctggagcgcctgaaaaagatcaggaatcatcgtggtttacgtcactactggggcctccgagttcgtggtcagcacacaaagaccactggccgcaggggaaagactgttggtgtctcaaaaaagcgataaattatctacttgtcagttccagtttgttacatgctttcttttatgcgctgctggcgatatatgtctaagatgtttgttagggattatgaactggttatgtttaaaatttcccgttggtgggttatagtttaatttcttgctttagtggcaaaaggattaggttgctgtatgatcatgttttgcaaattgttcttgaattttaaattgaatgagtagttttttggatgcaatattttatttcaactgtttgagtga

SEQ ID NO: 2939 - DNA, 622 bp, Selaginella moellendorffii
gggtttttggaattagggttcttcagccgccagtaagagcaagggatctcgggtcgggagctgaggcgctcggcggcaagatgtctctggtgagcaatgaggagttccagcacattcttcgtgtgctcaacacgaatgtggacgggcggcagaagattatgttcgcgctgacttccatcaagggaattgggcgccgattcgccaacatcgtctgcaagaaggcggatgtggacatgaacaagagggctggtgagctgactgctgcggagctcgagaacctcatggtgatcgttgccaacccccgccagttcaagatccccgactggttcctcaacaggaagaaggactacaaggacgggaggtactcgcaggttgtggcaaacgcgctggacatgaagctcagggacgacctcgagaggctcaagaagatcaggaaccaccgtggtcttcgtcactactggggcctgcgcgtccgcgggcagcacaccaagaccaccggacgccgtggaagaaccgtgggagtctccaagaagcgatagacagtatcctccatggctttgtacgagcatcgcttggttcttctcctaagtttttgacaaatgcatccttattttcttgccga

SEQ ID NO: 2940 - DNA, 2086 bp, Selaginella moellendorffii
ctccatccaaacctattttacgaggtgattctttcaaatgtgagagtttcaagaggtatgtttgcaatgtttttggcaatgttagccttggcttgtttccattctatgacaccaagcttagcattaatgtttgcatccaagactttgggtcgaggctcactctagatgaaaaagtggatgagatggtgaatgcttctcacacgactggctttttcaacaaggacggtgcttgaagtacattagaatcacagccgcaaagtcaaatgaacatgatccatttgatcggaaaataggtttgggttgtgaattcacacagaatgcacagcaagcccaagaggaggccatccaagctcgagatccttctccaggagccactcctgcaggaccacgatgaggaatcggcgatgcccaccatctcaaattgtggtaagctccgaagatccaggagcgctccctcctccgactgtggagcgatgaagatgaggcccaagaacatctccccagcgcccgcgtttggaatgaccaccaaatcctactctccaggcaagaccgcagctctcattctcgcgctctacctcgccattggaatcctctgcttcgtccacgtcagggacgagctccatggaaccaagaccctgagcttcgtcgacgccttgtacttttgcgtggtcaccatgaccaccgtcggctatggcgacttggttccagccacagcgacggccaagctcatgacgtgcctgttcgtcttcgtgggcttcgcgatctttggattgctgctcggcaacgctgcaaactatctggtggagaagcaggagaggctgctggagagagcgatcgagaaaagagagaagtacctccatcacaagaacaccgagagcgatgcaaggatccggagagttcactgcaaggtggcggtggcggcggggctggttctggtgctgtttggagccgggatctcggtgttggtgaagctggaggggatgagcttcctggatgcgttctactgcgtgaccgtgacggtgacgacgctgggctatggagatcgcagcttcacgagcgccggcgggaggatctttgcggtggtgtggatcttgatgagcacggtttgtgttgcgcagttcgtcctctacatcgcggagcttgtcacggagggaaggcagcattcgctcaccaagtggattctctccaggaagatcacttactcggatttcgaggcggcggatctggacgacgatggagctctcagcctcaccgagtatatggtgtataagctcaaagagatgggcaagctcgagaaagaggacttagaggcgattgtgagacaattccaagagcttgatgtggatagatctggaactatatctctacaagacatcaacttagcacagtttggtaggtagagaacacctccactaacatatattaataagagaaagttttgccctaattcttaaacaaagtgttagggcttttggaattagggttcttcagccgccagtaaagagcaagggatctcgggtcgggagctgaggcgctcggcggcaagatgtctctggtgagcaatgaggagttccagcacattcttcgtgtgctcaacacgaatgtggacgggcggcagaagattatgttcgcgctgacttccatcaagggaattgggcgccgattcgccaacatcgtctgcaagaaggcggatgtggacatgaacaagagggctggtgagctcactgctgcggagctcgagaacctcatggtgatcgttgccaacccccgccagttcaagatccccgactggttcctcaacaggaagaaggactacaaggacgggaggtactcgcaggttgtggcaaacgcgctggacatgaagctcagggacgacctcgagaggctcaagaagatcaggaaccaccgtggtcttcgtcactactggggcctgcgcgtccgcgggcagcacaccaagaccaccggacgccgcggaagaaccgtgggagtctccaagaagcgatagacaatatcctccatggctttgtacgggcatgtcttggtttttctcctaagtttttgacaaatgcgtccttattttcttgcc

SEQ ID NO: 2941 - DNA, 804 bp, Fragaria vesca
tattagggttttggtgctttctacttccgccttcaagctctcacacacagtcacggagctgctcagatccccaaaaccctagccatgtcgctggttgcgaacgaagagttccagcacattctgcgagtgctcaacaccaacgtcgatggcaagcagaagataatgttcgccatgacctccatcaaaggtattggccgccgtttggccaatatcgtctgcaaaaaggccgacgtcgacatgaacaagagagctggagaactatctgctgccgagattgataacctcatgacaatcgttgggaatcctcgccagttcaaaattccagattggtttttgaacaggaagaaggattataaggatgggaggtattctcaagttgttgccaatgcattggacatgaagctgagagatgatctcgagcggttgaagaaaatcaggaaccaccgtggtctacgtcactactggggtcttcgggtacgtggtcagcacaccaagactactggtcgtaggggaaagactgttggtgtctccaagaagcgataatctgcatttaagctttttcgtatgaccctttctggatattttgcttcaaaattttgcttcttaatatatcaggcatattatttgagttatgaacttccatattttggattatttcctggtcgcattttgtaatgttaactcttcatatcttcatatattccttttcattgcaatgttgatgttttagtctataacagtatctcacctttcattttcccctcttctatactccaactaattgtaacttccaatcttatcctc

SEQ ID NO: 2942 - DNA, 631 bp, Helianthus annuus
atgagtctggtagcaaatgaagaatttcagcatattcttcgtgtgcagaacacgaatgttgatggcaagcagaagatcatgtttgctatgacctcgattaaaggtattggtcgtcggtttgcgaatattgtctgcaagaaggctgatgttgatatgaacaagagggcgggagaactttcaagcgctgagattgataatctgatgacaatcgttgccaatcctcgacagtttaaaatcccagattggttccttaacagaaagaaggattacaaggatggcaagtactctcaagtcacttctaacgcccttgacatgaagcttagggatgatctcgagagattgaagaaaatcaggaaccaccgtggtcttcgtcactactggggtctgcgagtacgtggacagcacaccaagactactggtcgtcggggtaagaccgtcggtgtgtcaaagaagcgatgagcttgttttggtattagaaagtctttgtttttcatcatatttagaatgttttgttatgctttcttggatgtcgtagattctaggattcctttacaagagcgtgttgttagaaagtttttacatgttcggattatgttataagttttgttaaaaagttcgtatttgtcgtaaa

SEQ ID NO: 2943 - DNA, 764 bp, Nicotiana tabacum
gagcgttagggttttggtagttctgtatctcttcaggagtaaacgaagcagccgcaccgcagagtcggattcgaaaccgtagccatgtcgctggttgcaaatgaagaatttcagcacatacttcgtgtgcaaaacacgaacgttgatgggaaacagaagataatgttcgcaatgacatctatcaaaggtatcggccgtcgtttcgctaatattgcctgtaagaaagccgatatcgatatgagcaagagggcgggtgagctttctgctgctgaactcgatagcttgatggttgttgtggcaaatcctcgtcaattcaaaatccctgactggtttttgaataggcaaaaggattacaaggatggtaagttttcacaagttacatctaatgctctggacatgaagcttagggatgatctggaacgactgaagaagatcaggaatcatcgcggtttgcgtcactactggggtcttcgagtgcgtggtcagcacacaaagaccactggtcgccgggggaagactgttggtgtctccaagaaacgatagtcaccttctccggagccaattttgcatgttttatgctatatcattttcatatgcaacaagagggtttgaatgaacttaggtttatgattttgttgaatgtatcgggttgagttctatagagcagcattgcttttgaaggatgtgttatctacttgtcctcgtttgtgatgaagttcaatttttgatgccgttgatggtttttgtttgatatgcattttgtg

SEQ ID NO: 2944 - DNA, 754 bp, Nicotiana tabacum
agagggtttggtgctcacatctcttgaatacagaagaagccgccgccgcacagagcaagatttgaaacctagcaatgtcgctcgttgcaaatgaagaatttcagcacattcttcgtgtgcaaaacaccaatgtcgatgggaagcaaaagatcatgttcgctttgacctcaatcaaaggtatcggtcgtcgtttcgccaacattgcctgcaagaaagctgatatcgacatgaacaagagggcgggagaacttactgctgcagagcttgacagtgtgatggtggttgttgcaaatccccgtcaattcaaaatacctgattggtttctgaataggcagaaggattacaaggatggcaagttttcacaagttacctctaatgctcttgacatgaagcttagggatgatctcgaacgcctgaagaagatcaggaatcatcgtggtttacgtcactactggggtctccgagtgcgtggtcaacacacaaagaccacagggcgcagggggaagactgttggtgtctccaaaaagagataaatcatctacttgccagtttcagtttgttatgtgctttctctttatgttctccgggcgatatatgtttaagatattttaggggattttgtgttggtatgcttaaattttcttttccgttggtggattacagtataattttgttcgaaagtgagatggatttctctgctttatgatctaggttttgcagaatgctcttgaattaaattgaatgagtagttcct

SEQ ID NO: 2945 - DNA, 813 bp, Nicotiana tabacum
gttagggttttgggagttctgcatctcttcaggagtgaacgaaacagccgcaccgcagagcaggattcgaaaccgtagcaatgtcgctggttgcaaatgaagaatttcagcacatacttcgtgtgcaaaacacgaacgttgatgggaagcagaagataatgttcgcaatgacatctatcaaaggtatcggccgtcgtttcgctaacattgcttgcaagaaagccgatatcgatatgagcaagagagcgggtgaactatctgctgctgaactcgatagcttgatggtcgttgtggcaaatcctcgtcaattcaaaatccctgactggtttttgaataggcaaaaggattacaaggatggtaaattttcgcaagttacatctaatgctctggacatgaagcttagggatgatctggaacgcctgaagaagatcaggaatcatcgtggtttgcgtcactactggggtcttcgagtgcgtggtcagcacacaaagaccactggtcgccgggggaagactgttggtgtctccaagaagcgatagtcaccttcccaggaaccaattttgcatgttttatgctatatcattttcatatgcgacaagagggtttgaatggacttagctttatgattttgttgaatgtattggattgagttctatggagcagcattgcttttgaaggatgtgttatctacttgtcctcgtttgtgactgatgaagttcaattttctacacctttgatggtctttgtttgatatctatctcgtgcaaaattttcaacatctttagtacctttgggcacacaactagtttgaaa

SEQ ID NO: 2946 - DNA, 785 bp, Solanum lycopersicum
gtagggttttggaggtccatatctgttgaagaagctgccgccgccgcagagaggaagattcagaagaagctagcaatgtcgcttgttgcgaatgaagagtttcagcacattcttcgtgtgcaaaacacaaacgtcgatggaaagcagaagatcatgttcgcattgacctccatcaaaggtattggccgtcgtttcgccaacattgcctgcaagaaagccgatatcgacatgaacaagagggctggtgaactcactgctgcagagcttgacagtgtcatggtggttgttgccaatcctcgtcaattcaaaatccctgattggtttttgaacaggcagaaggattacaaggatggaaagttttcacaagtcacctctaatgctcttgacatgaagcttagggatgatctggagcgcctgaaaaagatcaggaatcatcgtggtttacgtcactactggggcctccgagttcgtggtcagcacacaaagaccactggccgcagaggaaaaactgttggtgtgtcgaaaaagcgataatctactcgtcagtttcagttatgttacatgctttcttttatgcgctgctggcgatatgtcttaagatgtttgttagggattgtctactggttatgtttagaatttcccgttggtgggttatagtttaatttcttgtttagtggcaaaaggattagtttgctatatgatcaagttttgcagattgttctttaattttaaattgaatgagtagttttttgaatgcaatattttactttcaactgtttgagtga

SEQ ID NO: 2947 - DNA, 792 bp, Tragopogon dubius
gggtgactcggaagaacgaaggaggcagagccgtacatcggagcaatccatctcaggtgtcgccatttgagaagaagcttaattgcaactgaatcatgtcgcttgtagctaatgaagactttcagcacattcttcgtgtccagaacacaaatgttgatggaaaacaaaaatcatgtttgccatgacctccatcaaaggtatcggtcgccgatttgcaaatatcgtttgcaagaaagccgatgtcgacatgaacaagagggctggagaactttcaaatgcagaaatcgataatctcatgacaatcgttgctaaccctcgtcagttcaaaatcccagattggtttcttaacagaaagaaggattacaaagatgggaaatactcccaggtcacatctaatgctctcgacatgaagcttagagatgatttggagcgtctcaagaagatcaggaaccaccgtgggctccgccactactggggtctccgagttcgtggacaacacaccaagaccactggtcgccggggaaagactgtgggtgtgtccaagaagcgataagcttttgtgtctttttgggttcttttaatttgaaaggtatgtggtaattttttgtttttttactctggtagtaagtttttagagttttttttgttaagaaactgttgttgcaactggagagttgatgagttattgtttttactattctgttaaaatcttgagttactggagcaccttaactttaagtaaatgttcttgtttttttgcattacgaaattgttattttatttcttttgtct

SEQ ID NO: 2948 - DNA, 665 bp, Triphysaria pusilla
aatctctctcaagaagaagcgaaagctaggcagccgctaactgaagaactgagcattctcagcagctagatttgaaaccctagccatgtcgctcgtagcaaatgaggagttccagcacattctgcgtgtgcagaacactaatgtggacggaaagcagaagatcatgttcgccatgacctccatcaagggtattggtcgccgatttgccaacatcgtctgcaagaaggccgatgtcgacatgaacaagagggctggtgaactttctaatgccgaaattgatggcttgatggctattgttgctaatccccgtcagttcaagatcccagactggttcctcaacaggaagaaggattacaaggatggtaaattctcacaggtgacatccaatgctttggatatgaagcttagggatgatcttgagcgtttgaagaagatcaggaaccaccgtgggcttcgtcactattggggtctccgtgtccgtggacagcacaccaagaccactggtcgtaggggaaagactgttggtgtgtccaagaagcgataagatgtatgcttattttttatatgctatcaatgaactcacaactttgtttggattttagtctacacccttgatcagattttgttggaatattgaatcactgtttttgtcgtgtttctgcttt

SEQ ID NO: 2949 - DNA, 697 bp, Triphysaria pusilla
cacactaactgacagcagagcagccgtcgaagaacacatcacactcagctgctcgattccaaaccctagccatgtcgctggtagcaaatgaggagttccagcatattctgcgtgtgcagaacactaatgtggatggcaaacagaagatcatgttcgccatgacctccatcaagggtattggccgccgtttcgccaacatcgtctgtaagaaagccgatgtcgacatgaacaagagggctggtgaactttctaatgctgaaatcgacggtttgatggctattgtggctaacccacgccagttcaagatcccagactggttcctgaacagaaagaaggattacaaggatggtaagttttctcaagtgacgtctaatgctctcgacatgaagctcagggatgatcttgaacgtctgaagaagatcaggaaccaccgtggtcttcgtcactactggggccttagagtgcgtggacagcacaccaagactactggccgtaggggaaagactgttggtgtctccaagaagcgataagctcgttttctcttgtttgttttctctttatgagtaatttatttggttttaggatgggtgccctattatatctaaagtggttatatgtactgagttatgatatctttgctgttttgggtttttgaagttttggactggattataaagattttttcatggtttgttgg

SEQ ID NO: 2950 - DNA, 686 bp, Utricularia gibba
tggtgctccatctttccttcggaattgaatcgtgagttctcggcggcggattcagagtctcggcactaacgatgtcgctggtagcaaatgaggatttccagcacattctacgtgtgcagaatactaacgtcgatgggaaacagaagatcatgttcgccttgacctcaatcaagggtattggccgccgtttcgccaatattgtttgcaagaaagctgatgtcgatatgaacaaaagggcgggtgagctctctgctgctgagctagacaatttgatggtgatcgtcgcaaatcctcgtcagttcaagattccggattggtttctcaacaggaagaaggattacaaggacggaaaatactcccaagtcacatcaaatgcgttggacatgaagctcagggatgatctcgagcgcctcaaaaagatcaggaaccaccgtgggctgcgccactattggggcctccgcgttcgcggccagcacaccaagaccaccggccgcagaggaaagactgtcggtgtctccaagaagcgataaacaaccacctattgtgatgcgtgccgtgatcacaattcgaagcattcttcttcggttcctcagtatttcctgaatggtttcttccttaagacagtggtgttagtagtgtcctttgtcacctatctatgtttcagcagagaaagcactgaatgaagg

SEQ ID NO: 2951 - DNA, 690 bp, Taraxacum officinale
gaggcggagccgcccatcggagtgattcattgcaggtattgataagagaaaaagcttattcacaatacaaccagtgtcgtcttgtagcaaatgaagacttccaacacattcttcgtgtttaaaacacaaacgttgatggaaagcaaaaaatcatgttcgccatgacctccatcaagggtatcggacgtcgttttgcaaacattgtctgcaaaaaagctgacgtggacatgaacaaaagggctggtgaactatcaaacgctgagattgataacctgatgacaattgtcgctaaccctcgtcagttcaaaatccctgattggtttttgaacagaaagaaggattacaaagatggaaaatactctcaagttacttctaatgcacttgacatgaagcttagagatgatttggagaggctcaagaagattaggaaccaccgtgggctccgtcactactggggtcttagagtccgtggtcaacacaccaagacgactggtcgtaggggaaagactgttggtgtgtccaagaagcgataagtttgtgtgttttttatttacttttttggaccttttgctatcattattttgaaagatatgtggtagtttgacaatttggtgcgttttttgtttttaattttgctaggactttttatcaagaaattgctatatgaacatggagagttgatgagttttt

SEQ ID NO: 2952 - DNA, 672 bp, Papaver somniferum
ttccagcacatattgcgtgtgttgaacacaaacgttgatggaaaacaaaagataatgtttgcaatgacatctatcaaaggtattggtaggcgatttgctaacattgtctagtaaaaaagccgatgtcgacatgaataagagggctggtgaattatctgctgctgagctagagaatctcatgacaattgttgctaatccacgccagttcaaaatcccagactggtttctgaacaggaagaaggattacaaggatggaagatattctcaggtggtgtctaatgctttggatatgaaactcagggatgatttagagcgcttgaaaaagatcaggaaccatcgtggtttgaggcactattggggtcttcgtgtgcgtggtcagcataccaagacaactggtcgccgggggaagactgttggtgtttccaagaaacgttgagttcttttctttcttttcgtatctttttgaactaaaaatccaagggttgtgttctttttcattctggggccaaagatctttacatgcatttcttaggttcatgctgttttgttttggttggcatcaactgaaccttttctaaatagtgccttctaacagtcagtttgtttggataatagataagtgtcatatctaacgaaacttcattccttttactgaaggctgttagttctatc

SEQ ID NO: 2953 - DNA, 1086 bp, Primula obconica
aaaaaccaaaaaagtgaaagtacaactgaaatattgagatagaacaacatcatccattcaaatgaagctcgcaaaatttaactttgttctgaaaattgaaaatgcaagatgagactatgatgtaaaacccagctgaagcctcactaaaaccaatcaacttgctcaagcagaagctgctgctccctttttccgtggggctgcttcagttccctctctgaagccactcttgaatctgcgaggtacattacgcaggtacctcatgcgacctgttccagttgtcttcctgcggccgaaactctctctatttctctctccggctgcgtaaattagggtttgagaactatcagctgcagatcgtaaccatgtctttggtggcaaatgaagagtttcagcatattctgcgtgtgcaaaatactaatgtggatggcaagcagaagattatgtttgctatgacctcaatcaaaggtatcgggcgtcgtttcgctaacatcgtctgacaaaaaggccgatgttgatatgaacaaaagggctggtgagtctttcttctcaggagatcgataacctgatgaccattgttcgccaacccacgccaattcaacattccagactggtttctgaacaggaagaaagattacaaggatgggtaaattttctcaggtcacatccaatcgccctcgacatgaagctcagagacgacttggagcgtttgaagaagatcaggaaccaccgtggtctccgtcactactggggtctgagggtgcgtgggcagcacaccaagaccactggccgcaggggaaagactgttggtgtctctaagaaacgttaagcttctatcgatgttgtctttttgtctggcaacttgttcgactttttgcgtagacctttcgtggttcttacttatctactagtttggacgtatttctgaattatggttgtttgatgatctgttgaaagattaaacttttgtctatgttctatatcattacttctcggttgttttggctcgtcgaacgatatggtcatttatttgagttcagtacttaaccttgaacaagttgtttggaaggtcattatgtgcttgttttt

SEQ ID NO: 2954 - DNA, 746 bp, Euphorbia esula
ggcacgaggcttgcgttgctcttctcgcccgctccggctaattgcgatcaaagatgtctctggtagcaaatgaggactttcacacattttgcgtgtgctgaatactaatgtggatggaaagcagaagattatgtttgctttgacctcaatcaaaggtattgggaggcgccttgctaacattgtctgcaagaaagctgatgttgacatgaacaagagggctggtgaattaactgctgctgagcttgataatctgatggtgattgttgcgaatcctcgtcagttcaagatcccacattggtttttgaataggcaaaaggactacaaggatgggaagtactctcaagttgtctccaatgctctggacatgaagttgagagatgatttggagcgattgaagaagataaggaatcatcgtggtctgaggcattactggggccttcgagttaggggacagcacaccaagactactggtcgtcgcggaaaaactgttggtgtttctaagaagagatgaataatctaattattttgttggtaggtagagggtaaattagtcacctgctacaagaaattttgcaccagagaagttcagatatggctatgttagattgaagcattttagtacttttaatgatttttatcaatttaccttgtttgcactggaccttattctatgttgtctgttttagaatcctagctgttggatcttattttcaaatgcaagcagtttgatcttattttaatgctgt

SEQ ID NO: 2955 - DNA, 768 bp, Arabidopsis lyrata
tcatattaggttcgaaaaccctaaaggagttacgccgcttataacagacctgaccttgttaagctgtggtggcgcctccagagtctgtgaaagagcttaatccttgtatcgcgatctttctcggcatccaaaaatgtctctagttgcgaacgaggagtttcagcatattttgcgtgtgctcaacactaatgtcgatgggaagcaaaagattatgtttgccttgacctcgatcaagggtattggaaggcgattggccaacattgtgtgcaagaaggctgatgttgacatgaacaagagggctggagaactaagtgctgcagaaatcgacaacctcatgacaatcgttgcgaaccctcgtcagttcaagatcccagactggttcttgaacaggcaaaaggattacaaggatgggaaatactcccaagttgtttccaacgctctggacatgaagctgagagatgatcttgagcgtctcaagaagatcaggaaccatcgtggtctgaggcactactggggtctccgtgtacgtggacagcacaccaaaaccaccggacgccgtggaaagactgttggtgtctctaagaagcgttaaaaaagagttggagcttggttcaatggctttgctttgttttgtattgttttttgcagaagagatagtttaagcaatgttgtttcatcaaaagacggtcttagcttttacaatatataattgaatccaaaaactatgttgttcctagtctttttgttacattctcttaaaatctgctt

SEQ ID NO: 2956 - DNA, 726 bp, Arabidopsis lyrata
actgaagaagagaaagcttgaagacggcgagagctccatcttttcacaggcacttcttctctacaattcacaatgtctctggttgcaaatgaggagttccagcacattttgcgtgtgctcaacactaacgttgatggtaagcaaaagattatgtttgcccttacctctatcaaaggtattgggaggcgattggccaacattgtctgcaagaaagccgatgtcgacatgaacaagagggctggtgagttatctgcagctgagattgacaacctcatgactatcgttgcaaacccaagacagttcaagattccagactggttcttgaacagacagaaagattacaaggacgggaagtactctcaagttgtctccaatgcccttgacatgaagctcagggatgatcttgaacgtctcaagaaaatcagaaaccatcgtggtctaagacattactggggtctccgagtccgtggacaacacaccaagaccactggtcgcagaggaaagactgttggtgtgtctaagaagcgttaagccaatgttgctggtggaagctgggttggtttattgataagaaccgattttaagttttgtgattcgtacaattttgctcgactcgactttgggtcttttataagagatatttactaccgttttattactcttaagataatattttgttactggatccttgtgtcacttctctagttgcatgatttttcagttggc

SEQ ID NO: 2957 - DNA, 797 bp, Arabidopsis lyrata
gaaaaaccctagcagacctcttttgtgttcttcactctccagagatcgtttattgcttgaagacggcttcttcttcttttaacaaatctcatctctgcaaatcaaaatgtctctggttgcaaatgaggagtttcagcacattcttcgtgtgttgaacacaaatgttgatggtaagcagaagattatgtttgcccttacctctatcaaaggtattggaaggcgattggctaacatcgtctgcaagaaggctgatgtcgacatgaacaaaagggctggtgagttatctgctgctgagattgacaacctcatgacaatcgttgctaacccacgtcagttcaagatcccagactggttcttgaacaggcagaaggattacaaagatggcaagtattctcaagttgtctccaatgcactggacatgaagctgagagatgatcttgaacgtctcaagaagatcagaaaccatcgtggtctgaggcattactggggtctccgtgtcagaggacaacacaccaagaccactggtcgcagaggaaagactgttggtgtgtcaaagaagcgttaaagcaagagccaatgttgctacttacagctgtattggatacttcctaaggacctgtttttatttcgtactaggacttttttctgtgacgcttttcgggctttttgtgatcacataactctgtttttcatcttcatccctccggctccagtgtcatgaatgtcgtatttatttcaatttccagctcactctgcgtattgtctattgtgagagcaagagatgactaagccgattc

SEQ ID NO: 2958 - DNA, 768 bp, Arabidopsis thaliana
tcatattaggttggaaaaccctaaatatgccgcttataacagacctgagcttaagctgtggtggcgcctccagagtctggtaaaagagcttaatcctcctctcgcgatctttctcggcatccaaaaatgtctctagttgcgaacgaggagtttcagcatattctgcgtgtgctcaatactaatgtcgatgggaagcaaaaaattatgtttgctttgacctcaatcaagggtattggaaggcgattggctaacattgtgtgcaagaaggctgatgttgacatgaacaagagggctggagaactaagtgctgctgagattgataacctcatgacaatcgttgctaaccctcgccagttcaagatcccagactggtttcttaacagacaaaaggattacaaggatgggaaatactcccaagttgtttccaatgctcttgacatgaagttgagagatgatcttgagcgtctcaagaagatcagaaaccatcgtggtctgaggcactactggggtctccgtgtacgtggacagcacaccaaaaccaccggacgccgtggaaagactgttggtgtttccaagaagcgttaaaaagagtttgagcttggttcaatggctttgttttgttttttttgtattgttgttttttgcagaagagatagtttaagagatgttgtttcatcaaaagacggtcttagcttttacaatatataattgaatccaaaaactagtctctatttattacattctcttctctcaaaatctgctttaaac

SEQ ID NO: 2959 - DNA, 767 bp, Arabidopsis thaliana
gctcacgctgttgaatcactgaagagagaaagcttgaagacggcgagagctccatcttttctcaggcatctcttatcttcaaatcacaatgtctctggttgcaaatgaggagtttcagcacattttgcgtgtgctcaacactaacgttgatggtaagcaaaagattatgtttgcccttacctctatcaaaggtattggaaggagattggccaacattgtctgcaagaaagccgatgtcgacatgaacaagagggctggtgagttatctgcagctgagattgacaacctcatgactattgttgcaaacccaagacagttcaagattccagactggtttttgaacagacagaaagattacaaggatgggaagtactctcaagttgtctccaatgcccttgacatgaagctcagggatgatcttgagcgtctcaagaaaatcagaaaccatcgtggtctgagacattactggggtctccgtgttcgtggacaacacaccaagacaactggtcgcagaggaaagactgttggtgtgtctaagaagcgttaagccaatgttgctagttgcagctggattggatctttgataaggactgaattttaaattttgttgttcgtacaattttgcacgactcgattttgggtcttttgtgagagatcttctctactgtcatattgcttttaagataatgttgcttactggatcttatgtcacctctctagttacatcatctttcggttggcctatttaattgttttcttcatcgatt

SEQ ID NO: 2960 - DNA, 799 bp, Arabidopsis thaliana
gaaaaaccctagcagacctcttttgtgttcttcactctccagcgatcgtttattgcttgaagacggcttcttcttctcacaaatctcatctctgctaatcaaaatgtctctggttgcaaatgaggagtttcaacacattcttcgtgtgttgaatactaatgttgatggtaagcagaagattatgtttgcccttacctctatcaaaggtattggtaggcgattggctaacattgtctgcaagaaggctgatgtcgacatgaacaaaagggctggtgagttatctgctgctgagattgataacctcatgacaatcgttgcaaacccacgtcagttcaagatcccagactggttcttgaacaggcagaaggattacaaagatggcaagtattctcaagttgtctccaatgctcttgacatgaagctgagagatgatcttgaacgtctcaagaagatcagaaaccaccgtggtttgaggcattactggggtctccgtgtcagaggacaacacaccaagactactggtcgcagaggaaagactgttggtgtctcaaagaagcgttaagaaagatccaatgttgctacttacttctgtattggatacttcataaggacctgtttttatttcgtactaggacctttttgtgtgacgcttttcgagctttttgtgatcacattcctctgtttttcattcttgatccctccagtgccttgaatagtcttatttattttaatttccagcttactctgcttattgtctactgtgacagcaacagatgtctaaggcaattcaacaatgctt

SEQ ID NO: 2961 - DNA, 923 bp, Vaccinium corymbosum
agccttcctttttaaagcgaggagagtgaattacaaccaccatcgtcgtttagggttttcgcgcttctctctgtggccagccgcactcacaagcacctagcaagaagaacctgatctgaaaccctagccatgtcgctggtagcgaatgaagagttccagcacattcttcgtgtgcagaacacgaacgtcgatggaaaacagaagatcatgtttgcgctgacctcgatcaagggtatcggccgtcgttttgccaacatcgtttgcaagaaagccgatgtcgacatgaacaagagggctggtgagctctcaaaccaggaaattgataatctgatgacaattgttgcaaatcctcgccagttcaaaatccctgactggtttttgaacagaaagaaggattataaggacggcaagtactctcaggtgacatccaatgctctggacatgaagctcagggatgacttggagcgtctgaagaagatcaggaaccatcgcgggctccgtcactactggggtcttagagtgcgtggacagcataccaagaccactggccgcagaggaaagactgtcggtgtctccaagaagcgataaatttgcttctgtgtttgctatggttcctgctgctagttttgttgaacgacctttaccgtgttatcttttgctggtcatttttgcaccattttgatgttttctgctacttatctttatgttggtctctgcgcattattatgactttctagtttacttgggtaatcttctagtttatggggattaatattaacggagtttgtttctggaactcttttggttgcaatggatttcggaactctcaagtttttgtgcttccaccgggatttccaccatgcaattttttgtgcccgcccgtgcttgtgctggttgggggtggtgttactttgttactttcg

SEQ ID NO: 2962 - DNA, 894 bp, Vaccinium corymbosum
ccctactccctgtgctcgtgcagtccagacccggtgtctacacgcagcgtcgctagtacggcggggagagtgaattacaactaccatcgtcgtttagggttttcgcgcttctctctgtggccagccgcactcacaagcacctagcaagaagaacctgatctgaaaccctagccatgtcgctggtagcgaatgaagagttccagcacattcttcgtgtgcagaacacgaacgtcgatggaaaacagaagatcatgtttgcgctgacctcgatcaagggtatcggccgtcgttttgccaacatcgtttgcaagaaagccgatgtcgacatgaacaagagggctggtgagctttcaaaccaggaaattgataatctgatgacaattgttgcaaatcctcgccagttcaaaatccctgactggtttttgaacagaaagaaggattataaggacgggaagtactctcaggtgacatccaatgctctggacatgaagctcagggatgacttggagcgactgaagaagatcaggaaccatcgcgggctccgtcactactggggtcttagagtgcgtggacagcataccaagaccactggccgcagaggaaagactgtcggtgtctccaagaagcgataaatttgcttctctgtttgctatggttcctgcagctagttttgtggaacgacctttaccatgttatcttttgctggtcatttttgcaccattttgatgttttctgctacttatctttatgttggtctctgcgcattatgacttatggtttacttgggtagtcttcttgtttatggggattaatattaacggagtttgtttctgaactcttttggtttggtcaataggtagtttacggtaactctctaagttttgttgtactaac

SEQ ID NO: 2963 - DNA, 702 bp, Bupleurum chinense
agccgcgacatcatctgagcctccgagactcaccgcatcggcgactctagtttcaacatccggcaaccatgtcgctcgtagcaaatgaggatttccagcacattctgcgtattcagtatactaatgttgatggaaagcagaagattatgtttgcgctcacttctattaagggtattggacgtcgtttcgctaacatcgtttgcaaaaaagctgatgtcgatatgaacaagagggctggtgaactatcatcggctgagattgacagcttgatgaccattgttgccaaccctcgtcagttcagtatcccagattggttcctgaacaggaagaaggattacaaggatggaaagttctctcaggtgacatccaatgcactagacatgaaactgagggatgatcttgagcggttgaagaaaatcaggaaccatcgtggtctccgtcactactggggtcttcgagtacgtggacagcacaccaagactactggtcggaggggaaagactgttggtgtctccaaaaagagatagagatgcgcttattattactacttttttgttttcaaccagtttagttggattgatcattgtgaaacaaaatgtagactgatgcggctatgtagacaattttattttaatcaatgtttttgtgtatgaatatgataatccaatcttttttataaatcatgtggtacttattggttgt

SEQ ID NO: 2964 - DNA, 688 bp, Euphorbia peplus
ttgccgtcagctgatatttgatctcctgctccggctaattgcaatccaaaatgtctctcgttgcgaatgaggagtttcaacacattttgcgtgtgctgaatactaatgttgatggcaagcagaagattatgtttgctttgacctctatcaaaggtatcgggaggcgccttgctaacattgtctgcaagaaggctgatgtggacatgaacaagagggctggtgaattaactgctgctgagcttgataatctgatggtcattgttgcaaatccgcgtcagttcaagatcccacattggtttttgaataggcaaaaggactacaaggatgggaagtactctcaagttgtctccaatgcactggacatgaagttgagagatgatttggagcgattgaagaagataaggaaccatcgtggtctgaggcactattggggtcttcgagttaggggacagcacaccaagacaactggtcgtcgtggaaagactgttggtgtttctaagaagagatgaaaatcctaattattcgcttgaacagctttgttggtaggcagaggctaaattagtcacctgttacaagaaattttgccccagaaaagttcagatatggctttgttagactgaagcatttaatgctgttaacaatttaccttgtctgcatagaaccttattttatgttgtctgttttagaa

SEQ ID NO: 2965 - DNA, 699 bp, Euphorbia peplus
gggtaacatcgagagttttatacttcggcgccgcgcatagaagagatcttctcctcatctgaaaccctagccatgtcgctggtagcaaatgaagagtttcaacacattcttcgtgttctgaacacgaacgtagattgtaaacagaaaattatgtttgccctgacctccatcaagggtattggccgccgtttcgccaacatcgtctgcaagaaagccgatgttgatatgaacaaaagagctggtgaactgtcagctgaagagctggacaagctaatggtaattgttgctaacccacgccagttcaagattccagactggttcctgaacaggcagaaggattataaggatggaaagtaccaccaggttgtatccaatgccttggatatgaagttgagagatgaccttgagcgattgaagaagatcagaaaccaccgcggtcttcgtcactactggggtctccgagtgcgtggacagcacaccaagactaccgggcgcaggggaaagactgttggtgtctctaagaagcgatgatctgtgtctacattttatatgtttcgatcatcttgatggttttgtgtgtgctcaattttcaaacttctttttcagttatttaaaagaacttagcatgtcttagaagttaaaaggaatcttgttgtttagtaatgcggatattacttgttgcatttactcatggattca

SEQ ID NO: 2966 - DNA, 733 bp, Euphorbia peplus
gagcttcccgaacatcgccgccgcgcagagaagagagcttcttcacatctggaaccctagccatgtcgctggtagcaaatgaagagtttcaacacattcttcgtgttttgaacacgaacgtcgatggtaagcagaaaattatgtttgccctgacctctatcaagggtattggccgccgtctcgccaacatcgtctgcaaaaaagccgatgttgacatgaacaagagagctggtgaactatcaagtgaagagcttgataaacttatggtgattgttgctaatccccgccagttcaagattccagactggttcttgaacaggcaaaaggattataaggatggaaagtaccaccaggttgtttccaatgccttggacatgaagctcagagatgaccttgagcgattgaagaagattagaaaccaccgtgggcttcgtcactactggggtctccgtgttcgtgggcagcacaccaagactactggacgcaggggaaagacagttggtgtctccaagaagcggtgattttgttcttattatatgttcaatcttctggatgatggttttgtgtgtgttcaattttactctttctttttatattacctgaaagaacttggtatgtcttagagtgttaaaggaatttcagttttgtaatgcggatattacttgttgcatgcgtttactcagatcagatggattcacttaatttaaaagattttaggtattttgatcttttg

SEQ ID NO: 2967 - DNA, 929 bp, Euphorbia peplus
ggttctagtcacgcatctagggtttaagagctccccgaacatcgccgccgccgcgcagagacaactgaaaccctagccatgtcgctggtagcaaatgaggagtttcaacacattcttcgtgttctgaacaccaacgtcgatggtaaacagaagattatgtttgccctaacctccatcaagggtatcggtcgccgtctcgctaacatcgtctgcaagaaagccgatgtggacatgaacaagagagctggtgaactatcaagtgaggagcttgacaaacttatggtgattgttgctaatcctcgccagttcaagattccagactggttcctgaacaggcaaaaggattataaggacgggaagtaccaccaggttgtatccaatgctttggacatgaagctcagagatgaccttgagcgattgaagaagatcagaaaccatcgtggtctccgtcactactggggtcttcgtgttcgtgggcagcacaccaagactactggacgcaggggaaagacagttggtgtctccaagaagcggtgatctgttcttatatgttataatgttcaatcttctggatggttttgtgtgttcattttactctctttggtttttatattacctgaaagaacttggtatgtcttagagtgttaaaggagtttcaattttgtaatgcggatattacttgttgcatgcatttactcagatcagatgtattcacttaatttaaaagattttaggtatttttaatcttttgtatatgcatccagtgtatgatgcgtggctattgtgagatgtgtggttttagtgcaagtaaatgtatgttatgcatagttcaccagaattgtgagcttccatgccatttcctatctatcaggttcggatacatgattaagtatgtctttaaattttttattttggacccatttgtatta

SEQ ID NO: 2968 - DNA, 864 bp, Adiantum capillus-veneris
tacctttcgttcaattctgcgcatcctctttcacgtagcaaatcggcaagcagagctctgcgagcgaagatgtcgctggttgcaaatgaggaatttcagcacattttgcgtgttctcaataccaatgtggatggacggcagaagatcatgtttgctctgacatctattaagggtatcggccgacgttttgctaacctcatctgcaagaaagcagatgtagacatgaacaagagagcaggggagctgtctgctcaagagcttgaaaacctgatgtttatcgttgccaatcctcgtcagttcaagattcctgactggttcttgaacaggaagaaagattacaaggatggccgattttctcaagtggtgtctaatcaactcgacatgaagttgagagatgacctggaaaggctgaaaaagatcagaaaccaccgtggtcttcgtcattattggggcttgcgtgtgcgtggtcagcacacaaaaacaactggaaggcgggggaggacagttggtgtgtccaagaagcgttaagtcaaggcactgcagagtctttaggatgcagttcctaagagttttgatactgatctgtgcaacaatatttttagagttaaaagccagcttttttggtttggttcccggctggctgattagaattgatcatgcacgggatctttcctgacctgtgcgctgggttagttttcttcagctggagggcttcttctctttatcagctggtattgtaattccatgagagccttttaaagtattcttgccttgattaggtatttactgaagtgaatggttaacacttctggaattatgtttctgatatgttgttttgttactttatttagttgtctggaggac

SEQ ID NO: 2969 - DNA, 572 bp, Fraxinus spp
gcaaatgaggatttccagcacattctccgtgtccagaacacgaacgtggatggcaagcagaagattatgttcgcattgacctccatcaagggtattggtcgtcgtttcgctaacatcgtctgcaagaaagctgatattgatatgaacaagagggctggtgaactttcggctgctgagattgacagcttgatgacaattgttgcaaatcctcgccagttcaagattcctgactggtttttgaacaggaagaaggattataaggatggaaaattttctcaagtgacttccaatgctcttgacatgaagctcagggatgatcttgagcgcttgaagaagatcaggaaccaccgtggtctccgtcactactggggtcttcgcgtgcgtggacagcacaccaagaccactggccgcaggggtaagactgttggtgtctccaagaagcgatgagctgcagcttatcttcctttctatcgttatggataacttgtcagttttaaaccttcctcagtgtaacatctgcacttaatatagctagtttgctagttcttattgttctagtaccttcggcctag

SEQ ID NO: 2970 - DNA, 954 bp, Lotus japonicus
ggactataaattgccatcaaaccctagagtttcagatcctcaatcgacctcgacctacacagcttcggcggcaatcggcactctcagactactccgcggcggcgaaaatgtctctggtagcgaacgaggagttccagcacattctgcgtgtgctgaataccaacgttgatgggaagcagaagatcatgtttgccctgacctccatcaagggtattggaaggagattcgccaacatctgttgcaagaaggctgatgttgacatgaacaagagggctggtgaattgagtgctgcggagttggataatgtgatgactgttgttgctaaccctaagcagtttaagatcccagattggtttttgaacaggaagaaggattacaaggatgggaagtaccatcaggtggtgtctaatgcccttgacatgaagctcagggatgacttggagagactcaagaaaatcagaaaccatcgtggtttgaggcactactggggcctccgtgtgcgtggtcagcataccaagactactggccgcagagggaaaactgttggtgtctctaagaagcgttaagctgttatgttttggcttggagattagatatttttgaggaggcaaatttgaagttatatttcagacttgtttcgcatacaaactttgtatttgtcaaatgccgtgactatttcagttttgtttgctattgcattaagtttctgtttacctggatgatgttggtattcttagttgtagaccttaaaatagtattgatgaaattaagtattcatgttttttcctaaaatcacatggaagggctttctcaaataatgatactactgcatgagatgcaaaatgtgatgccctgttattcactgccttatgtggtaacttatgtaagtcccccaaaaagggggtagttttttttgaatgctgcctaaaataaatataactggttttccctttt

SEQ ID NO: 2971 - DNA, 689 bp, Tropaeolum majus
gtaacaaaagaagcgcgcaaattctacagtgacaccacttcatctcgccccataaccaggaggaatcaacaacgccaatcatgtctctagtagcgaatgaggatttccagcatattcttcgtgtattgaacacgaacgttgatggaaaaaagaacatcatgttcgctctcacatcgatcaaaggtattggtcgccgtttcgccaacattgtgtgcaaaaaagccgatgttgacatgactaaaagggctggtgaactatctgctgcggagctagagaatctaatggtcattgtcgcgaatcctcgtcagttcaagatccctgattggtttttaaacagacaaaaggattacaaggatggaaaatattctcaggttgtctccaatgcattggatatgaagcttagggatgatcttgagcgtttgaagaagatcagaaaccaccgaggtctgcgacactactggggtctacgagtccgtggacaacacacaaagacaactggtcgtagggggaagactgttggagtgtcaaagaagcgttaagttgctgtcgttctttttttttgtttccatatgcaaattttgattatgtgcgtttttttctgtggcataattatttccttaatttggtccaaagaatgacttgaaggtactgagccttctcattagataaatcatacatacaattttaag

SEQ ID NO: 2972 - DNA, 838 bp, Nicotiana benthamiana
  misc_feature (247)..(247): n is a, c, g, or t
gcacgaggttttctttggagcttggcatctctttcaaactaaagcagccgcagccgcagccgcactgtgccgaaagcagtgaaaccctagccatgtcgctggttgcaaacgaagagtttcagcacattcttcgtgtacaaaacacgaacgttgttggaaagcagaagatcatgttcgctatgacctctatcaaaggtatcggtcgccgttttgctaacattgcttgcaagaaagccgatatcgacangaacaagagggccggagaactctctgctgcagagcttgacagcttgatggtggttgtggctaatcctcgccaattcaaaatcccagattggtttttgaacaggcagaaggattacaaggatggcaagttttctcaagttacatctaatgcacttgatatgaaactcagggatgatctggaacggctgaagaagatcaggaatcaccgtggtttgcgtcactactggggccttcgtgtacgtggtcagcacacaaagaccactggccgcagggggaagactgttggtgtctccaagaagagataaatcatttacttgccagttcctttatgttttatgcttctctttggtatgtggagtccgaacacccgcaggaagtttattaggtattttgtaatgtttgcactggaattttctagtcttgccatttggagggttatagttcctataaatcctctggcggcattgcaagcatttgtttattgtgggatcaaagttttgccggttttacgcttgaattattacattgattgagtactttttattgagatgcattctgttcttctaaataaatagcgagtaagaaatagtta

SEQ ID NO: 2973 - DNA, 809 bp, Allium cepa
attcaggtagcataaaatcgcaacttttctagggtttactataccgttaccttgatagccgtcatctctgcaaactatatcgctgctgcaatgtctctagttgcaggtgaggacttccaacatattctgcgtgttcaaaacacaaatgttgatggaaagcagaaaatcatgttcgccttgacttcaatcaagggtattggaagacgatttgcgaatatcgtctgcaaaaaagcagacatagatatgaaccgaagggctggtgaactgtctaatgccgagattgaccaactcatgaacattgttgctaaccctcgtcaattcaagatcccagactggttcttgaacaggcagaaggattacaaagatggcagatacactcaggttacttccaatgctttggacatgaagctcagggatgatttggagcgtttgaagaagatcaggaaccatcgtggtctgcgacactactggggtcttagagtcagaggacaacacacaaagactactggaagaagaggaaagactgttggtgtttccaagaagcgttgagtttctttaaattgcttctcttgtttctgttattttatggttttatcgatatgtatgccttaagacgttttgttttcgagagtttgctatgatggctagttgtttcctaccatttgtatcaatcaatattagattatttttagtactgtatttcccttaaagaaatttgacctgagatggtatattttaagtctgaattgttgatgtttctactcctctgtgcatctatggagaatggtgtctgcccaagggttactctt

SEQ ID NO: 2974 - DNA, 883 bp, Allium cepa
tatgaaatgcctatgggtttagagccagcccatttgctatttctattcaggtagtataaaatcgcaacttttctagggtttactacaccgttaccttgatagccgtcatctctgcaaactatatcgctgctgcaatgtctctagttgcaggtgaggacttccaacatattctgcgtgttcaaaacacaaatgttgatggaaagcagaaaatcatgttcgccttgacttcaatcaagggtattggaagacgatttgcgaatatcgtctgcaaaaaagcagacatagatatgaacagaagggctggtgaactgtctaatgccgagattgaccaactcatgaacattgttgccaaccctcgtcagttcaagatcccagactggttcttgaacaggcagaaggattacaaagatggcagatacactcaggttacttccaatgctttggacatgaagctcagggatgatttggagcgtttgaagaagatcaggaaccatcgtggtctgcgacactactggggtcttagagtcagaggacaacacacaaagactactggaagaagaggaaagactgttggtgtttccaagaagcgttgagtttctttaaattgcttctcttgtttctgttattttatggttttatcaatatttatgccttaagacgttttgttttcgagagtttgctttatgatggctagttgtttactaccatttgtatcaatcaatattagattattttagtactgtatttcttttaaaaaatttgtcctgagatggtatattttaagtctgaattgttgatgtttctactctgttctctgtgcatgtatagagaatggtgtctgcccaagtgcaactttcaagtttacaagcgagctgtaataatt

SEQ ID NO: 2975 - DNA, 747 bp, Allium cepa
ttgcagccgtcacatttcctcctccttcacagattggatcacataatctaagctgccatgtctctagtcgcaggtgaagattttcagcacattcttcgtgttcagaacacgaatgttgatggaaagcagaagattatgtttgctttgacctcgattaagggtattggaaggagatttgctaacatagtttgcaaaaaagctgacattgacatgaacagacgggccggggaactctcaaatgctgagattgatcaactcatgactattgtatccaaccctcgtcaatttaagattccagactggttcttgaacagacagaaggactacaaggatggaagatacacacaggtcacttccaatgctttggacatgaagctcagggatgatttagagcggttgaagaagatcaggaaccaccgagggctgaggcactactggggtcttagagtccgagggcaacacaccaagaccaccggtagaaggggaaaaactgttggtgtctccaagaagcgttaaaatttctttgtactagttgcatcttattcttcttttgtttattttaatgttctaattagatattttttaatgtatttgtgacttgacaactgtgtttcatttgaactgtttggtcttgcttagctcttttgctctttgtgaatcttgtgccctttgatttttatttttcacggggtcctttgtaatgcggctacgaacctggttctgtaaaactaaggatgctgttggttt

SEQ ID NO: 2976 - DNA, 742 bp, Allium cepa
ttgcagccgtcacatttcctcctccttcacagattggatcacataatctaagctgccatgtctctagtcgcaggtgaagattttcagcacattcttcgtgttcagaacacgaatgttgatggaaagcagaagattatgtttgctttgacctcgattaagggtattggaaggagatttgctaacatagtttgcaaaaaagctgacattgacatgaacagacgggccggggaactctcaaatgctgagattgatcaactcatgactattgtatccaaccctcgtcaatttaagattccagactggttcttgaacagacagaaggactacaaggatggaagatacacacaggtcacttccaatgctttggacatgaagctcagggatgatttagagcggttgaagaagatcaggaaccaccgagggctgaggcactactggggtcttagagtccgagggcaacacaccaagaccaccggtagaaggggaaaaactgttggtgtctccaagaagcgttaaaatttctttgtactagttgcatcttattcttcttttgtttattttaatgttctaattagatattttttaatgtatttgtgacttgacaactgtgtttcatttgaactgtttggtcttgcttagctcttttgctctttgtgaatcttgtgccctttgatttttatttttcacggggtcctttgtaatgcgactacgaacctggttctgtaaaactaaggatgctgtt

SEQ ID NO: 2977 - DNA, 792 bp, Orobanche aegyptiaca
acagcatcattcgtaccccaattcaaaaccctagctatgtcgctggtagcaaatgaagagttccagcacattctgcgtgtgcagaatacaaacgtggacgggaagcagaagatcatgttcgctctgacctccatcaaaggtatcggtcgccgtttcgctaacattgtctgcaagaaggctgacgtcgacatgaacaagagggccggtgaactttcgaatgcggagattgataacctgatggtgatcgttgcaaatcctcgtcagttcaagatccccgactggttcttgaacaggaagaaggattacaaggatggaaagttttctcaggtgacatccaacgctttggatatgaagctcagggacgatctcgagcgtctgaagaagatcaggaaccaccgtgggctccgtcactattggggtcttcgtgttcgtggtcagcacaccaagaccactggccgtaggggaaagactgttggtgtgtccaagaagcgataagcgtgcgtcgttttttatttaatggtatggttaaaatgataattatgtttggattctggttgtaccctagttgggaatttgctatctcgttgttctccgttttatggtaatttttatatgggacctaatcgacttgaggaatgaatcagtagagttttatactgaactggtcgtgatatttttcgcgattaatttttgcaattaagcctgttacagaaggtggatggaacttgaatattcgaagtgttttttactgataaaaaatggcaatggaaagcatcttttctcaaaaaaaaa

SEQ ID NO: 2978 - DNA, 839 bp, Orobanche aegyptiaca
tagggttcgagccccccgcacttgacagtagagcagccgtcgaacaacacagttctgccctctgctcgattcgaaaccctagccatgtcgctggtagcaaatgaggagttccagcacattctgcgtgtgcagaacacgaacgtggacggcaaacagaagattatgttcgccttgacctctatcaagggtatcggccgacgtttcgccaatatcgtttgtaagaaagccgatgtcgacatgaacaagagggctggtgagctatctgctgcagaaatcgaaaacttgatggtaattgttgcaaatcctcgccaatttaaaattccagactggtttctgaacagaaagaaagattacaaagacggaaagtattctcaagttacatccaatgctctcgacatgaagctgagagatgaccttgagcggttgaagaagatcaggaaccaccgtggtctgcgtcactattggggccttcgcgtgcgtggacagcataccaagactaccggtcgtaggggaaagactgttggtgtctcaaagaaacgttaaacatttttttggttatgttgtctttatgagtaagttctttttggatttattttttgtttttgaagtttttttggactctgttataaacgattttcattggttcttgagagattgttctgttacaagttggagtctgctcttttcatcaatttatgtccttacttttaaaatttaaccgtgaaacataattctcgtttttaattttaaattttctatggagattgaaccgtaagaacttgtattagttttttggcaaaacggtttcctagattgaaatgagttgattggttatcgtt

SEQ ID NO: 2979 - DNA, 559 bp, Carica papaya
agacgagcttctcccttctgttggctgaaaacttgtacgtaagaatcctaaaacggaaacagaagagtagacatgtcgcttgtggcgaacgaggactttcaacatatacttcgtgtactgaatacgaacgtcgatggtaaacagaagatcatgtttgctctcacctctatcaaaggtattggtcgccgtttcgccaatgtcgtgtgcaagaaagccgatgtcgacatgaacaaaagagccggtgaactatctgccgctgaactggagaacctgatgtccattgtggcaaatcctcgccagtacaagatccctgattggtttctgaacaggcaaaaggattacaaggatggcaagtattcacagcttgtctccaatgcattggacatgaagcttagggatgatctcgagcgcttaaaaaagatcaggaaccaccgaggcctgcgacactactggggtctccgggttcgtggacagcacacaaaaacaactggccgcagggggaagactgtcggtgtctcgaagaaacgataagttggtgtccacttttgtgggaaagtgc

SEQ ID NO: 2980 - DNA, 743 bp, Euphorbia esula
cgacagcaacggagcttcccgaacatcgccgccgcgcagagaagagagcttcttcacatctggaaccctagccatgtcgctggtagcaaatgaagagtttcaacacattcttcgtgttttgaacacgaacgtcgatggtaagcagaaaattatgtttgccctgacctctatcaagggtattggccgccgtctcgccaacatcgtctgcaaaaaagccgatgttgacatgaacaagagagctggtgaactatcaagtgaagagcttgataaacttatggtgattgttgctaatccccgccagttcaagattccagactggttcttgaacaggcaaaaggattataaggatggaaagtaccaccaggttgtttccaatgccttggacatgaagctcagagatgaccttgagcgattgaagaagattagaaaccaccgtgggcttcgtcactactggggtctccgtgttcgtgggcagcacaccaagactactggacgcaggggaaagacagttggtgtctccaagaagcggtgattttgttcttattatatgttcaatcttctggatgatggttttgtgtgtgttcaattttatctttctttttatattacctgaaagaacttggtatgtcttagagtgttaaaggaatttcagttttgtaatgcggatattacttgttgcatgcgtttactcagatcagatggattcacttaatttaaaagattttaggtattttgatcttttg

SEQ ID NO: 2981 - DNA, 913 bp, Abies balsamea
catcatgctaaagccctagcggtttctttgcagtgcatagcgttacaggcgactgtggaggctcctgcgttcagcgaaaatgtctttgattgccaatgaagaattccagcacattcttcgtgtcctcaacactaatgtcgatgggcgacagaagatcatgtttgccctgacttccataaagggaattggtcggcgtttggctaaccttgtatgcaaaaaggccgatgttgatatgaacaagagagctggtgagctttctgcacttgagcttgagaatctgatgacaattgttgcgaatcctaaacaattcaagatcccggaatggtttttaaacagacagaaagatatcaaggatggccgaaccagtcaggttgtatccaatgctcttgacatgaaactcagggatgacttggaacgcttgaagaagatcaggaaccaccgtggtcttcgtcactactggggccttcgggtgcgtggacagcacacaaagaccactggtcgcaggggaaagactgttggtgtctcaaaaaagcgttgaacatcataatattctggaaagaaacaattttactgaagtttttttccttgttttatcagccactttgggtttatttcattcctaggaatctttaggctatgttatttgacttagtgaagggtctgttaccttttatatgtctgagaaggctgtaaagctacgaatatgtactctatacagtttttaagaatgttctataccgttttataagattcatttgtgttaagataaataataaaatgtttggtaatattgtttttcttgaacaatggcaatagctgatgcagattttggcttcctctgggtttatttcattcttagggatctttaggtcatgttatttgacttagtaaaaggtccgttaccttttatatg

SEQ ID NO: 2982 - DNA, 760 bp, Amsonia hubrichtii
accctagccccccattcggagacccccagaaggtgtttggacgattctgaggaattctcatttgtcattgccataaccatgtctctggtagcaaacgaagactttcagcacattctgcgtatccagaacacaaacgtagatggaaaacagaaggtgatgttcgcgcttacctctattaagggtattggccgtcgttttgccaacattatgtgcaaaaaggctgatgtcgacatgaacaagagagctggtgagctgtctgctcaagagattgacaacttgatgacaattgtggccaaccctcgccaatttaagatcccagattggttcctcaacaggcagaaggattacaaggatggaaagtactcacaagttgtttccaatgcactggacatgaagctgagggatgaccttgagcgattgaaaaagattaggaaccaccgtggtctccgtcactactggggcctcagagtgcgtggacagcacaccaaaacaacaggacgtaggggcaagactgttggtgtctcgaagaagcgttgagttaggataccatatggattgtctttacttccagttttgccaactctgatttgttttcagtatagcagaaattgtgaaccaaaaggattttgtagtatgagattagattttaaagacctgaggattgagttggtggtgaattgatgttgctacttcaatgaatattgcttgatggcttatgaactcttttatctaaagctatttgataatccattatgcattg

SEQ ID NO: 2983 - DNA, 488 bp, Arnica chamissonis
cggatcaccagccgccaagacctgcaactccgactgcaatcatgtcgctcgtcgcaaatgaagattttcagcacattcttcgtgttcagaacacaaatgttgacggcaaacagaagattatgtttgctatgacttccatcaagggtattggtcgtcgttttgccaacatcgtctgcaaaaaggccgatgtcgacatgaacaagagggctggagaactttctaatgctgagatagataatctgatgaccatcgttgctaatccacgccagttcaaaatcccagattggtttttgaacaggaagaaagattacaaagatgggaagtactcacaagtcacatcaaatgctcttgacatgaaattgagagacgaccttgaacgattgaagaagatcaggaaccatcgtggtcttcgtcattactggggtctccgagtgcgtggacagcacaccaaaaccaccggtcgtaggggaaagactgttggtgtgtcc

SEQ ID NO: 2984 - DNA, 864 bp, Cedrus atlantica
ttatttgcccatggttacaaccacctttctctactgcctaaaatatgtcgaaatagggctagggttccaactagggttttatagcaagcctgtaaatactttcatcctccataactctggcttttgaaactacgcctggcattggagcctgcaagctgtgtctgcgaaaatgtcgctcgtagcgaacgaagattttcagcacattcttcgtgtgctcaacaccaatgtcgacggacgccagaagataatgtttgcgctgacatccatcaagggtatcggtcgccgtttcgctaatatcgtatgtaagaaggcagatgtcgacatgaacaaaagagctggagagctttcggcagctgagttggaaggactgatgactatagtaaataatccgaagcagtttaagatcccagagtggtttctcaacagacagaaggactataaggatggacgtaccagtcagctcgtctccaatgccctcgacatgaggctcagggatgacttggagcgtcttaagaagattaggaaccatcgtggactccgacactattggggcctacgtgttcgtgggcagcacacaaaaaccactggtcgtaggggaaagactgttggtgtctcaaagaagcgttgagtatatattgtttttatgagaaaattttcatgcctaattggataagtttgcctcagcttgaagcataatagtcttgttattgtgcatcttctctgcttttgaatgcctgaattcttgggtagttatgtccacaactatatcaataccattgaggaccatcataaacaattggcattaggaatacttgctcaattttgttctagtttcagtgagcctcctctttgttatcattaggc

SEQ ID NO: 2985 - DNA, 808 bp, Cedrus atlantica
tatttattgttcgtgtattttctcacgaacctgtcatcataccgaagtacttgctgtctttgcagacattagcgtcacacgcgactgtggaggctccggcgttcagcgaaaatgtctttgattgcgaatgaagacttccaacacattcttcgggttctcaacactaatgtcgatgggcgacagaaaatcatgtttgccctgacttccatcaagggaataggtcggcgtttggctaaccttgtatgcaaaaaggccgatgttgatatgaacaagagagctggtgagctttctgctcttgagcttgagaatctgatgataattgttgggaatcctaaacaattcaagatcccagactggtttttaaacagacagaaagatatcaaggatggccgaaccagtcaggttgtatccaatgctcttgacatgaaactcagggatgacttggaacgcttgaagaagatcaggaaccaccgcggtcttcgtcactactggggccttcgggtgcgtggacagcacacaaagaccactggtcgcaggggaaagactgttggtgtctcaaaaaagcgttgagcatgataatattgtggaaaaacaattttgtggaagttttccttgttttattagccactgggtttatttcattcctctgagtctttaggttgtgttatttgactaggtaaaaggtctgctaccttttatatgttgagaaggctgtaaagcttcgactgtgcactctctattttgaaatgtttttaagaatgttctatccagttttataagatttatttgtgttgagaataaaggtttg

SEQ ID NO: 2986 - DNA, 932 bp, Gnetum gnemon
atgaagaaacgaaggcaaggtaaacggcatgaaaaagtaaattatagcaatgaaccctaagtccaggaagctatttaaactggggactagggttttagagacgagtcgtttgccacatcgagattgcccgagttggaggatttccggcggagaaaacttgctgcgatttttgcactcgtgattgttttggagggccttcgctctttgcagcgatgtctttggtggcgaacgaagatttccagcacattcttcgtgttctgaacacgaatgtcgatgggcgacagaagatcatgtttgccctcacttccatcaagggtattggaagacgttttgctaacattgtctgcaagaagggcgatgttgatatgaacaagagggcaggagagctgtcggctgcagagattgagaacctcatggtgattgttgccaatcccaggcagttcaagatccctgactggttcctcaacaggaagaaggacatcaaggacggcagatactcgcaggttgtggccaatgctcttgacatgaagctcagggatgaccttgaacgtttgaagaagatcagaaatcaccgtgggcttcgtcatcactggggccttagagtccgtggacagcacacgaagaccacaggacgtagaggaaagactgttggtgtctccaagaagcgttgaggttgaagatggagattttgcagcgaaacgtaaaagttcaagttttttgttgtttttttgctgtttgaacggttgatcatcgagatatatgccttttttgcaagcgtagtttctttattgtcttattactggcttgattttatgaggactatgtaactttgagggttcctgaatccgttcaaattggttttggtattcacgtgttctttgactacgaattccggaagcaaatttatacatttttgtgactgtcaattttat

SEQ ID NO: 2987 - DNA, 977 bp, Gnetum gnemon
ataagtaggcgtctgcgagcctgagcgcagggtttagcggggatctcgagggccgtgatactgtctcgttcatatttcagtacacaggaagatctattgcatcggcaaatatgtctttggtggcaagcgaggatttccagcacattcttcgtgttctgaacacgaacgtggatggacgtcagaagatcatgtttgctcttacatccatcaagggtatcgggaggcgattcgccaacatagtctgcaagaagggagatgttgacatgagcaagagggcaggagaattgtcggcagcagagcttgagaatctgatggtgatcgttgccaatcctcgccagtttaagatccctgactggttcctgaacaggaagaaggacatcaaggatggtaggtactcgcaggttgtggccaacgcccttgacatgaaactcagggatgatcttgagcgcttgaagaagataagaaaccaccgagggcttcggcatcactggggcctcagggtgcgtggtcaacatacaaagaccactggccgtagagggaaaactgtcggtgtctctaaaaagcgctgatgctgattatgccaagaaggattgcaggattatgtttttgcagagtgttcttttcttttgtcttttttttgtttgtttgaaacaagagatacattattaaagattttgctactcctgcatgtccaatcacatgcacaaagtgttcttttctttgaacgtatttatcacaggtttggtttaccatgccttcatattttaacgtactgtagctttgattgcctattgcattaattgactgtaacagtagcacgttatctaaactggtaatggtgagttctaaactgtaacagtagcacgttcatctctccggaggcatgttactatattgtagttttggttgcctattgcatcacttgttttacaagtaacaagtagcaatgttgaatgttatttcaaagcaaattcaaa

SEQ ID NO: 2988 - DNA, 650 bp, Guizotia abyssinica
agggttcacagagtcatcggcgattttgagcattggcagccgcttgaagaacaaactcaaatcgcagtcatgagcctggtagcaaatgaagatttccagcatattcttcgtgtgcagaacacgaatgttgatggaaagcagaagatcatgtttgctatgacctccattaaaggtatcggtcgtcgtttcgcgaacattgtctgcaaaaaggccgatgttgatatgaacaagagggccggagaactttctagtgctgagatagacaatcttatgacaattggggctaatccccggcagtttaaaatcccagactggtttcttaacagaaagaaggattacaaggatggcaagtactcccaagtcacatccaacacccttgacatgaagcttagagatgatctcgagagattgaagaagatcaggaaccatcgtggtcctcgtcattactggggtctgagagtacgtggacagcacacgaagactactggtcgtaggggtaagaccgttggtgtgtccaagaagcgataagcagctagtcttggtttttattttccatcatatttagaacgccgggcacttcatgttatgctatgttaagtttgactgtttttggtgtcgatgtaagattcttaatcgagagtttgtttaca

SEQ ID NO: 2989 - DNA, 805 bp, Podocarpus macrophillus
cgcttcggaggaaggaagttgtcacggtttttgagcttctgcaaaaatgtcgcttgttgcaaatgaagaattccaacatattcttcgtgtcctcaacacgaatgttgatgggcgacagaagatcatgtttgcccttacgtcgatcaagggaattggtaggcgttttgccaacattgtctgtaaaaaagctgatgttgacatgaacaagagagctggtgagctttctgctgctgagcttgaaaccctaatgggaattgttgctagtcctcggcaattcaagattcctgactggtttttgaacagaaagaaggatcataaggatggcaagtactcgcaggttgtagccaatgctcttgatatgaaactgagagatgacttggaacgcttgaagaagatcaggaatcatcgtggtctacgtcactattggggtctacgagtgcgtggacaacatacaaagaccactggtcgtaggggaaagactgttggtgtttcaaaaaagcgttgagcacaaaaatattatggtggaaaacaatttcacctatggctttgtcgtgtttttctttagaaatccttccatgtattcttacttcacaaaaggcctaggcgtattttctttttgaaacattaataagtttattcgagaagcctaaaagattttgattttacgctcttcaatttctcataatgtttatttgaaagttctatctacatctgcaagactgtttaaatggtggtggttaaatgtctggtaatatatatctatttgataccatatctatataaagtgatttatttttctgcaagc

SEQ ID NO: 2990 - DNA, 914 bp, Picea glauca
tcgagttaattaaattaatcccccccccccccgatcatactaaagccctagcggtcttaggaatacttagcgttacaggcgactgcggaggctccagcgttctgcgaaaatgtctttgatcgcgaatgaagagttccaacacattcttcgtgtcctcaacaccaatgtcgatgggcgacagaagatcatgtttgccctgacttctatcaagggaattggtcggcgtttggctaatcttgtatgcaaaaaggccgatgttgatatgaacaagagagctggtgagcttacggcacttgaacttgagaatctgatgataattgttgcgaatcctaaacaattcaagatcccagattggtttttaaacagacagaaggatatcaaggatggccgaaccactcaggtggtatccaatgctcttgatatgaaactcagggatgacttggaacgcttgaagaagatcaggaaccaccgtggtcttcgtcactactggggccttcgggtgcgtggacagcacacaaagaccactggtcgcaggggaaagaccgttggtgtctcaaaaaagcgttgagcatgataatattctggaaaaaaacaattttgctcagtttttttccttgttttatcagtcattctgggtttatttcattcccgggaatcataaggttgcgttatttgacttagtaaaatggtggttcacctttgatgtgtttgagaaggctgtaaagcttcgactgtgcactttctatcttgaaatgtttttaagaatgttctgtctagttttataagatttattagagaaagaacagagtaaaggtttggtgcttttgtttttcttgatcaatgacatagattgtgcagaatttggcttcctctttgcttctgaaatctagttgctattcacttttgttgtcttt

SEQ ID NO: 2991 - DNA, 923 bp, Picea glauca
actaaagccctagcggtcttaggaatacttagcgttacaggcgactgcggaggctccagcgttctgcgaaaatgtctttgatcgcgaatgaagagttccaacacattcttcgtgtcctcaacaccaatgtcgatgggcgacagaagatcatgtttgccctgacttctatcaagggaattggtcggcgtttggctaatcttgtatgcaaaaaggccgatgttgatatgaacaagagagctggtgagcttacggcacttgaacttgagaatctgatgataattgttgcaaatcctaaacaattcaagatcccagattggtttttaaacagacagaaggatatcaaggatggccgaaccactcaggtggtatccaatgctcttgatatgaaactcagggatgacttggaacgcttgaagaagatcaggaaccaccgtggtcttcgtcactactggggccttcgggtgcgtggacagcacacaaagaccactggtcgcaggggaaagaccgttggtgtctcaaaaaagcgttgagcatgataatattctggaaaaaaacaattttgctcagtttttttccttgttttatcagtcattctgggtttatttcattcccgggaatcataaggttacgttatttgacttagtaaaatggtggttcacctttgatgtgtttgagaaggctgtaaagcttcgactgtgcactttctatcttgaaatgtttttaagaatgttctgtctagttttataagatttattagagaaagaacagagtaaaggtatggtgcttttgtttttcttgatcaaatgacatagattgttcagaatttggcttcctctttgcttctgaaatctagttgctattcacttttgttgtctttcctgaaagggcaagctattatatctcctgttgtgtatgctgaatac

SEQ ID NO: 2992 - DNA, 904 bp, Picea glauca
aagtgatatttattgttggtgtattctctcacgaatctctcatcacactaaagccctagcggtcttaggaatacttagcgttacaggcgactgcggaggctccagcgttctgcgaaaatgtctttgatcgcgaatgaagagttccaacacattcttcgtgtcctcaacaccaatgtcgatgggcgacagaagatcatgtttgccctgacttctatcaagggaattggtcggcgtttggctaatcttgtatgcaaaaaggccgatgttgatatgaacaagagagctggtgagcttacggcacttgaacttgagaatctgatgataattgttgcgaatcctaaacaattcaagatcccagattggtttttaaacagacagaaggatatcaaggatggccgaaccactcaggtggtatccaatgctcttgatatgaaactcagggatgacttggaacgcttgaagaagatcaggaaccaccgtggtcttcgtcactactggggccttcgggtgcgtggacagcacacaaagaccactggtcgcaggggaaagaccgttggtgtctcaaaaaagcgttgagcatgataatattctggaaaaaaacaattttgctcagtttttttccttgttttatcagtcattctgggtttatttcattcccgggaatcataaggttgcgttatttgacttagtaaaatggtggttcacctttgatgtgtttgagaaggctgtaaagcttcgactgtgcactttctatcttgaaatgtttttaagaatgttctgtctagttttataagatttattagagaaagaacagagtaaaggtatggtgcttttgtttttcttgatcaatgacatagattgtgcagaatttggcttcctctttgcttctgaaatctagttgcta

SEQ ID NO: 2993 - DNA, 1035 bp, Picea glauca
aagtgatatttattgttggtgtattctctcacgaatctctcatcatactaaagccctagcggtcttaggaatacttagcgttacaggcgactgcggaggctccagcgttctgcgaaaatgtctttgatcgcgaatgaagagttccaacacattcttcgtgtcctcaacaccaatgtcgatgggcgacagaagatcatgtttgccctgacttctatcaagggaattggtcggcgtttggctaatcttgtatgcaaaaaggccgatgttgatatgaacaagagagctggtgagcttacggcacttgagcttgagaatctgatgataattgttgcgaatcctaaacaattcaagatcccagattggtttttaaacagacagaaggatatcaaggatggccgaaccactcaggtggtatccaatgctcttgatatgaaactcagggatgacttggaacgcttgaagaagatcaggaaccaccgtggtcttcgtcactactggggccttcgggtgcgtggacagcacacaaagaccactggtcgcaggggaaagaccgttggtgtctcaaaaaagcgttgagcatgataatattctggaaaaaaacaattttgctcagtttttttccttgttttatcagtcattctgggtttatttcattcccgggaatcataaggttgcgttatttgacttagtaaaatggtggttcacttttgatgtgtttgagaaggctgtaaagcttcgactgtgcactttctatcttgaaatgtttttaagaatgttctgtctagttttataagatttattagagaaagaacagagtagaggtttggtgcttttgtttttcttgatcaatgacatagattgtgcagaatttggcttcctctttgcttctgaaatctagtttctattcacttttgttgtctttcctgaaagggcaagctattatatctcctgttgtgtatgctgaatacttttccttaaaagtttctttgtaattttttaaaaaatctcaattttagatgggagacacttctctag

SEQ ID NO: 2994 - DNA, 1024 bp, Picea glauca
gatgagcttagataatgctaactcgttgccaacttcaaaccacgatggctgattaaaagtaaaactcaaaaccatttaaccccagctccctcaaaacctaactatataagtttactaaaagtgaaggattagggtttttctgaggtcaagtgatatttattgttggtgtattctctcacgaatctctcatcatactaaagccctagcggtcttgggaatacttagcgttacaggcgactgcggaggctccagcgttctgcgaaaatgtctttgatcgcgaatgaagagttccaacacattcttcgtgtcctcaacaccaatgtcgatgggcgacagaagatcatgtttgccctgacttctatcaagggaattggtcggcgtttggctaatcttgtatgcaaaaaggccgatgttgatatgaacaagagagctggtgagcttacggcacttgagcttgagaatctgatgataattgttgcgaatcctaaacaattcaagatcccagattggtttttaaacagacagaaggatatcaaggatggccgaaccactcaggtggtatccaatgctcttgatatgaaactcagggatgacttggaacgcttgaagaagatcaggaaccaccgtggtcttcgtcactactggggccttcgggtgcgtggacagcacacaaagaccactggtcgcaggggaaagaccgttggtgtctcaaaaaagcgttgagcatgataatattctggaaaaaaacaattttgctcagtttttttccttgttttatcagtcattctgggtttatttcattcccgggaatcataaggttgcgttatttgacttagtaaaatggtggttcacctttgatgtgtttgagaaggctgtaaagcttcgactgtgcactttctattttgaaatgtttttaagaatgttctgtctagttttataaaatttattagagaaagaacagagtaaaggtttggtgcttttgtttttcttgatcaatgacatagattgtgcagaatttggcttc

SEQ ID NO: 2995 - DNA, 1119 bp, Picea glauca
ggaagatgagcttagataatgctaactcgttgccaacttcaaaccacgatggctgattaaaagtaaaactcaaaaccatttaaccccagctccctcaaaacctaactatataagtttactaaaagtggaggattagggtttttctgaggtcaagtgatatttattgttggtgtattctctcacgaatctctcatcataccaaagccctagcggtcttaggaatacttagcgttacaggcgactgcggaggctccagcgttctgcgaaaatgtctttgatcgcgaatgaagagttccaacacattcttcgtgtcctcaacaccaatgtcgatgggcgacagaagatcatgtttgccctgacttctatcaagggaattggtcggcgtttggctaatcttgtatgcaaaaaggccgatgttgatatgaacaaaagagctggtgagcttacggcacttgaacttgagaatctgatgataattgttgcgaatcctaaacaattcaagatcccagattggtttttaaacagacagaaggatatcaaggatggccgaaccactcaggtggtatccaatgctcttgatatgaaactcagggatgacttggaacgcttgaagaagatcaggaaccaccgtggtcttcgtcactactggggccttcgggtgcgtggacagcacacaaagaccactggtcgcaggggaaagaccgttggtgtctcaaaaaagcgttgagcatgatagtattctggaaaaaaacaattttgctcagtttttttccttgttttatcagtcattctgggtttatttcattcccgggaatcataaggttgtgttatttgacttagtaaaatggtggttcacctttgatgtgtttgagaaggctgtaaagcttcgactgtgcactttctatcttgaaatgtttttaagaatgttctgtctagttttataagatttattagagaaagaacagagtaaaggtatggtgcttttgtttttcttaatcaatgacatagattgtgcagaatttggcttcctctttgcttttgaaatctagttgctattcacttttgttgtctttcctgaaagggcaagctattatatctcctgttgtgtatgctgaatac

SEQ ID NO: 2996 - DNA, 972 bp, Picea glauca
ttttctgaggtcaagtgatatttattgttggtgtattctctcacgaatctctcatcatactaaagccctagcggtcttgggaatacttagcgttacaggcgactgcggaggctccagcgttctgcgaaaatgtctttgatcgcgaatgaagagttccaacacattcttcgtgccctcaacaccaatgtcgatgggcgacagaagatcatgtttgccctgacttctatcaagggaattggtcggcgtttggctaatcttgtatgcaaaaaggccgatgttgatatgaacaagagagctggtgagcttacggcacttgagcttgagaatctgatgataattgttgcgaatcctaaacaattcaagatcccagattggtttttaaacagacagaaggatatcaaggatggccgaaccactcaggtggtatccaatgctcttgatatgaaactcagggatgacttggaacgcttgaagaagatcaggaaccaccgtggtcttcgtcactactggggccttcgggtgcgtggacagcacacaaagaccactggtcgcaggggaaagaccgttggtgtctcaaaaaagcgttgagcatgatagtattctggaaaaaaacaattttgctcagtttttttccttgttttatcagtcattctgggtttatttcattcccgggaatcataaggttgtgttatttgacttagtaaaatggtggttcacctttgatgtgtttgagaaggctgtaaagcttcgactgtgcactttctatcttgaaatgtttttaagaatgttctgtctagttttataagatttattagagaaagaacagagtaaaggtatggtgcttttgtttttcttaatcaatgacatagattgtgcagaatttggcttcctctttgcttctgaaatctagttgctattcacttttgctgtctttcctgaaagggcaagctattatatctcctgttgtgtata

SEQ ID NO: 2997 - DNA, 878 bp, Picea glauca
gggaggtcaagtgatatttattgttggtgtattctctcacgaatctctcatcatactaaagccctagcggtcttgggaatacttagcgttacaggcgactgcggaggctccagcgttctgcgaaaatgtctttgatcgcgaatgaagagttccaacacattcttcgtgtcctcaacaccaatgtcgatgggcgacagaagatcatgtttgccctgacttctatcaagggaattggtcggcgtttggctaatcttgtatgcaaaaaggccgatgttgatatgaacaagagagctggtgagcttacggcacttgaacttgagaatctgatgataattgttgcgaatcctaaacaattcaagatcccagattggtttttaaacagacagaaggatatcaaggatggccgaaccactcaggtggtatccaatgctcttgatatgaaactcagggatgacttggaacgcttgaagaagatcaggaaccaccgtggtcttcgtcactactggggccttcgggtgcgtggacagcacacaaagaccactggtcgcaggggaaagaccgttggtgtctcaaaaaagcgttgagcatgataatattctggaaaaaaacaattttgctcagttttttccttgttttatcagtcattctgggtttatttcattcccgggaatcataaggttgcgttatttgacttagtaaaatggtggttcacctttgatgtgtttgagaaggctgtaaagcttcgactgtgcactttctatcttgaaatgtttttaagaatgttctgtctagttttataagatttattagagaaagaacagagtaaaggtttggttcttttgtttttcttgatcaatgacatagattgtgcagaattt

SEQ ID NO: 2998 - DNA, 953 bp, Fragaria vesca
atcgtcttcttcactcgccccttctctcaccaaacggcgcacacacccacacgcagagactcccagagcgcagaagccaaaccctaaagccgccgccgcaaccatgtctctcgtagcgaacgaggagttccagcatattctgcgtgtgatgaacaccaacgtcgatgggaagcagaagatcatgtttgctctcacctctatcaaaggtatcggtcgccgtctcgctaacatcgtctgcaagaaggccgacgtcgacatgaacaagagggctggagagctgtctgctcaggagattgagaacctgatgcacattgtggcaaatccccgccagttcaagattcctgactggtttctcaacagaaagaaagactacaaagatggtaaatattcccaggttgttgccaatgccttggacatgaagctcagggatgatctcgagaggctcaagaagatcaggaatcaccgtggtctgcgtcactactggggccttcgtgtgcgtggacagcacaccaagaccactggtcgcaggggtaagactgttggtgtgtccaagaagcgttgaagaacatgttctggctgtctgggaggatgccatgttgttgctctttttgtgttatttaaaataccttctagtttagcatcttcagtcaagttaagttttggtggattaattcagaatatctagttatcgtctatctattccatttgactgtttgatactttgtgtttgaggatagtacggtatgcaatggaagtggataatttttatttcatcggccttttgttcagtcatgtttgattgatcaagcggtcttttaatctgatgcctggcattgagtttgagatatggacattggaaatcaaaaatggatctactgattacacaagctaaatgcgtttctgcctgtgtagtctaaatgcagcagggatttgatttgaaagttctctagatt

SEQ ID NO: 2999 - DNA, 504 bp, Flaveria ramosissima
attttgtatcatttgccgcttgaagacgaaactcaaatcgccaccatgagtttggtagcaaatggagattttcagcatattcttcgtgttcagaacacgaacgttgatggcaaacaaaagatcatgttcgccatgacctccattaaaggtattggtcgtcgttttgcgaacatcgtctgcaagaaggctgatgttgatatgaacaagagggcaggagaactttctagtgctgagattgataatctgatgacaatcgttgccaacccacgacagtttaaaattccagattggtttcttaacagaaagaaggattacaaggatggcaagtactctcaagtcacatctaacgcccttgacatgaagcttagggatgatcttgaaagattgaagaagatcaggaaccaccgtggtcttcgtcattactggggactgcgagtacgaggacagcacacaaagactactggtcgtcgtggtaagaccgttggtgtgtcgaagagcgatgag

SEQ ID NO: 3000 - DNA, 1786 bp, Brassica juncea
gttctaagatgtctaggctacatccagccttctcatcttcccttcacagagcttcttaagttcattctgtttgcaaacttttcgatcgttgggatgaatgttagtcttatgtggaactctgttgggttttatcagattgcaaagcttagcatgattcctgtagcttgcttgttggaagtagtgttcgataagattcgttactcaagagacacgaagcttagcataggacttgttcttgtgggtgttggtgtttgcactgttactgatgttagtgtcaacaccaaaggcttcgttgctgcttttgttgctgtctggagtactgctttgcaacaatactatgttcattatctccagcgaaagtattcgcttacctcattcaacctactgggtcatactgctccggcccaagctgcaacgttgttgatagtcggtccatttctcgacttttggctgacagagaaacgagtagacatgtatgactacaacgttgtctctctgatgtttataaccctctcatgcacaatagcgatcgggaccaacctcagccagttcatctgcatcgggagatttacagctgtgtcgttccaagtcctgggccatatgaagacgatcttggtgctgataatgggcttcttcttctttgacagagacggtctaaacctgcacgtggttatcggcatgataattgcagtgctggggatgatctggtacggtaatgcctcgtccaagccaggtggtaaggagaagaaaagctattctcttccaacgacccgtcaacagaaacatggagatgattcggattctgatgaaagaccaaggttaaaagcttagcaagcgttaagcgagttaatcccacatacatggcaccatttttatacatcatatggtttattctttcttagctgaatactgtaaaatcctagtattttaatttatgattttcaatacgatgaactagccttacatatatgccacagttgttatacatcatatgttttgttaccattatttactatggtatgacttcatcaccagttaactatttttcaagctgtaatcacttcaaagccatgataatcgctaacaatggagagtagaaacagatgaaccaatggaaaagaaagagagcacaagaagatccaaaagtatcacacaaactatcacataaaatagttcaaagcagaaacataaatcaaaacgataaagcagtaactagcaacatgtggcttgcttaacgcttctttgagacaccaacagtctttcctctgcgaccagtcgtcttggtgtgctgaccacggacacggagaccccagtagtgtctcagcccacggtggttcctgattttcttgagacgctcaagatcgtccctgagcttcatgtcaagggcattggagacaacttgagagtactttccgtccttgtagtccttctgcctgttcaagaaccagtctggaatcttgtactgcttggggttcgcaacaatggtcatgaggttgtcgatctcagctgcagataactcaccagccctcttgttcatgtcgacatctgctttcttgcagacaatgttggccaaacgcctcccaatacccttgattgaggtaagggcgaacatgatcttctgctttccatcgacatttgtgttaagcacacggagaatgtgctgaaactcctcatttgctacaagagacattgtgattagcggagatggaatgcgtgagaagaagccgccttcaagcagtgatgatctctgcaagctaaaaacacacaaaagaggtctccccgcgta

SEQ ID NO: 3001 - DNA, 875 bp, Picea glauca
gcggggaggtcaagtgatatttattgttggtgtattctctcacgaatctctcatcatactaaagccctagcggtcttgggaatacttagcgttacaggcgactgcggaggctccagcgttctgcgaaaatgtctttgatcgcgaatgaagagttccaacacattcttcgtgtcctcaacaccaatgtcgatgggcgacagaagatcatgttgccctgacttctatcaagggaattggtcggcgtttggctaatcttgtatgcaaaaaggccgatgttgatatgaacaaaagagctggtgagcttacggcacttgaacttgagaatctgatgataattgttgcgaatcctaaacaattcaagatcccagattggtttttaaacagacagaaggatatcaaggatggccgaaccactcaggtggtatccaatgctcttgatatgaaactcagggatgacttggaacgcttgaagaagatcaggaaccaccgtggtcttcgtcactactggggccttcgggtgcgtggacagcacacaaagaccactggtcgcaggggaaagaccgttggtgtctcgaaaaagcgttgagcatgataatattctggaaaaaaacaattttgctcagtttttttccttgttttatcagtcattctgggtttatttcattcccgggaatcataaggttgcgttatttgacttagtaaaatggtggttcacctttgatgtgtttgagaaggctgtaaagcttcgactgtgcactttctatcttgaaatgtttttaagaatgttctgtctagttttataagatttattagagaaagaacagagtaaaggtatggtgcttttgtttttcttgatcaatgacatagattgtgcc

SEQ ID NO: 3002 - DNA, 1071 bp, Brassica napus
acgggggtccgggaaggacccgaacgagggaaacgtacctggtcggaggaccggccgagcgatactgacgtggcaacacgttcgtcctggacttgggtataaggggcggaaagactaatcgaaccatctagtagctggttccttcccgaaggttacccgtcctaggatagctggagctcggaacgaagttcgtatcgggtaaagccaatgattagaggcgatcggggacggcaatgtcctcgacctattctcaactttaaataggtagacggggtggctgcttgttgagccatcccacggaatcgagagctccaagtgggccgatttttggttaaggcagggacctcctcgcgtgttttagcttgcagagatcgtcacttcttgaaggcggcggcttctcctcactcatctccgctaatcacaatgtctctggtcgcgaatgaagagtttcagcacattctccgtgtgcttaacacaaatgtcgatgggaagcagaagatcatgttcgcccttacctcaatcaagggtattgggaggcgtttggctaacatcgtctgcaagaaagcagatgtcgacatgaacaagagggctggtgagctatctgcagctgagatcgacaacctgatgaccatcgttgccaacccgaagcagtacaagatcccagactggttcttgaacaggcagaaggactacaaggacggcaagtactcccaagttgtctccaacgcccttgacatgaagctcagggatgatctcgagcgtctcaagaagatcaggaaccaccgtgggctgagacactactggggtctccgtgtccgtggacagcacaccaagacaaccggtcgcagaggaaagaccgttggtgtgtcaaagaagcgttaagcaagccacatgttgctatttactactgctttatttgatatgcttcatatgaaccggctttgatttatgtttctgcttcgaactagtttatgtgttgcttttggatatttgaaatagtttatgtcacttttggatcttccaaatagtttgtgtgatacttttggatcttcctgtcctctcttattatct

SEQ ID NO: 3003 - DNA, 904 bp, Brassica juncea
acgcggggctaattggtttgcgcgagagttagtgtgtaaaacggcgacagcttctcatcctctctctcaggcagcttcttccgatcaacaatgtcgctggtagcaaacgaggagttccagcacattctgcgtgtgctcaacactaacgttgatggcaagcaaaagattatgtttgctcttacctccatcaagggtattggaaggagacttgccaacattgtctgcaagaaagctgatgtcgacatgaacaagagggccggtgagttgtctgcagctgagattgacaacctcatgaccatcgttgcaaacccaaagcagtacaagattccagactggttcttgaacagacagaaggactataaggatggaaagtactcccaggttgtttccaatgccctcgacatgaagctcagggatgatcttgaacgcctcaagaagatcaggaaccaccgtgggctgaggcactactggggtctccgtgtccgtggacaacacaccaagacaactggtcgcagaggaaagactgttggtgtctctaagaagcgttaagagaatgatgttatctgcagctggattggatctttgacaatgcccgtttttatgtttttgttatttcgtacaattttgcaagtctcaaagactcgattttaggtgttttgtaagagatccttcgcttgttttgttacatttcgagataatatttttctcacgggatcttgaagtcaattctctagtaatatcttttgtttacgttagtaaagtattcttagtaataaagtattctatgcctctatggttcgttactgttttgggaaaattctatgtatttcttttttattaaaaagatatttcatacattatgataaggtatatgattccgcaaaaacattacaaaattaaaaaa

SEQ ID NO: 3004 - DNA, 687 bp, Brassica juncea
gtttttagcttgcagagatcgtcacttcttgaaggcggcggcttctcctcactcatctccgctaatcacaatgtctctggtcgcgaatgaagagtttcagcacattctccgtgtgcttaacacaaatgtcgatgggaagcagaagatcatgttcgcccttacctcaatcaagggtattgggaggcgtttggctaacatcgtctgcaagaaagcagatgttgacatgaacaagagggctggtgagctatctgcagctgagatcgacaacctgatgaccatcgttgccaacccgaagcagtacaagatcccagactggttcttgaacaggcagaaggactacaaggacggcaagtactctcaagttgtctccaacgcccttgacatgaagctcagggacgatctcgagcgtctcaagaagatcaggaaccaccgtgggctgagacactactggggtctccgtgtccgtggacagcacaccaagacaaccggtcgcagaggaaagaccgttggtgtgtcaaagaagcgttaagcaagccacatgttgctagttactgctgctttattcgatatgcttcatatgaaccggctttgattttttatgtttctgcttcgaactagtttatgtgttgcttttggatatttgaaatagtttatgtcacttttggatcttccaaatagtttgtgtga

SEQ ID NO: 3005 - DNA, 737 bp, Brassica juncea
gctactgtaaaacggcgacagcttccgtactcagtcttctccttcaggcagctcttatctaccgatcgaacaatgtctctggttgcaaatgaggagttccagcacattcttcgtgtgctcaacactaacgtcgatggtaagcaaaagatcatgtttgcccttacctccatcaaaggtatcggcaggcgtttggccaacatcgtctgcaagaaagccgatgtcgacatgaacaagagggctggtgagttgtctgcagctgagatcgacaacctgatgactattgttgccaacccaaaacagtacaagatcccagactggttcttgaacagacagaaagactacaaggatggaaagtactctcaggttgtctccaatgcccttgacatgaagctcagggatgatcttgaacgtctcaagaaaatcaggaaccaccgtgggctgagacactactggggtctccgtgtccgtggccaacacaccaagacaactggtcgcagaggcaagactgttggtgtgtctaagaagcgttaagccactgtcggtagctgataaggaccgtctttaagttaatttgaacaatttttcacaactctattatgtgtcgtttatgagagaccttcactactgttttattacattctaaaataatattatggtctttattacatatttacatctttggtcttggcctattcagtttcttgtttctgttcttcaatgtagtaacggattacagg

SEQ ID NO: 3006 - DNA, 629 bp, Brassica juncea
gttcaattctgcagagatcgtcgctgcggcttgcttctttcacgcatctcatctctgcaaatcacaatgtctttggtcgcaaatgaggagtttcagcatattctccgtgtgctgaacacaaatgttgatggtaagcagaagattatgtttgcccttacctctatcaaaggtattgggaggcgattggctaacatcgtctgcaagaaggctgatgtcgacatgaacaaaagggctggtgagttatctgctgctgagatcgacaaccttatgacaattgtcgcaaacccaaagcagtacaagatcccagactggttcctgaacaggcagaaagattacaaagacggtaagtactcccaagttgtctccaatgcccttgacatgaagctcagggatgaccttgaacgtctcaagaaaatcaggaaccatcgtggtctgagacactactggggtctccgtgttcgtggacaacacaccaagacaactggtcgcagaggaaagactgttggtgtgtcaaagaagcgttaagcaagcctattgttgctattattggatatgctttacaagaatcgtttttgatttatgtttcttcttcgaactggtttgtgagacaccttttgaatctagttttg

SEQ ID NO: 3007 - DNA, 786 bp, Brassica juncea
catttccggcgtgagcttctcaattttttctttcagcagcagcagtcttcccttcccttccgatcgaacaatgtctctagttgcaaacgaggagttccagcacattctgcgtgtactcaacactaacgttgatggtaaacaaaagattatgtttgcccttacctccatcaagggtattggcaggcgtttggccaacattgtctgcaagaaagcagatgttgacatgaacaagagggctggtgagttatccgcagctgaaattgacaacctcatgacaattgttgcaaacccaaaacagtacaagattccagactggttcttgaacaggcagaaagactacaaggatggaaagtactctcaggttgtctccaacgcccttgacatgaagctcagggatgatcttgagcgtctcaagaaaatcaggaatcaccgtgggctgagacactactggggtctccgtgtccgtggacaacacaccaagacaactggtcgcagaggaaagactgtcggtgtctctaagaagcgttaagccaatgttcctatttgcagctggtttggatctttgataaggaccgattttgatctccagctggttttgttattctgttcaattttgtacgactcagttttgtgtcttttattagatctccattactattttattacatgttcagatgatattctgtcacctgatctttgtcacttctctggttacatacagaacacaatattttggatttaaggtaggaaaatttaaatttactttactataatatggtaaagcta

SEQ ID NO: 3008 - DNA, 738 bp, Brassica juncea
aaaacggcgacagcttccgtactcactcctctccctcaggcacctcttctcttcgagatcgcacaatgtctctggttgcaaacgaggagttccagcacattctacgtgtgctcaatactaatgtggatgggaagcagaagatcatgtttgcccttacctccatcaagggtattggcaggcgtttggccaacatcgtctgcaagaaagctgatgtcgacatgaacaagagggctggtgagttgtctgcagctgagatcgacaacctcatgaccattgttgccaacccaaaacagtacaagatcccagactggttcttgaacagacagaaagactacaaggacggaaagtactctcaagttgtctccaacgcccttgacatgaagctcagggatgatcttgaacgtctcaagaaaatcaggaaccaccgtgggctgagacactactggggtctccgtgtccgtggtcaacacaccaagacaactggtcgcagaggcaagactgttggtgtctctaagaagcgttaagccagtgatggtagctccagctggattcaatctttgataaagaccgtcttttaacttctttgaacaattttgcacaactctattatgtgttcgtttttgagagaccttcgctgctgttttattacatgaagtaagataatattttgttacttgggtcttttcccacttatctatctattgtattcgtattgtcaaatgggaatgtttaacaagc

SEQ ID NO: 3009 - DNA, 800 bp, Brassica juncea
gttctagtctgcagagatcgtcgctgcttgaagacggcttgctgctttcgcgtatctcatctctgcaaatcacaatgtctttggtcgcaaatgaggagtttcagcatattctccgtgtcctgaacacaaatgttgatggtaagcagaagataatgttcgcccttacctctatcaaaggtattgggaggcgattggctaacatcgtctgcaagaaggctgatgtcgacatgaacaaaagggctggtgagttatctgcagctgaaatcgacaacctgatgacaattgtcgcaaatccaaaacagtacaagatcccagactggttcctgaacagacagaaagattacaaagacggaaagtactcccaagtcgtctccaatgcccttgacatgaagctcagggatgaccttgaacgtctcaagaaaatcaggaaccatcgtggtctgagacactactggggtctccgtgttcgtggacaacacaccaagaccaccggtcgcagaggaaagactgttggtgtgtcaaagaagcgttaagcaagcctattgttgctagttactactttattgaatatgcttcacaaggatcggttttgatttatgtttcctcttcgaactagtttttgagacaccttttgaatctagttttggaacctttgcaatcttatgatctttctttgttttacacatctgcctgctttctctattgttagctattattgtggctttcaagttattacaccttaaacatagattaatttacttgtttgttataactaactggaaaataatgctaataaatcg

SEQ ID NO: 3010 - DNA, 747 bp, Brassica oleracea
tggggtcgaggacgcgtccgagcttgcagagatcgtcacttcttgaaggcggcttctcctcacgcatctcatctccgctaatcacaatgtctctggtcgcgaatgaggagtttcagcacattctccgtgtgcttaacacaaatgtcgatgggaagcagaagatcatgttcgcccttacctcaatcaagggtattgggaggcgtttggcaaacatcgtctgcaagaaagcagatgtcgacatgaacaagagggctggtgagctatctgcagctgagatcgacaacctgatgacgattgttgccaacccgaagcagtacaagatcccagactggttcttgaacaggcagaaggactacaaggacggcaagtactcccaagttgtctccaatgcccttgacatgaagctcagggacgatctcgagcgtctcaagaagatcaggaaccaccgtgggctgagacactactggggtctccgtgtccgcggacagcacaccaagacaaccggtcgcagaggaaagaccgttggtgtctcaaagaagcgttaagcaagccacatgttttgctagttactgctgctttattggatatgcttcatatgaaccggctttgatttatgtttctgcttcgaactagtttatgtgttgcttttggatatttgaaatagtttatgtcacttttggatcttccaaatagcttgtgtgatacttttggttcttcttgtcctctcttattatcttttccattggt

SEQ ID NO: 3011 - DNA, 1352 bp, Brassica rapa
ggaggtaacatataagcacaccacaccacctacagaagaaaccctactctaaaacggcgacagcttccgtactcactcctctccctcaggcacctcttctcttcgagatcgcacaatgtctctggttgcaaacgaggagttccagcacattctacgtgtgctcaatactaatgtggatgggaagcagaagatcatgtttgcccttacctccatcaagggtattggcaggcgtttggccaacatcgtctgcaagaaagctgatgtagacatgaacaagagggctggtgagttgtctgcagctgagatcgacaacctcatgaccattgttgccaacccaaaacagtacaagatcccagactggttcttgaacagacagaaagactacaaggacggaaagtactctcaagttgtctccaatgcccttgacatgaagctcagggatgatcttgaacgtctcaagaaaatcaggaaccaccgtgggctgagacactactggggtctccgtgtccgtggtcaacacaccaagacaactggtcgcagaggcaagactgttggtgtctctaagaagcgttaagccagtgatggtagctccagctggattcaatctttgataaagaccgccttttaagttctttgaacaattttgcacaactctattatgtgttcgtttatgagagaccttcgctactgttttattacatgaagtaagataatattttgttacttgggtctttttatcacttatcttattacatctttttcttagcctcttcagttggttgtttctgttctgttacttggtctttatatcacttatcttattacatcgttttcttagcctattcagttgcttgtttctgttcttctatataggaagaagaacggtgcccagatttgattaaaaaaaaaatctcaatcatctgtattaaaaatctttttgtttgttaattgtgtgctagagaaaacagagctcaaaaacaaagatgtatactatgtgatggtcgtgaacatttactactagtgctaggctgtgccttcgttgtcgtcagaatcagaagcagctccaagtttctgttgacgggtcgttggaagagaatagcttcgtcgctctttcccacctggcttagaagaggcattgccgtaccagatcataccaagtactgcaatgatcattccaatgaccacgtgcaagtttagaccttctctaccaaagaagaagaatcccattacgagcaccaggatcgtcttcatgtgtcccaggacttggaacgataccgctgtgaatctcccgatgcagatgaactgacttaggttggtcccaatcgctattgtgcacgatagggttataaaca

SEQ ID NO: 3012 - DNA, 896 bp, Brassica rapa
atacaactcgccgagaacacactagcgacctcctctcgtgttttagcttgcagagatcgtcacttcttgaaggcggcggcttctcctcactcatctccgctaatcacaatgtctctggtcgcgaatgaagagtttcagcacattctccgtgtgcttaacacaaatgtcgatgggaagcagaagatcatgttcgcccttacctcaatcaagggtattgggaggcgtttggctaacatcgtctgcaagaaagcagatgtcgacatgaacaagagggctggtgagctatctgcagctgagatcgacaacctgatgaccatcgttgccaacccgaagcagtacaagatcccagactggttcttgaacaggcagaaggactacaaggacggcaagtactcccaagttgtctccaatgctcttgacatgaagctcagggacgatctcgagcgtctcaagaagatcaggaaccaccgtgggctgagacactactggggtctccgtgtccgtggacagcacaccaagacaaccggtcgcagaggaaagaccgttggtgtgtcaaagaagcgttaagcaagccacatgttgctagttactgctgctttattcgatatgcttcatatgaaccggctttgattttttatgtttctgcttcgaactagtttatgtgttgcttttggatatttgaaatagtttatgtcacttttggatcttccaaatagtttgtgtgatacttttggatcttcctgtcctctcttattatcttttccattggttacatctgtttttactctccattgttagcctaacaatggatttgaagtgtttacagcatgaaaaatagttaactggtgattaagtaagtcatattatagaaaatgattgtaacaaattattttgtt

SEQ ID NO: 3013 - DNA, 819 bp, Brassica rapa
ctcttttgttttgtgttctgaagagatcgtcactgcttgaagacgtcttgctgctttcgcgtatctcatctctgcaaatcacaatgtctttggtcgcaaatgaggagtttcagcatattctccgtgtgctgaacacaaatgttgatggtaagcagaagataatgttcgctcttacctctatcaaaggtattgggaggcgattggctaacatcgtctgcaagaaggctgatgtcgacatgaacaaaagggctggtgagttatctgcagctgaaatcgacaacctgatgacaattgtcgcaaatccaaaacagtacaagatcccagactggttcctgaacagacagaaagattacaaagacggaaagtactcccaagtcgtctctaatgcccttgacatgaagctcagggatgaccttgaacgtctcaagaaaatcaggaaccatcgtggtctgagacactactggggtctccgtgttcgtggacaacacaccaagaccaccggccgcagaggaaagactgttggtgtgtcaaagaagcgttaagcaagcctattgttgctagttactactttattgaatatgcttcacaaggatcggttttgatttatgtttcttcttcgaactagtttttgagacaccttttgaatctagttttggaacctttgcaatcttatgatctttctttgttttacacatgtgcctgctttctctattgttagctattattgtgcctttcaagttattacagcttaaacatagattaatttacttgtttgttataactaactggaaaataatgctaataaatcggtctacgtat

SEQ ID NO: 3014 - DNA, 1316 bp, Brassica rapa
aagaaaccctagtttttctaatcggtttgcgcgagagagtttagagtgtaaaacggcgagagcttctctcatcttctcactcaggcagcttctattccaaccgaacaatgtcgctggtagcaaacgaggagttccagcacattctgcgtgtgctcaacaccaacgtcgatggcaagcagaagattatgtttgctcttacctccatcaagggtattggaaggagactagccaacattgtctgcaagaaagccgatgtcgacatgaacaagagggccggtgagttgtctgcagctgagatcgacaacctcatgaccatcgtagcaaacccgaagcagtacaagattccagactggttcttgaacagacagaaggactataaggatggaaagtactcccaggttgtttccaatgccctcgacatgaagctcagggatgatcttgaacgcctcaagaagatcaggaaccaccgtgggctgaggcactactggggtctccgtgtccgtggacaacacaccaagacaactggtcgcagaggaaagactgttggtgtctctaagaagcgttaagagaatgatgttatctgcagctggattggatctttgataaggcccgtttttttatgttttgttgtttcgtacaattttgcaagtctcaaaatctggattttaggtttttttttgtaagacatccttcacttgtttttttacatttcgttatattacttttgtcacggtatttttgaagtcgcttctctagtgatattaatatcttttgtttaagtaataaaagtgcagcaatagttcgttgcatttatgtttggttaaattaaaaaatatttgttagttattaaaaagaaatctcatatattatgggttgatacaattgtaaacaatgattccgagaaaaaacattacaaaacaatctcaaacgtctgggaggatcataagaccataaatcaaaacagagatgtggtagctatgtgatgttcctgatcatttactacttaatactactactaggctttgtcttcgttgtcatcagaatccgaagcagctccaagcttctgttgacgagtagttggaagagaatagcttcttcgctctttgcctcctggcttggaagaggcattaccgtaccagatcataccaagtactgcaataaccattccaataaccacatgcaagttcagaccttctctaccaaagaagaaaaatcccatcaccagcaccaggattgtcttcatgtgtcccaggacttgaaatgacaccgctgtgaatctcccgatgcatatgaactggcttaggttggtcccgatt

SEQ ID NO: 3015 - DNA, 561 bp, Bruguiera gymnorhiza
  misc_feature (8)..(9): n is a, c, g, or t
  misc_feature (12)..(12): n is a, c, g, or t
  misc_feature (77)..(77): n is a, c, g, or t
  misc_feature (81)..(81): n is a, c, g, or t
  misc_feature (162)..(162): n is a, c, g, or t
  misc_feature (165)..(165): n is a, c, g, or t
  misc_feature (192)..(192): n is a, c, g, or t
  misc_feature (531)..(532): n is a, c, g, or t
  misc_feature (534)..(535): n is a, c, g, or t
  misc_feature (541)..(541): n is a, c, g, or t
  misc_feature (553)..(554): n is a, c, g, or t
  misc_feature (560)..(560): n is a, c, g, or t
gccatctnnggntctgcggctctgccactgcatagctctgcacacttgaaatcaggcgccgcaccgcgaaacagctnctcngcatctcaaaccctagccatgtcgttggttgcaaatgaagattttcaacacattcttcgtgtgctgaacacgaacgttganggnaaacagaagataatgtttgccctcacntccatcaaaggtatcggtcgccgttttgctaatatcgtgtgcaagaaggccgatgtcgacatgaacaagagagctggtgagctatcagctgaagagctagacaagctaatggtgattgttgctaatcctcgccaattcaagatcccagactggttcctcaacaggcagaaggattataaagatgggaagtactctcaggttgtctccaatgcattggatatgaagctgagagatgaccttgagcgcttgaagaagatcagaaaccaccgtggtctccgtcactattggggtgttcgagtgcgtgggcagcacaccaagactactggtcgtaggggaaanncnnttggtntgtccaagaagnnctaatnt

SEQ ID NO: 3016 - DNA, 801 bp, Brassica napus
acaccacctacagaagaaaccctactctaaaacggcgacagcttccgtactcactcctctccctcaggcacctcttctcttcgagatcgcacaatgtctctggttgcaaacgaggagttccagcacatactacgtgtgctcaatactaatgtggatgggaagcagaagatcatgtttgcccttacctccatcaagggtattggcaggcgtttggccaacatcgtctgcaagaaagctgatgtcgacatgaacaagagggctggtgagttgtctgcagctgagatcgacaacctcatgaccattgttgccaacccaaaacagtacaagatcccagactggttcttgaacagacagaaagactacaaggacggaaagtactcccaagttgtctccaacgcccttgacatgaagctcagggatgatcttgaacgtctcaagaaaatcaggaaccaccgtgggctgagacactactggggtctccgtgtccgtggtcaacacaccaagacaactggtcgcagaggcaagactgttggtgtctctaagaagcgttaagccaatgatggtagctccagctggattcaatctttgataaagaccgccttttaagttctttgaacaattttgcacaactctattatgtgttcgtttatgagagaccttcgctactgttttattacatgaagtaagataatattttgttacttgggtctttttatcacttatcttattacatctttttcttagcctcttcagttggttgtttctgttctgttacttggtctttatatcacttatcttatt

SEQ ID NO: 3017 - DNA, 828 bp, Brassica napus
ccggaaattcccagggctcagacggccattaacgggccgggggggttttgcgcgagagtttagagtgtaaaacggcgagagcttctcatcttctctctcaggcagcttctctcatcttctcactcaggcagcttctattccaaccgaacaatgtcgctggtagcaaacgaggagttccagcacattctgcgtgtgctcaacaccaacgtcgatggcaagcagaagattatgtttgctcttacctccatcaagggtattggaaggagactagccaacattgtctgcaagaaagccgatgtcgacatgaacaagagggccggtgagttgtctgcagctgagatcgacaacctcatgaccatcgtagcaaacccgaagcagtacaagattccagactggttcttgaacagacagaaggactacaaggatggaaagtactcccaggttgtttccaatgccctcgacatgaagctcagggatgatcttgaacgcctcaagaagatcaggaaccaccgtgggctgaggcactactggggtctccgtgtccgtggacaacacaccaagacaactggtcgcagaggaaagactgttggtgtctctaagaagcgttaagagaatgatgttatctgcagctgggattggatctttgataaggcccctttttttatgttttgttgcagtctcaaaatctggattttaggttttttttgtaagacatccttcacttgttttttcacatttcgttatattacttttgtcacggtatctctgaagttgcttctctagtaatattttttatttgagtaataaaagtgctcaatagttcgttag

SEQ ID NO: 3018 - DNA, 817 bp, Brassica napus
catctcatctccgctaatcacaatgtctctggtcgcgaatgaggagtttcagcacattctccgtgtgcttaacacaaatgtcgatgggaagcagaagatcatgttcgcccttacctcaatcaagggtattgggaggcgtttggcaaacatcgtctgcaagaaagcagatgtcgacatgaacaagagggctggtgagctatctgcagctgagatcgacaacctgatgacgatcgttgccaacccgaagcagtacaagatcccagactggttcttgaacaggcagaaggactacaaggacggcaagtactcccaagttgtctccaatgcccttgacatgaagctcagggacgatctcgagcgtctcaagaagatcaggaaccaccgtgggctgagacactactggggtctccgtgtccgcggacagcacaccaagacaaccggtcgcagaggaaagaccgttggtgtctcaaagaagcgttaagcaagccacatgttgctagttactgctgctttattggatatgcttcatatgaaccggctttgatttatgtttctgcttcgaactagtttatgtgttgcttttggatatttgaaatagtttatgtcacttttggatcttccaaatagtttgtgtgatacttttggttcttcttgtcctctcttattatcttttccattggttaaatctgtttttactctccattgttagcgaccatggatttgaagcctttacagcatgaaaaggcgagttcctcgtattggttaaatctgtttttattgagtcatattatagaaaataatggtatcaaatcatttt

SEQ ID NO: 3019 - DNA, 1278 bp, Brassica napus
ccctcccaaccgacgtgtaccctacccaaggtcgtcctacctaatcgtcccgttgaactataggaagctcgaggagtacgtctagaacgtctcaaagaaatcgaacggaacatcggtgtctgagacactacgtgggtctccgtgttcgtgctcttttgttttgtgctcaattctgcagagatcgtcactgcttgaagacggcttgctgctttcgcgtatctcatctctgcaaatcacaatgtctttggtcgcaaatgaggagtttcagcatattctccgtgtgctgaacacaaatgttgatggtaagcagaagataatgttcgctcttacctctatcaaaggtattgggaggcgattggctaacatcgtctgcaagaaggctgatgtcgacatgaacaaaagggctggtgagttatctgcagctgaaatcgacaacctgatgacaattgtcgcaaatccaaaacagtacaagatcccagactggttcctgaacagacagaaagattacaaagacggaaagtactcccaagtcgtctccaatgcccttgacatgaagctcagggatgaccttgaacgtctcaagaaaatcaggaaccatcgtggtctgagacactactggggtctccgtgttcgtggacaacacaccaagaccaccggtcgcagaggaaagactgttggtgtgtcaaagaagcgttaagcaagcctattgttgctagttactactttattggatatgcttcacaaggatcgattttgatttatgtttcttcttcgaactagtttttgagacaccttttgaatctagttttggaacctttgcaatcttatgatctttctttgtgttacacatgtgcctgctttctgtattgttagctattattgtggctttcaagttattacagcttaaacatagattaatttacttgtttgttataactaactggaaaataatgctaataaatcggtctatgtatatatccaaatagtggtttaatagggaaactcgcatcattctgtggttgtgttttgtggtaaagaatggctgttccactccttaccaccgggtctaccgtaggcatcttagagttaagacggaagtagcttctgtaaccggaagatgagaaggctgaatgtagcctagcatcttagaaaagtgtcaaatgaagattggttatctctccgtttgtgtccggtaaacaggaacgtctacaagagcatgtgtgagtcgtacgtggtgttgtaccccttcttttcgtcgtctaagttgtattatattct

SEQ ID NO: 3020 - DNA, 466 bp, Cirsium arvense
gaagctcaatcgcctttcagccatgtctcttgttgcaaatgaggacttccagcacattcttcgtgtacagaacacgaatgttgatggcaagcaaaagatcatgtttgctatgacctctatcaagggtatcggtcgtcgttttgcaaatatcgtttgcaagaaggctgatgtagacatgaacaagagggctggtgagctgtctagtgccgagattgataacctgatgacaattgtggctaatcctcgccagtttaaaatcccagactggtttcttaacagaaagaaagattacaaggatggcaagtactctcaggtgacctctaacgctcttgacatgaagcttagagatgacttggagcgtttgaagaaaataaggaatcatcgtgggcttcgtcactattggggtcttcgggttcgtggacagcataccaagaccaccggtcgcaggggaaagactgttggtgtc

SEQ ID NO: 3021 - DNA, 625 bp, Flaveria ramosissima
caaacgaagactttcagcacattcttcgtgtacagaacacgaacgttgatggcaaacagaagatcatgtttgccatgacttcaatcaagggtatcggtcgtcgttttgccaacatcgtctgcaaaaaggccgacgtcgacatgaacaagagggctggagaactttcaagtgctgagatcgataatctgatgaccatcgtggccaacccacgccaattcaaaatcccagattggtttttgaacaggaagaaagattacaaggacggaaagtactcgcaagtcacatcaaatgctcttgacatgaaattgagagatgaccttgaacgtttgaagaagatcaggaaccatcgtggtcttcgtcactactggggtcttcgagtgcgtggacagcacaccaaaaccactggtcgcaggggaaagactgttggtgtgtccaagaagagataagtttttcatgtttttgaaaacaagctaccttgtggtttagatgttctcatgaatctttattgtcatcaattttgaacgttttgggttaagttgttatctcatggttatagttgtacttttggatttcatgtgagttgctgttttcgaattggatgttatgatgaaatttggtgatttta

SEQ ID NO: 3022 - DNA, 974 bp, Pinus pinaster
agctcctccctcaatacctaaatagtccactgaaagtgaacgattagggtttttctcagacgtaaagtgatatttatggttggttattctctcacgagcgtctcataacactaaagccctagcagtcttcgtaatacccaacgttactggcgactgttgaggctcccgcgttctgcgaaaatgtctttgattgcgaatgaggagtttcaacacattcttcgtgtcctcaataccaatgttgatgggcgacagaagatcatgtttgccctgacttctatcaagggaattggtcggcgtttggccaaccttgtatgcaagaaggccgatgttgatatgaacaagagagctggtgaactttctgcacttgagcttgagaacctgatgataattgtcgcgaatcctaaacaattcaagatcccagattggtttttaaacagacagaaagatatcaaggatggccgaaccactcaggtggtatccaatgctcttgacatgaaactcagggatgacttggaacgcttgaagaagatcaggaaccaccgtggtcttcgtcactactggggccttcgggttcgtggacagcacacaaaaaccactggtcgcaggggaaagactgttggtgtctcaaaaaagcgttaagcatgataatatattggaaaaaaacaattttgctcgagtttttttcctcattttattagtcattctgggtttatttcattcccgggaatcataaggttgtgttatctgacttggtaaaacgtttgttcatctcgtgtttgagaaggctgtaaaggttcgactgtgcactccccatcttgaagtgtttttaagaatgttctatccagttttataagattcattagagaaagaacagagtaacagtttggtgcttttgtttttttaattaatgacagagaaagaacagagtaatggtttggtgcttttgttttcttaattaatgacacagcttgtcc

SEQ ID NO: 3023 - DNA, 858 bp, Pseudotsuga menziesii
gtaaagccctggtggtctttccagtttccagagttacaggcgactgtggaggctccagcgttccgcaaaaatgtctttgattgcgaatgaagaattccaacacattcttcgtgtcctcaacactaatgtcgatgggcggcagaagatcatgtttgccctgacttccatcaagggaatcggtcgacgtttggctaaccttgtatgcaaaaaggccgatgttgatatgaacaagagggctggtgagctttctgcacaagagcttgagagcctgatgataattgttgcaaatcctaagcaattcaagatcccagattggtttttaaacagacagaaagacatcaaggatggccgaacctctcaggtggtatccaatggtcttgacatgaaactcagggatgacttggaacgcttgaagaagatcaggaaccaccgtggtcttcgtcactactggggccttcgggtgcgtggacagcacacaaagaccactggtcgcaggggaaagaccgttggtgtctcaaaaaagcgttgagcgggataatattctggaaagaaacaattttgctccagtttttttcctctttttatcagtcattttggtttgtctcattcctgagaatcattaggtcgtgttatttgacgtagtaaaaggtccgttcgccttttaagtgtttgagaaggctgtaaagcttcggcgttgcactctctatcttgaaatgtgtctgagtatgttctatccagttttataagattcattagagaaagaacataataaagaaagctttggtactttttcttgatcaatgacagcttgtgcagaatttggcttcctctttgcttctataatttagtcgctatccg

SEQ ID NO: 3024 - DNA, 776 bp, Raphanus sativus
ggatttctaaccgatttgcgcgagtgttaaagagtgtaaaacggcgagagcttcgcatcttctctctcaggcagctctctctactctaccgatcgaacaatgtcgctggtagcaaacgaggagttccagcacattctgcgtgtgcttaacactaacgttgatggcaaacaaaagattatgtttgctcttacctccatcaagggtattggaagaagattggccaacattgtctgcaagaaagccgatgtcgacatgaacaagagggccggtgagctgtctgcagctgagatcgataacctcatgaccatcgttgcaaacccaaagcagtacaagattccagattggttcttgaacagacagaaagactacaaggatggaaagtactcccaggttgtttccaatgcactcgacatgaagctgagggatgatcttgaacgtctcaagaagatcaggaaccaccgtggtctgagacactactggggtctccgtgtccgtggacaacacaccaagacaactggtcgcagaggaaagactgttggtgtctctaagaagcgttaagacaatgatgctagctgcagctggattggatctttgacagtcccgtttttatgtttttgttatttcgtacaattttgcaagtctcaaagactcgattttaggtgttttgtaagacatccttcacttgttttgttatatttcgagataatattgttgtcacgggatcttgaagtcaattcttttgttttccttataaaactatccaaatattctttgca

SEQ ID NO: 3025 - DNA, 790 bp, Raphanus sativus
accctactgtaaaacggcggcagattctgtactcagtcctctccctcaggcagctcttctcttccagatcgaacaatgtctctggttgcaaacgaggagttccagcacattctgcgtgtgctcaacactaacgtcgatgggaagcaaaagatcatgtttgcccttacctccatcaagggtattggcaggcgtttggccaacatcgtctgcaagaaagccgatgtcgacatgaacaagagggctggtgagttgtctgcagctgagatcgacaacctcatgactattgttgccaacccaaaacagtacaagatcccagactggttcttgaacagacagaaagactacaaggatggaaagtactctcaagttgtctccaatgcccttgacatgaagctcagggatgatcttgaacgcctcaagaaaatcaggaaccaccgtgggctgagacactactggggtctccgtgtccgtggtcaacacaccaagacaactggtcgcaggggaaagactgttggtgtctctaagaagcgttaagccagtgttcgttgctgcagctggattgaacctttaataagaaccgtttttaagataatttgaacaattttgcaaaaccctattatgtcgtttatcctgcactgtttttttgttacattataagataatattttgttactgtgtcttttccaattatctagtttcatttttggtcgtggcctattcatttacttgtttctgttctatataagtacaacagtatccggatttgatcaaaaataaactttattccgcc

SEQ ID NO: 3026 - DNA, 804 bp, Raphanus sativus
  misc_feature (17)..(17): n is a, c, g, or t
gggccgaaaacccttgngcagtcgtcctctatttttcttgtgttcaactctccagcgatcctcactgcttgaaagaacggcttgcctcttttacgaatctcatctctgcaaatcacaatgtctttggtcgcaaatgaggagtttcagcatattctccgtgtgctcaacacaaatgttgatggtaagcagaagataatgtttgcccttacctctatcaaaggtattgggaggcgattggctaacatcgtctgcaagaaggctgatgtcgacatgaacaaaagggctggtgagttatctgctgctgagatcgacaacctgatgacaattgtcgctaacccgaagcagtacaagatcccagactggttcctgaacagacagaaggattacaaagacgggaagtactctcaagttgtctccaatgcccttgacatgaagctcagggatgaccttgaacgtctcaagaaaatcaggaaccatcgtggtctgagacactactggggtctccgtgttcgtggacaacacaccaagacaactggccgcagaggaaagactgttggtgtgtcaaagaagcgttaagcaagcctattggtgttgctagttactgctttactggatatgtttcacaagaatcgattttaatttatgttttcttcttcgaactagtttgtgagacaccttttgaatctagttttgagaccttttcaatcttatgatctgtctttgtgaaccatttgttacacatgtgcctgctcgctcccttctctattgctatctatattggtttcgaagtgattaaaaaaaaaa

SEQ ID NO: 3027 - DNA, 756 bp, Raphanus sativus
tttttcttgtgttcaactctccagcgatcctcactgcttgaaagacggcttgcctcttttacgaatctcatctctgcaaatcacaatgtctttggtcgcaaatgaggagtttcagcatattctccgtgtgctcaacacaaatgttgatggtaagcagaagataatgtttgcccttacctctatcaaaggtattgggaggcgattggctaacatcgtctgcaagaaggctgatgtcgacatgaacaaaagggctggtgagttatctgctgctgagatcgacaacctgatgacgattgtcgctaacccgaagcagtacaagatcccagactggttcctgaacagacagaaggattacaaagacggcaagtactctcaagttgtctccaatgcccttgacatgaagctcagggatgaccttgaacgtctcaagaaaatcaggaaccatcgtggtctgagacactactggggtctccgtgttcgtggacaacacaccaagacaactggccgcagaggaaagactgttggtgtgtcaaagaagcgttaagcaagcctacttgtgttgctagttactgcttcactggatatgcttcacaagaatcgattttaatttatgtttcttcttcgaactagtttgtgagacaccttttgaatctagttttgagaccttttcaatcttatgatctgtcttttgtgaaccatttgttacccatgtccctgctcccttctctattgttatctattgtggtttcaaagtga

SEQ ID NO: 3028 - DNA, 783 bp, Raphanus sativus
gggagacttctcttcgtgtgtttagagcattgcagagatcatcactgcttgaaggcggcgtcttcttcttcttctcacgcatctcatctccgctaatcaaaatgtctctggtcgcgaatgaggagtttcagcacattctccgtgtgcttaacacaaatgtcgatggaaagcagaagatcatgttcgcccttacctcaatcaagggtattgggaggcgtttggctaacatcgtctgcaagaaagctgatgtcgacatgaacaagagggctggtgagttgtctgcagctgagatcgacaacctgatgacgattgttgctaacccaaagcagtacaagatcccagactggttcctgaacaggcagaaggactacaaggacgggaagtactcccaagttgtctccaatgcccttgacatgaagctcagggacgatctcgagcgtctcaagaaaatcagaaaccaccgtgggctgagacactactggggtcttcgtgtccgtggacagcacaccaagacaactgggcgcagaggaaagactgttggtgtctcgaagaagcgttaagcaagattacttctttatctgttttgatatatgtttctgctttgaactagtttatgtgacacttttggatcttcgaaatagtttgtttgatacttttggatctttgtgctctctatctctcttttccagtggtttacatctgttttaactttaattgtttttgagtctttatcatggctttgtccccttcaacagagttttgaagtgtttatcattctctcca

SEQ ID NO: 3029 - DNA, 698 bp, Raphanus sativus
actgtaaaacggcggcagattccttactcagtcctctccctcaggcagctcttctcttcgagatcgaacaatgtctctggttgcaaacgaggagttccagcacattctgcgtgtgctcaacactaacgtagatgggaagcaaaagatcatgtttgcccttacctccatcaagggtattggcaggcgtttggccaacatcgtctgcaagaaagccgatgtcgacatgaacaagagggctggtgagttgtctgcagctgagatcgacaacctcatgactattgttgccaacccaaaacagtacaagatcccagactggttcttgaacagacagaaagactacaaggatggaaagtactctcaagtcgtctccaatgcccttgacatgaagctcagggatgaccttgaacgtctcaagaaaatcaggaaccaccgtgggctgagacactactggggtctccgtgtccgtggtcaacacaccaagacaactggtcgcaggggaaagactgttggtgtctctaagaagcgttaagccagtgttcgttgctgcagctggattgaacctttaataagaaccgtttttaagataatttgaacaattttgcaaaaccctattatgtcgtttatcctgcactgttttttttgttacattataagataatattttgttaccgtgtcttttccaattatctagtttcatt

SEQ ID NO: 3030 - DNA, 757 bp, Raphanus sativus
  misc_feature (202)..(202): n is a, c, g, or t
  misc_feature (550)..(550): n is a, c, g, or t
  misc_feature (554)..(554): n is a, c, g, or t
  misc_feature (587)..(587): n is a, c, g, or t
  misc_feature (709)..(710): n is a, c, g, or t
  misc_feature (718)..(718): n is a, c, g, or t
  misc_feature (720)..(720): n is a, c, g, or t
tttctaaccgatttgtgcgagtgttaaagagtgtaaacggcgagagcttcgcatcttctctctccctctctactctaccgatcgaacaatgtcgctggtagcaaacgaggagttccagcacattctgcgtgtgcttaacactaacgttgatggcaaacaaaagattatgtttgctcttacctccatcaagggtattggaagnagattggccaacattgtctgcaagaaagccgatgtcgacatgaacaagagggccggtgagctgtctgcagctgagatcgataacctcatgaccatcgttgcaaacccaaagcagtacaagattccagattggttcttgaacagacagaaagactacaaggatggaaagtactcccaggttgtttccaatgcactcgacatgaagctgagggatgatcttgaacgtctcaagaagatcaggaaccaccgtggtctgagacactactggggtctccgtgtccgtggacaacacaccaagacaactggtcgcagaggaaagactgttggtgtctctaagaagcgttaaganaatnatgctagctgcagcttgattggatctttggcantcccgtttttatgtttttgttatttcgtacaattttgcaagtctcaaagactcgatttttaggccttttgtaagacatccttcacttgttttgttatatttcgagataatatttttgtcacnngatcttgnantcaagtcaatagtaatatcttttgttttccttataga

SEQ ID NO: 3031 - DNA, 723 bp, Raphanus sativus
  misc_feature (700)..(700): n is a, c, g, or t
ggacttacagaagagaagaaaccctactgtaaaacggcggcagattctgtactcagtcctctccctcaggcagctcttctcttccagatcgaacaatgtctctggttgcaaacgaggagttccagcacattctgcgtgtgctcaacactaacgtcgatgggaagcaaaagatcatgtttgcccttacctccatcaagggtattggcaggcgtttggccaacatcgtctgcaagaaagccgatgtcgacatgaacaagagggctggagagttgtctgcagctgagatcgacaacctcatgactattgttgccaacccaaaacagtacaagatcccagactggttcttgaacagacagaaagactacaaggatggaaagtactctcaagtcgtctccaatgcccttgacatgaagctcagggatgatcttgaacgtctcaagaaaatcaggaaccaccgtgggctgagacactactggggtctccgtgtccgtggtcaacacaccaagacaactggtcgcaggggaaagactgttggtgtctctaagaagcgttaagccaatgttggttgctgcagctggattgaatctttgataaggaccatgtttttaagttaatttgaacaattttgcaaaaccctattatgtgtcgtttatccttcactgctgttttgttacattataagataatattttgttactgngtcttttcaattatctagtttca

SEQ ID NO: 3032 - DNA, 823 bp, Rosa hybrid cultivar
cacacactcaaacgcaaagtctgagaccaaaccctaaggccgccgccgccgcaaccatgtctctcgtggcgaacgaggagttccagcacattctgcgtgttctgaacaccaacgtcgatggaaagcagaagatcatgttcgctctcacctccatcaagggtatcggtcgccgtttagccaacatcgtctgcaagaaggccgacgtcgacatgaacaagagggctggtgagctgtctggtcaggagattgataacctgatgcacattgtgagtaatccccgccagttcaagatccctgactggtttctcaacagaaagaaggattacaaggatggtaaatattcccaggttgttgccaatgccttggatatgaagctcagggatgatctcgagaggctcaagaagatcaggaatcaccgtggtcttcgacactactggggccttcgtgtgcgtggacagcacaccaagaccactggccgcagggggaagactgttggtgtgtccaagaaacgttgaagaatatgttctggctgtctgggaggatgtcatgttgttgctctttttgtgttacttttaaaaataccttctagtttagcattctcagtcaacttaagttttggtggattaatgcggaatgtctagttacttatatcgattccatttgactgcttggtactttgtgtttgaggatagtgtggtatgcatatgcaatggaagcggataatttttatttttgttggtgtttccgttttgactaggcagtcttggcatataaagcagccttttgatttgatgctttagcattcagtttgaaaaaaaaaaaa

SEQ ID NO: 3033 - DNA, 797 bp, Tabernaemontana elegans
tagttctccaaaccctagcccccattcagagatcccaaaagggttcggtcgattttgagaaactctcatctcccatcgccataaccatgtctgtgatcgtaaacgaagattttcagcacattctgcgtatccagaacacaaatgtggatggaaagcagaaggtgatgttcgcgctcacctctattaagggtattggccgccgttttgccaacattatctgcaaaaaggctgatgtcgacatgaacaagagagctggtgagctgtctgctcaagagattgacaacttgatgacaattgtggccaaccctcgacagttcaagatcccagattggttccttaacaggcagaaggattacaaggatggcaagtactcacaagttgtttccaatgcactggacatgaagctgagggatgaccttgagcgattgaaaaagattaggaaccaccgtggtctccgtcactactggggccttcgagtgcgtggacaacacaccaagacaacaggtcgtaggggcaagactgttggtgtctccaagaagcgctgagtttggataccatattttagcatgttcttggcttctcatggattgtctttattttccaattttgctgactcttatttgtttttatatagcagaaactgtgaaacattggattttgtagtgcgatggtaaattttaaagttaatgcacccgaggatgagttggtgatggatcaatgcatcttgcttaatgcagattgtttgatggcttatgaaactctcgtaatactaaaagtttttttagaataactaccgt

SEQ ID NO: 3034 - DNA, 1257 bp, Eutrema parvulum
gtctctggtagcaggcgaggagtttcagcacattctgcgtgtgctcaacactaacgttgatggtaagcaaaagattatgtttgcccttacctcaatcaagggtattgggaggcgattggccaacattgtctgcaagaaagctgatgtcgacatgaacaagagggctggtgagttatctgcagctgagattgacaacctcatgacaattgttgcaaacccaaaacagtacaagattccagactggttcttgaacagacagaaagactacaaagacggaaagtactctcaagttgtctccaatgcccttgacatgaagctcagggatgatcttgaacgtctcaagaaaatcagaaaccaccgtggtctaagacactactggggtctccgtgtccgtggacaacacaccaagacaactggtcgcagaggaaagactgttggtgtgtctaagaagcgttaagacaatgttgctagttgcagcttgtttggatctttgataaggaccgtttttaagtttttgttattcgtacaattttgcacgactcaattttgggtcttttatgagagatcttcacttctgtttttgttacattttaagatgatatgttgtcactggatcttaatgtcatttctctagttacatcttttgttttcttcagaaaaaaattccaaatttggttcttacgtttctgttttggaaaaattgtatgaatttgtttggtagtaaaaagaaatatcatataatattggaagctatgcattgatctaataacttgattccgcaaaaaacgttacaaagaatctcaatcgtctgtttagaaacaaaaaaatcgttctttttatggtacccaagcacaattagcacgaggatcacaaattaagctaaatgaacaactcatgtttcctgatcatttactaattgctactagtactaggctttgtcttcgttgtcttcagaatcagaagcagctccaagtttctgttgacgagtcgttgggagagaataacttcgtcgctctttgcctcctggcttggaagaggcattaccgtaccagatcataccaagtactgcaataatcattccaagaaccacgtgcaagtttagaccttctctaccaaagaagaagaaccccattatcagcaccaggatcgtcttcatgtgtcccaggacttggaacgataccgctgtgaatctcccgatgcagatgaactggcttaggttggtcccgatcgctattgtgcacgagagggttataaaca

SEQ ID NO: 3035 - DNA, 817 bp, Eutrema parvulum
gaaaagccgtagcagacctcttttgtgttttagtctgcagagatcgtcattgcttgaagacggcttcttctcacgcatctcatctctgcaaatcacaatgtctctagttgcaaatgaggagtttcagcacattctccgtgtgctgaacacaaatgttgatggtaagcagaagattatgtttgcccttacctctatcaagggtattgggaggcgattggccaacattgtctgcaagaaagccgatgtcgacatgaacaagagggctggtgagttatctgcagctgagattgacaacctcatgacaattgttgcaaacccaaaacagtacaagattccagactggttcttgaacagacagaaagactacaaagacggaaagtactctcaggttgtctccaatgcccttgacatgaagcttagggatgatcttgaacgtctcaagaaaatcaggaaccaccgtggtctgagacactactggggtctccgtgtccgtggacaacacaccaagacaactggtcgcagaggaaagactgttggtgtgtcaaagaagcgttaatcgagcctaatgttgctagttactgctttattggatatgcttcataagaaccggttttgatttatgtttcttcttcaaactagtttgtgtgacacttttgaatcttctggtgatgtcttttttttccattgtcacatctgtgcctgccatctattgttagctattattgtggctttgacgtgattacagcttaaaaatagtttaacttggtgattaagtcttactaatgagtaagtaatacgaataaatcggtctatgtat

SEQ ID NO: 3036 - DNA, 781 bp, Vinca minor
tcaaaccctagtgtcatttgcgactttctgccgtcagagctaaactcagagagagcgctagagatagaaagctagggtttatcaccgaagctgcaatcatgtctctggtggcgaacgaagaatttcagcacattttgcgtattcagaatacaaacgtagatggaaagcagaaggtgatgttcgctttgacttcgatcaaaggtattggtcgccgtttcgctaacatcatctgcaagaaggctgatgttgatatgaacaaaagagctggtgagcttagcgctgctgagattgacaatctgatgacaattgtggccaacccacgtcaattcaagatccctgactggttccttaacaggcagaaggattataaggatgggaagtactcacaggtcgtttctaatgctttggacatgaagcttagggatgaccttgagcgtttgaagaagatcaggaaccaccgtggtctacgacactactggggtcttagagtccgtggacagcacaccaagacaactggacggaggggcaagactgttggtgtctccaagaagcgttgagcctggatatttaatttgcaaattttgcagtctggttatggttttgtttattttctaaaacttgtagctcctagtatcttgatagctccttatcgcaacagtcaattgaacttagattttgtggtatgagaattttttaaaattcttgaagatgctccggtaaagtttctgaagagttgatgatttgtaaaatttttgttgccaagtttatatggcctatttat

SEQ ID NO: 3037 - DNA, 609 bp, Vinca minor
gagagagagagagttagggttcatcatctgaagtttgtaatcatgtctctggtggcgaacgaggagtttcagcacattttgcgtattcagaatacgaacgtcgatggaaagcagaaggtgatgttcgctctgacttcgatcaaaggtatcggtcgccgttttgctaacatcatctgcaagaaggctgatgttgacatgaacaaaagggctggtgagcttagctctgctgagattgacaacctgatgactattgtggccaaccctcgccaattcaagattcctgattggttccttaacaggcaaaaggattataaagatggaaagtattctcaagttgtttctaatgcattggacatgaagctcagggatgaccttgaacgcttgaagaagatcagaaaccaccgtggtctgcgacactactggggtcttagagtgcgtggacagcacaccaagacaactggccgtaggggaaagactgttggtgtctcaaagaagcgttgagtctggatatttcattttcagattttgcattctgattatgattgtcatttttttctaaaacatgtagctcagcatcttgatagctcttatagcaacagacaagtaaaa

SEQ ID NO: 3038 - DNA, 741 bp, Vinca minor
ggagcaaaccaggaagacatagagagagaaagatagggtttatcttcgaagctgcaatcaatcatgtctctggtggcgaacgaggagtttcagcatattttgcgtattcagaatacgaatgtcgatggaaaacagaaggtgatgtttgctctgacttcgatcaaaggtattggtcgccgtttcgctaacatcatctgcaagaaggctgatgttgatatgaacaaaagggctggtgagcttagctctcaggagattgacaacctcatgacaattgtggccaacccccgccaattcaagatccctgattggttccttaacaggcagaaggattacaaggatggaaagtactcacaggttgtttctaatgctttggacatgaagctcagggatgaccttgaacgcttgaagaagatcagaaaccaccgtggtctgcgacactactggggccttagagtgcgtggacagcacaccaagacaactggacgtaggggaaagactgttggtgtttcgaagaagcgttgagtctggctgttgttcatctgcagattttgcagtctcgttttgattttgtttatttccgaaaacttgtagctcctaatatcttgatagctcttgtagcaacagacagaagtgagctcagattttgtggtacgagtatttctttaaattcttaaagatgtctgtctggttatgtttatgaagagttgatgatttatgaatttttttcttgctgaatttaag

SEQ ID NO: 3039 - DNA, 797 bp, Amsonia hubrichtii
tgaagcaaaccctagtccattcgtcactttctgcctcggagcaaaagaggaagaaagagatagtacatctccaaagctgcaaccatggctctggtggcgaacgaggattttcagcacattttgcgtattcagaatacgaacgtcgatggaaagcagaaggtgatgtttgccctgacttcgatcaaaggtattgggcgacgtttcgctaacattatctgcaagaaggctgatgttgatatgaacaaaagagctggtgagcttagtgctgctgagattgacaacctgatgactattgtgtccaacccacgccaattcaagatccctgattggttccttaacaggcagaaggattacaaggatgggaagtactcacaggttgtttctaatgcattggacatgaagctcagggatgaccttgaacgcttaaagaagatcaggaaccaccgtggtctacgacactactggggtcttcgagtgcgtggacagcacaccaagacaactggacgtaggggcaagactgttggtgtctccaagaagcgttgagttcggatatttcatttgcagattttgcagtctggttatgattttgtttattttcgatatctgtagctctagtattgcgatagctcttatagcaacaaatgtgaacctagaggattttgaggcatgagaatttgtttacatcttaaagatgctctggtttaagtttctgaagagttgatttatgaagtgtttgccaaagtttcaagtggtttatggtttattgactgactaaaagtttgcaaattttaatccta

SEQ ID NO: 3040 - DNA, 696 bp, Brassica oleracea
aggactctaaaacggcgacagcttccatactcagtcctctccctcaggcagctcttctcttcgagatcgcacaatgtctctggttgcaaacgacgagttccagcacattctacgtgtgctcaatactaatgtggatgggaagcagaagatcatgtttgcccttacctccatcaagggtattggcaggcgtttggccaacatcgtctgcaagaaggccgatgtcgacatgaacaagagggctggtgagttatctgcagctgagatcgacaacctcatgaccattgttgccaacccaaaacagtacaagatcccagactggttcttgaacagacagaaagactacaaggacgggaagtactctcaagttgtctccaacgcccttgacatgaagctcagggatgatcttgaacgtctcaagaaaatcaggaaccaccgtgggctgagacactactggggtctccgtgtccgtggtcaacacaccaagacaactggtcgcagaggcaagactgttggtgtctctaagaagcgttaagccaatgatggtagctgcagctggattcaatctttgataaagaccgtcttttaatttctttgaacaattttgcacaactctattatgtgttcgtttatgagacaccttcgctactgttttataacatgaagtaagataatattttgttacttggtctttatacc

SEQ ID NO: 3041 - DNA, 494 bp, Bupleurum chinense
gcctatgtgattcacagctccggcgacagaaaatctcatttccggcaaccatgtcgcttgtagcaaatgaagattttcaacatattctccgtattcaaaacacaaatgttgatggcaaacagaagataatgttcgctctaacttcgattaaaggtatcggacgtcgtttcgctaacatcgtttgcaaaaaagccgatgttgatatgaacaagagggctggtgaactttcagctgctgaaattgacagcttgatgacaattgtggcaaatccccgacagttcaagattccagactggttcctgaacaggaagaaagactacaaggatggaaagttttctcaggtgacatctaatgcgctggacatgaaattaagggatgaccttgagcgccttaagaaaatcagaaaccatcgtggtctgcgtcactactggggtcttcgagtgcgtggacagcacaccaggactactggacgcaggggaaagactgttggtgtt

SEQ ID NO: 3042 - DNA, 745 bp, Brassica napus
gagaggtaacatataaaccacccacaccacctgcagaagaaaccctactctaaaacggcgacagcttccatactcagtcctctccctcaggcagctcttctcttcgagatcgcacaatgtctctggttgcaaacgacgagttccagcacattctacgtgtgctcaatactaatgtggatgggaagcagaagatcatgtttgcccttacctccatcaagggtattggcaggcgtttggccaacatcgtctgcaagaaggccgatgtcgacatgaacaagagggctggtgagttatctgcagctgagatcgacaacctcatgaccattgttgccaacccaaaacagtacaagatcccagactggttcttgaacagacagaaagactacaaggacgggaagtactctcaagttgtctccaacgcccttgacatgaagctcagggatgatcttgaacgtctcaagaaaatcaggaaccaccgtgggctgagacactactggggtctccgtgtccgtggtcaacacaccaagacaactggtcgcagaggcaagactgttggtgtctctaagaagcgttaagccaatgatggtagctgcagctggattcaatctttgataaagaccgtcttttaatttctttgaacaattttgcacaactctattatgtgttcgtttatgagacaccttcgctactgttttataacatgaagtaagataatattttgttacttggtctttatatcacttat

SEQ ID NO: 3043 - DNA, 803 bp, Coffea canephora
agcaaaccctagtgcccatccttcactttcttctgcctcggagcgaaaaaaccaggagctgaaaaacgaaaaaaaagctcagaggagtactccaaagaccctaacaatggctctggtggcgaatgaggaattccagcacattctgcgtatccagaacaccaacgtggatgggaagcaaaaggtgatgttcgctctcacctcgatcaaaggtatcggtcgccgtttcgctaacatcatctgcaaaaaggccgatgtcgacatgaacaaaagagctggtgagctttctgctgctgaaatagataacttgatgaccattgtggccaaccctcgccagttcaagatcccagactggttccttaacaggcaaaaggattacaaggatggaaagtactctcaggttgtctccaatgctctggacatgaagctgagggatgaccttgagcgcctgaagaagatcaggaaccaccgtggtctccgacattactggggtctccgggtgcgtggacagcataccaagaccacaggaagaaggggcaagactgttggtgtctccaagaagcgttgaacatggatattttattttaggaccttgcagtcgagttatgattattttttttttttttacttcgtgttcttaaactttattatgtgtttccatagagtaacaaattatggaacttagaaaattttgtggctgaagaattcttgcttgtgaaagataatgcaatctatgtttgagaagttggtgaatctatgcagggtgcctcgtttgggcgttgataactaaaaaaaaaaaaaaaaaa

SEQ ID NO: 3044 - DNA, 945 bp, Pinus pinaster
gatatacccacttcacatccaatttttacgatcccccaaattatgtgtcgaaataggtctagggttccaagtagggttttatagcaagcatataatgcgttccaccctccataactgcggccgataaaaccacgcctgtcattgtagcctgcaatttgtttctgtgaaaatgtcgctcgtagcgaacgaagaatttcagcacattctccgtgttctcaacaccaatgtcgatggacgccagaagataatgtttgcattgacatccattaagggtatcggtcgtcgtttcgctaatctcgtctgcaagaaagcagacgtcgacatgaacaaaagagccggagagctttcagcagctgagctggaaaacctgatgacgatagtaagtaatccaaagcagttcaagattccagactggtttctcaacagacagaaggattataaggatggacgtaccactcagctcgtctccaatgccctcgacatgaggctcagagatgacttggagcgtcttaagaagattaggaaccatcgtggactacgacactactggggactccgtgttcgtggacagcacacaaaaacgactggtcgtaggggaaaaactgttggtgtctcaaagaagcgttgagtatatattatttcttatgagaaattgttgtgtaactgaacaattttgcaccagtttgaagtgtagtaaaaccttttctgctttggaatacctgacttcttggtaggtatgtccgtcattatatcaatacatttgagaatacttcttgggtaggtatgtccattatatcaatacatttgatattcaccataaaaaactggcattggcaatacttacttagatttggactagtatcagtgattccccttgttatcattaggctgtttttaaatttacattctttattcaaaattttggatagaaaattgtcattcttc

SEQ ID NO: 3045 - DNA, 854 bp, Allium cepa
tacgggggtagggttttattaccttgtagctgccgccatttcacatctctgaaacttccaccatggctttggttgcgaatgaagattttcaacacattcttcgtgttcagaacactaatgtagatgggaaacagaagataatgtttgccttgacttcgatcaagggtattggtcgtcgtttcgcaaacatcgtctgcaaaaaagcagacatcgacatgaacagaagggcaggtgagctttccaatgcagaaattgatcagcttatgaacattgtccaaaaccctcgccagttcaaaatcccagactggttccttaacagacagaaggactataaggatggcaggtatacccaggtcacttccaacgctcttgacatgaagctcagggatgatttggaacggttgaagaaaatcaggaaccatcgagggctgaggcactactggggtcttagagtaagaggacaacacaccaagactactgggagaagaggaaagaccgtcggtgtttctaagaagcgttgaaaattcatgtttactatttgcatgtcttacttcgacgtattttgaagttctatgttgtaatcagaaatctatgtctaggttcatcctgatttcaatacttatgttttcaagctagttgttgtgacccttttgtttttggttaactattgaatcttgtttggtttttctgattttgttagtctggtgtttgccaaactttgttcttcactcttgagattttacttctattttttcaccgtgttaaggtacttttacttttgtacattgtaactttatatgtactgataatccgtcatttgtacacgttgctttggaatcaaccttctttcctac

SEQ ID NO: 3046 - DNA, 1008 bp, Pinus taeda
gtccactgaaagtgaacgattagggtttttctcagacgtaaagtgatatttatggttggttattctctcacgagcctctcataatactaaagccctagcagtcttcgtaatacccagcgttactggcgactgttgaggctcccgcgttctgcgaaaatgtctttgattgcgaatgaagagtttcaacacattcttcgtgtcctcaacaccaatgttgatgggcgacagaagatcatgtttgccctgacttctatcaagggaattggtcggcgtttggccaaccttgtatgcaagaaggccgatgttgatatgaacaagagagctggtgaactttctgcacttgagcttgagaacctgatgataattgtcgcgaatcctaaacaattcaagatcccagattggtttttaaacagacagaaagatatcaaggatggccgaaccactcaggtggtatccaatggtcttgacatgaaactcagggatgacttggaacgcttgaagaagatcaggaaccaccgtggtcttcgtcactactggggccttcgggtgcgtggacagcacactaagaccactggtcgcaggggaaagactgttggtgtctcaaaaaagcgttgagcatgataatatattggaaagaaacaattttgctcaagtttttttcctcattttattagtcattctgggtttatttcattcccaggaatcataaggttgtgttatctgacttggtaaaacgtttgttcatctcgtgtttgagaaggctgtaaagcttcgactgtgcattccctatcttgaagtgtttttaagaatgttctatccagttttataagattcattagagaaagaacagagtaacggtttggtgcttttgtttttcttaatcaatgacatagcttgtgcagaatctggcttcctctttgcttctaaaatctagttcctatgacatatcccgtctttcctggaagggaagctatgatgtgtcctgttatgtatgctaaatacttgttc

SEQ ID NO: 3047 - DNA, 962 bp, Pinus taeda
cggcacgaggctcatttacacgtggatatacccacttcacatccaaattttacaatcacccaaattatgtgtagaaataggtctagggttccaagtagggttttataggaagcatataaagcgttccaccctccatagttgcggccgatgaaaccacgcctgtcgttgtagcctgcaatttgtttctgtgaaaatgtcgctcgtagcgaacgaagaatttcagcacattctccgtgttctcaacaccaatgtcgatggacgccagaagataatgtttgcattgacatccattaagggtatcggtcgtcgtttcgctaatctcgtctgcaagaaagcagacgtcgatatgaacaaaagagccggagagctttcagcagctgagctggaaaacctgatgacgatagtaagtaatccaaagcagttcaagattccagactggtttctcaacagacagaaggattataaggatggacgtaccactcagctcgtctccaatgccctcgacatgaggctcagagatgacttggagcgtcttaagaagattaggaaccatcgtggactacgacactactggggactccgtgttcgtggacagcacacaaaaacgactggtcgtaggggaaaaactgttggtgtctcaaagaagcgttgagtatatattatttttttatgagaaattgttatgtgtaactgaacaattttgcaccagtttgaagtgtagtaaaaccttttctgctttggaatacctgacttcttggtaggtatgtccatcattatatcaatacatttgagaatacttcttgggtaggtatgtccattatatcaatacatttgatgttcaccataaaaaattggcattggcattactttcttagatttggacctagtatcagtgatcctccttgtttaggctgtttttaaatttacattctttattcaaaattttggatagaaaattgtca

SEQ ID NO: 3048 - DNA, 789 bp, Helianthus annuus
gccgccctccatcatctcaggtatttgcataaaggaagaagcgtcaatcgcctttcatccatgtctcttgatgcaaatgaggacttccagcacattcttcgggtaccgaatacgaatgttgataggcagcaaaagatcatgtttgctatgacctctatcaagggtatcggacgtcgttttgcaaatatcgtttgcaagaaggctgatgtagacatgaacaagagagctggggagctgtctagtgccgagattgataacctgatgacaattgtggctaatcctcgccagtttaaaatcccagacagggttcttaacagaaagaaagattacaaggatggcaagtactctcaagtgacctctaacgctcttgacatgaagcttagaaatgacttggagcgcttgaagaaaataaggaatcatcgtgggcttcgtcactattggggtctccgggttcgtggacagcacaccaagaccaccggtcgcaggggaaagacggttggtgtctccaagaaacgataagtttgttttcgctttttttggtttagaagatatcttcttgaacctttattcacatcgatttgaaaaggtgttatggtctttaagttttaggatttcatatgaaggaattgctgttgagttttgttctctagtttgtttgacttaaaatcatttattgggcatgttggggacccattttttctattttataactattaattttaagtaaaccagtttcgtatatgttatagccttgaaaacctatgcactgcctatcatctattcattgta

SEQ ID NO: 3049 - DNA, 663 bp, Tabernaemontana elegans
ggctctggtggcgaacgaggatttccagcatattttgcgtatccagaatacgaacgtcgatggaaagcagaaggtgatgtttgctctgacttcgatcaaaggtattgggcgccgtttcgctaacattatctgcaagaaggctgatgttgatatgaacaaaagagctggtgagcttagtgcggctgagattgacaacctgatgactattgtggccaacccacgccaattcaagatccctgattggttccttaaccggcagaaggattacaaggatgggaagtactcgcaggttgtttctaatgcattggacatgaagctcagggatgaccttgaacgcttgaagaagatcaggaatcaccgtggtctgcgacactactggggtcttcgagtgcgtggacagcacaccaagacgactggacgtaggggcaagactgttggtgtctccaagaagcgttgagtctggatatttcatttgcagattttgcattcgggttaagattttgtttattttcaatgtctgtagctttagtatcctgatagctcttatagcagcaaatgtgatcctggaggattttgtggcatgagaatttgtttacatcttaaagatgctctggttaagtttttgaaaagttgatttatgaagtttttgccaaagttgaagtg

SEQ ID NO: 3050 - DNA, 516 bp, Zinnia violacea
gcttcaatcgctttacaggcgatgtctattgctgcaaatgaggacttccagcacattcttggtgtacagaacacgaatgtcgatggcacacaaaagatcatgttggctatgacttctatcaagggtattggtcgtcgttttgcaaatattgtttgcaagaaggctgatgtcgacatgaacaagagggctggtgtactgtctagtgctgagattgataacttgatgacaatcgttgccaatcctcgtcagtttaaaatcccagactggtttcttaaccgaaagaaagattacaaggatggaaaatactcccaggtcacttctaatgcccttgacatgaagctcagagacgacctggagcgtttgaagaaaatcaggaaccatcgtgggcttcgtcactattggggtcttagggttcgtggacagcacactaagaccactggtcgcaggggaaagactgttggtgtctccaagaagcgataaatttgttttgcactctttttggcttcttcttgagcc

SEQ ID NO: 3051 - DNA, 574 bp, Secale cereale
cgggtgaggagttccagcacatcctgcgtgtgcctcaacgccaacgtcgatggtaagcagaagatcatgttcgcgctgacctccatcaagggtgtgggccgccgcttctccaacatcgtctgcaagaaggccgacatcgacatgaacaagagggctggagagctgtccgcggaggagatggaccgtctgatggcggtggtgcacaacccgcgccagttcaaggtgccggactggttccttaacaggaagaaggactacaaagacgggagttctcccaggtcgtctccaacgctgtcgacatgaagctcagggatgaccttgagaggctcaagaagatcaggaaccatcgtggtctccgtcactactggggctgcggtgtccgtggtcagcacaccaagactaccggcagggtagaggaaaagctgttggtcggtctaccaaggaaccgattaagctttgcaaccatcctgcatagctttgctactactgtgttggtccattttcgagaatatggtgggttcttagtttagactattaccttggatgtactgttttgccctagataattgtttgc

SEQ ID NO: 3052 - DNA, 673 bp, Zostera marina
cgtccggaacggcaccgggaacctgaaaagaatagacctgaattcaaagttcccgaagtaggcggcgatggctttagttgcaaatgaggattttcagcatattctccgtgtgttgaacacgaatgtggatgggaagagaaagatcatgtacgcccttacctccatcaagggtattggacggcgttttgcaaacattgtctgtaagaaagctgatgttagaacaatagaaacaaagagggactggtagaaatatctgcagaagagcttgaaactttgatgaccattgtcgcaaatcccagacaattcaaaatcccagactggtttctcaacagaaagaaggattacaaggatggaagattctcccaagttgtttcaaatgcattggacatgaaactcagagatgatttggaacgtttgaagaagatcaggaatcaccgtggtctgagacattactggggtcttcgtgtccgcggacagcatactaagacaaccggtcgcagaggaaagactgtcggtgtttcaaaaaagcgttgattattcgtttatgtgtggttttttaacttttgttctctgcttatctttgttgagtaagatttttggattatgtgatattttgaagaatgatttcactttagatttatttaaatctcgacatcaatacattattctgtat

SEQ ID NO: 3053 - DNA, 699 bp, Nuphar advena
gtttcatttcctcttatctttcttctgctttagacatagatagatagagagagagagagagatctgatctctcccttgtcacaatgtctctcatcaccaatgaggatttccagcacattcttcgtatcctgaatacgaacgtcgatgggaggcagaagatcatgttcgccctcacctccatcaagggtgtcggacgaaggttcgcgaacatcgcctgcaagaaagccgatatcgacatgaacaagagggctggtgagttgtcatctgctgagctagagcaacttatggtaattgttgcgaaccctcgacagttcaagatcccagattggtttctcaataggaagaaggattacaaggatgggagatattcccaggttgtttcaaattcgttggacatgaaattgagggatgatttagagcgtttgaagaagattaggaaccaccgtggtcttcgccactactggggccttcgtgtgcgtgggcagcataccaagacaaccggccgtcgggggaagactgttggtgtctctaagaaacgaagagaagtcctggtcgtccttttgctttgatactctactgtgctgctgtttttgaatttctttcatgaacacctcgactaccttcgtcagacatgggctcatgtcatattttttgtttcaattttgtgttggcattattacctttaattgctattctaaa

SEQ ID NO: 3054 - DNA, 839 bp, Vaccinium corymbosum
cttaaccctgcagcctccttttaaaagcgaggagagtgaattacaactaccatcgtcgtttagggttttcgtcgcttctctctgtggccagccgcactcacaagcacctagcaagaagaacctgatctgaaaccctagccatgtcgctggtagcgaatgaagagttccagcacattcttcgtgtgcagaacacgaacgtcgatggaaaacagaagatcatgtttgcgctgacctcgatcaagggtatcggccgtcgttttgccaacatcgtttgcaagaaagccgatgtcgacatgaacaagagggctggtgagctttcaaaccaggaaattgataatctgatgacaattgttgcaaaatcctcgccagttcaaaatccctgactggtttttgaacagaaagaaggattataaggacgggaagtactctcaggtgacatccaaatagactactaggaacaatgaagctcagggatgacttggagcgactgaagaagatcaggaaccatcgcgggctccgtcactactggggtcttagagtgcgtggacagcataccaagaccactggccgcagaggaaagactgtcggtgtctccaagaagcgataaatttgcttctctgtttgctatggttcctgcagctagttttgttgaacgacctttaccatgttatcttttgctggtcatttttgcaccattttgatgttttctgctacttatctttatgttggtctctgcgcattatgacttgtggtttacttgggtagtcttcttgtttatggggattaatattaacggagtttgtttctgaactcttttggttgcaatggatttcggaact

SEQ ID NO: 3055 - DNA, 600 bp, Tripterygium wilfordii
catattgcgtgtgctgaacacaaacgttgatgggaaggcagaagataatgttcgctctgacctcaatcaaaggtattgggaggcgatttgctaacattgtctgcaagaaggccgatgttgacatgaacaagagggctggtgaattaactcctgctgagctggacaatctcatggttgttgttgctaatcctcgacaattcaaaatcccagactggtttttgaataggcagaaggattacaaggatgggaaatattctcaggttgtgtcaaatgctttggatatgaaattgagagatgatttggaacgtttgaagaagatcaggaaccaccgtggtctgagacactactggggtcttcgtgtccgtggtcagcacaccaagaccactggtcgcagagggaagactgtcggtgtctcaaagaagcgctgagatattatttattgtcaggcaatggtagaatattattttttgaatatctgtgcttaaggcagttttggagtaatgttattgaattggatgtgtttttaatattgtgaaccttattacagttttggtttttttttaatggttgtgaattatttttacactttaattgcatttc

SEQ ID NO: 3056 - DNA, 896 bp, Picea glauca
cgaagaacgcgagagaattgatcttatgagaacccattcgcccatggatatacccacttcacttcaaatttttacaactacccaaactatatgtcgaaagagggctagggttccaagtagggttttatagcaagcatataaagcctttcatccatcttattctgggctgatgaaaccacgcttggcattgtagcttgcaatctgtttctgcgaaaatgtcgctcgtagccaacgaagagtttcagcacattcttcgtgtcctcaacaccaatgtcgatggacgccagaagataatgtttgcactgacatccattaagggtatcggtcgccgttttgctaatcttgtctgcaagaaggcagacgtcgatatgaacaaaagagctggagagctttcggcagctgagctggaaaacctgatgacgatagtaagtaatccaaagcagttcaagatcccagagtggtttctcaacagacagaaggattacaaggacggacgtaccaatcagctcgtctccaatgccctcgacatgaggctcagagatgacttggagcgtcttaagaagattaggaaccatcgtggactccgacactactggggcctccgtgttcgtggacagcacacaaaaacaactggtcgtaggggaaaaactgttggtgtctcaaagaagcgttgagtatatattaatttttgtgaggaagtgtcatgcctaactggacaattttgccttggcttgaagtggtgtagtctcattttgtattcttttctgctttggaatacctgacttcttgggtaggtatgtccatcattatatcaatacatttagaaccaccacaaattattggcattagcaattcttgctcggattgggactagttttagtgagcctcattgttat

SEQ ID NO: 3057 - DNA, 794 bp, Picea glauca
agggctagggttccaagtagggttttatagcaagcatataaagcctttcatccatcttatcctgggctgatgaaaccacgcttggcattgtagcttgcaatctgtttctgcgaaaatgtcgctcgtagccaacgaagagtttcagcacattcttcgtgtcctcaacaccaatgtcgatggacgccagaagataatgtttgcactgacatccattaagggtatcggtcgccgttttgctaatctcgtctgcaagaaggcagacgtcgatatgaacaaaagagctggagagctttcggcagctgagctggaaaacctgatgacgatagtaagtaatccaaagcagttcaagatcccagagtggtttctcaacagacagaaggattacaaggacggacgtaccaatcagctcgtctccaatgccctcgacatgaggctcagagatgacttggagcgtcttaagaagattaggaaccatcgtggactccgacactactggggcctccgtgttcgtggacagcacacaaaaacaactggtcgtaggggaaaaactgttggtgtctcaaagaagcgttgagtatatattaatttttgtgagaaagtgtcatgcctaactggacaattttgccttggcttcaagtggtgtagcctcattttgtattcttttctgctctggaatacctgacttcttgggtaggtatgtccattatatcaatacatttagaaccaccacaaactattggcattagcaatacttgctcggattgggactagttttagtgagcctcattgttatc

SEQ ID NO: 3058 - DNA, 894 bp, Picea glauca
caaactatatgtcgaaagagggctagggttccaagtagggttttatagcaagcatataaagcctttcatccatcttatactgggctgatgaaaccacgcttggcattgtagcttgcaatctgtttctgcgaaaatgtcgctcgtagccaacgaagagtttcagcacattcttcgtgtcctcaacaccaatgtcgatggacgccagaagataatgtttgcactgacatccattaagggtatcggtcgccgttttgctaatcttgtctgcaagaaggcagacgtcgatatgaacaaaagagctggagagctttcggcagctgagctggaaaacctgatgacgatagtaagtaatccaaagcagttcaagattccagagtggtttctcaacagacagaaggattacaaggacggacgtaccaatcagctcgtctccaatgccctcgacatgaggctcagagatgacttggagcgtcttaagaagattaggaaccatcgtggactccgacactactggggcctccgtgttcgtggacagcacacaaaaacaactggtcgtaggggaaaaactgttggtgtctcaaagaagcgttgagtatatattaatttttgtgaggaagtgtcatgcctaactggacaattttgccttggcttgaagtggtgtagtctcattttgtattattttctgctttggaatacctgacttcttgggtaggtatgtccatcattatatcaatacatttagaaccaccacaaattattggcattagcaattcttgctcggactgggactagttttagtgagcctcattgttatcattaggcttgttttaattatatttttgtcctaaatttggaacaaaaattgcttatttcttctagttactaactatatat

SEQ ID NO: 3059 - DNA, 904 bp, Picea glauca
caacccgaagaacgcgagagaattgatcttatgagaacccattcgcccatggatatacccacttcacttccaatttttacaactacccaaactatatgtcgaaagagggctagggttccaagtagggttttatagcaagcatataaagcctttcatccatcttattctgggctgatgaaaccacgcttggcattgtagcttgcaatctgtttctgcgaaaatgtcgctcgtagccaacgaagagtttcagcacattcttcgtgtcctcaacaccaatgtcgatggacgccagaagataatgtttgcactgacatccattaagggtatcggtcgccgttttgctaatctcgtctgcaagaaggcagacgtcgatatgaacaaaagagctggagagctttcggcagctgagctggaaaacctgatgacgatagtaagtaatccaaagcagttcaagatcccagagtggtttctcaacagacagaaggattacaaggacggacgtaccaatcagctcgtctccaatgccctcgacatgaggctcagagatgacttggagcgtcttaagaagattaggaaccatcgtggactccgacactactggggcctccgtgttcgtggacagcacacaaaaacaactggtcgtaggggaaaaactgttggtgtctcaaagaagcgttgattatatattaatttttgtgagaaagtgtcatgcctaactggacaattttgccttggcttgaagtggtgtagtctcattttgtattcttttctgctttggaatacctgacttcttgggtaggtatgtccattatatcaatacatttagaaccaccacaaattattggcattagcaatacttgctcggattgggactagttttagtgagcctcattgttatcattag

SEQ ID NO: 3060 - DNA, 799 bp, Picea glauca
gggctagggttccaagtagggttttatagcaagcatataaagcctttcatccatcttatcctgggctgatgaaaccacgcttggcattgtagcttgcaatctgtttctgcgaaaatgtcgctcgtagccaacgaagagtttcagcacattcttcgtgtcctcaacaccaatgtcgatggacgccagaagataatgtttgcactgacatccattaagggtatcggtcgccgttttgctaatctcgtctgcaagaaagcagacgtcgatatgaacaaaagagctggagagctttcggcagctgagctggaaaacctgatgacgatagtaagtaatccaaagcagttcaaaatcccagagtggtttctcaacagacagaaggattacaaggatggacgtaccaatcagctcgtctccaatgccctcgacatgaggctcagagatgacttggagcgtcttaagaagattaggaaccatcgtggactccgacactactggggcctccgtgttcgtggacagcacacaaaaacaactggtcgtaggggaaaaactgttggtgtctcaaagaagcgttgattatatattaatttttgtgagaaagtgtcatgcctaactggacaattttgccttggcttgaagtggtgtagtctcattttgtattcttttctgctttggaatacctgacttcttgggtaggtatgtccattatatcaatacatttagaaccaccacaaattattggcattagcaatacttgctctgattgggactagttttagtgagcctcattgttatcattagg

SEQ ID NO: 3061 - DNA, 878 bp, Eutrema halophilum
ctgggcgtacaacaaacactaaagaaaccctagttttcgaatccattttggcgatactgttagacggcgcgagcttctcgatcttttctctcagacacagttcttctcttcagatcaaacaatgtctctggttgcaaacgaggagtttcagcacattctgcgtgtgctcaacactaacgttgatggtaagcaaaagattatgtttgcccttacttcaatcaagggtattgggaggcgaatggccaacattgtctgcaagaaagccgatgtcgacatgaacaagagggctggtgagttatctgcagctgagattgacaacctcatgacaattgttgcgaacccaaagcagtacaagattccagactggttcttgaacagacaaaaagactacaaagatggaaagtactctcaagttctctccaatggtcttgacatgaagctcagggatgatcttgaacgtctcaagaaaatcaggaaccaccgtggtctgagacactactggggtctccgtgtccgtggacaacacaccaagacaactggtcgcagaggaaagactgttggtgtgtctaagaagcgttaagccctaatgttgcttgttgcagctggattggatctttgttaaggaccgattttaagttttgttattcgtacaattttgcacgacttgattccgggtcttgcacgactcgattttgggtcttttatgagagatctttactactgttttattgcattctaagataatgttttgtcgtcgaatctttatatcacttctctaggttgcatcttttgatttcctaagcaaaattactcgcattgctgttttggaaaaatagtatggatttgtttggtaatctcacatttgattcagcgatctt

SEQ ID NO: 3062 - DNA, 745 bp, Eutrema halophilum
tgtgattcatagcctgcagattatcgtcactgcctgaagacggcttcatctcacgcacctcatctctgcaaatcacaatgtctctggttgcaaacgaggagtttcagcacattctccgtgtgctgaacacaaatgttgatggtaagcagaagattatgtttgcccttacctctatcaaaggtattggtaggcgaatggccaacattgtctgcaagaaggctgatgtcgacatgaacaaaagggctggtgagttatctgcagctgagatcgacaacctcatgacaattgttgcgaacccaaagcagtacaagattccagactggttcttgaacagacaaaaagactacaaagatggaaagtactctcaagttctctccaatggtcttgacatgaagctcagggatgatcttgaacgtctcaagaaaatcaggaaccatcgtggtctgagacattactggggtctccgtgtccgtggacaacacaccaagacaactggtcgcagaggaaagactgttggtgtgtcaaagaagcgttaagcaagccataatgttgctacttacacctttatttggatatgcttcatgaggagttttgaattatgttttttcgaactagtttgtgcgacacttttggatcatcctgtgaaactgtctttttcattagtacattttggcttttagaattatctgtttctatgcttgttacatctgtgcctgttctcgctgttattgtggcttcaaagtga

SEQ ID NO: 3063 - DNA, 632 bp, Jatropha curcas
acgcggggctcccttcttggtttagcaatttgccgctgcttctcggtcagtaggagccccattttctctgtacctcgcgtgtcactataatacaagatgtctctggttgcaaatgaagaatttcagcacattcttcgtgtgctcaacactaatgttgatgggaagcagaagattatgtttgctttgacctcaatcaaaggtattgggaggcgtttcgctaacattgtctgcaagaaagctgatgttgatatgaacaagagggctggggaattaactgctgctgagctggataatctcatggtcattgttgcaaatcctcgtcagttcaagatcccagattggtttttgaataggcagaaggattacaaggatgggaaatattctcaagttgtgtctaatgcactagacatgaagttgagagatgatttggagcgattgaagaagatcaggaaccaccgtggtctgaggcactactggggtcttcgtgtcaggggacaacacaccaagaccactggtcgtcgtggaaagactgttggtgtctctaagagcggtgacattatttactattaactgggtggagcaatttatgtaagggctggcggaattgtggccttttccaggtaaattttgtg

SEQ ID NO: 3064 - DNA, 850 bp, Abies balsamea
cacttccaatattattattgcgaaagagggctagggttccaagtagggttttatagggtgctctcgactgtcgaaaccaaaaccaagcctcgcattctactctgcaatttctctgcgaaaatgtcgcttgtagctaacgaagagtttcagcacattcttcgtgtgctcaacactaatgtcgatggacgccagaagataatgttcgccctaacatccattaagggtattggtcgccgtttagctaatcttgtttgcaagaaggccgacgtcgatatgaacaaaagagctggagagctttcggcagctgagctggaaaatctgatgacgatagtaagtaatccaaagcagttcaagatcccagagtggtttctcaacagacaaaaggattataaagatggacgtaccactcagctcgtttccaatgccctcgacatgaggctcagagatgacttggagcgtcttaagaagattaggaaccatcgtggactccgacactactggggcctacgtgttcgtggacagcacacaaaaaccactggtcgtaggggaaaaactgtcggtgtctcaaagaagcgttgagcatattactttttgcaagagaatcgtcatttgcctaactggataattttgccttagcttgaagcgaaatactcgcctcattatgcaacttttgtgctttttaatatcggaattcttgggtaggtatgtctgccattatatcaatgcctttcaggaccatcctaaacaatttgcagtagcaatacttgctcagatttgggctagattcagtgagcctctttgttatttctaggctgtttttactttctgaatctacatttttgccaaaaat

SEQ ID NO: 3065 - DNA, 833 bp, Catharanthus roseus
gatccaaagaattcggcacgaggctgccccagagcacaagactgagagagaaagagagagagagagagcggcaaggcatttccgaagctgcaatcatgtctctggtcgcgaatgaggattttcagcatattttgcgtattcagaacaccaacgttgatggaaagcaaaaggtgatgtttgctttgacttcaatcaaaggtattggtcgacgtttcgctaatattatctgcaagaaggctgatgttgatatgaacaaaagagctggtgagcttagtgctgctgagattgaccaactgatggctattgtgggagacccacgacaatacaagatcccagattggttccttaacaggcagaaggactataaagatgggaagtactctcaggttgtttctaatgcactggacatgaagctcagggatgaccttgaacgtttgaagaagatcaggaaccaccgtggtcttcgacactactggggtctccgagtgcgtggacagcacaccaagaccactggacgaaggggaaagactgttggtgtgtccaagaagcgttgagggtggatatttcttttgcagattttgctatggttatgattttgtttatttcctaaagtttgtagctctagtactctgatagctcttatagcaacaaaaattgaacctagatgattttgtggtataaggatttgtctacatctttaaagatgctctggttaaatttctgaatagttgatttttttaagtttttgcggaagtttttggtcccttggctctatccaagtttgcaaactattaaaccctctgtgtgtgactggaaattgttacttgattggg

SEQ ID NO: 3066 - DNA, 951 bp, Pseudotsuga menziesii
gttccgagtagtgttttatggcaagcatataaagtctttcacccgtcgaagagtggctgacgaaaccacgctgtgcactggagcctgcaatccgtttctacgaaaatgtcgctcgtagccaacgaagagtttcagcacatacttcgtgtgctcaataccaatgtcgatggacgccagaagataatgtttgcactgacatccattaagggtatcggacgccgttacgctaatctcgtctgcaagaaggcagatgtcgatatgaacaaaagagctggagagcttactgcagctgagctagaaagcgtgatgactatagtaagtaatccaaagcagttcaagatcccagagtggtttctcaacagacagaaggattacaaggatggacgtaccactcagctcgtctccaatgccctcgacatgaggctcagagatgacttggagcgtctaaagaagattaggaaccatcgtggacttcgacactactggggtcttcgtgttcgtggacagcacacgaaaaccacaggccgtaggggaaaaactgttggtgtttccaagaagcgttgagtacatattactgtttctgagaaagttatggtgcctaactggataatttaatctcagcttgaagtgtagtacttctgttttcttttgcatcctttactttaaatacctgacttcttggttaggtatgttcgtcattatatcaatgcctttgaggaccatcatagacaattggcactaccaatactttctcagctttggactagtttcagtgagcttctttgttatcattaggcttattttaaattttgaatttatatatttatccaaaattttggatagagaattgtcattcttatattactaactatgtatttgaacataggtattgtaacttcggatctcagttttttgtttcaattaaattgatgttcttaatcccttgccacc

SEQ ID NO: 3067 - DNA, 545 bp, Sesamum indicum
aaatctccacattagggtttcgagctctagctcttcccaactgaaagcgaagcagccgctcgacggagaataccggcattctcagcagctcgattcggaactctagccatgtcactcgtagcaaatgaggatttccagcacattctgcgtgtgcagaacaccaacgtggacggaaagcagaagatcatgtttgccttgacctctatcaagggtatcggccgccgtttcgctaatatcgtctgtaagaaggccgacatcgacatgaataagagggctggtgaactttctgcagctgagattgatagcttgatggtaattgttgcaaacccccgacagttcaagatcccagattggtttctgaacaggaagaaggattacaaggatggaaagttttctcaagtgacatctaatgctttggatatgaagcttagggatgacctcgagcgtttgaagaaaatcaggaatcaccgtggtcttcgtcactactggggtcttcgcgtgcgtgggcagcacaccaagaccactggtcgtaggggaaagactgt

SEQ ID NO: 3068 - DNA, 749 bp, Allium cepa
tttcattgcagccgtcacatttcctcctccttcacagattggatcacataatctaagctgccatgtctctagtcgcaggtgaagattttcagcacattcttcgtgttcggaacacgaatgttgatggaaagcagaagattatgtttgctttgacctcgattaagggtattggaaggagaattgctaacatagttagcaaaaagactgacatgacatgaacagacgggccggggaactctcaaatgctgagattgatcaactcatgactattgtatccaaccctcgtcaatttaagattccagactggtcttgaacagacagaaggactacaaggatggaagatacacacaggtcacttccaatgctttggacatgaagctcagggatgatttagagcggttgaagaagatcaggaaccaccgagggctgaggcactactggggtcttagagtccgagggcaacacaccaagaccaccggtagaaggggaaaaactgttggtgtctccaagaagcgttaaaatttctttgtactagttgcatcttattcttcttttgtttattttaatgttctaattagatattttttaatgtatttgtgacttgacaactgtgtttcatttgaactgtttggtcttgcttagctcttttgctctttgtgaatcttgtgccctttgatctttatttttcacggggtcctttgtaatgcgactacgaacctggttctgtaaaactaaggatgctgttggtt

SEQ ID NO: 3069 - DNA, 422 bp, Gossypium hirsutum
atgtcgctgatcgcgggtgaggagttccagcacatcctgcgtgtgctcaacaccaacgtcgatggtaagcagaagatcatgttcgcgcttacctccatcaagggtgtgggccgccgcttctccaacatcgcctgcaagaaggccgacatcgacatgaacaagagggccggagagctctcctcggaggagatggaccggctgatgacggtcgtggccaacccgcgccagttcaaggtgccggactggttccttaacaggaagaaggactacaaggacggcaggttcacccaggtggtctccaacgccgtcgacatgaagctcagggacgaccttgagaggctcaagaagatcaggaaccaccgtggtcttcgtcactactggggcgtgcgtgtccgtggtcagcacaccataagaacttaacc

SEQ ID NO: 3070 - DNA, 977 bp, Mesostigma viride
gggtgatgggttcataaacgccagtaccttggcgatcagcgcttgcaggtcggcgaaggtcacttctgtctcgtcgtatttcggaacttcgatttcagccaggcgggcagaaacgcctttggcgaagtcgacccacgcgtccgcgccgtggcaaggcagctgacagcctttgtggcccagttgcgccagagaagaagcaaccatgtcgttcgtcgctggagaagatttccagcacattattcgtttgatgaacaccaacgtcgatgggcgtcagaaaatcatgtatgccctgacatccatcaggggtgtgggtcgccgttttgccaacgtggtgtgcaagaaggctgaggttgacatgtccaaaagggccggcgagctgagcgcgcaggagctggagagtcttatggtcattgttaccaaccctcgccaattcaagatccctgactggttcctcaacaggaagaaggatattaaggatggccggtactctcaggtcacctccaacgtcctggatattaagctccgtgacgaccttgagcgcctgaagaagatcaggaaccaccgtggtttgaggcactactggggcctgcgtgtgcgtggtcagcacacgaagaccaccggccgccgcggtaagaccgtcggtgtgtccaagaagcgttaaacaaatattccatacggctttggaccatagtatggacatggaatgccgtgatgtcgaggcaacgtttgtggaaggcgacgatgtagggctggctgacgccctgtctctattccgggaccacataatagtgctcccgttctgcctggcatttcggttcgtgacctacgcgaccccggcatctattcgccgcggtaaaatgtacacaacttggtgcgtatgcataggccaaagtcgcagcctcgacacaggcacctgtgtcccattatgtattttgattcgtcaataaattcagtatcttcccctcaaaaaaaaaaaa

SEQ ID NO: 3071 - DNA, 833 bp, Mesostigma viride
acgaggctcgtgccgaattcggcacgaggcagctgacagcctttgtggcccagttgcgccagagaacaagcaaccatgtcgttcgtcgctggagaagatttccagcacattattcgtttgatgaacactaacgtcgatgggcgtcagaaaatcatgtatgccctgacatccatcaggggtgtgggtcgccgttttgccaacgtggtttgcaagaaggctgaggttgacatgtccaaaagggccggcgagttgagcgcgcaggagctggagagtcttatggtcattgttaccaaccctcgccaattcaagatccctgactggttcctcaacaggaagaaggatattaaggatggccggtactctcaggtcacctccaacgtcctggatattaagctccgtgacgaccttgagcgcctgaagaagatcaggaaccaccgtggtttgaggcactactggggcctgcgtgtgcgtggtcagcacacgaagaccaccggccgccgcggtaagaccgtcggtgtgtccaagaagcgttaaacaaatattccatacggctttggaccatagtttggacattgtatgccgtgatgtcgaggcaatgtttttaaaaggcggcgatgtagggctggctgacgccctatctgtattccgggaccttacatagtgctcccgtcctgcctggcatttcggttcgtggcgtacgcaacccggcacgtattcgccgcggtaaattgtacacaacttggtgtgtatgcataggccaaagtcgcggccccgacacaggcgcccgtgtcccattatgtactttgattcgttaataaagtcagtattccccc

SEQ ID NO: 3072 - DNA, 757 bp, Secale cereale
gctcaacaccaacgcgacggcaagcagagatcatgttcgcgctcacctccatcaagggcgtgggccgccgcttctccaaacatcgtctgcaagaaggccgacatcgacatgaacaagagggccggagagctttcgcggaggagatggaccgtctgatggcggtggtgcacaacccgcgccagttcaaggtgcccgactggttcctcaacaggaagaaggactacaaggacggcaggttctcccaggtcgtctccaacgccgttgacatgaagctcagggatgaccttgagcggctcaagaagatcaggaaccatcgtggtctgcgtcactactggggcgtgcgtgtccgtggtcagcacaccaagactaccggcaggagaggaaagactgttggtgtctccaagaagcgataagctgctttgcaaagatgccgcatagctttgccactactgtgttggtccatttccagaatcttaatgagtgttaccttggatgatgttttgccctagataatgttttggttctggacctttaatattgtagagtttgttttgccatgggcttgagtcatttgaatggttggcaacatcatgtctgttctaagcatatctgtgcattacaggtttgttggctaattgaatcctggtatatttttgggcgtgccattctagttgtgggtgtaatttgtggcattgtgtacctggacgatttttgttataaagaaataaacctacgacatatacaaagtaagtcatta

SEQ ID NO: 3073 - DNA, 592 bp, Trifolium pratense
acactaacgttgatggaaagcagaagatcatgttcgcaatgacctcaatcaagggtattggaaggagattttctaacatctgttgtaagaaagctgatgtggacatgaacaagagggctggtgaattgagtgctgcagagttggataatttgatgaccgtggttgcgaatcctcgtcaattcaagattcctgattggtttttgaataggaagaaggattacaaggatggaaagttctctcaagttgtgtctaatgctcttgacatgaagttgagggatgatttggagagactcaagaaaatcagaaaccaccgtggtttgaggcactactggggccttcgtgttcgtggtcagcataccaagactactggccgcaggggaaagactgttggtgtctcaaagaagcgttaaactgttatattttggcatggagattagatgattttgatttggagcacaatagacttgttttctataccgactttgtatggttaaatgatcatgacaatttgagttttgtttggtttttgtgtttaaagtttattatttgttgaatgattttggcatttatttattctcgttggttcataaca

SEQ ID NO: 3074 - DNA, 621 bp, Euphorbia peplus
gaggactttcacacattttgcgtgtgctgaatactaatgtggatggaaagcagaagattatgtttgctttgacctcaatcaaaggtattgggaggcgccttgctaacattgtctgcaagaaagctgatgttgacatgaacaagagggctggtgaattaactgctgctgagcttgataatctgatggtgattgttgcgaatcctcgtcagttcaagatcccacattggtttttgaataggcaaaaggactacaaggatgggaagtactctcaagttgtctccaatgctctggacatgaagttgagagatgatttggagcgattgaagaagataaggaatcatcgtggtctgaggcattactggggccttcgagttaggggacagcacaccaagactactggtcgtcgcggaaaaactgttggtgtttctaagaagagatgaataatctaattattttgttggtaggtagagggtaaattagtcacctgctacaagaaattttgcaccagagaagttcagatatggctatgttagattgaagcattttagtacttttaatgatttttatcaatttaccttgtttgcactggaccttattctatgttgtctgttttagaatcct

SEQ ID NO: 3075 - DNA, 577 bp, Taxus baccata
ggaaactggaagaggctccgagcttctacgaaaatgtctcttattgcaaaatgaagactttcaacatattcttcgtgtcctcaacactaatgttgacgggcgacagaagataatgtttgcccttacctccatcaagggaattggcaggcgttttgctaacattgtctgtaaaaaggctgatgttgacatgagcaagagagctggtgagctttctgcccaagagcttgagaacctgatggtgattgtggcaaatccacgacaattcaagatccctgactggttcttgaacagaaagaaggatcataaggatggcaggttttctcaggtggtatctaatgcacttgacatgaagctcagggatgatttggaacgcttgaagaagatcaggaatcatcgcggtctccgtcactattggggtctgcgagtgcgtggacaacatacaaagaccacaggccgtagggggaaaactgttggtgtctcaaaaaagcgttgagcaagaaaatattctggagaaaaagaattttgccgttggttcatattgttttatttttcttataggtgctctatgttgtattga

SEQ ID NO: 3076 - DNA, 690 bp, Arnica chamissonis
tttcgtagcattagccgcttgaggaagaaactcagctcgccgtcatgagcctggtagcaaatgaggattttcagcatattcttcgtgtccagaacacgaatgttgatggcaaacagaagattatgtttgccatgacctccattaaaggtattggcaacataatcttctgtttgccatgacctccattaaaggtattgggcgtcgtttcgcgaacattgtctgcaagaaggccgatgttgatatgaacaagagggcgggagaactttctaatgctgagatcgataatctgatgacaatcgttgctaatcctcgacagtttaaaatcccagattggtttcttaacagaaagaaggattacaaggatggcaagtactctcaagtcacatctaatgcccttgacatgaagcttagggatgatcttgagagattgaagaaaatcaggaaccaccgtggtcttcgtcattactggggtctgcgagtacgtggacagcacacaaagactactggtcgtaggggtaaaaccgtcggtgtgtcgaagaagcgatgaggttttggttttagaaaatcttcattttcatcttgtttagaatgtgctggattgttatgtttcgctatgttttggatatcaagcttctaggatattcttcatcaagagggagaatttcatatatttctggattatgttataag

SEQ ID NO: 3077 - DNA, 1181 bp, Saccharum officinarum
cggacgcgtgggaaaaaagaacgcgtagaaacaccgaaaggcagccggcagcaccgaacatttctcccaaaaatcctccaaaaaaatcgaaaaaaggagagggaaaaaaattctcgtctccttcccccagcttgccagcacccgaagtcgcgtcgcggagcgagagcggcgatggggtcgagcgaggcggagaagccgctgcgtcggatcgcggcgtcgttcgaggagctcgccgccgtcgccaagcagcagcccgcggtgtccatggacgccggggccttctcgcgcgcctgctccaacgtctccgtcctcttcggttgcctcggcatcgccttcaagttcgcggagatggactacgtcgccaaggttgatgatttggtggaggcgtccaagtcaatttcaacattgccttctatggttgagctagacattcagactgacactgtcaggaaaccagggagccatacaaggaatctgcttagagtgaagcgtgggattgatatggttaaagtcctgtttgagcaaattcttgtcacagagggcaactcactaagggatgcggcatcagtagcttatgctcaggtctttgctcctcaccatggatgggcaataaggaaagcagttgccgctggaatgtacgcccttccctcaaagtcccagctgttgaagaaattgaatgaagatgaggaatcagcaaaggttcaaatgcagaactttgtcaggtcatcagctcccgtaatctgctatgttgaagaacttttcacctcaaggaatttgggcatagattggtgaagaaactacggatacatttccttgatgtactaatccagtcagattgtgtgctgtgagctgggctcggaaaacctttttctggattccatgtctccaagatgtaacaaaatctataagcttcggtctaaaactacttagcgatcctattctggagtcgatcgtgatggatgttgagtacgcatgtggcgacatgcatagttgatgaggaaatatacgtgtcggctgattgaaactctctctctctctctctgtatctctctctctctctggatatgctgcttcatttcatgtatgctcacctgatgtggccgtaatgcagagcaatttcattctcttagtgatggcatttcaggaattcgataatcatgacatcatgccaatttgacctc

SEQ ID NO: 3078 - DNA, 925 bp, Zea mays
aaaaatgaacgcgttgaaacaccgaaaggcaagccggcagcaccaaacttttctcctaaaaatcctccaaaaaaacaaaaaaggggaggggaaaatattctcgtcttcttccccgtgcttgccagctcccgaagtcggcgagctctccgaaagcggcggctatgggttccagccaggcagataagccactgcgacgtatcgcggcgtcgttcgaggagctcgccgccgtcgccaagcagcatcccgcggtgcccatggacgctggggccttctcgcgcgcctgctccaacgtctccgtcctcttcggctgcctcggcatcgctttcaagttcgcggagatggactacgtcgccaaggttgatgatttggtggaggcgtccaagtcaatttcaacattgccttctatggttgagcgagacattcagaccgacactgtcaggaaaccagggagccatacaaggaatctgcttagagtgaagcgcgggattgatatggttaaagtcctgtttgagcaaattcttgtcacagagggcaactcactaagggatgcagcatcggtggcttatgctcaggtctttgctcctcaccatggatgggcaataaggaaagcagtttctgctggaatgtacgcccttccctcaaagtcccagctgttgaagaaattgaatgaagatgaggaatcagcaaaggttcaaatgcagaactttgtcaggtcatcagctccagtaatctgctatgttgatgaccttttcacctcaaggaatttgggcatagattggtgaagaaaaatatggatacgtttgtttgatgtactaatccagtcagatggtgtgctgtgtgagctgggctcagaaaacctttttctggatccgtgtttccaagtcgtaaactaatataactacttagcgatcccgttctggagtta

SEQ ID NO: 3079 - DNA, 802 bp, Cynodon dactylon
cgtcgtcgagcgagatcggtgcggcgatggggtcgaacgaggcggagaagccgctgcggcggatcgcggcgtcgttcgaggagctcgcggccgtcgccaagcagcagcccccgggggacatggacaccggggcgttctcgcgcgcctgctccaacgtctccgtcctcttcggctgcctcggcatcgccttcaagttcgccgagatggactacgtcgcaaaggttgatgatttgctggaggcatccaagtctatctcaacactgccttcgatggttgagttagacgttcaaaatgacaccgtcaggaagcctgggagccatacaaggaatatgcttagagtgaagcgtggggttgatatggtcaaggttctgtttgagcaaatactggttacagaaggcaactcgctgagggatgctgcatcagtggcttatgctcaggtgtttgctcctcaccatggccgggccataaggatggctgttgctgctggaatgtatgctcttccctcaaagtcacagctgttgaagaaactaaatgaagatgaggcctcagcaaaggttcaaatgcagaactttgttagatcatctgctccagtaatccagtatgtagaaggcctattcacctcgaggaatttgggcatagactggtgaagagaacttgcattacagtgttccatgtactaatcaatcagatgtgccgtgagcattgctacaaaaggttgaacctgattcaagtgattggctgattgcaacctgtaaccaaatcgatatgtgccgttctgtcactacctagcaaacttataaga

SEQ ID NO: 3080 - DNA, 1105 bp, Panicum virgatum
tatcttgccgtgggccgaggtgtagcccaaagtccggcccatcgaggcccagcacggcatcgatgaacctcggcgtcgtcgccggccagctgcaggtgccacctcaaaaaggaagcgtaggaaacccgaaaggcagcgcagaaaaattctctccaaatagcatcccaaaaaagaggaaggaaaaaaaaagctcgtctccttccccgcagcttgccagcacccggtagtcggcgagcgagagcggccgggcgcgaggatggggtcgagcgaggcggacaagccgctgcggcggatcgcggcgtcgttcgaggagctcgccgccgtcgccaagcagcagcccccaggggccatggacgccgcggcgttctctcgcgcctgctccaacgtctccgtcctcttcggctgcctcggcatcgccttcaagttcgccgagagggactacgtcgccaaggttgatgatttgctggaagcatccaattcaatttcaacattgccctcgatggttgagttagacattcagaaggacactgtcagggcagtagggagccatacaaggaatctgcttagagtgaagcgtggtattgatatggttaaggttctgtttgagaaaatgctggttacagagggcaactcgcttagggatgcagcatcagtagcttatgctcaggtgtttgctcctcatcatggatgggccataaggaaagcagttgctgctggaatgtacgctcttccctcaaagtcccaacttttgaagaaactgaatgaagatgaggagtcggcaaaggctcaagtgcaaaacttcgtcaggtcatcagcaccagtaatccgctacgtcgaagacctgttcacctcaaggaatttgggcatagattggtgaagagaacttgcagatacctttgatgtacttatctagtcagatgatctgcgagctggtgtcacacccggtttcaaggacaaaaccgaatgcatagctatatgtatgccaggatcaagtttcatacatatagagacgtcataagtgaataatcagtaacagtatcacgaaaagaaaactaaaacaaataaaagactatcagagttatacagcttatcctggaaacgaagg

SEQ ID NO: 3081 - DNA, 1074 bp, Panicum virgatum
tccaaatagcatcccaaaaaagaggaaggaaaaaaaaaagctcgtctccttccccgcagcttgccagcacccggtagtcggcgagcgagagcggccgggcgcgaggatggggtcgagcgaggcggacaagccgctgcggcggatcgcggcgtcgttcgaggagctcgccgccgtcgccaagcagcagcccccaggggccatggacgccgcggcgttctcccgcgcctgctccaacgtctccgtcctcttcggctgcctcggcatcgccttcaagttcgccgagagggactacgtcgccaaggttgatgatttgctggaagcatccaattcaatttcaacattgccctcgatggttgagttagacattcagaaggacactgtcagggcagtagggagccatacaaggaatctgcttagagtgaagcgtggtattgatatggttaaggttctgtttgagaaaatgctggttacagagggcaactcgcttagggatgcagcatcagtagcttatgctcaggtgtttgctcctcatcatggatgggccataaggaaagcagttgctgctggaatgtacgctcttccctcaaagtcccaacttttgaagaaactgaatgaagatgaggagtcggcaaaggctcaagtgcaaaacttcgtcaggtcatcagcaccagtaatccgctacgtcgaagacctgttcacctcaaggaatttgggcatagattggtgaagagaacttgcagatacctttgatgtacttatctagtcagatgatctgcgagctgggctcaacaaactttatcctggttatctactactaagcaatcctgctctggagttgtttgtgatggatagttgagtaaacactttgcaagtttgaactcaagtttcatgtatgtgatgatcgtcgatgatgaggaaacatatcggcctgcttttgtaaaattttctagatatctttgcatcttgcttatgcgtgctctcctaagatgatatgccttaggaaacatagaatgatagcacagtgagcttgagtgcttgatccaatttcatttgctgaatgaatgacctttccgg

SEQ ID NO: 3082 - DNA, 988 bp, Pennisetum glaucum
gaaaaacatccagaaaaagaggagagaaaaaactcccgtctccttctcccccaccaagcttgccagcacccgaacgaagtcggtgagcgagagcggccggcgcggcgatggggtcgagcgaggcggacaagccgctgcggcggatcgcgtcgtcgttcgaggagctcgccgccgtcgccaagcagcagcccgcgggggccatggacgccggggcgttcgcgcgcgcctgctccaacgtctccgtcctcttcggctgcctcggcatcgccttcaagttcgccgagagggactacgtcgccaaggttgatgatttgctggaggcatccaagtcaatttctacattgccctcgatggttgagttagacattcagcaggacactgtcagggtagcagggagccatacaaggaatctgcttagagtaaagcgtggtattgatatggtcaaggttctgtttgagcaaatgctggttacagagggcaactcgctcagggatgctgcatcagtagcttatgctcaggtgtttgctcctcaccacggatgggccataaggaaagcagttgctgctggaatgtatgctcttccctcaaagtcccagctgttgaagaaattgaatgaagacgaggattcggcaaaggctcaaatgcagaacttcatcaggtcatcagcaccagtaatcagctatgtcgaagacctattcacctccaggaatttgggcatagattggtgaagagaacctacagatacctgtgcttgatgtactaatccaatcagatggtctgctgtgagctgggctccaaaaacttaatccaggtttcaatgtttgcaagttgtaaccaaatcaacaagcttcggtactactaaggaatcccgatctggagttgtttgtgttgggtcgctgagtatacaatttgcaactttgaactcttgtatgtgaggttatgacatccatcgatgatgaggaaatatatctgctggctgatagggagg

SEQ ID NO: 3083 - DNA, 1106 bp, Setaria italica
atgattttttttccaagcaaatgctgcaaaagtaattcgaaccagtacagtccgctgtcctgttgtcatgggccgagctgcgtcccaaattccggcccatcgcagcccaacacggcatcgagcaacctcggcgtcgtcgccagccagctgctgaaaaagaggaggaaaaaaagactcgtctccttccccaccaagcttgccagcacccgaagtcggcgagcgagagcggcaggcgcggcgatggggtcgagcgaggcggacaagccgctgcggcggatcgcggcgtcgttcgaggagctcgccgccgtcgcgaagcagcagcccgcgggggccatggacgccggggcgtttgcgcgcgcctgctccaacgtctccgtcctcttcggctgcctcggcatcgccttcaagttcgccgagagggactacgttgatgatttgctggaggcatccaagtcaatttctacattgcccttgatggttgagttagacattcagcaggacactgtcagggtaccagggagccatacaaggaatctgcttagagtaaagcgtggtattgatatggttaaggttctgtttgagcaaatgctggttacagagggcaactcgctcagggatgcagcatcagtagcttatgctcaggtgtttgctcctcaccatggatgggccataaggaaagcagttgctgctggaatgtatgcgcttccctcaaagtcccagctgttgaagaaattgaacgaagatgaggattccgcaaaggctcaaatgcagaacttcgtcaggtcatcagcaccagtaatcagctacgtcgaagatctattcacctcaaggaatttgggcatagattggtgaagagaacttacagatacctgtgctcgatgtactaatccagtcagatggtctgctgtgagctgggctccaaaaacttaatcctggtttcgatgtttgtaaccaaatcaacaagcttcggtctattactaggaatcccgctctggagttgtttgtgatgggtagatgagtaaacgatttgcaagtttgaactcttgtacgtgacgtgtgatgacatccatcgatgatgaggaaatatatctgccggccgattggga

SEQ ID NO: 3084 - DNA, 928 bp, Panicum virgatum
ggaaggaaaaaaaaaaagctcgtctccttccccgcagcttgccagcatctacccggaagtcggcgagcgagagaggccgtgcgcggcgatggggtcgagcgaggcggagaagccgctgcggcggatcgcggcgtcgttcgaggagctcgccgccgtcgccaagcagcagcccccgggggccatggacgccgcggcgttctcccacgcctgctccaacgtctccgtcctcttcggctacctcggcatcgccttcaagttcgccgagatggactacgtcgccaaggttaatgatttgctggaagcatccaattcagtttcaacattgccctcgatggttgagttagacattcagaaggatactgtcaggacagtaggtagccatacaaggaatctgcttagagtgaagcgtggtattgatatggttaaggttctgtttgagaaaatgctggttacagagggcaactcgcttagggatgcagcatcagtagcttatgctcaggtgtttgctcctcatcatggatgggtcataaggaaagcagttgctgctggaatgtacgctcttccctcaaagtcccaactgttgaagaaactgaatgaagatgaggagtcggcaaaggctcaactgcaaaacttcgtcaggtcatcagcaccagtaatccgctacgtagaagacctgttcacctcaaggaatttgggcatagattggtgaagagaagttgcagatacctatgttgatgtacttatctagtcagatgatctgctgtgagctgggctccacaaactttatcctggttatctactacttagcaatcctgctctggagttgtttgtgatggatagatgagtaaacactttgcaagtttgaactcaagtttcatgtccgacgacatccatcgatgatgaggaaatatatcagcctgctgtttgt

SEQ ID NO: 3085 - DNA, 1394 bp, Panicum virgatum
gcagtgttgcagctaaaatgtatatcttgtaatgggccgaggtgtagcccaatgtccggcccatcgaggcccagcacggcatcgatgaacctcggcgtcgtcgccagcttgctgcaggtgccgcctcaaaaaggaagcgtaggaaccccgaaaggcagcgctgaaaaattctctcgaaaagcatcccaaaaagggggaaggaaaaaaaaaagctcgtctccttccccgcagcttgccagcatctacccggaagtcggcgagcgagagaggccgtgcgcggcgatggggtcgagcgaggcggagaagccgctgcggcggatcgcggcgtcgttcgaggagctcgccgccgtcgccaagcagcagcccccgggggccatggacgccgcggcgttctcccacgcctgctccaacgtctccgtcctcttcggctacctcggcatcgccttcaagttcgccgagatggactacgtcgccaaggttaatgatttgctggaagcatccaattcagtttcaacattgccctcgatggttgagttagacattcagaaggatactgtcaggacagtaggtagccatacaaggaatctgcttagagtgaagcgtggtattgatatggttaaggttctgtttgagaaaatgctggttacagagggcaactcgcttagggatgcagcatcagtagcttatgctcaggtgtttgctccccatcatggatgggtcataaggaaagcagttgctgctggaatgtacgctcttccctcaaagtcccaactgttgaagaaactgaatgaagatgaggagtcggcaaaggctcaactgcaaaacttcgtcaggtcatcagcaccagtaatccgctacgtagaagacctgttcacctcaaggaatttgggcatagattggtgaagagaagttgcagatacctatgttgatgtacttatctagtcagatgatctgctgtgagctgggctctacaaactttatcctggttatctactacttagcaatcctgctctggagttgtttgtgatggatagatgagtaaacactttgcaagtttgaactcaagtttcatgtccgacgacatccatcgatgatgaggaaatatatcagcctgctgtttgtaaaattttctagatatattggcatcttgcttatgctttgctctcctgagatgatctgccttaggaaacatagaatgatagcaccgtgagcttgagtgcttgacccaatttcatttgctgaatgaatgtcatttccagaattcgaagaacatggtctcaatatctaacagcatcatgttgatttcaaatcaaatttgcgagctttcagcaagcatgatactattatatggggaacttgtatatgaaagaatcgcaaataattgacattggcac

SEQ ID NO: 3086 - DNA, 1150 bp, Avena sativa
cgcgtacaaccaccaaaagcccacaaggcatcagctaccggactacgacagacgagagacgacacggcaccaccggagctctcgtctcgaagcacccaccgcgctcgtccttgccgacctccagccgccgccgcggggaccgatgggctccaacgaggcggacaagccgctgcggcggatcggcgcctcgttcgaggagctggcggccgtcgcgaagcagcagcagcccgcggcgatggtggcgggggacttctcccgcgcctgctcccacgtctccgtcctcttcggctgcctcgggatcgccttcaagttcgccgagatggactacgtcgccaaggttgacgatttactggaggcatccaagtcaatctcaacattgccttccatggttgagctagatattcagaagggcactgtcagagtggcgggcagccatacgaggaatctactgagggtcaagcgtgggatcgatatggtcaaagttctgtttgagcagatattggttacagagggcaactccctgagggacgcagcatcaaaggcttatgctcaggtgtttgctcctcaccatggctgggccataaggaaagcagttggcgctggaatgtacgcccttccttctaaatcgcagctcctgaagaaactgaatgaagatgagacttcagcaagggctcaaatgcagagtttcgtcaggtcagctggaccagtaatcctctacgtcgaaaacctctttacctcgaagaatttaggactagactggtgagcgaagcctgtatacagacactcccaatgtgtgtactaatgatgtggcgatcagatggtgtgctctgctgtgactctaaaacaactgtagctggtttcggtgtttgcgttcgagagtgcagggctgttgtaacctaaattcaataagctgtgctgtatggaggttcctgactggtggatatggaaccttttgtaacgaagcttttacaaacccgagattccattccatctctagagagctgttaaactggaatgctacttgtatgtatggggtatcatgagaactagtactattgactaatttgaaacatggtgcggagagttcttctgtaaatcttatggtagcagatttatgaatgtcttggagactgggcaagacgtccaaaaa

SEQ ID NO: 3087 - DNA, 982 bp, Secale cereale
ccgtacgcacagagagagagagggaaaaaaagaagcacaaggcatcacgcccagacgccgacgcaacccaagctctcgaactcgaagcgcccaccctccccgcccgcggacgccggcggcgagccgcggcggcgaccggacgatggggtccaacgaggcggacaagccgctgcggcggatcggcgcgtcgttcgagcagctcgcggccgtcgccaagcagcagcccgccgcgatggcggcgggggacttctcgcgcgcctgctccaacgtctccgtcctcttcggctgcctcggcatcgccttcaagttcgccgagatggactacgtcgccaaggttaatgatttagtggaggcatcgaagacgatttcgacactgccctccatggttgagcttgacattcagaagggcactgtcaggcaggcggggagccatacgaggaatctactgagggttaagcgtgggattgatatggtgaaagttctttttgagcagatattagtcacagaaggcaactccctgaaggacgcagcgtcaaaggcttatgctcaggtgtttgctcctcaccatggctgggccataaggaaagcagttggtgctggaatgtacgcccttccttccaagtcacagctcctgaaaaaactgaatgaagatgaaaattctgcaagggctcaaatgcagagtttcgtcaggtcgtctggaccagtaattctctacgtcgaagacctcttcacctcaaagaatttaggactagactggtgaacgaagcctacacacagaatgtactaatgcgatgagatggtgtgctgtgacctcaaacaactgtagctggttttggtgtttgtttgagagttctgagctgtaacctaaattcaataagctgtgctgccgtggagcgggagcctttgttactaaaatctctaggaatgttaccgttacctgcctgtggtgtatgggtcatacatgtcgagagagtatgcatca

SEQ ID NO: 3088 - DNA, 1086 bp, Pseudoroegneria spicata
  misc_feature (113)..(113): n is a, c, g, or t
  misc_feature (864)..(864): n is a, c, g, or t
gcacaacgcatcagcccagacgccgacgccacccaagctctcgaactcgaagcgcccaccctctccgcccgcggacgccggcggcgagccgcggcggcgaccgaccgatgggntccaacgaggcggacaagccgctgcggcggatcggcgcgtcgttcgagcagctcgcggccgtcgccaagcagcagcagcagcccgcgatggcggcgggggacttctcgcgcgcctgctccaacgtttccgtcctcttcggctgcctcggcatcgccttcaagttcgccgagatggactacgtcgccaaggttaatgatttactggaggcatccaagacgatttcaacactgccctccatggttgagcttgacattcagaagggcactgtcaggcatcctgggagccatacgaggaacctactgagggttaagcgtgggattgatatggtgaaagttctgtttgagcagatattggtcacagaaggcaactccctgaaggacgcagcatcaaaggcttatgctcaggtgtttgctcctcaccatggctgggccataaggaaagcagttggtgctggaatgtatgccctcccttctaagtcgcagctcttgaagaaactgaatgaggatgaaaattcagcaagggctcagatgcagagtttcgtcaggtcgtctgggccagtgattctctatgtcgaagacctcttcacctcgaggaatttaggactagattggtgaacaaagcctgcacacaggcttccgatgtactaatgcgaccagatggtgtgctgtggcctcaaacaactgtagctggcttttttgtttgagttcgagagttcagaattgtaacctaaattcaataagccgttctacngtggaggttcttgacgggtggatacgggagccgttgttacaaacctgaaattccagcttatctgtaagctgttaaactggaattctaccctgcaatgtatgatgtaccaacatgaaattccagcttatctctaagctgttaaactggaatgctacctgcaatgtatgatgcatgccgtatgcatctttgagaatatatagtccgattggaacatttctatca

SEQ ID NO: 3089 - DNA, 1012 bp, Secale cereale
cccccgcacagagagagaagggaaaaaaaagagcacaaggcatcagcccagacgccgacgccacccaagctctcgaactcgaagcgcccaccctccccgcccgcggacgccggcggcgagccgcggcggcgaccggacgatggggtccaacgaggcggacaagccgctgcggcggatcggcgcgtcgttcgagcagctcgcggccgtcgccaagcagcagcccgccgcgatggcggcgggggacttctcgcgcgcctgctccaacgtctccgtcctcttcggctgcctcggcatcgccttcaagttcgccgagatggactacgtcgccaaggttaatgatctactggaggcatccaagacgatttcgacactgccctccatggttgagcttgacattcagaagggcactgtcaggcaggcggggagccatacgaggaatctactgagggttaagcgtgggattgatatggttaaagttctgtttgagcagatattagtcacagaaggcaactccctgaaggacgcagcgtcaaaggcttatgctcaggtgtttgctcctcaccatggctgggccataaggaaagcagttggtgctggaatgtacgcccttccttccaagtcacagctcctgaaaaaactgaatgaagatgaaaattctgcaagggctcaaatgcagagtttcgtcaggtcatctggaccagtaattctctacgtcgaagacctcttcacctcaaagaatttaggactagactggtgaacgaagcctacacacagaatgtactaatgcgatgagatggtgtgctgtgacctcaaacaactgtagctggttttggtgtttgtttgagagttctgatgagttgtaagttgtaacctaaattcaataagctgtgctgccgtggagcgggagccgttgttactaaaatctataggaatgttaccgttacctgcctgtggtgtatgggtcatacatgtcgagagagtatgcatcacctgattggaaaatttccagtgc

SEQ ID NO: 3090 - DNA, 1013 bp, Secale cereale
tttcttgtctttttagcgcaaaatgagcggtcttaattatcttcgacaagatgaaccatcttttcttatagtcaaaaaaaaaaaaagacacaaggcatcagcccagacgccgacgccacccaacgctctcgaactcgaagcgcccaccctccccgcccgcggacgccggcggcgagccgcggcggaaaccggccgatgggtccgaacgaggcggacaagccgctgcggcggatcggcgcgtcgttcgagcagctcgcggccgtcgccaagcagcagcccgccgcgatggcggcgggggacttctcgcgcgcctgctccaacgtctccgtcctcttcggctgcctcggcatcgccttcaagttcgccgagatggactacgttgccaaggttaatgatttactggaggcatccaagacgatttcgacactgccctccatggttgagcttgacattcagaagggcactgtcaggcaggcggggagccatacgaggaacctgctgagggttaagcgtgggattgatatggtgaaagttctgtttgagcagatattagtcacagaaggcaactccctgaaggacgcagcgtcaaaggcttatgctcaggtgtttgctcctcatcatggctgggccataaggaaagcagttggtgctggaatgtacgcccttccttccaagtcacagctcctgaaaaaactgaatgaagatgaaaattctgcaagggctcaaatgcagagtttcgtcaggtcgtctggaccagtaattctctacgtcgaagacctcttcacctcaaagaatttaggactagactggtgaacgaaggctacacacagaatgtactaatgcgatgagatggtgtgctgtgacctcaaacaactgtagctggttttggtgtttgtttgagagttctgagttgtaacataaattcaataagctgtgctgccatggagcgggagccgttgttactaaaatctctaggaatgttaccgttacctgcctgtggtgtatgggtcata

SEQ ID NO: 3091 - DNA, 977 bp, Triticum aestivum
ccggccgatggggtccaacgaggcggacaagccgctgcggcggatcggcgcgtcgttcgagcagctcgcggccgtcgcgaagcagcagcagccgcagcagcccgcgatggcggcgggggacttctcgcgcgcctgctccaacgtctccgtcctcttcggctgcctcggcatcgccttcaagttcgccgagatggactacgtcgccaaggttaatgatttactggaggcatccaagacgatttcaacattgccctccatggttgagcttgacattcagaagggcactgtcaggcaggcggggagccatacgaggaatctactgagggttaagcgtgggattgatatggtgaaagttctgtttgagcagatattggtcacagaaggcaactccctgaaggacgcagcgtcaaaggcttatgctcaggtgtttgctcctcaccatggctgggccataaggaaagcagttggtgctggaatgtatgccctcccttccaagtcgcagctcttgaagaaactgaatgaagatgaaaattcggcaagggctcaaatgcagagtttcgtcaggtcgtctggaccagtaattctctacgtcgaagacctcttcacctccaagaatttagggctagactggtgagcaaagcctatacaaagagacttccaatgtactaatgcaactagatggtgtgctgtgacctcaaacaactgtagctggttttggtgtttgagttcgagagttcagagttgtgacctaaattcaataagctgtgctgctaccgtggaggttcttgacggggtggatacgggagccgttgttacaaacctgaaattccagcttatctgtaagctgttaaactggaatgctaccctgcaatgtatgatgtaacaacatgaaattccagcttatctctaagctgttaaactggaatgctacctgcaatgtactatgatgcatgccatatgcatctttgagaatagtc

SEQ ID NO: 3092 - DNA, 1292 bp, Oryza sativa
gtaaaatacggggttttcagcttcttctggacaaagcaaaattcagcttcttctagaggaggcaaaagttcaggtttaggaatagaaaggatcgacgagccgacacgtcggtctcattcgatgggccgagacgatacaaatattcctccggcccactgcagagcgaactcgattcctccccttcacctctacgcgtaaaaccacaaccaaaagcaaagcacacgagagagagacccacccaccccaaccatcccggaggcggagagcttgacgccgccgccgacgagccgcagcggcggagcaagcgggagcgggaggtggggatggggtcgagcgacggggacaagccgctgcggcggatcgcggcgtcgttcgaggagctcgaggcggtggccaagcagcaggcccccggcccggccatggaggtgggctccttcgcccgcgcctgctccaacgtctccgtcctcttcggctgcctcggcatcgccttcaagttcgccgagatggactacgtcgccaaggttgatgatttgctggaggcatccaagtcaatctcaaaattgcctgagatggttgagttggacattcagaagggcaccgtcaggcaagctgggagccatactaggaatatgctgagggttaagcgtgggattgatatggttaaaattctgtttgagcaaatactggttacagagggcaactccttaagggatgcagcatctaaggcttatgctcaggtttttgctcctcaccatgggtgggccataaggaaagccgttgctgctggaatgtacgcccttccctcaaaatcgcagctcctgaagaaattgaatgaagatgaaaattcggcaaaggttcaaatgcagactttcatcagagcatctggaccagtaattctctacgttgaagatctgtttacctcaaggaatttaggcatggactggtgaaccaaagcctacttatccacttcgaatgtactaatccaattagacggtgtcaatacgcacgctttgtatgtactgatccaatatgatggtgtgctttgagctatgactacaatcagttgtatctggtttcgacctgttaaataagcttcagtctatgcgaatcagctcagtgattgacctgctgtgctgttctggatgctgtttttttaacaggtgaatgagaaattaagaattcgttgttagcacataatgcagtttgaaacaactgaaattctatttgcatatgtccttcctccgtcccataatatttccttcgtcccagaatataagggatcctccgtccca

SEQ ID NO: 3093 - DNA, 1067 bp, Hordeum vulgare
cacaacaacgcgtacaaccaccaaaagaacgaggcatctcaccacagagagagggggagagagggaaaaaaaaagagcacagctcatcagcccagacgccgacgccacccaagctctagaacctccaagcgcggcggacgccggcggcggcggagaccggccgatggggtccaacgaggcggacaagccgctgcggcggatcggcgcgtcgttcgagcagctcgcggccatcgccaagcagcagcagcagcccgcgatggcggcgggggacttctcccgcgcctgctccaacgtctccgtcctcttcggctgcctcggcatcgccttcaagttcgccgagatggactacgtcgccaaggttaatgatctactggaggcatccaagacgatttcgacattgccctccatggttgagcttgacattcagaagggcactgttaggcagccggggagccatacgaggaatctactgagggttaagcgtgggattgatatggtgaaagttctgtttgagcagatattggtcacagaaggcaactccctgaaggacgcagcgacaaaggcttatgctcaggtgtttgctcctcaccatggctgggccataaggaaagcagttggtgctggaatgtacgccctaccttccaagtcgcagctcctgaaaaaactgaatgaagatgaaaattcggcaagggctcaaatgcagagtttcgtcaggtcgtccggacaagtgattctctacgtcgaagacctcttcacctcgagtaatttaggactagactggtgagcaaagcctatacagacttccaatgtactaatgcgatcggatggtgtgccgtgccctcaaataactgtagctggtcttggtgtttgagtttgagagtccggagttgtaacgaaaattcaataagccgtgctgccgtggaggttctggatgggtggatacgggagccattgttacaaacctgaaattccagcttatctgtaagctgttaaactgaaatgctacctgcaacgcatgattctgagaatatagtctgatcagaacatttctagtgcttgcaactttt

SEQ ID NO: 3094 - DNA, 1724 bp, Zea mays
gtatttattgctcttctgtcttctccccgctcgtattggcacgcaccacatcaaccgccgcccgtatagctttgtgagatggcggagccgggcaaaagagcggtggcgcagtggcggcggtgggcgctggccaacctgggcccgttcgcggccctgttcaccaccaacttcggctcggcgtggctgatcctggcgccggtggtgtcgctggtggccacctacgcgccgcggcggctgttccggacctacttcaacctgttcctccgccggcgctcccgccgcctgctcaacgtcgtggacccctacgtgaccatcgacatctcggagcccggcggcgaggtgcgctactcgcgctacggccccgtctccgacaacgacagcacctacgaggaggtgaaggcgtacctgagcggcgccgcgcgcgagcaggacgcgcgcgagctccgcgccgagggcgcccgggagggcaacggcctcgtcgtcagcatgcgcgacggccaggacgtggccgacgagttccgcggcgtcccgctctggtggtcctccgtggtcgccagggacgtgcagggccagcgcaagggcgaccggcgcttccagcggctcaccttccacctgagccaccgcgcgctcgtcgtcgacgagtacctgccccacgtccgccgccagggccgcgagatcctcttcagcaaccgccgccggaggctctacaccaacagcaagtcacgcgactcctacagctacgagtacaagtcgtggagctacatcgacttcgaccacccgacgacgttcgacacgctggccatggaccgggccaagaagagggacatcatccacgacctcgacacgttccggaacagcagggagttctaccggcgcgccggcaagccgtggaagcgcgggtacctgctgtacggcccgccgggcacgggcaagtccaccatggtcgccgccatggccaactacctcgactacgacatctacgacgtggagctcaccgtggtgcacaccaacagcgacctccgcaagctcctcatcgacaccaccagcaagtccatcatcgtcatcgaggacatcgactgcacgctcgacgtcaccggcgaccgcgccggcaggccgcggcgccgggccaacggcggcggcgacgccgacgacaggccgcgcgactcggtgaccctgtccggcctgctcaacttcatcgacgggctctggtcggcgtgcacgggcgagcggatcgtcgtcttcaccaccaaccacgtcgagaggctggacccggcgctgatccggcgcggcaggatggacatgcacatcgagatgtcctactgcaggttcgaggcgttccagacgctcgccaagaactacctggacatcgacgaccacgacgacctgttcgccgccgtcggggaggtactacgggaggagaacctcacgccggccgacgtcgccgagtgcctcatggcggccaggcgcgctggctccggcgagccttccccgtgcctccagatactgatcgatgagctgaagaagagagcggtggagaaggcgaaggccgaggcagaggctaaggcaagagcagaagcacaggccaaggcatgggcggaagcagaggccagggctgcggtggaggcaaatgcggccgcaagggaccgtgcaatggcaacccacagtaatgtttaattttatatacacgaagaacagaaagtttggagatttgagacaacttgcaa

SEQ ID NO: 3095 - DNA, 900 bp, Zea mays
gaccagaccacgacgtcgcgcgcggccaccactgggctcgtcgccgatcgctataaaacgcggccgctgccttgccgcctttcttcaagccgagaccaagaaaacacaagtacagactacagagccatctttgatctttccagtccaagatgagcgtggagatcctcgacgggcggacggtgcagagcttcgtggaggacgagcgcgcgttcaactcgtccgtggacgcccgcttcgcggcgctggacgtggaccgcgacggccgcctctcgtacgccgagatggccggggagctcatggcgctgcgcgtgcgggaggcgcacttcggggccgacgcgccggcgcccgcggccgagctcgccgcgctgtacggggcgctcttcgcgcgcttcgaccgcgacggggacggcgccgtggaccgcgacgagttccgcgccgggatgagggaggtcatgctcgccgtcgccagcggcctcggcgtgctccccgtgcagatggtggtcgaggaaggcagcctcctcaagtgggccgtcgacagggagctggccactaccatgccagcttgaccagctcggctccatcagctagctgcctgacagtgtgcactagcgctagtgctcaccgctagctgaatgagagttttatcacctatgtatgtatgtaaccgtacgccgagggtgtcggtctaatttgggctcgtttaacgttttcgtgtttgtagacctgacatgagtatgtaacgtacgcactgaaccttttttatcagtccgaaaactagcgttttacacttttactccaagagacttcatgcatcgttgcaagatgcgagttgtaaaatggaattggagcaccacccacccaatctcctcattggaggcttggagccctccttgtatcacc

SEQ ID NO: 3096 - DNA, 1469 bp, Panicum virgatum
aatacacgaaagaaagtatcaagaacctcttggatggcattctagcggatgaacatcgttcataatggcaatctggcgaaatcctttctcacaatgatatttctccgaaactcacttctcaagttggtctaaatccaaaaagcacccggagctctcgctgcccacacgacacgatgcatagaccggaagcaagcgcctctgatgaccgaccttgccactctcggacgtcctggcaaacaggtctcgctcgacgcctcggccggccgaacgcaccgagaggagaaccctccttttggaaagggaagggagcacgctcaccggctgcacggcggagccgtccacgactcaacgctgcacattcccccctcgcgtattctgcgaggctttgctggagaacgaataatccatgggagggggcggggcgccggagcctctgctttagcctttacttcttggcttacatctcaagcgagcgcatatcggatcagactcggacctcgcgcacaactcgcggcatattaccaccaccgccaccgggcaaaaccgccgccggccgcaggtggcgcgccgctataaaaagccgccacgggccctgccgcatctccccaaacaggccggccgaccgaccaaagagagagagctagcacacgacgagcactagtggtagcgagctctaggaacaagaacaactaatcctttgtgcttgtttccaagatgagcgtggagatcctggacgggcggacggtgcagagcttcgtggaggacgagcgcgcgttcaactcgtgcgtggacgcccggttcgcggcgctggacgcggaccgcgacggccggctctcgtacgccgagatggcgcgggagctcgcggcgctgcgcgtgcgggaggcgcacttcggcgccgacgcgccggcgcccgcggccgagctcgcgcgcctctacggggcgctcttcgcgcgcttcgaccgcgacggcgacggcgccgtgggcccggacgagttccgcgccgagatgcgggaggtcatgctcgccgtcgccagcggcctcggcgcgctccccgtccagatggtcgtcgaggagggcggcctcctcaggagggccgtcgacagggagctcgccgccaccacggcagcctgctgaacgcctcgccgtcgtcgtcatgcgccgccgtttgatccctgtgctgatcctggattcctgacctcgctctggcgttgcagctcacgggtctttgagaatttctaattatgcagtatctcgtagtacactcatcataacatatagtactttacacgctacttactatcacgcacaagagtatttggattgtgtacttatgtactaataggcgtgtgtactaattatcgctgagtgagatttcatttcagcaggctttcagctgtgtaaccgtgacgcaaacagtatttctatacatgatcggagagtattgatgaatttctttctgtcttgtttac

SEQ ID NO: 3097 - DNA, 776 bp, Panicum virgatum
ggccgaccgaccaaagagagagagctagcacacgacgagcactagtggtagcgagctctaggaacaagaacaactaatcctttgtgtgcttgtttccaagatgagcgtggagatcctggacgggcggacggtgcagagcttcgtggaggacgagcgcgcgttcaactcgtgcgtggacgcccggttcgcggcgctggacgcggaccgcgacggccggctctcgtacgccgagatggcgcgggagctcgcggcgctgcgcgtgcgggaggcgcacttcggcgccgacgcgccggcgcccgcggccgagctcgcgcgcctctacggggcgctcttcgcgcgcttcgaccgcgacggcgacggcgccgtgggcccggacgagttccgcgccgagatgcgggaggtcatgctcgccgtcgccagcggcctcggcgcgctccccgtccagatggtcgtcgaggagggcggcctcctcaggagggccgtcgacagggagctcgccgccaccacggcagcctgctgaacgcctcgccgtcgtcgtcatgcgccgccgtttgatccctgtgctgatcctggattcctgacctcgctctggcgttgcagctcacgggtctttgagaatttctaattatgcagtatctcgtagtacactcatcataacatatagtactttacacgctacttactatcacgcacaagagtatttggattgtgtacttatgtactaataggcgtgtgtactaattatcgctgagtgagatttcatttcagcaggcttt

SEQ ID NO: 3098 - DNA, 976 bp, Setaria italica
gattagaattattagtcttcttagaccgcccgctgttgctgatgcttcggcacatcccacagcatattgcccccggcaaaaccaactcccggctcaattagcgcgccgctataaaactccggcacggtcctgccgcatctctccaaaccggtcgacagaaacacaagcacgtagctagccagcgagctaacaagctctcgatcgtgaggaaactgaaggtttttttcccggccaagatgagcgtggagatcctggacgggcggacggtgcagagcttcgtggaggacgagcgcgcgttcaactcgtgcgtggacgcccggttcgcggcgctggacgcggaccgggacggccggctctcgtacgccgagatggcgcgggagctggcggcgctgcgggtgcgggaggcgcacttcggcgccgacgcgccggcgcccgcggccgagctcgccgagctctacgggtccctcttcgcgcgcttcgaccgcgacggggacggcgccgtggggcccgacgagttccgcgccgagatgagggagctcatgctcgccgtcgccagcggcctcggcgcgctccccgtccagatggtcgtcgaggaaggaagcctcctcaggagggccgtcgacagggagatggcagccgccgccacggcagcgtgaccgaccgaccgtcggcgagggctcaccgtcgccgtgcctcggcgtgtcgtgaactcgtgatgcagttcgcagttcctgagagatcgagtttctgatgcggtgtctcatagtagactcgcaacgcatttgtacttacaagttactccgtattacgcacaagagtatttggagcggcgtcaagcgtgtgctcatgtaccattgtattaccgcagcgcgtgtactaactaatgctgactgatcgagatttcagctgtgtaaccgtgacagtataaatgtactaatgtacgccgagagtgataatgaacttatatttctgtttt

SEQ ID NO: 3099 - DNA, 1387 bp, Panicum virgatum
cggccgcaagtggcgcgccgctataaaaagcccgccacggacccttgcctgccgcatctccccaaacaggccgaccgaccaaagagagagctagcagacgagcactagcagcgagctatataaactgtaagctctcgatctatcaagaggaaatcctctctcagtttccaagatgagcgtggagatcctggacgggcggacggtgcggagcttcgtggaggacgagggcgcgttcaactcgtgcgtggacgcccggttcgcggcgctggacgcggaccgcgacggccggctctcgtacgccgagatggcgcgggagctcgcggcgctgcgcgtgcgggaggcgcacttcggcgccgacgcgccggcgcccgcggccgagctcgcgcagctctacggggcgctcttcgcgcgcttcgaccgcgacggggacggcgccgtgggccccgacgagttccgcgccgagatgagggaggtcatgctcgccgtcgccagcggcctcggcgcgctccccgtgcagatggtcgtcgaggacggcggcctcctcaggagggccgtcgacagggagctcgcccccaccacggcagcctgaacgccacgccgtcctcatgcgccgctgatccccgtgctgatcctgaattcctgactcgccgtgtggcgttgcagctcacggttatttgagagtttcttattaatgcagtatcacgtagtacactcatcacaacgtatagtacttttacacgctacttattatcacgcacaagagtatttggattgtgtacttatgtactaggcgcgtgcattaattattgctgagagtggtttcagcaggctttctcagctgtgtaaccgtgacggtatttataaatatggtcggagagtactcctacgtgctgatgaatttctttctgttttgtttacctcaatcttctcaacgtttgcatcccagccacgcacactctggaatgttacttgtctaacctgaccagctcggatcagcgcatgccttattatggctatacgcagcttgcccatgctggaaatgacagttcagctatgtatgtaaccgaatgccgactgccgactgccgagaggatgttgccttttggactcgattaaaatttgagagcatgtctctttgtgcatgttgagagttttagatgctccacgcgagcaaatacaactttccttttggcacgacaaaaggttatgcgaatctctttcttagagtaattatgctgatctcttgatgatggtttcgataccatttttgctatgaaatgccggtagcttacatttgtggtcttcatcgctatgcatgtcggcgtcgcttaacttgtctcagacacccgcatcgccgcaagaggagccatctgaagatgaggactga

SEQ ID NO: 3100 - DNA, 1701 bp, Saccharum officinarum
gtgtcgtcccatctgttcttcgcgaggcgcaagtgcgcaacaaaggcacaaacccctcacctccctcaaaccctagccctcgcgccccctgcttgcccccgtcgccgccaccatgggctcagatgcggacatggaggattacgggttcgagtactcggacgaagagcctgaggagcaggacgtcgacatcgagaaccagtattacaactccaaaggtttggtcgagacagacccggagggtgcacttgctggttttgatcaagtagtcagtatggagcctgaaaaggctgaatggggatttaaagctcttaaacaaactgtcaagctttactataagctggggaaatacaaagaaatgatggatgcctatagagagatgttaacatacataaaatctgctgtcacccggaactacagtgagaaatgtataaacaacataatggattttgtttctggatcagctagtcagaactttactcttctgcaagagttctaccagacgacactgaaagcgcttgaagaagcaaaaaatgagaggttatggttcaagacaaacttgaagctttgcaagatttggtttgatatgggcgaatacggtcgcatgagcaagatattgaaggagctgcataaatcttgccaaagggaagatggttctgatgatcaaaagaaaggcacacagcttttggaagtctatgctattgaaatccaaatgtacactgaaacaaagaataataaaaagcttaaggaattgtatcaaagggctctttccatcaaatcagcgatacctcacccaagaatcatgggtataattcgtgagtgtggtgggaagatgcatatggctgagaggcagtgggctgaggctgcgactgatttctttgaagctttcaagaactacgatgaagcaggcaatccacggagaatccaatgcctaaaatatcttgtccttgccaatatgttgatggaatctgaagtgaatccttttgatggacaagaggccaagccgtacaagaatgatcccgaaatccttgcaatgacaaacctgattgcagcgtaccagaagaatgacatcatggaatttgaaaagatcctgaagagtaatagaagaacaataatggatgatccttttatccgtaactatattgaggacttattgaagaacatcagaacccaagtgctgctcaagcttattaaaccatatactcgaattaggataccattcatttcacaggaactcaatttcccagagaaggatgtcgagcagctgttggtatcgctcatcctggacaaccgtatccaaggccacatagatcaggtcaacaagctactagagcgtggagaaaggtccaaggggatgaggaagtacaatgccatcgacaagtggaatactcagctgaagtccatttaccaaacattgtccaacagagttggatgagacggatcatgtctgctgtatgctttgcacacctagaattgttgatagcctgttttggggatttgagggcaactgcaaaagaactgtctggcaatgcttgcagtagaatcctggatctgggtaaagtgaaatgtccatgtaagcgcttgatctggtggattatattcgctttcttcagttatattgactaggaggttgtctctgaactgaatttggtgttttgagagtgcaagacatgacagtggtcgaaagccagatgtcaagagggg

SEQ ID NO: 3101 - DNA, 1706 bp, Zea mays
attcgttataatgacaaaaaaggtccctctcctcgcgtctcgttgtcccatctagcccatctgctctctcagcgaggacgaaggcacaaacccctcacctccctcaaaccctagccctcgctctcccgcttgttcccgtcaccgccatcatgggctcagatgcggacatggaggactacgggttcgagtactctgacgaagagccggaggagcaggatgtcgacattgagaaccagtattacaactccaaaggtttggtcgagacagacccagagggtgcacttgctggttttgatcaagtggtcagtatggagcctgaaaaggctgaatggggatttaaagctcttaaacaaactgtcaagctttactataagctggggaaatacaaagaaatgatggatgcatatagagagatgttaacatacataaaatctgcggtcacccggaactacagcgagaaatgtataaacaacataatggattttgtttctggatcagctagtcagaattttactcttctgcaagagttctaccagacaacactgaaagcgcttgaagaagcgaaaaatgagagattatggttcaagacaaacttgaagctttgcaaaatttggtttgatataggcgagtacggtcgcatgagcaagatattgaaggaactgcataaatcttgccaaagggaagatggttctgatgatcaaaagaaaggcacacaacttttggaagtctatgctattgaaatacaaatgtacactgaaacaaagaataataaaaagcttaaggaattgtatcaaagggctctttccatcaaatcagcgatacctcatccaagaatcatgggtataattcgcgagtgtggtggaaagatgcatatggctgagaggcagtgggctgaggctgcgactgatttctttgaagctttcaagaactacgatgaagcaggcaatccacggagaatccaatgcctaaaatatcttgtccttgccaatatgttgatggaatctgaagtgaatccttttgatggacaagaggccaagccgtacaagaatgatcctgaaatccttgcaatgacaaacctgattgcagcgtaccagaagaatgacatcatggaatttgaaaagatcctgaagagtaatagaagaacaataatggacgatccttttatccgtaactatattgaggacttattgaagaacatcagaacccaagtgctgctcaagcttattaaaccatatactcgaatcaggataccattcatttcacaggaactcaattttccagaaaaggatgtcgagcagctgttggtgtcactcattctggacaaccgtatccaaggccacatagatcaggttaacaagctgctagaacgtggagaaaggtccaaggggatgaggaagtacaatgctatcgacaagtggaatactcagctgaagtccatttaccaaacattgtccaacagagtttgatgagaaggatcgctgctgctgcgtgcattgcacacctagcattgttgatagcctgttttgcggatttgagggcaactgcaaagaactgtctggtgacgcttgcgatagaatcctggatctgggtaaagttaatattgactacgaggtcgtctctgaattgaatctggtgttttgatagtgcaagactacttgactggtcaaaagccaaatatacgacgatgcccttctggttggtctttg

SEQ ID NO: 3102 - DNA, 1765 bp, Zea mays
gagccggggtctggtttccagacctagcccaaactgaaaaaattgttcttgcttcccgatttccagtcctctgtcgtttgttgtcccatactcccatctgttctccgcgaggcgcaacgaaggcacaaaacccttacctccatcaaaccctagcgctcgtgtccccgtttagctcccgtcgccgctaccatgggctcagatgcggatatggaggactacgggttcgagtactcagacgaggagccggaggagcaggatgtcgatatcgagaaccagtattacaactctaaaggtttggttgagacagacccagagggtgcacttgctggttttgatcaagtagtcagtatggagcctgaaaaagctgaatggggatttaaagctcttaaacaaactgtcaagctttactataagctgggaaaatacaaagaaatgatggatgcctatagagagatgttaacatacataaaatctgctgtcacccggaactacagtgagaaatgtataaacaacataatggattttgtttctggatcagctagtcagaactttagtcttctgcaagagttctaccagacaacactgaaagcgcttgaagaagcgaaaaatgagagattatggttcaagacaaacttgaagctctgcaaaatttggtttgatatgggcgaatatggtcgcatgagcaagatattgaaggagctgcataaatcttgccaaagggaagatggttctgatgatcaaaagaaaggcacacagcttttggaagtctatgctattgaaatccaaatgtacactgaaacaaagaataataaaaagcttaaggaattgtatcaaagggctctttccatcaaatcggcgataccacatccaagaatcatgggtataattcgtgagtgtggtgggaagatgcatatggctgagaggcagtgggatgaggctgccactgatttctttgaagctttcaagaactatgatgaagcaggcaatccgcggagaattcaatgcctaaaatatcttgtccttgccaatatgttgatggagtctgaagtgaatccttttgatggacaagaggccaagccgtacaagaacgatagtgaaatccttgcaatgacaaacctgattgcagcgtaccagaagaacgacatcatggagtttgaaaagatcctgaagagtaatagaagaacaataatggatgatccttttatccgtaactatattgaggatctgttgaagaacatcagaacccaagtgctgctcaagcttattaaaccgtatacacgaatcaggattccattcatttcgcaggaactcaatttcccggagaaggatgtggagcagctgttggtatcgctcatcctggacaaccgaatccaaggccacatagaccaggtcaacaagttgctagagcgtggagagaggtccaaggggatgaggaagtacaatgccatcgacaagtggaatactcagctcaagtccatttaccaaacattgtccaacagagtttgatgagacgaatcgtggctgctgtatgtttgcacacctagaattgttgatagcctgttttggggatttgagggcaactgcaaagagctgtatggcaacgcttgcagtagaatcttggatctgggtaaaatgagatgtccatgtaagcatttgatattagctttttcagttatattgactatgaggatgtccatgtagcgatttcgttaggactgctttcaacgtctaatctcgagaatgtcactggtgccttttactgttg

SEQ ID NO: 3103 - DNA, 2066 bp, Panicum virgatum
cttcgcgtcccctctgctcccatctagccagcccatctgctctccgcctgcctctccgcaagggcgcaaagccgcaaacccctcgtccccccagaaaccctagccctcgcgcgcccgcttcgtggactcccccgccgcgctcaccgccccctcgacgccgccatgggctccgatgcggacatggaggactacgggttcgagtactcggacgaggagccggaggagcaggatgtcgacatcgagaaccagtactacaactccaaaggtatggttgagacagacccagagggtgcacttgctggttttgatcaagtagtcaaaatggagccagaaaaggctgaatggggatttaaagctcttaagcaaactgtcaagctttactataagctggggaaatacaaagaaatgatggatgcctacagggagatgttaacatacataaagtctgctgtgacccgaaactacagtgagaaatgtataaacaacataatggattttgtttctggatctgctagtcagaacttttctcttttacaagagttctaccagacaacactgaaagctcttgaagaagcaaaaaatgagagattatggttcaagacaaacctgaagctttgcaaaatttggtttgatatgggggagtatggccgcatgagcaagatactgaaggagctgcataaatcttgtcaaagggaagatggttctgatgaccaaaagaaaggcacacagcttttggaagtctatgctattgaaatccaaatgtacaccgaaacaaagaataataaaaagcttaaggaattgtatcagagggctctttcaatcaaatcagcaatacctcatccaagaatcatgggtataattcgtgaatgtggtggtaagatgcacatggctgagaggcagtgggcagaagctgcgactgatttctttgaagctttcaagaactacgatgaagcaggcaatccgcggagaattcaatgcctcaaatatctcgtccttgccaatatgttgatggaatctgaagtgaatccctttgatggacaagaggccaagccgtacaaaaatgatcctgaaatccttgcaatgacaaacttgattgcagcgtaccagaagaatgacatcatggaatttgaaaagatcctaaagagtaatagaaggacaataatggatgatcctttcatccgtaactatattgaggacctgttgaagaacatcagaactcaagtcctgctcaagcttattaagccatatacacggatcaggataccattcatttcacaggaactcaatgtccccgaaaaggatgtcgagcagctgttggtatccctgattctggacaaccggatccagggccacatagatcaggtgaacaagctgctagaacgtggagacaggtccaaggggatgaggaagtacaatgccatagacaagtggaatagccagcttaagtcaatataccaaacggtgtccaacagagttgggtgagacggcttctggcagtcgcacgctttgcacttatgagatatgttgatagcctgttttgggatctgagggcaaatgcatattgttttgtgacgcttgaggtagaatgttggatctggctgatgcgaaacaccgatgtaatgtagagcttgaactgaacccagtgttgacattactgtggtccaagccaattgccaggggaaaaacatgtaactacatccatctggttgccttacaacttttttgtgcttactgcctaagaatcctttacatgcctggaccatctgtgaggcagctgcacttgaacaatgctgtttgagcacgtttgatctcagggttgaagcccaatgaccctcgtccatgtaccaatggccgcccaatccagtagttttccccctttattattattgttattattactccgtccatgtaccaatgtaagacttacccctcaaagaaaaaaccaatgttagactataaaagggaaaaaagatcaaactattcttctcttttttgacgaagagtaggtcaaatatatacatcttttgtgtatgtaaaagttacattaatatatttgtatttagaat

SEQ ID NO: 3104 - DNA, 1881 bp, Setaria italica
cgtcccttgtgttcccatcgagcccatctctccgcctctccgcaaggtgcaagggcgcaaagacgcaaacccctcgttccccagaaaccctagccctccatccccgcgctcgccgagtccctcgccgccgccatgggctccgatgcggacatggaggactacgggttcgagtactcggacgaggagccggaggagcaggacgtcgacatcgagaaccagtactacaactccaaaggtatggttgagacagacccagagggtgcacttgctggttttgatcaagtagtcaaaatggagccagaaaaggctgaatggggatttaaggctctcaaacaaactgtcaagctttactataagctggtgaaatacaaagaaatgatggatgcctacagggagatgttaacatacataaaatctgctgtgacccgaaactacagtgagaaatgtataaacaacataatggattttgtttctgggtcagctagtcagaacttttctcttttgcaagagttctaccagacaacactgaaagcgcttgaagaagcaaaaaatgagagattatggttcaagacaaatctgaagctttgcaaaatttggtttgatatgggggagtacggtcgcatgagcaagatactgaaggagttgcataaatcttgtcaaaaggaagacggttctgatgatcaaaagaaaggcacacagcttttggaagtctatgctatcgaaatccaaatgtacactgaaacaaagaataataaaaagcttaaggaattgtatcagagggctctttccatcaaatcagcgatacctcatccaagaatcatgggtataattcgtgaatgtggtgggaagatgcacatggctgagaggcagtgggcagaagctgcgactgatttctttgaagcttttaagaactacgatgaagcaggcaatccacggagaattcaatgcctcaaatatcttgtccttgccaatatgttgatggaatctgaagtgaatccctttgatggacaagaggccaagccgtataaaaatgatcccgagatccttgcaatgacaaacttgattgcagcgtaccagaagaatgacatcatggaatttgaaaagatcctaaagagtaatagaagaacaataatggatgatccttttatccgtaactatattgaggacctattgaagaacatcagaactcaagtcttactcaagcttattaagccatatacgcggatcaggataccgttcatttcacaggaactcaatgtccccgagaaggatgtcgagcagctcttggtatctctcattttggacaaccgtatccagggccacatagatcaggtgaacaagctgctagaacgtggagacaggtccaaggggatgaggaagtacaatgccattgacaagtggaatactcagctgaagaccatttaccaaacggtgtccaacagagttgggtgagacggcttctggctgtcgtgtatttgcactcatgagatatgttgatagcctgttttggggatctgagggcaaatgcaaattgttttgacgcttgaggtagaatgttggatctgggtgtaatgtagagcttgaactgaacccagtgtttttagagtccgagagactttactatggtccaagccaattgccagaggggaacgattatccatctggttgccctacttttcgtgcaagcctctcgagtccttcacatgccgaacctgctggcctccgtgcttaatttaatgtttcccagcaacgcgtcaacaaattatagtcgatttaggtggaatccattcatgttagaattaattttccagttttgcttcctcatcaaacaattgaaatcttgcttataactaatgtacagtgaggtggtctgggcttccg

SEQ ID NO: 3105 - DNA, 1934 bp, Oryza sativa
ggcttatacgcaaaagtcgccccctcccttcgtcctctcctctcttctctctccgcatccgcctccgcaactgcaaaccgctgcggtctcggaaaccctagctctcgccccctcccctccctctccgcccgtcgccgcgcgggtcgcctcctcctctccgccgccaccgccgccgctgacatgggctccgatgcggacatggaggattacgggttcgagtactccgacgacgagccggaggagcaggatgttgacatcgagaaccagtactacaactccaaaggtatggttgagacagaccctgagggtgcacttgctggcttcgatcaagtagtacgtatggagcctgaaaaggctgaatggggtttcaaagctctgaaacaaacagtgaagctgtattataagcttgggaagtacaaagaaatgatggatgcctatagggagatgttgacatacatcaaatctgctgtgacacgtaactacagtgagaaatgtataaacaacattatggattttgtctccggatcagctagtcaaaacttctctcttctgcaagagttctaccagacaacactgaaagcacttgaagaggcaaagaatgagagattatggtttaagacaaacctgaagctttgcaaaatttggtttgacatgggggagtatggccggatgagcaagatactgaaggagctgcataaatcttgtcaaagagaagatggttctgatgatcagaagaaaggcacacaacttttggaagtctatgctattgagatccaaatgtacactgaaacaaagaacaacaaaaaattgaaggaactatatacaaaagctctttccatcaaatcagcgatacctcatccaagaatcatgggtataattcgtgaatgtggtggaaagatgcacatggctgagaggcaatgggcagatgctgcaactgatttctttgaagcattcaaaaactatgatgaagctggcaatccgcggagaattcaatgcctgaaatatcttgttcttgcaaatatgttgatggaatctgaagtgaatccctttgatgggcaagaggctaagccgtacaaaaatgatcctgagatcctcgccatgacaaacttgattgcagcatatcagaagaatgacatcatggaatttgaaaagattctaaagagcaacagaagaacaataatggacgatcctttcatccgtaattatattgaggacctattgaagaacatcagaactcaagttctgctcaagcttattaagccatatactagaatcaggattccattcatttcacaggagctaaatttcccagaaaaggatgtcgagcagctcttggtctcactcattctggataaccgaatccagggccacatagatcaggtgaacaagttactagaacgtggtgacaggtcgaagggaatgaggaaataccaagccatagacaagtggaatactcagctgaagaacatctaccaaacggtgtccaacagagttgggtgagagagatagcaggatgcctgggctgcactgcgcttggcacctgcttgcacgttttgttgtggtgggtaaatgcagcgagtgtttggtgcgtgcattacatttgagataggctcttggataggtaaagaaaaaaacagtctcgtgtattaaacatggtactcttttgcgcgccatgtgaagatgctgggattttgtcctgaactgaatctatctgcaaattccaacccctctgaaactatactagcgtcaatggctcgaaacttttggttttgttggcattgccgcactagcaaattttggtatggtagagagaatgtttggttccgtgtaaaatatgcaccaggtacaagacatactgctaatattgtgccgttgccgagttctgatagtgttgccaaccaatcactttcaaatcaaactaaactactgctgct

SEQ ID NO: 3106 - DNA, 2026 bp, Hordeum vulgare
agcaacgcaggggtagtagatgaccctgttttaaagccgcagttccgaggggccagctcgcaaaagttgttcccccctctcttcccccgttctcctcctctcgcctcgcctcgcctccgctccgcaaacccctcctctctcacaaaccctaactctcgcccccgacgctccattgccgctcgggtcgcctcttccccgccgtcatgggttcagatgcggacatggaggactacggtttcgagtattcggacgacgagcctgaggagcaagacgtcgacattgagaaccagtactacaactctaaaggtatggttgagacagaccccgagggtgcacttgctggttttgatgctgtagttcgcatggagcctgaaaaggctgaatggggattcaaggctctcaaacaaactgtgaagctttattataagctggggaagtacaaagaaatgatggatgcttacagagagatgttgacatacataaaatctgctgtgacacgtaactacagtgagaaatgtataaacaacataatggattttgtttctggatctgctagtcaacacttcaatcttctgcaagagttctaccagacaacacttaaagctcttgaagaggcaaaaaatgagagattatggtttaagacaaatctgaagctttgcaaaatttggtttgacatgggggagtacggccgcatgagcaagatactgaaggagctccataagtcttgccaaaaggaagatggttctgatgaccagaagaaaggcacacaacttctggaagtctatgctatcgagattcaaatgtacactgaaacaaaaaacaacaaaaagttgaaggaattgtaccagagggctctttctattaaatcagcaatacctcatccaagaattatgggtataattcgtgaatgtggtgggaagatgcacatggctgagaggcagtgggcggacgcagcgactgatttctttgaagcattcaaaaactatgatgaagctggcaatccacggagaatccagtgtcttaaatatcttgttcttgccaatatgttgatggagtctgaagtgaatccttttgatggacaagaggccaagccgtacaaaaatgatcctgaaatccttgcaatgacaaacttgattgcagcataccagaagaatgacatcatggaatttgagaagatcctaaagagcaatagaagaacaataatggatgatccatttatccgtaattacattgaggacttattgaagaacatcagaactcaagtgctgctcaagcttattaagccatacacaagaataaggattccattcatttcacaggagttaaatgtcccagaaaaggatgttgagcagctgttggtgtcattgattctggacaaccgtgtccagggccacatagatcaggtgaacaagctgctagaatgcggtgacaggtcaaaggggatgcggaaatatcaagccatcgacaagtggaatactcagctcaaatccatttaccagacggtgtccaacagagttgggtgagagatggcaggtttccattcatacctgctggttttgttttggtgttctgggggggcttaaatgtgaaggagtatttcgtttggtccgtggggtgggcatcctgaatgtgggtaaagtaacttgtcactgtaatgaacgtgacactccagttggtggattatatcgtcttaatcttttctgtgatttggccagctggatgttgggattttgtcctgagctgaaacggcgctgctagttccaatttcagcctccctagattttactgttgtcgaaaactcggaatctatgcttagcgcgatcgagtagttagtttgttcatttaaactgaatttgatcatggttgctgcgccacaaatgtctcagcttgcttcaaccgacgcatattattacctggcgtttggcatttcactgcgcctcttagtgaatgaaagatctgttgatgtgtgcgaattgagatattggtaagcgtctcgacctcttccaacctccacaaggaggccgca

SEQ ID NO: 3107 - DNA, 1701 bp, Avena sativa
gctccgcaaacccttcctctcccagaaaccctagctttcgctcccgactctccattgctgctctagttgcttcttcgccgccgccatgggttccgatgcggacatggaggactacggtttcgagtattcggatgacgagccggaggagcaggacgtcgacatcgagaaccagtactacaactccaaaggtatggtcgagacagacccagagggtgcacttaatggttttggtggtgtagttcgtatggagcccgaaaaggctgaatggggattcaaggctctcaaacaaacagtgaagctttattataagctggggaagtacaaagaaatgatggatgcctacagagagatgttgacatacataaaatctgctgtaacacgtaactacagcgagaaatgtataaacaacatcatggattttgtttctgggtctgctagtcagcacttctctcttctgcaagagttctatcagacaacacttaaagctcttgaagaggcaaaaaatgagagattatggttcaagacaaatctgaaactgtgcaaaatttggtttgacatgggggagtatggtcgcatgagcaagatactgaaggagctgcataaatcttgtcaaaaggaagatggttctgatgaccagaagaaaggcacacaacttctagaagtgtatgctattgagattcaaatgtacactgaaacgaaaaataacaaaaaactgaaggaattgtaccagagggctctttctatcaaatcagcaatacctcatccaagaattatgggtattattcgtgaatgtggtgggaagatgcacatggctgagaggcagtgggcggaagcagcgactgatttcttcgaagcattcaaaaactacgatgaagctggcaatccacggagaattcagtgcctcaaatatcttgttcttgccaatatgttgatggagtccgaagtgaatccctttgatggacaagaggccaaaccgtacaaaaatgatcctgaaatcctcgcaatgacaaacttgattgcagcataccagaagaatgatataatggagttcgaaaagatcctaaagagcaatagaagaacaataatggatgatccttttatccgtaattacatcgaggacctattgaagaacatcagaactcaagtactgctgaagcttattaagccatatacaagaataaggattccattcatttcacaggagctaaatgtcccggaaaaggatgtggagcagctcttggtttcattgattctggacaaccgtgtccagggccatatagatcaggtgaacaagctgctagaatgcggtgacaggtcaaagggaatgcggaaatatcaagccattgataagtggaacactcagcttaagtccatttaccaaactgtgtccaacagagttgggtgagatgggaggtttccattcgtacctgctacttgagtgcttttggtttctgggggcgtaagtgcaaagggccctgtcggggtacttgagatgaaatcctggatgtgtgaaagaatcttttcagcgtaatgaacgcagcactccagttggtggattaaatgttctaattatctcttatattctgtgatttggccagcgggttgctgggatttttgtcctgaactgtatcggattccagtcagcccagatttcactgtggttgaaaactcgaaatctatgccagtagatgatgcacacca

SEQ ID NO: 3108 - DNA, 1822 bp, Secale cereale
gactccaaccctcctattttaaagccgcagcttccgaggggccagctcgcaaaacttgtcctcccctctcttccccgttttcctccgctcccctccaatcagcaaacccttcgtctctcgcaaaccctagctctcgcccccgactctccattgccgctcgagtcgccacttcgccatgggttcagatgcggacatggaggactacggtttcgagtattcggacgacgagccggaggagcaagacgtcgacatcgagaaccagtactacaactccaaaggtatggttgagacagacccggagggtgcccttgctggttttgatgctgtagttcgcatggagcctgaaaaggcggaatggggattcaaggctctcaaacaaacagtgaagctttattataagctggggaagtacaaagaaatgatggatgcctacagagagatgttgacatacataaaatctgctgtgacacgtaactacagtgagaaatgtataaacaacataatggattttgtttctggatctgctagtcagcacttcaatcttctgcaagagttctaccagacaacacttaaagctcttgaagaggcaaaaaatgagagattatggtttaagacaaatctgaagctttgcaaaatttggttcgacatgggggagtatggtcgcatgagcaagatactgaaggagctgcataagtcttgccaaaaggaagatggttctgatgaccagaagaaaggcacacaacttctggaagtctatgctatcgagattcaaatgtacactgaaacaaaaaacaacaaaaaattaaaggaattgtaccagagggctctttctattaaatcggcaatacctcatccaagaattatgggtataattcgtgaatgtggtgggaagatgcacatggctgagaggcagtgggcggacgcagcgactgatttctttgaagcattcaaaaactacgatgaagctggcaatccacggagaatccagtgtctcaaatatctcgttcttgccaatatgttgatggagtctgaagtgaatccctttgatggacaagaggccaagccgtacaaaaacgatcctgaaatcctcgcaatgacaaacctgattgcagcataccagaagaatgatatcatggaatttgagaagatcctaaagagcaatagaagaacaataatggatgatccttttatccgtaattacattgaggacttattgaagaacatcagaactcaagtgctgctcaagctcattaagccatacacaagaataaggattccattcatttcacaggagctaaatgtcccagaaaaggatgttgagcagctcttggtgtcattgattctggacaaccgtgtccagggccacatagatcaggtgaacaagctgctagaatgcggtgacaggtcaaagggaatgcggaaatatcaagccatcgataagtggaatactcagctcaaatccatttaccaaacggtgtccaatagagttgggtgagagatggcaggtttcatagtacctgctgctggttgagttgttttggtgtctgggggcttaaatgtgaatcggtccgtgaggtagggatcctggatgcgggtaaagttacttgtcactgtaatgaacgtagcactccagttggtggattatatcctcttatcttttctgtgatttggccagcgggatgctggattttgacctgggctgaaacagcactgctagttcctatttcagcctgcctagatttcactttggaactcgaagtaacttgtcactgtaatgaacgtagcactccagttggtggattatatatcctctttatctttt

SEQ ID NO: 3109 - DNA, 1995 bp, Triticum aestivum
ctcctactttaaagccgcagcttccgaggggccagctcgcaaaacttgtcctcccctctcttccccgttttcctcctctcccctcgcatccgctccgcaaacccctcctctttcgcaaaccctagctctcgcccccgacgctccattgccgctcgagtcgcctcttcaccgccgtcatgggctcagatgcggacatggaagactacggtttcgagtattcggacgacgagccggaggagcaagacgtcgacatcgagaaccagtactacaactccaaaggtatggttgagacagacccggagggtgcacttgctggttttgatgctgtagttcgcatggagcctgaaaaggcggaatggggattcaaggctcttaaacaaactgtgaagctttattataagctggggaagtacaaagaaatgatggatgcttacagagagatgttgacatacataaaatctgctgtgacacgtaactacagtgagaaatgtataaacaacataatggattttgtttctggatctgctagtcagcacttcaatcttctgcaagagttctaccagacaacacttaaagctcttgaagaggcaaaaaatgagagattatggtttaagacaaatctgaagctttgcaaaatttggtttgacatgggggagtatggtcgcatgagcaagatactgaaggagctgcataagtcttgccaaaaggaagatggttctgatgaccagaagaaaggcacacaacttctagaagtctatgctattgagattcaaatgtacactgaaacaaaaaacaacaaaaagttgaaggaattgtaccagagggctctttctattaaatcagcaatacctcatccaagaattatgggtataattcgtgaatgtggtgggaagatgcacatggctgagaggcagtgggcggacgcagcgactgatttctttgaagcattcaaaaactacgatgaagctggcaatccacggagaatccagtgtctcaaatatcttgttcttgccaatatgttgatggagtctgaagtgaatccctttgatggacaagaggccaagccgtacaaaaatgatcctgaaatcctcgcaatgacaaacttgattgcagcataccagaagaatgacatcatggaatttgagaagatcctaaagagcaatagaagaacaataatggatgatccttttatccgtaattacattgaggacttgttgaagaacatcagaactcaagtgctgctcaagctcattaagccatacacaagaataaggattccattcatttcacaggagctaaatgtcccagaaaaggatgttgagcagctcttggtgtcattgattctggacaaccgtgtccagggccacatagatcaggtgaacaagctgctagaatgcggtgacaggtcaaagggaatgcggaaatatcaagccatcgataagtggaatactcagctcaaatctatttaccagacggtgtccaacagagttgggtgagagatggcaggtttccattagtacctgctggttgagttgttttggtatctgggggcttaaatgtgaaggagtatcttgtccgtgaggtagatcctggacgtgggtaaagtaacttgtcactgtaatgaacgtagcactccagtttgtggattatatcctctttatcttttctgtgatttggccagcgggatgctgggattttgtcctgagctgaaacggccctgctagttcctacttcatcctgcctagatttcactgtggtcgaaaactcggtatcgatgcgaatagagaaatgcacaaaactagcatggtcaagtatttagtttgttcatttaaattgaatttgaccatggatgctgcgccacaaatgtctcagcttgcatcacccttcgcatattattccctggcgtttggcatcttcgtatatactattaggtgttatctctagcttatacgtgcacacgtctctcatgatgaattaaggttcagatgttgcatg

SEQ ID NO: 3110 - DNA, 2082 bp, Brachypodium distachyon
ggcccggtataaaccaaaccctaatcccctctccctcggaccctctctgtttttccccacgactccacccccgatccccctcgctcgtcttcctcgtcgagcactactgactccagcgactccagcgtcgccgccgccggttgatctcccggcggccgtcctaccttgccctacagggtcctacaatggacgcggacatggaggactacggtttcgagtattcggacgacgagccggaggagcaggacgtcgacatcgagaaccagtactacaactcgaaaggtatggttgagacagacgcagagggagcacttgctggttttgatgctgtagtccgtatggagcctgaaaagggtgaatggggattcaaggctctcaaacaaacagtgaagatttattacaagctggggaagtacaaagaaatgatggatgcctacagagagatgttgacatacataaaatctgctgtgacacgtaactacagtgagaaatgtataaacaacataatggattttgtttctggatctgctagccagaacttttctcttttgcaagagttctaccagacaacacttaaagctcttgaagaggcaaaaaatgagagattatggtttaagacaaatctgaagctttgcaaaatttggtttgacatgggggagtatggtcgaatgagcaagatactcaaggagctgcataaatcttgtcaaaaggaagatggttctgacgaccagaaaaaaggcacacaacttctggaagtctatgctattgagatccaaatgtatacggaaacaaagaacaacaaaaaactgaaggaattgtaccagagggctctctctatcaaatcagcaatacctcatccaagaattatgggtataatccgtgaatgtggtgggaagatgcacatggcagagaggcagtgggcagatgcagcgactgatttctttgaagcattcaaaaattatgatgaagctggcaatccacggagaattcagtgcctcaaatacctcgttcttgccaatatgttgatggaatctgaagtgaatccctttgatggacaagaagccaagccgtacaaaaatgaccctgaaatccttgcaatgacaaacttgattgcagcataccagaagaatgacatcatggaatttgaaaagatcctaaagaccaatagaagaacaataatggatgatccttttatccgtaattacattgaggacttattgaagaacatcagaactcaagttctgctcaagcttattaagccatatacaagaataaggattccattcatttcacaggaactaaatttcccagaaaaggatgtggagcagctcttggtgtcattaattctggacaaccgtgtccagggtcacatcgatcaggtgaacaagctgcttgaatgtggtgacaggtcaaaggggatgcggaaatatcaagctattgacaagtggaatactcagctcaagtccatctaccaaacggtgtccaacagagttgggtgagagaaggcaggtttccatttgtacctgcttattttggtgtcttggggcgtaatgcgaggggtattttgcggtatacttgagattggatcatggatgtgggtaaagaaacttgccagtgtgatgaacgtagcactttagttggtggatcatatcgtcttgtctatcttttcatctgtgagttggccagtggggtgctgggattttgtcctgaactgagtcgccgtgctaattccagtatgctgagatttctgcggttgaaaactcgaaatgaatgccactggagaagcacaaaaaattatgcttatggtatgtaatagagcatagccagcttgttcatattagcagctgctttagccatttacagtttgttcatagaaattgcgcttgtcgaggtattcatctagggctcagttgaaaatttcccgaccaagcatatttttacggcaattgtaaggatagtcttcccgcgcgacgcaagatcttaactattatcctagggctgtcgtaatgatagattagcgtgtgccgttgcgcattagtgcattccatgttcttattgtcagtttggaccatgtcgaatgca

SEQ ID NO: 3111 - DNA, 1651 bp, Theobroma cacao
gaaagttgtttcaccaaacgccctctgttgctaggacggtagcactgtaaaaaggagaagagaaaggaagaaggcaggtttctgcctattcaactcctactgttcacaccctatcaaggactttcgaaacagtagcagtgcccagtgtggggggtttattgctttgcttgaaatttacttttatttcagcaaatcgataccttcaccttcgcttctctaattccaaaaattttctaattcactaaacctgtcgatttcatcccggcaatcatggcttcagatgcagatatggaggattatggatttgagtactccgatgaggaacctgaggaacaagacgttgacattgagaatcaatattacaattccaaaggtttagtagaaacagaccctgaaggagcgcttgctggttttgctgaagttgttaacatggagcctgaaaaggctgagtggggattcaaagctctgaagcaaactgtaaagctctattaccgtttagggaggtataaagaaatgatggacgcttacagggagatgttaacatacatcaaatcagctgtgacgcgaaattacagtgaaaaatgtataaacaatattatggattttgtttccgggtcagctagtcaaaattttggtcttttgcaagaattctatcagactacactgaaggcccttgaagaggcaaagaatgagagactttggtttaagacaaatcttaagctttgcaagatctggtttgatatgggtgagtacgggcgaatgagcaagattttgaaggaacttcataagtcttgtcaaagggaagatggtactgatgatcaaaagaagggaagtcagcttctggaggtatatgcaattgaaattcaaatgtatactgagaccaagaacaacaagaagctgaagcaattataccagaaagcacttgctatcaagtcagcaataccacatccaaggatcatgggaataattcgcgaatgtggtggcaagatgcatatggctgagcgtcaatgggctgaggcagccacagatttctttgaagctttcaagaactatgatgaagctggaaatcagagacgtatacaatgcctaaaataccttgttctggcaaatatgctgatggaatctgaagttaatccttttgatggtcaggaggcaaagccgtacaaaaatgaccctgagattttggcaatgacaaatctaatagcagcatatcaacgaaatgaaataatagagtttgaaaaaatccttaagagtaacaggaggacaatcatggatgatccattcatcagaaattatattgaagatcttttgaagaatgtgagaactcaagtgctacttaagcttataaaaccatatacaagaatccggatcccttttatatcaaaggaactcaatgtgccagaaaaagatgttgagcagttgttggtttccttgatcttggataatcgtattgatgggcatattgatcaagtgaaccggctgttggagcgtggtgacaggtcaaagggtatgaagaagtacaccgccatagataaatggaacacacagcttaggtcgctttatcaaactgtcagcaacagggtgtactgagattgcaattatgctgtatgttagccctttggcgaaggtgcttccagtagtttttttttgg

SEQ ID NO: 3112 - DNA, 2539 bp, Ricinus communis
attaatggaagtactaaaataacaagagtaacacaggcaaaaccgtgtaaccataagcagagagataataatatagacggaaagccctagagagtgagagagtggggcttttgattcagaatatcggagttgctttctacattcaaattatttaatctgaaatctaaaactcttccaattttttctgctgctaataatcatgggttcagatgcagatatggaagattatggattcgagtactctgacgatgagcccgaggagcaagatgttgatattgagaatcagtattacaattccaaaggtttggtcgaaacagacccagaagcagcacttgcaggttttgctgaagttgttagcatggaaccagagaaggcagaatggggttttaaagcactaaaacaaactgtcaagctttattatcgtttagggaagtataaagaaatgatggatgcttatagagagatgcttacatacattaaatcagcggtcacacgtaactacagtgagaaatgcataaacaacataatggactttgtttctggatcagctagtcagaactttggcctccttcaagaattttatcagaccaccctgaaggccctggaagaggcaaagaatgagagactttggttcaagacaaatcttaaactttgcaagatatggtttgatatgggcgaatatgggcgaatgagcaagattctgaaagaactccataaatcttgtcaacgagaagatggtacggatgatcaaaagaaaggcagtcaactcctggaggtatatgcaattgaaattcaaatgtacactgagaccaagaacaacaaaaagcttaagcaattataccaaaaagctcttgcaatcaagtcggcaattccacatccaaggatcatggggataattcgggaatgtggtgggaagatgcatatggcagagcgtcaatgggctgaggctgcaacagatttctttgaagctttcaaaaactatgatgaagctgggaaccaaagacgcatacaatgcctaaaatacctggttttggctaatatgctgatggaatctgaagtgaatccatttgatggtcaagaggcaaagccatataaaaatgaccctgagattttggcaatgacaaacctaatagcagcatatcaacgaaatgaaatattggagtttgagaaaatcctcaagagtaacagaaggacaataatggatgatccgttcatacggaattatattgaagatctattgaagaatgtcagaactcaggtgctgctcaagcttattaagccttatacaagaattcggattcctttcatatcgaaggaactcaatgtgccagaaaaagatgttgagcagctgttggtttcactaatattggacaatcgtattgatgggcatattgatcaagtgaacaggctattagagcgtggtgacaggtcaaagggaatgaagaagtatactgccattgataaatggaacacacagcttagatcactttatcaaactatcagcaatcgcgtgtactgagattgtgtttctaggtagtgtgattttcatccgagggaggtacaatcttcttctccatattttggtggtatcgacaacagaactttgccttctctgtgtgaaaccagtgttatagaagctacttctagaagtaaacctttagattgagaagagctgtctttcacagctggtgcatttcaaagaaaaatgagggtagaggatgtataatctatagtatacaaataattttgacactttgagaaaaagtccactctggcaggttttgcacattcaatcaatccatttttttgccagttgtttcttacgattgatttttcaactgccgccttctataaggacaggagaaagttattattattattatgactctggcatccttaaaagaatgcacaaaagaaaggtagtactcctgattgggacttggtgtaggtccaaaaacagtggggatctgaattaattcttcagcacaagagtgtagatgttcttctatctcagcttggaaaacagaggtgggctcggctcaattggggcatatgctttaatttagataaagcttttgatcttgactgatctttgacacctggggctctgtttgtttctgcaaaaaagaaaaaaaaaaagccattttcgagttcaacaagctttctcttctttgatgacaccgatccagtcaccttgtcccaaatttgtaggcatgtgtttatcaagctttctggtagttgggtggcatttggcaacaacctttccaacagacccaattttcaattttattacgcttatggtgtcccttatgaggtgtttctaaattatttgcttttgctaaatgaaagctggaaaagctataatttatgaatcctttctcactctgaaacgtgtaattattgaatttggaggtccgatttctggcttttgatgggaatagaagagtttgttaagggaaaacaattttctactttacagaaaattaagtaaaataatgactctttttctgtttttcccttggacaaggactaaccaaaa

SEQ ID NO: 3113 - DNA, 2251 bp, Citrus clementina
aacaagaaatagtaggcactgttaaataatcataattgttattgaaatatttaacggtttcttcttcaccaaccatgggttcagatgcggatatggaggattatgggtttgaatactcagatgaggagcctgaagagcaggatgtcgacatcgagaatcaatattacaactccaaaggtttggttgaaacggatccagaaggggcacttgctggttttgctgaagtagttgccatggaacctgagaaggctgagtggggattcaaagcactgaagcaaactgtaaagctctattatcggctagggaagtataaagaaatgatggatgcttatagggagatgttaacatatatcaaatctgcagtgacacgaaactacagtgagaagtgcataaacaacataatggattttgtttctggatctgcaagtcagaatttcagtctcctgcaagaattttatcagaccactttgaaggctcttgaagaggctaagaatgagaggctttggttcaagacgaatcttaagctttgcaaaatctggttcgatatgggtgaatatgggcgaatgagtaagattttgaaggaacttcataaatcttgtcaaagagaagatgggacagatgatcaaaagaaaggaagtcaacttctggaggtctatgcaatcgagattcaaatgtacactgaaaccaaaaataacaagaagctaaagcaattataccagaaagctcttgctatcaagtcagccataccacatccaaggatcatgggaataattcgtgaatgtggtgggaagatgcacatggcagaacgtcaatgggcagatgcagcaactgatttctttgaagcatttaagaactatgacgaagcagggaaccagaggcgtattcaatgcttgaagtatctggttctggcgaatatgctgatggaatctcaagtgaatccatttgatggacaagaggcaaagccatataagaatgatcctgagattctggctatgacaaatctgatcgcagcataccaaagaaatgagataatagagtttgaaaaaatcctcaagagcaacagaaagactatcatggatgatccatttattcggaattacattgaagatctgttgaagaatgtcaggactcaagtcttgcttaagcttatcaagccctacacaaggatccggatccccttcatatctaaggagctcaatgtgccagaaaaagatgttgagcagttgttggtttcacttattctggataatcgaattgacggacatattgatcaagtgaaccggctattagagcgaggagacaggtcaaagggaatgaagaagtatactgccatagacaaatggaactcgcagctaaggtctctgtatcaaactgtcagcaatcgagtgtcttgagtacatagatatatgtgggatggtagcaaaaggtgcttgattggaattttgtagtattttgttgatgagtcggcggaaagttgctactggtttttggcattatgttgttcaggaatatacttctagtataatctttttttttttttttaattggttagcacactgaatcttaaaagtgcttatcttcatctcttgaattatctatatgtacgaatgaagaaagaaaaggagagataaccagcggcgatgatatggcgtgaatgccctgactgagagttgtggtacaaactccaaagcatggtagcggcctttgattcatttccaagcagccgacaaattaaaacgttcccaagatattaacgcagaaaccgcaagggtctgtctctttgggttgcaaattcatgggattgagttaaaactttgggttacaaatggaacccaatacccgcctccgtgttctcagtttgaatgtgttcatttcatgcactctgatatacagaattatgaatcatcgatcgtggcttgatcatggccctgggccggtgagccgtgagcagtttgcatattgaaggttatttaggtgccgcgggcgaggcagaggcactatggcagtccaggctcaacaaaagagtttgtttctatcgtaatcgtagttcttcaagcctactgttatgtacctcttgagtcagatgatattttatcttctcctaaatggattagcgacaagtcacccaattctctcaaatctcaatttagatgatctgtcgacaaaattttcacacgcaagagacaatcaattattcttggaattatttgtgataaatcgatattgtttgattctccgaaaataataataa

SEQ ID NO: 3114 - DNA, 1820 bp, Populus trichocarpa
ggtaccgaagtgccaaacatgaactaaaacacccataaaaagccctggaccattttcaagggttttcaaaataaactgattcctttctttactgtaagaactaagaacacagtcgaaattttctgctctatcaacaatgggttcagatgctgatatggaggattatgggttcgagtactcagacgaagagcctgaggaacaggatgttgatattgagaatcaatattacaattctaaaggtttggttgaaacggacccagaaggagcacttgcaggttttgctgaagtagttagcatggaaccagagaaggcagaatggggattcaaagcattgaaacaaacagttaagctttattatcgattggggaaatataaagaaatgatggaagcatatagggagatgctaacatacatcaaatcagcagtgactcgaaattacagtgagaaatgtataaacaatatcatggactttgtttctggatcagctagtcagaactttggtctcctacaagagttttatcagaccactttgaaggctcttgaagaggcaaagaatgagagactttggttcaagacaaatcttaagctttgcaagatttggtttgatatgggtgaatatggacggatgagtaagattctgaaggaactccacaaatcttgtcaaagagaagatggaacggatgatcagaagaaaggtagccaacttttggaagtctatgcaattgagattcaaatgtatactgaaactaagaataacaaaaagctcaagcaattataccaaaaggcactggctatcaagtcagcaattccacatccaaggatcatgggaataatccgtgaatgtggagggaagatgcatatggcagagcgtcaatgggctgaggcagcgacagatttttttgaagcttttaagaactatgatgaagctggaaaccagagacgcatacaatgcttaaaatacctagttctagctaatatgctgatggaatctgaagtaaatccatttgacggtcaagaggcaaaaccatataaaaatgaccctgagattttggcgatgaccaatctcatagctgcatatcaacgaaatgaaatattggagtttgagaaaatcctcaagagtaacagaaggacaataatggatgatccattcataagaaattatattgaagatttattgaagaatgtgaggactcaagttctgctcaaacttattaaaccttatacaagaatcaggattcctttcatatcaaaggaactcaacgtgccagaaaaagatgttgaacagttgttggtttcacttatattggataatcgcattgatggacacattgatcaagttaacaggctgttagagcgtggtgacaggtcaaagggaatgaagaagtatactgccattgagaaatggaacgcacaacttaggtctctttatcaaactgtcagcaaccgggtgtcttgagattgcagcgttgtgtgatttccctccaaattaggcactctggttataccagtattttggtggattcaagagcaaacttttcttctctctttcgcgaggcctgagtgttagagaagttgctgctgagtttggtccataaatgagttttatgtttaacagcgattcattttgaagcaaaaaaatgtgagtagagaatgtataaatatatagcttactgataattttgaatttttgatactgagaaaattcaagtcctactgtttatttatttgtttttctccattcttattttcacattgctgctgctggcctttggtttctatgtcagtatcttaagaatgtcataagatataatggattgctg

SEQ ID NO: 3115 - DNA, 1890 bp, Populus trichocarpa
ggtaccgaagtgccaaacatgaactaaaacacccataaaaagccctggaccattttcaagggttttcaaaataaactgattcctttctttactgtaagaactaagaacacagtcgaaattttctgctctatcaacaatgggttcagatgctgatatggaggattatgggttcgagtactcagacgaagagcctgaggaacaggatgttgatattgagaatcaatattacaattctaaaggtttggttgaaacggacccagaaggagcacttgcaggttttgctgaagtagttagcatggaaccagagaaggcagaatggggattcaaagcattgaaacaaacagttaagctttattatcgattggggaaatataaagaaatgatggaagcatatagggagatgctaacatacatcaaatcagcagtgactcgaaattacagtgagaaatgtataaacaatatcatggactttgtttctggatcagctagtcagaactttggtctcctacaagagttttatcagaccactttgaaggctcttgaagaggcaaagaatgagagactttggttcaagacaaatcttaagctttgcaagatttggtttgatatgggtgaatatggacggatgagtaagattctgaaggaactccacaaatcttgtcaaagagaagatggaacggatgatcagaagaaaggtagccaacttttggaagtctatgcaattgagattcaaatgtatactgaaactaagaataacaaaaagctcaagcaattataccaaaaggcactggctatcaagtcagcaattccacatccaaggatcatgggaataatccgtgaatgtggagggaagatgcatatggcagagcgtcaatgggctgaggcagcgacagatttttttgaagcttttaagaactatgatgaagctggaaaccagagacgcatacaatgcttaaaatacctagttctagctaatatgctgatggaatctgaagtaaatccatttgacggtcaagaggcaaaaccatataaaaatgaccctgagattttggcgatgaccaatctcatagctgcatatcaacgaaatgaaatattggagtttgagaaaatcctcaagagtaacagaaggacaataatggatgatccattcataagaaattatattgaagatttattgaagaatgtgaggactcaagttctgctcaaacttattaaaccttatacaagaatcaggattcctttcatatcaaaggaactcaacgtgccagaaaaagatgttgaacagttgttggtttcacttatattggataatcgcattgatggacacattgatcaagttaacaggctgttagagcgtggtgacaggtcaaagggaatgaagaagtatactgccattgagaaatggaacgcacaacttaggtctctttatcaaactgtcagcaaccgggtgtcttgagattgcagcgttgtgtgatttccctccaaattaggcactctggttataccagtattttggtggattcaagagcaaacttttcttctctctttcgcgaggcctgagtgttagagaagttgctgctgagtttggtccataaatgagttttatgtttaacagcgattcattttgaagaaaaaaaatgtgagtagagaatgtataaatatatagcttactgataattttgaatttttgatactgagaaaattcaagtcctactgtttatttatttgtttttctccattcttattttcacattgctgctgctggcctttggtttctatgtcagtatcttaagaatgtcataagatataatggattgctgaactgagaggctcgtggcctgcgtgcttaagataggaggaactgggtactgtgttgcattctgggcataa

SEQ ID NO: 3116 - DNA, 1679 bp, Populus trichocarpa
ccttatgctggatttcaaaaaatctaacaaaactgctttctttctttccagtaaaaccacactgacttggaattttctgctcaatcaataatgggttcagatgcagatatggaggattatgggttcgaatactcagacgaagagcctgaggaacaggatgttgatattgagaatcaatactacaattctaaaggtttggttgaaacagatccagaaggagcacttgcaggttttgctgaggtagttagcatggaaccagagaaggcagaatggggattcaaagcattaaaacaaacggttaagatttattatcgattggggaaatataaagaaatgatggaagcatacagggagatgctaacatacatcaaatcagcagtgactcgaaattacagtgagaaatgtataaacaatatcatggactttgtttctggatcagctagtcagaacttcagtctcctgcaagaattttatcagaccactttgaaggcccttgaagaggcaaaaaatgagagactttggttcaagacaaatcttaagctttgcaagatttggtttggtatgggtgaatatgggcggatgagtaagattctgaaggaactccacaaatcttgtcaaagagaagatggtacagatgatcagaagaaaggtagccaacttttggaagtgtatgcaattgagattcaaatgtataccgaaaccaagaataacaaaaagctcaagcaattataccaaaaggcactggctatcaagtcagcaattccacatccaaggatcatgggaataatccgtgaatgtggaggtaagatgcatatggcagagcgtcaatgggctgaggcagcaacagatttttttgaagcttttaagaactatgatgaagctgggaaccagagacgcatacaatgcttaaaatacctggttctagctaatatgctgatggaatctgaagttaatccttttgacggtcaagaggcaaagccatataaaaatgaccctgagattttggcaatgacaaatctcatagctgcatatcaacgaaatgaaatattggagttcgagaaaattctcaagagtaacagaaggacgataatggatgatccattcataagaaattatattgaagatctgttgaagaatgtgaggactcaagttctgcttaagcttattaaaccttacacaagaatcaggattcctttcatatcaaaggaactcaatgtgccagaaaaagatgtagaacaattgctggtttcactaatattggataatcgtattgacggacacattgatcaagtgaacaggttattagagcgtggtgacaggtcaaagggaatgaaaaagtatactgccattgagaaatggaacacacagcttaggtctctttaccaaactgtcagcaaccgagtgtattgagattttagcaggttgtgtgatttccctcaagttaagcactctgattgtatcagtattttggtggattcaagagcaaacttttcttttcttttgtgatttccctcagttggccctgaatgagttctatgtttaatgacgatacattttgaagaaaaatgtgattggagagtgtataaacctatagcttacagataattttgaaactgggaaaattcaagacttgcatgaccatatcaggctatcagacagttttagagcttttaattatt

SEQ ID NO: 3117 - DNA, 1742 bp, Populus trichocarpa
cagtgttaaagtaaaacacgtacaaaaagccctgtacccttatgctggatttcaaaaaatctaacaaaactgctttctttctttccagtaaaaccacactgacttggaattttctgctcaatcaataatgggttcagatgcagatatggaggattatgggttcgaatactcagacgaagagcctgaggaacaggatgttgatattgagaatcaatactacaattctaaaggtttggttgaaacagatccagaaggagcacttgcaggttttgctgaggtagttagcatggaaccagagaaggcagaatggggattcaaagcattaaaacaaacggttaagatttattatcgattggggaaatataaagaaatgatggaagcatacagggagatgctaacatacatcaaatcagcagtgactcgaaattacagtgagaaatgtataaacaatatcatggactttgtttctggatcagctagtcagaacttcagtctcctgcaagaattttatcagaccactttgaaggcccttgaagaggcaaaaaatgagagactttggttcaagacaaatcttaagctttgcaagatttggtttggtatgggtgaatatgggcggatgagtaagattctgaaggaactccacaaatcttgtcaaagagaagatggtacagatgatcagaagaaaggtagccaacttttggaagtgtatgcaattgagattcaaatgtataccgaaaccaagaataacaaaaagctcaagcaattataccaaaaggcactggctatcaagtcagcaattccacatccaaggatcatgggaataatccgtgaatgtggaggtaagatgcatatggcagagcgtcaatgggctgaggcagcaacagatttttttgaagcttttaagaactatgatgaagctgggaaccagagacgcatacaatgcttaaaatacctggttctagctaatatgctgatggaatctgaagttaatccttttgacggtcaagaggcaaagccatataaaaatgaccctgagattttggcaatgacaaatctcatagctgcatatcaacgaaatgaaatattggagttcgagaaaattctcaagagtaacagaaggacgataatggatgatccattcataagaaattatattgaagatctgttgaagaatgtgaggactcaagttctgcttaagcttattaaaccttacacaagaatcaggattcctttcatatcaaaggaactcaatgtgccagaaaaagatgtagaacaattgctggtttcactaatattggataatcgtattgacggacacattgatcaagtgaacaggttattagagcgtggtgacaggtcaaagggaatgaaaaagtatactgccattgagaaatggaacacacagcttaggtctctttaccaaactgtcagcaaccgagtgtattgagattttagcaggttgtgtgatttccctcaagttaagcactctgattgtatcagtattttggtggattcaagagcaaacttttcttttcttttgtgatttccctcagtttggccctgaatgagttctatgtttaatgacgatacattttgaagaaaaatgtgagtggagagtgtataaacctatagcttactgataattttgaaactgggaaaattcaagacttgcatgaccatatcaggctatcagacagttttagagcttttaattattatttatttgtggtttattggtttat

SEQ ID NO: 3118 - DNA, 1815 bp, Prunus mume
atctaaaatgacgatgtcacagacagtttgcgtgcgaagtcccaaagcgcccttttcaatcggaatgccctaataagagggatttgagccctctctcgattcagtctcctctctgctctcttctgctttcactagcttccgaatcttaaacgctttgaaagctcagaattccttcttggctcttgagcagtcatgggttccgatgctgatatggaagattacggattcgagtactcggatgaggagcctgaggaacaggatgttgacattgagaaccaatattacaactctaaaggtttggttgagacagatcccgaaggagcactttcaggattcgacgaagtagttcgaatggagcctgagaaggccgagtggggatttaaagctttgaagcaaactgtgaagctctattatcgtctggggaggtataaagaaatgatggatgcgtacagggtgatgttaacatacatcaaatcagcagtaacacgaaattacagtgaaaaatgtataaacaatattatggattttgtttctggttcagctagtcagaactttggtctcctgcaagagttctatcagaccactttaaaggcccttgaagaggcaaagaatgagagactttggttcaagacaaatcttaagctgtgcaaaatttggtttgatatgggtgaatatgggcgaatgaataagattctgaaagaactccataaatcttgtcaaaaagaagatggtacagatgaccaaaagaaaggaagtcaacttctggaggtttatgcaattgagattcagatgtacacggagactaaaaataacaaaaagctcaagcaattataccaaaaagctcttgcaatcaagtcagcaatacctcatcctaggatcatgggaataattcgtgagtgtggggggaagatgcatatggcagagcgtcagtgggcggatgcagccacagatttttttgaagcctttaagaactacgatgaagctgggaaccagaggcgtatacaatgcttgaagtatctagttctggctaatatgctgatggagtcagaggttaatccatttgatggtcaagaagcaaagccgtataaaaacgatcctgagatcttggcaatgacaaatctgatagcagcatatcaacgaaatgagatactggagtttgagaaaattcttaagagtaacaggaggacaattatggatgatccgttcatccgaaactatattgaagatctgttgaagaatgttaggacacaagtgctgcttaaacttatcaagccgtacactagaattcggattcccttcatatcaaaggaacttaatgtgcctgagaaagatgttgagcaactcttggtttcgcttatattggataaccgaatcgatggacatatagatcaggtgaaccggctcttagagcgtggtgacaggtcaaagggaatgaagaaatatgctgctatagataaatggaacacacagctaaagtctctttaccaaactatcagtaaccgagtatattgagaatcacatttatcgtttacgatctggacggtgcccagctttctgttattatgtcatgagttagttgagctccaacttttaccccttttgagaacaaatgctggatgagatgtgaatagacgtgatttctgagctttataagctggtttttatttagtgtagtatattattaagtatgaccattttgtaagattcgattgtgtcgaactgttgctaggcaggaaggagaatgtatgtgtttaatggtgctatcatgtctgtttggatcagcaatatagcttcggtttttatactaaccacttg

SEQ ID NO: 3119 - DNA, 1932 bp, Gossypium hirsutum
cttcaccttcgccttcgcttctctaatttccgagaacactgaaatttactgatcctccagttttgtcagagtaaccatggcttcagatgcggatatggaagattatggatttgagtactctgatgaggagcctgaggagcaagacgttgatattgagaatcaatattacaattccaaaggtttggtagaaacagaccctgaaggagcacttgttggtttttctgaagtagttagcatggagcctgaaaaggctgagtggggattcaaagctttgaagcaaactgtaaagctctattaccgtttagggaagtataaagaaatgatggactcatacagggagatgctaacatacatcaaatcagcagtgacacgaaattacagtgaaaaatgtataaacaatattatggattttgtttctggatcagctagtcaaaattttgatctcctgcaagaattctatcagaccactcttaaggcccttgaagaggcaaagaatgagagactttggtttaagacaaatctaaagctttgcaagatctggtttgatatgggcgagtatgggcgaatgagcaagattttgaaggaacttcacaaatcgtgtcaaagggaagatggtacagatgatcagaaaaagggaagtcagcttctggaggtatatgcaattgaaattcaaatgtatacggagacaaagaacaacaaaaagctcaagcaattataccagaaagcacttgctatcaagtctgctataccacatccacggatcatgggaataatccgtgaatgtggtggcaagatgcatatggctgagcgtcaatgggctgaggcagccacagatttctttgaggctttcaagaactatgatgaagctgggaatcagagacgcattcaatgtcttaaataccttgttctggctaatatgcttatggaatccgaagttaatccttttgatggccaggaagcaaagccgtacaaaaatgaccctgagattttggcaatgacaaatcttatagcggcctatcaacgaaatgaaataatagagttcgaaaaaatcctcaagagtaaccgaaggacaattatggatgatccattcatccgaaattatatcgaagatctgttgaagaatgtcagaactcaagtgctacttaagctaataaaaccatatacaagaatccggatccctttcatatcaaaggaactcaatgtgccagaaaaagatgttgaacagttgctagtttcattgatcttggataatcgtattgaggggcatattgatcaagtgaaccggctgttggagcgcggtgacagatcaaagggtatgaagaagtacactgctatagataaatggaacacgcagcttagatccctgtatcaagccgtcagcaacagggtttcctgagattgcaagtaaatggttatatgatatatctgatttcattgttcattgaggccataataatatgcattctcaattctcatattaggtgatttagataagcaattcggaaaaagaaaatggtgtacctagaatcggatgttatatgtttggttagccaaagttgtagttttgttgaatgagccaaaagaagaaaacatatttgcctggttgcaagaattttgattatgagattgacagtcgtaatgtgaacaatagaatatggattctctgcattaagtgcatattaaatgtggaatgttgatggctggttgctgttgtcaatgcttgcttggtagtatgttattgggatttttcatatttgctaatgtacttgtgtgtgataattattttttgcaatagaactcggttctttttatctcaacctaaagtcacgccaatcggttcaattcttagatgtcaacagtgcctagttttgaaggtgtggtcggctccaaataatgaagtgtttattaaatcaccagatttcaaatagaaga

SEQ ID NO: 3120 - DNA, 1510 bp, Euphorbia peplus
atttctggttacgatcatgggttcagatgcagatatggaggattatggattcgaatactccgacgaggaacctgaggaacaagatgttgatattgaaaatcagtattataactccaaaggtttggttgaaacagacccagaaggtgcacttgcaggttttgctgaagttgttagtatggaaccagagaaggctgaatgggggttcaaagcactgaaacaaactgtcaaactttattatcgtttgggcaagtataaagaaatgatggatgcttacagggagatgcttacttacattaaatcagcagtcactcgcaactacagtgagaaatgcataaacaacattatggacttcgtttctggatcagctagtcagaacttcggtctcctgcaagaattttaccagaccaccttaagggctctcgaagaggcaaagaatgagagactctggttcaaaacaaatcttaagttgtgcaagatatggtttgacatgggtgaatatgggcgcatgagcaagattttgaaagaactccataaatcttgtcaacgagaagatggtacagacgaccaaaagaaaggtagtcaacttttggaggtatatgcaattgaaatccaaatgtacactgagaccaagaacaacaaaaagcttaagcaattataccaaaaagcccttgcaatcaagtcagcaatccctcatccaaggattatggggataattcgagagtgtggtggaaaaatgcacatggctgagcgtcaatggcctgatgcagcaacagatttctttgaagcttttaagaattatgatgaagctgggaatcacagacgtatacagtgcctgaagtaccttgttctagccaatatgctgatggaatcagaagtgaatccatttgatggtcaggaagcaaagccatacaaaaatgatcctgagattttggcaatgactaacctaatagcagcatatcaacgaaacgaaatattagagtttgagaaaattctcaagagtaaccggaggacgatcatggacgatccatttatacgaaattacattgaggatctattgaagaatgttagaactcaagtgctgctcaaacttattaaaccttatacaagaattcggattccattcatatcaaaggaactcaatgtgccagaaaaagatgtagagcagctgttggtttcattgatattggataaccgtattgatggtcatattgatcaagtgaaccggctactagagcgtggcgacaggtcaaaaggaatgaagaaatatacagctattgagaaatggaacacacagcttagatctctgtatcaaactgtcagcaaccgtgtgtactgagaatgtgttggcgggcaggtatctagtgaagttacttttggtttttcggtattcagtatagcgccaaaagaactcctttctcctgtatgaaagcacaaaatttcatagaatggtagttgctacttacaagtaatcaattagattgagagctttttgcggttttacagccgatgc

SEQ ID NO: 3121 - DNA, 2167 bp, Gossypium raimondii
aacacaaagtaaattcaatttaatataatttcacaaatcgacagcttcaccttcgccttcgcttctcttatttccgagaacattgaaatttactgatcctccagttttgtcagagtaaccatggcttcagatgcggatatggaagattatggatttgagtactctgatgaggagcccgaggagcaagacgttgatattgagaatcaatattacaattccaaaggtttggtagaaacagaccctgaaggagcacttgttggtttttctgaagtagttagcatggagcctgaaaaggctgagtggggattcaaagctttgaagcaaactgtaaagctctattaccgtttagggaagtataaagaaatgatggactcatacagggagatgctaacgtacatcaaatcagcagtgacacgaaattacagtgaaaaatgtataaacaatattatggattttgtttctggatcagctagtcaaaattttgatctcctgcaagaattctatcagaccactcttaaggcccttgaagaggcaaagaatgagagactttggtttaagacaaatctaaagctttgcaagatctggtttgatatgggcgagtatgggcgaatgagcaagattttgaaggaacttcacaaatcgtgtcaaagggaagatggtacagatgatcagaaaaagggaagtcagcttctggaggtatatgcaattgaaattcaaatgtatacggagacaaagaacaacaaaaagctcaagcaattataccagaaagcacttgctatcaagtctgctataccacatccacggatcatgggaataatccgtgaatgtggtggcaagatgcatatggctgagcgtcaatgggctgaggcagccacagatttctttgaggctttcaagaactatgatgaagctgggaatcagagacgcattcaatgtcttaaataccttgttctggctaatatgcttatggaatccgaagttaatccttttgatggccaggaagcaaagccgtacaaaaatgaccctgagattttggcaatgacaaatcttatagcggcctatcaacgaaatgaaataatagagttcgaaaaaatcctcaagagtaaccgaaggacaattatggatgatccattcatccgaaattatattgaagatctgttgaagaatgtcagaactcaagtgctacttaagctaataaaaccatatacaagaatccggatccctttcatatcaaaggaactcaatgtgccagaaaaagatgttgaacagttgctagtttcattgatcttggataatcgtattgaggggcatattgatcaagtgaaccggctgttggagcgcggtgacagatcaaagggtatgaagaagtacactgctatagataaatggaacacgcagcttagatccctgtatcaagccgtcagcaacagggtttcctgagattgcaagtaaatggttatatggtatatctgatttcattgttcattgaggccataataatatgcattctcaattctcatattaggtgatttagataagcaattcggaaaaagaaaatggtgtacctagaatcggatgttatatgtttggttagccaaagttgtagttttgttgaatgagccaaaagaagaaaacatatttgcctggttgcaagaattttgattatgagattgacagtcgtaatgtgaacaatagaatatggattctctgcattaagtgcatataaaatgtggaatgttgatggctggttgctgttgtcaatgcttgcttggtagtagtatgttattgggatttttcatatttgctaatgtacttgtgtgtgataattattttttgcaatagaactcggttctttttatctcaacctaaatcacggcaatcggttcaattcgtagatgtcaacagtgcctagttttggaggtatggtcggctccaaataatgaagtgtttattaaatcaccagatttcaaatagatgaaattctagaatagtttagaaatgagtgagacataaatgggtttgaagttagttggcacactttgatgtgtggattgtaggagggacatacatacgtggtagatttattgataaagaataatctgatgctgaattgtgtctcgatcttgtactggagcagacgtggctaataagtcgccaattgtattta

SEQ ID NO: 3122 - DNA, 1746 bp, Prunus persica
atctaaaatgacgatgtcacagacagtgtgcgtgcgaagtcccaaaccgccccttttccatcggactgccctaataagagggatttgagccctctctcgattcagtctcctctctgctctcttctgctttcagtagcttccgaatcttaaacgctttgaaagctcagaattccttcttggcttttgagcagtcatgggttccgatgctgatatggaggattacggattcgagtactcggatgaggagcctgaggaacaggatgttgacattgagaaccaatattacaactctaaaggtttggttgagacagatcccgaaggagctctttcaggattcgatgaagtagttcgaatggagcctgagaaggccgagtggggatttaaagctttgaagcaaactgtgaagctttattatcgtctggggaggtataaagaaatgatggatgcgtacagggtgatgttgacatatatcaaatcagcagtaacacgaaattacagtgaaaaatgtataaacaatattatggattttgtttctggttcagctagtcagaactttggtctcctgcaagagttctatcagaccactttaaaggcccttgaagaggcaaagaatgagagactttggttcaagacaaatcttaagctgtgcaaaatttggtttgatatgggtgaatatgggcgaatgaataagattctgaaagaactccataaatcttgtcaaaaagaagatggtacagatgaccaaaagaaaggaagtcaacttctggaggtttatgcaattgagattcagatgtacacggagactaaaaataataaaaagctcaagcaattataccaaaaagcgcttgcaatcaagtcagcaatacctcatcctaggataatgggaataattcgtgagtgtggggggaagatgcatatggcagagcgtcagtgggcagatgcagccacagatttttttgaagcctttaagaactacgatgaagctgggaaccagaggcgtatacaatgcttaaagtatctagttctggctaatatgctgatggagtcagaggttaatccatttgatggtcaagaagcaaagccgtataaaaatgatcctgagatcttggcaatgacaaatctgatagcagcatatcaacgaaatgagatactggagtttgagaaaattcttaagagtaacaggaggacaattatggatgatccgttcatccgaaactatattgaagatctgttgaagaatgttaggacacaagtgctgcttaaacttatcaagccgtacactagaatacggattcccttcatatcaaaggaacttaatgtgcctgagaaagatgttgagcaactcttggtttcgcttattttggataaccgaatcgatggacatatagatcaggtgaaccggctcttagagcgtggtgacaggtcaaagggaatgaagaaatatgctgctatagataaatggaacacacagctaaagtctctttaccaaactatcagtaaccgagtttattgagaatcacatttatcgtttacgatctggatggtgcccagctttctgttattatgtcatgagttagttgagctccaactacaaatgctggatgagatgtgaatagacgtgatttctgagctttataagctggtttttattgagtagtatattattaagtatgaccattttgtaagattcaattgtgtcgaactgtcgctaggcaggaaggagaaggtatgtgtttaatggtgtta

SEQ ID NO: 3123 - DNA, 3744 bp, Vitis vinifera
caggacccaatttcaaatcagcaaaaaaaaagattgagccagcacaaaaaagattcagccaggtgtcttataacccagtacccgggttccaaaacgggtgcgattctgaaccgacatcgccgcttccgttgatgcgtaagtgtgaaactacgcaagctgcgtacaatagaaaaaaaggcgtaggtgagagcgctctgccttccacagtcgcaaagcttcactgataaaatccccaactccgtagtcatttgaggatttgagtctctcatcctcaatcgccatgggttccgatgcagacatggaggattatggatttgagtactcagaagaggagcctgaggagcaggatgttgatattgagaatcaatattacaattctaaaggtttggttgagactgatccagaaggtgcacttgctggctttgctgaagtagttcgcatggaaccagagaaggcagagtggggatttaaagctctaaaacaaacagtcaagctttattatcggttagggaagtataaagagatgatggaagcctatagggtgatgttgacctatattaaatctgcagtgacacgaaactacagtgaaaaatgcatcaacaacatcatggattttgtttctggatcagctagccagaattttgggcttctgcaagagttttaccagaccactctgaaggcccttgaagaggcaaaaaatgagagattgtggtttaagacaaatcttaagctttgcaagatttggttcgacatgggtgaatatgggcgaatgagtaagattttgaaagaacttcacaaatcttgtcgaagagaagatggtacagatgatcaaaagaaaggaacccaacttttggaagtatatgcaattgagattcaaatgtatactgagaccaagaataacaaaaaactcaagcaactataccagaaagcacttacaatcaaatcagccataccccatccaagaataatggggataattcatgaatgtggtgggaaaatgcatatggcagagcgccaatgggcagatgcagcaactgacttttttgaagcttttaagaattatgatgaagctgggaatcagcgacgtatccaatgcttaaaatacttggttctggctaacatgctcatggagtcagaagttaatccttttgatggacaggaggcaaagccatataaaaatgatcctgaaattttggccatgacaaatctgatagcagcatatcaacgcaatgagatattggagtttgaaaaaattctgaagagtaatagaagaacaattatggatgatctcttcatcagaaattacatcgaggatctgttaaaaaatattagaacacaagtgttgctcaagctcatcaaaccatacacgagaatccgtatccctttcatatcaaaggagctgaatgtgccagaggaagatgttgagcagctgttggtgtcgctgattttggataaccgaattcaagggcatattgatcaagtgaaccgattattagagcgtggtgacagatcgaaaggaatgaagaagtatgcagcagtggagaaatggaacacacagcttaaatccctttatcaaactattagcaatcgagtgggttgagagttgtattaaagaaaggtacagtggttcccatcccgatatttggtgattttgtgatgtcaagttgagaagtacttcatgctgtattggggaaaagttggccaaactacacacagatgacagtattttcatatattcatctttctttttaataatatatcatttgaactttatatcctcattccatttctttttaggttttagcctgttgaaatcattttcattttaacttgtcagagtcccaattcacaagagagtcctttattgaccatgtactgtgtcctggtagagggattaagcttgtgcctgacagttactgatagatacaaatgcttaagcttcttttcaagatagcagttagcacaagtcaatgcttctgcttgaaggcaggtcatttactaattaatcatacctttcaaaactatagaatccatggtgtttttttgttcttttgtgtgtgtgtattttttcccattgagaagttttgatacagctgagaccattaggactatctaatggtccttaaattagtcagaaagctgatactgaaccaagtagaagggtgagcagaaaaaatgttggtaatggtgtttatttactgggtcagatcatgccagagacaggattagaggtacaaaaaatgtacaataaaaaagaaatcagcttgaaagcaacttgaccaaaagataatcttgggccaagcttttagacttagggtatggttaggtacatatttgggccatacaaatgattggttgggtccaaaaagagcccaatatgtatatttgtaattttgtgctaatatgatatatttctttatgtttgaagattcaaaatgttatgtctattggtgatatagatttagaggaattatttaccaaatctttttatgcaatacaatatttcttctaatgattataatcatgctagttattctagggcctagtcacaaatttacaagtgaacgataaaaaattgaactaattgcaaccgtttgagtgcatagttacaatgaaaaaaatttatgaaagtgatttttcccttgaaactcttaatgtctttgtccaagatggtctaagttttgagtcgacttgggagagatgtctttaagtggaacaagcacagtttgagcagtgatgggtgtgcctcgaattcaacctagtgtgggaacttttttctgccattagttttgtttgtagccgtcaggtagaaagccttccaagtagagagagcaaacatcagatgtgtgtttgtttaatatagtgtaaaatagaaaaattgggtacgagccctctaacacaagattacaaaactttttaagcggcactggcatcccactgtgaacctgatttgtcaatctggttctggatgtatacatcccttgtaatccttcttactctagtttaccgcacctgaatcaactcagctccattgctgtatgaactcgtttaaatagaaacagacttctacgccaacctggactggtgcaacactactttagctcatgtcactcgcttaaagagaccctctgggcagtactaggttagtcttcaacctgattgaagctgtgggaattgtaatcctgcagacattactctctccaatgttccccaaactttttttcagaacccaattgctatagtgattctacctacgtcatttttcttgaccattttctgcccctggttactggaaggggaagaaatccaggagcttctagtaaaagaagggtgtaaagtatgtcacctgccttgtttattgcttaggtgcaaggatcatagggttgggataattttatttgtctgcgttttttttcagataaaatgtcttctgagggaggaaaaacttcagaatagaagagcttaagatcattccacagacatggtaggggcaaagcaatgacgagtcccataaataaaggtgaaacatattacaaatcaaaagaagaaaaaccagaagttaatccagggggagcactaattttccttcagcacccagggtgttctacataggaaaactatgataagaataggcaaacattatttcactcactcacactccaaaatttctttaaaagcatggtccggagtggagggctacctttatctatatccccacctgattgcttcaggcttgtgttgcct

SEQ ID NO: 3124 - DNA, 1789 bp, Elaeis guineensis
gccccctcccgtttttagccctctctctccccccgtcccttcttccaaccgtcgaagaacgcgaccatcggagatcttgttccttccttctcgactctctacctctcgtgcagcggtaggggctctattcttcagccatgggttccgatgcagatatggaggactatggcttcgagtactcagacgacgaacccgaggagcaggatgtcgatatcgagaaccagtactacaattctaaaggtttggtagaaacagatccagaggaagcacttgctggttttgctgaagtagttcgaatggaacctgagaaagcagaatggggattcaaagctctaaagcagaccgtcaaactctactatcgactggggaggtataaagagatgatggaggcatacagggtgatgttgacatacatcaaatcagcagttacacgtaattacagtgaaaaatgcataaacaacataatggattttgtttctggctcagcaagccaaaatttcagtcttctgcaggagttctatcagactacactgaaggctcttgaagaggcaaagaatgagagactatggtttaagacaaatcttaaactatgcaaaatttggtttgatatgggtgaatatggacggatgaacaagatattgaaggaacttcataaatcttgtcgaaaagaggatggtagtgatgatcataagaagggtacccagcttctggaagtctatgctattgagattcagatgtacactgaaactaagaacaacaaaaaactcaagcaattgtaccagaaggccctttcaataaaatcagcaataccgcatccgcgaatcatggggataatccatgaatgcggtggaaaaatgcatatggctgaacgacagtgggctgaagcagccactgatttttttgaagcattcaagaactatgatgaagctgggaatcaacgtcgtatccaatgcctcaagtatttggttctggccaacatgttgatggaatctgaagtgaatccatttgatgggcaggaggccaagccatacaaaaatgaccctgaaatcttagcaatgacaaacctcattgcagcatatcagcgaaatgagatacttgagtttgaaaaaatcttgaagagcaatagaagaactattatggatgatcctttcatccgcaactacattgaggatctcttgaagaacatcagaactcaagttctacttaagctcattaagccgtatactagaatccgtatccctttcatttcaaaggaactgaatgtgccagagaaagatgttgagcagctcttggtctccttgattcttgacaaccgtattcagggtcacatcgaccaagtcaacaggctattggagcgcactgacaggtcaaagggaacgaagaagtatactgctatagataaatggaatactcagctccggtccctgtaccaaaccataagcaacagagtgggctgagatccagaagttactgttaagaaagcaatttttttttttttttgagattactggattttattttcttgatcagaaaccttccttggaatgttttctgccctctgtgggttgccatatgtggatagctggcaagattttcacctctaaaggatcttgttatgttcatgtgcagctgtttgaacggtcattatagacaccatttttctatttatatgatgtcactatgaaccattcgtgctgttgatgtgctaaactacttttcctggttagagcaaggtacagcggcaatatttagctctaactattgtgaggttttctaagattcttaaaaa

SEQ ID NO: 3125 - DNA, 1786 bp, Euonymus alatus
gagtttaaaaaaaaaactgaaaacaagaataatttttcgcagtataaaaataattcccaactcatatgaccagccggagtagaaatgagtcactggactatacccgcaaccctgtaacatcagcctagtgctaagcctctcagtggacgccctgaccgggatttcaaccggatttctgatcgctttcttgtagtttcatcaaatccggcgccgcgagctctatcaatccacgctacgcgactaatcatgggttgagatgccgatatggaggattatggcttcgagtattcagacgaggagcctgaggaacaggatgttgacatcgagaatcaatattacaactccaaaggtttggttgaaacagatccagaaggagcgcttgcaggttttgctgaagtggttagcatggaacctgagaaggctgagtgggggttcaaagcactaaagcaaactgtgaagctctactatcgtttagggaagtacaaaaaaatgatggatgcttacagggagatgttaacgtacatcaaatcagcagtgactcgaaattacagtgagaaatgcataaataatattatggattttgtttctgggtcggctagtcagaactttggccttttaaaagaattttatcagactactctaaaggccttggaggagcaaaaaatgagagactttggttcaaaacgaatctaagttatacaagatttggtttgatatgggtgaatatgggcgaatgagtaagattctaaaggaactccataaatcttgtcaaagagaagacggcactgatgatcaaaagaaaggaagccaacttctagaggtatatgcaattgagattcaaatgtacacagaaactaaaaacaacaaaaagctcaagcaattataccaaaaggcacttgcaattaagtcagcaataccacatccaaggataatgggaataattcgagaatgtggtgggaagatgcatatggcagagcgtcagtgggctgaagctgcaaccgatttttttgaagcctttaagaactatgatgaagctggaaatcaacggcgcatacaatgcctgaagtatctggttcttgccaatatgctaatggaatctgaagttaatccatttgatggtcaagaagccaagccatacaaaaatgatcctgagattttggcaatgacaaatctcatagcagcatatcaacgtaatgagattttggagtttgaaaaaattcttaagagtaaccggaggacgataatggatgacccattcatcagaaattatattgaagatctgttgaaaaatgtcagaacccaggtgctgcttaagcttatcaaaccttacactagaatccggattcctttcatatcaaaggaactcaatgtgccagaaaaagatgttgagcagttgttggtttcattgattttggacaatcgcattgatggccacattgatcaagtgaacaggcttttagaacgcggtgacaggtcaaagggaatgaaaaagtacgctgccatagataaatggaacacccaactaaggtctctttatcaaactgtcagcaatcgcgtatgaaatcgttggcctgaaacatggtttctctcagagtgccaatataatggtgctttttgccctagcatggccacagcatagtataaactgcaaattagatgggctcaattttttacgcattagagaatatcagcgcgaaaatttcttgttcatcgaattataagatgttttgaagacacgtttgaggggtataaatattgttcggaacgcaaccgaattttggtgctg

SEQ ID NO: 3126 - DNA, 1911 bp, Gossypium hirsutum
aaggaacaatttttaacatttgccgaacgtagcaagtacaaggttgtttttgtagtttagtttaatttctgcaactcgacaccgacaccgtcaccgtcgcctctctatattccggaaagtttctactttagccaattttttctcccagtaactatggcttcagatgcagatatggaggattatggattcgagtactccgatgaggaacctgaggaacaagacgttgatatcgagaatcaatattacaattccaaaggtttggtagaaacagaccctgaaggagctctagctggttttgctgaagtggtcagcatggaaccggaaaaggctgagtggggattcaaagctcttaagcagactgtaaagctctattaccgattagggaggtataaagaaatgatggaggcttacagggagatgctaacatacatcaaatcagcagtgacacggaattacagtgagaaatgtataaataatattatggactttgtgtctgggtcagctagtcaaaattttgggctcctgcaagaattctatcagaccactctaaaggcccttgaagaggcaaagaatgagagactttggtttaagacaaatcttaagctatgcaagatctggtttgatatgggtgagtatgggcgaatgagcaagattttgaaggaacttcataaatcttgtcaaaaggaagatggaacagacgatcaaaagaagggaagtcagcttctggaagtatatgcaattgaaattcaaatgtataccgagacaaagaacaacaaaaagctcaagcaattataccagaaagcacttgctgtcaagtctgcaataccacatcctaggatcatgggaataattcgtgaatgtggtggcaagatgcatatggctgagcgtcaatgggctgaggcagccacagatttctttgaagctttcaagaactatgatgaagctggaaatcagagacgtatacaatgcctaaaataccttgttctagctaacatgctgatggaatctgaagttaatccttttgatggccaggaggcaaagccgtacaaaaatgaccctgagattttggcgatgacaaaccttatagcagcctatcaacgaaatgagataatagagtttgaaaaaatccttaagagtaaccgaaggacaatcatggatgatccgttcatccgaaattatattgaagatcttttgaagaatgtcagaactcaagtactacttaagcttataaaaccatatacgagaatccggatccctttcatatcaaaggaactcaatgtgccagaaaaagatgtagaacagttgttggtttccttgatcttggataatcgaatcgatgggcatattgatcaagtgaaccggctgttggagcgtggtaacaggtcgaagggtatgaagaagtacactgctatcgataaatggaacacacaactgaggtccctttatcaaaccgttaacaacagggtttattgagaaagcaaaaatgctatatgatataatccctttggctaaggtactcccctttctttttggggctacaagaatatgcttgctttcttgtgttaggtgactttagataatctagattcgaaagtttatgttttgttttggttagtcaaagttttattcttattcaatgacagaaaaaagaaaacccgatatatttgcctgtttgcaagaattttgattccgggttgacgctgttatatgaagtgatgatgttgtgtagatctgacatgaaaaaagtgatactagcactataaatatatgatggaatcaaaatctacgttaaatgcggtcacatcggtttgttttgtcgtaatgtgtattgtctggtatatgaaagaatgtagacttataatttagtgctgtttaaattcttcagaacaattagagcttattcttttaaaa

SEQ ID NO: 3127 - DNA, 1732 bp, Eucalyptus grandis
gattccaccaccgtccgtagtaaagccaaaaaaggcaaatcatcactgtacaattctactccccgtcgcggtccattgctgtgaaatttctctccacccttggcaaccagcagcgatggcttcagatgcagatatggaggattatggttttgagtactcggatgaggagcccgaggagcaggacgttgacattgagaatcagtattacaactccaaaggcctcatagaaactgatccagaaggagcacttgcaggctttgctgaggttgtccgcatggaacctgagaaggctgaatggggatttaaagctcttaagcaaactgtcaagctatattatcggttggggaagtataaagaaatgatggattcttatagagtgatgcttacatacatcaaatcagcggtgacaagaaattacagtgaaaaatgtataaacaatgtgatggattttgtttcgggatcagccagtcagaattttagtcttctacaggaattttatcagaccactttgaaggctcttgaagaggcaaagaatgagagactttggttcaagacaaatctcaagctttgcaagatttggtttgatatgggcgaatatggaagaatgaataagattttgaaggagcttcacaaatcttgccaaagagaggatggtacagatgaccacaagaaaggaagtcagcttcttgaagtgtacgctattgagatccaaatgtatactgagaccaagaataataagaagcttaagcaattgtatcagaaagcacttgcaatcaagtcagctataccccatccaagaattatgggtataattcgggaatgtggtggtaagatgcatatggccgagcgccagtgggctgaggcagcaaccgatttctttgaagcctttaaaaattatgatgaagctggaaaccaaaggcgaatccaatgtctaaaatatttggttctagctaatatgctgatggagtctgaagttaacccatttgatggccaagaagcgaagccgtataagaatgaccctgaaattttggccatgacaaatcttatagctgcatatcaacgaaatgagattctagaatttgagaaaatccttaagagcaacagaagaactataatggatgacctattcatccggaattatattgaagatcttctgaagaatatcaggacgcaagtattgctcaaacttatcaagccttataccagaatccgcatccctttcatctcgaaggaacttaatgtgccggaaaaggatgtcgagcagttgttggtttctctaattttggacaaccgtattgatgggcacattgatcaagtaaatcggttgttagagcgtggtgacaggtcaaagggaatgaagaagtacgccgccattgataagtggaacacacagctgaagtctctctaccaaactataaacaacagagtgtattgagttttactgctagacgattggccagctttttgagcgatgtattgtcctttgcttgggtcgaggttgaattttttttctgcttttttactttgggagtggtgatatcgggtgatttgttcaatagcgccctcggaaattactctttttgatgtcgccctcaacatggctcttcttgtaattgcacccacatgatgtgtacaaaatgacttattgcaagagattgatggtgagaaaaagtaaaagatgtttgcagaacaaataaactgtccattgctcagaaggttttgggaaatcctc

SEQ ID NO: 3128 - DNA, 1733 bp, Euonymus alatus
ggactaccacgcgacccgcttatttgcagctctcacctctgtcgatgccctaactgggatttcaaccggatttctgatcgttttctcgtttcgccactctaggtgcctgcacgttcccggagcggaatctctattgtacgagtaatcatgggttcagatgccgatatggaggattatggcttcgagtattcagacgaggagcctgaggaacaggatgttgacatcgagaatcaatattacaactccaaaggtttggttgaaacagatccagaaggagcacttgaaggctttgctgaagtggttcgcatggaacctgagaaggcagagtggggatttaaagcactaaagcaaactgtcaaactctattatcgtttagtgaagtacacagaaatgatggacgcttacagggagatgttaacatacatcaaatcagcagtgacgcgaaattacagtgagaaatgcataaataatattatggattttgtttctgggtcagctagtcagaactttggccttttgaaagaattttatcagactactctaaaggccctggaggaagcaaagaatgagagactttggttcaaaacaaatcttaagctatgcaagatttggtttgatatgggtgaatatgggcgaatgaataagattctaaaggaactccataaatcttgtcaaagagaagacggcactgatgaccaaaagaaaggaagccaacttctggaggtatatgcaattgagattcagatgtacacggaaactaaaaacaacaaaaagctcaagcaattatacctacaagcacttgcaattaagtcagcaataccccatccaaggataatgggaataattcgggaatgtggtgggaagatgcatatggcagagcgtcagtgggctgaagctgcaacagatttttttgaagcctttaagaattatgatgaagctgggaatcaacggcgcatacaatgcctgaagtatctggttcttgccaatatgctaatggaatctgaagttaatccatttgatggtcaagaagccaagccatacaaaaatgatcctgagattttggcaatgacaaatcttatagcagcatatcaacgtaatgagattttggagtttgaaaaaattcttaagagtaaccgcaggacaataatggatgatccgttcatcagaaattatattgaagatctgttgaaaaatgtcagaacccaggtgctgcttaagcttatcaaaccttacactagaatccggattcctttcatatcaaaggaactcaatgtgccagaaaaagatgttgagcagttgttggtttcattgattttggacaatcgcattgatggccacattgatcaagtgaacaggcttttagaacgcggtgacaggtcaaagggaatgaaaaagtatgctgccatagataaatggaacacccaactaaggtctctttatcaaactgtcagcaatcgcgtatgaaatcggtggcctgaaacatggtttctctcagagtgccaatataatggtgctttttgccctagcatggccacagcatagtataaactgctaattagatgggcttaatttttacgcattagagaatatcagcgcgaaaatttcttgttcatcgaattataagatgttttgaagacaagtttgaggggtataaatattgttcggaacgcaaccgaattttggtgctgcaaaatccaagacttgttgatcgcccagatggaagacattgcttc

SEQ ID NO: 3129 - DNA, 1568 bp, Nicotiana benthamiana
tgacgattctcttttcaattcacagctcaaaatctccctctttaccttcgttttggatcttctctgtcattctaatcagccatgggttctgatgcggatatggaggattatggattcgagtactcggatgaggagcccgaagagcaggatgttgatattgagaaccaatactacaattccaaaggcttggttgaaacagaacctgaggcagcacttgagggctttgctgaagtagttcgtatggaacctgagaaggctgagtggggattcaaagctttaaagcaaactgttaagctttactataagcttgggaagtacaaggaaatgatggatgcttacagagagatgctaacctacattaaatcagcagtgacgagaaattatagtgaaaagtgtattaacaatatcatggatttcgtctcaggatcagctagtcagaacttcagcctcctacaagagttctacgagacaacattgaaagcccttgaagaggcaaagaatgagaggttgtggttcaaaacaaatctaaagctttgcaaaatttggtttgacattggggaatatgggcgaatgagtaagattttgaaagaactccacaagtcttgtcaaaaagaagatggcactgatgatcagaagaaaggtacacagctattggaggtgtatgcaattgagatccaaatgtatacagagacaaaaaataacaaaaaactgaaggagctatacaataaagcactttcagtcaagtcagcaatccctcacccaagaataatgggaataattcgtgaatgtggaggaaaaatgcatatggcagaacggcagtgggcagaggcagctacagacttctttgaagcttttaagaactatgatgaagccgggaatcagaggcgcatccagtgtctcaagtacttggttctggcaaatatgctgatggagtctgaggtaaaccctttcgatggccaagaagcaaaaccctacaaaaatgaccccgagatattggcaatgacaaaccttatagcagcatatcaacgaaatgagatcttggagttcgagaaaattctcaagagtaacagaagaacaataatggatgaccccttcattagaaattacattgaagatcttttaagaaatgtcagaacccaagtgttgctgaagatcatcaagccttacacaagaatccggattcccttcatttccaaggagcttaatgtgccagaaaaagacgtggaggagttgttggtatcactgatcttggacaaccgtatccatgggcacattgatcaagtgaaccggttgctagagtgtggagacagatcgaaaggaatgaaaaaatacgctgccattgacaaatggaacacacaactaaagtctctataccaaaccgttggcaacagagtatgttgagccgtaccctgacatgaaaagaggagagtgattatgttatggactcttaattgttttttgggttgattctgaagtgaacgggattcatgctctggaatattagaatatttagttgctctttttgacatgtagttattttgtacaaaattcgaaatttctctcccttt

SEQ ID NO: 3130 - DNA, 1941 bp, Amsonia hubrichtii
acgcagctcgaagagcactactccactctctccaacttcgattcctttctctttctgctgttcgtggaggcgaaacctccttattccttgaaacaattgtctctgccaatcatgggttccgatgtggatatggaggattatggattcgagtactcagacgaggagccagaggagcaggatgtggatattgagaaccaatattacaactccaaaggcatggttgaaactgatccagaagcagcacttgaaggttttgctgaagtagttcgtatggaacccgagaaggctgagtggggatttaaggctttaaaacagactgtgaagttgtattataagctagggaagtacaaagaaatgatggatgcttacagagatatgctaacttatataaaatcagcagtaacacgaaactacagtgagaagtgtataaataatattatggattttgtctctggctctgctagtcagaacttcagtctcctgcaggaattctatcagacaactttgaaagcacttgaagaggcaaaaaatgagagactttggttcaagacaaatctaaagctttgtaagatctggtttgatatgggggaatatggtagaatgagcaagattttgaaggaactccataaatcttgccaaaaagaggatggcactgatgatcagaagaaagggacacaattattagaggtctatgccattgaaattcaaatgtacactgagacaaagaataacaagaagttgaagcaactataccaaaaagctttgtcaatcaagtcagcaatacctcatccaaggattatggggataatacgtgaatgtggtgggaaaatgcatatggcggagcgacagtggccggaagcagctaccgacttctttgaagctttcaaaaattatgatgaggctggaaaccagcgaagaatccaatgcctaaaatacttggttctggctaatatgctgatggaatctcaggtcaacccatttgatggtcaagaagcaaaaccgtataaaaatgacccagagattttggctatgacaaatcttatagcagcatatcaacggaatgaaatattggagttcgaaaagattctcaagagtaatcggaggaccataatggatgatccattcatccgaaactacattgaagatcttctcaagaatgtcagaacccaagtattgcttaagctcatcaaaccttataccaggattcggatccccttcatatcaaaggagcttaatgtgccagagaaagatgttgaggaattgttggtttcccttatcttggataatcgtatccatgggcatattgatcaagtgaaccggttattagaacgtgaagacagttcaaagggaatgaagaaatatgctgcgatagacaagtggaacacacagctgaggtccctctaccaaactgtttccaaccgagtatgttgagattgcttttgcatggaaacagcttactttttgtgttgcagcccgagttgatgctctcctcaggatgaagtttctcatattcagtgtgaatagcagagtgagtacatattggagatgtctattcatattctagaaaaagagcatcactcgtgacatttctatgaagactagcaattaaaatcctgttgcatgtgacccttgtgcttttgatgctcagaggtgaaaaggttttttggcgtcagatagtaaactattttattctttagagcttctgaggttaattttaatatttggtttatttggtgttagatactattcttagtttacaagtcagatgtgcttttactgcttggatcttcactatggctgtgtactcttttgatgaaatattatagaggaaagtctcttacctagtaaccttgtagctgaatctagtggacttgggaagcgagacaaatgcatgatatttcaagttctaatgcaagtcctacttggcttgtgcacgttttc

SEQ ID NO: 3131 - DNA, 1718 bp, Aristolochia fimbriata
cctctgcaggaagggaacaggggttttcttctccgcacagcacaggaagtaacactcgacacacagaaccccgaaaaactgaccatcacgttcgttagtaagccatctgcttaaattcgatccttctgaaagttcgagtagaggacgagaaatcatgggttcagatgcagatatggaagattatggttttgaatactccgatgaggaacccgaagagcaggatgttgatattgaaaatcagtactataattccaaaggtttggtggaaactgatcctgagggagcacttgctggctttgcggaagttgttcgtatggaaccacagaaggcagaatggggattcaaagctttgaagcagactgtgaagctctactatcgattagggaagtataaagagatgatggaggcttatagggtgatgttgacgtacataaaatctgctgtaacacgcaattacagtgagaaatgtataaacaacataatggattttgtttctggatctgcaagccagaattttggtctgctacaagagttctaccagacaactctaagagcccttgaagaggcaaagaatgagagattgtggtttaagacaaaccttaagttatgcaagatctggtttgacatgggggagtatggtcggatgaacaagatcttgaaggaattgcacaagtcatgtagaagagaagatggaacagatgaccaaaagaaaggcactcaacttttggaggtgtatgccattgaaatccaaatgtacacagaaaccaaaaacaacaaaaaactcaagcaactttatcagaaagcgctttctataaagtcagccatcccccatccgaggattatggggatcattcatgagtgtggtggtaagatgcacatggcagaacgccagtgggcagaagcagcgactgatttttttgaagctttcaaaaactatgatgaagctgggaaccatcgtcgaatccagtgcctcaaatacttggtgctggctaatatgttgatggaatcggaggtgaatccttttgacggccaggaggccaaaccatacaaaaatgatcctgagattttggcgatgaccaatctgatagcagcttaccaaagaaatgagatattggagtttgagaaaatcttgaagagtaacagaaggactataatggacgacccttttattcgaaattatattgaagatttattgaagaacataagaacccaagttctgctgaagctgatcaaaccatatacaagaatccgaatccctttcatatcgaaggaactcaatgtgccagagaaagatgttgagtcgctactcgtctccctaattttagacaaccgcattcatgggcatatagatcaagtaaaccggctgttagaacgaggagacaggtcaaagggaatgaagaaatacactgccatagatacttggaatactcaattgaggtccctctatcaaactgtcgcgtacagagtaggttgagagggccagatggtatatgaacgtatcgtctcagttgtactaaagagctgcaattttgaatgacattttagtttattatatttgggaacttgtgattggatatcttctgggtttcccattccaatgtgtttacagacgagcaatttagagtaaaacaagatgtgaataacaggaaaggttttgatcatagaagtgtagtcgatccccatcaattgaatctactagtgattttggttctggccat

SEQ ID NO: 3132 - DNA, 1618 bp, Mimulus guttatus
accagaactccctttatattttctctctctagacgaagccttgaatttgaaggaatttcaaaaattcgcgatgggttccgatgctgatatggaggattacgggtttgagtattccgacgaggagccagaagaacaggatgttgatattgagaatcagtattacaactctaaaggcttggttgaatccgacccggaagctgcacttgagggtttcgcagaagttgtgaatatggaacctgaaaaggccgaatggggatttaaagctttgaagcaaactgttaagctttattataagcttgggaagtacaaagaaatgatggatgcgtacagggatatgttgacttatattaaatctgcagtgactcgaaattacagtgagaaatgcataaacaacatcatggattttatttctggatctgctggtcaaaactttagtctgctgcaagagttttatcaaacaaccttaaaagcccttgaagaggcgaagaatgagagactgtggtttaagacaaatctgaaattgtgcaaaatatggttcgatatcggcgaatacggacgtatgagtaagatactgaaggagcttcacaagtcatgtcaaaaagaagatggtaccgatgatcagaagaagggcacacagttgttagaagtgtatgcaatcgagatccaaatgtacaccgagactaaaaacaacaaaaaactgaaggaattatatcaaaaagcattatcagtcaaatctgctattcctcatccgagaattatggggataattagagaatgtggtggaaaaatgcacatggcagaacgacaatggccagacgcggctactgatttctttgaagcttttaagaactatgatgaagctgggaaccagagacgcatccagtgcctaaagtatttggttctggcaaatatgctgatggaatcagaggtcaatccatttgatggtcaagaggcaaagccatacaaaaacgatccggagatcctggccatgacaaacctaatcgcagcatatcaaaggaacgagattttggagtttgaaaaaattctcaagagtaacagaaggacaataatggacgatccatttattcgaaattacatcgaagatcttctaaagaatgtgagaacacaagtgttgcttaagctcattaagccgtacacaagaattcggatcccttttatctcaaaggagcttaacgtaccagagaaggatgtcgaggcattattggtgtcccttatcttggataatcgaattgatgggcacattgatcaagtgaaccggctattagaacgtggcgacaggtcgaagggaatgaagaagtacactgcgatagacaaatggaacacacagctgaaatctctgtaccaaactgttggcaatcgagtttattgagactgttaatagatgtgcatctccttttatcagacggtgtttagtagttatagcttgtgaaactttgagcatagaagcactttcagctttcctttttgttaattattgaatgaatgttcgcaatttaggtcaatcagcctaagtgcttaactgaatcgggctgcgtctgcacattggttccgtttttcgttatatttttttataatatataattttgttttccaaatt

SEQ ID NO: 3133 - DNA, 1639 bp, Mimulus guttatus
accagaactccctttatattttctctctctagacgaagccttgaatttgaaggaatttcaaaaattcgcgatgggttccgatgctgatatggaggattacgggtttgagtattccgacgaggagccagaagaacaggatgttgatattgagaatcagtattacaactctaaaggcttggttgaatccgacccggaagctgcacttgagggtttcgcagaagttgtgaatatggaacctgaaaaggccgaatggggatttaaagctttgaagcaaactgttaagctttattataagcttgggaagtacaaagaaatgatggatgcgtacagggatatgttgacttatattaaatctgcagtgactcgaaattacagtgagaaatgcataaacaacatcatggattttatttctggatctgctggtcaaaactttagtctgctgcaagagttttatcaaacaaccttaaaagcccttgaagaggcgaagaatgagagactgtggtttaagacaaatctgaaattgtgcaaaatatggttcgatatcggcgaatacggacgtatgagtaagatactgaaggagcttcacaagtcatgtcaaaaagaagatggtaccgatgatcagaagaagggcacacagttgttagaagtgtatgcaatcgagatccaaatgtacaccgagactaaaaacaacaaaaaactgaaggaattatatcaaaaagcattatcagtcaaatctgctattcctcatccgagaattatggggataattagagaatgtggtggaaaaatgcacatggcagaacgacaatggccagacgcggctactgatttctttgaagcttttaagaactatgatgaagctgggaaccagagacgcatccagtgcctaaagtatttggttctggcaaatatgctgatggaatcagaggtcaatccatttgatggtcaagaggcaaagccatacaaaaacgatccggagatcctggccatgacaaacctaatcgcagcatatcaaaggaacgagattttggagtttgaaaaaattctcaagagtaacagaaggacaataatggacgatccatttattcgaaattacatcgaagatcttctaaagaatgtgagaacacaagtgttgcttaagctcattaagccgtacacaagaattcggatcccttttatctcaaaggagcttaacgtaccagagaaggatgtcgaggcattattggtgtcccttatcttggataatcgaattgatgggcacattgatcaagtgaaccggctattagaacgtggcgacaggtcgaagggaatgaagaagtacactgcgatagacaaatggaacacacagctgaaatctctgtaccaaactgttggcaatcgagtttattgagactgttaatagatgtgcatctccttttatcagacggtgtttagtagttatagcttgtgaaactttgagcatagaagcactttcagctttcctttttgttaattattgaatgaatgttcgcaatttaggtcaatcagcctaagtgcttaactgaatcgggctgcgtctgcacattggttccgtttttcgttatatttttttataatatataattttgttttccaaatttcaattgattttgttttctga

SEQ ID NO: 3134 - DNA, 1493 bp, Triphysaria pusilla
gggttactttatttttggttcttcttccaaaagctcacttctctcgaaggactacgagttagccatgggttccgatgctgatatggaggattatggattcgagtactcggacgaggagcctgaggaacaggatgttgatattgagaaccagtactacaactctaaaggcttggttgaaacggaaccagaagcagcactggaaggtttctctgaagtggtcaatatggaacctgaaaaggcggaatgggggtttaaagctttgaaacaaactgttaagctctactataagcttgggaagtacaaagaaatgatggatgcttacagaggcatgttgacttatataaaatctgcagtgactcgaaattacagtgagaaatgcataaacaatattatggattttatttctggatctgcaagtcaaaactttagtctactccaggagttttatcaaaccaccttgttcgcccttgaagaggcaaagaatgagagattatggttcaaaacaaatcttaagttgtgcaaaatatggtttgacattggcgaatacgggcgtatgagcaagattctgaaggagcttcacaaatcttgtcaaaaagaagatggtaccgatgatcagaagaaaggcacacagttgttggaagtgtatgcaatagagatccaaatgtacactgagacaaaaaacaacaaaaaactgaaggaactataccaaaaggcattaactgttaaatctgctatacctcatccaaggatcatgggtataattcgtgaatgtggtgggaaaatgcatatggcagagcgacaatgggcagaagcggctacagacttctttgaagctttcaagaactacgatgaagctgggaaccagagacgaatccagtgcttaaagtatttggttctggcaaatatgctgatggaatcggaggtcaatccatttgatggtcaagaggcaaagccttacaaaaatgatcctgagattttggcaatgacgaacctgatcgctgcatatcaaaggaatgagattttggagttcgaaaaaattcttaagagcaacagaaggacaatcatggatgacccgtttattcgaaactacatcgaagatcttctcaagaatgtgagaacacaagtgttgcttaagctcattaagccttacacaagaatccggatcccctttatatcgaaggagcttaatgttcctgagaaagatgtcgaggagctgttggtgtcccttatactggataaccggatcgatggccacattgatcaagtgaatcggcttttagagcgtggcgacaggaccaagggaatgaagaagtacactgcgatagacaaatggaacacgcagcttaaatccctctaccaaaccgtgggcaatcgtgtatgttaaccctgtcttcatcttcaagacataagtaatggatctgtatttactatcaaatttgttggaatatttttggaaaacctcggttgatttttgcaatattttgtgagcgctc

SEQ ID NO: 3135 - DNA, 1564 bp, Lippia dulcis
tacttgctgtggagaatcccctacagactttagcctaaacccacgaaatcatcttcagttgagaaggatactgaatcgcgatgggttccgatgctgatatggaggattacgggtttgagtactccgacgaggagccggaggagcaggatgttgatattgaaaatcagtattacaactcaaaagggttagtagaaacagaccctgaaggggcgcttgaaggttttgcagaagtggtgcgtatggaaccagaaaaggctgaatggggatttaaagctttgaaacaaactgttaaactttactataagcttgggaggtacaaggaaatgatggatgcctacagggacatgttaacttacatcaaatctgcagtcactcgaaattacagtgaaaaatgcataaacaatatcatggattttatctctggatctgccggtcaaaacttcaatctgctgcaagagttttaccaaaccaccctgaaggcccttgaagaagcaaagaatgagagactatggttcaagacaaatctaaagttgtgcaaaatatggtttgatattggtgaatatgggcggatgagtaagattttgaaggagcttcataaatcttgtcaaaaagaagatggcactgatgatcaaaagaaaggcacacaattgttggaagtgtatgcaattgaaatccaaatgtacactgaaactaaaaacaacaaaaaactgaaggaattatatcaaaaagcactatctgtcaaatctgcaatccctcatccaagaatcatgggtattattcgtgaatgtggtggaaaaatgcacatggcagagcgacaatggccggatgcagccactgatttctttgaagctttcaaaaactatgatgaagctggaaatcaaaggcgcatccaatgcctaaagtacttggttctagcaaatatgctgatggaatcagaagtcaatccatttgatggtcaagaggcaaagccatacaaaaatgaccctgagattctagcaatgacaaacctaatcgcagcataccaaaggaatgagattttggagtttagaaaaaattttgaagagtaacaggaggacaattatggatgatccttttattcgcaattacattgaagatctcttaaagaatgtgagaacacaagtgctgctcaaactcatcaagccttacacaaggattcggatccccttcatatcaaaggagcttaacgtcccagagaaggatgttgaagagttgttggtgtcgcttattttggataatcggattactgggcacattgatcaagtgaatcggctgttggagcgtggtgacaggtcaaaaggaatgaagaagtacactgcaatagacaaatggaacacacagctaaaatcactgtatcaaactgttgggaacagagtatgctgagaccctcacacaaaaaagtatagaatttatggtgtctgattttgggatctgctgctgtaaaagtattattgtgtatcagtaagcatgaagagtacatcctcagtcaactcctctattttgacaattgattttggtcactcatttatcccatcagaaaagtgat

SEQ ID NO: 3136 - DNA, 1669 bp, Phaseolus vulgaris
aaaacgtttctccttcgcttcactcaccggattcttactctcggctcatattacaactcggagtctctgactcaccgcttccgaccttaaacctaactcggatcctcaaattcagtcgatttcatcaccatggcttcggatgctgatatggaggactatggatttgagtactcagatgaggagcaagaggagcaagatgttgatattgagaatcagtattacaattcaaaaggtttggttgaaactgatccagaaggtgcacttgctggttttgcggaggttgtgcgcatggaacaagaaaaggcagaatggggatttaaagctctaaagcaaactgtgaagctctattatagacttggaaggtataaagagatgatggaagcctacagggagatgttgacttacattaaatcagcagtgactcgtaactatagtgaaaaatgcataaacagcattatggactatgtgtcgggttcagctagccagaactttggtcttctgcaggagttctaccagacaactctgaaagcccttgaagaagcaaagaatgagagattatggtttaagacaaatcttaagctttgtaagatcttctttgatattggggaatatggacggatgagtaagattttgaaagaacttcacaaatcttgtcaaagggaagatggtacagatgaccataagaaaggaacccaacttttggaggtttatgcaatagaaattcagatgtacacagagaccaaaaacaacaaaaaactcaagcaactttaccagaaagcactcactattaagtcagcaattccccatccgcggataatgggaataatccatgaatgtggggggaaaatgcatatggcagagcgacaatgggctgaagcagctacggatttttttgaagcttttaagaattatgatgaagctgggaatcagaggcgtatccaatgcttgaaataccttgttcttgccaacatgttgatggagtctgaagtaaacccttttgatgggcaggaggcaaagccatacaaaaatgaccctgaaattttggcaatgacaaatttgatagcagcttatcagcggaatgaaatattggaatttgagaaaatcttgaagagtaacagacgtaccatcatggatgacccatttatcagaaattacattgaggatcttctaaagaatatcagaactcaagtcttactgaagctcatcaaaccatatacgaggatcaggatcccgtttatatctaaggaacttaatgtgcctgagaatgatgtcgagcagctactggtatctcttatcttggataacagaattcaaggacacatcgatcaagtcaaccggctcttagaacgctctgataggtcgaaaggaatgaagaagtatactgccatagacaagtggaacacacagcttaaatccctttatcaaactatcagcaacagagttggttaaaccgtggtgtctgtcgggagagttctgttttgttgtcccagcttgcagttttgtcatgtgaattaatgtagccattatggagagttagggatgtattgcatcaatagtggaatcaaatcgagacccaacttgtgattcatgttctattttataaaatataattgtttgaaacattcatgattgatcgattcaagtagtctaattttatgtttgtgctgaa

SEQ ID NO: 3137 - DNA, 1851 bp, Nicotiana benthamiana
ttcaatgctcggaagcgagagacagtgacgattctctttttcaatcacagctcaaaatctcctcttttgccttcgttttcgatcttctctgtcattctaatcagccatgggttctgatgcggatatggaggattatggattcgagtactcggatgaggagcccgaagagcaggatgttgatattgagaaccaatactacaactccaaaggcttggttgaaacagaaccggaggcagcacttgagggttttgctgaagtagttcgtatggaacctgagaaggctgagtggggattcaaagctttaaagcaaactgttaagctttactataagcttgggaagtacaaggaaatgatggatgcttacagagagatgctaacctacattaaatcagcagtgacgagaaattatagtgaaaagtgtattaacagtatcatggatttcgtctcaggatcagctagtcagaactttagcctcctacaagagttctacgagacaacattgaaagcccttgaagaggcaaagaatgagaggttgtggttcaagacaaatctaaagctttgcaaaatttggtttgacattggggaatatgggcgaatgagtaagattctgaaagaactccacaagtcttgtcaaaaagaagatggcactgatgatcaaaagaaaggtacacagttgttggaggtgtatgcaattgagatccaaatgtatacggagacgaaaaataacaaaaaactgaaggagctatacaataaagcactttcagtcaagtcggcaatccctcacccaagaataatgggaataattcgtgaatgtggaggaaaaatgcatatggcagagcggcagtgggcagaggcagcgacagacttctttgaagctttcaagaactatgatgaagccgggaatcagaggcgcatccagtgtctcaagtacttggttctggcaaacatgctgatggagtctgaggtaaaccctttcgatggccaagaagcaaaaccctacaaaaatgaccccgagatattggcaatgacaaaccttatagcagcatatcaacgaaatgagatcttggagttcgagaaaattctcaagagtaacagaagaacaataatggatgaccccttcattagaaattacattgaagatcttttaagaaatgtcagaacccaagtgttgctgaagatcatcaagccttacacaagaatccggattcccttcatttccaaggagcttaatgtgccagaaaaagacgtagaggagttgttggtatcactgatcttggacaaccgtatccatgggcacattgatcaagtgaaccggttgctagagtgtggagacagatcgaaaggaatgaaaaaatacgctgccattgacaaatggaacacacaactaaagtctctataccaaaccgttggcaacagagtatgttgagagtgccctgacatgaatagaggagagtgattatgttatggactctttaattgttttttgggttgattctgaagtgaacgggattcatgctctggaatattagaatatttagctgctctttttgacgtttagtttttttgtacaaaattccatatttcttccccccttgtttttgtgtttaagcaagcaatgtgggaaaatagaagaaaattcggttcatcgtattcgagtaaaaaccgaaaagaagaccaacggagtatcgagccacgcatgtcaaagcagtgaactattaaatagcaagagcttttatgttactttttgcttctatactgtgacgactaagcagcgatgaattgctgacgacgctaaccaacaatttaatctactctctcatctctctctctctctctttttgaattatccta

SEQ ID NO: 3138 - DNA, 1586 bp, Ambrosia trifida
tgttcggttttcaaaaccaaaccaaaccctagaaaccactgatcgcttctgctttcatatcgtcactcgatcatgggttcagatgcagacatggaggactacggattcgagtactcggaggaggaacccgaagaacaagatgttgacattgaaaatcaatattacaattctaaaggtttggttgagactgatccagagggtgcactcagcggttttgctgaagtagttcagatggaaccagagaaagcagaatggggattcaaagcacttaaacagactgtaaagctttattaccgtttagggaggtacaaagagatgacagatgcttatagggaaatgttaacttacattaagtctgcagtgactcgaaattacagtgaaaaatgtataaacaatatcatggattttgtatccgggtctgctagtcaaaactttggtcttctacaagagttctatcaaaccacgttaaaagcacttgaagaagcaaaaaatgagagattatggttcaagacaaatcttaagctttgcaagatctggtttgacatgggtgaatatggtagaatgaataagattttgaaggagcttcacaaatcttgtcaacgggcagatggtactgatgatcaaaagaaaggaactcagttattggaagtgtatgcaattgaaattcaaatgtacacagagacaaaaaacaacaaaaaacttaaacaactttatcagaaagcacttaccataaaatcagcaattccgcatcctaggatcatgggtatcatacatgagtgtggtggcaaaatgcacatggcagaacgccaatgggcagaagcagctactgacttttttgaagctttcaagaactatgatgaagctgggaatcaaagaagaattcagtgtcttaaatacttggtactggctaacatgcttatgcaatccgaggtcaatccatttgatgggcaagaggcaaagccatacaaaaatgatccagaaatcttagcaatgacaaacttgattgcagcatatcaacgtaatgaaatattggaatttgagaagatactcaagagtaacagaagaaccatcatggatgatcccttcatcagaaactatattgaagatcttctgaaaaacatcagaactcaagtgttactcaagctcatcaaaccgtacacaagaatcagaatcccctttatatcaaaggagcttaatgtgccagagaccgatgtggagcagctgttagtttcattgatattggataatcgggttcaaggtcatattgatcaagttaacaggctgctggagtgtggggacaggtcaaagggaatgaagaaatacactgctgtggacaaatggaacacacaacttaggtcactttatcaaaccgttagcaacagggttggatgagaggcttaagaatacaacttttgatgagagattggtatggtatgttactttttgacaattttttgtttggtcatgtccaattggtaaaagtttgtatctgaatagaacatgagaattaatgtgttaaaaaggggacattgattgcatttgggttttttagccttgatatacgttgtttgtttgggaaaaaagaa

SEQ ID NO: 3139 - DNA, 1583 bp, Ambrosia trifida
gttcaagtgtcgcttctttttattagagatatataattcccaaacttgagcatagcctaaatcaacaccactgttcagtttttaaaaccaaaccctagaaaccactgatcgcttctgcttccatcgtcactcaatcatgggttcagatgcagacatggaggactatggattcgagtactctgaggaggaacctgaagagcaagatgttgacattgaaaatcaatattacaattctaaaggtttggttgagactgatccagagggtgcactcagtggttttgctgaagtagttcagatggaaccagagaaagcagaatggggtttcaaagcacttaaacagactgtgaaactttattaccgtttagggaggtacaaagagatgacagatgcttatagggaaatgttaacttacattaagtctgcagtgactcgaaattatagtgaaaaatgtataaacaatatcatggattttgtatccgggtctgctagtcaaaactttggtcttcttcaagagttctatcaaaccacattaaaagcacttgaagaagcaaaaaatgagcgattatggttcaagacaaatctcaagctttgcaagatatggtttgatatgggtgaatacggtagaatgaataagattttgaaggagcttcacaaatcttgtcagcgggcagatggtactgatgatcaaaagaaaggaactcagttattggaagtgtatgcaattgagattcaaatgtatacagagacaaaaaacaacaaaaaacttaaacaactttatcagaaagcacttaccataaaatcagcaattcctcatcctaggatcatgggtatcatacatgagtgtggtggcaaaatgcacatggcagaacgccaatgggcagaagcagctactgacttttttgaagctttcaagaactatgatgaagctgggaatcaaagaagaattcagtgtcttaaatacttggtactggctaacatgcttatgcaatccgaggtcaatccatttgatgggcaagaggcaaaaccatacaaaaatgatccagaaatcttagcaatgacaaacttgattgcggcatatcaacgtaatgaaatattggaatttgagaagatactcaagagtaacagaagaaccatcatggatgatcccttcatcagaaactatatcgaagatcttctgaaaaacatcagaactcaagtgttactcaagctcatcaaaccgtacacaagaatcagaatcccctttatatcaaaggagcttaatgtgccagagaccgatgtggagcagctgttagtttcattgatattggataatcgggttcaaggtcatattgatcaagttaacaggctgctggagtgtggggacaggtcaaagggaatgaagaaatacactgctgtggacaaatggaacacacaacttaggtcactttatcaaaccgttagcaacagggttggttgagatgcttaagaatataacttttgatgagagattggtatgttactttttgacattttttgtttgtcatgtccaattggtaaaagtttgtatctgaacagaacatgagatttaatgtgttaaaaggggg

SEQ ID NO: 3140 - DNA, 1689 bp, Musa acuminata
taactcttcttgttggtttttttagatgctgatatggaggactatgggtttgaatactctgatgaggaaccggaggagcaggacgtcgacattgagaaccaatactacaactcgaaagggttagtggaaactgatcctgaggaagcacttgctggttttgctgaagtagtgcgcatggaacctgaaaaagccgagtggggattcaaagctttaaaacaaacagttaagctttattataggttaggcaagtataaagagatgatggaagcttacagggagatgttgacatatatcaaatcagcagttacacgtaactatagtgaaaaatgtataaataacataatggactttgtttcgggttccgcaagtcagaactttggtcttctacaggagttctatgagacgacgctgaaggcacttgaggaagcaaagaatgagagactttggtttaaaacaaatcttaagctttgcacgatttggttcgacattggtgaatatggacgaatgagtaagatattgaaagaactccacaaatcttgccagcgagaagatggtactgatgatcaaaagaaaggcacacaacttctggaggtctatgctattgagattcaaatgtacacacagactaagaataacaaaaaactaaagcaactatatcagaaggcactttccataaagtcagcaatacctcatccaagaatcatgggtataattcatgaatgtggagggaaaatgcacatggctgagagacaatgggcagaagctgccactgatttttttgaagccttcaagaactatgatgaagctggaaaccagcgtcgtatccaatgtctcaagtatttggttcttgccaacatgctgatggaatctgaagtaaatccatttgatggtcaagaggcaaagccatacaagaatgatcccgaaattttggcaatgacaaatctgatcgcagcatatcaacgaaatgagatattagaatttgagaagatcttaaagagtaacagaagaacaattatggatgatcctttcatccgaaattatattgaagatcttttgaaaaatatcagaactcaagttctcctgaagcttataaaaccttatacacgaatcaggattccattcatctcaaaggaacttaatgtgcctgagaaagatgtggagcagctcctagtttcgttgattttggacaatcgtattcaaggtcacatcgatcaagtcaacaagctattagagagaagcgacaggtccaagggaatgaagaaatatgctgccatagacaagtggaacactcagcttagatcattgtaccaaacaatctcaaatagagtaggctgaccctgaaatccgctttgttctacatgtctttgtgttgtactcagctttgttctactgtgtcgaagattacatacatgtcgaagcatttcgtcagaagaggccacaaactatgggcgtgtgttgttttcttttgtagtgaacagttgaccgagtgccaagaagaagctgttttttcgggtcatagtgggcagaatctacaaatggtacgtattccatgagtaatggtgatttagaaagaggtcatttacattacattgggacctatgtttatgtgttttgccttaaattcttgtcttctaacgttcaaaaatgttttacaagaaagtacactttctttgcttaggtggcatcatt

SEQ ID NO: 3141 - DNA, 1760 bp, Citrullus lanatus
ccactgcttccccacgatcgcctctgccttccactttgcaatccactcttgcaaccatgggttccgatgcggatatggaggattatggtttcgaatactcggacgatgaacctgaagagcaggatgttgatattgaaaatcaatactacaactctaaagggttggttgaaacggaccccgaaggagctcttgcagggtttgccgaggtggtacgcatggaacctgataaggcagagtggggcttcaaggctctcaagcaaactgtcaagctttattatagactggggaagtataaagaaatgatggattcatatcgagtgatgcttacatacataaaatcagcagtgacccgtaattatagcgaaaaatgtataaacaatatcatggattttgtatctggatcagcaagtcagagctttggtctcttgcaagaattttatcaaaccactttgaaagcccttgaagaggcaaagaatgagaggctttggttcaagactaatttaaagctctgcaagatttggtttgatattggtgaatatggtcgcatgattaagattttgaaggaactccataagtcctgtcaaagagaagatggtacagatgatcaaaagaaaggaagtcaacttctggaagtatatgcaattgagattcaaatgtatactgagactaaaaataacaaaaagctaaagcaattataccagaaagctcttgcaatcaagtcggccataccccatccacgaattatgggaataattcgggagtgtggaggaaagatgcatatggcagaacgtcagtggccagaagcggcaactgatttctttgaggcttttaaaaactatgatgaagctgggaaccaaaggcgtatccagtgcctgaagtatctagttttggctaatatgctgatggaatctgaagttaatccattcgatggtcaagaggcgaaaccgtataaaaatgaccccgagatcttggcaatgactaatcttattgcagcataccaaaggaatgagatacttgagtttgagaaaattctcaagagcaatagaaggacaataatggatgatccattcattcgaaattacattgaagatctgttgaagaatgtcagaacgcaggtgttactcaaacttatcaagccttacacaagaatccggattccatttatatcaaaggaactcaatgtaccggagaaagatgttgagcaattattggtttctctaatcctggataatcgcattgatggtcacattgatcaagtcaaccggcttctggaacgtggtgacaggtcaaagggaatgaagaagtatactgccatagataaatggaacacccagttgaaatccctctttcaaactgtcagcaaccgagtatattgatgtcttattggatggataacctaattgttgtttcatttacatcttcaagagtgtcgaggaatctcccaagtctaattttttgagtttaagttctacgcgttgtctgtttaaagcacaatgtgaatgacactgtaaaatgttgtttggaaactctatcagatgtccccagctacctagaaagagccacatatgatcatcgaaaatcatccaggtaaagtcatgtatagaaaatgaaacctatttgataggacaagaaggggtttgtgtgcaagtctagatgtaatgataataaggacggtggaagtgcgatagaattagaaatgttcttgaggggtaaacaacttgatttgatattggtatttgagggcttcttgaacaataggc

SEQ ID NO: 3142 - DNA, 1659 bp, Cucurbita pepo
ggatacagtgagtgaccaacgcaacggattcgctaaattgttgagaaaatctctccaagaactccgtctttcagtagatcgttcactactcgccgctgcttgctaccgatcgcctccgctctccgtcttccactttgcaatccaatctcgcaaccatgggttccgatgcggatatggaagattatggttttgaatactcggacgatgagcctgaagagcaggacgttgatattgaaaatcaatactacaattctaaaggtctggttgaaatggaccccgaaggagctcttgcagggtttgctgaggtggtacgcatggaacccgagaaggcagagtggggcttcaaggctctcaagcaaactgtcaagctttattatagactggggaggtacaaagaaatgatggattcatatcgagtgatgctgacatatataaaatcggcagtgactcgtaattatagtgagaaatgtataaacaacatcatggattttgtatctggatcagcaagtcagagctttggtctcttgcaagaattttatcaaaccactttgaaagcccttgaagaggcaaagaatgagaggctttggttcaaaactaatttaaaactctgcaaaatttggtttgatattggtgaatatggtcgtatgattaagattttgaaggagctccacaagtcctgtcaaagagaagatggtacagatgatcaaaagaaaggaagtcaactgctggaggtatatgcaattgagattcagatgtatacagagactaaaaataacaaaaagctcaagcaattataccagaaggctcttgcaatcaagtcggccataccccatccacgaattatgggaataattcgggagtgtggaggaaagatgcacatggcagagcgtcagtggccagaagcagctactgatttctttgaggcttttaagaactatgatgaagctgggaatcaaaggcgtatccagtgcctgaaatatctagttttggctaatatgctgatggaatctgaagttaatccatttgatggtcaagaggcaaaaccgtacaaaaatgaccccgagattttggcaatgaccaatcttattgctgcgtaccaaaggaatgagatacttgagtttgagaaaattcttaagagcaataggaaaacaataatggacgatccattcattcggaattacattgaagatctgttgaagaatgtcagaacccaagtgttgctcaaacttatcaagccttacacaagaattcggattccatttatttcaaaggaacttaatgtgccggagaaagatgttgagcaattattagtatcactaatcctggataatcgcattgatggccacatcgatcaagtcaaccgtcttttggagcgtggtgacaggtcaaagggaatgaagaagtatactgccatagataaatggaacacccagttgaaatccctctatcaaactgtcagcaaccgagtatattgagcctcatcgaataatcccgatggggaagtatgtcgattttagcctcaaacatggtatggtttatcacttttttcaccttgaacttgaacttgtaatgtgctatactagatttctgatgaaccaaacttagaaaataattatacaagttcaaacttggattttgttcgggtactatttgagccat

SEQ ID NO: 3143 - DNA, 1330 bp, Manihot esculenta
caataacggcaatgtgcagatgccgatatggaggattatgggttcgagtactcggacgaggagcctgaggaacaggacgttgacattgagaaccaatattataactctaaaggtctggttgaaacagacccagaaggagcacttgcaggttttgctgaagttgttagtatggaaccagagaaggcagagtgggggttcaaagcattgaaacaaactgttaagctttattatcgcttgggaaagtataaagaaatgatggatgcttacagggagatgcttacatacattaagtcagcagtcacccgcaactacagtgagaaatgtataaacagcatcatggacttcgtttcgggatcagctagtcagaattttggcctcctgcaagaattttatcaaaccaccttgaaggccctggaagaagcaaagaatgagagactttggttcaagacaaatcttaagctctgcaaaatatggtttgatatgggtgaatatggccggatgagcaagattctgaaagaactccataaatcttgtcaacgagaagatggtacagatgaccaaaagaaaggcagtcagcttctggaggtatatgcaattgagattcaaatgtacactgagaccaagaacaacaaaaagcttaagcaattataccaaaaggcacttgcaatcaagtcagcaattccacatccaaggataatggggataattcgagaatgtggtgggaagatgcatatggcagagcgtcaatgggatgaggcagcgacagatttctttgaagcttttaagaattacgatgaagctgggaaccaaagacgcatacaatgcctaaaatacctggtactggctaatatgctgatggaatctgaagtgaatccatttgatggtcaagaggcaaagccatataaaaatgatcctgagattttggccatgacaaacctcatagcagcatatcaaaggaatgaaatattggaatttgagaaaatcctcaagagtaacagaaggacaataatggatgatccattcatacggaattatattgaagatctattgaaaaatgtccgaactcaagtgctgctcaagcttattaaaccttatacaagaattcggattcctttcatatccaaggaactcaatgtaccagaaaaagatgttgagcagctgttggtttcactaatattggataatcgtattgatggacatattgatcaagtgaacaggctattagagcgtggagacaggtcaaagggaatgaagaagtatactgccatcgagaaatggaacacacaacttaggtcacttcatcaaactatcagcaaccgtgtatactgag

SEQ ID NO: 3144 - DNA, 1606 bp, Centaurea maculosa
aagtttaccaggtttacggaaagagagaaaacgccatagtcatcttccaaaccaaaccctagacctctgatcgcttctctattctccatcttcttatcatcctccatctaatcatgggttcagatgcagacatggaggattatggattcgagtactccgaggaagaacctgaggagcaagatgtagatattgagaatcagtattacaattctaaaggtttggttgagactgatccagagggtgcacttagtggttttgctgaagtagttaagatggaaccagagaaagcagaatggggattcaaagcacttaaacagactgtcaagctttattaccgtttagggaggtacaaggagatgacggatgcatatagggagatgttaacctacattaaatctgcagtgacccgaaactatagtgaaaaatgtataaacaatatcatggatttcgtatctgggtctgccagtcagaacttcggtcttttacaagagttctaccaaaccaccttgaaagcacttgaagaagcaaaaaatgagaggctgtggttcaagacaaatcttaagctttgcaagatctggtttgacatgggtgagtatggtagaatgaacaagattttgaaggaactacacaaatcttgtcaacgagcggatgggactgatgatcaaaagaaaggaactcagttattggaagtgtatgcaattgagattcaaatgtatacagagacaaagaataacaaaaagctgaagcaactgtaccaaaaagcacttacgataaaatcagcgattcctcatccaagaatcatgggcataatacacgagtgtggtggcaaaatgcacatggcagagcgccaatgggcagaagcagctactgacttttttgaagcttttaaaaactatgacgaagctgggaatcaacgaagaatacagtgtctgaaatacttggtactagccaacatgcttatgcaatctgaggtcaatccattcgatgggcaagaggcaaagccatacaaaaacgatcccgaaatcttggctatgacgaacttgattgcagcttatcagcggaatgaaatattggaatttgagaaaatcctcaagagtaaccgaagaaccatcatggatgatcctttcatcagaaattatattgaagatcttctgaagaacatcagaactcaagttttacttaagctgatcaagccatacacaaggatcaggatccccttcatatcaaaggagcttaatgtgccagaggctgatgtcgaacagctgttagtctcgctgatattagacaacagagttcaaggccatatcgatcaagtcaacaggctgttggagtgcggtgacagatcaaagggaatgaagaaatacactgctgtggagaaatggaacacacaattgaggtcactgtatcaaagtgttagcaatagagttggttgaaaacttgaagttgttatttccattggcatattttgttcatcatgtcaaattagtatctcaacagaacacaaattgatgtgtgtttttttagagaggacactgcttgcaagcctaaaatgatgtcttcttttgcagagtgaatagtagtattttgaggtatattattacttatt

SEQ ID NO: 3145 - DNA, 1649 bp, Centaurea maculosa
  misc_feature (113)..(113): n is a, c, g, or t
  misc_feature (118)..(118): n is a, c, g, or t
  misc_feature (120)..(120): n is a, c, g, or t
  misc_feature (196)..(196): n is a, c, g, or t
  misc_feature (658)..(658): n is a, c, g, or t
  misc_feature (901)..(901): n is a, c, g, or t
ggcgggggcttgaagtttaccaggttacggaaagaagagaaacgccatagtcatcttccaaaccaaaccctagacctctgatcgcttctctattctccatcttcttatcatcntccancnaatcatgggttcagatgcagacatggaggattatggattcgagtactccgaggaagaacctgaggagcaagatgtngatattgagaatcagtattacaattctaaaggtttggttgagactgatccagagggtgcacttagtggttttgctgaagtagttaagatggaaccagagaaagcagaatggggattcaaagcacttaaacagactgtcaagctttattaccgtttagggaggtacaaggagatgacagatgcatatagggagatgttaacctacattaaatctgcagtgacccgaaactatagtgaaaaatgtataaacaatatcatggatttcgtatctgggtctgccagtcagaacttcggtcttttacaagagttctatcaaaccaccttgaaagcacttgaagaagcaaaaaatgagaggctgtggttcaagacaaatcttaagctttgcaagatctggtttgacatgggtgagtatggtagaatgaacaagattttgaaggaactacacaaatcttgtcaacgggcngatgggactgatgatcaaaagaaaggaactcagttattggaagtgtatgcaattgagattcaaatgtatacagagacgaagaataacaaaaagctcaagcaactgtaccaaaaagcacttacaataaaatcagcgattcctcatccaagaatcatgggcataatacacgagtgtggtggcaaaatgcacatggcagagcgccaatgggcagaagcagctactgacttttttgaagcttttaanaactatgacgaagctgggaatcaacgaagaatacagtgtctgaaatacttggtactagccaacatgcttatgcaatctgaggtcaatccattcgatgggcaagaggcaaagccatacaaaaacgatcccgaaatcttggctatgacgaacttgattgcagcttatcagcggaatgaaatattggaatttgagaaaatcctcaagagtaaccgaagaaccatcatggatgatcctttcatcagaaattatattgaagatcttctgaagaacatcagaactcaagttttacttaagctgatcaagccatacacaaggatcaggatccccttcatatcaaaggagcttaatgtgccagaggctgatgtcgaacagctgttagtctcgctgatattagacaacagagttcaaggccatatcgatcaagtcaacaggctgttggagtgcggtgacagatcaaagggaatgaagaaatacactgctgtggagaaatggaacacacaattgaggtcactgtatcaaagtgttagcaatagagttggttgaaaacttgaagttgttatttccattggcatattttgttcatcatgtcaaattagtatctcaacagaacacaaattgatgtgtgtttttttagagaggacactgcttgcaagcctaaaatgatgtcttcttttgcagagtgaatagtagtattttgaggtatattattacttattttgttatgttctaaaataagcgttcacatttg

SEQ ID NO: 3146 - DNA, 1500 bp, Cirsium arvense
gatcgcttctctattctccatcttccaccaaatcatgggttcagatgcagacatggaggattatggattcgagtactccgaggaagaacctgaggagcaggatgtagatattgagaatcagtattacaattctaaaggtttggttgagactgatccagagggtgcacttagtggttttgctgaagtagttaagatggaaccagagaaagcagaatggggattcaaagcacttaaacagactgtcaagctttattaccgtttagggaggtacaaggagatgacagatgcatatagggagatgttaacctacattaaatctgcagtgacccgaaactatagtgaaaaatgtataaacaatatcatggatttcgtatctgggtctgctagtcagaacttcggtcttttacaagagttctatcaaaccaccttgaaagcacttgaagaagcaaaaaatgagaggctgtggttcaagacaaatcttaagctttgcaagatctggtttgacatgggtgagtatggtagaatgaacaagattttgaaggaactacacaaatcttgtcaacgggcagatgggaccgatgatcaaaagaaaggaactcagttattggaagtgtatgcaatcgagattcaaatgtatacagagacgaagaataacaaaaagctcaagcaactgtaccaaaaagcacttacaataaaatcagcgattcctcatccaagaatcatgggcataatacacgagtgtggtggcaaaatgcacatggcagagcgccaatgggcagaagcagctactgacttttttgaagcttttaagaactatgatgaagctgggaatcaacgaagaatacagtgtctgaaatacttggtactagccaacatgcttatgcaatctgaggtcaatccattcgatgggcaagaggcaaagccatacaaaaatgatcccgaaatcttggcgatgacgaacttgattgcagcgtatcagcggaatgaaatattggaatttgagaaaatcctcaagagtaaccgaagaaccatcatggatgatcctttcatcagaaattatattgaagatcttctgaagaacatcagaactcaagttttactcaagctgatcaagccgtacacaaggatcaggatccccttcatatcaaaggagcttaatgtgccagaggctgatgttgaacagctcttagtctcgctgatattagacaacagagttcaaggccatatcgatcaagttaacaggctgttggagtgcggtgacagatcaaagggaatgaagaaatacactgctgtggagaaatggaacacacaactgaggtcactgtatcaaagtgttagcaatagagttggttgaaaacttgaagtttatttctattggcatattttgttcatcatgtcaaattagcatctcaacagaacacaaattgatgtgtggttttttagagaggacactgcttgcaagcctaaaatgatgtcttcttttgcagagtgaaaaaagaa

SEQ ID NO: 3147 - DNA, 1688 bp, Cirsium arvense
aagtttaccaggtttacggaagcagagaaacggacctaggctaaacatacctgttacatgttccaaaccaaaccctaggccactgatcgctcctctattccccatcttctttaccatcgtcaaccaatcatgggttcagatgcagacatggaggattatggattcgagtactccgaggaagaacccgaggagcaagatgtggacattgaaaatcaatattataattctaaaggtttggttgagactgatccagagggtgcacttactggttttgctgaagtagttcagatggaaccagagaaagcagaatggggattcaaagcgcttaaacagactgtcaagctttattaccgtttagggaggtacaaggagatgacggatgcatatagggagatgttaacttacattaaatctgcagtgacccgaaattatagtgaaaagtgtataaacaatatcatggattttgtatctgggtctgctagtcagaactttggtcttttacaagagttctatcaaaccaccttgaaagcacttgaagaagctaaaaatgagaggttatggttcaagacaaatcttaagctttgcaagatctggtttgacatgggtgagtatggtagaatgaacaagattctgaaggaacttcataagtcttgtcaacgggcagatgggactgatgatcaaaagaaaggaactcagttattggaagtgtatgcaattgaaattcaaatgtacactgagacgaagaataacaaaaaacttaagcaactgtaccaaaaagcacttaccataaaatcagcgattcctcatcctaggattatgggcataatacatgagtgtggcggcaaaatgcatatggcagaacgccaatgggcagaagcagctactgacttttttgaagcttttaaaaactacgatgaagctggaaatcaacgaagaatacagtgtctgaaatacttggtactggccaacatgcttatgcaatctgaggtcaatccatttgatgggcaagaagcaaagccatacaaaaatgatcccgaaatcttggcgatgacaaacttgattgcagcatatcaacgaaatgaaatattggaatttgagaaaatcctcaagagtaacagaagaaccatcatggatgatcccttcattagaaattatattgaagatcttctgaaaaacatcagaactcaagtcttactcaagctcattaagccatacacaaggatcaggatccccttcatatcaaaggagcttaacgtcccagaggctgatgttgaacagctgttagtctcgctgatattggacaacagagttcaaggccatatcgatcaagttaacaggctcttggagtgcggcgacagatcaaagggaatgaagaaatacactgctgtggagaaatggaacacacaactgaggtcactgtatcaaagtgttagcaatcgggttggttgaaaattgaagctgtttatttccattggcatattttgttcatcatgtcaaattagtatctgaacacaacacaccagggtttatgtgtttttttagaggggacacttattgcaagcctaaaatagctgtcttcttttgcggagtgaatagtatctgaggtatattattactttttctgttattctgtttttaaataatcgtgcatatttctattttagggtatgtttgttagcagcttaata

SEQ ID NO: 3148 - DNA, 1699 bp, Glycine max
aaaccaaccaaacagtgtaaattgctttgctgagttttgaaaggaatggttagtacttagtagtgcaatgaatcgaagctgaaacgcttcatcaccggattctcgctctcaactcagataccaactcggagtttcggactcatcgcctccgattcaaaaccctaactcggacctcaaactcaatcgatttcatacaacatggcttcggatgctgatatggaggactatggatttgagtactcagatgaggagcaagaggaacaggatgttgatattgagaatcaatattacaattcaaaaggtttggtcgaaagtgatccagaaggtgcacttgctggttttgctgaggtagtgcgcatggaacaagagaaggcagaatggggatttaaagctctaaagcaaactgtgaagctctattatagacttggaaggtataaagagatgatggaagcctacagggagatgttgacttacattaagtcggcagtgactcgtaactatagtgaaaaatgcataaacagcattatggactatgtctcaggttcagctagccagaactttggccttctgcaggaattctatcagacaactctgaaagcccttgaagaagcaaagaatgagagattatggtttaagacaaatcttaagctttgtaagatcttctttgacattggggaatatggacggatgagtaagatattgaaggaacttcataaatcttgtcaaagggaagatggtacagatgaccataagaaaggaacccaacttttagaggtttatgcaatagaaatccaaatgtacacagagacaaaaaacaacaaaaaactcaagcaactttaccagaaagcactcactattaaatcagcaattccccatccacggataatgggaataatccatgaatgtggggggaaaatgcatatggcagagcgccagtgggctgaagcagctacagatttttttgaagcttttaagaattatgatgaagctgggaatcagaggcgtatccaatgcttgaagtaccttgttctggccaacatgttgatggagtctgaagtaaatccttttgatgggcaggaggctaagccatacaagaatgaccctgaaattttggcaatgacaaacttgatagcagcctatcagcggaatgaaatattggaatttgagaaaatcttgaagagtaacagaagaaccatcatggatgatccatttatcagaaactacattgaggatctgctaaagaatatcagaactcaagtcttgctgaagctcatcaaaccatatacaaggatcaggattccgtttatatccaaggaacttaatgtgcctgagcatgatgttgagcaattactggtatcacttattttggataacagaattcaaggacacattgatcaagtcaaccggctcttagaacgatctgataggtcgaaaggaatgaaaaagtacactgccgtagacaaatggaacacacagcttaaatctctttatcaaactatcagcaacagagttggttaaaccgcagtgtatgacgggagagttatctgttttgttgtcccagcttgcagttttgtcatgtgaattaatgtatctattatggagagttagggatgtgtattgcaccaatagtggaaccaaagcgatacccaacttgtgattcatgttctattttataaaatataattgtttgaaacattca

SEQ ID NO: 3149 - DNA, 1777 bp, Glycine max
tttttgttatttctctttcctttttatttttacaaaccaaccaaacagtgtaaattgctttgctgagttttgaaaggaatggttagtacttagtagtgcaatgaatcgaagctgaaacgcttcatcaccggattctcgctctcaactcagataccaactcggagtttcggactcatcgcctccgattcaaaaccctaactcggacctcaaactcaatcgatttcatacaacatggcttcggatgctgatatggaggactatggatttgagtactcagatgaggagcaagaggaacaggatgttgatattgagaatcaatattacaattcaaaaggtttggtcgaaagtgatccagaaggtgcacttgctggttttgctgaggtagtgcgcatggaacaagagaaggcagaatggggatttaaagctctaaagcaaactgtgaagctctattatagacttggaaggtataaagagatgatggaagcctacagggagatgttgacttacattaagtcggcagtgactcgtaactatagtgaaaaatgcataaacagcattatggactatgtctcaggttcagctagccagaactttggccttctgcaggaattctatcagacaactctgaaagcccttgaagaagcaaagaatgagagattatggtttaagacaaatcttaagctttgtaagatcttctttgacattggggaatatggacggatgagtaagatattgaaggaacttcataaatcttgtcaaagggaagatggtacagatgaccataagaaaggaacccaacttttagaggtttatgcaatagaaatccaaatgtacacagagacaaaaaacaacaaaaaactcaagcaactttaccagaaagcactcactattaaatcagcaattccccatccacggataatgggaataatccatgaatgtggggggaaaatgcatatggcagagcgccagtgggctgaagcagctacagatttttttgaagcttttaagaattatgatgaagctgggaatcagaggcgtatccaatgcttgaagtaccttgttctggccaacatgttgatggagtctgaagtaaatccttttgatgggcaggaggctaagccatacaagaatgaccctgaaattttggcaatgacaaacttgatagcagcctatcagcggaatgaaatattggaatttgagaaaatcttgaagagtaacagaagaaccatcatggatgatccatttatcagaaactacattgaggatctgctaaagaatatcagaactcaagtcttgctgaagctcatcaaaccatatacaaggatcaggattccgtttatatccaaggaacttaatgtgcctgagcatgatgttgagcaattactggtatcacttattttggataacagaattcaaggacacattgatcaagtcaaccggctcttagaacgatctgataggtcgaaaggaatgaaaaagtacactgccgtagacaaatggaacacacagcttaaatctctttatcaaactatcagcaacagagttggttaaaccgcagtgtatgacgggagagttatctgttttgttgtcccagcttgcagttttgtcatgtgaattaatgtatctattatggagagttagggatgtgtattgcaccaatagtggaaccaaagcgatacccaacttgtgattcatgttctattttataaaatataattgtttgaaacattcacgattgattcaaggggaatacgtcgaattttattttaatgctgaa

SEQ ID NO: 3150 - DNA, 2400 bp, Helianthus annuus
aaccaaaccctagacccctgatcgcttctctacccatcgtcttcgtatcaccatgggttcagatgcagacatggaggactatggattcgagtactctgaggaggaacctgaagagcaagatgttgacattgaaaatcaatattacaattctaaaggtttggttgagactgacccagaaggtgcactcagcggttttgctgaagtagttcagatggaaccagagaaagcagaatggggattcaaagcacttaaacagactgtaaagctttattaccgtttagggaggtacaaagagatgacagatgcttatagggaaatgctaacttacatcaagtctgcagtgacacgaaactatagtgaaaaatgtataaacaatatcatggattttgtatccgggtctgctagtcaaaactttggtcttctacaagagttctatcaaaccacattaaaagcactcgaagaagcaaaaaatgagagattatggttcaagacaaatcttaagctttgcaagatctggtttgacatgggtgaatacggtagaatgaataagattttgaaggagcttcacaaatcttgtcagcgggcagatggtactgacgatcaaaagaaaggaactcagttattggaagtgtatgcaatagagattcaaatgtacacagagacgaaaaataacaagaaacttaaacaactttaccaaaaagcacttaccataaagtcagcgattcctcatcctaggatcatgggtatcatacatgagtgcggtggcaaaatgcacatggcagaacgccaatgggcggaagcagctaccgacttttttgaagcatttaaaaactatgatgaagctgggaatcaaagaagaattcagtgtcttaaatacttggtactggccaacatgcttatgcaatccgaggtcaatccatttgacgggcaggaggcaaagccatacaaaaatgatccagaaatcttggcaatgacaaacttgattgcagcatatcaacgtaatgaaatattggaattcgagaagatactcaagagtaacagaaggaccatcatggatgatcccttcatcagaaattatattgaagatcttttgaaaaacatcagaactcaagtgttactcaagctcatcaaaccgtacacaagaatcagaatcccctttatatcaaaggagcttaatgtgccagagactgatgtggaacagctgttagtgtcattgatattggataatcgggttcaaggtcatatcgatcaagttaacaggctgctggagtgtggggacaggtcaaagggaatgaagaaatacactgctgtggagaaatggaacacacaacttaggtcactttatcaaagtgttagcaacagagttggttgagggtttaagaatataacttttgatgagagattgttattttgcttttgacattttttgtttgtcatgtccaattggtaaaagtttgtatctgaacagaacataaaagaaaatacaacattgccacccgtcgtaacctcggtttacaatctagttgctcaactaaaatccctatctctacattaggaaaaggaaaaaagtcaaacgtgaaacgatcgcgcaaacggtatcttacaagctaagcaaaaccattatcagattcaaacccactctttcgggttaatacaagcatccaaaagtttccattcttcgctaccctcttcaggtttatggtcgtattcccatctggctgttagcggcaaagagacaagaatgctttcaatccgacctccagttttaagaccgaatgttgttcctcgatcatacaccaaattgaattccacataacggccccttctcagttgctgccatgccttgtgtttatcagtgaatggcgtatcctttctcctttctataattggtatatatgcatcaaccacagagttggcgcactcagtggcaaaagagaggagcatttcttgatcatagtcgtttaaatcatcgaaaaatatgcctccgagcccccgtctctcatttcggtgcttaatgtagaaataatcatcacaccatttcttgaaacgtggatagaagctcggatcaaatttgtcacaggcatttttttgtaccgtatggaagtgcttgacatcttcttcgaatatataagcaggtgtcaaatcagtacccccaccaaaccaccatgatcttggtgctccgggagcatcttttcgagcatcagtctcaaaataacgataattgaaatgcaacgttggtgcaaaagggttctttgggtgtaaaacagagctaacaccagcagcaaaaaagggaacaggttcaggcttaaagttgccattttcagcagcattagcagcaggattagcagccctataagcttcaggtggcatcacaccatacaccaccgaaacattcacccc

SEQ ID NO: 3151 - DNA, 1829 bp, Olea europaea
ctccttccaaaatccaatacactattcttcccgtataaatctcccactttcttttcctttctgcacaaatcgaatcatactccactcaaatcagccatgggttctgatgcagatatggaggattatggtttcgagtattcagacgaggagccagaggaacaagacgtcgatattgagaatcaatattacaattccaaaggcttggtcgaaacagatccagaagctgcacttgagggttttgcagaagttgtgcggatggaacctgataaggccgagtggggattcaaagctttaaagcaaactgttaagctctactataagctagtgaagtacaaagaaatgatgttagcttatagagatatgttaacttacatcaaatcagcagtgactagaaattacagtgagaagtgcatcaacaatataatggatttcatttctggatcagctggtcagaactttaacctcttgaaagagttttaccagaccactttaaaggcacttgaagaggcaaagaacgagagactgtggttcaaaacaaatctgaagctttgcaagatatggtttgatatgggtgaatatggacggatgaacaagattttgaaggagctccacaaatcttgtcaaaaagaagatggtacagatgatcagaagaaagggacacaattgcttgaagtatatgcaattgaaattcaaatgtacacagagactaaaaacaacaaaaaactcaaggaattatatctaagagcactgtcaatcaagtcagctattcctcatcctagaattatgggaattattcgtgagtgtggtggaaaaatgcatatggcagagcgacaatgggcagacgcagctactgatttctttgaagcatttaagaactatgatgaagctggaaaccataggcgtatccagtgtctaaaatatttagttctggctaatatgctgatggaatctgaggtcaacccatttgacggtcaagaggctaagccttataaaaatgaccctgagatattggccatgacaaacctaatagcggcatatcaacggaatgagatattggagtttgagaaaattctgaagagtaatagaaggacgataatggatgatccatttatccgaaattatattgaagatcttttgaagaatgtgagaacacaagtgttgcttaagcttattaagccttatacaagaattcggatcccctttatatcaaaggaacttaatgtgccagaaaaagatgtcgaggagctgttagtgtccctaatcttggacaatcgtattcatgggcacattgaccaagtgaatcggctcttggaacgtggtgacaggtcaaagggaatgaagaagtacaatgcaatagagaaatggaacacacagcttaggtccctgtatcaaacggttggaaaccgagtgtcttgagattgctgtcatatggatatagggtgaacgaaatgaacctgtgtgggagctcgaattctgttgttgtttacaaatcaagcatttcatcttgtttaatcattgttagatgtctgcaagggtttttaactgctgcttttggaaggaaggtgtaaagatttaggacatcacgagttttttcaacttctttgatgcgaaccaaatggaggcatttgattcttattggttcgaattcttttggttcgtagaagcaatattatctcttttatttgctgtatattgcagttatgttgcttctgctttctgccgttctgggtttgaaaaacccgattataattgaaaacatgcagctgaataacacaaacaatctgttctctcactcagatgttggaagtatgcaaaacttattattgcat

SEQ ID NO: 3152 - DNA, 1472 bp, Cichorium intybus
ggcgggggcgtacccgcaactaagtcgctgttatcacaggtgttgtatttctaaaccaaaccctagagcactgatcgctactgtattcatcatcttctcatcatcgttaagcaatcatgggttcagatgcagatatggaggattatggatttgagtactctgaggaggaaccagaagagcaagatgtagacattgaaaatcaatattacaattctaaaggtttggtggagactgatccagagggtgcacttactggttttgcggaagtagttcagatggaaccagaaaaggcagaatggggatttaaagcacttaaacaaactgtcaagctttattaccgtttagggaggtacaaggagatgacagatgcatatagagagatgttgacttacattaaatctgcagtaactcgaaattacagcgaaaaatgtataaacaatatcatggattttgtatctggatccgctagtcaaaactttggtcttttacaagagttctatcagaccaccttgaaagcacttgaagaagctaaaaatgagagattgtggttcaagacaaatcttaagctttgcaagatctggtttgacatgggtgaatatggtagaatgaataagattttgaaggaacttcataaatcttgtcaaagggcagatggaactgatgatcaaaagaaaggaactcagttactggaagtgtatgcaatagagattcaaatgtacacagagacaaagaacaacaagaaactcaagcaactttaccaaaaggcccttactatcaaatctgcaattccacatccaagaatcatgggaatcatacatgaatgtggtggcaaaatgcacatggcagaacgccaatgggcagaagcagctactgacttttttgaggcttttaaaaactatgatgaagctggaaatcaaagaagaatccagtgtctgaaatacttggtgctagcaaacatgcttatgcaatctgaggtcaacccatttgacggtcaagaggcgaaaccatacaaaaatgatccggaaatcttggcaatgacaaacttaattgcagcatatcaacgtaacgaaatattggaatttgagaaaattctcaagagcaacagaagaacaatcatggatgatcctttcataagaaattacatcgaagatcttctgaaaaacataagaactcaagtgttactcaagctgattaagccatacaccaggatcagaatccccttcatatcaaaggagcttaatgtgccagaagctgatgtggaacagctgttagtgtcactgatattggacaacaaagttcagggtcacattgatcaagttaacaggctgttggagcgtggcgacaggtcaaagggaatgaagaagtatactgccgtggagaaatggaatactcaacttaggtcactttatcaaagtgttgggaatcgtgttggttaagaagcttgaaaaaaaaatagacttttggtgagagtt

SEQ ID NO: 3153 - DNA, 1536 bp, Flaveria ramosissima
tctattcatcgtcttcgtatcatcgtcattcaaccatgggttcagatgcagacatggaggattacgggttcgagtactccgaggaggaacctgaagagcaagatgttgacattgagaatcagtattacaattctaaaggcttggttgagactgatccagaggctgcactcagtggttttgctgaagtagttcagatggaaccagagaaagcagaatggggattcaaagcacttaaacagactgtaaagctttattaccgtttagggaggtacaaagagatgacagatgcttatagagaaatgttaacgtacattaagtctgcagtgactcgaaattatagtgaaaaatgtataaacaatatcatggattttgtatccggctctgctagtcagaactttggtcttctacaagagttctatcaaaccacattaaaagcactcgaagaagcaaagaatgagagattatggttcaagacaaatcttaagctttgcaagatctggtttgacatgggtgaatatggtagaatgaataagattttgaaggagcttcacaaatcttgtcaacgggcagatggtactgatgatcaaaagaaaggaactcagttattggaagtgtatgcaattgagattcaaatgtacacagagactaaaaataacaagaaacttaagcaactttaccaaaaagcacttactataaaatcagcaattcctcatcctaggatcatgggtatcatacatgagtgtggtggcaagatgcacatggcagaacgccaatgggcagaagcagctactgacttttttgaagcttttaaaaactatgatgaagctggaaaccaaagaagaattcagtgtcttaaatacttggtactggctaacatgcttatgcaatccgaggtcaatccatttgatggtcaagaggcaaagccatacaaaaatgatccagagatcttggcaatgacaaacttgattgcagcatatcaacgtaatgaaatattggaatttgaaaagatactcaagagtaacagaagaaccatcatggatgacccctttatcagaaattatattgaagatcttctgaaaaacatcagaacccaagtgttactcaagctcatcaaaccctacacaagaatcagaattcccttcatatcaaaggagcttaatgtgccagaggctgatgtggagcagctgttagtttcactgatattggataatcgggttcaaggtcatattgatcaagttaacaggctgctggagtgcggggacaggtcaaagggaatgaagaaatacactgctgtggagaaatggaacacacaacttaggtcactttatcaaagtgttagcaacagagttggttgagaagtttaagcatataacttttgatgagagattgttattttacttttgacattttttgtttatcttgttcaattggtaaagctggtatctgaacagaaatgaagaggatactgtgtttaaaagtgggtcattggttgcatttttgtttgtttattgctatgttgattatttgcaatagaac

SEQ ID NO: 3154 - DNA, 1921 bp, Gossypium raimondii
ctcttattttctctgtgattttctttgattctaatttaaattctgtaaaaaaaaaaaaatcagtttcgctattagcgcttgataaaattgttttctttcttggattggacagatgcagatatggaggattatggattcgagtactccgatgaggaacctgaggaacaagacgttgatatcgagaatcaatattacaattccaaaggtttggtagaaacagaccctgaaggagctctagctggttttgctgaagtggtcagcatggaaccggaaaaggctgagtggggattcaaagctcttaagcagactgtaaagctctattaccgattagggaggtataaagaaatgatggaggcttacagggagatgctaacatacatcaaatcagcagtgacacggaattacagtgagaaatgtataaataatattatggactttgtgtctgggtcagctagtcaaaattttgggctcctgcaagaattctatcagaccactctaaaggcccttgaagaggcaaagaatgagagactttggtttaagacaaatcttaagctatgcaagatctggtttgatatgggtgagtatgggcgaatgagcaagattttgaaggaacttcataaatcttgtcaaaaggaagatggaacagacgatcaaaagaagggaagtcagcttctggaagtatatgcaattgaaattcaaatgtataccgagacaaagaacaacaaaaagctcaagcaattataccagaaagcacttgctgtcaagtctgcaataccacatcctaggatcatgggaataattcgtgaatgtggtggcaagatgcatatggctgagcgtcaatgggctgaggcagccacagatttctttgaagctttcaagaactatgatgaagctggaaatcagagacgtatacaatgcctaaaataccttgttctagctaacatgctgatggaatctgaagttaatccttttgatggccaggaggcaaagccgtacaaaaatgaccctgagattttggcgatgacaaaccttatagcagcctatcaacgaaatgagataatagagtttgaaaaaatccttaagagtaaccgaaggacaatcatggatgatccgttcatccgaaattatattgaagatcttttgaagaatgtcagaactcaagtactacttaagcttataaaaccatatacgagaatccggatccctttcatatcaaaggaactcaatgtgccagaaaaagatgtagagcagttgttggtttccttgatcttggataatcgaatcgatgggcatattgatcaagtgaaccggctgttggagcgtggtaacaggtcgaagggtatgaagaagtacactgctatcgataaatggaacacacaactgaggtccctttatcaaaccgttaacaacagggtttattgagaatgcaaaaatgctatatgatataatccctttggctaaggtactcccctttctttttggggctacaagaatatgcttgctttcttgtgttaggtgactttagataatctagattcgaaagtttatgttttgttttggttagtcaaagttttattcttattcaatgacagaaaaaagaaaacccgatatatttgcctgtttgcaagaattttgattccgggttgacgctgttatatgaagtgatgatgttgtgtagatctgacatgaaaaaagtgatactagcactataaatatatgatggaatcaaaatctacgttaaatgcggtcacatcggtttgttttgtcgtaatgtgtattgtctggtatatggaagaatgtagaattataatttagtgctgtttaaattcttcagaacaattagagcttattcttttcatatatgggtaggataaattgaatcatattgaatgcaagattgatagaacataacagtaaacaa

SEQ ID NO: 3155 - DNA, 1729 bp, Lactuca sativa
tgacgaaagggtccagtcccgcaactaaactcgctattttcacaggtgttgcatttgtaaaccaaaccctagagaccactgatcgctactgtattcatcatcttctcatcatcgtcaagcaatcatgggttcagatgcagatatggaggattatggatttgagtactctgaggaggaacctgaagagcaagacgtggacattgaaaatcaatattacaattctaaaggtttggtggagactgatccagagggtgcacttactggttttgctgaagtagttcagatggaacctgagaaagcagaatggggattcaaagcactaaaacagactgtcaaactttattaccgtttagggaggtacaaggagatgacagatgcatatagggaaatgttaacctacattaaatctgcagtaactcgaaattacagtgaaaaatgtataaacaatatcatggattttgtctctgggtctgctagtcaaaactttggtcttttacaagagttctatcaaaccactttgaaagcacttgaagaagctaagaatgagagattatggttcaagacaaatcttaagctttgcaagatctggtttgacatgggtgaatatggtagaatgaataagattttgaaggagcttcataaatcttgtcaaagggcagatgggactgatgatcaaaagaaaggaactcagttactggaagtgtatgccattgagattcaaatgtacacagagactaagaacaacaaaaaactcaagcaattgtaccaaaaagcccttactattaaatctgcaatcccacatccaagaatcatgggaataatacacgaatgtggtggcaaaatgcatatggcagaacgccaatgggcagaagcagctactgacttttttgaagcttttaaaaactatgatgaagccgggaatcagagaagaatccagtgtctgaaatacttggtgctagcaaacatgcttatgcaatctgaggtcaatccatttgatggtcaagaggctaaaccatacaaaaacgatccagaaatcttggctatgacaaacttaattgcagcatatcaacgtaatgaaatattagaatttgagaaaatcctcaagagcaacagaagaacaatcatggatgatccttttatcagaaattacattgaagatcttctgaaaaacattagaacccaagtgttactcaagctaattaagccatacaccaggatcaggatccccttcatatccaaggagctgaatgtgccagaggctgatgtggaacagcttttagtgtcgctgatattggacaacaaagtgcagggtcacatcgatcaagttaacaggctgttggagcgtggtgacaggtcaaagggaatgaagaaatacactgctgtggagaaatggaacacgcagcttaggtcactttatcaaagtgttgggaatcgagttggttgaaaaaaatagatatatatattgaattgtgatgagattttgtttgtttccatcgcggcatattttgtccatcatgtcaaattggtaaaaaagtttgtatctaaaggaaaactcaactcaagtcaagtcaagtcgaggattaatgtgttttgattattgattgcatttgtgcatttggtatttgggcttgtgaggtatatttgacaatttttggaaaccttttcaactttaattattcatcaatcctatggaggagtaggtgagttggtaaatgataattcaatttac

SEQ ID NO: 3156 - DNA, 1823 bp, Cajanus cajan
tatgcaaacagagcgtaaataatttagcatttcggagttccgaaaggaatgttaaataacaaggctttgaaagggaaaatgaatagaagctgaaaggctcaactccttcgcttcactcaccggattctcactctcaactcacataccaactccgagtttccaactcaccgcttccgacaataaaagccctaactcggatcctcaaactcatcgatttcactcgacatggcttccgatgctgatatggaggactatggatttgagtactcagatgaggaacaagaggagcaagatgttgatattgagaatcaatattacaattcaaaaggtttggtagaaactgatccagaaggtgcactttctggttttgctgaggtagtgcgcatggaacaagagaaggcagaatggggctttaaagctctaaagcaaactgttaagctctattatagacttggaaggtataaagagatgatggaagcctacagggagatgttgacttatattaagtcggcagtgactcgtaactatagtgaaaaatgcataaacagcattatggactatgtctccggttcagctagccagaactttggccttctgcaggaattctaccagactactctgaaagcccttgaagaagcaaagaatgagagattgtggtttaagacaaatcttaagctttgtaagatcttctttgatattggggaatatggacggatgagtaagatcttgaaggaacttcacaaatcttgtcaaagggaagatggtacggatgaccataagaaaggaactcaacttttggaggtttatgcaatagaaattcaaatgtacacagagaccaagaacaacaaaaaactcaagcaactttaccagaaggcactcactattaagtcagcaattccccatccacggataatgggaataatccatgaatgtgggggtaaaatgcatatggcagagcgccagtgggctgaagcagcaacagatttttttgaagcttttaagaattatgatgaagctgggaatcaaagacgtatccaatgcttgaagtaccttgttcttgccaacatgttgatggagtctgaagtaaatccttttgatgggcaggaggctaagccatacaagaatgatcctgaaattttggcaatgacaaatttgatagcagcctatcagcggaatgaaatattggaatttgagaaaatcttgaagagtaatagaaaaaccatcatggatgatccatttatcagaaattacattgaggatctgctaaagaatatcagaactcaagtcttgctgaagctcatcaaaccatatacaaggatcaggatcccatttatatccaaggaactgaatgtgcctgagcatgatgttgagcagctactggtatcacttattttggataatagaattcaaggacacattgatcaagtcaaccggctcttggaacgctctgataggtcgaaaggaatgaaaaagtatactgccgtagacaaatggaacacacaactcaaatctctctatcaaacaatcagcaacagagttggttaaacggtggtgtctgacgggagttatctgttttgttgtcccagcttgcagttttgtcatgtgaattaacgtagcttttatggagagttagtgatgtattttgcaccaatagtggaaccaaagcgagacccaacttgtgattcatgttctattttataattgatgaaagattcgtgttctattttataaaatataattgtttgaaacattcatgattgatgattcaaggggattcctcctattttcttttagtgctgaatataactgcgcagtacattaag

SEQ ID NO: 3157 - DNA, 1606 bp, Plantago ovata
tgtactataatcggagagaattgctgttctgtaaatccctttctctttctcaacggaaatctaaaactgaagttcgatcacaatgggttccgatgctgatatggaggactatggttttgagtactcggacgatgagccggaggagcaagatgttgatatcgagaaccagtattacaattctaaaggcttggttgagtctgacccggaagctgcactcgaaggattcgcggaagtggtgcgaatggagcctgagaaggcggactggggatttaaagctttaaaacaaactgtgaagctttactacaagcttgggaaatacaaagaaatgatggatgcttacagagacatgctgacatatattaaatccgcggtgacccgaaattacagtgagaaatgtataaataatatcatggattttatctctggatctgctagtcagaactttgctttattgcaagagttttatcagacaactttgagggcacttgaagaggcgaagaatgagagactctggtttaagacaaatctcaaactctgcaaaatatggtttgatatgggagaatatgggaagatgagtaagattttgaaggagcttcacaaatcttgccaaaaagaagatggtagtgatgatcagaagaaagggacacaactgctggaggtctatgcaattgagatccaaatgtacaccgagactaaaaacaacaaaaagttgaaagagctatatcagaaggcattaactatcaaatcagccattcctcaccctagaatcatggggattattcgtgaatgtgggggtaaaatgcacatggcggagcgacaatgggcagaggctgccactgatttctttgaagcttttaagaattatgacgaagctggaaaccataggcgtatccaatgcctgaagtacttggttttggcaaatatgttgatggagtcacaggtcaatccatttgatggtcaagaggcaaaaccgtacaaaagtgaccctgagattctagcaatgacaaacctaattgccgcctatcaaaagaatgagattttggagttcgagaaaattttgaagagtaatagaaggacaataatggatgatcctttcataagaaattacattgaagatcttctaaagaatgttagaacacaagttttgcttaagctcatcaagccctacacgagaattcggctcccctttatatcaaaggagcttaacgtgcctgagaaagacgtcgaggacttgttagtctcactgatcttagacaatcgcattgatggacacattgaccaagtaaataggcttttagagcgtggtgacaggtcgaagggaatgaagaagcatgccgcagtagacaaatggaacacacaactgaagagcctctaccaaactattggcaaccgtgtatgttgatacagttattataccagactttaggagcttggaacatttctgttgtcctgtctaacggcattttctgtatgttgttgagcttattgcattaaggtgaattatacggagtatgtacacaatgtaattgtaatatagatgtaccttttttagtttatggtgtatcgcagagagggagacaggagtataaactactttccttgcatt

SEQ ID NO: 3158 - DNA, 1897 bp, Arachis hypogaea
tcactctgtcaaacaccacaacggcagcccattcctttttccggcatcactcccatctcttcactgcggctgctgctacgtcttctctctccaccatcgctgttgctatgtaatgtctctccaccgaggctgcaacctgtgaccttgtcgccgatctactcttctctggtgttatgtgcctctctccgtcgctgttgtgctctttgctcacccaatctcgttcttgatttatctcagagttccactgactcaccgattccaacgatcaaaaccctaactcggatccgtaccctacaacatggcttccgatgctgatatggaggactatggatttgagtactctgatgaggagcaagaggagcaagatgttgatattgagaatcaatattacaattcgaaaggtttggttgaaactgatccagaaggtgcactttctggttttgctgaggtagtgcgcatggaacaagaaaaggctgaatggggatttaaagctctaaaacaaaccgtcaagctctactatcgacttgggagatataaagagatgatggaagcctacagggagatgttgacttatattaagtctgcagtgactcggaactacagtgaaaaatgcataaacagcattatggactatgtctcaggttcagctagccagaactttggtcttctgcaaaaattactaccagacaactctgaaagcccttgaagaagcaaagaatgagagattgtggtttaaaacaaatctgaagctttgtaagattttctttgatattggtgaatatggacgaatgagcaagatcttgaaggaacttcacaaatcttgccaaagagaagatggcacagatgaccataagaaaggaacccaactgttggaggtttatgcaatagaaatccagatgtacacagagaccaagaacaacaaaaaactcaagcaactttaccagaaagcacttactattaagtcagctattccccatccaagaataatggggataatccatgaatgtgggggtaaaatgcatatggcagagcgccagtgggcagaagcagctactgacttctttgaagcttttaagaattatgatgaagctgggaatcataggcggatccaatgcttgaagtaccttgttcttgccaacatgttgatggagtctgaagtgaatccttttgatggacaggaggctaagccatacaagaatgacccggaaattttggcaatgacaaatttgatagcagcctatcaacggaatgaaatattggaatttgagaaaatactgaagagtaacagaagaaccatcatggatgatccatttatcagaaattacattgaggatctgctaaagaatatcagaacacaagtcttgcttaagctcatcaaaccatatacaaggataaggataccatttatatctcaggaactgaacgttcccgaacatgatgttgagcagctgcttgtgtcactgattctggataatagaattcaaggacacattgatcaagtgaacaggctcttggaacgttctgataggtcgaaaggaatgaaaaagtacactgccatagacaaatggaacacacagctaaaatctctctatcaaacaatcagcaatagaggttagaccttggtgtgtggtggaaagggatatctatattgttgcttcagcatgcagtttagtcatgtgaattaacttagcttctatgcagagttaggaaagtgttacaaatagtgggaaccaacgtgaaaatgcaacttgtgattcatgttttagtttatttggaaacaattttaaaggtgttcaatgttgtgtagaagggtttgatgctccgtgagcgctgttccaatttattcgtcgtttagtaaaatataatgctgcaaccggcgtcgatatataattatata

SEQ ID NO: 3159 - DNA, 1432 bp, Flaveria ramosissima
gatcgatcctcaattcatcgtcttcgcatcatcgtcattcaaccatgggttcagatgcagacatggaggattatgggttcgagtactccgaggaggaacctgaggagcaggatgttgacattgagaatcagtattacaattctaaaggtttggttgagactgatccagagggtgcactcagtggttttgctgaagtagttcaaatggaaccagagaaagcagaatggggattcaaagcacttaaacagactgtaaagctttattaccgtttagggaggtacaaagagatgacagatgcttatagggaaatgttaacgtacatcaagtctgcagtgacccgaaattatagtgaaaaatgtataaacaatatcatggattttgtatccggctctgctagtcagaactttggtcttctacaagagttctatcaaaccacattaaaagcacttgaagaagcaaaaaatgagagattatggttcaagacaaatcttaagctttgcaagatctggtttgacatgggtgaatatggtagaatgaataagattttgaaggagcttcacaaatcttgtcaacgggcagatggtactgatgatcaaaagaaaggaactcagttattggaagtgtatgcaattgagattcaaatgtacactgagacaaaaaataacaaaaaacttaagcaactttaccaaaaagcacttactataaaatcagcaattcctcatcctaggatcatgggtatcatacatgagtgtggaggcaaaatgcacatggcagaacgccaatgggcagaagcagctaccgacttttttgaagcttttaaaacttatgatgaagctggaaatcaaagaagaattcagtgtcttaaatacttggtactagccaacatgcttatgcaatccgaggtcaatccatttgatgggcaagaggcaaagccatacaaaaatgatccagaaatcttggcaatgacgaacttgattgcagcatatcaacgcaatgaaatattgggaatttgagaagatactgaagagtaacagaagaaccatcatggatgacccctttatcagaaattatattgaagatcttctgaaaaacatcagaactcaagtgttacttaagctcatcaaaccatacacaagaatcggaattccctttatatcgaaggagcttaatgtgccagaggctgatgtggagcagctgttagtttcactgatattggataatcgggttcaaggtcatatcgatcaagttaacaggctgctggagtgtggggacaggtcaaagggaatgaagaaatacactgctgtggagaaatggaacacacaacttaggtcactttatcaaagtgttagcaacagagttggttgagaagttaagaatattaacttttgatgagagattgtttattttacttgtgacattttttgtttatcat

SEQ ID NO: 3160 - DNA, 1684 bp, Glycine max
gaatgcttagtagtgcaatgaatcgaagctgaaacaaacgctctatcccattactccttcgcttcactcaccggattctcactctcaactcatataccaactcggagtttcggtcttaccgtttccgattcaaaaccctaactcggatcctcaaactcagttgatttcatacaacatggcttcggatgctgatatggaggactatggatttgagtactcagatgaggagcaagaggagcaagatgttgatattgagaatcaatattacaattcaaaaggtttggttgaaactgatccagaaggtgcactttctggttttgctgaggtagtacgcatggaacaggagaaggcagaatggggatttaaagctctaaaacaaactgtgaagctttattatagacttggaaggtataaagagatgatggaagcctaccgggagatgttgacttacattaaatcggcagttactcgtaactatagtgaaaaatgcataaacagcattatggactatgtctctggttcagctagtcagaactttggccttctgcaggaattctatcagacaacactgcaagcccttgaagaagcaaagaatgagagattatggtttaagacaaatcttaagctttgtaagatcttctttgatattggggaatatgggcggatgagtaagatattgaaggaacttcacaaatcttgtcaaagggaagatggtacagatgatcacaagaaaggaacccaacttttggaggtttatgcaatagaaattcaaatgtacacagagatgaagaacaacaaaaaactcaagcaactttaccagaaagcactcactattaagtcagcaattccccatccgcggataatgggaataatccatgaatgtggagggaaaatgcatatggcagagcgccagtgggctgaagcagctacagatttttttgaagcttttaagaattatgatgaagctgggaatcataggcgtatccaatgcttgaagtaccttgttcttgccaacatgttgatggagtctgaagtaaatccgtttgatgggcaggaggctaagccatacaagaatgaccctgaaattttggcaatgacaaatttgatagcagcctatcagcgtaatgaaatattggaatttgagaaaatcttgaagagtaacagaagaaccatcatggatgatccatttatcagaaactacattgaggatctgctaaagaacatcagaactcaagtcttgctgaagctcatcaaaccatatacaaggatcaggatcccatttatatccaaggaacttaatgtgcctgagcatgatgttgagcagctactggtgtcgcttattttggataacagaattcaaggacacattgatcaagtcaaccggctcttagaacgctctgataggtcaaaaggaatgaaaaagtatactgccgtagacaaatggaacacacaacttaaatctctttaccaaactatcagcaacagagttggttaaaccgtggtgtctaacgggagagttatctgttttattgtccccgctgcagttttgttatgtgaattaatgtatctattatggagagttagggatgtgtattgcaccaatagtgaaccaaagcgagacccaacttgtgattcatgttctattttataaaatataattgtttgaaacattcacgattgattc

SEQ ID NO: 3161 - DNA, 1726 bp, Glycine max
gccaaacagtgtaaataatagttttgctgagttttgaaatgaatgcttagtagtgcaatgaatcgaagctgaaacaaacgctctatcccattactccttcgcttcactcaccggattctcactctcaactcatataccaactcggagtttcggtcttaccgtttccgattcaaaaccctaactcggatcctcaaactcagttgatttcatacaacatggcttcggatgctgatatggaggactatggatttgagtactcagatgaggagcaagaggagcaagatgttgatattgagaatcaatattacaattcaaaaggtttggttgaaactgatccagaaggtgcactttctggttttgctgaggtagtacgcatggaacaggagaaggcagaatggggatttaaagctctaaaacaaactgtgaagctttattatagacttggaaggtataaagagatgatggaagcctaccgggagatgttgacttacattaaatcggcagttactcgtaactatagtgaaaaatgcataaacagcattatggactatgtctctggttcagctagtcagaactttggccttctgcaggaattctatcagacaacactgcaagcccttgaagaagcaaagaatgagagattatggtttaagacaaatcttaagctttgtaagatcttctttgatattggggaatatgggcggatgagtaagatattgaaggaacttcacaaatcttgtcaaagggaagatggtacagatgatcacaagaaaggaacccaacttttggaggtttatgcaatagaaattcaaatgtacacagagatgaagaacaacaaaaaactcaagcaactttaccagaaagcactcactattaagtcagcaattccccatccgcggataatgggaataatccatgaatgtggagggaaaatgcatatggcagagcgccagtgggctgaagcagctacagatttttttgaagcttttaagaattatgatgaagctgggaatcataggcgtatccaatgcttgaagtaccttgttcttgccaacatgttgatggagtctgaagtaaatccgtttgatgggcaggaggctaagccatacaagaatgaccctgaaattttggcaatgacaaatttgatagcagcctatcagcgtaatgaaatattggaatttgagaaaatcttgaagagtaacagaagaaccatcatggatgatccatttatcagaaactacattgaggatctgctaaagaacatcagaactcaagtcttgctgaagctcatcaaaccatatacaaggatcaggatcccatttatatccaaggaacttaatgtgcctgagcatgatgttgagcagctactggtgtcgcttattttggataacagaattcaaggacacattgatcaagtcaaccggctcttagaacgctctgataggtcaaaaggaatgaaaaagtatactgccgtagacaaatggaacacacaacttaaatctctttaccaaactatcagcaacagagttggttaaaccgtggtgtctaacgggagagttatctgttttattgtccccgctgcagttttgttatgtgaattaatgtatctattatggagagttagggatgtgtattgcaccaatagtgaaccaaagcgagacccaacttgtgattcatgttctattttataaaatataattgtttgaaacattcacgattgattcaa

SEQ ID NO: 3162 - DNA, 2291 bp, Amborella trichopoda
agaaaacggggaccagtgcgtcatttgaaaaattagtctcctttttagctcccttccgcttccattctcttctctcccctgaactccctgtcctcggatcttcacttttctctcttaattttgtttaccataattttttattcaatatttccattgttagaaacatcttcaagctggccctcatctgaaaagccttagggctcagaagcaatgggttcggatgcagatatggaggattatgggttcgagtactcggaggaggaacctgaagagcaagatgtggatattgagaaccagtattacaactccaaaggattggtggagtctgatcccgaaggagctcttgctggatttgctgaagtagttcgaatggagcccgagaaggctgactggggattcaaggctctgaagcaaacggttaagctctattatcgactggggaggtataaagagatgatggatgcatacagggatatgttgacatatattaaatcggctgtaactcgaaattatagcgagaaatgcataaacaacattatggactttgtttctggctcagcaagccagaactttgaccttttgcaagaattttatcagaccacactgaaggcgcttgaagaatcaaagaatgagagactttggtttaagacgaatcttaagctttgcaagatatggtttgacatgggtgaatatgggcgcatgaataagattctgaaggagcttcacaaatcttgtcgaagagaagatgggtctgatgatcagaagaaaggcactcaactgttggaggtctacgctattgaaatccagatgtacactgaaacaaagaataacaaaaaactcaagcaattgtacaacaaagctctctctataaagtcagcaataccccatcctcggatcatgggaatcattcatgaatgtggtggaaaaatgcatatggcggaaagacaatgggcacaagcagccacagatttttttgaggctttcagaaactatgatgaagccgggaatcagcggcgaattcagtgccttaagtatttggttctggccaacatgctaatggaatctcaagtaaaccctttcgatggccaagaagccaagccatacaaaaatgatccagaaatattggcaatgacaaatctcgtggcagcataccagcgtaatgagattttagagttcgagaaaatattgaagagcaatagacgaacgattatggatgatccatttgtccggaattatattgaagatctcttgaaaaatatcagaacccaggttctacttaagctcatcaagccatacacgagaattcgaattccattcatatcaaaggagcttaatgtgccggaaaaagatgttgagcagctcctggtttccctcattttggacaaccgcattaatggccatattgaccaagttaaccgacttttagaacggggtgacaggtcaaaggggatgaagaaatatacagccatagagaaatggaatactcagcttagatcattgtaccaaacagtcaccaatagaataggttgagactcaaaaagttccaatttttatcagaggaccaatttttatccgtcctgagcttcattttttggattataattagagcatgtcaaaaaacagaacctgttgctggtaggggaagttgtgggtgtatttgattgtgtatagctagtgagagaaaatagaattgtaagcttatttgcgggcgaggttttttttttttcaattttttttttagtatatatcccacaacattacaattgatcagaagagtagtattatttgaaatactaccattgattgtcatgtgcaagtatgcatttttttttaacattgcaaatggcttatcacacaggggggatggatagagtggggaggaagaataacattcaaaggggcagaaaaaaaaaggtggggaaggaagaataggtgtcttttgattagccgttgtttgttataatcactgaatatgatgtggatttggtaattcttatttattgtgttaaatcaatattcttatattaaatgaatatggaacttgtgtctgattaatatatgggtggggttagccttatggcctagctgtatgttaagaagtaaagttgcaccttaaaattttgttagaaaatgcagccataaaaccggaaacttgagtgcttgaaaatctatttttgctcttgatcatgaaatttgaagatccaaaaagtaatgctattgataattgggaaaaggttttgatgatgatgataatttttcaggcggaaagagataagggccactatattata

SEQ ID NO: 3163 - DNA, 1610 bp, Manihot esculenta
caataatggctatgcgcagatgcggatatggaggattatgggttcgagtactcggacgaggagcctgaggaacaggacgtcgacattgaaaaccaatattacaactccaaaggtatggttgaaacagacccagaaggagcgcttgcaggttttgctgaagttgttagcatggagccagagaaggcagaatggggattcaaagcactgaaacaaactgttaagctttattaccgtttggggaagtacaaagaaatgatggtttcttatagagaaatgcttacatacattagatcagcagtcacccgcaactacagtgagaaatgtataaacaacatcatggacttcgtttctggatcagctagtcagaattttggcctcctgcaagaattttatcaaaccaccttgagagccctggaagaagcaaagaatgagagactttggttcaaaacaaatcttaagctctgcaagatatggtttgatatgggtgaatacgggcggatgagcaagattctgaaagaactccacaagtcttgtcaacgagaagatggtacagatgaccaaaagaaaggcagtcaacttctggaggtatacgcaattgagattcaaatgtacactgaaaccaagaacaacaaaaagcttaagcaattataccaaaaagcacttgcaatcaagtcagcaattccacatccaagaataatggggataattcgagaatgtggtgggaagatgcatatggcagaacgtcaatgggctgaagcagcaacagatttttttgaagcttttaagaattatgatgaagctgggaaccaaagacgtatacagtgcctaaaatacctggttctggctaatatgctgatggaatctgaggtgaatccatttgatggtcaagaggcaaaaccatataaaaatgaccctgagattttggcaatgacaaacctcatagcagcatatcaacgaaatgaaatattggagtttgagaaaatcctgaagagtaacagaaggacaataatggatgatccattcattcggaactatattgaagatctgttgaagaatgttagaactcaagtgctgctgaagcttattaaaccttatacaagaattcggattcctttcatatccaaggagctaaatgtgccagaaaaagatgttgagcagctgttggtttcactaatattggataaccgtattgatggacatattgatcaagtgaaccgactattagagcgtggagacaggtcaaaaggaatgaagaagtatactgccatcgagaaatggaacacacaacttagatcactttatcaagctgtcagcaaccgtgttcactgagatcgtgtcaataggtagtgtgactaccatctggagaaggtacttaactttttattttggtggtattgacaacggaacttttctcgctcttgtgagaccacagggtcatagaagctacttcctgaagcattaaaattgtgtgcttttatagctgatgcattttgatgaaaatgagggtagagtgtataatagaatactcatagttttgatactgagaaaataccagacgtggattctgacagctttcgtgcattttatttacatttttgtttgttggtttg

SEQ ID NO: 3164 - DNA, 1474 bp, Castanea mollissima
ccggattctagaacctctctcagtctctgctctccgatcgatttcgagttagagagagagagagagcgaaagagagccctaagaatacgaaagccctaaacacgatctttaagcacctccatcgacaatgggttccgatgcggacatggaagattacggatttgagtactcggaggaggagcaagaggagcaagatgttgacattgagaatcaatactacaatgcaaaaggtttggttgaaactgatccagaaggtgcattggctggtttttctgaagtagtacacatggaggcagagaaggcagagtggggatttaaggctctaaaacaaacagtcaagctttattatcggttagggaagtatgaagaaatgatgcaagcgtatcgggaaatgttgacctacattaagtcagctgtgacacgaaactatagtgaaaaatgtataaatagcatcatggattttgtttctgggtcagctagtcagaactttgggcttttgcaagagttctaccagacaacattgaaggcccttgaagaagcgaaaaatgagagactatggtttaaaacaaatctcaagctttgcaagatttggtttgacatgggtgaatatgggcggatgagtaagattttgaaggagcttcacaaatcttgtcgaaaagaagatggtagtgatgaccacaagaaaggaacccaacttttggaggtatacgcgatagagattcaaatgtacactgagaccaagaataacaagaaactcaagcaactttatcaacaagcacttatgatcaaatcagccataccccatccaaggataatggggataattcacgaatgcggaggtaaaatgcacatggcggagcgccagtgggcagaagcagctactgatttttttgaagcttttaaaaactatgatgaagctggaaatcagcggcgaatccaatgcttgaaatatctggttcttgccaacatgctgatggagtctgaggttaatccattcgatgggcaggaggctaagccatacaaaaatgacccagaaattttggcaatgacaaatctaatagcagcctatcaacggaatgaaatattggaatttgagaaaatcctgaagagtaacagaagaactattatggatgatccatttatcagaaattatatcgaggatcttttgaaaaatattagaactcaagtcctgctcaagctcatcaaaccttatacaaggatcaggatcccattcatatctaaggagcttaatgtgcctgagcaagacgttgagcagctgttggtgtcactaatattggataacagaatccatgggcacatagatcaagtgaaccggctgctagagcgctgggacaggtcaaagggaacaaagaagtatgctgctgttgagaaatggaatacacagctaaagtctctctaccaaactatcaacaatagagtttgttaggatttgtttataaggttaaaaaaaaag

SEQ ID NO: 3165 - DNA, 1810 bp, Cicer arietinum
aaaacgtgctttcgaaaattaatttccgatagtgtattatcttgtgcgaaaaaatgaagttcatacctttttttccctttgttttctataattggtaagaaacaagcccaaattgtatataggttcgaaagtggatttgggctaagaagcataagcttactctccacatcacccattgcaatttacattacattacaccttctctgtttcgtttaatttcatttcttccttatgcaattctcttcactgcctcaccgggttccaagttttccctctcgcaccttatagttatagactaactcgttgttgctggctcaccacttccaactataaaaccctaactcggatcctcaaactcaatcgatttcccacaatcatggcttccgatgctgatatggaggactatggatttgagtattctgatgaggagcaagaggaacaagatgttgatattgagaatcaatattacaattcaaaaggtttggttgaaactgatccagaaggtgcactttccggttttgccgaggtagtgcgcatggaacaagacaaggcagaatggggatttaaagctctgaagcaaactgtcaagctttattatagacttggaaggtataaagagatgatggaagcctacagggagatgttgacatatatcaaatcagcagtgacccgtaactacagtgaaaaatgcataaacagcattatggactatgtgtcaggttcggctagccaaaattttggccttttgcaggaattctatcaaacaactctgaaagcccttgaagaagcaaaaaacgagagattgtggtttaagacaaatcttaagctttgtaagattttctttgacatcggggaatatggacggatgagtaagatccttaaggaacttcacaaatcttgtcaaaaagaggatggtacagatgaccataagaaaggaactcaacttttggaggtttatgcaatcgaaattcaaatgtatacagagaccaagaacaacaaaaaactcaagcaactttaccagaaagcacttactattaagtcagcaattccccatccaaggataatgggtataatccatgaatgcggggggaaaatgcatatggcagagcgccagtgggctgaagcagctacagatttctttgaagcttttaaaaattatgatgaagctgggaatcagaggcgtatccaatgcttgaagtacctcgttcttgccaacatgttgatggagtctgaagttaatccatttgatgggcaggaggctaagccatacaagaatgaccctgaaattttggcaatgacaaatctcatagcagcctatcaacgaaatgaaatattggagtttgagaaaatcctcaagagtaacagaagaaccatcatggatgatccatttatcagaaattacattgaggatttactaaagaatatcagaacacaggtcttgctgaaactcatcaaaccatatacaaggatcaggatcccatttatatctaaggaacttaatgtacccgagcatgatgttgagcagctactggtgtcgcttattttggataatagaattcaaggacacattgatcaagtgaaccggctcttggaacgctctgacaggtcgaaaggaatgaagaagtatacggctgtggacaaatggaacacacaacttaaatcactttatcaaactatcaacaacagagttggttaaaccatagtgtctggtataaggattatctgttttgttgccccggtttacagttttgtcatgtgaatgaatgtaacctaggctgtatgaagtaagggctgtattactctatggtgg

SEQ ID NO: 3166 - DNA, 1962 bp, Cicer arietinum
tttcatttcaaaagcgataaattgagtgaattaccttaccaaaaacgtgctttcgaaaattaatttccgatagtgtattatcttgtgcgaaaaaaatgaagttcataccttttttttccctttgttttctataattggtaagaaacaagcccaaattgtatataggttcgaaagtggatttgggctaagaagcataagcttactctccacatcacccattgcaatttacattacattacaccttctctgtttcgtttaatttcatttcttccttatgcaattctcttcactgcctcaccgggttccaagttttccctctcgcaccttatagttatagactaactcgttgttgctggctcaccacttccaactataaaaccctaactcggatcctcaaactcaatcgatttcccacaatcatggcttccgatgctgatatggaggactatggatttgagtattctgatgaggagcaagaggaacaagatgttgatattgagaatcaatattacaattcaaaaggtttggttgaaactgatccagaaggtgcactttccggttttgccgaggtagtgcgcatggaacaagacaaggcagaatggggatttaaagctctgaagcaaactgtcaagctttattatagacttggaaggtataaagagatgatggaagcctacagggagatgttgacatatatcaaatcagcagtgacccgtaactacagtgaaaaatgcataaacagcattatggactatgtgtcaggttcggctagccaaaattttggccttttgcaggaattctatcaaacaactctgaaagcccttgaagaagcaaaaaacgagagattgtggtttaagacaaatcttaagctttgtaagattttctttgacatcggggaatatggacggatgagtaagatccttaaggaacttcacaaatcttgtcaaaaagaggatggtacagatgaccataagaaaggaactcaacttttggaggtttatgcaatcgaaattcaaatgtatacagagaccaagaacaacaaaaaactcaagcaactttaccagaaagcacttactattaagtcagcaattccccatccaaggataatgggtataatccatgaatgcggggggaaaatgcatatggcagagcgccagtgggctgaagcagctacagatttctttgaagcttttaaaaattatgatgaagctgggaatcagaggcgtatccaatgcttgaagtacctcgttcttgccaacatgttgatggagtctgaagttaatccatttgatgggcaggaggctaagccatacaagaatgaccctgaaattttggcaatgacaaatctcatagcagcctatcaacgaaatgaaatattggagtttgagaaaatcctcaagagtaacagaagaaccatcatggatgatccatttatcagaaattacattgaggatttactaaagaatatcagaacacaggtcttgctgaaactcatcaaaccatatacaaggatcaggatcccatttatatctaaggaacttaatgtacccgagcatgatgttgagcagctactggtgtcgcttattttggataatagaattcaaggacacattgatcaagtgaaccggctcttggaacgctctgacaggtcgaaaggaatgaagaagtatacggctgtggacaaatggaacacacaacttaaatcactttatcaaactatcaacaacagagttggttaaaccatagtgtctggtataaggattatctgttttgttgccccggtttacagttttgtcatgtgaatgaatgtaacctaggctgtatgaagtaagggctgtattactctatggtggaaccaaagttaaacccaacttgtcatttttgttttactttatgaaaatataattgtttgaaattgatgattgtggtcataattattatcatttaatcctttcttttact

SEQ ID NO: 3167 - DNA, 1763 bp, Quercus alba
ctctcgagttccaaataaggccttgatgttgcccaagccccaaacccggaaccgagcattaaaaacagtagtataaattaaaaatcacaaaccgggcatcttcaccggtttctagaacctctctcagtctctgctctccgatcgatttcgagttagcgagagagagagaaagagagccctaagaatacgaaagccctaaacacgatctctaagcacctccatcgacaatgggttccgatgcggacatggaagattacggatttgagtactcggaggaggagcaagaggagcaagatgttgatattgagaatcaatactacaatgcaaaaggtttggttgaaactgatccagaaggtgcattggctggtttttctgaagtagtacacatggaagcagagaaggcagagtggggatttaaggctctaaaacaaactgtcaagctttattatcggttagggaagtatgaagaaatgatgcaagcctatagggaaatgttgacctacattaagtcagctgtgacacgaaactatagtgaaaaatgtataaatagcatcatggattttgtttctgggtcagctagtcagaactttgggcttttgcaagagttctaccagacaacattgaaggcccttgaagaagcgaaaaatgagagactatggtttaaaacaaatctcaagctttgcaagatttggtttgacatgggtgaatatgggcgaatgagtaagattttgaaggagcttcacaaatcttgtcgaaaagaagatggtagtgatgaccacaagaaaggaacccaacttttggaggtatacgcaatagagattcaaatgtacactgagaccaagaataacaagaaacttaagcaactttaccagcaagcacttatgatcaaatcagccataccccatccaaggataatggggataattcatgaatgcggaggtaaaatgcacatggcagagcgccagtgggcagaagcagctactgatttctttgaagcttttaaaaactatgatgaagctggaaatcagcggcgaatccaatgcttgaaatatctggttcttgccaacatgctgatggagtctgaggttaatccattcgatgggcaggaggctaagccatacaaaaatgacccagaaattttggcgatgacaaatctaatagcagcctatcaacggaatgaaatattggaatttgagaaaatcctgaagagtaacagaagaactattatggatgatccatttatcagaaattatatcgaggatcttttgaaaaatattagaactcaagtcctgctcaagcttatcaaaccttatacaaggatcaggatcccattcatatctaaggagcttaatgtgcccgagcaagacgttgagcagctgttggtgtcactaatattggataacagaatccatgggcacatagatcaagtgaaccggctgctagagcgctgggacaggtcaaagggaacaaagaagtatgctgctgttgagaaatggaatacacagctaaagtctctctaccaaactatcaacaatagagtttgttaggatttgtttataaggtaaaaaaaaaagggtggcgtttttccattcccccacttggtgtttttgtgatgtaatattgagatgacagttatcctctaccaaggcaaattacctgaacaatttgttgattattacatttatcataactatcttttaatgaaagtttttaagggctaaacccatactttatactaggcatttacgtatttgataagcaaa

SEQ ID NO: 3168 - DNA, 1718 bp, Trigonella foenum-graecum
tgggctaagaaacctaacaccactctacacatcacacacttccttcttaattcattctctcactctttcctttctcattctcttcgctccctcaccgggttcttattttccccctcacacctcaactcggtgttgttaattcaccacttcaactataaaccctaactcgggtcctcaaactcaatcgatttcacacaaccatggcgtccgatgctgatatggaggactatggatttgagtactcagatgaagaacaagaggagcaggatgttgatattgagaatcaatattacaattcaaaaggtttggttgaagctgatccagaaggcgcactttctggtttttccgaggtagtgcgcatggaacaagacaaggcagaatggggatttaaagctctgaaacaaactgtcaagctttattataaacttggaaggtataaagagatgatggaagcctacagggagatgttgacatatatcaaatcagcagtgacccgtaactatagtgaaaaatgcataaacagcattatggactatgtctctggttcagctagccagaatttcggccttctgcaggaattctaccaaacaactctgagagcccttgaagaagcaaagaatgagagattgtggtttaagacaaatttgaagctttgtaagattttttttgacattggggaatatggacggatgagtaagatccttaaggagcttcacaagtcttgtcaaagggaggatggtacagatgaccataagaaaggaactcaacttttggaggtttatgcaattgaaattcaaatgtacacagagaccaagaacaacaaaaaactcaagcaactttaccagaaagcacttactattaagtcagcaattccccatccaaggataatggggatcatccatgaatgtggagggaaaatgcatatggcagaacgccagtgggctgaagcagctacagatttctttgaagctttcaagaattatgatgaagctgggaatcagaggcgtatccaatgcttgaagtacctcgttcttgccaacatgttgatggagtctgaagtaaatccatttgatgggcaggaggctaagccatataagaatgaccctgaaattttggcaatgacaaatctgatagcagcttatcaacgaaatgaaatattggaatttgagaaaatcttgaagagtaacagaagaaccatcatggatgatccatttatcagaaattacattgaagatctgctaaagaatatcagaacacaggtcttgctgaaactcatcaaaccttatacaaggatcaggatcccatttatatctaaggaacttaatgtacctgagcatgatgttgagcagctactggtgtcgcttattttggataacagaattcaagggcacattgatcaagtgaaccggctcttggaacgctctgataggtccaaaggaatgaagaagtatacggctgtggataaatggaacacacagcttaaatctctttatcaaactatcaacaacagagttggttaaaccatactgtctgctgtaaggatgatctgttttgttgccctgatttgcagttttgtcatgtgaattaatagacgtaggctgtatggagtagggggtttattactctatggtggaaccaaagtgaaatccaacttgtgattcttgttttactttatgaaaatatgattgtttgaaattgatgatcgtaattataattat

SEQ ID NO: 3169 - DNA, 1449 bp, Vinca minor
atcttattattgctctcttcactctttgaaatcatgggttccgatgtagatatggaggattacggattcgagtactcagacgaagagccagaggagcaggacgttgatattgagaaccaatattacaattccaaaggcatggtcgaaacggatcccgaagcagcacttgaaggtttcgctgaagtagttcgtatggaacctaacaaggctgactggggatttaaggctttgaaacaaacagtgaagttgtattataagttagggaagtatgaagagatgatggatgcatacagagatatgctaacttatataaaaacggcagtgacaagaaattacagtgagaagtgtattaataatatcatggattttgtctctggctctgctagccagaacttcagtcttcttcaggaattttatcagacaactttgaaggcacttgaagaggcaaagaatgagaggctttggttcaagacgaatctaaagctttgtaagatctggtttgatatgggagaatatggtagaatgaacaagattttgaaggaactccacaagtcttgtcaaaaagaagatggcactgatgatcagaagaagggaacacaactgttggaagtttatgccattgaaattcaaatgtacactgcgacaaagaataacaagaaactcaagcaactataccaaaaggctttgtctatcaagtctgcaatacctcatccaaggattatgggcataatccgtgaatgtggtgggaaaatgcacatggcagagcggcagtgggcagaagcagcaactgacttctttgaagctttcaaaaattatgatgaggccggataccagcgacgaatccagtgccttaagtacttggttctggctaatatgctgatggaatctcaggtcaacccgttcgatggtcaagaagcaaaaccgtataagaacgacccagagattttggctatgacgaatcttatagcagcatatcaacggaatgaaatattggagtttgagaaaattctcaagagtaatagaaggaccataatggatgatccattcattcgaaactatattgaagatcttctcaagaatgtcagaacacaagtattgctcaagctcataaaaccttatactaggattcggatacccttcatatcaaaggagctgaacgtgccagagaaagatgttgaggatttgctggtttcccttatcttggataatcgtatccacgggcatattgatcaagtgaaccggctactggaacgtggtgacagttcaaagggaatgaaaaagtatgctgccgtagacaagtggaacacacagctgaggtctctctaccaaactgtgtccaaccgagtctgttgagattgctttctcatacgaaaaacggcctttgcttttgtatcacagcccgagtgtgaatagcagagtgagtatttattggagatatctattcatgtt

SEQ ID NO: 3170 - DNA, 1586 bp, Solanum tuberosum
caactctctcttcatccacagctcaaaaatctccccattaaatcttttcagtcttctctaatcagccatgggctctgatgcagatatggaggactatggattcgagtattcggaggaggagcctgaagagcaggatgttgatattgagaaccaatactacaactccaaaggcttggctgaaacagacccagaggcagcacttgagggatttgctgaagtagttcatatggaacctgagaaggctgattggggatttaaagccttgaagcaaactgttaagctttactataagctagggaagtacaaggaaatgatggatgcttacagagaaatgctaacctacatcaagtcagcagtgacaagaaattatagcgaaaagtgtataaacaatatcatggatttcgtctcaggatcagctagtcagaactttgatctcctacaagagttctaccagacaacattgaaagcccttgaagaggcaaaaaacgagaggttgtggttcaagacaaatctaaaactttgcaaaatatggtttgacatttgggagtatggacgaatgaataagattttgaaacaactccacaaatcttgtcaaaaagaagatggtactgatgaccagaagaaaggtacacaattgttggaggtatatgcaatagagatccaaatgtacacggagacgaaaaataacaaaaaactgaaggaactatacactaaagcactttcagtcaagtcagcaatccctcaccctagaataatgggaataattcgtgaatgtggaggaaaaatgcatatggcagagcggcagtgggcagaggcagctacagacttctttgaagctttcaagaactatgatgaagctgggaaccagaggcgcattcagtgtctaaagtacttggttctggcaaatatgctgatggagtctgaggttaacccctttgatggccaagaagcaaaaccgtacaaaactgaccctgagatactggcaatgactaaccttatagcagcatatcaacgaaatgagatcttagagtttgagaaaattcttaagagtaatagaagaacaataatggatgatcccttcatcagaaattacattgaagatcttttaagaaatgtcagaacccaagtgctgctgaagatcattaagccttacacaagaatccggattcccttcatttccaaggagcttaatgtgccagaaaaagacgtcgaggagttgttggtctcactcatcttggacaaccgtatccatgggcacattgatcaagtgaaccggttgctagaatgtggagatagatcgaaaggaatgaagaaatacgctgccatcgacaaatggaacacacaacttaggtctttgtaccaaactgttggcaacagagtatgttgatattacctggacatgaaaaaaagctctgtgtgattatattatggactcattatttagctcctctgttcaacatgtagattttttgtacaaaattcgatatttctctctgtttaagtagcaagagcttctatctgatttatgttactctttgtttctatactgcgacagaaacagcatgctaagataactttgtctatct

SEQ ID NO: 3171 - DNA, 2094 bp, Pseudotsuga menziesii
aagaagttcgaatgattctctaatcgaacaaaatcgtatttttttctcgtctgttttcctccatcacaaccaaggcagcgatacactggattttcagctttgattcgccgctaattcttgccctgccccctagcagggtccagcgaccatgggttcagacgcagatatggaagattacggatttgaatactcggaagaagaaacagaagagcaggacgtcgacattgaaaatcagtattacaactccaaaggtttggtggagtctgacccgcaggaagctcttgctggctttgctgaagtagtgagaatggaacctgaaaaagccgaatggggatttaaggctttgaaacaaactgtcaagttgtactaccgccttggaaaatacaaagagatgatggattcttatcgtgtaatgctgacatatattagatcagcagtaacacggaactacagtgaaaaatgtataaacaacatcatggattttgtttctggttctgccagtcagaacttcgaactccttcaggagttttatcagactacactcaaggcccttgaagaagcaaaaaatgagaggctttggttcaagaccaatctcaagctttgcaagattttttttgatatgggagaatatggtcgcatgaacaagatactcaaggagcttcacaaatcttgccgtagagaagatggttcagatgaccagaagaaaggcactcaactcttggaggtttatgcaatagagattcaaatgtacactgagacaaaaaacaataaaaagttgaagcaattgtaccaaaaggctctttctattaaatctgcaatacctcatccccgtattatgggcattatccatgaatgtggtgggaaaatgcatatggctgaacggcaatgggcagaggcagcgacagacttctttgaagcattcaaaaactatgatgaagctggaaatcatcgacgcattcaatgtttgaaatacttagttcttgcaaacatgttgatggaatctgaagtgaatccttttgatggtcaagaggcaaagccgtacaaaaatgatccagagattctggcaatgaccaatcttgtagcagcgtaccagaggaatgaaatattagagtttgaaaagattctgaagagtaacaggaggacaattatggatgatccatttattcgcaactatattgaagatttattgaaaaacattagaacgcaagtactgctgaaactcatcaagccatatacacgcatccgtataccttttatatctaaggagctaaatgttccagagaaagatgttgaacagcttttagtatctttgattttggataaccgagttcatgggcatattgatcaggtcaaccaacttttggaacttggtgataggtccaaagggttaaagaagtatgtggcaatagacaaatggaatacacaactaaggtccctgtaccagactgtaacaaacaagatgggatgaatgtggatccctttagatgcattgtagccataatgagatcttgttgagttgcactgttttctgggtcccgatctcttatatgtggagcttgcttgatgtacatttgtacttttgagttgagtatttttcagactatggaatggaagatccttttgaaaggaaatgtatccagaagcatcagagaaacattaattatgagcctcaaaagatttcctctttgtacgaggagcaaaacttttgcgcttcctggatgagtttgctgattattttcattgtgaggttatagtaataaagcagcattcaggtggattactgtggcacgatattttattggctggaatagtaggtgaggatattacaatttaatgggtgtttgacagtttttccatccacaattgtaaaagcataccaagcaccttctactgataggttgcatgtatgtgtatgcaatttgtatcaatggcggttatatcttcagtgaagttttttttctaatatgtattttccattgacgtgttatatcttgaatcagtaagttgagttctaataggcatttatccataattaaggaagacttgtgaagaaagcagcattcagtacttgctagaatctggtaagagaataca

SEQ ID NO: 3172 - DNA, 2132 bp, Picea glauca
ttaattaaattatcccccccccccccgaaaacatttatgaccaagcccctgcgttttaagcaccgtgacgtgaccacggaccgaaagctcttcatagttcacaaaatcgacaccggaacgtcaagtgttggatagatatacacaaactctcaacatccatgatggatgcacaggcgcaagaagttcgatgattctctaatcgagcaaaatcatattttcttcctcctctgatttcctccgtcacaaaccaaggcagcgatacacagttttttcggctttgattcgcagctagttcctaccctgccccggtagcagggtccagcgaccatgggttcagacgcagatatggaagattatggatttgaatactcggaagaggaaacagaggagcaggacgtggacattgaaaatcagtattacaactccaaaggtttggtggagtctgacccacaggaagctcttgctggctttgctgaagttgtgaaaatggaacctgaaaaagcagaatggggatttaaggctttgaaacaaactgtgaagttgtactaccgccttggaaaatacaaagagatgatggattcttatcgtgtaatgctgacatatattagatcagcggtaacacggaactacagtgaaaaatgtataaacaacatcatggattttgtttctggttctgccagtcagaacttcgaactccttcaggagttttatcagactacactcaaggcccttgaagaagcaaaaaatgagaggctttggtttaagaccaatctcaagctttgcaagattttttttgatatgggagaatatggccgcatgaacaagatactcaaggagcttcacaaatcttgccgtagagaagatggttcagatgatcagaagaaaggcacccaactcttggaggtttatgcaatagagattcaaatgtacactgagacaaaaaacaataaaaaattgaagcaattgtaccaaaaggctctttctattaaatctgcaataccccatccccgtatcatgggcattatccatgaatgtggtggaaaaatgcatatggctgaacgacaatgggcagaggcggcaacagacttctttgaagccttcaaaaactatgatgaagctggaaatcatcgacgcattcagtgtttgaaatacttagttctggcaaacatgttaatggaatctgaggtgaatccttttgatggtcaggaggcaaagccgtacaaaaatgatccagagatcctggcaatgaccaatcttgtagcagcgtaccagcggaatgaaatattagagtttgaaaaaatcctgaagagtaacaggaggacaattatggatgatccatttattcgaaattatattgaagatttactgaaaaacattaggacgcaagtgttgctgaaactcatcaagccatatacacgcatccgtataccctttatatctaaggagttaaatgttccggagaaagatgttgagcagcttcttgtatccttaattttagataaccgagttcatgggcatattgatcaggtcaaccaacttttggaacttggtgataggtccaaagggttaaagaagtatgtggcaatagacaaatggaatacgcaactaaggtccctgtaccagactgtaacaaacaagatgggatgaatttggatccctctagatggattgtagccatactgagatcttgttgagttgcactgttttctgggtcacaatatcttatctgtggagcttggttgatgtacattgcatttgtaattttgagttgagtatttttgagactatggaatggaagatccttttgaaaggaatatatgcagaagcatcggaaaaacattaattatgagcctcaaaatttcccctttgtacgaggagcgaaacttttgggctttctggatgagtttgctgattattttcattgtgaggttatagaaataaagcagcattcaggtggattattttggtatgatattttatttgttggaaaagtaggtgaggatattacaatttaatgggtgtttggcggtttttgcatccacaattggaaaaacataccaagcaccatctactgataggatgcttgtatgtatatacaatttgtatcaatgccctttatatcatgagcagag

SEQ ID NO: 3173 - DNA, 1543 bp, Solanum lycopersicum
aaaaacccactactctctcttcacttcatccacagctcaaaaatctcctccattaatcttcgttttcgagtcttctctaatcagccatgggctctgatgcagatatggaggactatggattcgagtattcagaggaggaacctgaagagcaggatgttgatattgagaaccaatactacaactccaaaggcttggctgaaacagacccagaggcagcacttgagggttttgctgaagtagttcgtatggaacctgagaaggctgattggggatttaaagccttaaagcaaactgttaagctttactataagctagggaagtacaagggaatgatggacgcttacagagaaatgctaacctacatcaagtcagctgtgacaagaaattatagtgaaaagtgtataaacaatatcatggatttcgtctcaggatcagctagtcagaactttgatctcctacaagagttctaccaaacaacattgaaagcccttgaagaggcaaaaaacgagaggttgtggttcaagacaaatctaaaactttgcaaaatatggtttgacattggggagtatggacgaatgaataagattttgaaagaactccacaaatcttgtcaaaaagaagatggtactgatgaccagaagaaaggtacacaattgttggaggtatatgcaatagagatccaaatgtacacggagacaaaaaataacaaaaaactgaaggaactatacactaaagcactttcagtcaagtcagcaatccctcacccaagaataatgggaataattcgtgaatgtggaggaaaaatgcatatggcagagcggcagtgggcagaggcagctacggacttctttgaagctttcaagaactatgatgaagctgggaatcagaggcgcatccagtgtctaaagtacttggttctggcaaatatgctgatggagtctgaggttaacccttttgatggccaagaagcaaaaccgtacaaaaatgaccctgagatactggcaatgactaaccttatagcagcatatcaacgaaatgagatcttagagtttgagaaaattcttaagagtaatagaagaacaataatggatgatcccttcatcagaaattacattgaagatcttttaagaaatgtcagaacccaagtgctgctgaagatcattaagccttacacaagaatccggattcccttcatttccaaggagcttaatgtgccagaaaaagacgtcggggagttgttggtctcactcatcttggacaaccgtatcaatgggcacattgatcaagtgaaccggttgctagaatgtggagatagatctaaaggaatgaagaaatacgctgccatcgacaaatggaacacacaacttaggtctttgtaccgaactgttggcaacagagtatgttgatattacctgggcatgaaaaaagctgaatgtgattatattatggactcatttttagctcctctgttcaacatgtagatttttgtacaaaattctatatttctcctccctgcttaagtagcaagcatactgtgacagaa

SEQ ID NO: 3174 - DNA, 1573 bp, Arnica chamissonis
ctcaaccatgggttcagatgcagacatggaggactatggattcgagtactctgaggaggaacctgaagagcaagatgttgacattgaaaatcaatattacaattctaaaggtctggttgagactgatccagagggtgcactcagcggttttgctgaagtagttcagatggaaccagagaaagcagaatggggattcaaggcacttaaacaggactgtaaagctttattaccgtttagggcggtacaaagagatgaccgatgcttatagggaaatgttaacttacattaagtctgcagtgactcgaaattatagtgaaaaatgtataaacaatatcatggattttgtatctgggtctgctagtcaaaactttggtcttctacaagatttctatcaaaccacattaaaagcacttgaagaagcaaaaaacgagagattatggttcaagacaaatcttaagctttgcaagatctggtttgacatgggggaatatggtagaatgaataagattttgaaggagcttcacaaatcttgtcaacgggcagatggtaccgatgatcaaaagaaaggaactcagttattggaagtgtatgcaattgagattcaaatgtacacagagacaaaaaataacaaaaaacttaagcaactttaccaaaaagcacttactataaaatcagcaattcctcatcctaggatcatgggtatcatacatgagtgtggtggcaaaatgcacatggcagaacgccaatgggcagaggcagctactgacttttttgaagcctttaaaaactatgatgaagctgggaatcaaagaagaattcagtgtctcaaatacttggtattggccaacatgcttatgcaatccgaggtcaatccatttgacgggcaagaggcaaagccatacaaaaatgatccagaaatcttggcaatgacaaacttgattgcagcataccaacgcaatgaaatattggaatttgagaagatactcaagagtaacagaagaaccatcatggatgatccgtttatcagaaattatattgaagatcttttgaaaaacatcagaactcaagtgttactcaagctcatcaaaccgtacacaagaatccgaattccctttatatcaaaggagcttaatgtgccagaggctgatgtggaacagctgttagtttcactgatattggataaccgggttcaaggtcatatcgatcaagttaaccggctgctgatgtgtggggacaggtcaaagggaacgaagaaatacactgccgtggagaaatggaacacacaacttaggtcactttatcgaagtgttagcaacagagttggttgagaagtttataacttttgatgagagattgttattttacttttgacattttttgtttatcatgtccaattggtaaaagttggtatctgaacagaacatgaagaggaggatcaatgtgttcaaaaaggggacatttgtgttttttgtttttgctattttgattatttggaacagaacatgaggaggctattatatcatataaaagtagttgcgactgtttaatatataactagttaactatttattag

SEQ ID NO: 3175 - DNA, 2344 bp, Pinus pinaster
ggatggatacacagtgacgcaagaagttcgatgattctctaatcgcacaaaatcgaatttttttcgtttgttttcctccatcacaaccaagacagtgatacacagattttcagctttgattcgcagctaattccttccctgccccagtagcagggtccagcgaccatgggttcagacgcagatatggaagattatggatttgaatactcggaagaggaaacggaggagcaggacgtcgacattgaaaatcagtattacaattctaaaggtttggtggagtctgacccacaggaagctcttgctggctttgctgaagttgtgaaaatggaacctgaaaaagcagaatggggatttaaggctttgaaacaaactgtcaagttgtactaccgccttggaaaatacaaagagatgatggattcttatcgtgtaatgctgacatatattagatcagcagtaacacggaactacagtgaaaaatgtataaacaacattatggattttgtttctggttctgcaagccaaaactttgaactccttcaggagttttatcagactacactcaaggcccttgaagaagcaaaaaatgagaggctttggtttaagaccaatctaaagctttgcaagatattttcgatatgggagaatatggtcgcatgaacaagatacttaaggagcttcacaaatcttgccgtagagaggatggttcagatgaccagaagaaaggcactcaacttttggaggtttacgcaatagagattcaaatgtacactgagacaaaaaacaacaaaaaattaaagcaattgtaccaaaaggctctttctattaaatctgcaataccccatccccgtatcatgggcattatccatgaatgtggtgggaaaatgcatatggctgaacgacaatgggcagaggcagcaacagacttctttgaagctttcaaaaactatgatgaagctggaaatcatcgacgcattcagtgtttgaaatacctagttctggcaaacatgttaatggaatctgaggtgaatccttttgatggtcaggaggcaaagccgtacaaaaatgatccagagattctggcaatgacgaatctcgtagcggcataccagcggaatgaaatattagagtttgaaaaaattctgaagagtaacaggaggacaattatggatgatccatttattcgcaattatattgaagatttactgaagaacattagaacacaagtattgctgaaactcatcaagccatatacacgcatccgtataccttttatatctaaggagctaaatgttccagagaaagatgttgagcagcttcttgtatccttaattttagataaccgtgttcatgggcatattgatcaggtcaaccaacttttggaacttggtgataggtccaaagggttaaaaaagtatgtggcgatagacaaatggaatacacaactaaggtccctgtaccagactgtaacaaacaagatgggatgaatttggatccctctggtggattgtaactatactgggatcttgttgagttgcactgttttctgggtcccaatctctgtggagcttgcttgatgtacaatgtacattgcatttgtacttttgagttgagtatttttcagactatggaatgggagatccttttgaaaggaaatatatgcagaagcatcgaaaaaatattaatgttggtgctagtttgttttgctcttatttctcagtgctcttcctccggattttttttccttgcaatgtcagattgatagcttttgacagctgttgtcttctctggtgtgcagtatgagcctcaaaaaatttccccctttgtacgaggagcgaaacttttgggctttctggatgagtttgctgattattttcattgtgaggttatagaaataaagcagcattcaggtggattactttggtatgatattttgttggctggaaaagtaggcgagtatatgacaatttaatgggtgtttgacagtttttgtgtccacaactggaaaagcataccaagcacctactgataggatgcttgtatgtatatgcaatttgtatcaatgccctttatatcttgagcagcgttttttcaatgtgttttctattgatgcgttatatttcggttcaataatttgagttttagtaggcatctatctacactccataatcaaggaagacttgtgaaggcagcattcaatccttgcttggatcgaggaaaagaatacaggataaaacaaaaagtatgaaggggtaaaacaacttgcttaggaagaatgcttcagatctataaattggggctcattcgaagggattttcaagggatatgcaatcatcctaatcttata

SEQ ID NO: 3176 - DNA, 1516 bp, Ambrosia trifida
actgttcggttttcaaaaccaaaccaaaccctagaaaccactgatcgcttctgctttcatatcgtcactcgatcatgggttcagacatggaggactacggattcgagtactcggaggaggaacccgaagaacaagatgttgacattgaaaatcaatattacaattctaaaggtttggttgagactgatccagagggtgcactcagcggttttgctgaagtagttcagatggaaccggagaaagcagaatggggattcaaagcacttaaacagactgtaaagctttattaccgtttagggaggtacaaggagatgacagatgcttatagggagatgttaacttacattaagtctgcagtgactcgaaattatagtgaaaaatgtataaacagtatcatggattttgtatctggttctgctagtcaaaactttggtcttttacaagagttctatcaaaccaccttgaaagcacttgaagaagcaaaaaatgagaggttatggttcaagacaaaccttaagctttgcaagatatggtttgacatgggtgagtatggtagaatgaataagatcttgaaggagcttcacaaatcttgtcagcgggcagatgggactgatgatcaaaagaaaggaactcagttattggaagtttatgcaattgagattcaaatgtacacagagacaaaaaataacaaaaaactcaagcaactttaccaaaaagcacttactataaaatctgcaattccccatcctaggattatgggtatcatacacgagtgtggtggcaaaatgcatatggcagaacgccaatgggcagaagcagctaccgacttttttgaagcttttaaaaactatgatgaagctgggaatcaaagaagaatacagtgtctcaaatacttggtactggctaacatgcttatgcaatctgaggtcaatccatttgatgggcaagaggcaaaaccatacaaaaatgatccagaaatcttggcaatgacaaacttgattgctgcatatcaacggaatgaaatattggaatttgagaagattctcaagagtaacagaagaaccatcatggatgatcccttcatcagaaattatattgaagatcttcttaagaacattagaactcaagtgctacttaagctcatcaagccatacacaagaatcaggatccctttcatatcaaaggagcttaatgtgcccgaggctgatgtagaagagttgttggtctctctgatattggataaccgggttcaaggtcatatcgatcaagttaataggctgttggagtgtggggacaggtcaaagggaatgaagaaatatactgctgtggataaatggaacacacaacttaggtctctttatcatagtgttgccaacagagttggttgagatgttaaaaattacaagttttgatgaaggattgctatatatcattagcatattttgttatcatgtcaagtggggacattagtatgcacagtgtggagttgatatatagtatcagtcccctttctcaa

SEQ ID NO: 3177 - DNA, 1679 bp, Medicago truncatula
tcctccactctttcctttcccattctcttcactccctcaccgggttcttatatttcccactcactactccaatctataaaaccctaactcggattctctaactcaatcgatttcacacaatcatggcttccgacgctgatatggaggactatggatttgagtactctgatgaggaacaagaggagcaggatgttgacattgagaatcaatattacaattcaaagggtttggttgaaactgatccagaaggtgcactttctggttttgccgaggtagtgcgcatggaacaagacaaggcagaatggggatttaaagctctaaagcaaactgtcaagctttattatagacttggaaggtataaagagatgatggaggcctacagggagatgttgacatacatcaaatcagcagtgacccgtaactatagtgaaaagtgcataaacagcattatggactatgtctctggttcggctagccagaattttggccttctgcaggaattctaccaaacaactctgagagcccttgaagaggcaaagaatgagaggttgtggtttaagacaaatttgaagctttgtaagattttttttgacattggggaatatggtcggatgagtaagatccttaaggaacttcacagatcttgtcaacgagaggatggcacagatgaccataagaaaggaactcaacttttggaagtttatgcaattgaaattcaaatgtacacagagaccaagaacaacaaaaaactcaagcaactttaccagaaagcacttactattaagtcagcaattccccatccaagaataatggggataatccatgaatgtggggggaaaatgcacatggcagagcgccagtgggccgacgcagctacggatttctttgaagcttttaagaattatgatgaagctgggaatcagaggcgtatccaatgcttgaagtatctcgttcttgcaaacatgttgatggagtctgaagtaaatccatttgatgggcaggaggctaagccatacaagaatgaccctgaaattttggctatgacaaatctgatagcagcctatcaacgaaatgaaatattggaatttgagaaaatcctgaagagtaacagaagaaccatcatggatgatccatttatcagaaattacattgaggatttgctaaagaatatcagaacacaggtcttgctgaaactcatcaaaccatatacaaggatcaggatcccatttatatctaaggaacttaatgtacccgagcatgatgttgagcagctactcgtgtcacttattttggataacagaattcaaggacacattgatcaagtgaaccggctcttggaacgctctgataggtcaaaaggaatgaagaagtatacagctgtggataaatggaacacacaactaaaatctctttatcaaaccatcaacaacagagttggttaaaccatactgagattatctggtgtatggattatctgttttgttgcctgactcgcagttttgtcatgtgaattaatagaatgtaggctgtatggagttagggtgtttattacactatggtggaaccgaagtgaaatccaacttgcgattcttgttttactttataaaaaatataattgtttgaaattgatgattgtgatcaaaattatcatttattccttctcggttatttttaactct

SEQ ID NO: 3178 - DNA, 1623 bp, Tripterygium wilfordii
ttatggcttcgagtattcagacgaggagcctgaggaacaagatgttgacatcgagaatcaatattacaactccaaaggtttggttgaaacagatccagaaggagcgcttgcaggttttgctgaagtggttagcatggaacctgagaaggcagagtggggattcaaagcactaaagcaaactgtgaagctctactatcgtttagggaagtacaaagaaatgatgaatgcttacagggagatgttaacatacatcaaatcagcagtgacacgaaattatagcgagaaatgcattaataatattatggattttatttctgggtcagctagtcagaactttggccttttgcaagaattttatcagactactctatgggccctggaggaggcaaagaatgagagactttggttcaaaacgaatctgaagctatgcaagatttggtttgatatgggtgaatatgggcgaatgagtaagattctaaaggaactccataaatcttgtcaaaaagaagacggcacagacgaccaaaagaaaggaagtcaacttctggaggtatatgcaattgagattcaaatgtacacagaaactaaaaacaacaaaaagctcaagcaattataccaaaaggcacttgcaattaagtcagcaataccccatccaaggattatgggaataattcgagaatgtggtgggaagatgcatacggcggagcgtcaatgggctgaagctgcaacagatttttttgaagcctttaagaactacgatgaagctggaaatcaacggcgcatacaatgcctgaagtatctggttctggccaatatgctaatggaatctgaagttaatccatttgatggtcaagaagccaagccatacaaaaatgatcctgagattttggcaatgacaaatctcatagcagcatatcaacgtaatgagattttggagtttgaaaaaattcttaagagtaaccggaggacgataatggatgacccattcatcagaaattatattgaagatctgttgaaaaatgtcagaacccaggtgctgcttaagcttatcaaaccttacactagaatccggattcctttcatatcaaaggaactcaatgtgccagaaaaagatgttgagcagttgttggtttcattgattttggacaatcgcattgatggccacattgatcaagtgaacaggcttttagaacgcggtgacaggtcgaagggaatgaaaaagtatactgccatagataaatggaacacgcaacttaggtctctttatcaaactgtcagcaatcgcatatactgaaatcattggcaggtaacatggttttcctctcagatggccaagaaaacagtcctctttccctgctaccgggccacaacaaagtaaaaactgcaaagtagatgtgcttagttttatgcattagagaatgtcagctgggaaatttcttgttcatctcattataagatgttttgaagacgagtttgagggtataaatatcttccgaacacgacagaattttggtactgcaaaatttgagacgtgtcttatgttgatagcatagatggagaatatgcttcctagtaaatgcttttggtttgtctattgctgctgttttggactttggttgatga

SEQ ID NO: 3179 - DNA, 1529 bp, Valeriana officinalis
tacccccaatttgttcagcgatattcaagtgaaaaattagtttcgtccctcatcacagatcatgggttctgatatggaggattacggatttgaatattccgatgaagaggctgaagagcaggatgttgatattgagaaccaatattacaactccaaaggattggtcgaaactgatccagaagaagctctgtctgggtttgctgaagtagttcgcatggaacctgacaaggctgagtggggattcaaagctctaaagcaaaccgttaaactctattatagattaggcaagtacaaggaaatgatggaagcttatagggagatgcttacatatataaaatcagcagttactcgaaattacagcgagaaatgtataaacagtattatggattttgtttctggatctgctagtcagaactttaatcttcttcaagaattctatcagactacactcaaggctcttgaagaagcaaagaatgagaggctatggtttaagacaaatctaaagctctgcaagatctggtttgatatgggtgaatacggacggatgagtaagattttgaagcaacttcataagtcatgcaaaaaagaagacggatcggatgatcaaaagaaaggtacacagctcttggaggtatatgcaattgagattcaaatgtacaccgagaccaagaacaacaaaaagctcaagcaactatacttggctgcgctttcaatcaaatcagcgatacctcatccaagaataatgggaataattcgcgagtgtggtgggaaaatgcacatggcagagcgtcagtgggctgaggcagctaccgatttctttgaagcttttaaaaattatgacgaggctggtaatcagaggcgtatccagtgtttgaaatacttggttattgctaatatgctgatggaatctgaagttaatccttttgatggccaagaagctaagccttacaaaaatgatcctgaggtgctggcaatgacgaatctgataggggcatatcaaaggaatgagatcatagaatttgagaagattttgaagagtaaccgaaggacaataatggatgatccatttattcgaaattacatcgaggatcttttgaagaatgttagaacacaagttctgcttaagttaatcaagccttacaccagaattcgcattcctttcatatccaaggagcttaatgtgccggagaaagacgtggaggagctgcttgtttcgcttatattggataatcgcattcatggccatatcgatcaagtcaacagactcttggagcgtggcgacaggtcaaagggaatgaagaagtatacggcgatagagaaatggaacacgcagctgaggtctctatatcaaactgtcggaaaccgcgtctgctgatccaacttcctcttactagtattattactttactactattattattttgttcaaagagatgactgatgaatacatacaaattcggttatcttagctgaggcattatatatgtttgaaattattgtctttaattttggtgaagctacactttctt

SEQ ID NO: 3180 - DNA, 1969 bp, Abies balsamea
ggagttcgatgattatctaatcgaacaaaatcatattttcttcctcctccgttttcctccatcacgaacaaggttgcgacacatagatttttcagctttgattcgcacctaattcctaccctgcccccgtagcagggtccagcgacaatgggttcagacgcagatatggaagattatggatttgaatactcggaagaggaaacagaggagcaggacgtcgacattgaaaatcagtattacaactccaaaggtttggtggagtctgacccgcagggagctcttgctggctttgctgaagttgtgagaatggaacctgaaaaagcagaatggggatttaaggctttgaaacaaactgttaagttatactaccgccttggaaaatacaaagagatgatggaatcgtatcgggtaatgctgacatatattagatcagcggtaacacggaactacagtgaaaaatgtataaacaacatcatggattttgtttctggttctgccagccagaacttcgacctcctccaggagttttatcagactactctaaaggcccttgaagaagcaaaaaatgagaggctttggttcaagaccaatctgaagctttgcaagatattttttgatatgggagaatatggccgcatgaacaagatacttaaggagcttcacaaatcttgccgtagagaagatggttcagatgaccagaagaaaggcactcaactcttggaggtttatgcaatagagattcaaatgtacactgagacaaaaaacaataaaaaaattgaagcaactgtaccaaaaggctctttctattaaatctgcaatacctcatccccgtatcatgggcattatccatgaatgtggtgggaaaatgcatatggctgaacgacaatgggcagaggcagcaacagacttctttgaagccttcaaaaattatgatgaagctggaaatcatcgacgcattcagtgtttgaaatatttagttctggcaaacatgttaatggaatctgaggtgaatccttttgatggtcaagaggcaaagccgtacaaaaatgatccagagattctggcaatgaccaatcttgtagcagcgtaccaacggaatgaaatattagagtttgaaaaaattttgaagagtaacaggaggacaattatggatgatccatttattcgcaactatattgaagatttactgaaaaacattagaacacaagtattgctgaaactcatcaagccatatacacgcatccgtataccttttatatctaaggagctaaatgttccagagaaagatgttgagcagcttcttgtatccttaattttagataaccgagttcatgggcatattgatcaggtcaaccaaactttggaacttggtgataggtccaaagggttaaagaagtatgtggcaatagacaaatggaatacacaactaaggtccctgtaccagactgtaacaaacaagatgggatgaatttggatccctcagaacatgacgaccacttgcatgcttacattttggatggattgtagccataatgagatcttgttgagttgcactgttttctgggtcccgatctcttatctgtggagcttgcttgatgtacattgcatttgcacttttgagttgagtaattttcagactatggaattgaagatcctttcgagaggaagtatatgcagaagcatcggaaaaacatcaattatcagcctcaaaaaatttcccctttgtacgaggagcgaaactttgggcttcctggatgagttttgctgattattttctttgtgaggttatagaaataaagcagcgttcaggtggattactttggcatgatattttattggctggaaaagtaggcgaggatattacaattttttaatgggtcgtttgactagttttttatgtccacaattggaaaagcaataccaagcacctactgctagggttcttgtatgtatatgcaatttgcatcag

SEQ ID NO: 3181 - DNA, 1664 bp, Papaver somniferum
ttttatttaaaagagaaagctaaactcgaacgctgccccctctctattactgagaatagatttgttacttagccatgggttctgatgcagaaatggaagattatggatttgagtactctgaggaggaaccggaggagcaagatgttgatattgagaaccaatattacaactctaaaggtttggttgaaaccgatcctgaaggagcgttggaaggattttctgaagtggtgcagatggaaccggataaggcagaatggggtttcaaagctttaaaacaaactgttaagctgtactatcggttggggaagtataaagagatgatggaatcctatagggagatgttaacttatatcaagtcagctgtaacacggaattacagtgaaaaatgtatcaacaacataatggattttgtttctgggacagctagccagaactttgatcttctacaggaattttatcagaccacattgagggcccttgaagaggcaaagaatgagagattgtggttcaagacgaatttaaagctctgcaagatttggtttgacatgggtgaatatgggcgaatgaataagatcttgaaggagcttcacaaatcttgtcggaaagaagatgggacagatgaccaaaagaaaggaactcagcttttggaagtgtatgctattgagatccaaatgtacacagagaccaagaataataaaaaactcaagcaactatatcagaaggctctttccatcaaatctgcaataccgcatccaaggattatggggatcattcatgagtgtggtgggaaaatgcacatggcagaacgccaatgggcagaggcagccacagatttctttgaagcttttaagaactatgatgaagctgggaatcagcgacgcatccaatgcctcaagtacctagttttggcgaacatgcttatggaatctgaagtgaacccgtttgatgcacaggaagcaaagccatacacaaatgatcctgagatcttggccatgacaaatctgattgcagcctatcaacgaaatgagattctggagtttgagaaaattctcaaaagtaatagaaggacaattatggatgatccatttattcgaaattatattgaggaccttttgaagaatatcagaacccaagttttgctcaagctcatcaaaccttacactaggatccggattcccttcatatctaaggagctcaacgtgcccgaaaaggatgtagaacagctacttgtttcattaatcttggataaccgtgtccagggtcacattgatcaagtgaaccgccttctagagcgtagtgacaggtccaagggcattaaaacatatgctgccatagagaaatggaacacacagctgaaggttctgtatcagacaatcaacaaccgagtaggctgttagaagaaaaagaaggggacagcttctgctactcttgttcaaagtaactcaagcagtttttggtgcatttgtcccaccatattttgcttcactccatgtatagttaaggcagtttttgaacaaccagtgggatttttatagagcgcgtcatattaaatttatatactttcggaatttgaaaacttacaatctgatctttttaagatcggatcagaacttccgaaaaatggcagtggagtggagaactttgttttggccgccaaaaaaaaa

SEQ ID NO: 3182 - DNA, 1720 bp, Allium cepa
ccaagaagcaggtggtataccaacgcagaggtacgggggagagtaattagttccgttcgacccctaaccctaatctaaaacttctccgatttgggtacagtggccatggattccgatgcagatatggaagattatggattcgagtactcagaagacgaacctgaagagcaggatgtcgacattgagaatcaatattataattctaaaggcctagtggaaactgatcctgaggctgctctcactggtttttcagaagtagtcagcatggagtctgagaaagcagagtggggattcaaagcattgaaacaaacagtaaaactttactaccggctggggaaatataaagagatgatggaagcctacagggagatgttgacatatatcaaatcagctgtcacgcgtaactatagcgaaaaatgtttaaacaacattatggattttgtctctggtcccacaagccaaaattttaaccttctacaggagttctatcagacaaccctaaatgctcttgaagaagcaaagaacgagaggttgtggttcaagactaatcttaaactttgtaagatatggttcgacatgggtgaatatggacgaatgaacaagatactgaaagaacttcacaaatcgtgtcgaaaagaagatggctccgatgaccataaaaaaggtactcagcttctggaagtgtatgccattgagattcaaatgtacacggaaacaaaaaataacaagaaactcaagcaattgtaccaaaaagcgctaacaataaaatcagcaattccccatcctcggatcatgggaatcattcgtgaatgtggtggaaaaatgcaaatggcggagcgacaatggggggaagcagcaacagatttcttcgaagcattcaagaattacgatgaagctggaaatcatcgtcgtatccaatgtcttaagtatttggttctagctaatatgctgatgcagtctgaagtcaatccatttgatggacaggaagcaaagccgtacaagaatgatccggaaattttagcaatgactaatctcatagctgcatatcaaagaaatgatattcttgaattcgagaagattttgaagagcaaccgaaaaactattatggatgatccctttattcgcaattacatcgaagatcttttaaagaacatcagaacacaagtgctacttaaactcattaaaccttacaccagaatccgtatccctttcatttcaaaggaactaaatgtgccagagaaagatgtggagcaactgttggtatctctaattcttgataaccgtgtccagggtcatatcgaccaagtcaacaggttactcgagcgtggtgacaagtcaaaaggtatgaagaaatacactgccatcgataaatggaacactcagctcaagtccctataccaaactataaacaacagagttgcttgaaagttgaaaatggatgcacatttttgtatctgggtttaaagaaatttgatggtttctgcattcgcttgtctggttggtccacctattttacagagatgtgaaaaattgatcatgagattgtatatttgtagaaaggttatgtatacctaacctgttttatctgctggcttttggttttttccttcttcaatctttctatctgggtagtgaattgagtgtaatggtttctgaacatttgaattgagaaaattacttaggtgccaaaattgattatggagttgattgtgtcgtcgtc

SEQ ID NO: 3183 - DNA, 1602 bp, Solanum phureja
gaaaaaccgacaactctctcttcatccagagctcaaaaatctcccccattaatcttcttttcagtgttctctaattagccatgggctctgatgcagatatggaggactatggattcgagtattcagaagaggagcctgaagagcaggatgttgacatcgagaaccaatactataactccaaaggcttggctgaaacagacccagaggcagcacttgagggatttgctgaagtagttcatatggaacctgagaaggctgattggggatttaaagctttgaagcaaactgttaagctttactataagctagggaagtacaaggaaatgatggatgcttacagagaaatgctaacctacatcaagtcagcagtgacaagaaattatagcgaaaagtgtataaacaatatcatggatttcgtctcaggatcagctagtcagaactttgatctcctacaagagttctaccagacaacattgaaagcccttgaagaggcaaaaaacgagaggttgtggttcaagacaaatctaaaactttgcaaaatatggtttgacatttgggagtatggacgaatgaataagattttgaaacaactccacaaatcttgtcaaaaagaagatggtactgctgaccagaagaaaggtacacaattgttggaggtatatgcaatagagatccaaatgtacacggagacgaaaaataacaaaaaactgaaggaactatacactaaagcactttcagtcaagtcagcaatccctcaccctagaataatgggaataattcgtgaatgtggaggaaaaatgcatatggcagagcggcagtgggcagaggcagctacagacttctttgaagctttcaagaactatgatgaagctgggaatcagaggcgcattcagtgtctaaagtacttggttctggcaaatatgctgatggagtctgaggttaacccctttgatggccaagaagcaaaaccgtacaaaaatgaccctgagatactggcaatgactaaccttatagcagcatatcaacgaaatgagatcttagagtttgagaaaattcttaagagtaatagaagaacaataatggatgatcccttcatcagaaattacattgaagatcttttaagaaatgtcagaacccaagtgctgctgaagatcattaagccttacacaagaatccggattcccttcatttccaaggagcttaatgtgccagaaaatgacgtcgaggagttgttggtctcactcatcttggacaaccgtatccatgggcacattgatcaagtgaaccggttgctagaatgtggagatagatcgaaagaaatgaagaaatacgctgccatcgacaaatggaacacacaacttaggtctttgtaccaaactgttggcaacagagtatgttgatattacctggacatgaaaaaaagctgagtgtgattatatttatggactcattatttagctcctctgttcaacatgtagattttttgtacaaaattcgatatttctctgtttaagtagcaagagcttctatctgatttatgttactctttgtttctatactgcgacagaaacagcatgctaagataactttgtctatctcatc

SEQ ID NO: 3184 - DNA, 1461 bp, Solanum lycopersicum
gaaacttcaaatttctatttttttttcaatcgtctctttcatctgaaaatcagctatgggttctgatgcggatatggaggattatggattcgagtattcggacgaggagcaggaagaacaagatgttgatatagagaatcagtactacaattctaaaggtatggtcgaaactgatcccaaaggagcacttgagggttttgctgaagtagtacatatggagcctgagaaggcagagtggggatttaaagctttaaagcaaactgttaagctttactataagctagggaagttcaaggaaatgatggattcttatagagaaatgcttacctacataaaatcagcagtgacacggaactatagtgagaagtgtataaatggtatcatggattttgtttctggatcagctagtcagaacttcagccttttgcaagagttctaccagacaacattgaaagccctcgaagaggcaaagaatgagaggttgtggttcaagacaaatctaaagctttgcaagatttggtttgacatgggggaatatggacgaatgagcaagattctgaaagagctccacaaatcttgtaaaaaagaagatggcactgatgatgagaagaaagggacacaattgttggaggtatatgcaattgagattcaaatgtatacagagacaaaaaacaacaaaaaactgaaggaactgtacaacaaagcactttcagtcaagtcggcaattcctcatccaagaataatgggaatcattcgtgaatgcggaggcaaaatgcatatggcagagagaaagtgggcagaggcagctacagacttctttgaagctttcaagaactatgatgaagctgggaatcataggcgtattcagtgcctcaagtacttggtcctggcaaatatgctgatggagtctgaagttaacccttttgatggccaagaagctaaaccttacaaaaatgaccctgagatcttggccatgacaaaccttatcgcagcatatcaacgaaatgagatcttagagttcgagaaaattattaagagtaatagacggacaataatggatgaccctttcattcggaattacattgaggatcttttaaggaaggtcagaacccaggttttactgaagctcatcaagccttacacaagaatccgaattcccttcatatccaaggagctgaatgtgccagaaaaagatgttgaggacttgttggtctcactaatcttggataaccggattgatggccacattgatcaagtgaacggactgctagagtgtcgcgacagatcaaaagggatgaagaagtacactgccattgataaatggaacacacagctaaggtctctctaccaaactgttggcaacaaagtatgttaaggactaaggtttatataaacctatgctcataaaatcatacacatttttgtttcattaattttagtttaatatatgtgttgtttgta

SEQ ID NO: 3185 - DNA, 1703 bp, Vinca minor
tttttactccgatttctttatcttcttattgctctctctccgggaaagcgtaatctctaaagcatgggctccgatgtagatatggaggattacggattcgagtactcagacgaagagccagaggagcaggacgttgatattgagaaccaatattacaattccaaaggcatggttgaaacagatccagaagcagcacttgaaggttttgctgaagtagttcgtatggaacctaacaaggctgactgggggtttaaggctttgaaacaaacagtgaagttgtattataagttagggaagtatgaagagatgatggaagcatacagaaatatgctaacttatataaaaacggcagtaacacgaaattacagtgagaagtgtataaacaatatcatggattttgtctctggctctgctagccagaacttcagtcttctacaagaattttatcagacaactttgaaggctcttgaagaggcaaagaatgagaggctttggttcaagacaaatctaaagctttgtaagatctggtttgatatgggagaatatggtagaatgaacaagattttgaaggaactccacaaatcttgtcaaaaagaagatggcactgatgatcagaagaaggggacacaactgttggaggtttatgccattgaaattcaaatgtacactgcgacaaagaataacaagaagctcaagcaactataccaaaaagctttgtctatcaagtctgcaatacctcatccaaggattatgggcataatccgtgaatgtggtgggaaaatgcacatggcagagcggcaatgggcagaagcagcaacggacttttttgaagctttcaaaaattatgatgaggccggataccagcgacggatccaatgcctcaagtacttggttttggctaatatgctgatggaatctcaggtcaacccgttcgacggtcaagaagcaaaaccgtataagaatgatccagagattttggctatgacgaatcttatagcagcatatcaacggaatgaaatattagagtttgagaaaattctcaggagtaataggagaaccataatggatgatccattcattcgaaactatattgaagatcttctcaagaatgtcagaacacaagtattgcttaagctcataaaaccttatacaaggattcggatacccttcatatcaaaggagcttaacgtgccagagaaagatgttgaggaattgctggtttccctcatcttggataatcgtatccatgggcatattgatcaagtgaaccggctattggaacgtggtgacagttcaaagggaatgaaaaagtatgctgccgtagataagtggaacacacagctgaggtctctctaccaaactgtgtccaaccgaatctgttgagattgcttttgtatcagtcttgactgtgaatagcagagcgagtatatattggagatgtatattcatgttttagagaaaaagagtatccctcaagacatgtttactaaagaagtctcttgctatacatgcgactcttgttcttttgatgttcttaggtgaaaggtctttgtttcaagactggaaaactaattgatttttgagaatttttacggtttccttgtatgttttagtggaattattcataggtaaaaactatttgtagttttcgggttgctttttaactgtctgtgtctcacatttgctgtcttttgatcaaatta

SEQ ID NO: 3186 - DNA, 2078 bp, Pinus taeda
acacagtgacgcaagaagttcgatgtttctctaatcgcacaaaatcgaatttttttcgtttgttttcttccatcacaaccaagacagtgatacacagattttcagctttgattcgcagctaattccttccctgcccaagtagcagggtccagcgaccatgggttcagacgcagatatggaagattatggatttgaatactcggaagaggaaacggaggagcaggacgtcgacattgaaaatcagtattacaattctaaaggtttggtggagtctgacccacaggaagctcttgctggctttgctgaagttgtgaaaatggaacctgaaaaagcagaatggggatttaaggctttgaaacaaactgtcactaccgccttggaaaatacaaagagatgatggattcttatcgtgtaatgctgacatatattagatcagcagtaacacgaaactacagtgaaaaatgtataaacaacatcatggattttgtttctggttctgccagccaaaactttgaactccttcaggagttttatcagactacactcaaggcccttgaagaagcaaaaaattgagaggctttggtttaagaccaatctaaagctttgcaagatatttttcgatatgggagaatatggtcgcatgaacaagatacttaaggagcttcacaaatcttgccgtagagaggatggttcagatgaccagaagaaaggcactcaacttttggaggtttacgcaatagagattcaaatgtacactgagacaaaaaacaataaaaaattgaagcaattgtaccaaaaggctctttctattaaatctgcaataccccatccccgtatcatgggcattatccatgaatgtggtgggaaaatgcatatggctgaacgacaatgggcagaggcagcaacagacttctttgaagctttcaaaaactatgatgaagctggaaatcatcgacgcattcagtgtttgaaatacctagttctggcgaacatgttaatggaatctgaggtgaatccttttgatggtcaggaggcaaagccgtacaaaaatgatccagagattctggcaatgacgaatctcgtagcggcataccagcggaatgaaatattagagtttgaaaaaattctgaagagtaacaggaggacaattatggatgatccatttattcgcaattatattgaagatttactgaagaacattagaacacaagtattgctgaaactcatcaagccatatacacgcatccgtataccttttatatctaaggagctaaatgttccagagaaagatgttgagcagcttcttgtatccttaattttagataaccgtgttcatgggcatattgatcaggtcaaccaacttttggaacttggtgataggtccaaagggttaaagaagtatgtggcaatagacaaatggaatacgcaactaaggtccctgtaccagactgtaacaaacaagatgggatgaatttggatccctctgatggattgtaactatactgggatcttgttgagttgcactgttttctgggtcccaatctctgtggagcttgcttgatgtacaatgtacattgcatttgtacttttgagttgagtatttttcagactatggaatgggagatccttttgaaaggaaatatatgcagaagcatcgaaaaaatattgatgttggtgctagtttgttttgctcttatttctcagtgctcttcctccggatttttttccttgcaatgtcagattgatagcttttgacagctgttgtcttctctggtgtgcagtatgaacctcaaaaaatttccccctttgtacgaggagcgaaacttttgggctttctggatgaatttgctgattattttcattgtgaggttatagaaataaagcagcattcaggtggattactttggtatgatattttattggctggaaaagtaggcgagtatatgacaatttaatgggtgtttgacagtttttgtgtccacaactggaaaagcataccaagcacctactgataggatgcttgtatgtatatgcaatttgtatcaatgccctttatatcttgagcagcgttttttcag

SEQ ID NO: 3187 - DNA, 1588 bp, Artemisia annua
aaccaaaaacaaaccctagaacaaccaaacactgatcgctttcattaatccatcatcaccttcttcaaatcaattaaccatgggttcagatgcagatatggaggattatggatttgaatactccgaagaggaacaagaagagcaagatgttgatatcgaaaatcaatattacaactctaagggtttggttgagactgatccagagggtgcacttactggttttgccgaagtagttcagatggaacctgagaaagcagaatggggattcaaagcacttaaacagactgtcaagctttactaccgtttagggaggtacaaggagatgacagatgcttatagggagatgttaacctacattaagtctgcagtgactaggaactatagtgagaagtgtataaacaatatcatggattttgtatctgggtcggctagtcaaaactttggtcttttgcaagacttctatcaaaccaccttgaaagcactcgaagaagctaaaaatgagagattgtggttcaagacaaatcttaagctttgcaagatctattttgacatgggggaatatggtaaaatgaataagattttgaaggaacttcacaaatcttgtcaaaaggcggatgggactgatgatcaaaagaaaggaactcagttgttggaagtgtatgcaattgaaattcaaatgtatacagagaccaaaaataacaaaaaactcaagcaactgtaccaaaaagcgctcaccattaaatcagcaattccacatccaaggatcatgggtataatacacgagtgtggtggcaagatgcatatggcagagcgccaatgggctgaagcagctactgacttttttgaagctttcaagaactatgatgaagctgggaatcaacgaagaatccagtgtctaaaatatctggtactggctaacatgcttatgcaatctgaagtcaatccatttgatgggcaagaagcaaagccatacaaaaatgatccagaaatcttggcaatgacgaacttgattgcagcataccaacggaatgaaatcttggagtttgagaagatcctgaagagtaacagaagaaccatcatggatgatctcttcatcagaaattatattgaagatcttctgaaaaacatcagaactcaagtgttgctcaagctgatcaagccatacacaagaatcaggatccccttcatctcaaaggagcttaatgtgccggaggctgatgtggaacagctgttggtctcattgatactggataaccgagtccaaggccacattgatcaagttaacaggctattggagtgtggtgacaggtcaaagggaatcaagaaatacactgctgtggagaaatggaacacacaacttaggtcactttatcagagtgttagcaatcgggttggttgagcagcctgagattttatcttttgatgagcgtatgttatttcacattggcatattttgtccatcatgtcaaattggtaaagttggtatctgaacacaaggattgatgtgttttaaagaggggtacattggttgaattgtgtattttggtcttgtgatgtcgatatctttatgtagtgaagatattaatgg

SEQ ID NO: 3188 - DNA, 1854 bp, Pennisetum glaucum
ctccaaaggtatggttgagacagacccggagggtgcacttgctggttttgatcaagtagtcaaaatggagtcagaaaaggctgaatggggatttaaggctctcaaacaaactgtcaagctttactataagctggggaaatacaaagaaatgatggatgcgtacagggagatgctaacatacataaaatctgctgtgacccgaaactacagtgagaaatgtataaacaacattatggattttgtttctgggtcagctagtcagaacttctctcttttgcaagagttctaccagacaacactgaaagctcttgaagaagcaaaaaatgagagattatggttcaagactaacctgaagctttgcaaaatttggtttgatatgggggagtatggtcgcatgagcaagatactgaaggagttgcataaatcttgtcaaaaggaagatggttctgatgatcaaaagaaaggcacacagcttttggaagtgtacgctattgaaattcaaatgtacactgaaacaaagaataataaaaagcttaaggaattgtatcagagggctctttccattaaatcagcgatacctcatccaagaatcatgggtataattcgtgaatgtggtgggaagatgcacatggctgagaggcagtgggcagaagctgcgactgatttctttgaagctttcaagaactacgatgaagcaggcaatccgcggagaattcaatgcctcaaatatcttgttcttgccaatatgttgatggaatctgaagtgaatccctttgatggacaagaggccaagccgtacaaaaatgatcccgagatccttgcaatgacaaacttgattgcagcgtaccagaagaatgacattatggaatttgaaaagatcttaaagagcaatagaagaacaataatggatgatccttttatccgtaactatattgaggacctattgaagaacatcagaactcaagtcttgctcaagcttattaagccatatacgcggatcaggataccattcatttcacaggaactcaatgtccctgaaagggatgtggagcagctcttggtttctctcattctggacaaccgtatccagggccacatagatcaggtgaacaagctgctagaacgtggagacaggtccaaggggatgaggaagtataatgccattgagaagtggaatactcagctgaagaccatttaccaaacggtgtccaacagagttgggtgagacggcttctggctgtcggtgtatttgccactcatgagatatgttgatagcctgttttgggatctgagggcaaatgcaagttgttttgacgcttgaggtagaatgttggatctgggtgtaatgtagagaacccagtgttcagagtccgaaactttactatggtccaagccaattgccagagggaaacgattatccatctggttgccttacttttcgtgcaagcctctcgagtcaacaaattatagtcgatttagctgaaatctatgcatgttagaattatttttctagtttttcttcctcaaacacttaaaattataggcgatgatctagagcgaagcaaaagaaaaagaataaactgaactatcgggctttgatcattatataaaatacagtcaattgataagatatatgaccatgtgaccgtatctgttgttaatccgctaaatacagagcgtctgcagtttcacttgattctaagtaacatcatgtgttaacacaagttatggcttaagagctggtgaagctatctgcactagttatgacttatgacttgagagctcggcaaggctcgtaagacgaaaaaatataggctagtacactcgcagttctaaatcgaggcctgaaatccg

SEQ ID NO: 3189 - DNA, 2621 bp, Quercus alba
gtgcatttataaatgaatgaaagccggcgatggcatcgtcaccaccggattgttgagtctcattctctcccttccacgccttgtgatctctgaaggagtttgtttcaggtttttctccttcaccaagaaagaaccaactaagccctaaattactaattattaccatccatccaacaatggcttccgatgcagacatggaggattacggatttgagtactcggaggaggagcaagaggagcaagatgttgacattgagaatcaatactacaatgccaaaggattggttgaaactgatccagaaggtgcattggctggttttgctgaggtagtaggcatggaagcggagaaggcagagtggggatttaaagctttaaaacaaactgtcaagctttattatcggttagggaagtatgcagaaatgatgcaagcctatcgggaaatgttgacttacattaaatcagcagtgacacgaaattatagtgaaaaatgtataaataacatcatggacttcatttctgggtcagctagtcaaaattctgggcttctgcaagagttctatcaaaccactctgaaggcccttgaagaggcaaaaaatgagagactctggtttaaaacaaatctcaagctttgtaagatttggtttgacatgggtgaatatgggcgaatgaataagattttgaaggagcttcacaaatcttgtcgaaaagaagatggcacagatgaccacaagaaaggaacccagcttttggaggtatatgcgatagagatccaaatgtacactgagaccaagaataacaaaaaactcaagcaactataccagcaagcactaatgatcaaatcagcaatacctcatccaaggataatgggaataattcatgaatgtggggggaaaatgcacatggcagagcgccagtgggcagaagcagctacagatttttttgaagctttcaaaaattatgatgaagctggaaatcagcggcgtatccaatgcttgaaatatctggttcttgccaatatgctgatgcagtctgaagttaatccctttgatgggcaggaggctaagccatacaaaaatgaccctgaaattttagctatgacaaatctaatagcagcctatcaacggaatgaaatattcgagtttgagaaaatcctgaagagtaacagaagaacaattatggacgatccatttatccgaaattatattgaggatctcttaaaaaatattagaactcaagtcttgctcaagctcatcaagccttatacaagaatcaggatcccattcatatccaaggagctaaatgtgcccgagcaagatgttgagcagctgttggtgtcactaatattggataaccgaatccatgggcacattgatcaagtgaacaggctgctagagcgctgggacaggtcaaagggaacaaagaagtatactgctgtggacaaatggaacacacagcttaagtctctctatcaaactatcaacaatagagtttcttaggatttgcatttatacccttatttggtgtttttgtcattttaagttgagatcaacgatattctccaccagtggaaggcagtctaggaaaatacaattttcaataaaatattacattttatccttaatatgtttatatgaatgaaagatacatgtcaagagggcaaatccataccaaagacaaggaaattttctaatacataaaccgatctggatcattcatttgaaccgaactggtggaaagagaccaatgtcttcatatccgaaattatcaggccgaggctgcatcaacaacttcaagttccctattgtttgtgttaattgcactcttttcatggttgtggatcttacatgcttcttctgcatttttctcctcaaattccacttttgcttctccattttccatttcatgcttgttttccacagcacaattattattacaatggaggatttctgctgtccaaccttgcaactgctcgatagcaacctcatctaatcttgggactgtatggccttgaggatgccttatgatgagagggttgtcgaaagcggtagcaagatcctcagaaggcagtttcaaccaatccttggctcctatgaagtggacagatttgaccttgatggggtctttgtaggcaacctcacatatgcttgggtctctgaactttgccccagatattgatacgaatagtttcatgggtggatgatctttcaacacctttccttgtgcctggtagcccagcagaagggctgacagtgttgcaccctgagagaagccaagaaaaccatcaaaaggacctttggttgttatgtattcacacaagtaagaaatgcattcttccaagtttgtgtactctgtgaagtccttgtcatactggaaccactcaaaataaggtggtgggaagatgccttcaatgtctgattttcctcctgcaggaaaaataccatctgggaaatccatgtcaaattgagcaaatatagaaggatcccatttgctaatttgctttttcagaaaactcccactggtcctaaatccatggaggcatagtatcttcatcttcttctcttttgtgccttccatgtttctctctctctctctctctctctctctctcaacctggcaacaat

SEQ ID NO: 3190 - DNA, 1591 bp, Solanum phureja
ttctatatttttcaatcgtctctttcatctgaaatcagctatgggttctgatgcggatatggaggattatggattcgagtattcggacgaggaacaggaagaacaagatgttgatatagagaatcagtactacaattctaaaggtatggtcgaaactgatcccaaaggagcacttgagggttttgctgaagtagtacatatggaacctgagaaggcagagtggggatttaaagctttaaagcaaactgttaagctttactataagctagggaagttcaaggaaatgatggattcttatagagaaatgcttacctacataaaatcagcagtgacacggaactatagtgagaagtgtataaacggtatcatggattttgtttctggatcagctagtcagaacttcggccttctgcaagagttctaccagacaacactgaaagcccttgaagaggctaagaatgagaggttgtggttcaagacgaatctaaagctttgcaagatttggtttgacatgggggaatatggacgaatgagcaagattttgaaagagctccacaaatcttgtaaaaaagaagatggcactgatgatgagaagaaagggacacaattgttggaggtatatgcaattgagattcaaatgtatacagagacaaaaaacaacaaaaaactgaaggaactgtacaacaaagcactttcagtcaagtcggctattcctcatccaagaataatgggaatcattcgtgaatgcggaggtaaaatgcatatggcagagagaaagtgggcagaggcagctacagacttctttgaagctttcaagaactatgatgaagctgggaatcataggcgtatccagtgcctcaagtacttggtcctggcaaatatgctgatggagtctgaagttaacccttttgatggccaagaagctaaaccttacaaaaatgaccctgagatcttggccatgacaaaccttatcgcagcatatcaacgaaatgagatcttggagttcgagaaaattattaagagtaatagacggacaataatggatgacccattcattcggaattacattgaagatcttttaaggaaggtcagaacccaggttttactgaagctcatcaagccttatacaagaatccggattcccttcatatccaaggagctgaatgtgccagaaaaagatgttgaggacttgctggtctcactaatcttggataaccggattgatggccacattgatcaagtgaacgggctgctagagtgtcgcgacagatcaaaagggatgaagaagtacactgccattgataaatggaacacacagctaaggtctctctaccaaactgttggcaacaaagtaagttgaggtttatataaacctatatactcataagtcatacacagttttgtttcattaattttagtttatatatttgttgtttgtagtaattttgattttgatttctaagaatgaacttaatttgtttgaaaaaagtttgaaggtgacttattactcttgttaacttgatgtacaattactcttgttattaaatagtactatttaaatgacttataattaatagaggtgatatagtaa

SEQ ID NO: 3191 - DNA, 1597 bp, Phalaenopsis aphrodite
cgcttcctcgctcgtattggttccttgctcaggtggcaatcacttccacactctgcgaggagccctcatcctgctcgtgtcttgttctccctgtagaactggagcttccgcttctttggtgaagcagccacgcgaaccatgggttccgatgctgatatggaggattatggttttgagtattcggaggaggaacccgaggagcaggatgttgatatcgagaatcaatactacaattcaaaaggtctggttgaaactgatccagaggctgctttatctggttttgctgaagttgtgcgaatggagcctgaaaaagcagagtggggattcaaagctctaaaacagactgttaagctttattatcgacttgggaagtataaggagatgatggaatcctatagggaaatgctaacatatatcaaatcagctgttacacgcaactacagtgaaaaatgtattaacaacatcatggattttgtctctggaccagctagtcagaattttggtcttctacaggagttttaccagacgacactgaaggcactcgaagaggcgaagaatgagaggttgtgggtttaaaaccaaatttgaaactttagtcaaaatttggtttgatgttggcgaatatggtaaaatgaacaagatactgaaagaactccacaaatcttgtcaaagagaagatggcactgatgatcataaaaagggtacccaactattggaggtgtatgctattgagatccaaatgtataccgaaacaaagaacaacaagaaattgaagcaattatatcaaaaagccctatcaatcaaatcagcgatacctcatccacgaattatgggaataatccatgaatgtggtgggaaaatgcacatggctgagcgtcagtgggccgatgctgctactgacttcttcgaagcattcaagaactatgacgaagccggaaatcataggcgcattcagtgtctcaaatatcttgttttggccaatatgctaatggaatctgaggtgaacccattcgatggacaagaagcaaaaccatataaaaacgaccctgaaatcttagcaatgacaaatctgatagccgcgtatcagagaaacgaaatatttgaatttgaaaaaatcttgaagagcaacaggaaaacgattatggacgatcctttcatccgaaattacattgaggatctcttaaagaagatcaggacccaagttttgctcaagcttattaagccgtatacgcggattcgaattcctttcatctcgaaggagctcaacgtgccggagaaagacgtcgagcagctattggtatctttaattctggacaatcgtatccaaggccacattgatcaggtcaatcggcttctggagcggagcgacagatcaaagggaatgaaaaaatatgcagctgtagacaagtggaacactcagctcaggtctttgtgcaagactatctccaatagagttggttgagaatccatgacccacttcctcttcctcttcttttgactcgaggtgagaattgttgttttttgagtgtgaattttcctctgcatgtgtagtacagctgcccagctgacaaaaaataaaaattttgttatatctgct

SEQ ID NO: 3192 - DNA, 1888 bp, Fragaria vesca
cgattcgttctctgcgctttgttctcagctttcagtggccaccgaatcccaacgcgaaaccctccgactccgtttctcagccgtttaagcagccatgggttccgatgctgatatggaggattacggattcgagtactcggatgaagagcctgaggagcaggatgttgatatcgagaaccagtattacaactccaaaggtttggttgagactgatccagaagaagcgctctcaggatttcaagaagtaattcgcatggagcctgagaaggctgagtggggatttaaagctttgaagcaaactgtgaagatccattatcgtctcgggaggtataaagagatgatggattcatacagagagatgctgacgtacatcagatcagctgtgacacggaattacagtgaaaaatgtataaacaacattatggattttgtgtctggatcagctagtcagaactctggtttcctgcaagagttttatcagactactctaaaggccctggaagaggcaaagaacgagaggctttggttcaagacaaatcttaagctttgcaaaatttggtttgatatgagtgaatatgggcgaatgagtaagattttgaaggaactccacaaatcttgtcaaaaagaagatggtactgatgatcaaaagaaaggaagccaacttttggaggtttatgcaattgagattcaaatgtacaccgagactaaaaataacaaaaagctgaagcaattataccaaaaggcacttgcaatcaagtcagcaataccccatcctaggatcatgggaataattcgtgagtgtgggggtaagatgcatatggcagagcgtcagtgggcagaggccgctactgatttctttgaagcttttaagaattatgatgaagcggggaaccagaggcgtatacaatgcttgaaatatttagttctggctaacatgctgatgcagtctgaggttaatccatttgatggtcaagaagcaaagccgtataaaaatgatcctgagatcttggcaatgacaaatctggttgcagcatatcaacgaaatgagatattggagtttgaaaaaattctgaagagtaacaggaagacaattatggatgatccattcattcggaactatattgaagacctattgaagaatattaggacacaagttttgcttaaactaatcaagccgtacacacgaatccggattccattcatatcaaaggaacttaatgtccctgagaaagatgttgagcagctcttggtttcactaattttagataacagaatcgatggacatattgaccaggtgaaccagatcatggagcgtggtgacaggtcaaagggaaggaagaagtatgctgccatagataaatggaacacgcagctgaagtctctgtcccaaactattggtaaccgagtatattgagaaagatggcacaatattgcttatgatcttattctgaatggtgccagttttttgtcatgtcgtggcttgagttagagttccaactttacctgttgaggtcaaatgcttgagaaactgtgaatgtgattatgagccctaagttttacatgtttgctagtaagaatttttctttcataccgtagatgtcgctacttatctgtgattgtcgctgcttatctgtgctaacaacagttttaatagcaagttttgcagagagcaaatccaaatgattttttatttaagccctactgcaagtctcaattaaattcaagatagaaacatttctttatgttagttttgacagcatacggtaatttgtaaaagaggcacttgagtccaatatacagtctgctgttagaggccccgatcaagtctatgataagatgataacaaagttgttttaggcctagtagatgtgcccctagtcatctttaa

SEQ ID NO: 3193 - DNA, 1659 bp, Plantago ovata
gtaccgtctctctgaaaatccctcttcacaaatcaccatgggttcagatgctgatatggaggactacgggttcgagtactccgatgacgagcccgaggaacaggatgttgatatcgagaaccagtattacaattccaagggactggttgaaacagaccctgaagaagcacttgaaggcttcagagaagtggtgcggatggaaccagaaaaggctgaatggggatttaaggctttgaagcagactgttaagctatactataagcttggaaagtacaaggaaatgatggatgcatacagagatatgttgacttacataaagtcagcggtgacccgaaactatagcgagaaatgtataaacggccttatggattttatttctgtatctgctagtcagaacttcagcttgttgcaagagttttatgagaacaccttaaaggcccttgaagaggcaaagaatgagaggctctggtttaagaccaatctaaagctttgcaaaatatggtttgacatcggagaatatgggcggatgagtaagattttgaaggagcttcacaaatcgtgccaaaaagaagatggaactgatgatcagaagaaaggaacacagctgttggaagtatatgcagttgagatccagatgtacactgagaccaaaaacaacaaaagttgaaggagttatatctgaaggcactatctgttaaatcagctatacctcatccaagaatcatggggataattcgtgaatgtggtggaaagatgcatatgacagagcgccaatgggcagaagcagctactgacttctttgaagcttttaagaattacgatgaagctggaaaccagaggcgtattcagtgcctgaagtacttggttctggcgaacatgctgatggaatcacaagtgaaccccttcgatggtcaagaggcaaagccatacaaaaatgatcccgagattacggcaatgacaaatctaattgccgcatatcagcgaaacgagattttggagtttgagaaaattctgaagagtaacagagggacgataatggacgatccattcatccggaattacattgaagatcttttgaagaatgtgagaacgcaggttttacttaagctcattaagccttacacaagaattcggatcccgttcatctcaaaagagcttaatgtgcctgagaaagatgtagaggtgttgttggtctctctgatcttggataaccgaatcgatggtcatattgatcaggtcaatcgacttttggagcgtggtgataggtcgaagggaatgaagaagtacgctgctattgacaaatggaacacagcgctcaaatctttgtatcaaagcattgataaccgggtttattgaaactgatagccagcaatagtaggaaacgtaagtgttttgaatggttaaaatcacttgtttaggcctttttgaaatatattcaacagtattgtcatcccataccatctgtgctgttgagtaacttgagttcattactgtatttattatgcaaacggccctgagtatgaatgaccttacacacactgcccggtgcttgaccagttgcacaaatttgttggtttgtctaaataaatactactattatgttttgttaatataacttactacagtagtaaatataacttgctagtaatatttaatgaa

SEQ ID NO: 3194 - DNA, 1513 bp, Helianthus annuus
tgggttcagacgcagatatggaggattatggattcgagtactctgaggaggaacctgaagaacaagatgtggatattgagaatcagtattataattcgaaaggtttggttgagactgatccagagggtgcacttagcggatttgcagaagtagttcagatggaaccagagaaagcagaatgggggttcaaagcacttaaacagactgtgaagctttattaccgtttagggaggtacaaggagatgacagatgcttatagggagatgctaacttacattaagtccgcagtgactcgaaactatagtgaaaaatgtataaacagtatcatggattttgtatctggttccgctagtcaaaactttggtcttctacaagagttctatcaaaccaccttgaaagcacttgaagaagcaaaaaatgagagattatggttcaagacaaaccttaagctttgcaagatctattttgacatgggcgagtatggtagaatgaataagatcttgaaggagcttcacaaatcttgtcagcgggcagatgggacagatgatcaaaagaaaggaactcagttgttggaagtttatgcaattgagattcaaatgtacacggagacaaaaaacaacaaaaaactgaagcaactttaccaaaaagcacttactataaaatcagcaattccccatcctaggatcatgggtatcatacacgagtgtggtggcaaaatgcatatggcagaacgccaatgggcagaagcagctactgacttttttgaagcttttaaaaactatgatgaagctgggaatcaaagaagaattcagtgcctcaaatacttggtactggctaacatgcttatgcaatctgaggtcaatccttttgatgggcaagaggcaaaaccatacaaaaatgatccggaaatcttggcaatgacgaacttgattgcagcatatcaacggaatgaaatattggaatttgagaagattctcaagagtaacagaagaaccatcatggatgatcccttcatcagaaattatattgaagatcttcttaagaacatcagaactcaagtgttactcaagctcattaagccgtacacaagaatcaggatccctttcatatcaaaggagcttaatgtgcctgaggctgatgtagaacagctgttggtctctctgatattggataaccgggttcaagggcatatcgatcaagttaataggctgttggagtgtggggacaggtcaaagggaatgaagaaatatactgctgtggagaaatggaacacacaacttaggtcgctttatcaaagtgttggcaacagagttggttgagatgtttgaaagtataagttttgatcagtgaatagtgattgctactttggcatattttgttcatcatggcaagtggggatattagttgcacacaatgtggagttgatatagtattatttgtccccttcatcactatcttgcgcctctaattttacgatatctttatatttcatcttttgaattgatgatgttga

SEQ ID NO: 3195 - DNA, 1673 bp, Aquilegia formosa
ctgaaaagtaaaaagaaattattataattaaactctctggaaaaaattggtgtttccgttcaattgttttcgagaatcgatcgaaaacctacattctactctcgcttcttcttcttcttcttcatcatcacagttacagcaatgggttctgatgcagatatggaagattatggttttgagtactcagaagaagaacctgaggagcaggatgttgacattgagaaccaatattacaactctaaaggtttggttgaaaccgatcccgaaggagcacttactggattttctgaagtagttagcatggaaccagagaaggcggaatggggttttaaagctctaaagcaaactgtcaagctctattatcgattggggaggtttaaagagatgatggaagcttacaaggagatgctgacatacattaaatccgctgtaactcggaattatagtgagaagtgtataagcaacatccttgactttgtttctggttcggctagccaaaactttggtctcctagaggaattttatcagtctactctgaaggcccttgaagaggcaaagaatgagaggctttggttcaagacaaatttaaagctttgcaagatttggtttgacatgggtgaatatggacggatgaataagatattgaaggagcttcacaaatcctgtcgaaaagaagatggttcagatgatcaaaagaaaggaacacagcttttggaggtctatgcaattgagattcaaatgtacactgagaccaagaataacaaaaagctaaagcaattataccagaaagcactttcaatcaaatccgcaattccacatcctcggatcatgggtataattcacgaatgtggtgggaagatgcatatggcagagcggcaatgggaggaagcagccactgatttctttgaagcttttaagaattatgatgaagctggaaaccagcggcgtatccagtccctgaaatatttggtgcttgcgaacatgctgatggaatctacagtgaatccatttgatgggcaggaggcaaagccatacaaaaacgatcctgagatcttggccatgacaaatctgatagctgcatatcaacggaatgagatattggaatttgagaaaatccttaagagtaatagaaagacaattatggatgacccattcatccggaattacattgaagacttgttgaagaagatcaggacccaagtgttgctgaagctcatcaaaccatatacacgaattcggatccccttcatatcaaaggagcttaatgtgcctgagaatgatgttgagcagttgctcgtctcactgatccttgacaatcgtgtccatgggcacattgatcaggtgaaccggcttctagagcgtggtgacagttcaaaggggatgaagaagtttgcagccatagacaaatggaacactcagctcaggtcactctatcaaactgttagcaccagaatagcatgatatttaatttattatgggtccaaagtgtaagaacactcgtgtattgtgatacccatttacaccatgttgagtccactagttcatgaaagaggaattttctatctacaagtgatgttatatacaatatgcatggtcaaactgttgccgttgttgcatcttttgttattccgacatagatttacagaaaatttgatggaaaggtgctttttttc

SEQ ID NO: 3196 - DNA, 1593 bp, Silene vulgaris
tggaagattacggatttgaatactccgacgacgatgccgatgaatttgatgtagatattgagaatcaatactacaattccaaaggattggttgaaactgatcccgaaggtgcacttgctggctttgcggaggtagttagcatggaaccagagaaggctgattggggatttaaagcattaaagcaaactgtgaagctgtattacaagttaggaaggtataaagagatgatggaagcatacagagagatgttaacgtacataaaatctgcagtgactagaaattatagtgagaagtgtatcaacagcattatggattttgtttctgggtcagcaagccacaattttgatctcctgcaagagttctaccagacgaccttgatagctcttgaagaggccaagaatgagagactttggtttaaaactaatctaaagctttgcaacatttggttcgacatgggagagtatgggcgaatgaacaagatcttgaaggaactccacaaatcatgtcaaaaggaagatggcactgatgatcagaaaaaaggaacccagctgttggaagtatatgcaatagaaattcaaatgtatactgagaccaagaacaacaagaaactcaagcaattgtaccagaaggctctcaccgtgaagtcagcgataccacatccaaggataatgggaataattcatgaatgtggtggaaaaatgcacatggctgaacgtcagtgggcagaagcagctactgattttttcgaggcatttaagaattatgatgaagctgggaacgcacggcgaatccagtgtctgaaatacttggttcttgctaatatgttaatggaatcagaggtcaacccatttgatgggcaggaggcgaagccatataagaatgatcctgaaattttagccatgaccaatttgatagcagcgtatcagcgaaacgagattcttgaatttgagaagattctaaagagtaacagaagaacaattatggatgatcccttcatccgaaattacattgaagacctcttgaaaaacatcagaactcaagtgttactgaagttgattaaaccttacacgagaatcagaataccttttatatccaaggagcttaatgtgccagagcaagatgttgagcagttattggtgtcactaatattggacaaccgagtacaaggacacattgatcaagtcaacaaattactggagcgtagcgaccggtcaaagggattgaagaagtatacagctattgacaaatggaacactcaactcaagtcattatatcaaacggttaacaaccgggttggttgagaattgagattggacttggtaaatggtaatgcttactttgtgatttattttgtgccgggtttcatacaaaggttgcagtaacctcggttaacttacttggcccttccagtcaagtgacaattgaatttgagcatctacctcatgtatcaaaaacacattacaaattgcaaattcccttgatgggtggtcgttatcggcgagtagctctcctgggtttttttggtctacaattttggaattgatattggtcgatctgaacgcaagctgcttgttttcttaagcgtgcgtgcaa

SEQ ID NO: 3197 - DNA, 1669 bp, Glycine max
ggattttgagcaccgtgtgcgtagaggactggtgaacactcactcgccactgctcacgaaccgtataaaccctaaaaccttgatttttcccaatccattccacgcacaatatggcttcagatgctgacatggaggactacggtttcgagtactccgatgaggaggaagtggagcaagacgttgatatcgagaatcaatattacaattcaaaaggtatggtagaaagtgatccagaaggtgcgcttgctggttttgctcaggtagtgcaaatggaacaagaaaaagcagaatggggatttaaagctctaaaacagactgtcaagctatattatcgactgggaaggtataaagagatgatggaagcctatagggagatgttgacatatattaagtcagcagtgactcgtaactatagtgaaaaatgcataaacagcattatggactatgtctcaggttcagcaagccagaactttggccttctccaggaattctaccagactactctgaggtcccttgaagatgcaaagaacgagagattgtggtttaagacaaatctgaagctttgcaagatatattttgatattggtgaatatgggcgtatgaataagatcttgaaggaacttcacaaatcttgtcaaaaagaagatggcacagatgaccacaaaaaaggaactcaacttttggaggtatatgctgtagagattcaaatgtacacagagaccaagaacaacaaaaaacttaagcaactttaccagaaagcactcactattaagtcagcaattccccatccaaggataatgggaataatccatgaatgtggcgggaaaatgcatatggcagagcgccagtgggcagaagcagctactgatttctttgaagctttcaagaattatgatgaagctgggagtcagagacgtatccaatgcttgaagtaccttgttcttgccaacatgttgatggagtctgaagtaaatccatttgatgggcaggaagctaagccatacaagaatgaccctgaaattttggtgatgactaacttaatagcggcttatcaacgtaatgaaatattggaatttgagaaaattctgaagagtaacagaagaactatcatggatgatccatttatcagaaattacattgaggatctgctaaagaatattagaacacaagtcttgctgaagctcatcaaaccatatacaaggatcaggatcccttttatatctaaggaacttaatgttcctgagcatgatgttgagcagctattggtgtcgctgattttggataatagaattcaagggcatattgatcaagtgaaccggctcttagaacgcgctgataggtcgaaaggaatgaaaaagtacactgcagttgacaaatggaacacacagcttaaatctctttatcaaactattaacaacagagtttgttaaaacgtgtatcatggaagtgttatatttcttgttttccccaacttgcagttttgccatgtgaattattgtaagctacactgaggggaggagggagatgggagtgtattaccactatagcggaattcaggtcaaaccaacttgtggttcttgttttatattatagaaaaatataattgtttgaaacattcatgattcaatttttttggggccaatacatgtctgtatatctgcatattact

SEQ ID NO: 3198 - DNA, 1766 bp, Glycine max
taccccttccggcataccttcaccggattttgagcaccgtgtgcgtagaggactggtgaacactcactcgccactgctcacgaaccgtataaaccctaaaaccttgatttttcccaatccattccacgcacaatatggcttcagatgctgacatggaggactacggtttcgagtactccgatgaggaggaagtggagcaagacgttgatatcgagaatcaatattacaattcaaaaggtatggtagaaagtgatccagaaggtgcgcttgctggttttgctcaggtagtgcaaatggaacaagaaaaagcagaatggggatttaaagctctaaaacagactgtcaagctatattatcgactgggaaggtataaagagatgatggaagcctatagggagatgttgacatatattaagtcagcagtgactcgtaactatagtgaaaaatgcataaacagcattatggactatgtctcaggttcagcaagccagaactttggccttctccaggaattctaccagactactctgaggtcccttgaagatgcaaagaacgagagattgtggtttaagacaaatctgaagctttgcaagatatattttgatattggtgaatatgggcgtatgaataagatcttgaaggaacttcacaaatcttgtcaaaaagaagatggcacagatgaccacaaaaaaggaactcaacttttggaggtatatgctgtagagattcaaatgtacacagagaccaagaacaacaaaaaacttaagcaactttaccagaaagcactcactattaagtcagcaattccccatccaaggataatgggaataatccatgaatgtggcgggaaaatgcatatggcagagcgccagtgggcagaagcagctactgatttctttgaagctttcaagaattatgatgaagctgggagtcagagacgtatccaatgcttgaagtaccttgttcttgccaacatgttgatggagtctgaagtaaatccatttgatgggcaggaagctaagccatacaagaatgaccctgaaattttggtgatgactaacttaatagcggcttatcaacgtaatgaaatattggaatttgagaaaattctgaagagtaacagaagaactatcatggatgatccatttatcagaaattacattgaggatctgctaaagaatattagaacacaagtcttgctgaagctcatcaaaccatatacaaggatcaggatcccttttatatctaaggaacttaatgttcctgagcatgatgttgagcagctattggtgtcgctgattttggataatagaattcaagggcatattgatcaagtgaaccggctcttagaacgcgctgataggtcgaaaggaatgaaaaagtacactgcagttgacaaatggaacacacagcttaaatctctttatcaaactattaacaacagagtttgttaaaacgtgtatcatggaagtgttatatttcttgttttccccaacttgcagttttgccatgtgaattattgtaagctacactgaggggaggagggagatgggagtgtattaccactatagcggaattcaggtcaaaccaacttgtggttcttgttttatattatagaaaaatataattgtttgaaacattcatgattcaatttttttggggccaatacatgtctgtatatctgcatattacttaaagcacactcccctctttaaccatttccatccttttcatgactctgaaaacaacttatggatgatcagtgg

SEQ ID NO: 3199 - DNA, 1998 bp, Cephalotaxus harringtonia
aatacaaatcgattaatcacttggatcaagtcgtaaaaactcgaagatcctttaaaaatgcattctgcggtaatgccgaataatatatacgtgttttcccgaatcacaattaaaggcgggcacactggtatatctagctgaataacatatcattctgccatctgacaagcactatagcttccagcacccatgtcttcagatatggaggattatggctttgaatactccgaggaggagaccgaggagcaggatgtcgacattgaaaatcagtattacaactctaaaggtttggtggagtctgatccacaagaagctcttgctggtttttctgaagttgtgagaatggaatccgaaaaagccgaatggggatttaaggctttgaaacaaactgttaagttgtactaccgtttaggaaaatataaagagatgatggatgcatatcgggaaatgctgacatacattaaatcagcagtgacacggaactacagtgaaaaatgtataaacaatattatggattttgtttctgggtctgcaagccaaaattttgaactcctacaggagttctatcagactacacttagagctcttgaagaggcaaaaaatgagaggctttggttcaagactaatctcaagctttgtaagatttggtttgatatgggagagtatggtcgcatgaacaagatacttaaggagcttcacaaatcttgccggagagaagatggatcagatgaccagaagaaaggcactcagctcttggaggtctatgccattgagattcaaatgtacactgaaacaaaaaacaacaagaagttgaagcaattgtaccaaaaagcactttctattaaatctgcaatacctcatccacggataatgggtattattcatgaatgtggtgggaaaatgcatatggctgaaagacaatgggcagaggcagcaacggacttctttgaagccttcaaaaactacgatgaagctggaaatcatcgacgcattcagtgtttgaaatatctagtgctggcaaatatgttgatggaatctgaggtgaatccctttgatggtcaggaggcgaagccgtacaaaaacgatccagagattctagcaatgaccaatcttgttgcagcataccaacggaatgagatattggagttcgaaaagattctaaagaacaacatgaagacaattatggaagacccatttatccgcaactatattgaagatctattgaagaacattagaacacaagtattgctgaaactcatcaaaccttatacacgtattcgtatacccttcatatctaaggagctaaatgttccagagaaagatgttgagcagcttcttgtatctttaattttagataaccgagttcatgggcacattgatcaggttaatcaacttctggagcttggtgatagatcaaaggggttaaagaaatatgtggcaatagacagatggaatacacaactcaggaccctgtaccagactgtcacaaacagggtaggctgaatttagaccactctagatacaatgtatccatcttgataggttgtcaagcgataattgtatggttcctgctctctttcctcggaagctgctaaatgcatgttccatttttagtactagagttacatattttacaataattcatggaatataaaaatccttcatgagaacatttgcagaatcaccgagaaaactttagtaacagaatctggtaaatttactcttcttacttctctgcctcttgggagcatttttgctgcaaagtgaactctgataaactttgactggtattattgtcttgtctcgcatgggttatgaaccacacaagttcttcactttgtacatgaagagaactgtgtgtcctgatttcactaaaattcatggcagttgttttgtctatataaataaaacagccttcatgtggattactttggaataatattgtattggctggaaaagtaggagaaggataatgcaatcttatgggtgttctctttc

SEQ ID NO: 3200 - DNA, 1680 bp, Vaccinium corymbosum
ttcggggagaagataaaaaaaacacgatttgtaagcgaaccctcgtgcttcgattttcattatcccaccattcaaccatggcctctgatgcagatatggaggattatggatttgagtattcagatgatgagcctgaggaacaggacgtcgacattgaaaaccaatattacaactctaaaggtttggttgaaactgacccggaaggagcacttgcggggtttgctgaagtcgttcagatggaacctgaaaaggctgagtggggattcaaagctttgaagcagactgttaagctctactacagattagggaagcataaagaatgatggacacttacagggtgatgctcacatatattaaatccgctgtgacaaggaattacagtgaaaagtgtataaacaatatcatggatttcgtttctggatcagctagtcagaactccattctcttgcaagagttttatcagaccactctgaaggcccttgaagaggcaaagaatgagaggctctggtttaagacaaatctaaagctctgcaagatttggttcgatatgggtgaatatgggagaatgagtaagattttgaaggagctacacaaatcctgtcaaaaagatggagcagatgatgaaaagaaaggaacacaactcttagaggtgtatgcaattgagattcagatgtacactgaaactaaggataacaaaaggctcaagcaactatatcaaaaagcactatctatcaagtcggcaataccccatcctagaatcatgggaatcattcgcgagtgtggtggtaaaatgcatatggcagaacgtcagtgggctgaggcagccacagatttctttgaagctttcaagaactatgatgaagctggtaaccagaggcgtatccagtgtctgaaatatttggttctggccaatatgctgatggaatctgaagttaacccatttgacggacaagaagcaaagccgtataaaaatgaccctgaggtattggtaatgacaaatttgattgcagcatatcaacgtaatgagatactggaatttgagaaaatccttaagactaatagaaggacgataatggacgatccatttattaggaattacattgaagatctcttgaagaaggttaggaccctagtgttgctaaagctaatcaagccttacacaagaattcgtcttcccttcatatcaaaggagcttaacattccagagaaagacgttgaggaattgttggtttctctaatcttggataatcgtatccatgggcacatcgatcaagtcaaccggctgttagagcgtggtgacagttcaaagggagtaaagaagtacaccgccatagataaatggagtactcaactcaagtctctcaacctaaccattgaaaacagagtatgttgagatcgattttacaaggaaatggcgctctagaatgttgactgtggcttgaaatcgtgttctcttgccctgatttaagttctatacttgctaggaggctttctgcaactcatactgcaacttaaggctttaaagttatgattgtacaagaatgtatgaaaccaaattggctttattttaggatctaaaaatgtgtcctggaggggatacaagcaaattttatgaagctctggctcagtattttggcttgatagtttcttttgactgctactctcgatccagtctacgaa

SEQ ID NO: 3201 - DNA, 1727 bp, Glycine max
gagcacccagactgggcggtgaggacttgcgaacactcactcgccactgctcacgaaacgtcgaaaccctaaaacctcgatttttcccaatccattccacacacaatatggcttcagatgctgacatggaggactatggcttcgagtactctgatgaggagcaagaagagcaagacgttgatatcgagaatcaatattacaattcaaaaggtatggttgaaagtgatcccgaaggtgcgcttgctggttttgctcaggtagtgcaaatggaacaagaaaaagcagaatggggatttaaagctctaaaacagactgtcaagctacattatcgactgggaaggcataaagagatgatgaaagcctatagggagatgctgacatatattaagtcagcagtgactcgtaactatagtgaaaaatgcataaacagcattatggactatgtctcgggttcagcaagccagaactttggccttctccaggaattctaccagactactctgaggtcacttgaagaagcaaagaatgagagattgtggtttaagacaaatctgaagctttgcaagatatattttgatattggtgaatatgggcgcatgagtaagatcttgaaggaacttcacaaatcctgtcaaaaagaagatggcacagatgaccataagaaaggaacccaacttttggaggtatatgctgtagagattcaaatgtacactgagaccaagaacaacaaaaaacttaagcaactttaccagaaagcactcactattaagtcagcaattccccatccaaggataatgggaataatccatgaatgtggtgggaaaatgcatatggctgagcgccagtgggcagatgcagctactgatttctttgatgctttcaagaattatgatgaagctggtagtcagagacgtatccaatgtttgaaataccttgttcttgccaacatgttgatggagtctgaagtaaatccatttgatggacaggaagctaagccatacaagaatgaccccgaaattttggtaatgacaaacttaatagcagcttatcaacggaatgaaatatcggaattcgagaaaatcctgaagagtaacagaagaaccatcatggatgatccatttatcagaaattacattgaggatctgctaaagaatattagaacccaagtcttgctgaagcttatcaaaccatatacaaggatcaggatcccttttatatctaaagaacttaatgttcctgagcatgatgttgagcagctattggtgtcactgattttggataatagaatccaagggcatattgatcaagtgaaccggttcttagaacgctctgataggtcgaaaggaatgaagaagtacactgcagttgacaaatggaacacgcagcttaaatctctttatcaaactattaacaacagagtttcttaaaacgtgtatcgtggaagtgttatatttcttgttttccccagcttgcagttttgtcatgtgaattattgtaagcttcaatggtgagggagatgatgggagcgtattaccagtttaccactatagaggaattcaggtcaaaccaacttgtgattcatgttttatattataggaaagtataattgttttgaaacattcatgattcaattttttggagccaatacatgtctgtatatctgcatattacttaaagcgcgcgactctgataacaacaatgtatttggaatttgggaagttgcacta

SEQ ID NO: 3202 - DNA, 1834 bp, Glycine max
ccaaaatgggccccgtattggatttgggccatgggtagcagcagcaactgttataaataaccccttccggcaccttcaccggcttttgagcacccagactgggcggtgaggacttgcgaacactcactcgccactgctcacgaaacgtcgaaaccctaaaacctcgatttttcccaatccattccacacacaatatggcttcagatgctgacatggaggactatggcttcgagtactctgatgaggagcaagaagagcaagacgttgatatcgagaatcaatattacaattcaaaaggtatggttgaaagtgatcccgaaggtgcgcttgctggttttgctcaggtagtgcaaatggaacaagaaaaagcagaatggggatttaaagctctaaaacagactgtcaagctacattatcgactgggaaggcataaagagatgatgaaagcctatagggagatgctgacatatattaagtcagcagtgactcgtaactatagtgaaaaatgcataaacagcattatggactatgtctcgggttcagcaagccagaactttggccttctccaggaattctaccagactactctgaggtcacttgaagaagcaaagaatgagagattgtggtttaagacaaatctgaagctttgcaagatatattttgatattggtgaatatgggcgcatgagtaagatcttgaaggaacttcacaaatcctgtcaaaaagaagatggcacagatgaccataagaaaggaacccaacttttggaggtatatgctgtagagattcaaatgtacactgagaccaagaacaacaaaaaacttaagcaactttaccagaaagcactcactattaagtcagcaattccccatccaaggataatgggaataatccatgaatgtggtgggaaaatgcatatggctgagcgccagtgggcagatgcagctactgatttctttgatgctttcaagaattatgatgaagctggtagtcagagacgtatccaatgtttgaaataccttgttcttgccaacatgttgatggagtctgaagtaaatccatttgatggacaggaagctaagccatacaagaatgaccccgaaattttggtaatgacaaacttaatagcagcttatcaacggaatgaaatatcggaattcgagaaaatcctgaagagtaacagaagaaccatcatggatgatccatttatcagaaattacattgaggatctgctaaagaatattagaacccaagtcttgctgaagcttatcaaaccatatacaaggatcaggatcccttttatatctaaagaacttaatgttcctgagcatgatgttgagcagctattggtgtcactgattttggataatagaatccaagggcatattgatcaagtgaaccggttcttagaacgctctgataggtcgaaaggaatgaagaagtacactgcagttgacaaatggaacacgcagcttaaatctctttatcaaactattaacaacagagtttcttaaaacgtgtatcgtggaagtgttatatttcttgttttccccagcttgcagttttgtcatgtgaattattgtaagcttcaatggtgagggagatgatgggagcgtattaccagtttaccactatagaggaattcaggtcaaaccaacttgtgattcatgttttatattataggaaagtataattgttttgaaacattcatgattcaattttttggagccaatacatgtctgtatatctgcatattacttaaagcgcgcgactctgataacaacaatgtatttggaatttgggaagttgcactaaattgagtttttttattttt

SEQ ID NO: 3203 - DNA, 1724 bp, Solanum phureja
gaagaaatataaaggaacacaaaatcccccgaagcttcattcactctgattttctcacaaatccataacgaagcaaatcaaagggctctgtacttcttctacgaaacatgggttcagatgctgatatggaggattacggatttgagtattcggacgaggaccaggaggagcaggatgttgatattgagaatcagtattacaattcaaaaggtatggttgagacggatccagagggtgcacttgagggattcgcggaggtggtacaaatggaacctgagaaggcagaatggggttttaaagctcttaagcagacagtcaaaatttattatcgtttagggaggtataagcagatgatggacgcttacagggaaatgcttacttatattatatcagcggtaacgcgaaattacagcgagaagtgcatcaacaacataatggattttgtctctggctcagctagtcagaatgttggtttgttgagggagttctatgaaaccacactgaaagcccttgaagaggctaaaaatgaaaggttgtggtttaagacaaatcttaagctttgcaagatctggtttgacatgggtgagtatggtaaaatgaacaagattatgaaggagcttcacagatcttgtcaaaaagctgatggtactgatgatcaaaagaaagggactcagctcttggaggtttatgctattgaaattcaaatgtacactgagacaaagaacaacaaaaagctgaaggaattgtatgggaaggctcttacaatcaaatcagctatcccacatcctagaataatgggaataatccgtgagtgtggtgggaaaatgcatatggcacaaagacagtgggcagaggcagctactgacttctttgaagcttttaagaactacgatgaagctggtaatcaacggcgcatacagtgcctgaaatacttggtgttggccaacatgcttatggaatcacaagttaatccgtttgatgggcaggaggcaaaaccgtacaaaaatgacccagaaatcttggccatgactaatttgattgctgcatatcaacgaaatgagatattggaattcgagaaaatccttaagagcaatagaaaaactatcatggatgatccattcattagaaattatattgaggacttgttgaagaatataaggactcaagtgttgctgaaactcattaaaccatatacacggatcaggattcctttcatatcgaaggagattaacgtaccagaaggtgaagtggaaacgttattggtgtcactgatactggataaccggatacaaggtcatattgaccaagtaaacaaattgttggagcattgcgacaggtcaaaggggatgaagaagtatacagctattgatagatggaacacacaatttcagtctctttatcaaaccattagcaataaagtggggtaaaatcagtattcaactgaagtttttattttattttatgaagattagaagccagctacaaagaggacaagaagaaaaagtttactaggtttctcttgtctatttatgttttcaacttcacaaatttagctctttgtactttccatcctcaatttttgaattgaactctttgagaaattttaagaatttgagtactttctttgatgcaatctcttacaagctgtgagcttataaaaattgattttaccaaattattttatttattatgatgatgacgatgacatgatatgagcttaaatg

SEQ ID NO: 3204 - DNA, 1744 bp, Solanum lycopersicum
gaagtaatataaaggaacacaaaatcccccgaagcttcattcactcggattctctcacagtgataaacgaatccctaacgaagcaaatcaaagggctctgtacttcttctacgaaacatgggttcagatgctgatatggaggattacggatttgagtattctgacgaggatcaggaggagcaggatgttgatattgagaatcagtattataattcaaaaggtatggttgaaacggatccagagggtgcacttgagggattcgcagaggtggtacgaatggaacctgagaaggcagaatggggttttaaagctcttaagcagacagtcaaaatttattatcgtttagggaggtttaagcagatgatggactcttacagagaaatgcttacttatattatatcagcggtaacgcgaaattacagcgagaagtgcatcaacaacataatggattttgtctctggctcagctagtcagaatgttgggttgttgagggagttctacgaaaccacactgaaagcccttgaagaggctaaaaatgaacgattgtggtttaagacaaatcttaagctttgcaagatctggtttgacatgggtgagtatggtaaaatgaacaagattatgaaggagcttcacagatcttgtcaaaaagctgatggtaccgatgatcaaaagaaagggactcagctcttggaggtttatgctattgaaattcaaatgtacactgagacaaagaacaacaaaaagctgaaggaattgtatgggaaggctcttacaatcaaatcagctatcccccatcctagaataatgggaataatccgtgagtgtggtgggaaaatgcatatggcacaaagacagtgggcagaggcagcgactgacttctttgaagcttttaagaattacgatgaagctggtaatcaacggcgcatacagtgcctgaaatacttagtgctggccaacatgcttatggaatcacaagttaatccgtttgatgggcaggaggcaaaaccgtacaaaaatgacccagaaatcttggccatgactaatttgattgctgcatatcaacgaaatgagatattggagtttgagaaaatccttaagagcaatagaaaaactatcatggatgatccattcattagaaattatatcgaggacttgttgaagaatataaggactcaagtgttgctgaaactcattaaaccatacacacggatcaggattccttttatatcgaaggagattaacgtaccggaaggtgaagtggaaacgttattggtgtcactgatattggataaccggatacaaggtcatattgaccaagtaaacaaattgttggagcattgcgacaggtcaaaggggatgaagaagtatacagctattgataaatggaacacacaatttcagtctctttatcaaaccattagcaacaaagtggggtaaaatcagtgttcaactgaagtttattttatttattttttattataaggattagcaacaagctacaaagtgaactggaggacaagaagaaaagagttttctctatttatggtttcaactttacaaatttagctctttgtacttcccatcctcaatttttcaattgatctctttatgaaattttaagaatttgagtactttgtttgatgcaatctcttacaagctgtgagcttatagaaattgattttaccaaattattttgtttattataatgacgacgatgatatgatatgagcttaaatgttgaaag

SEQ ID NO: 3205 - DNA, 1643 bp, Podocarpus macrophillus
gagagcacaactattcgtctgatatcgagcagccatggcctccgatgcagacatggaggattatggcttcgaatactccgacgaagagacggaggagcaggatgtcgacattgagaaccagtattacaactccaaaggtttggtggagtctgatccacaagaagctcttgctggttttgctgaagttgtgagaatggagtcagagaaagcagaatggggattcaaggctttgaaacaaactgttaagttgtatttccgtttaggaaagtacaaagagatgatggaagcctatcgggaaatgctgacatatattaaatcagcagttacacgaaattacagtgaaaagtgcataaacaacatcatggattttgtttctggaacagcaagccagaattttgaacttctgcaggagttctatcagactacactaaaggcccttgaagaggcaaaaaatgagaggctttggtttaaaacaaacctcaagctttgcaagatctgttttgatattggagagtatggtcgcatgaacaagatacttaaagagcttcataaatcctgccgtaaagaagatgggtcagatgaccagaagaaaggaagtcaactcttggaggtctatgctctcgagattcaaatgtatactgaaacaaaaataacaagaagttgaagcaattgtaccaaaaagcactgtctattaaatctgcaatacctcatcctcggataatgggtattattcatgaatgtggtgggaaaatgcacatgactgaacgacattgggcagaggcagcaacagacttctttgaagccttcaaaaactatgatgaagctggaaatcatcgtcgcattcagtgtttgaaatatttagttctggcaaatatgctgatggaatctgaggtgaacccttttgatggtcaggagactaaaccatacaaaaatgatccagagattctggcaatgaccaatcttgtggcggcataccaacgaaatgagatactggaatttgaaaagattttgaagagcaacaggaagacgatcatggatgatccatttatccggaactacatagaagatctattgaaaaacattagaacacaagtattgctgaaactcattaaaccatatacacgtattcgtataccatttatatccaaggagctaaatgttccagtgaaagatgttgagcagcttcttgtatctctaattttagataatcgagttcatggacacattgatcaggtcaatcaacttttggagcttggtgatagaaccaaggggttaaagcagtatgtggcaatggacaaatggaatacgcaactcaggtccctgtatcagaccgtcacaaacaggataggctgattttgaacctctagaaacaatttattcatcttgatatcttgttgaggaatattctggtgcggaatagtctgatgcttcattgtgtctgttctccaaagctaggcgatgttccatttgaatgtttacagttgtatatttgcaagcgttctatggaattgaaaattcttcaaaagaaaacacttgtataatcattgcgaaaaaaaacaaaagagtatccatttttgttaattttcatcatgttcttatttctctgccttctggcaacgtgtttgttgcaaagtcaaacttgt

SEQ ID NO: 3206 - DNA, 1383 bp, Fagus grandifolia
ggattctagaacctctctcacactctctactttccgagcgaattcaagttttagagagagagaaagagagggttttcaccaacaatttcaaacgatctttaatcacctcgatccacaatgggttccgatgcagacatggaagattacggattcgagtactcagaggaggagcaagaggagcaagatgttgacattgagaatcaatactacaatgcaaaaggtttggttgaaactgatccaaaaggtgcattggctggcttttctgaagtagtaaacatggaagaggagaaggcagagtggggatttaaagctctaaaacaaactgtcaagctttattatcggttagggaagtatgaagaaatgatggaagcctatagggaaatgttgacctacattaagtcggcagtgacacgaaactatagtgaaaaatgtataaatagcatcatggatttcgtttctgggtcagctagtcagaactttgggcttttgcaagagttttaccagacaactttgaaggcccttgaagaggcaaaaaatgagagactgtggtttaaaacaaatctcaagctttgcaagatttggtttgacatgggtgaatatgggcgaatgagtaagattttgaaggagcttcacaaatcttgtcgaaaagaagatggtacagatgaccacaagaaaggaacccaacttttggaagtatacgctatagagattcaaatgtacactgagaccaagaataacaagaaactcaagcaactataccaacaagcacttacgatcaaatcagccataccccatccaaggataatggggataattcatgaatgcggtggtaaaatgcacatggcggagcgccagtgggcagaagcagctactgatttctttgaagcgtttaaaaattatgatgaagctggaaatcagcgtcgaatccaatgcttgaaatatctggttcttgccaacatgctgatggagtctgaggttaatccatttgatgggcaggaggctaaaccatacaaaaatgacccagaaattttggcaatgacaaatctaatagcagcctaccaacggaatgaaatattggaatttgagaaaatcctgaagaataacagaagaacaattatggacgatccatttattagaaattatatcgaggatctcttaaaaaatattagaactcaagtcttgctcaagctcatcaaaccttatacaaggatcaggatcccattcatatctaaggagcttaatgtgcccgagcaagatgttgagcagctgttggtatcactaatattggataacagaatccacgggcacatcgatcaagtgaatcggctgctagagcgctgggacagatcaaagggaacaaagaagtatgctgctgtggagaaa

SEQ ID NO: 3207 - DNA, 1376 bp, Pseudoroegneria spicata
tgcacttgctggttttgatgctgtagttcgcatggagcctgaaaaggcggaatggggattcaaggctctcaaacaaactgtgaagctttattataagctggggaagtacaaagaaatgatggatgcttacagagagatgttgacatacataaaatctgctgtgacacgtaactacagtgagaaatgtataaacaacataatggattttgtttctggatctgctagtcagcacttcaatcttctgcaagagttctaccagacaacacttaaagctcttgaagaggcaaaaaatgagagattatggtttaagacaaatcttaagctttgcaaaatttggttcgacatgggggagtacggtcgcatgagcaagatactgaaggagctgcataagtcttgccaaaaggaagatggttctgatgaccagaagaaaggcacacaacttctggaagtctatgctatcgagattcaaatgtacactgaaacaaaaaacaacaaaaagttgaaggaattgtaccagagggctctttctattaaatcagcaatacctcatccaagaattatgggtataattcgtgaatgtggtgggaagatgcacatggctgagaggcagtgggcggacgcagcgactgatttctttgaagcattcaaaaactacgatgaagctggcaatccacggagaatccagtgtctcaaatatcttgttcttgccaatatgttgatggagtctgaagtgaatccctttgatggacaagaggccaagccgtacaaaaatgatcctgaaatcctcgcaatgacaaacttgattgcagcataccagaagaatgacatcatggaatttgagaagatcctaaagagcaatagaagaacaataatggatgatccttttatccgtaattacattgaggacttattgaagaacatcagaactcaagtgctgctcaagctcattaagccatacacaagaataaggattccattcatttcacaggagctaaatgtcccagaaaaggatgttgagcagctcttggtgtccttgattctggacaaccgtgtccagggccacatagatcaggtgaacaaactgctagaatgcggtgacaggtcaaagggaatgcggaaatatcaagccatcaataagtggaatactcagctcaaatctatttaccagacggtgtccaacagagttgggtgagagatggcaggtttccattagtacctgctggttgagttgttttggtgtcttggggcttattaaatgtgaaggagtatctcgttcggtccgtgaggcagggatcctggatgtgggtaaagtaacttgtcactgtaatgaacgtagcactccagttggtggattatatcctctcatcttttctgga

SEQ ID NO: 3208 - DNA, 1712 bp, Ceratodon purpureus
gtcgaagaagacgaagaaggcgacgcagagtttggaggagaggaggagagcagtgcgtgcgctgcgctatcgcttctcttccgcgccttccactcggccctcgctgctcccccctacgcagccatggattcagatgcggacatggaagattatggcttcgaatattcggatgaggaacccgaagagcaggatgttgatatcgagaatcaatactataataccaaaggattggtggaagctgatcctgagggggccctcaggggattttctgaggttgtaaagatggaaggagagaaaggagagtggggttttaaggcgttgaagcagacagtgaagcttcattatcggattggtaattacaaggagatgatggatgcttaccgggagatgttgacctacatcaagtcagctgttactcgcaattacagcgaaaagtgcatcaacaacatccttgactttgtgtcaaatggtgctaatcagaacttggagttgcttcaggagttctaccagaccactttgaaggctttggaggaggccaaaaacgagaggttatggttcaagacgaacttgaagttgtgtaaattgtggtttgatatgggcgagtatggccgaatgaataaaatcttgaaggagctccataaatcctgtcagaaggaagatggtacagacgaccagaagaagggcacacaattgttggaggtttatgcgatagagattcagatgtatacagagaccaagaacaacaagaagctcaagcaactatacctgaaagcgctgaacataaagtctgctattccacatccacgaatcatgggtatcattcacgaatgtggagggaaaatgaacatggctgagcggcagtgggctgttgcagccacggacttctttgatgcattcaagaactacgacgaggctggtactcacaggagaattcagtgtctgaagtacttggtgcttgcgaatatgctgatggagtctgaggtgaacccgttcgatgctcaggaggctaaaccgtacaagaacgacccagagattttagcgatgacaaacttggtggctgcctatcagaggaatgaaattcttgaatttgaaaagattctgaagagtaacagaaagacgatcatggatgaccccttcatacggaattacattgaagatttgctcagcaaaattcgtacacaagtgctactgaagctcatcaagccttatacccgaattcgcattcccttcatatctaaggagctgaacatacctgaaaaggatgtggaacaacttcttgtgtctttgatcctggataatagagtgcatggtcatattgaccaggtaaaccagttgctggagctcggtgacaggtcaaaggggctgaggaaatacacagcgattgatacatggaacacccaactgaagtcgctctctcaaacagtgacggcaaggattggttagaaacgtgcattaaatttctatacatttgcacaaatagctgtgacaacttagtcgcacaagtgtcttcaccacaccagtgtacattttggaggtcctagtctatacatcagagggtttattggatcaccatttcttgtgagagagacatcaggaggaaccccattggtgccctcttctccttgtagattgagttgccctagtgtctggtttttgtaggcacctgtgttagcccaccgggacaggaagtaaagaaacggaatacaatattt

SEQ ID NO: 3209 - DNA, 2142 bp, Citrus sinensis
atgtggatatatatattttttcttttctcggatgagttcactgtttcacgagttctttgttctattcttgaaaaaggtttggttgaaacggatccagaaggggcacttgctggttttgctgaagtagttgccatggaacctgagaaggctgagtggggattcaaagcactgaagcaaactgtaaagctctattatcggctagggaagtataaagaaatgatggatgcttatagggagatgttaacatatatcaaatctgcagtgacacgaaactacagtgagaagtgcataaacaacataatggattttgtttctggatctgcaagtcagaatttcagtctcctgcgagaattttatcagaccactttgaaggctcttgaagaggctaagaatgagaggctttggttcaagacgaatcttaagctttgcaaaatctggttcgatatgggtgaatatgggcgaatgagtaagattttgaaggaacttcataaatcttgtcaaagagaagatgggacagatgatcaaaagaaaggaagtcaacttctggaggtctatgcaatcgagattcaaatgtacactgaaaccaaaaataacaagaagctaaagcaattataccagaaagctcttgctatcaagtcagccataccacatccaaggatcatgggaataattcgtgaatgtggtgggaagatgcacatggcagaacgtcaatgggcagatgcagcaactgatttctttgaagcatttaagaactatgacgaagcagggaaccagaggcgtattcaatgcttgaagtatctggttctggcgaatatgctgatggaatctgaagtgaatccatttgatggacaagaggcaaagccatataagaatgatcctgagattctggctatgacaaatctgatcgcagcataccaaagaaatgagataatagagtttgaaaaaatcctcaagagcaacagaaagactatcatggatgatccatttattcggaattacattgaagatctgttgaagaatgtcaggactcaagtcttgcttaagcttatcaagccctacacaaggatccggatccccttcatatctaaggagctcaatgtgccagaaaaagatgttgagcagttgttggtttcacttattctggataatcgaattgacggacatattgatcaagtgaaccggctattagagcgaggagacaggtcaaagggaatgaagaagtatactgccatagacaaatggaactcgcagctaaggtctctgtatcaaactgtcagcaatcgagtgtcttgagtacatagatatatgtgggatggtagcaaaaggtgcttgattggaattttgtagtattttgttgatgagtcggcggaaagttgctactggtttttggcattatgttgttcaggaatatacttctagtataatcttttttttttaattggttagcacactgaatcttaaaagtgcttatcttcatctcttgaattatctatatgtacgaatgaagaaagaaaaggagagataaccagcggcgatgatatggcgtgaatgccctgactgagagttgtggtacaaactccaaagcatggtagcggcctttgattcatttccaagcagccgacaaattaaaacgttcccaagatattaacgcagaaaccgcaagggtctgtctctttgggttgcaaattcatgggattgagttaaaactttgggttacaaatggaacccaatacccgcctccgtgttctcagtttgaatgtgttcatttcatgcactctgatatacagaattatgaatcatcgatcgtggcttgatcatggccctgggccggtgagccgtgagcagtttgcatattgaaggttatttaggtgccgcgggcgaggcagaggcactatggcagtccaggctcaacaaaagagtttgttctatcgtaatcgtagttcttcaagcctactgttatgtacctcttgagtcagatgatattttatctacttctaaatggattagcgacaagtcacccaattctctcaaatctcaatttagatgatctgtcgacaaaattttcacacgcaagagacaatcaattattcttggaattatttgtgataaatcgatattgtttgattctccaataaaaaataa

SEQ ID NO: 3210 - DNA, 1498 bp, Selaginella moellendorffii
gggaggcgctcagctcgtcgcgaggacgcttggcgcatcgccgctctccggaggcgccatggattccgacgcggacatggaagattatggctttgagtactcggaagaagaccccgaggagcaagatgtcgatatcgagaatcagtactacaactctaaaggatttgtggaggctgatcctcgaggagctctcaagggcttcgcggaggtcgtgaagatggaagaagagaaaggagaatggggattcaaggctttgaagcagaccgtgaaggtgcattttcgattggggacctacaaggagatgatggacgcctatagggagatgctgacgtacatcaagtccgcggttacccggaactacagcgagaaatgcatcaacaacatcatggattttgtctccggcactgcaaaccaaaacctggagctgctgcaagagttttaccagacaacgctcaaagctctcgaggatgccaagaatgagaggttgtggtttaaagcgaatctcaaactttgcaagctttggttcgacatgggagagtatgcacgcatgagcaagattttgaaagagctccacagatcgtgccagagagaagatggctctgatgatcagaagaaaggaactcagcttctggaagtatacgccattgagattcagatgtacacggagacaaagaacaacaagaagctaaagcaactctatcaaaaagctttgtctatcaaatcggcgattcctcatccacgcatcatgggaatcatccacgagtgcggcggaaagatgcatatggctgagaggcactgggcagacgcagccactgactttttcgaggccttcaagaactatgacgaagccggagcacaaagacggatccaatgcttgaagtatttggttcttgcaaatatgctgatggagtctcaggttaaccccttcgacgcgcaagaagcaaaaccgtataagaacgaccctgaaattctagcgatgacaaaccttgtcgcagcttaccagcgcaacgaaattttcgagtttgagaagatcctgaagagcaaccggaaaacgataatggacgacccgttcattcggaattacatcgaggacttgctgaagaacatccggacacaagtactattgaagctcatcaagccttacacccggatccgcattccatttatctcgaaggagctcaacattccggaaagagatgtggagcagctcttagtgtctctcatcctggacaaccgggttcacggtcacatagatcaagttcatcagctcctggagctcggtgacagatcgaaagggctgaaaaaatacaccgcgatcgacaaatggaacacgcagctgagatctctgtgccagaccgtctccaacaggatcggctgagagcgagaggattttttgtaacgcatttagcaacatccacgccaggtcggagtttcttcttcttcttcttctcttttggcctttgtagctcagtgtgtatattcgcgaaagaaaattttg

SEQ ID NO: 3211 - DNA, 1368 bp, Gnetum gnemon
gaattctttgagtaattcagctacgcagcagctatgagttcagatttggatatggaagattatgggttcgagtactcagatgaggaacagggagagcaggacgttgacatcgaaaaccagtactataattctaaaggattgatcgactctgaacctaaggaagctcttgctggctttgctgaagttgtgaaaatggaatcagaaaaaggagattggggatttaaggctttgaaacagactgtcaagctgtattatcggttagggaattacaaagagatgatggaagtgtatagagaaatgttgacttacataaagtcagcagtaacacggaacacaagtgagaaatgcataaacaacattatggatttcatctcagggtctgctggtcagaactttgacttccttcaagacttctatcagacaacattgaaggctcttgaagaggcaaaaaatgagaggctctggttcaagaccaatctaaaactttgtaagatatggtttgacatgggggagtatggacgaatgagtaagattctcaaagagctccacaaatcttgtcgcagagaagatggatcagatgaccaaaagaaaggaactcaacttttggaagtgtatgcaattgaaattcaaatgtatacagaaaccaaaaataacaaaaagttgaagcaattataccagaaagcactttcaattaaatctgcaatcccgcatcctcgcattatgggtataattcatgaatgtggtgggaagatgcacatggctgagcgccattgggcagaagcagcaactgattttttcgaggccttcaaaaattatgatgaagctggcaactataggcgtatccagtgtttaaaatacttagtcctcgcaaatatgttgatggaatctgaagtgaacccttttgatggacaagaagctaaaccatacaagaatgatcctgagattttagcaatgaccaatcttgtagcagcctaccaacgcaatgatattttagagtttgagaacattttgaagaataacaggagaactatcatggatgacccttttgttcgaaactacattgaagatttattgaagaaaatcagaacccaagtgttgctcaaactcatcaaaccttacacccgaattcgtatacctttcatatctaaggagctaaatgttccggaaaaagatgttgagcagcttttggtatctttaatcctggacaaccgagttcatggacatatagaccaggtcaatcaactgttagagctaggtgacaggtccaagggcttgagaaaatatgcagcaattgacaaatggaatacacaattgagatcactgtaccagaatgtatcatacaagatgagcgtgtattaggttgaatat

SEQ ID NO: 3212 - DNA, 1694 bp, Physcomitrella patens
agtctctctctcgcttcaatctcatcgcgtgatttctcactttctacacgcgatcacagcggaagccgagctcgaattcgccaccccccagacatggattcagatgcagacatggaagattatgggtttgagtattctgacgaggagcctgaagagcaagatgtcgatattgagaatcagtattataataccaaaggattggtagaagctgatcctgaaggagcaattaagggatttgcggaggttgtgaggatggaaggagagaagggggagtggggttttaaggcgctgaagcaaacagtgaagcttcactatcgaattggaaattacaagcaaatgatggatgcttacagagagatgttgacctacatcaagtcggctgttacacgtaattacagcgagaaatgtatcaacaacatcctcgactttgtgtcgaatggtgccaatcagaatttggagttgctccaggagttttaccagactaccttgaaggctttggaggaagccaaaaatgagaggttatggttcaagacaaacttgaagttgtgtaaattgtggtttgatatgggtgaatatggtcgaatgaataagattttgaaggagctccacaaatcttgtcagaaagaagatggtacagatgatcagaagaagggcacacaattgctcgaggtttatgcgatagagattcagatgtatacagagaccaagaacaacaagaagctcaagcaactatatctaaaagcgttgaacatcaagtctgcaattccacatccgcgcattatggggattatccacgaatgtggaggcaaaatgaacatggctgagcgacagtgggcagttgcggctaccgatttttttgatgcattcaagaattacgatgaggctggtacccacaggaggatccagtgtctcaagtacttggtgcttgctaacatgctaatggagtctgaagtgaacccatttgatgctcaggaggctaaaccgtacaagaatgacccagaaattctggctatgacaaatttggtggctgcttatcaaaggaatgaaatccttgaatttgagaaaattctcaagagcaacagaaagacaataatggacgatcccttcataaggaattacattgaagatctgcttagcaaaatccgcacacaagtgttgctgaagctcatcaagccttatacccgaattcgcattccctttatatctaaggagctgaacatacctgaaaaggatgtggagcagcttcttgtatctctcatcctggataatagagtgcatggtcatattgatcaagtaaaccaattgctggagcttggtgacagatcaaaggggctgaggaaatatacagcgattgataaatggaacactcaactcaagtcactttctcaaacagtgacggcaaggattggttagcaacatgcattaaaacggtatagctttggtgcacgaatagataagtggttattgtcgcatgtgtttcttcgccactgtatattctttatcgttacggtcccaacctttttgaggttttattggatcaccattacctgcgagggagatatccaggggaaccccattggtgacctcctctccttccagattgagttgtcctggtgtgtggtttttgttggcctatgtgtcaacccaccaggacaagatgtaaacaaacagaatgaaatgttttgatgcggtat

SEQ ID NO: 3213 - DNA, 1688 bp, Physcomitrella patens
tttgccgcccaggcccaagacttggctccacaacagggctactactttttttctagcagcttgctcttggccctggaatcgccgtctccgacgtctctttgcagcaatcaaccatggattcagatgcggatatggaagattatggctttgagtattctgatgaggagcctgaagagcaagatgttgacatcgagaatcagtactacaatactaaaggacttgtggaagctgatcctgaaggagcgctaaaggggtttgcggaagttgtgaggatggaaggagagaagggggagtggggattcaaggcgctgaagcaaacagtcaagcttcattatcgggtcggtaattacaagcagatgatggatgcgtatagagaaatgttgacctacatcaagtcggctgttactcggaattacagcgaaaaatgtatcaacaacatccttgactttgtatcaaatggcgctaatcagaacttggagttgcttcaggagttctaccagaccactctaaaggccttggaagaagctaggaatgagagattatggttcaaaacgaacttgaagttgtgcaaattgtggtttgatatgggagaatatggtcgaatgaacaaaatcttgaaggagcttcacaaatcttgtcaaaaggaagatggcacagatgaccagaagaagggcacgcagctgctggaagtttatgcgattgaaattcagatgtatacagagactaagaacaacaaaaaacttaagcaactatacctgaaagcgctgaacataaagtctgctattccgcatccacgcattatggggatcatccacgaatgtggagggaaaatgaacatggctgagcggcagtgggccgttgcagccactgacttttttgatgcattcaagaactacgatgaggctggtacccacaggagaatccagtgtttgaagtacttggtgcttgcgaacatgcttatggagtctgaggtgaacccatttgatgctcaggaggctaaaccatacaagaatgatccagaaattttggcaatgacaaatttagtggctgcctatcaaaggaatgaaattcttgagttcgaaaaaattctcaagagtaacagaaagaccataatggatgaccctttcattcggaactacattgaagatctgctcagtaaaatccgcacgcaagtgttgctgaagctcattaaaccttatacccgaatacgtattcccttcatatctaaggagctgaacatacctgaaaaggatgtggagcaactccttgtatctctgatcctggataatagagtacatggtcatattgatcaagtaaaccaattgctggaacttggtgacaggtccaaggggttgaggaaatatacagcgattgatacatggaacactcaactgaagtctctctcgcaaacagtgacggccaggattggttagaaactttctctaatttaattctacagctctggcgcacactaacatgtgcgacaactttccgtccatgtctctttactagtgtacattttgggggtactagtctgaactacttagggtttcgtgggatcaatatttcacgtgagagaggcccctttcggcgaccttttcatgtagattgagttggcatactgtttttgtaggcgcctgtgttagcccaccagcactagttagaaacggaatacaatattttgatac

SEQ ID NO: 3214 - DNA, 1269 bp, Sesamum indicum
ctctaacgatcgcagttctctggaaatccttttcagttttgagttgaacaaatattcgcgatgggttccgatgctgatatggaggattatgggtttgagtactcggacgaggagccggaggaacaggatgtagatattgagaatcagtattacaattctaaaggcttggttgaaacggacccagaagcagcacttgaaggtttcgcagaagtggtgcggatggaacctgaaaaggctgaatggggatttaaagctttgaaacaaactgttaagctttactataagcttgggaagtacaaagaaatgatggatgcatacagagacatgttaacttatattaaatctgcagtgactcgaaactatagtgagaaatgcataaacaatatcatggatttcatttctggatctgctagtcagaactttggtctactgcaagagttttatcaaaccaccttgaaggcccttgaagaggccaagaatgagagattatggttcaagacaaatctgaagttgtgcaaaatatggtttgatattggtgaatacgggcggatgagtaagatattgaaggagcttcacaaatcttgtcaaaaagaagatggtactgatgatcagaagaaaggcacccaattgttggaagtgtatgcaattgagatccaaatgtacactgagactaaaaacaacaaaaaactgaaggaactatatcagaaggcattatctgtcaaatctgctattcctcatccaagaatcatgggcataattcgtgaatgcggtggaaaaatgcatatggcagagcgacagtgggcagaagcagccactgatttctttgaagcttttaagaattatgatgaagctgggaaccagaggcgcatccaatgtctaaagtacttggttttagcaaatatgctgatggaatcagaggtaaacccgtttgatggtcaagaggcaaagccatataaaaatgatcctgagattttggcaatgacaaacctaatagcagcatatcagaggaatgagattttggagtttgaaagaattttgaagagtaacagaaggacaataatggatgatccatttattcgaaattacattgaagatctcctgaagaatgtgagaacgcaagtgttgcttaagctcattaagccttacacaagaattcggatcccctttatatcaaaggagcttaatgtgccagagaaggacgttgaggagttattagtctcccttatcctggataatcggattcaggggcacattgatcaagtgaatcgg

SEQ ID NO: 3215 - DNA, 2200 bp, Physcomitrella patens
aaatcactgaatacatttcaatggagaattctacaaagaagaaaaacaatttcatgccaataccttccaacatcgttcaatatgctagtaccaagacacaaacccatgaaagtgacttagcaacccaatcctcagaacaaacaagggtcgtcagaatcgcaattgcccacaccttacgaagccattatttacagggtaacatcagagtacaggcactcttcttccacatttacccgctgagagattttcctgggtataaagttgagcactatatacccgctggaggacaagttatccaatcgtttcctccaggtatcaaagtccgagcctcattgggccgcgtctaccagtggcggacttcctcttatacccgctatttgtgtcaccatgtgcgacctaggcaaaatatacccgcttcaggacctactcatccagccgcagtatcagggtatcattgcccgtgtctcattcggcctccgcctgccggatgcggagcggagaacgttggaggcagagacaatcggacaagcttaggcgagagtgatcccgcctcgctcttcgtcactggactcaatccctgcaggaatcggcctcgatttcgtgttgctacagcaatggattcagatgccgacatggaagattatgggttcgagtattcggacgaggaacccgaggagcaagatgttgatattgagaatcaatattataataccaaaggattggtagaagctgatcctgaaggagcactgaagggatttgcagaggttgtaaggatggaaggagagaagggggagtggggttttaaggcgctgaagcaaacagtgaagctccactaccggattggaaattataagcaaatgatggttgcttacagagagatgttgacttacatcaaatcggctgttacgcgcaattacagcgaaaaatgcatcaacaacatcctcgactttgtgtcaaatggcgctaatcagaacttggagttacttcaggagttttatcagactaccctgaaggctttggaggaagccaaaaatgagaggttatggttcaagacaaacttgaaattgtgtaaattgtggtttgatatgggagaatatggtcttatgaacaaaattttgaaggagctccataaatcttgtcagaaggaagatggtacagatgaccagaagaagggcacacaattgctggaggtgtatgcgatagagattcagatgtatacagagaccaagaacaacaagaagctcaagcaactatacttgaaagcgttgaacataaagtctgcaatcccacatccacgcattatgggtatcatccacgaatgtggtggcaaaatgaatatggctgagcgacagtgggcagttgccgccaccgacttttttgatgcattcaaaaactacgatgaggctggcacccacaggaggatccaatgtctgaagtacctggtacttgctaacatgttgatggagtctgaagtgaacccatttgatgctcaggaggctaaaccgtacaagaatgaccctgaaattctagcgatgacaaatctggtggctgcttatcaaaggaatgaaattcttgaatttgaaaaaatcctcaagagtaacagaaagacaattatggacgacccctttatacggaattacattgaagatctgctaagcaaaattcgcacacaggtgttactgaagcttatcaagccttacacccgaattcgcattcccttcatatctaaggagctgaacatacctgaaaaggatgtggagcaacttcttgtatccctcattctagataatagagtccatggtcatattgatcaagtgaaccaattgcttgagcttggtgacaggtcgaaagggctgaggaagtacacggcgatagatacatggaacacccaattaaagtcgctgtctcaaacagtatcggcaagaatttgttaagatcgtgaaagagaatcctattacttcggtgcacgaatagatgtgacgatattgtcacatgtttcttcgctactgtatattttcgacgctatggtcccaacctttcgaggctttattggataaccatttcgtctgagacaacatccagaggaatcccattggtgacctcgtctccgagtagattgaattatcttggtgtatggttttgtaggtaccccttctgggacaagtaaagaaatggaacataaaatgttaagatacgatct

SEQ ID NO: 3216 - DNA, 1328 bp, Carthamus tinctorius
cggggagttacggaagagggaaacgtagcgaggccatagttcatcttccaaaccaaaccctagacctctgatcgctctctattccccaatcttcttatcatcctccatcaatcatgggttcagatgcagacatggaggattatggattcgagtactccgaggaagaacccgaggagcaggatgtagatattgaaaatcagtattacaattctaaaggtttggttgagactgatccagagggtgcacttagtggttttgctgaagtagttaagatggaaccagagaaagcagaatggggattcaaagcacttaaacagactgtcaagctttattaccgtttagggaggtacaaggagatgacggatgcatatagggagatgttaacctacattaaatctgcagtgacccgaaactatagtgaaaaatgtataaacaatatcatggattttgtatctgggtctgccagtcagaacttcggtcttttgcaagagttctatcaaaccaccttgaaagcacttgaagaagcaaaaaatgagaggctgtggttcaagacaaatcttaagctttgcaagatctggtttgacatgggtgagtatggtagaatgaacaagattttgaaggaactacacaaatcttgtcaacgggcggatgggaccgatgatcaaaagaaaggaactcagttattggaagtgtatgcaattgagatccaaatgtatacagagacgaagaataataaaaagctcaagcaactgtaccaaaaagcacttacaataaaatcagcgattcctcatccaagaatcatgggcataatacacgagtgtggtggcaaaatgcacatggcagagcgccaatgggcagaagcagctactgacttttttgaagcttttaaaaactatgacgaagctgggaatcaacgaagaatacagtgtctgaaatacttggtactagccaacatgcttatgcaatctgaggtcaatccattcgatgggcaagaggcaaagccatacaaaaatgatcccgaaatcttggcgatgaccaacttgattgcagcgtatcagcggaatgaaatattggaatttgagaaaatcctcaagagtaaccgaagaaccatcatggatgatcctttcatcagaaattatatcgaagatcttctgaagaacatcagaactcaagttttactcaagctgatcaagccatacacaaggatcaggatccctttcatatcaaaggagcttaatgtgcctgaggctgatgtcgaacagctgttagtctcgctgatattggacaacagagttcaaggccatatcgatcaagttaacaggctgttg

SEQ ID NO: 3217 - DNA, 1666 bp, Eutrema halophilum
gtcttccagaaaaccctcttttattttcgtttttttttctttgcttgccctaagtttctgctcatcgatttttactctgcttcgacttcgactttagtccgtcacaagcttaatcggtgttgtgttcttgttctgatcatcatggcctcagatgctgatatggaggattatgggttcgagtattccgatgaggaacaggaggaacaagacgttgacattgagaatcagtattataactccaaaggtatggttgagactgaacctgaaggtgcactttctgggtttgctgaggttgttaagatggaaccagacaaggctgagtggggtttcaaagctctgaagcagacggtgaagatttactatcgtctaggtaaatacaaaaagatgatggatgcgtatagggagatgcttacgtacatcaagtcagcagtgacccggaactacagcgagaaatgtataaataacattatggatttcgtttctggatctgctagccagaacactggccttctgcaagagttttatcagaccactttgaaagctcttgaagaggctaagaatgagagactctggttcaagacgaacctaaaactctgcaacatctggtttgacataggcgaatacagacgaatgagcaagatcctgaaggagctccataaatcttgtcaaaaggaagatggaacggatgatcagaagaaaggaagtcagctgcttgaggtttatgcaattgaaattcagatctacacggaaacaaaggacaacaaaaagcttaagcaactataccagaaagcacttgccatcaaatctgctatacctcatcctaggatcatgggtataatccgcgagtgtggtggaaaaatgcacatggcagaacgtcagtgggcagaagcagccacagacttctttgaggcttttaaaaattatgatgaagctggcaaccaaaggcgtattcagtgcctaaagtaccttgttcttgcgaatatgctgatggaatcagaggtgaatccatttgacgggcaagaggcaaaaccgtacaaaaacgaccctgagatcttggcaatgacaaatctgatagcagcatatcaacgaaacgaaatcatcgagtttgagaggatactgaagagcaaccgaaggacgataatggatgatccattcatcagaaactacatggaagatctgctgaagaaggtgagaacacaagtgttgctaaagctgataaagccatacacaaagatcgggattccattcatatcgaaggaactgaacgtgccagagaaggaagtgacggagttgcttgtgtctctgatactcgataatcgaatcgatgggcacattgatgaaatgaaccgttacttgctgagagctgacagtgccaacggaaggaagttgcacaaggcggttgataaatggaacacccagctcaagtctctttctctcagtatcaccaaccgagtctgttaatttgcccccaccctctcattcggattgttcgttttacaatgctcaatcattttatattttgtggattatttgtttcttcacttagctggatttgatgaagctaatgcaagttaccttttactcctaaaagtcaggctcctactttctcttatcttactagagtctctatctacataaagtgaattcacaagctttggttacaagt

SEQ ID NO: 3218 - DNA, 1882 bp, Panicum virgatum
atatcacaccgctgtcatctattaagcagcatcacaccaccttcacttgctagcagcatcacaccaccatcgtcttctggtagcatcacaccgccctcacttactagtagcatcagagaagagggatttaaagctcttaaacaaactgtcaagctttactataagctggggaaatacaaagaaatgatggatgcctacagggagatgttaacatacataaaatctgctgtgacccgaaactacagtgagaaatgtataaacaacataatggattttgtttctggatcagctagtcagaacttttctcttttacaagagttctaccagacaacactgaaagctcttgaagaagcaaaaaatgagagattatggttcaagacaaacctgaagctttgcaaaatttggtttgatatgggggagtatggccgcatgaacaagatcctgaaggagctgcataaatcttgtcaaagggaagatggttctgatgaccaaaagaaaggcacacagcttttggaagtctatgctattgaaatccaaatgtacactgaaacaaagaataataaaaagctcaaggaattgtatcagagggctctgtctatcaaatcagcaatacctcatccaagaatcatgggtataattcgcgaatgtggtggtaagatgcacatggctgagaggcagtgggcagaagctgcgactgatttctttgaagctttcaagaactacgatgaagcaggcaacccgcggagaattcaatgtctcaaatatctcgtccttgccaatatgttaatggaatctgaagtgaatccttttgatggacaagaggccaagccgtacaaaaatgatcctgaaatccttgcaatgacaaacttgattgcagcgtaccagaagaatgacatcatggaatttgaaaagatcctaaagagtaatagaaggacaataatggatgatcctttcatccgtaactatattgaggacctgttgaagaacatcagaactcaagtcctgctcaagcttattaagccatatacacggatcaggataccattcatttcacaggaactcaatgtccccgaaaaggatgtcgagcagctgttggtatccctgattctggacaaccggatccagggccacatagatcaggtgaacaagctgctagaacgtggagacaggtccaaggggatgaggaagtacaatgccatcgacaagtggaatagccagcttaagtcaatctaccaaacggtgtccaacagagttgggtgagacggctactggccgtcgcgtgatttgcacttatgagatatgttgatagcctgttttggggatctgagggcaaatacatattgttttatgacgcttgaggtagaaagttggatctgggtgacgcgaaatgccgatgtaatgtagagcttgaactgatcccagtgttcttacttagagtctgaggcattactgtggtccaagccaattgccagtggggaaaacatgtaactacatccatctggttccttcacaactttttttgtgcttactgcccaagattcctttacatgcttgaaccagctgggaggcagctgcacttgaacaatactgtttcagcacgtttgatctcaggtcgagagttgaaactttgacgagcaattttggacagggttgagagtagacttcactgacgtgccatagaggtccgatgttgggctcgttatgtacaaagagttggccgaatttcaggtaaaaatcatgcatggcccaaattctgactgatgtaccaatgaagcaaagttagttcagcccaatgaccctcgtcgatgtaccaatggcccaatccagtagttttccctctatctataaaatatatatagttggtccctactagagatttctc

SEQ ID NO: 3219 - DNA, 1285 bp, Centaurea maculosa
aggtttggttgagactgatccagagggtgcacttagtggttttgctgaagtagttaagatggaaccagagaaagcagaatggggattcaaagcacttaaacagactgtcaagctttattaccgtttagggaggtacaaggagatgacagatgcatatagggagatgctaacctacattaaatctgcagtgacccgaaactatagtgaaaaatgtataaacaatatcatggatttcgtatctgggtctgccagtcagaacttcggtcttttacaagagttctatcaaaccaccttgaaagcacttgaagaagcaaaaaatgagaggttgtggttcaagacaaatcttaagctttgcaagatctggttcgacatgggtgagtatggtagaatgaacaagattttgaaggaactacacaaatcttgtcaacgggcagatgggaccgatgatcaaaagaaaggaactcagttattggaagtgtatgcaattgagattcaaatgtatacagagacaaagaataacaaaaagctcaagcaactgtaccaaaaggcacttacaataaaatcagcgattcctcatccaagaatcatgggcataatacacgagtgtggtggcaaaatgcacatggcagagcgccaatgggcagaagcagctaccgacttttttgaagctttcaaaaactatgacgaagctgggaatcaacgaagaatacagtgtctgaaatacttagtgctagccaacatgcttatgcaatctgaggtcaacccattcgatgggcaagaggcaaagccatacaaaaatgatcccgaaatcttggcaatgacgaatttgattgcagcgtatcagcggaatgaaatattggaatttgagaaaatcctcaagagtaaccgaagaaccatcatggatgatcctttcatcagaaattatattgaagatcttctgaagaacatcagaactcaagtcttactcaagctgatcaagccatacacaaggatcaggatccctttcatatcaaaggagcttaatgtgccagaggctgatgtcgaacagctgttagtctcgctgatattggacaacagagttcaaggccatatcgatcaagttaacaggctgttggagtgcggtgacagatcaaagggaatgaagaaatacactgctgtggagaaatggaacacacaactgaggtcactgtatcaaagtgttagcaatagagttggttgaaaacttgaagttcatttctattggcatattttgttcatcatgtcaaattagcatctcaacagaaca

SEQ ID NO: 3220 - DNA, 1618 bp, Arabidopsis lyrata
tcttcttcttctacttccgcaaaaaccctttgcataaaaaatctgaagccgaagcaaaattctctcatcgttcttactttgccctaattcacgaatcgtttgttcttcttcttcctctgatcgtcatggcttcagatgctgatatggaggactatggattcgagtattctgatgaggaccaagaggaacaagatgttgacattgagaaccagtattataactctaaaggtatggttgagactgaacctgaagaagcactttctgggtttgctgaggttgttcagatggaacctgacaaagctgactggggtttcaaagctcttaagcagactgtgaagatctattatcgtctaggtaaatacaaagaaatgatggaagcatatagagagatgcttacatatatcaagtcagcagtgaccaggaattacagcgaaaaatgtataaacaatattatggatttcgtctctggatctgctagccagaatactggcctgctgcaagagttttatcagaccactttgaaagcccttgaagaggctaagaatgagagactctggttcaagacgaatcttaaactctgcaacatctggtttgacattggtgaatacagacgtatgaccaagattcttaaggaactccataaatcttgtcaaaaggaagatggaactgatgatcagaagaaaggaagtcagctgcttgaggtttatgcaattgaaattcagatttacactgaaacgaaggacaacaaaaagcttaagcaactataccataaggcactttccatcaaatctgccatacctcatcctaggatcatgggtataatccgcgagtgtggtggaaaaatgcacatggcagaacgtcagtgggcagaagcagcgacagacttctttgaggcttttaaaaattacgatgaagctggcaaccaaagacgtatacagtgcctgaaatatcttgttctcgcgaatatgctgatggagtcggaagtgaatccatttgatggccaagaggcaaagccgtacaaaaacgaccctgagatcttggcaatgacaaatttgatcgcagcatatcaacgaaatgagatcatagagtttgagagaatactaaagagtaaccggaggacgataatggatgatccattcatcagaaactacatggaagatctgctgaggaaagtgagaacacaagtgttgctgaagctgataaagccatacacaaagatagggattccgttcatatcaaaggaactgaacgtaccagagaaggatgtgacggagttgctagtgtcgctgatactcgacagtcgaatcgacggtcacattgacgaaatgaaccgttacttgctgagaggtgacagtggcaatggaaggaagctgcataaggcggttgataaatggaacacacagctcaagtctctttcttcaaatatcaccagccgagtctgttaatttctcaacctcatcttttcgatagattttgtgttttggcgttgattctctgtggattatctgtttctcttcacatagctggattttatggagttgataaaccacttcaatgccaaaaaaaaggatttgaaagtttctaaattctcgtctttaaaattgatttctttactttg

SEQ ID NO: 3221 - DNA, 1532 bp, Brassica napus
aaaaacccttcttctaccttttccgccacttctcccatcgaattctactctgcttagcccttcgaatcggtgttggtttctttttcatctggtcgtcgtcatggcttcagatgctgatatggaggactatgggttcgagtattcggacgacgaaccggaggaacaagacgttgacattgagaaccagtattacagcgccaaaggtagggttgaggctgagcccgaagatgcactttctgagttcgctatggttgttaagatggaaccagacaaggccgagtggggtttcaaagcgctgaagcagaccgtgaagatttactatcgacttggcaaatacaaagagatgatggatgcgtacagagagatgcttacatatatcaagtcagcagtgaccaggaactacagcgagaaatgtataaacaatatcatggatttcgtctctggatctgctagccagaacactggcctgcttcaagagttttaccagaccaccttgaaagcccttgaagaggccaagaacgagagactctggttcaagacgaatctaaagctctgcaacatctggtttgacattggtgaatacagacggatgactaagatcctcaaggagctacataaatcttgtcaaaaggaagatggaactgatgatcagaagaaaggaagtcagctgcttgaggtctatgcgattgaaattcagatctacactgaaacaaaggacaacaaaaagctcaagcaactataccagaaagcacttgctatcaaatctgctatacctcatcctaggatcatgggcattatccgcgagtgtggtggcaaaatgcacatggcagaacgtcagtgggcagaagcggccactgacttctttgaggctttcaaaaactatgatgaagctggcaaccaaaggcgcattcagtgcttaaagtatcttgttctcgcaaatatgctgatggaatcagaagtgaatccatttgacggtcaagaggcgaagccgtacaaaaacgaccctgagatcttggcaatgacaaatctgatagcagcatatcaacgaaacgaaattatagagttcgagaaaatactaaagaataaccggaggacgataatggatgatccattcatcagaaactacatggaagatctgctgaagaaggtgagaacacaggtgttgctgaagctgataaagccctacacgaagatcaagattccgtttatatcaaaggagctgaacgtgccggagaatgatgtgacggagttgctggtgtcgctgatactggacagccgaatcgatggtcacattgatgaaatcaaccgttacttgctgagaggggacagtgctaatggaaggaagcttcacaaggcggttgataaatggaacacacaactcaagtctctttctatgagtatcaccaaccgagtttgttaaatgtccctccacctctcttttggatagtcgtcgcggtttaaccttttctggtttgatggattattttgtacttagctggatttgactgatgagttactatgttattcttaaa

SEQ ID NO: 3222 - DNA, 1559 bp, Pteridium aquilinum
gacacgacaccaccaagacagctctcttcgtcgatcgtctcggcaaattcacgccatgggttcagatgcagatatggaagattatggttttgagtactcggatgaggagccagaagagcaggatgttgatatcgaaaaccaatattacaattcaaagggcttggtggagatggatcctgaaggtgctttgtctggttttgcggaggtggtcaggatggaaggggaaaagggtgaatggggtttcaaggccttgaagcaaacggtcaaactacactaccgtcttgccaatttcaagcaaatgatggatgcttacagagagatgttgatgtacattaagtcagcggtgacgcgaaactacagcgagaagtgtataaataatattctagactttgtgtcaggaagtgctagtcagaacatggaactacttcaggaattttatcagacaactctgagggctttggaagatgcgaaaaatgagcggctatggttcaaaacaaatttaaagctttgcaaactatggtttgatatgggagaatatggccgcatgaacaagatattgaaggagcttcataaatcatgtcgaagagaggatggctcagatgatcagaagaagggtacacagttgttggaagtgtacgccatcgagatacagatgtacacagagacaaaaaacaacaagaaattgaagcaattgtataagcaggctctaacaatcaaatctgcaattccacatccacgtattatgggaatcatacacgaatgtgggggaaagatgaacatggcagaacggcaatgggcagaggctgcaacagacttctttgatgctttcaagaattatgatgaggcaggaacgcaccgccgtatccaatgcctcaagtacctggtactcgcaaacatgctgatggaatcacaagttaatcccttcgatggtcaagaagcaaagccgtacaaaaatgatcctgaaattcttgcaatgaccaaccttgttgcagcatatcagcggaatgatatattggagttcgagaagataatcaagagtaatcggaaaacaataatggacgacccatttattcgcaattacatcgaggacttgctgaagaacattcgaacacaagttctgttgaagctcatcaagccatatacgcgtatacgcattccattcatctctcaggagctgaacattccagaaaaggatgtggagcagttgcttgtatcactgattttggataatcgtgtacatggtcatatagatcaagtcaaccagctcctagaacttggggacaggtcgaagggtccaaagagtatacagcaattgataaatggaacactcaattaaggggcttgtgccaagtggtcacaacacgagtaggctgatcaccccagcatggttgctactgcttttgcaaagatgggagttggactgccaacctattgtaattgagtagaaaattttgtggccttctcagatcatattattcggcttttgtaaaggggctgcttatgctccctagagattttacattatcatgaaaggtgtccttctctctctcaaaaaagaa

SEQ ID NO: 3223 - DNA, 1551 bp, Raphanus sativus
  misc_feature (35)..(36): n is a, c, g, or t
  misc_feature (41)..(41): n is a, c, g, or t
  misc_feature (55)..(55): n is a, c, g, or t
  misc_feature (90)..(90): n is a, c, g, or t
  misc_feature (119)..(119): n is a, c, g, or t
  misc_feature (126)..(126): n is a, c, g, or t
  misc_feature (189)..(189): n is a, c, g, or t
  misc_feature (426)..(426): n is a, c, g, or t
cttcgcctccgtctctagtttaatcggtgttgggnnttttncttcatctgatcantaatggcttcagatgcggatatggaggactacggnttcgagtactcagacgaggagcaggaggngcaagangtcgacatcgagaaccagtattacaactccaaaggcaatgtcgagaccgaccccgaggaggcnctctccggcttcgccgaggttgttaagatggagcctgacaaggctgagtggggtttcaaagctctgaagcagacggtgaagatatactatcgtttggggaagtacagagagatgatggatgcgtatagagagatgcttacgtatatcaagtcggcggtgacgaggaactacagcgagaagtgtattaacagtattatggatttcgtctctgggtctgctagccagaacactggtctncttcaggagttttaccagaccaccttgactgcccttgaggaggctaagaatgagagactctggttcaagacgaatcttaaactgtgcaacatctggtttgacattggtgaatacagacggatgactaagatcctgaaggaactgcataagtcttgtcaaaaggaagatgggacggatgatcagaagaaaggaagtcagctgcttgaggtttatgccattgaaattcagatttacactgaaactaaggacaacaaaaagctcaagcaactgtaccagaaagcacttgctatcaaatctgctattcctcatcctaggatcatgggtattatccgcgagtgtggtggcaagatgcacatggccgaacgtcagtgggctgaagcggccactgacttctttgaggctttcaaaaattatgatgaagctggcaaccaaaggcgtattcagtgcttaaagtatcttgttcttgcgaacatgctgatggagtcggaagtgaatccatttgacggtcaagaggcaaagccgtacaaaaacgaccctgagatcttggctatgacgaatctggtagcagcctatcaacgaaacgaaatcatagagtttgagaaaatactcaagaataaccggaagacaataatggacgatccattcatcagaaactacatggaagatctgctgaagaaggtgaggacacaggtgttgctgaagctgataaagccctacacaaagatcgggatccctttcatatcgaaggagcttaacgtgccagagaaggatgtgacggagttgctggtgtcgcttatactggacagccgaatcgatggacacattgatgagatcaaccgttacttgctgagaggtgacagcgctaatggaaggaaacttcacaaggcggttgataaatggaacacacagctcaagtctctttccatgagtatcaccaaccgtgtctgttaatttacccatcacctctgtccttttcggtagctttgacattttcttgtttctaccatttcgtggattacattttgttttcttcacttcgctgaattctcttttgatggtgatatgtgagttacattttgttccaaaaaatcttggccgatttcaaaaatactactagtaaaacga

SEQ ID NO: 3224 - DNA, 1439 bp, Eutrema parvulum
tttccgaactttgtaatctggttagacgctgatatggaggactatggattcgagtattccgatgaggaacaggaagaacaagacgttgacattgagaaccagtattataactccaaaggtatggttgagactgaacctgaaggtgcactttctgggtttgctgaggttgttaagatggaaccagacaaggctgagtggggtttcaaagctcttaagcagaccgtgaagatttactatcgtctaggtaaatacaaagagatgatggatgcgtatagagagatgcttacatatatcaaatcagcggtgacccgaaactacagcgagaaatgtataaacaatattatggatttcgtctctggatctgctagccagaacactggcctgctgcaggagttttaccagaccaccttgaaagcccttgaagaggctaagaatgagagactctggtttaagacgaatctaaaactctgcaacatctggtttgaaataggtgaatacagacgaatgactaaggtcctgaaggaactccataaatcttgtcaaaaagaagatggaacggatgatcaaaagaaaggaagtcagctacttgaggtttatgcaattgaaattcagatttacactgaaacaaaggacaacaaaaagcttaagcaactataccagaaagcacttgctatcaagtctgctatacctcatcctaggatcatgggtataatccgcgagtgtggtggcaaaatgcacatggcagaacgtcagtgggcagaagcagccacagacttctttgaggctttcaagaattatgatgaagctggcaaccaaaggcgtattcaatgcttgaagtatcttgttcttgcgaatatgctgatggaatcagaagtaaatccatttgacggtcaagaggcaaagccgtataaaaacgaccctgagatcttagcaatgacgaatcttatagcagcatatcaacgaaacgaaattatagagtttgagaaaatactaaagagtaaccggaggacgataatggatgatccattcatccgaaactacatggaagatctgctgaagaaagtgagaacacaggtgttgttgaagctgataaaaccgtacacaaagatcgggattccgtttatatcaaaggaactgaacgtaccagagaaggatgtgacggagttgctggtgtcgcttatactcgacagccgaattgatggacacattgatgaaattaaccgttacttgctgagaggtgacagtgttaatggaaggaagcttcacaaggcggttgataaatggaacacacaactcaagtctctttctatgagtattaccaaccgagtctgttaatttctcaacctctctcttgtattgtgatcggtttaaccttttattgtttctgccattttgtggattttggttcttttcacttctagcttatgtgagttattcct

SEQ ID NO: 3225 - DNA, 1634 bp, Brassica juncea
caaatcaacctttcttccttctcgttcgttggctctgtgccctacccctgatctccgatcgaattctactcaccgctttgcctccgtctctagtttaatcgtcgctgggggtgttttcttcatctcatcaataatggcttcagatgctgacatggaggactacggattcgagtactcagacgaggagcaggaggagcaagacgtcgacatcgagaaccagtactacaactccaaaggcatggttgagaccgagcccgaagaggcgctctctggcttcgccgaggttgttaagatggagcctgacaaggctgagtggggtttcaaagctctgaagcagacggtgaagatttactaccgtctaggcaaatacagagagatgatggatgcgtatagagagatgcttacgtacatcaagtcggctgtgactaggaactacagcgagaagtgtattaacagtattatggattttgtttccggatctgctgggcagaacactggtctgcttcaggagttttatcagaccactttgactgctcttgaggaggctaagaatgagagactctggttcaagacgaatcttaagctctgtaacatttggtttgacattggtgaatacagacggatgactaagattctgaaggaactgcataagtcttgtcaaaaggaagatgggacggatgatcagaagaaaggaagtcagctgcttgaggtttatgcgattgagattcagatttacactgaaactaaggacaacaagaagcttaagcaactgtaccagaaagcacttgctatcaaatctgctatacctcatcctaggatcatgggcataatccgtgagtgtggtggcaaaatgcacatggctgaacgtcagtgggcagaagcggccacagacttctttgaggctttcaaaaactatgatgaagctggcaaccaaaggcgtattcagtgcttaaagtatcttgttcttgcgaacatgctgatggaatcagaagtgaatccatttgacggtcaagaggcaaagccgtacaaaaacgaccctgagatcttggcaatgacgaatctggtagcagcgtatcaacggaacgaaatcattgagtttgagaaaatactcaagaataaccggaagacgataatggacgatcctttcatcagaaactacatggaagatctgctgaagaaggtgaggacacaggtgctgctgaagctgataaagccgtacacgaagatcgggattcctttcatatcaaaggagctgaacgtgccagagaaggatgtgacggagttgctggtgtcgctgatactggacagccgaatcgatggacacattgatgaaataaaccgttacttgctgagaggtgacagtgctaatggaaggaaacttcacaaggcggttgataaatggaacacacaactcaagtctctttctatgagtgtcaccaaccgagtttgttaatttccctccacctctctattttggatagttgtcacggtttaaccttttctgatttggtggttggttttgtacttagctcgatttgattgagtttatgggaattactatttaattcttaaaattcagttttcttaaatcttacacctggaagactcttgttatataaccttcaagagtggct

SEQ ID NO: 3226 - DNA, 1702 bp, Brassica rapa
ataaaaaatctcgaaagaggtataataggagaagtcgggcccaataccaaaaatgctaaaccacaccgtcttgttccagaaaaacccttcttcaaccttttcccctacttctccgatcgaattctactctgcttagccttcgaatcggtgttggtttcttcttcatctggtcgtcgtcatggcttcagatgctgatatggaggactatgggttcgagtattcggacgacgaaccggaggaacaagacgttgacattgagaaccagtattacagcgccaaaggtagggttgaggctgagcccgaagatgcactttctgagttcgctatggttgttaagatggaaccagacaaggccgagtggggtttcaaagcgctgaagcagaccgtgaagatttactatcgacttggtaagtacaaagagatgatggatgcgtacagagagatgcttacctatatcaagtcagcagtgaccaggaactacagcgagaaatgtataaacaatatcatggatttcgtctctggatctgctagccagaacactggcctgcttcaagagttttaccagaccaccttgaaagcccttgaagaggccaagaacgagagactctggttcaagacgaatctaaagctctgcaatatctggtttgacattggtgaatacagacggatgactaagatcctcaaggagctacataaatcttgtcaaaaggaagatggaactgatgatcagaagaaaggaagtcagctgcttgaggtctatgccattgaaattcagatctacactgaaacaaaggacaacaaaaagctcaagcaactataccagaaagcacttgctatcaaatctgctatacctcatcctaggatcatgggcataatccgcgagtgtggtggcaaaatgcacatgacagaacgtcagtgggcagaagcggccacagacttctttgaggctttcaaaaactatgatgaagctggcaaccaaaggcgcattcagtgcttaaagtatcttgttcttgcaaatatgctgatggaatcagaagtgaatccatttgacggtcaagaggcgaagccgtacaaaaacgaccctgagatcttggcaatgacgaatctgatagcagcatatcaacgaaacgaaattatagagttcgagaaaatactaaagaataaccggaggacgataatggatgatccattcatcagaaactacatggaagatctgctgaagaaggtgagaacacaggtgttgctgaagctgataaagccctacacgaagatcaagattccgtttatatcaaaggagctgaacgtgccggagaatgatgtgacggagttgctggtgtcgctgatactggacagccgaatcgatggtcacattgatgaaatcaaccgttacttgctgagaggggacagtgctaatggaaggaagcttcacaaggcggttgataaatggaacacacaactcaagtctctttctatgagtatcaccaaccgagtttgttaaatttccctccacctctcttttggatggtcgtcgcggtttaaccttttctggtttgatggattattttgtacttagctggatttgactgatgagttactatgttattcttaaaattcagttttcctaaatcttactcttgttagaaacttataaccctctagtggctgctataaaacagcgggattctctatctgaatattaaag

SEQ ID NO: 3227 - DNA, 1672 bp, Arabidopsis thaliana
aatatttcacaaatccagcaacaaatcttacttcttccaccttcttcttctcttcttcttctcttcttcttctacttccgcaaaaaccctttgagaaagagaagcaaaattctctaatcgttctttctctgccctaatccacgtatcgtttggtgttcttcttcatcgaatcgacatggcttcagatgctgacatggaggactatggattcgagtattctgatgaggagcaagaggaacaagatgttgacattgagaaccagtattataactctaaaggtatggttgagactgaacctgaagaagcactttctggatttgctgaggttgttcagatggaacctgagaaagctgactggggtttcaaagctcttaagcagactgtgaagatctattatcgtctaggtaaatacaaagaaatgatggaagcctatacagagatgcttacatatatcaagtcagcagtcaccaggaattacagcgaaaaatgtataaacaatatcatggatttcgtctctggatctgctagccagaacactggcctgctgcaagagttctatcagaccactttgaaagcccttgaagaggctaagaatgagagactctggttcaagacaaatcttaaactctgcaacatctggtttgacattggtgaatacagacggatgactaagattctgaaggaactccataagtcttgtcaaaaggaagatggaactgatgatcagaagaaaggaagtcagctgcttgaggtttatgcaattgaaattcagatttacactgaaacgaaggacaacaaaaagcttaagcaactataccataaggcacttgccatcaagtctgccatacctcatcctaggatcatgggtataatccgcgagtgtggtggaaaaatgcacatggcagaacgtcagtgggaagaagcagcgacagacttctttgaggcttttaaaaattacgatgaagctggcaaccaaagacgtatacagtgcctgaagtatcttgttctggcgaatatgctgatggagtcagaagtgaatccgtttgatggccaagaggcaaagccgtacaaaaacgaccctgagattttggcaatgacaaatttgatcgcagcatatcaacgaaatgagatcatagagtttgagagaatactaaagagtaaccggaggacgataatggatgatccattcatcagaaactacatggaagatctgctgaagaaagtgagaacacaagtgttactgaagctgattaagccatacacaaagatagggattccgttcatatcaaaggaactgaacgtgccagagacggatgtgacggagttactagtgtcgctgatactcgacagcagaatcgatggtcacattgatgaaatgaaccgttacttactgagaggcgacagtggcaatggaaggaagttgcataaggcggttgataaatggaactcacagctcaagtctctttcttcaaatatcaccagccgagtctgttaacttggaaacctctcttttggatagattttgtgatttggcgttgattctttgtggattatctgtttctcttcacatagctggatttgatggagtttataaaccacttcaatgccaagaaaaaggatttgaaacttttcttcattctcatttttaaaattgatttcttaactttgcagc

SEQ ID NO: 3228 - DNA, 1714 bp, Brassica rapa
taaactcggcccaatataaaaaaaaaaaaaatcccaaatcaaccttccttcctttcttcttctcgttccttcctctgtgccctacctaaactccgatcgaatcctctactctgcttcgcctccgcctctagcttaatcggtgtttgggattcttcttcaatccgatcaataatggcttcagatgctgatatggaggactacggattcgagtactcagacgaggagcaggaggagcaagacgtcgacatcgagaaccagtactacaactccaaaggcaatatcgagactgagcccgaggaggctctttccgggttcgccgaggttgttaggatggagcctgacaaggccgagtggggtttcaaagctctgaagcagacggtgaagatttactaccgtctaggcaaatacagagagatgatggatgcgtatagagagatgcttacgtacatcaagtcggctgtgactaggaactacagcgagaagtgtattaacagtattatggattttgtttccggatctgctgggcagaacactggtctgcttcaggagttttatcagaccactttgactgctcttgaggaggctaagaatgagagactctggttcaagacgaatcttaagctctgtaacatttggtttgacattggtgaatacagacggatgactaagattctgaaggaactgcataagtcttgtcaaaaggaagatgggacggatgatcagaagaaaggaagtcagctgcttgaggtttatgcgattgagattcagatttacactgaaactaaggacaacaagaagcttaagcaactgtaccagaaagcacttgctatcaaatctgctattcctcaccctaggatcatgggtattatccgcgagtgtggtggcaaaatgcacatggcggagcgtcagtgggcagaagcagccactgacttctttgaggctttcaaaaactatgatgaagctggcaaccaaaggcgtattcagtgcttaaagtatcttgttcttgcgaatatgctcatggaatcagaagtgaatccattcgacggtcaagaggcaaaaccgtacaaaaacgaccctgagatcttggcaatgacgaatctggtagcagcgtatcaacggaacgaaatcatagagtttgagaaaatactcaagaataaccggaagacgataatggacgatcctttcatcagaaactacatggaagatctgctgaagaaggtgaggacacaggtgctgctgaagctgataaagccgtacacgaagatcgggattcctttcatatcaaaggagctgaacgtgccagagaaggatgtgacggagttgctggtgtcgctgatactggacagccgaatcgatggacacattgatgaaataaaccgttacttgctgagaggtgacagtgctaatggaaggaaacttcacaaggcggttgataaatggaacacacaactcaagtctctttctatgagcatcaccaaccgagtctgttgatttccctcacacctctctcttttcgatagctttgacattttcttgtttctaccattttgtggattacttctttttttttacttcgctgaattttctttttaaatggtgaaatgtgagttgcattttgttcctaaaactctggccgattacaaaaatactacaagaaaaacgaatattataaaagaacatttcaagaaacctttcaccattactctattttgta

SEQ ID NO: 3229 - DNA, 1562 bp, Brassica napus
ccgatcgaatcctctactctgcttcgcctccgcctctagcttaatcggtgtttgggattcttcttcaatccgatcaataatggcttcagatgctgatatggaggactacggattcgagtactcagacgaggagcaggaggagcaagacgtcgacatcgagaaccagtactacaactccaaaggcaatatcgagactgagcccgaggaggctctttccgggttcgccgaggttgttaggatggagcctgacaaggccgagtggggtttcaaagctctgaagcagacggtgaagatttactaccgtctaggcaaatacagagagatgatggatgcgtatagagagatgcttacgtacatcaagtcggctgtgactaggaactacagcgagaagtgtattaacagtattatggattttgtttccggatctgctgggcagaacactggtctgcttcaggagttttaccagaccactttgactgctcttgaggaggctaagaatgagagactctggttcaagacgaatcttaagctctgtaacatttggtttgacattggtgaatacagacggatgactaagattctgaaggaactgcataagtcttgtcaaaaggaagatgggacggatgatcagaagaaaggaagtcagctgcttgaggtttatgcgattgagattcagatttacactgaaactaaggacaacaagaagcttaagcaactgtaccagaaagcacttgctattaaatctgctattcctcatcctaggatcatgggtattatccgcgagtgtggtggcaaaatgcacatggcggagcgtcagtgggcagaagctgccactgacttctttgaggctttcaaaaactatgatgaagctggcaaccaaaggcgtattcagtgcttaaagtatcttgttcttgcgaatatgctcatggaatcagaagtgaatccattcgacggtcaagaggcaaaaccgtacaaaaacgaccctgagatcttggccatgacgaatctggtagcagcgtatcaacggaacgaaatcatagagtttgagaaaatactcaagaataaccggaagacaataatggacgatccattcatcagaaactacatggaagatctgctgaagaaggtgaggacacaggtgctgctgaagctgataaagccgtacacgaagatcgggattcctttcatatcaaaggagctgaacgtgccagagaaggatgtgacggagttgctggtgtcgctgatactggacagccgaatcgatggacacattgatgagataaaccgttacttgctgagaggtgacagtgctaatggaaggaaacttcacaaggcggttgataaatggaacacacaactcaagtctctttctatgagtatcaccaaccgagtctgttgatttccctcacacctctctcttttcgatagctttgacattttcttgtttctaccattttgtggattacttctttcttttcacttcgctgaattttctttttaaatggtgaaatgtgagttgcattttgttcctaaaactctggccgattacaaaatactacaag

SEQ ID NO: 3230 - DNA, 1565 bp, Zostera marina
gaattctcatcataatctgcgttaccagaggaactggaacacacatcgactgtcgcctcgggtgcaagatggaagatgctgatatggaggattacggattcgagtactccgaagaggagcaggaggagcaggacgttgacgttgagaatcagtattataattcaaagggtttgcttgaaactgatcctgaaggagctctttctgggttttctgaagtaattcagatggaacctgagaaagcggaatggggatttaaagctttgaagcagaccgtcaagctttattaccgccttggaaaatacaaggagatgatggaaacatatcgtgtgatgctgacatacatcaaatcggctgtaactagaaattacagtgaaaaatgtataaataacatcatggactttgtttctggatctgcaagtcagaattttgatcttttacaagaattctatcaaaccactctcaaggttcttgaagaagcgaagaatgagcggttgtggttcaagacaaacctaaagctttgtaaaatttggtttgacatgcgtgaatatggtagaatgaacaagatattgaaggagcttcacaaatcatgtcaaaaagatgatgggactgatgatcagaaaaaaggacacagcttctggaggtgtatgctattgagattcaaatgcacactgaaacaaagaataacaaaaaactaaagtctttgtaccagaaggcacttacaattaagtcagctatacctcatccccgaattatgggaataattcatgaatgcggtggtaaaatgcatatggctgaaaggcattggaggcaggctgctactgatttctttgaagcttttaaaaactacgatgaagctggaaatcatcgccgtattcaatgtttgaaatacttggttcttgctaacatgctaatggggtctcaagtcaatccttttgacggtcaagaagctaaaccctataaaaatgatccagaaattttagcaatgacaaatttggtggctgcatatcaacggaatgagattatagagtttgagaagattttgaggagtaacagaaggacaataatggatgatctatttattcgcaactatatagaggatctcctaaagaatgtcaggacacaggttcttctgaaactcattaagccttacacaaggatcagaattccttttatagcaaaggaactaaatgtgcaagaggaagaagttatacagcttttggtctccttaatccttggtgcctctatagatgggcatatcgatcaagtgaacggaatcttagaatgtggtgacaagtccaagggatcaaagaaatacactgctgttgataagtggaaccgccaactgaattctctctacattgcaattgcaagtagagtatgctgattatatagatggcttttactatggtttttttggttatctttctatttcaacattccagatcagtagagtagcatccaagagtgagtgaaatattatgtggtttgtacaattttaaaaacagagtgaaattctttttatacaataatgttcatatcttgagcctttctgagtagctcagttt
